United States Patent 11,640,849 (METHODS FOR HISTOLOGICAL DIAGNOSIS AND TREATMENT OF DISEASES) - sequence listing, part 85

SEQ ID NO: 3241806 - protein, 5 aa, Plasmodium falciparum
NTRGF

SEQ ID NO: 3241807 - protein, 6 aa, Plasmodium falciparum
NTRGYE

SEQ ID NO: 3241808 - protein, 5 aa, Plasmodium falciparum
NTRKK

SEQ ID NO: 3241809 - protein, 8 aa, Plasmodium falciparum
NTRNNDKN

SEQ ID NO: 3241810 - protein, 6 aa, Plasmodium falciparum
NTRNNH

SEQ ID NO: 3241811 - protein, 26 aa, Plasmodium falciparum
NTRNSSDQTFTSKNHSYDDSEFEKNR

SEQ ID NO: 3241812 - protein, 6 aa, Plasmodium falciparum
NTRTQK

SEQ ID NO: 3241813 - protein, 6 aa, Plasmodium falciparum
NTSDAY

SEQ ID NO: 3241814 - protein, 6 aa, Plasmodium falciparum
NTSDEI

SEQ ID NO: 3241815 - protein, 5 aa, Plasmodium falciparum
NTSDH

SEQ ID NO: 3241816 - protein, 12 aa, Plasmodium falciparum
NTSDKLKNEHKK

SEQ ID NO: 3241817 - protein, 10 aa, Plasmodium falciparum
NTSDVQEKNM

SEQ ID NO: 3241818 - protein, 22 aa, Plasmodium falciparum
NTSEDALSNKYNVTSKNKNKKE

SEQ ID NO: 3241819 - protein, 43 aa, Plasmodium falciparum
NTSENESSSIQPSQQNGVDNSIAKKEAEQNIKKEEELKSDNGI

SEQ ID NO: 3241820 - protein, 9 aa, Plasmodium falciparum
NTSENTEQH

SEQ ID NO: 3241821 - protein, 17 aa, Plasmodium falciparum
NTSHNNNNDDDDNNNNN

SEQ ID NO: 3241822 - protein, 11 aa, Plasmodium falciparum
NTSHSKNNQKI

SEQ ID NO: 3241823 - protein, 9 aa, Plasmodium falciparum
NTSKENVQI

SEQ ID NO: 3241824 - protein, 13 aa, Plasmodium falciparum
NTSKGASKKIKGI

SEQ ID NO: 3241825 - protein, 29 aa, Plasmodium falciparum
NTSKKNNKEEYFEGKKNKTKQKTKKKRRD

SEQ ID NO: 3241826 - protein, 8 aa, Plasmodium falciparum
NTSLNTNK

SEQ ID NO: 3241827 - protein, 6 aa, Plasmodium falciparum
NTSNEY

SEQ ID NO: 3241828 - protein, 17 aa, Plasmodium falciparum
NTSNGHNSQNIQNNSNI

SEQ ID NO: 3241829 - protein, 5 aa, Plasmodium falciparum
NTSNI

SEQ ID NO: 3241830 - protein, 23 aa, Plasmodium falciparum
NTSNINNNTKLRNYTKSNHHHNN

SEQ ID NO: 3241831 - protein, 22 aa, Plasmodium falciparum
NTSNKMNDKRESDHFTNNEYGD

SEQ ID NO: 3241832 - protein, 7 aa, Plasmodium falciparum
NTSNMNN

SEQ ID NO: 3241833 - protein, 5 aa, Plasmodium falciparum
NTSNQ

SEQ ID NO: 3241834 - protein, 6 aa, Plasmodium falciparum
NTSNRK

SEQ ID NO: 3241835 - protein, 7 aa, Plasmodium falciparum
NTSNTTT

SEQ ID NO: 3241836 - protein, 15 aa, Plasmodium falciparum
NTSNVGKEHQEKLEQ

SEQ ID NO: 3241837 - protein, 6 aa, Plasmodium falciparum
NTSNYN

SEQ ID NO: 3241838 - protein, 7 aa, Plasmodium falciparum
NTSPSRW

SEQ ID NO: 3241839 - protein, 4 aa, Plasmodium falciparum
NTSQ

SEQ ID NO: 3241840 - protein, 12 aa, Plasmodium falciparum
NTSQKNPSSLKD

SEQ ID NO: 3241841 - protein, 18 aa, Plasmodium falciparum
NTSQNNNNNNNNNNNNLK

SEQ ID NO: 3241842 - protein, 9 aa, Plasmodium falciparum
NTSSPNDKI

SEQ ID NO: 3241843 - protein, 10 aa, Plasmodium falciparum
NTSSTAYSTI

SEQ ID NO: 3241844 - protein, 36 aa, Plasmodium falciparum
NTSSTMKNNTHDNITSNNTTHENNNSNNNNCSNNYN

SEQ ID NO: 3241845 - protein, 5 aa, Plasmodium falciparum
NTSTF

SEQ ID NO: 3241846 - protein, 18 aa, Plasmodium falciparum
NTSTGSLEQQFPISDVWN

SEQ ID NO: 3241847 - protein, 9 aa, Plasmodium falciparum
NTSTHCNKE

SEQ ID NO: 3241848 - protein, 6 aa, Plasmodium falciparum
NTSTNT

SEQ ID NO: 3241849 - protein, 14 aa, Plasmodium falciparum
NTSTVNKDSTNSMN

SEQ ID NO: 3241850 - protein, 7 aa, Plasmodium falciparum
NTSTYNN

SEQ ID NO: 3241851 - protein, 7 aa, Plasmodium falciparum
NTSVGKT

SEQ ID NO: 3241852 - protein, 7 aa, Plasmodium falciparum
NTSVNNN

SEQ ID NO: 3241853 - protein, 4 aa, Plasmodium falciparum
NTSY

SEQ ID NO: 3241854 - protein, 5 aa, Plasmodium falciparum
NTSYK

SEQ ID NO: 3241855 - protein, 4 aa, Plasmodium falciparum
NTTC

SEQ ID NO: 3241856 - protein, 9 aa, Plasmodium falciparum
NTTDDKGKT

SEQ ID NO: 3241857 - protein, 7 aa, Plasmodium falciparum
NTTEEGK

SEQ ID NO: 3241858 - protein, 6 aa, Plasmodium falciparum
NTTEKE

SEQ ID NO: 3241859 - protein, 7 aa, Plasmodium falciparum
NTTEMKG

SEQ ID NO: 3241860 - protein, 7 aa, Plasmodium falciparum
NTTEYDN

SEQ ID NO: 3241861 - protein, 8 aa, Plasmodium falciparum
NTTEYNDN

SEQ ID NO: 3241862 - protein, 6 aa, Plasmodium falciparum
NTTINN

SEQ ID NO: 3241863 - protein, 42 aa, Plasmodium falciparum
NTTKDDNKKENNNDKLQTGNVHKTNEKEDKNISNNLADTQDN

SEQ ID NO: 3241864 - protein, 8 aa, Plasmodium falciparum
NTTKKEKK

SEQ ID NO: 3241865 - protein, 48 aa, Plasmodium falciparum
NTTKKENKTNCISSDKSNVISSDKGNVISSDKSNVISSDQTKKETNYI

SEQ ID NO: 3241866 - protein, 12 aa, Plasmodium falciparum
NTTKKKKKKLEK

SEQ ID NO: 3241867 - protein, 6 aa, Plasmodium falciparum
NTTKNK

SEQ ID NO: 3241868 - protein, 6 aa, Plasmodium falciparum
NTTNGN

SEQ ID NO: 3241869 - protein, 5 aa, Plasmodium falciparum
NTTNK

SEQ ID NO: 3241870 - protein, 14 aa, Plasmodium falciparum
NTTNNNNNNNVNNN

SEQ ID NO: 3241871 - protein, 8 aa, Plasmodium falciparum
NTTNNNNV

SEQ ID NO: 3241872 - protein, 15 aa, Plasmodium falciparum
NTTPNNNNNNNNNIN

SEQ ID NO: 3241873 - protein, 8 aa, Plasmodium falciparum
NTTPSRSE

SEQ ID NO: 3241874 - protein, 61 aa, Plasmodium falciparum
NTTQSALATSEATSNNNNINNNNSSSNNNNNNNNNSSSNNNNNNNNNNNNNNNNNNNNSND

SEQ ID NO: 3241875 - protein, 4 aa, Plasmodium falciparum
NTTS

SEQ ID NO: 3241876 - protein, 17 aa, Plasmodium falciparum
NTTSESSYSNCSSYNSV

SEQ ID NO: 3241877 - protein, 6 aa, Plasmodium falciparum
NTTSGT

SEQ ID NO: 3241878 - protein, 14 aa, Plasmodium falciparum
NTTSKFSNNEQTNF

SEQ ID NO: 3241879 - protein, 38 aa, Plasmodium falciparum
NTTSTNQNDSNNNNIDNNNNNNNNNNDSCSNNYGDHNK

SEQ ID NO: 3241880 - protein, 10 aa, Plasmodium falciparum
NTTVSTNSKL

SEQ ID NO: 3241881 - protein, 26 aa, Plasmodium falciparum
NTTYANKSSNYSQSQYAKTSGDGKIK

SEQ ID NO: 3241882 - protein, 6 aa, Plasmodium falciparum
NTVTNT

SEQ ID NO: 3241883 - protein, 5 aa, Plasmodium falciparum
NTYCK

SEQ ID NO: 3241884 - protein, 13 aa, Plasmodium falciparum
NTYEEGNDYRRKD

SEQ ID NO: 3241885 - protein, 13 aa, Plasmodium falciparum
NTYEPSQNNVGPE

SEQ ID NO: 3241886 - protein, 13 aa, Plasmodium falciparum
NTYEQGSDYRRKD

SEQ ID NO: 3241887 - protein, 5 aa, Plasmodium falciparum
NTYET

SEQ ID NO: 3241888 - protein, 5 aa, Plasmodium falciparum
NTYKK

SEQ ID NO: 3241889 - protein, 22 aa, Plasmodium falciparum
NTYNHNNNNNNNNNISSSNYNK

SEQ ID NO: 3241890 - protein, 5 aa, Plasmodium falciparum
NTYNQ

SEQ ID NO: 3241891 - protein, 6 aa, Plasmodium falciparum
NTYNTS

SEQ ID NO: 3241892 - protein, 6 aa, Plasmodium falciparum
NTYQNS

SEQ ID NO: 3241893 - protein, 6 aa, Plasmodium falciparum
NTYQPI

SEQ ID NO: 3241894 - protein, 6 aa, Plasmodium falciparum
NTYTKS

SEQ ID NO: 3241895 - protein, 6 aa, Plasmodium falciparum
NTYTNE

SEQ ID NO: 3241896 - protein, 4 aa, Plasmodium falciparum
NTYV

SEQ ID NO: 3241897 - protein, 10 aa, Plasmodium falciparum
NVAEKKNAHY

SEQ ID NO: 3241898 - protein, 6 aa, Plasmodium falciparum
NVAKDT

SEQ ID NO: 3241899 - protein, 38 aa, Plasmodium falciparum
NVANDVSKNIENNVANDVSKNIKNNVANDVSKNIKNNV

SEQ ID NO: 3241900 - protein, 15 aa, Plasmodium falciparum
NVCESYEGRKESNNT

SEQ ID NO: 3241901 - protein, 12 aa, Plasmodium falciparum
NVCGEQNNEDED

SEQ ID NO: 3241902 - protein, 6 aa, Plasmodium falciparum
NVDDSP

SEQ ID NO: 3241903 - protein, 7 aa, Plasmodium falciparum
NVDEKNE

SEQ ID NO: 3241904 - protein, 6 aa, Plasmodium falciparum
NVDETF

SEQ ID NO: 3241905 - protein, 5 aa, Plasmodium falciparum
NVDEY

SEQ ID NO: 3241906 - protein, 8 aa, Plasmodium falciparum
NVDGEKGI

SEQ ID NO: 3241907 - protein, 5 aa, Plasmodium falciparum
NVDGS

SEQ ID NO: 3241908 - protein, 7 aa, Plasmodium falciparum
NVDGYEN

SEQ ID NO: 3241909 - protein, 8 aa, Plasmodium falciparum
NVDKNKKF

SEQ ID NO: 3241910 - protein, 4 aa, Plasmodium falciparum
NVDN

SEQ ID NO: 3241911 - protein, 18 aa, Plasmodium falciparum
NVDNNNNDEQHKDVQSGE

SEQ ID NO: 3241912 - protein, 19 aa, Plasmodium falciparum
NVDNSSKNNDISNEKDNIN

SEQ ID NO: 3241913 - protein, 10 aa, Plasmodium falciparum
NVDPKDRGIM

SEQ ID NO: 3241914 - protein, 10 aa, Plasmodium falciparum
NVDQNQKKRN

SEQ ID NO: 3241915 - protein, 6 aa, Plasmodium falciparum
NVDSEV

SEQ ID NO: 3241916 - protein, 6 aa, Plasmodium falciparum
NVDSND

SEQ ID NO: 3241917 - protein, 6 aa, Plasmodium falciparum
NVDYTN

SEQ ID NO: 3241918 - protein, 12 aa, Plasmodium falciparum
NVEDDKNINKEG

SEQ ID NO: 3241919 - protein, 11 aa, Plasmodium falciparum
NVEDDNEKYNN

SEQ ID NO: 3241920 - protein, 9 aa, Plasmodium falciparum
NVEDETYSE

SEQ ID NO: 3241921 - protein, 6 aa, Plasmodium falciparum
NVEDIS

SEQ ID NO: 3241922 - protein, 7 aa, Plasmodium falciparum
NVEDNNR

SEQ ID NO: 3241923 - protein, 7 aa, Plasmodium falciparum
NVEESGS

SEQ ID NO: 3241924 - protein, 61 aa, Plasmodium falciparum
NVEGENKNEDDQKNEGDQKNEDDQKNEDDQKNEDDQKNEGDQKNEDDQKNEGDQKKNEYNN

SEQ ID NO: 3241925 - protein, 14 aa, Plasmodium falciparum
NVEKDNKVKKKNSY

SEQ ID NO: 3241926 - protein, 12 aa, Plasmodium falciparum
NVEKGNRNEKYS

SEQ ID NO: 3241927 - protein, 18 aa, Plasmodium falciparum
NVEKKKKGKKKKSQIQQE

SEQ ID NO: 3241928 - protein, 8 aa, Plasmodium falciparum
NVEKKKSL

SEQ ID NO: 3241929 - protein, 5 aa, Plasmodium falciparum
NVEKN

SEQ ID NO: 3241930 - protein, 5 aa, Plasmodium falciparum
NVEKT

SEQ ID NO: 3241931 - protein, 5 aa, Plasmodium falciparum
NVENK

SEQ ID NO: 3241932 - protein, 7 aa, Plasmodium falciparum
NVENKCN

SEQ ID NO: 3241933 - protein, 33 aa, Plasmodium falciparum
NVENNEHDNDDDDDNDDDDDNDDEHDNEHDKGF

SEQ ID NO: 3241934 - protein, 8 aa, Plasmodium falciparum
NVENNNKI

SEQ ID NO: 3241935 - protein, 8 aa, Plasmodium falciparum
NVENSRRE

SEQ ID NO: 3241936 - protein, 6 aa, Plasmodium falciparum
NVEPQN

SEQ ID NO: 3241937 - protein, 37 aa, Plasmodium falciparum
NVEQIKNSEHTNHVTNSKGDGRKNPNDASQEYRNKEN

SEQ ID NO: 3241938 - protein, 8 aa, Plasmodium falciparum
NVEQPTNL

SEQ ID NO: 3241939 - protein, 9 aa, Plasmodium falciparum
NVERKKKKE

SEQ ID NO: 3241940 - protein, 8 aa, Plasmodium falciparum
NVGENNKY

SEQ ID NO: 3241941 - protein, 6 aa, Plasmodium falciparum
NVGGTV

SEQ ID NO: 3241942 - protein, 10 aa, Plasmodium falciparum
NVGKKKGTFT

SEQ ID NO: 3241943 - protein, 5 aa, Plasmodium falciparum
NVGKS

SEQ ID NO: 3241944 - protein, 5 aa, Plasmodium falciparum
NVGNN

SEQ ID NO: 3241945 - protein, 8 aa, Plasmodium falciparum
NVGNPAPT

SEQ ID NO: 3241946 - protein, 57 aa, Plasmodium falciparum
NVGNYDNNSNHSDDNNKNHCNDNNNKNHCDDNNNNNHCNDNNNNNHCDDNNNNKNHY

SEQ ID NO: 3241947 - protein, 8 aa, Plasmodium falciparum
NVGVDNGK

SEQ ID NO: 3241948 - protein, 7 aa, Plasmodium falciparum
NVHKNKD

SEQ ID NO: 3241949 - protein, 5 aa, Plasmodium falciparum
NVHTD

SEQ ID NO: 3241950 - protein, 6 aa, Plasmodium falciparum
NVHTNK

SEQ ID NO: 3241951 - protein, 14 aa, Plasmodium falciparum
NVKEDNVDKEEDKN

SEQ ID NO: 3241952 - protein, 15 aa, Plasmodium falciparum
NVKEKNKKKKKKKNY

SEQ ID NO: 3241953 - protein, 11 aa, Plasmodium falciparum
NVKEKRSYINN

SEQ ID NO: 3241954 - protein, 10 aa, Plasmodium falciparum
NVKEKYDDKN

SEQ ID NO: 3241955 - protein, 10 aa, Plasmodium falciparum
NVKENEQKKI

SEQ ID NO: 3241956 - protein, 20 aa, Plasmodium falciparum
NVKETSSKEQNIEIMNDTQW

SEQ ID NO: 3241957 - protein, 5 aa, Plasmodium falciparum
NVKEV

SEQ ID NO: 3241958 - protein, 20 aa, Plasmodium falciparum
NVKGKKKINLSDSSTDSEDM

SEQ ID NO: 3241959 - protein, 18 aa, Plasmodium falciparum
NVKKGTYKKNTNTSYNNN

SEQ ID NO: 3241960 - protein, 12 aa, Plasmodium falciparum
NVKKNQKKMGSN

SEQ ID NO: 3241961 - protein, 4 aa, Plasmodium falciparum
NVKN

SEQ ID NO: 3241962 - protein, 8 aa, Plasmodium falciparum
NVKNGNKI

SEQ ID NO: 3241963 - protein, 13 aa, Plasmodium falciparum
NVKNKEQKNITGN

SEQ ID NO: 3241964 - protein, 7 aa, Plasmodium falciparum
NVKNQNR

SEQ ID NO: 3241965 - protein, 33 aa, Plasmodium falciparum
NVKNSEDENLSAENVPSDENTINDKTKEGSTTL

SEQ ID NO: 3241966 - protein, 4 aa, Plasmodium falciparum
NVKR

SEQ ID NO: 3241967 - protein, 13 aa, Plasmodium falciparum
NVKRRREESHEMN

SEQ ID NO: 3241968 - protein, 4 aa, Plasmodium falciparum
NVKT

SEQ ID NO: 3241969 - protein, 9 aa, Plasmodium falciparum
NVKVNKNDK

SEQ ID NO: 3241970 - protein, 6 aa, Plasmodium falciparum
NVKVQE

SEQ ID NO: 3241971 - protein, 10 aa, Plasmodium falciparum
NVLNSSGTSV

SEQ ID NO: 3241972 - protein, 15 aa, Plasmodium falciparum
NVMNGQGNNYMNGQK

SEQ ID NO: 3241973 - protein, 16 aa, Plasmodium falciparum
NVMSNTSSNEINNRKS

SEQ ID NO: 3241974 - protein, 8 aa, Plasmodium falciparum
NVNANANA

SEQ ID NO: 3241975 - protein, 34 aa, Plasmodium falciparum
NVNDDNKNDHGTNESDDNNNNNNNNDDDDHHDNN

SEQ ID NO: 3241976 - protein, 8 aa, Plasmodium falciparum
NVNDKEKI

SEQ ID NO: 3241977 - protein, 18 aa, Plasmodium falciparum
NVNDVKDNNEISYNTKDP

SEQ ID NO: 3241978 - protein, 5 aa, Plasmodium falciparum
NVNEE

SEQ ID NO: 3241979 - protein, 37 aa, Plasmodium falciparum
NVNEKSSSNDNSSDDENQNENENENQNENENENENRK

SEQ ID NO: 3241980 - protein, 23 aa, Plasmodium falciparum
NVNESRKKKDINRKKKDINRKND

SEQ ID NO: 3241981 - protein, 10 aa, Plasmodium falciparum
NVNITTEQKQ

SEQ ID NO: 3241982 - protein, 5 aa, Plasmodium falciparum
NVNKN

SEQ ID NO: 3241983 - protein, 4 aa, Plasmodium falciparum
NVNN

SEQ ID NO: 3241984 - protein, 9 aa, Plasmodium falciparum
NVNNEKSNI

SEQ ID NO: 3241985 - protein, 29 aa, Plasmodium falciparum
NVNNENEKSKTKRFEKEKHNEEKKSINDE

SEQ ID NO: 3241986 - protein, 8 aa, Plasmodium falciparum
NVNNEQNY

SEQ ID NO: 3241987 - protein, 12 aa, Plasmodium falciparum
NVNNHNNNVNNH

SEQ ID NO: 3241988 - protein, 6 aa, Plasmodium falciparum
NVNNNN

SEQ ID NO: 3241989 - protein, 11 aa, Plasmodium falciparum
NVNNNNCNNIE

SEQ ID NO: 3241990 - protein, 29 aa, Plasmodium falciparum
NVNNNSKKNNKSSNNNNNNINCNNSGNNF

SEQ ID NO: 3241991 - protein, 6 aa, Plasmodium falciparum
NVNNTN

SEQ ID NO: 3241992 - protein, 9 aa, Plasmodium falciparum
NVNNTNNTN

SEQ ID NO: 3241993 - protein, 17 aa, Plasmodium falciparum
NVNNTSDKIKTKKNLST

SEQ ID NO: 3241994 - protein, 16 aa, Plasmodium falciparum
NVNQENIKPVNDKSDH

SEQ ID NO: 3241995 - protein, 8 aa, Plasmodium falciparum
NVNQNDKE

SEQ ID NO: 3241996 - protein, 6 aa, Plasmodium falciparum
NVNRKK

SEQ ID NO: 3241997 - protein, 13 aa, Plasmodium falciparum
NVNRTSNVNRTSN

SEQ ID NO: 3241998 - protein, 9 aa, Plasmodium falciparum
NVNRTSSIN

SEQ ID NO: 3241999 - protein, 9 aa, Plasmodium falciparum
NVNSNNMDV

SEQ ID NO: 3242000 - protein, 5 aa, Plasmodium falciparum
NVNSS

SEQ ID NO: 3242001 - protein, 4 aa, Plasmodium falciparum
NVNT

SEQ ID NO: 3242002 - protein, 6 aa, Plasmodium falciparum
NVNTPL

SEQ ID NO: 3242003 - protein, 11 aa, Plasmodium falciparum
NVPADKTKPYL

SEQ ID NO: 3242004 - protein, 10 aa, Plasmodium falciparum
NVPEKKSIGK

SEQ ID NO: 3242005 - protein, 4 aa, Plasmodium falciparum
NVPM

SEQ ID NO: 3242006 - protein, 16 aa, Plasmodium falciparum
NVPNPNEKNNNNNNNM

SEQ ID NO: 3242007 - protein, 14 aa, Plasmodium falciparum
NVPNPRKGKKKKVE

SEQ ID NO: 3242008 - protein, 9 aa, Plasmodium falciparum
NVPNTNRQP

SEQ ID NO: 3242009 - protein, 7 aa, Plasmodium falciparum
NVPNVPN

SEQ ID NO: 3242010 - protein, 26 aa, Plasmodium falciparum
NVPPAPPPQPPPPPAIPAPATTPGVN

SEQ ID NO: 3242011 - protein, 5 aa, Plasmodium falciparum
NVPPM

SEQ ID NO: 3242012 - protein, 6 aa, Plasmodium falciparum
NVPQEK

SEQ ID NO: 3242013 - protein, 5 aa, Plasmodium falciparum
NVPQH

SEQ ID NO: 3242014 - protein, 6 aa, Plasmodium falciparum
NVPSER

SEQ ID NO: 3242015 - protein, 14 aa, Plasmodium falciparum
NVPTDDNINNEENL

SEQ ID NO: 3242016 - protein, 13 aa, Plasmodium falciparum
NVPTNDQINDPIN

SEQ ID NO: 3242017 - protein, 6 aa, Plasmodium falciparum
NVPTRN

SEQ ID NO: 3242018 - protein, 6 aa, Plasmodium falciparum
NVPYKS

SEQ ID NO: 3242019 - protein, 5 aa, Plasmodium falciparum
NVQDD

SEQ ID NO: 3242020 - protein, 6 aa, Plasmodium falciparum
NVQDTS

SEQ ID NO: 3242021 - protein, 4 aa, Plasmodium falciparum
NVQE

SEQ ID NO: 3242022 - protein, 8 aa, Plasmodium falciparum
NVQGTNNK

SEQ ID NO: 3242023 - protein, 7 aa, Plasmodium falciparum
NVQKNDE

SEQ ID NO: 3242024 - protein, 35 aa, Plasmodium falciparum
NVQKQNEKKENNNTSGSTSKSSSSQNLENSKEVEQ

SEQ ID NO: 3242025 - protein, 4 aa, Plasmodium falciparum
NVQN

SEQ ID NO: 3242026 - protein, 7 aa, Plasmodium falciparum
NVQNDNN

SEQ ID NO: 3242027 - protein, 15 aa, Plasmodium falciparum
NVQNGQSVNIQNGQS

SEQ ID NO: 3242028 - protein, 5 aa, Plasmodium falciparum
NVQNN

SEQ ID NO: 3242029 - protein, 19 aa, Plasmodium falciparum
NVQNNKLDSQEKKNKDTVD

SEQ ID NO: 3242030 - protein, 22 aa, Plasmodium falciparum
NVQNNNIENNNVDNNIDDNKYI

SEQ ID NO: 3242031 - protein, 8 aa, Plasmodium falciparum
NVQQEKKE

SEQ ID NO: 3242032 - protein, 16 aa, Plasmodium falciparum
NVQSSNTNKHMPRKML

SEQ ID NO: 3242033 - protein, 4 aa, Plasmodium falciparum
NVQT

SEQ ID NO: 3242034 - protein, 40 aa, Plasmodium falciparum
NVRDDEEKKKKKKKKSKKKKVNNKKGNNDNGEDDETEFEE

SEQ ID NO: 3242035 - protein, 4 aa, Plasmodium falciparum
NVRK

SEQ ID NO: 3242036 - protein, 6 aa, Plasmodium falciparum
NVRNEE

SEQ ID NO: 3242037 - protein, 6 aa, Plasmodium falciparum
NVRNKQ

SEQ ID NO: 3242038 - protein, 8 aa, Plasmodium falciparum
NVRSNNNL

SEQ ID NO: 3242039 - protein, 4 aa, Plasmodium falciparum
NVSD

SEQ ID NO: 3242040 - protein, 19 aa, Plasmodium falciparum
NVSDNEESDQKDNVDDDER

SEQ ID NO: 3242041 - protein, 9 aa, Plasmodium falciparum
NVSEEIPEG

SEQ ID NO: 3242042 - protein, 12 aa, Plasmodium falciparum
NVSEHEGGSSNM

SEQ ID NO: 3242043 - protein, 17 aa, Plasmodium falciparum
NVSEQSDINKEDENNQC

SEQ ID NO: 3242044 - protein, 8 aa, Plasmodium falciparum
NVSGKKKK

SEQ ID NO: 3242045 - protein, 13 aa, Plasmodium falciparum
NVSGNDGTGNDDL

SEQ ID NO: 3242046 - protein, 18 aa, Plasmodium falciparum
NVSKNNQVELKQSSNENM

SEQ ID NO: 3242047 - protein, 6 aa, Plasmodium falciparum
NVSKPY

SEQ ID NO: 3242048 - protein, 10 aa, Plasmodium falciparum
NVSNASKKNR

SEQ ID NO: 3242049 - protein, 5 aa, Plasmodium falciparum
NVSNE

SEQ ID NO: 3242050 - protein, 11 aa, Plasmodium falciparum
NVSNEAKKYDE

SEQ ID NO: 3242051 - protein, 11 aa, Plasmodium falciparum
NVSNQQKQNVY

SEQ ID NO: 3242052 - protein, 7 aa, Plasmodium falciparum
NVSPSLS

SEQ ID NO: 3242053 - protein, 6 aa, Plasmodium falciparum
NVSPVQ

SEQ ID NO: 3242054 - protein, 9 aa, Plasmodium falciparum
NVSQNYNDK

SEQ ID NO: 3242055 - protein, 9 aa, Plasmodium falciparum
NVSQQLPPN

SEQ ID NO: 3242056 - protein, 6 aa, Plasmodium falciparum
NVSQTN

SEQ ID NO: 3242057 - protein, 20 aa, Plasmodium falciparum
NVSRKKENVTNSYNSSVESK

SEQ ID NO: 3242058 - protein, 8 aa, Plasmodium falciparum
NVSSDNKQ

SEQ ID NO: 3242059 - protein, 6 aa, Plasmodium falciparum
NVSSGF

SEQ ID NO: 3242060 - protein, 5 aa, Plasmodium falciparum
NVSSI

SEQ ID NO: 3242061 - protein, 5 aa, Plasmodium falciparum
NVSSL

SEQ ID NO: 3242062 - protein, 10 aa, Plasmodium falciparum
NVSSSTSDYT

SEQ ID NO: 3242063 - protein, 8 aa, Plasmodium falciparum
NVSTNTNI

SEQ ID NO: 3242064 - protein, 5 aa, Plasmodium falciparum
NVSVK

SEQ ID NO: 3242065 - protein, 4 aa, Plasmodium falciparum
NVTN

SEQ ID NO: 3242066 - protein, 6 aa, Plasmodium falciparum
NVTNKY

SEQ ID NO: 3242067 - protein, 10 aa, Plasmodium falciparum
NVTNSTCGSL

SEQ ID NO: 3242068 - protein, 5 aa, Plasmodium falciparum
NVTNV

SEQ ID NO: 3242069 - protein, 6 aa, Plasmodium falciparum
NVTQKG

SEQ ID NO: 3242070 - protein, 9 aa, Plasmodium falciparum
NVTQNRSEP

SEQ ID NO: 3242071 - protein, 11 aa, Plasmodium falciparum
NVTQSNKKYDN

SEQ ID NO: 3242072 - protein, 11 aa, Plasmodium falciparum
NVTSEKKNNEN

SEQ ID NO: 3242073 - protein, 7 aa, Plasmodium falciparum
NVTSENA

SEQ ID NO: 3242074 - protein, 8 aa, Plasmodium falciparum
NVTSNNMD

SEQ ID NO: 3242075 - protein, 9 aa, Plasmodium falciparum
NVTSNYTND

SEQ ID NO: 3242076 - protein, 8 aa, Plasmodium falciparum
NVTSSKSS

SEQ ID NO: 3242077 - protein, 11 aa, Plasmodium falciparum
NVTTGKDDPCD

SEQ ID NO: 3242078 - protein, 21 aa, Plasmodium falciparum
NVTTSNNNTENDNNSRSKSGI

SEQ ID NO: 3242079 - protein, 5 aa, Plasmodium falciparum
NVTYG

SEQ ID NO: 3242080 - protein, 14 aa, Plasmodium falciparum
NVVNNNNESNKEKV

SEQ ID NO: 3242081 - protein, 28 aa, Plasmodium falciparum
NVVTNKSNNNTINNTSNNNNTNNSSNNI

SEQ ID NO: 3242082 - protein, 25 aa, Plasmodium falciparum
NVYEEQKTKCQKESKSAKGNNHGNE

SEQ ID NO: 3242083 - protein, 5 aa, Plasmodium falciparum
NVYET

SEQ ID NO: 3242084 - protein, 10 aa, Plasmodium falciparum
NVYKDDSDKD

SEQ ID NO: 3242085 - protein, 4 aa, Plasmodium falciparum
NVYN

SEQ ID NO: 3242086 - protein, 13 aa, Plasmodium falciparum
NVYPKKDDNHLNK

SEQ ID NO: 3242087 - protein, 7 aa, Plasmodium falciparum
NVYPSKN

SEQ ID NO: 3242088 - protein, 14 aa, Plasmodium falciparum
NVYQDEYKKKQTEC

SEQ ID NO: 3242089 - protein, 4 aa, Plasmodium falciparum
NVYS

SEQ ID NO: 3242090 - protein, 5 aa, Plasmodium falciparum
NWEDN

SEQ ID NO: 3242091 - protein, 7 aa, Plasmodium falciparum
NWSNSKK

SEQ ID NO: 3242092 - protein, 15 aa, Plasmodium falciparum
NWTDDNDEDEKEKEI

SEQ ID NO: 3242093 - protein, 6 aa, Plasmodium falciparum
NYAEKT

SEQ ID NO: 3242094 - protein, 10 aa, Plasmodium falciparum
NYAKAGSYRL

SEQ ID NO: 3242095 - protein, 8 aa, Plasmodium falciparum
NYANKNEK

SEQ ID NO: 3242096 - protein, 7 aa, Plasmodium falciparum
NYAPNYN

SEQ ID NO: 3242097 - protein, 8 aa, Plasmodium falciparum
NYASEQEY

SEQ ID NO: 3242098 - protein, 4 aa, Plasmodium falciparum
NYDA

SEQ ID NO: 3242099 - protein, 4 aa, Plasmodium falciparum
NYDE

SEQ ID NO: 3242100 - protein, 10 aa, Plasmodium falciparum
NYDEDITSGD

SEQ ID NO: 3242101 - protein, 6 aa, Plasmodium falciparum
NYDEND

SEQ ID NO: 3242102 - protein, 9 aa, Plasmodium falciparum
NYDHNNNSL

SEQ ID NO: 3242103 - protein, 5 aa, Plasmodium falciparum
NYDHT

SEQ ID NO: 3242104 - protein, 4 aa, Plasmodium falciparum
NYDK

SEQ ID NO: 3242105 - protein, 22 aa, Plasmodium falciparum
NYDKNKGNYDAIDDANSDSASQ

SEQ ID NO: 3242106 - protein, 4 aa, Plasmodium falciparum
NYDN

SEQ ID NO: 3242107 - protein, 15 aa, Plasmodium falciparum
NYDNNKYNDEEKNMK

SEQ ID NO: 3242108 - protein, 12 aa, Plasmodium falciparum
NYDNTNNNSDII

SEQ ID NO: 3242109 - protein, 6 aa, Plasmodium falciparum
NYDNYN

SEQ ID NO: 3242110 - protein, 7 aa, Plasmodium falciparum
NYDSDPQ

SEQ ID NO: 3242111 - protein, 15 aa, Plasmodium falciparum
NYDSKNVNENDRNLG

SEQ ID NO: 3242112 - protein, 10 aa, Plasmodium falciparum
NYDSNKDLKP

SEQ ID NO: 3242113 - protein, 7 aa, Plasmodium falciparum
NYDTNYN

SEQ ID NO: 3242114 - protein, 4 aa, Plasmodium falciparum
NYDV

SEQ ID NO: 3242115 - protein, 14 aa, Plasmodium falciparum
NYDYEKSKKNYKGS

SEQ ID NO: 3242116 - protein, 11 aa, Plasmodium falciparum
NYEDKENDSLF

SEQ ID NO: 3242117 - protein, 7 aa, Plasmodium falciparum
NYEDNNK

SEQ ID NO: 3242118 - protein, 8 aa, Plasmodium falciparum
NYEEDYDP

SEQ ID NO: 3242119 - protein, 9 aa, Plasmodium falciparum
NYEEGNEKM

SEQ ID NO: 3242120 - protein, 5 aa, Plasmodium falciparum
NYEEK

SEQ ID NO: 3242121 - protein, 11 aa, Plasmodium falciparum
NYEENKKEKKE

SEQ ID NO: 3242122 - protein, 5 aa, Plasmodium falciparum
NYEFT

SEQ ID NO: 3242123 - protein, 4 aa, Plasmodium falciparum
NYEG

SEQ ID NO: 3242124 - protein, 4 aa, Plasmodium falciparum
NYEI

SEQ ID NO: 3242125 - protein, 11 aa, Plasmodium falciparum
NYEKDKKKKDL

SEQ ID NO: 3242126 - protein, 24 aa, Plasmodium falciparum
NYEKEGKSKELKGENDCINESSEN

SEQ ID NO: 3242127 - protein, 9 aa, Plasmodium falciparum
NYEKEKTEK

SEQ ID NO: 3242128 - protein, 6 aa, Plasmodium falciparum
NYEKNE

SEQ ID NO: 3242129 - protein, 4 aa, Plasmodium falciparum
NYEN

SEQ ID NO: 3242130 - protein, 10 aa, Plasmodium falciparum
NYENKNSSCA

SEQ ID NO: 3242131 - protein, 10 aa, Plasmodium falciparum
NYENNEDKNI

SEQ ID NO: 3242132 - protein, 5 aa, Plasmodium falciparum
NYENP

SEQ ID NO: 3242133 - protein, 7 aa, Plasmodium falciparum
NYEPPHG

SEQ ID NO: 3242134 - protein, 17 aa, Plasmodium falciparum
NYEQNDNITTTNTNDKK

SEQ ID NO: 3242135 - protein, 13 aa, Plasmodium falciparum
NYEQNEQEHMGND

SEQ ID NO: 3242136 - protein, 12 aa, Plasmodium falciparum
NYEQYKDKSKEG

SEQ ID NO: 3242137 - protein, 5 aa, Plasmodium falciparum
NYESV

SEQ ID NO: 3242138 - protein, 24 aa, Plasmodium falciparum
NYFSSNDDSYYSETTSNENEHNKY

SEQ ID NO: 3242139 - protein, 4 aa, Plasmodium falciparum
NYGN

SEQ ID NO: 3242140 - protein, 6 aa, Plasmodium falciparum
NYGNRN

SEQ ID NO: 3242141 - protein, 5 aa, Plasmodium falciparum
NYGSI

SEQ ID NO: 3242142 - protein, 5 aa, Plasmodium falciparum
NYGSN

SEQ ID NO: 3242143 - protein, 10 aa, Plasmodium falciparum
NYGYNKTNKE

SEQ ID NO: 3242144 - protein, 7 aa, Plasmodium falciparum
NYHDEDK

SEQ ID NO: 3242145 - protein, 10 aa, Plasmodium falciparum
NYHGGKRELE

SEQ ID NO: 3242146 - protein, 8 aa, Plasmodium falciparum
NYHKPSEK

SEQ ID NO: 3242147 - protein, 12 aa, Plasmodium falciparum
NYHNDNNKVGVN

SEQ ID NO: 3242148 - protein, 6 aa, Plasmodium falciparum
NYHNKN

SEQ ID NO: 3242149 - protein, 4 aa, Plasmodium falciparum
NYIE

SEQ ID NO: 3242150 - protein, 13 aa, Plasmodium falciparum
NYIGEKKKQNENI

SEQ ID NO: 3242151 - protein, 22 aa, Plasmodium falciparum
NYINEGKEYNNKDESGQNSEND

SEQ ID NO: 3242152 - protein, 5 aa, Plasmodium falciparum
NYINP

SEQ ID NO: 3242153 - protein, 6 aa, Plasmodium falciparum
NYIPNN

SEQ ID NO: 3242154 - protein, 8 aa, Plasmodium falciparum
NYIPPNPR

SEQ ID NO: 3242155 - protein, 10 aa, Plasmodium falciparum
NYISNEKNDD

SEQ ID NO: 3242156 - protein, 22 aa, Plasmodium falciparum
NYITTTTKKKKKKKKKKGIPAQ

SEQ ID NO: 3242157 - protein, 8 aa, Plasmodium falciparum
NYKAENKN

SEQ ID NO: 3242158 - protein, 17 aa, Plasmodium falciparum
NYKAEWNKNKKNKGEMI

SEQ ID NO: 3242159 - protein, 5 aa, Plasmodium falciparum
NYKDA

SEQ ID NO: 3242160 - protein, 9 aa, Plasmodium falciparum
NYKDEDLST

SEQ ID NO: 3242161 - protein, 9 aa, Plasmodium falciparum
NYKDPKKKY

SEQ ID NO: 3242162 - protein, 14 aa, Plasmodium falciparum
NYKEEEEEEDEEKR

SEQ ID NO: 3242163 - protein, 10 aa, Plasmodium falciparum
NYKEENNMGE

SEQ ID NO: 3242164 - protein, 10 aa, Plasmodium falciparum
NYKEKEERIE

SEQ ID NO: 3242165 - protein, 6 aa, Plasmodium falciparum
NYKENK

SEQ ID NO: 3242166 - protein, 13 aa, Plasmodium falciparum
NYKGEDKIETDEN

SEQ ID NO: 3242167 - protein, 18 aa, Plasmodium falciparum
NYKGNSKVHNNYSKEKIN

SEQ ID NO: 3242168 - protein, 6 aa, Plasmodium falciparum
NYKHPN

SEQ ID NO: 3242169 - protein, 4 aa, Plasmodium falciparum
NYKI

SEQ ID NO: 3242170 - protein, 10 aa, Plasmodium falciparum
NYKKESEHNR

SEQ ID NO: 3242171 - protein, 5 aa, Plasmodium falciparum
NYKKG

SEQ ID NO: 3242172 - protein, 6 aa, Plasmodium falciparum
NYKKKN

SEQ ID NO: 3242173 - protein, 30 aa, Plasmodium falciparum
NYKKQNQRYTEVKGTSPYKEDSDVKESKYA

SEQ ID NO: 3242174 - protein, 8 aa, Plasmodium falciparum
NYKKTTKK

SEQ ID NO: 3242175 - protein, 4 aa, Plasmodium falciparum
NYKL

SEQ ID NO: 3242176 - protein, 4 aa, Plasmodium falciparum
NYKN

SEQ ID NO: 3242177 - protein, 12 aa, Plasmodium falciparum
NYKNDKNDKDEK

SEQ ID NO: 3242178 - protein, 6 aa, Plasmodium falciparum
NYKNEK

SEQ ID NO: 3242179 - protein, 21 aa, Plasmodium falciparum
NYKNEKNNVEKKTKKRTKNIQ

SEQ ID NO: 3242180 - protein, 5 aa, Plasmodium falciparum
NYKNI

SEQ ID NO: 3242181 - protein, 13 aa, Plasmodium falciparum
NYKNKNNNNNNNK

SEQ ID NO: 3242182 - protein, 14 aa, Plasmodium falciparum
NYKNQNVDEEQERK

SEQ ID NO: 3242183 - protein, 9 aa, Plasmodium falciparum
NYKNRKDSI

SEQ ID NO: 3242184 - protein, 5 aa, Plasmodium falciparum
NYKQK

SEQ ID NO: 3242185 - protein, 9 aa, Plasmodium falciparum
NYKRNGNVI

SEQ ID NO: 3242186 - protein, 13 aa, Plasmodium falciparum
NYKSEQNSAEDNM

SEQ ID NO: 3242187 - protein, 21 aa, Plasmodium falciparum
NYKSNSSQTITEKDDEKDNYV

SEQ ID NO: 3242188 - protein, 9 aa, Plasmodium falciparum
NYKSQKKFK

SEQ ID NO: 3242189 - protein, 7 aa, Plasmodium falciparum
NYKTTKS

SEQ ID NO: 3242190 - protein, 7 aa, Plasmodium falciparum
NYKYEKT

SEQ ID NO: 3242191 - protein, 4 aa, Plasmodium falciparum
NYLK

SEQ ID NO: 3242192 - protein, 5 aa, Plasmodium falciparum
NYMEN

SEQ ID NO: 3242193 - protein, 6 aa, Plasmodium falciparum
NYMNEG

SEQ ID NO: 3242194 - protein, 13 aa, Plasmodium falciparum
NYNDDKENEDTIN

SEQ ID NO: 3242195 - protein, 7 aa, Plasmodium falciparum
NYNDDKK

SEQ ID NO: 3242196 - protein, 5 aa, Plasmodium falciparum
NYNDE

SEQ ID NO: 3242197 - protein, 7 aa, Plasmodium falciparum
NYNDNEK

SEQ ID NO: 3242198 - protein, 7 aa, Plasmodium falciparum
NYNDNEN

SEQ ID NO: 3242199 - protein, 8 aa, Plasmodium falciparum
NYNDNENN

SEQ ID NO: 3242200 - protein, 11 aa, Plasmodium falciparum
NYNDNKDYSRE

SEQ ID NO: 3242201 - protein, 42 aa, Plasmodium falciparum
NYNDNNDNDNNNNDNNNNDNNNDNNSNNINSNNNNNNNNNCE

SEQ ID NO: 3242202 - protein, 10 aa, Plasmodium falciparum
NYNDQNNNKK

SEQ ID NO: 3242203 - protein, 8 aa, Plasmodium falciparum
NYNDTTNI

SEQ ID NO: 3242204 - protein, 4 aa, Plasmodium falciparum
NYNE

SEQ ID NO: 3242205 - protein, 6 aa, Plasmodium falciparum
NYNEAS

SEQ ID NO: 3242206 - protein, 6 aa, Plasmodium falciparum
NYNEEK

SEQ ID NO: 3242207 - protein, 12 aa, Plasmodium falciparum
NYNEKKEDKKKI

SEQ ID NO: 3242208 - protein, 8 aa, Plasmodium falciparum
NYNETNSI

SEQ ID NO: 3242209 - protein, 7 aa, Plasmodium falciparum
NYNGEKE

SEQ ID NO: 3242210 - protein, 5 aa, Plasmodium falciparum
NYNIS

SEQ ID NO: 3242211 - protein, 34 aa, Plasmodium falciparum
NYNKDKSYNAQGGTHGENDETTNGTNISNDGLDK

SEQ ID NO: 3242212 - protein, 17 aa, Plasmodium falciparum
NYNKDTIHKSNENTHTN

SEQ ID NO: 3242213 - protein, 5 aa, Plasmodium falciparum
NYNKE

SEQ ID NO: 3242214 - protein, 5 aa, Plasmodium falciparum
NYNKK

SEQ ID NO: 3242215 - protein, 4 aa, Plasmodium falciparum
NYNN

SEQ ID NO: 3242216 - protein, 9 aa, Plasmodium falciparum
NYNNDFDDN

SEQ ID NO: 3242217 - protein, 11 aa, Plasmodium falciparum
NYNNDKSYTPL

SEQ ID NO: 3242218 - protein, 24 aa, Plasmodium falciparum
NYNNEQDVGLSNNTNIGGKEKIGD

SEQ ID NO: 3242219 - protein, 5 aa, Plasmodium falciparum
NYNNG

SEQ ID NO: 3242220 - protein, 5 aa, Plasmodium falciparum
NYNNH

SEQ ID NO: 3242221 - protein, 9 aa, Plasmodium falciparum
NYNNKYTDN

SEQ ID NO: 3242222 - protein, 5 aa, Plasmodium falciparum
NYNNL

SEQ ID NO: 3242223 - protein, 8 aa, Plasmodium falciparum
NYNNNDSS

SEQ ID NO: 3242224 - protein, 15 aa, Plasmodium falciparum
NYNNNHDDHNDDHND

SEQ ID NO: 3242225 - protein, 11 aa, Plasmodium falciparum
NYNNNHNNNHS

SEQ ID NO: 3242226 - protein, 58 aa, Plasmodium falciparum
NYNNNNENHSLQSNKISDNMKDPGNTYDNKNRKYKDDRNHVKEKDKRKKKKEKEKNII

SEQ ID NO: 3242227 - protein, 13 aa, Plasmodium falciparum
NYNNNNNNKESPS

SEQ ID NO: 3242228 - protein, 23 aa, Plasmodium falciparum
NYNNNNNNNNNNNNNNNNNNNNN

SEQ ID NO: 3242229 - protein, 13 aa, Plasmodium falciparum
NYNNNNNNSSLNT

SEQ ID NO: 3242230 - protein, 9 aa, Plasmodium falciparum
NYNNNNNYN

SEQ ID NO: 3242231 - protein, 11 aa, Plasmodium falciparum
NYNNNNQSSRH

SEQ ID NO: 3242232 - protein, 6 aa, Plasmodium falciparum
NYNNNY

SEQ ID NO: 3242233 - protein, 12 aa, Plasmodium falciparum
NYNNNYNNNNNL

SEQ ID NO: 3242234 - protein, 16 aa, Plasmodium falciparum
NYNNNYNNNYNNDNNC

SEQ ID NO: 3242235 - protein, 20 aa, Plasmodium falciparum
NYNNQSVSSPFDQKNNDQNF

SEQ ID NO: 3242236 - protein, 7 aa, Plasmodium falciparum
NYNNRNA

SEQ ID NO: 3242237 - protein, 26 aa, Plasmodium falciparum
NYNNTYQKGKGKYKNKINYNNKNENK

SEQ ID NO: 3242238 - protein, 6 aa, Plasmodium falciparum
NYNNYD

SEQ ID NO: 3242239 - protein, 5 aa, Plasmodium falciparum
NYNQI

SEQ ID NO: 3242240 - protein, 20 aa, Plasmodium falciparum
NYNQKEKNEKNEKKEKNENL

SEQ ID NO: 3242241 - protein, 6 aa, Plasmodium falciparum
NYNQQK

SEQ ID NO: 3242242 - protein, 9 aa, Plasmodium falciparum
NYNQTENNN

SEQ ID NO: 3242243 - protein, 12 aa, Plasmodium falciparum
NYNSENSDHKDQ

SEQ ID NO: 3242244 - protein, 12 aa, Plasmodium falciparum
NYNSNDVNQKIN

SEQ ID NO: 3242245 - protein, 5 aa, Plasmodium falciparum
NYNSQ

SEQ ID NO: 3242246 - protein, 28 aa, Plasmodium falciparum
NYNSRSNSGKRNLYEPQSHSKKKNLIQR

SEQ ID NO: 3242247 - protein, 15 aa, Plasmodium falciparum
NYNSSYDNVHNDNDN

SEQ ID NO: 3242248 - protein, 7 aa, Plasmodium falciparum
NYNSYDE

SEQ ID NO: 3242249 - protein, 6 aa, Plasmodium falciparum
NYNTAS

SEQ ID NO: 3242250 - protein, 5 aa, Plasmodium falciparum
NYNTI

SEQ ID NO: 3242251 - protein, 7 aa, Plasmodium falciparum
NYNTVSG

SEQ ID NO: 3242252 - protein, 7 aa, Plasmodium falciparum
NYNTYKS

SEQ ID NO: 3242253 - protein, 7 aa, Plasmodium falciparum
NYNTYND

SEQ ID NO: 3242254 - protein, 11 aa, Plasmodium falciparum
NYNYNEKREPL

SEQ ID NO: 3242255 - protein, 12 aa, Plasmodium falciparum
NYPDNRDKKEGI

SEQ ID NO: 3242256 - protein, 4 aa, Plasmodium falciparum
NYPF

SEQ ID NO: 3242257 - protein, 7 aa, Plasmodium falciparum
NYPGNNR

SEQ ID NO: 3242258 - protein, 5 aa, Plasmodium falciparum
NYPHK

SEQ ID NO: 3242259 - protein, 9 aa, Plasmodium falciparum
NYPNPQNER

SEQ ID NO: 3242260 - protein, 7 aa, Plasmodium falciparum
NYPYEDN

SEQ ID NO: 3242261 - protein, 6 aa, Plasmodium falciparum
NYQDES

SEQ ID NO: 3242262 - protein, 8 aa, Plasmodium falciparum
NYQDGYKE

SEQ ID NO: 3242263 - protein, 8 aa, Plasmodium falciparum
NYQDKKNK

SEQ ID NO: 3242264 - protein, 10 aa, Plasmodium falciparum
NYQKKDDNSL

SEQ ID NO: 3242265 - protein, 4 aa, Plasmodium falciparum
NYQN

SEQ ID NO: 3242266 - protein, 5 aa, Plasmodium falciparum
NYQNE

SEQ ID NO: 3242267 - protein, 5 aa, Plasmodium falciparum
NYQNK

SEQ ID NO: 3242268 - protein, 11 aa, Plasmodium falciparum
NYQNKKLEKKM

SEQ ID NO: 3242269 - protein, 5 aa, Plasmodium falciparum
NYQNN

SEQ ID NO: 3242270 - protein, 7 aa, Plasmodium falciparum
NYQNTDS

SEQ ID NO: 3242271 - protein, 4 aa, Plasmodium falciparum
NYRD

SEQ ID NO: 3242272 - protein, 5 aa, Plasmodium falciparum
NYREN

SEQ ID NO: 3242273 - protein, 4 aa, Plasmodium falciparum
NYRN

SEQ ID NO: 3242274 - protein, 7 aa, Plasmodium falciparum
NYRNDDI

SEQ ID NO: 3242275 - protein, 11 aa, Plasmodium falciparum
NYRNENKSFTI

SEQ ID NO: 3242276 - protein, 23 aa, Plasmodium falciparum
NYRNKNNNKTNNVNMSNNNNNND

SEQ ID NO: 3242277 - protein, 6 aa, Plasmodium falciparum
NYRQEY

SEQ ID NO: 3242278 - protein, 17 aa, Plasmodium falciparum
NYRQEYDNYPQKYDNYR

SEQ ID NO: 3242279 - protein, 6 aa, Plasmodium falciparum
NYRTGK

SEQ ID NO: 3242280 - protein, 9 aa, Plasmodium falciparum
NYSCSSNSS

SEQ ID NO: 3242281 - protein, 14 aa, Plasmodium falciparum
NYSDDSKSGSDSDP

SEQ ID NO: 3242282 - protein, 7 aa, Plasmodium falciparum
NYSDEYN

SEQ ID NO: 3242283 - protein, 11 aa, Plasmodium falciparum
NYSGKQNNQDI

SEQ ID NO: 3242284 - protein, 15 aa, Plasmodium falciparum
NYSKENESISKNNNY

SEQ ID NO: 3242285 - protein, 23 aa, Plasmodium falciparum
NYSNKEREKNKNYDKKGKRKIND

SEQ ID NO: 3242286 - protein, 17 aa, Plasmodium falciparum
NYSNKTHKEYNNNNNNN

SEQ ID NO: 3242287 - protein, 6 aa, Plasmodium falciparum
NYSNSN

SEQ ID NO: 3242288 - protein, 8 aa, Plasmodium falciparum
NYSPHKND

SEQ ID NO: 3242289 - protein, 7 aa, Plasmodium falciparum
NYSPPNS

SEQ ID NO: 3242290 - protein, 9 aa, Plasmodium falciparum
NYSPTIEHS

SEQ ID NO: 3242291 - protein, 14 aa, Plasmodium falciparum
NYSSDSNSSNDQRY

SEQ ID NO: 3242292 - protein, 5 aa, Plasmodium falciparum
NYSSG

SEQ ID NO: 3242293 - protein, 11 aa, Plasmodium falciparum
NYSSGAEYSSN

SEQ ID NO: 3242294 - protein, 8 aa, Plasmodium falciparum
NYSSSISS

SEQ ID NO: 3242295 - protein, 6 aa, Plasmodium falciparum
NYSTGD

SEQ ID NO: 3242296 - protein, 27 aa, Plasmodium falciparum
NYSTNKFTTTTTTNYNNSNNYKDDDEK

SEQ ID NO: 3242297 - protein, 8 aa, Plasmodium falciparum
NYSTNNIN

SEQ ID NO: 3242298 - protein, 21 aa, Plasmodium falciparum
NYSYEGKSKPLNTQLSKEENY

SEQ ID NO: 3242299 - protein, 6 aa, Plasmodium falciparum
NYTEKE

SEQ ID NO: 3242300 - protein, 9 aa, Plasmodium falciparum
NYTKENECH

SEQ ID NO: 3242301 - protein, 8 aa, Plasmodium falciparum
NYTKSSIK

SEQ ID NO: 3242302 - protein, 5 aa, Plasmodium falciparum
NYTND

SEQ ID NO: 3242303 - protein, 37 aa, Plasmodium falciparum
NYTNDNYKEKSNMQKCSDDYGDDYGDNHVSNHDNNHV

SEQ ID NO: 3242304 - protein, 6 aa, Plasmodium falciparum
NYTNGN

SEQ ID NO: 3242305 - protein, 20 aa, Plasmodium falciparum
NYTNGSFSNHNNKKHISSKG

SEQ ID NO: 3242306 - protein, 11 aa, Plasmodium falciparum
NYTREDAQNIE

SEQ ID NO: 3242307 - protein, 6 aa, Plasmodium falciparum
NYTRVE

SEQ ID NO: 3242308 - protein, 27 aa, Plasmodium falciparum
NYTSGDQQNESTSEDDDDGNTNKSTCK

SEQ ID NO: 3242309 - protein, 5 aa, Plasmodium falciparum
NYTSK

SEQ ID NO: 3242310 - protein, 12 aa, Plasmodium falciparum
NYTSSNENNNNF

SEQ ID NO: 3242311 - protein, 14 aa, Plasmodium falciparum
NYTYEKKYNQDRKN

SEQ ID NO: 3242312 - protein, 4 aa, Plasmodium falciparum
NYVE

SEQ ID NO: 3242313 - protein, 5 aa, Plasmodium falciparum
NYVSD

SEQ ID NO: 3242314 - protein, 10 aa, Plasmodium falciparum
NYYDKGNTLN

SEQ ID NO: 3242315 - protein, 9 aa, Plasmodium falciparum
NYYEKPPKN

SEQ ID NO: 3242316 - protein, 6 aa, Plasmodium falciparum
NYYGDY

SEQ ID NO: 3242317 - protein, 11 aa, Plasmodium falciparum
NYYNEKNRNDM

SEQ ID NO: 3242318 - protein, 9 aa, Plasmodium falciparum
NYYPSNSAP

SEQ ID NO: 3242319 - protein, 6 aa, Plasmodium falciparum
NYYQPE

SEQ ID NO: 3242320 - protein, 4 aa, Plasmodium falciparum
NYYS

SEQ ID NO: 3242321 - protein, 18 aa, Plasmodium falciparum
NYYSNNKNDTNQKNDKSN

SEQ ID NO: 3242322 - protein, 10 aa, Plasmodium falciparum
NYYTKEKDPN

SEQ ID NO: 3242323 - protein, 5 aa, Plasmodium falciparum
NYYTN

SEQ ID NO: 3242324 - protein, 7 aa, Plasmodium falciparum
PAAASAS

SEQ ID NO: 3242325 - protein, 12 aa, Plasmodium falciparum
PAAASDSAIPGG

SEQ ID NO: 3242326 - protein, 7 aa, Plasmodium falciparum
PAATSAG

SEQ ID NO: 3242327 - protein, 6 aa, Plasmodium falciparum
PAELKQ

SEQ ID NO: 3242328 - protein, 48 aa, Plasmodium falciparum
PAETVKKEEEEKEEQEEEEPDEKVPPPRAPEASKPKKEKPSQPPRPRR

SEQ ID NO: 3242329 - protein, 8 aa, Plasmodium falciparum
PAGGDKLS

SEQ ID NO: 3242330 - protein, 7 aa, Plasmodium falciparum
PAHDERK

SEQ ID NO: 3242331 - protein, 11 aa, Plasmodium falciparum
PAHKNKVRGNV

SEQ ID NO: 3242332 - protein, 15 aa, Plasmodium falciparum
PAKKQKTQNNNNEDL

SEQ ID NO: 3242333 - protein, 57 aa, Plasmodium falciparum
PAKTPEAPAASPAPKEPPAPSEGTKERPSPPEKKAPLPKEEKTKPKRSLTPTDDPWE

SEQ ID NO: 3242334 - protein, 4 aa, Plasmodium falciparum
PANN

SEQ ID NO: 3242335 - protein, 9 aa, Plasmodium falciparum
PANYDNDAE

SEQ ID NO: 3242336 - protein, 10 aa, Plasmodium falciparum
PANYDNDPEM

SEQ ID NO: 3242337 - protein, 10 aa, Plasmodium falciparum
PANYDNDTEM

SEQ ID NO: 3242338 - protein, 8 aa, Plasmodium falciparum
PAPRIPKD

SEQ ID NO: 3242339 - protein, 10 aa, Plasmodium falciparum
PAQKKSNQLK

SEQ ID NO: 3242340 - protein, 12 aa, Plasmodium falciparum
PASNNNNKKTQS

SEQ ID NO: 3242341 - protein, 4 aa, Plasmodium falciparum
PASS

SEQ ID NO: 3242342 - protein, 5 aa, Plasmodium falciparum
PATNA

SEQ ID NO: 3242343 - protein, 8 aa, Plasmodium falciparum
PATSELDS

SEQ ID NO: 3242344 - protein, 13 aa, Plasmodium falciparum
PCATPSGSYPSLA

SEQ ID NO: 3242345 - protein, 10 aa, Plasmodium falciparum
PCDDENDDKL

SEQ ID NO: 3242346 - protein, 10 aa, Plasmodium falciparum
PCDDNKNEVC

SEQ ID NO: 3242347 - protein, 17 aa, Plasmodium falciparum
PCDDPYDHPYEEEKYST

SEQ ID NO: 3242348 - protein, 6 aa, Plasmodium falciparum
PCENKK

SEQ ID NO: 3242349 - protein, 13 aa, Plasmodium falciparum
PCHNRNQNRFDEN

SEQ ID NO: 3242350 - protein, 21 aa, Plasmodium falciparum
PCKDGTQYNNSNYNDNSHYTH

SEQ ID NO: 3242351 - protein, 12 aa, Plasmodium falciparum
PCKNNDNGEGTI

SEQ ID NO: 3242352 - protein, 7 aa, Plasmodium falciparum
PCNKENN

SEQ ID NO: 3242353 - protein, 10 aa, Plasmodium falciparum
PCNNNDGNNI

SEQ ID NO: 3242354 - protein, 23 aa, Plasmodium falciparum
PCQNPKEEEKELGVDEGENKNNI

SEQ ID NO: 3242355 - protein, 8 aa, Plasmodium falciparum
PCRNNGEV

SEQ ID NO: 3242356 - protein, 10 aa, Plasmodium falciparum
PCSINNNNEE

SEQ ID NO: 3242357 - protein, 22 aa, Plasmodium falciparum
PCSKTYNENGVGKTDFDDDKTF

SEQ ID NO: 3242358 - protein, 7 aa, Plasmodium falciparum
PDAGGVY

SEQ ID NO: 3242359 - protein, 5 aa, Plasmodium falciparum
PDARN

SEQ ID NO: 3242360 - protein, 4 aa, Plasmodium falciparum
PDAS

SEQ ID NO: 3242361 - protein, 7 aa, Plasmodium falciparum
PDDDNMM

SEQ ID NO: 3242362 - protein, 8 aa, Plasmodium falciparum
PDDKKLSK

SEQ ID NO: 3242363 - protein, 5 aa, Plasmodium falciparum
PDDQI

SEQ ID NO: 3242364 - protein, 6 aa, Plasmodium falciparum
PDDTDE

SEQ ID NO: 3242365 - protein, 5 aa, Plasmodium falciparum
PDEIK

SEQ ID NO: 3242366 - protein, 12 aa, Plasmodium falciparum
PDENSKEKKKIQ

SEQ ID NO: 3242367 - protein, 7 aa, Plasmodium falciparum
PDENSKN

SEQ ID NO: 3242368 - protein, 6 aa, Plasmodium falciparum
PDEQGR

SEQ ID NO: 3242369 - protein, 4 aa, Plasmodium falciparum
PDEY

SEQ ID NO: 3242370 - protein, 5 aa, Plasmodium falciparum
PDFDE

SEQ ID NO: 3242371 - protein, 11 aa, Plasmodium falciparum
PDFRSQNKYAS

SEQ ID NO: 3242372 - protein, 28 aa, Plasmodium falciparum
PDGGSNMYPNNNNNNNNNNNNNNNSNNI

SEQ ID NO: 3242373 - protein, 6 aa, Plasmodium falciparum
PDGNPY

SEQ ID NO: 3242374 - protein, 4 aa, Plasmodium falciparum
PDGQ

SEQ ID NO: 3242375 - protein, 5 aa, Plasmodium falciparum
PDGTP

SEQ ID NO: 3242376 - protein, 7 aa, Plasmodium falciparum
PDINSDD

SEQ ID NO: 3242377 - protein, 8 aa, Plasmodium falciparum
PDISNTSQ

SEQ ID NO: 3242378 - protein, 7 aa, Plasmodium falciparum
PDKGGNI

SEQ ID NO: 3242379 - protein, 8 aa, Plasmodium falciparum
PDKKDFNC

SEQ ID NO: 3242380 - protein, 4 aa, Plasmodium falciparum
PDKN

SEQ ID NO: 3242381 - protein, 10 aa, Plasmodium falciparum
PDKNKEPDSL

SEQ ID NO: 3242382 - protein, 11 aa, Plasmodium falciparum
PDKNPGDEEAK

SEQ ID NO: 3242383 - protein, 4 aa, Plasmodium falciparum
PDKQ

SEQ ID NO: 3242384 - protein, 29 aa, Plasmodium falciparum
PDKQGYLRHKLECSMENNEHIFDLPPSTL

SEQ ID NO: 3242385 - protein, 7 aa, Plasmodium falciparum
PDKSKFI

SEQ ID NO: 3242386 - protein, 10 aa, Plasmodium falciparum
PDKTKNIKHH

SEQ ID NO: 3242387 - protein, 4 aa, Plasmodium falciparum
PDKY

SEQ ID NO: 3242388 - protein, 5 aa, Plasmodium falciparum
PDLNI

SEQ ID NO: 3242389 - protein, 4 aa, Plasmodium falciparum
PDLP

SEQ ID NO: 3242390 - protein, 4 aa, Plasmodium falciparum
PDLS

SEQ ID NO: 3242391 - protein, 5 aa, Plasmodium falciparum
PDMRE

SEQ ID NO: 3242392 - protein, 37 aa, Plasmodium falciparum
PDNEKEKCGDNKTMGKEGDKRKEDVIDGNEKHMEEEK

SEQ ID NO: 3242393 - protein, 8 aa, Plasmodium falciparum
PDNHLPND

SEQ ID NO: 3242394 - protein, 28 aa, Plasmodium falciparum
PDNINKDSMSSNFNNNHSEHENNRKNVS

SEQ ID NO: 3242395 - protein, 82 aa, Plasmodium falciparum
PDNNNNNNNDNDNNDNDNNDNDNDNNDNDNNNNDNNNNDNNNNDNNNNDNNNNDNNNNDNNNNDNNNNDNNNHNNDEKGEKD

SEQ ID NO: 3242396 - protein, 9 aa, Plasmodium falciparum
PDNYDNDAE

SEQ ID NO: 3242397 - protein, 20 aa, Plasmodium falciparum
PDNYEGEKKKKKNKTKKKRH

SEQ ID NO: 3242398 - protein, 14 aa, Plasmodium falciparum
PDNYPQKYDNYRQE

SEQ ID NO: 3242399 - protein, 17 aa, Plasmodium falciparum
PDPPPREYLPNGEPKTY

SEQ ID NO: 3242400 - protein, 7 aa, Plasmodium falciparum
PDPSVPS

SEQ ID NO: 3242401 - protein, 4 aa, Plasmodium falciparum
PDQI

SEQ ID NO: 3242402 - protein, 6 aa, Plasmodium falciparum
PDQNNS

SEQ ID NO: 3242403 - protein, 6 aa, Plasmodium falciparum
PDRNGT

SEQ ID NO: 3242404 - protein, 4 aa, Plasmodium falciparum
PDRT

SEQ ID NO: 3242405 - protein, 5 aa, Plasmodium falciparum
PDSLH

SEQ ID NO: 3242406 - protein, 8 aa, Plasmodium falciparum
PDSLNGRR

SEQ ID NO: 3242407 - protein, 4 aa, Plasmodium falciparum
PDSS

SEQ ID NO: 3242408 - protein, 16 aa, Plasmodium falciparum
PDSSSKRTFPLERSKK

SEQ ID NO: 3242409 - protein, 7 aa, Plasmodium falciparum
PDTARDL

SEQ ID NO: 3242410 - protein, 12 aa, Plasmodium falciparum
PDTNEEEKEQRK

SEQ ID NO: 3242411 - protein, 8 aa, Plasmodium falciparum
PDTPLDNN

SEQ ID NO: 3242412 - protein, 5 aa, Plasmodium falciparum
PDVTA

SEQ ID NO: 3242413 - protein, 19 aa, Plasmodium falciparum
PDYESSSDDYTSCSSSYSS

SEQ ID NO: 3242414 - protein, 70 aa, Plasmodium falciparum
PEAPPPKVPEIPKEEDKDKRDEEKPASPTDDVDTDSAGTEKLPTPPAPAPVPRSRPKQRKKQKRQITPKE

SEQ ID NO: 3242415 - protein, 10 aa, Plasmodium falciparum
PEDGDENNII

SEQ ID NO: 3242416 - protein, 13 aa, Plasmodium falciparum
PEDKKTDDSLNVK

SEQ ID NO: 3242417 - protein, 7 aa, Plasmodium falciparum
PEDRPTA

SEQ ID NO: 3242418 - protein, 6 aa, Plasmodium falciparum
PEDYDK

SEQ ID NO: 3242419 - protein, 94 aa, Plasmodium falciparum
PEEEAPPKSKPPDGDRGVGRSLGPTPRSEVEPEESENEDVEDEDDEEEEEDPDDDPEAESEEEDEDHGGQEAEAVPPQPQAPAPLPPPPPPLPP

SEQ ID NO: 3242420 - protein, 16 aa, Plasmodium falciparum
PEEEATAPTSPPRPPL

SEQ ID NO: 3242421 - protein, 5 aa, Plasmodium falciparum
PEEES

SEQ ID NO: 3242422 - protein, 4 aa, Plasmodium falciparum
PEEK

SEQ ID NO: 3242423 - protein, 12 aa, Plasmodium falciparum
PEEKEKTEIKEN

SEQ ID NO: 3242424 - protein, 50 aa, Plasmodium falciparum
PEENESYYEKKQKKEEKEEKEEKEQSLNKQNDMEDQEDNEEYKFEEENKE

SEQ ID NO: 3242425 - protein, 62 aa, Plasmodium falciparum
PEEPKETCEEAVTPSEPKKAEEEPAAEPEAVPEEEAPLPPPPPAAPPRESKEKAKPPPKPRI

SEQ ID NO: 3242426 - protein, 8 aa, Plasmodium falciparum
PEGGVPTL

SEQ ID NO: 3242427 - protein, 4 aa, Plasmodium falciparum
PEGY

SEQ ID NO: 3242428 - protein, 7 aa, Plasmodium falciparum
PEHKPTY

SEQ ID NO: 3242429 - protein, 9 aa, Plasmodium falciparum
PEHNDSPYL

SEQ ID NO: 3242430 - protein, 8 aa, Plasmodium falciparum
PEIAEKEE

SEQ ID NO: 3242431 - protein, 6 aa, Plasmodium falciparum
PEIGEK

SEQ ID NO: 3242432 - protein, 4 aa, Plasmodium falciparum
PEKK

SEQ ID NO: 3242433 - protein, 7 aa, Plasmodium falciparum
PEKKSEV

SEQ ID NO: 3242434 - protein, 4 aa, Plasmodium falciparum
PEKN

SEQ ID NO: 3242435 - protein, 16 aa, Plasmodium falciparum
PEKNGENKNSQQNSDH

SEQ ID NO: 3242436 - protein, 5 aa, Plasmodium falciparum
PEKVK

SEQ ID NO: 3242437 - protein, 5 aa, Plasmodium falciparum
PEMTR

SEQ ID NO: 3242438 - protein, 11 aa, Plasmodium falciparum
PENDSTNKENH

SEQ ID NO: 3242439 - protein, 21 aa, Plasmodium falciparum
PENFQGGYKNEENPRGPSGSI

SEQ ID NO: 3242440 - protein, 4 aa, Plasmodium falciparum
PENG

SEQ ID NO: 3242441 - protein, 11 aa, Plasmodium falciparum
PENGNENENKN

SEQ ID NO: 3242442 - protein, 8 aa, Plasmodium falciparum
PENGNGKI

SEQ ID NO: 3242443 - protein, 16 aa, Plasmodium falciparum
PENGNTETTSGENNDQ

SEQ ID NO: 3242444 - protein, 11 aa, Plasmodium falciparum
PENGTADTHGN

SEQ ID NO: 3242445 - protein, 5 aa, Plasmodium falciparum
PENRE

SEQ ID NO: 3242446 - protein, 10 aa, Plasmodium falciparum
PENTESTTDL

SEQ ID NO: 3242447 - protein, 6 aa, Plasmodium falciparum
PEPSLR

SEQ ID NO: 3242448 - protein, 6 aa, Plasmodium falciparum
PEQANP

SEQ ID NO: 3242449 - protein, 7 aa, Plasmodium falciparum
PEQARKK

SEQ ID NO: 3242450 - protein, 13 aa, Plasmodium falciparum
PEQCKGQKNLKEL

SEQ ID NO: 3242451 - protein, 18 aa, Plasmodium falciparum
PEQEDEHVKEAQKDYTSQ

SEQ ID NO: 3242452 - protein, 8 aa, Plasmodium falciparum
PEQITSTD

SEQ ID NO: 3242453 - protein, 6 aa, Plasmodium falciparum
PEQKTS

SEQ ID NO: 3242454 - protein, 8 aa, Plasmodium falciparum
PESEELEP

SEQ ID NO: 3242455 - protein, 7 aa, Plasmodium falciparum
PESGNNS

SEQ ID NO: 3242456 - protein, 7 aa, Plasmodium falciparum
PESKSFP

SEQ ID NO: 3242457 - protein, 10 aa, Plasmodium falciparum
PESNIEKAQT

SEQ ID NO: 3242458 - protein, 5 aa, Plasmodium falciparum
PESTS

SEQ ID NO: 3242459 - protein, 9 aa, Plasmodium falciparum
PESVESEYS

SEQ ID NO: 3242460 - protein, 7 aa, Plasmodium falciparum
PETATSG

SEQ ID NO: 3242461 - protein, 4 aa, Plasmodium falciparum
PETK

SEQ ID NO: 3242462 - protein, 4 aa, Plasmodium falciparum
PETN

SEQ ID NO: 3242463 - protein, 7 aa, Plasmodium falciparum
PETTNNT

SEQ ID NO: 3242464 - protein, 8 aa, Plasmodium falciparum
PETYSNPN

SEQ ID NO: 3242465 - protein, 8 aa, Plasmodium falciparum
PEVEEKTD

SEQ ID NO: 3242466 - protein, 6 aa, Plasmodium falciparum
PEYSSK

SEQ ID NO: 3242467 - protein, 4 aa, Plasmodium falciparum
PEYV

SEQ ID NO: 3242468 - protein, 10 aa, Plasmodium falciparum
PFDKDTHGYK

SEQ ID NO: 3242469 - protein, 10 aa, Plasmodium falciparum
PFEGKNTPKV

SEQ ID NO: 3242470 - protein, 5 aa, Plasmodium falciparum
PFEKQ

SEQ ID NO: 3242471 - protein, 4 aa, Plasmodium falciparum
PFEN

SEQ ID NO: 3242472 - protein, 4 aa, Plasmodium falciparum
PFEP

SEQ ID NO: 3242473 - protein, 15 aa, Plasmodium falciparum
PFGGDNYNQELEENI

SEQ ID NO: 3242474 - protein, 21 aa, Plasmodium falciparum
PFGNTTSNINDNNKINKDPFS

SEQ ID NO: 3242475 - protein, 13 aa, Plasmodium falciparum
PFHNNTDNKNQGV

SEQ ID NO: 3242476 - protein, 19 aa, Plasmodium falciparum
PFKEQNKKHLENDNNDDNN

SEQ ID NO: 3242477 - protein, 5 aa, Plasmodium falciparum
PFNEP

SEQ ID NO: 3242478 - protein, 5 aa, Plasmodium falciparum
PFNKT

SEQ ID NO: 3242479 - protein, 77 aa, Plasmodium falciparum
PFNRNDEYGDEYGDEYGDEYGNKYGNKYGNKYDDKYGNKYDDKYDDKYDDKYDDKYDDKYDDKYDDKYDDKYDDKYD

SEQ ID NO: 3242480 - protein, 14 aa, Plasmodium falciparum
PFPTKKNNTNNVNT

SEQ ID NO: 3242481 - protein, 12 aa, Plasmodium falciparum
PFQNNDYSSNIE

SEQ ID NO: 3242482 - protein, 4 aa, Plasmodium falciparum
PFSN

SEQ ID NO: 3242483 - protein, 9 aa, Plasmodium falciparum
PFSSKNENL

SEQ ID NO: 3242484 - protein, 12 aa, Plasmodium falciparum
PFTEGEETESLT

SEQ ID NO: 3242485 - protein, 10 aa, Plasmodium falciparum
PFTGKNANEL

SEQ ID NO: 3242486 - protein, 5 aa, Plasmodium falciparum
PFTKQ

SEQ ID NO: 3242487 - protein, 5 aa, Plasmodium falciparum
PFYDK

SEQ ID NO: 3242488 - protein, 9 aa, Plasmodium falciparum
PGAKTPPVD

SEQ ID NO: 3242489 - protein, 11 aa, Plasmodium falciparum
PGANQTSTTSN

SEQ ID NO: 3242490 - protein, 7 aa, Plasmodium falciparum
PGASPGS

SEQ ID NO: 3242491 - protein, 12 aa, Plasmodium falciparum
PGDIGNKENLTE

SEQ ID NO: 3242492 - protein, 4 aa, Plasmodium falciparum
PGEY

SEQ ID NO: 3242493 - protein, 4 aa, Plasmodium falciparum
PGGA

SEQ ID NO: 3242494 - protein, 15 aa, Plasmodium falciparum
PGGIGKQLGPEHSQR

SEQ ID NO: 3242495 - protein, 6 aa, Plasmodium falciparum
PGGLGP

SEQ ID NO: 3242496 - protein, 4 aa, Plasmodium falciparum
PGGN

SEQ ID NO: 3242497 - protein, 8 aa, Plasmodium falciparum
PGGPPWKD

SEQ ID NO: 3242498 - protein, 12 aa, Plasmodium falciparum
PGHVKKSDLPKD

SEQ ID NO: 3242499 - protein, 4 aa, Plasmodium falciparum
PGIT

SEQ ID NO: 3242500 - protein, 6 aa, Plasmodium falciparum
PGKDEE

SEQ ID NO: 3242501 - protein, 8 aa, Plasmodium falciparum
PGKGGEKQ

SEQ ID NO: 3242502 - protein, 5 aa, Plasmodium falciparum
PGKII

SEQ ID NO: 3242503 - protein, 5 aa, Plasmodium falciparum
PGKSF

SEQ ID NO: 3242504 - protein, 4 aa, Plasmodium falciparum
PGKV

SEQ ID NO: 3242505 - protein, 4 aa, Plasmodium falciparum
PGLT

SEQ ID NO: 3242506 - protein, 6 aa, Plasmodium falciparum
PGLTAD

SEQ ID NO: 3242507 - protein, 5 aa, Plasmodium falciparum
PGNEQ

SEQ ID NO: 3242508 - protein, 4 aa, Plasmodium falciparum
PGNI

SEQ ID NO: 3242509 - protein, 20 aa, Plasmodium falciparum
PGNISNKKNNNNNNNNYNNY

SEQ ID NO: 3242510 - protein, 4 aa, Plasmodium falciparum
PGNN

SEQ ID NO: 3242511 - protein, 10 aa, Plasmodium falciparum
PGNTKKGKVA

SEQ ID NO: 3242512 - protein, 6 aa, Plasmodium falciparum
PGNVNK

SEQ ID NO: 3242513 - protein, 7 aa, Plasmodium falciparum
PGPANSC

SEQ ID NO: 3242514 - protein, 9 aa, Plasmodium falciparum
PGPKTDMEK

SEQ ID NO: 3242515 - protein, 14 aa, Plasmodium falciparum
PGSYDPNDKENMRK

SEQ ID NO: 3242516 - protein, 9 aa, Plasmodium falciparum
PGTCEPPRR

SEQ ID NO: 3242517 - protein, 4 aa, Plasmodium falciparum
PGTE

SEQ ID NO: 3242518 - protein, 8 aa, Plasmodium falciparum
PGTGKTSI

SEQ ID NO: 3242519 - protein, 6 aa, Plasmodium falciparum
PGTKPL

SEQ ID NO: 3242520 - protein, 16 aa, Plasmodium falciparum
PGVEETTNNESHVKGE

SEQ ID NO: 3242521 - protein, 5 aa, Plasmodium falciparum
PGVNE

SEQ ID NO: 3242522 - protein, 11 aa, Plasmodium falciparum
PGVSSKDQPDV

SEQ ID NO: 3242523 - protein, 6 aa, Plasmodium falciparum
PGWSEG

SEQ ID NO: 3242524 - protein, 4 aa, Plasmodium falciparum
PGYR

SEQ ID NO: 3242525 - protein, 4 aa, Plasmodium falciparum
PHDH

SEQ ID NO: 3242526 - protein, 4 aa, Plasmodium falciparum
PHEI

SEQ ID NO: 3242527 - protein, 8 aa, Plasmodium falciparum
PHENENMR

SEQ ID NO: 3242528 - protein, 8 aa, Plasmodium falciparum
PHENNKNE

SEQ ID NO: 3242529 - protein, 8 aa, Plasmodium falciparum
PHETFSPS

SEQ ID NO: 3242530 - protein, 14 aa, Plasmodium falciparum
PHKKVQEKVSDTTF

SEQ ID NO: 3242531 - protein, 5 aa, Plasmodium falciparum
PHKRD

SEQ ID NO: 3242532 - protein, 5 aa, Plasmodium falciparum
PHNEN

SEQ ID NO: 3242533 - protein, 8 aa, Plasmodium falciparum
PHNEQDVN

SEQ ID NO: 3242534 - protein, 7 aa, Plasmodium falciparum
PHNNNNN

SEQ ID NO: 3242535 - protein, 7 aa, Plasmodium falciparum
PHRKKTQ

SEQ ID NO: 3242536 - protein, 8 aa, Plasmodium falciparum
PHTDDTDD

SEQ ID NO: 3242537 - protein, 4 aa, Plasmodium falciparum
PHTQ

SEQ ID NO: 3242538 - protein, 6 aa, Plasmodium falciparum
PHTSRK

SEQ ID NO: 3242539 - protein, 7 aa, Plasmodium falciparum
PHTSRYQ

SEQ ID NO: 3242540 - protein, 12 aa, Plasmodium falciparum
PHTTYDDNSLQN

SEQ ID NO: 3242541 - protein, 36 aa, Plasmodium falciparum
PHVSEKEKQKIQTINNSNNNNNNNNNNNNNNNNISN

SEQ ID NO: 3242542 - protein, 7 aa, Plasmodium falciparum
PIADNAG

SEQ ID NO: 3242543 - protein, 17 aa, Plasmodium falciparum
PIDDNTKRDIHQGEERT

SEQ ID NO: 3242544 - protein, 6 aa, Plasmodium falciparum
PIDEEI

SEQ ID NO: 3242545 - protein, 7 aa, Plasmodium falciparum
PIDNNNN

SEQ ID NO: 3242546 - protein, 18 aa, Plasmodium falciparum
PIDSNEYDKNISSKDQNA

SEQ ID NO: 3242547 - protein, 5 aa, Plasmodium falciparum
PIEDK

SEQ ID NO: 3242548 - protein, 11 aa, Plasmodium falciparum
PIEERGDTEDM

SEQ ID NO: 3242549 - protein, 10 aa, Plasmodium falciparum
PIEGAQKEGF

SEQ ID NO: 3242550 - protein, 7 aa, Plasmodium falciparum
PIHDSNK

SEQ ID NO: 3242551 - protein, 5 aa, Plasmodium falciparum
PIHNR

SEQ ID NO: 3242552 - protein, 8 aa, Plasmodium falciparum
PIKKRNGG

SEQ ID NO: 3242553 - protein, 13 aa, Plasmodium falciparum
PILSTQENKTREH

SEQ ID NO: 3242554 - protein, 7 aa, Plasmodium falciparum
PINDSTY

SEQ ID NO: 3242555 - protein, 4 aa, Plasmodium falciparum
PINE

SEQ ID NO: 3242556 - protein, 19 aa, Plasmodium falciparum
PINESNIKEKKKYKNNKKK

SEQ ID NO: 3242557 - protein, 10 aa, Plasmodium falciparum
PINKNSLKTD

SEQ ID NO: 3242558 - protein, 5 aa, Plasmodium falciparum
PINNE

SEQ ID NO: 3242559 - protein, 22 aa, Plasmodium falciparum
PINNNKNNDYLSPHDKKDQIKE

SEQ ID NO: 3242560 - protein, 12 aa, Plasmodium falciparum
PINNNNKKNIKK

SEQ ID NO: 3242561 - protein, 8 aa, Plasmodium falciparum
PINNNNNY

SEQ ID NO: 3242562 - protein, 8 aa, Plasmodium falciparum
PINNPPSQ

SEQ ID NO: 3242563 - protein, 95 aa, Plasmodium falciparum
PINNTNQNINGSPINTTTTNNNNNNENNNNNENNNNNENNNNNENNNNNENNNNNENNNNNENNNNNENNNNNENNNNNENNNNNENNNNNNHHN

SEQ ID NO: 3242564 - protein, 15 aa, Plasmodium falciparum
PINPPGKKKKKKEKC

SEQ ID NO: 3242565 - protein, 4 aa, Plasmodium falciparum
PINQ

SEQ ID NO: 3242566 - protein, 4 aa, Plasmodium falciparum
PINY

SEQ ID NO: 3242567 - protein, 6 aa, Plasmodium falciparum
PIQENS

SEQ ID NO: 3242568 - protein, 4 aa, Plasmodium falciparum
PIQK

SEQ ID NO: 3242569 - protein, 8 aa, Plasmodium falciparum
PIQQKDQE

SEQ ID NO: 3242570 - protein, 4 aa, Plasmodium falciparum
PISG

SEQ ID NO: 3242571 - protein, 13 aa, Plasmodium falciparum
PISNENGYDNNSN

SEQ ID NO: 3242572 - protein, 5 aa, Plasmodium falciparum
PISPF

SEQ ID NO: 3242573 - protein, 5 aa, Plasmodium falciparum
PISQQ

SEQ ID NO: 3242574 - protein, 12 aa, Plasmodium falciparum
PISSQNNNRSNN

SEQ ID NO: 3242575 - protein, 4 aa, Plasmodium falciparum
PITS

SEQ ID NO: 3242576 - protein, 12 aa, Plasmodium falciparum
PIYSSGYSRGSS

SEQ ID NO: 3242577 - protein, 9 aa, Plasmodium falciparum
PKAGSAPRI

SEQ ID NO: 3242578 - protein, 5 aa, Plasmodium falciparum
PKDEE

SEQ ID NO: 3242579 - protein, 10 aa, Plasmodium falciparum
PKDGNNNNNN

SEQ ID NO: 3242580 - protein, 7 aa, Plasmodium falciparum
PKDGVVG

SEQ ID NO: 3242581 - protein, 7 aa, Plasmodium falciparum
PKDKKKK

SEQ ID NO: 3242582 - protein, 23 aa, Plasmodium falciparum
PKDMKGSEEDPRNPQEEEHKRDE

SEQ ID NO: 3242583 - protein, 15 aa, Plasmodium falciparum
PKDNHTTNNNMNNTN

SEQ ID NO: 3242584 - protein, 10 aa, Plasmodium falciparum
PKDSEQNSSA

SEQ ID NO: 3242585 - protein, 65 aa, Plasmodium falciparum
PKEEAKEEGGCTPDIKKEEEKKEEKKKPEQTAEKPAAETKAKEEKPAQDEAGPPPADPLPAREPF

SEQ ID NO: 3242586 - protein, 7 aa, Plasmodium falciparum
PKEEEIK

SEQ ID NO: 3242587 - protein, 327 aa, Plasmodium falciparum
PKEEKKEPIPKKGKSVEPKKEKQAGVKKEKVPETKKEKAPAPKKEKVQAPKKEKVPAPKKEKPAVPKKEKVPEPKKEKVPEPKKEKAPAPKKEKVQAPKKEKAPAPKKEKAPAPKKEKAPAPKKEKAPAPKKEKPAVPKKEKPAVPKKEKVPETKKEKVPETKKEKVPETKKEKVPVPKKEKVPAPKKEKVPAPKKEKVPAPKKEKPAVPKKEKVPETKKEKAPEPKKEKAPEPKKEKAPEPKKEKAPEPKKEKAPAPKKEKVPVPKKEKVPAPKKEKVPAPKKEKPAVPKKEKVPETKKEKEKDSQPKKEKAKETSRPPKKEKEKG

SEQ ID NO: 3242588 - protein, 8 aa, Plasmodium falciparum
PKEEKKIS

SEQ ID NO: 3242589 - protein, 6 aa, Plasmodium falciparum
PKEEYE

SEQ ID NO: 3242590 - protein, 7 aa, Plasmodium falciparum
PKEGLNS

SEQ ID NO: 3242591 - protein, 17 aa, Plasmodium falciparum
PKEGNRETVRGEKNDDK

SEQ ID NO: 3242592 - protein, 4 aa, Plasmodium falciparum
PKEH

SEQ ID NO: 3242593 - protein, 11 aa, Plasmodium falciparum
PKEKDDKVDNK

SEQ ID NO: 3242594 - protein, 6 aa, Plasmodium falciparum
PKEKEN

SEQ ID NO: 3242595 - protein, 23 aa, Plasmodium falciparum
PKEKNKIKNKIKKKQKKNSNTIN

SEQ ID NO: 3242596 - protein, 7 aa, Plasmodium falciparum
PKELPQE

SEQ ID NO: 3242597 - protein, 15 aa, Plasmodium falciparum
PKELSNDLKEKGNKK

SEQ ID NO: 3242598 - protein, 5 aa, Plasmodium falciparum
PKELT

SEQ ID NO: 3242599 - protein, 4 aa, Plasmodium falciparum
PKEN

SEQ ID NO: 3242600 - protein, 5 aa, Plasmodium falciparum
PKENE

SEQ ID NO: 3242601 - protein, 15 aa, Plasmodium falciparum
PKENQNKTEEKTKIE

SEQ ID NO: 3242602 - protein, 4 aa, Plasmodium falciparum
PKEP

SEQ ID NO: 3242603 - protein, 4 aa, Plasmodium falciparum
PKEQ

SEQ ID NO: 3242604 - protein, 19 aa, Plasmodium falciparum
PKEVSTKISEEENSDDDMN

SEQ ID NO: 3242605 - protein, 8 aa, Plasmodium falciparum
PKEYTQNE

SEQ ID NO: 3242606 - protein, 8 aa, Plasmodium falciparum
PKGENKLK

SEQ ID NO: 3242607 - protein, 9 aa, Plasmodium falciparum
PKGIKKSDT

SEQ ID NO: 3242608 - protein, 19 aa, Plasmodium falciparum
PKGIYDDDDDNNNNNNNNS

SEQ ID NO: 3242609 - protein, 6 aa, Plasmodium falciparum
PKGKDI

SEQ ID NO: 3242610 - protein, 5 aa, Plasmodium falciparum
PKGKE

SEQ ID NO: 3242611 - protein, 7 aa, Plasmodium falciparum
PKGPDNY

SEQ ID NO: 3242612 - protein, 6 aa, Plasmodium falciparum
PKGRTA

SEQ ID NO: 3242613 - protein, 7 aa, Plasmodium falciparum
PKHDNEF

SEQ ID NO: 3242614 - protein, 7 aa, Plasmodium falciparum
PKHKNME

SEQ ID NO: 3242615 - protein, 14 aa, Plasmodium falciparum
PKHQEKYKDTGTAS

SEQ ID NO: 3242616 - protein, 58 aa, Plasmodium falciparum
PKIDDDNEKNNHENNSHNDNHNNSHNDNHNNSHNDNHNNSHNDNHNDNHNNNHNDNHN

SEQ ID NO: 3242617 - protein, 8 aa, Plasmodium falciparum
PKIDKEKE

SEQ ID NO: 3242618 - protein, 8 aa, Plasmodium falciparum
PKIDTTPR

SEQ ID NO: 3242619 - protein, 13 aa, Plasmodium falciparum
PKIEKENMKEDEQ

SEQ ID NO: 3242620 - protein, 5 aa, Plasmodium falciparum
PKIGG

SEQ ID NO: 3242621 - protein, 4 aa, Plasmodium falciparum
PKII

SEQ ID NO: 3242622 - protein, 4 aa, Plasmodium falciparum
PKIP

SEQ ID NO: 3242623 - protein, 6 aa, Plasmodium falciparum
PKISPD

SEQ ID NO: 3242624 - protein, 4 aa, Plasmodium falciparum
PKIT

SEQ ID NO: 3242625 - protein, 8 aa, Plasmodium falciparum
PKKDAEGT

SEQ ID NO: 3242626 - protein, 6 aa, Plasmodium falciparum
PKKENA

SEQ ID NO: 3242627 - protein, 10 aa, Plasmodium falciparum
PKKENAKDQV

SEQ ID NO: 3242628 - protein, 9 aa, Plasmodium falciparum
PKKGATSTE

SEQ ID NO: 3242629 - protein, 18 aa, Plasmodium falciparum
PKKHESEKKTADEPAEFQ

SEQ ID NO: 3242630 - protein, 9 aa, Plasmodium falciparum
PKKKEEELK

SEQ ID NO: 3242631 - protein, 5 aa, Plasmodium falciparum
PKKKH

SEQ ID NO: 3242632 - protein, 5 aa, Plasmodium falciparum
PKKKK

SEQ ID NO: 3242633 - protein, 9 aa, Plasmodium falciparum
PKKKNKDEF

SEQ ID NO: 3242634 - protein, 14 aa, Plasmodium falciparum
PKKKTSTQNEEQHN

SEQ ID NO: 3242635 - protein, 7 aa, Plasmodium falciparum
PKKNIYN

SEQ ID NO: 3242636 - protein, 10 aa, Plasmodium falciparum
PKKNNKEEEN

SEQ ID NO: 3242637 - protein, 4 aa, Plasmodium falciparum
PKKP

SEQ ID NO: 3242638 - protein, 9 aa, Plasmodium falciparum
PKKPEEGTK

SEQ ID NO: 3242639 - protein, 4 aa, Plasmodium falciparum
PKKS

SEQ ID NO: 3242640 - protein, 8 aa, Plasmodium falciparum
PKKSEIGR

SEQ ID NO: 3242641 - protein, 11 aa, Plasmodium falciparum
PKKSKMTKNDN

SEQ ID NO: 3242642 - protein, 8 aa, Plasmodium falciparum
PKKSSPET

SEQ ID NO: 3242643 - protein, 5 aa, Plasmodium falciparum
PKKTE

SEQ ID NO: 3242644 - protein, 8 aa, Plasmodium falciparum
PKKTVEGY

SEQ ID NO: 3242645 - protein, 8 aa, Plasmodium falciparum
PKKVDTSC

SEQ ID NO: 3242646 - protein, 7 aa, Plasmodium falciparum
PKKYNEK

SEQ ID NO: 3242647 - protein, 12 aa, Plasmodium falciparum
PKLTAEKRKTGI

SEQ ID NO: 3242648 - protein, 5 aa, Plasmodium falciparum
PKMGN

SEQ ID NO: 3242649 - protein, 4 aa, Plasmodium falciparum
PKMN

SEQ ID NO: 3242650 - protein, 15 aa, Plasmodium falciparum
PKNDNTCNTYEEPDE

SEQ ID NO: 3242651 - protein, 8 aa, Plasmodium falciparum
PKNEKAKL

SEQ ID NO: 3242652 - protein, 11 aa, Plasmodium falciparum
PKNGNGKNEGT

SEQ ID NO: 3242653 - protein, 16 aa, Plasmodium falciparum
PKNGTPSPAKKNTPTE

SEQ ID NO: 3242654 - protein, 17 aa, Plasmodium falciparum
PKNGTSPGSSSGNDPES

SEQ ID NO: 3242655 - protein, 27 aa, Plasmodium falciparum
PKNHEESNANMNNHNSFNDKSVNKKEA

SEQ ID NO: 3242656 - protein, 6 aa, Plasmodium falciparum
PKNINT

SEQ ID NO: 3242657 - protein, 7 aa, Plasmodium falciparum
PKNKDAN

SEQ ID NO: 3242658 - protein, 7 aa, Plasmodium falciparum
PKNKEVQ

SEQ ID NO: 3242659 - protein, 12 aa, Plasmodium falciparum
PKNKKNKNKNKI

SEQ ID NO: 3242660 - protein, 10 aa, Plasmodium falciparum
PKNKKSSNSE

SEQ ID NO: 3242661 - protein, 5 aa, Plasmodium falciparum
PKNNE

SEQ ID NO: 3242662 - protein, 9 aa, Plasmodium falciparum
PKNNGKTTT

SEQ ID NO: 3242663 - protein, 7 aa, Plasmodium falciparum
PKNNGYA

SEQ ID NO: 3242664 - protein, 8 aa, Plasmodium falciparum
PKNPKPEI

SEQ ID NO: 3242665 - protein, 10 aa, Plasmodium falciparum
PKNQNSDQIT

SEQ ID NO: 3242666 - protein, 11 aa, Plasmodium falciparum
PKNSNDEAIRG

SEQ ID NO: 3242667 - protein, 6 aa, Plasmodium falciparum
PKNTEH

SEQ ID NO: 3242668 - protein, 4 aa, Plasmodium falciparum
PKNV

SEQ ID NO: 3242669 - protein, 12 aa, Plasmodium falciparum
PKNVKGEKGNGN

SEQ ID NO: 3242670 - protein, 5 aa, Plasmodium falciparum
PKNVN

SEQ ID NO: 3242671 - protein, 17 aa, Plasmodium falciparum
PKNVNGETFEGQANGKN

SEQ ID NO: 3242672 - protein, 5 aa, Plasmodium falciparum
PKNVQ

SEQ ID NO: 3242673 - protein, 7 aa, Plasmodium falciparum
PKNYSSS

SEQ ID NO: 3242674 - protein, 57 aa, Plasmodium falciparum
PKPPEPKAEEKGACDPAPTTPKETASPADSGEGTKEHPSPPPTPDPAAPTSPPLPPL

SEQ ID NO: 3242675 - protein, 20 aa, Plasmodium falciparum
PKPPKLPKRQPKERDFPTPA

SEQ ID NO: 3242676 - protein, 58 aa, Plasmodium falciparum
PKPPPQPGDEDGCKQASPAPSEGTENQPPVIKPEEEAPAPRTPRPRPKPPQEPQPYLP

SEQ ID NO: 3242677 - protein, 48 aa, Plasmodium falciparum
PKPTCTTNTAETEKKKEEENDQLPAPKEQTDPGSDTPPPLPTPSKPDE

SEQ ID NO: 3242678 - protein, 24 aa, Plasmodium falciparum
PKPYPNEEAARYANGGASPPDLSS

SEQ ID NO: 3242679 - protein, 6 aa, Plasmodium falciparum
PKQNVT

SEQ ID NO: 3242680 - protein, 4 aa, Plasmodium falciparum
PKQT

SEQ ID NO: 3242681 - protein, 4 aa, Plasmodium falciparum
PKRL

SEQ ID NO: 3242682 - protein, 5 aa, Plasmodium falciparum
PKRST

SEQ ID NO: 3242683 - protein, 6 aa, Plasmodium falciparum
PKSCSS

SEQ ID NO: 3242684 - protein, 9 aa, Plasmodium falciparum
PKSDEDYPD

SEQ ID NO: 3242685 - protein, 4 aa, Plasmodium falciparum
PKSG

SEQ ID NO: 3242686 - protein, 10 aa, Plasmodium falciparum
PKSKKNNRTQ

SEQ ID NO: 3242687 - protein, 7 aa, Plasmodium falciparum
PKSKKVN

SEQ ID NO: 3242688 - protein, 6 aa, Plasmodium falciparum
PKSNKG

SEQ ID NO: 3242689 - protein, 8 aa, Plasmodium falciparum
PKSQRNEP

SEQ ID NO: 3242690 - protein, 5 aa, Plasmodium falciparum
PKSSL

SEQ ID NO: 3242691 - protein, 7 aa, Plasmodium falciparum
PKSSSKE

SEQ ID NO: 3242692 - protein, 4 aa, Plasmodium falciparum
PKST

SEQ ID NO: 3242693 - protein, 8 aa, Plasmodium falciparum
PKSTKTKF

SEQ ID NO: 3242694 - protein, 6 aa, Plasmodium falciparum
PKSTQV

SEQ ID NO: 3242695 - protein, 9 aa, Plasmodium falciparum
PKSTSLEGS

SEQ ID NO: 3242696 - protein, 7 aa, Plasmodium falciparum
PKSVPLT

SEQ ID NO: 3242697 - protein, 7 aa, Plasmodium falciparum
PKSYTGE

SEQ ID NO: 3242698 - protein, 10 aa, Plasmodium falciparum
PKTKQTKTHR

SEQ ID NO: 3242699 - protein, 26 aa, Plasmodium falciparum
PKTNGDTTNGVHGSGDCGGTNSDPSL

SEQ ID NO: 3242700 - protein, 8 aa, Plasmodium falciparum
PKTNIKNE

SEQ ID NO: 3242701 - protein, 6 aa, Plasmodium falciparum
PKTNPL

SEQ ID NO: 3242702 - protein, 4 aa, Plasmodium falciparum
PKTT

SEQ ID NO: 3242703 - protein, 11 aa, Plasmodium falciparum
PKTVKGYENDF

SEQ ID NO: 3242704 - protein, 12 aa, Plasmodium falciparum
PKVDSRGNKYEC

SEQ ID NO: 3242705 - protein, 13 aa, Plasmodium falciparum
PKVQGNSQLCEDS

SEQ ID NO: 3242706 - protein, 8 aa, Plasmodium falciparum
PKVRQQSA

SEQ ID NO: 3242707 - protein, 15 aa, Plasmodium falciparum
PKYDAEYSSGSGSDF

SEQ ID NO: 3242708 - protein, 7 aa, Plasmodium falciparum
PKYENDS

SEQ ID NO: 3242709 - protein, 10 aa, Plasmodium falciparum
PLAKPPGNMN

SEQ ID NO: 3242710 - protein, 5 aa, Plasmodium falciparum
PLDNK

SEQ ID NO: 3242711 - protein, 4 aa, Plasmodium falciparum
PLEA

SEQ ID NO: 3242712 - protein, 9 aa, Plasmodium falciparum
PLEENNNED

SEQ ID NO: 3242713 - protein, 7 aa, Plasmodium falciparum
PLENPSL

SEQ ID NO: 3242714 - protein, 4 aa, Plasmodium falciparum
PLEP

SEQ ID NO: 3242715 - protein, 11 aa, Plasmodium falciparum
PLFNEGKKKEN

SEQ ID NO: 3242716 - protein, 15 aa, Plasmodium falciparum
PLGGTSTLPTSSTNL

SEQ ID NO: 3242717 - protein, 10 aa, Plasmodium falciparum
PLINDDNNTK

SEQ ID NO: 3242718 - protein, 11 aa, Plasmodium falciparum
PLKGKRKHGGI

SEQ ID NO: 3242719 - protein, 20 aa, Plasmodium falciparum
PLLDSTDNENITKTSNRQIN

SEQ ID NO: 3242720 - protein, 14 aa, Plasmodium falciparum
PLNAKYKNEPNEHS

SEQ ID NO: 3242721 - protein, 11 aa, Plasmodium falciparum
PLNDEKEKKYI

SEQ ID NO: 3242722 - protein, 13 aa, Plasmodium falciparum
PLNEQNNNKEFSN

SEQ ID NO: 3242723 - protein, 12 aa, Plasmodium falciparum
PLNNNNNNKNEI

SEQ ID NO: 3242724 - protein, 12 aa, Plasmodium falciparum
PLNPGNSGGPAL

SEQ ID NO: 3242725 - protein, 38 aa, Plasmodium falciparum
PLNPYGSSKRNSSEDKPTSESKGTTPESNFDSKTPEIK

SEQ ID NO: 3242726 - protein, 12 aa, Plasmodium falciparum
PLPNDNNNNKQL

SEQ ID NO: 3242727 - protein, 5 aa, Plasmodium falciparum
PLPNY

SEQ ID NO: 3242728 - protein, 5 aa, Plasmodium falciparum
PLPRE

SEQ ID NO: 3242729 - protein, 5 aa, Plasmodium falciparum
PLPTE

SEQ ID NO: 3242730 - protein, 4 aa, Plasmodium falciparum
PLQD

SEQ ID NO: 3242731 - protein, 4 aa, Plasmodium falciparum
PLQT

SEQ ID NO: 3242732 - protein, 6 aa, Plasmodium falciparum
PLQTNN

SEQ ID NO: 3242733 - protein, 13 aa, Plasmodium falciparum
PLQYTSPPKEARN

SEQ ID NO: 3242734 - protein, 12 aa, Plasmodium falciparum
PLSNDNKKKKNN

SEQ ID NO: 3242735 - protein, 6 aa, Plasmodium falciparum
PLSNKK

SEQ ID NO: 3242736 - protein, 9 aa, Plasmodium falciparum
PLSSDNTSS

SEQ ID NO: 3242737 - protein, 10 aa, Plasmodium falciparum
PLSSQENDDI

SEQ ID NO: 3242738 - protein, 5 aa, Plasmodium falciparum
PLTDE

SEQ ID NO: 3242739 - protein, 19 aa, Plasmodium falciparum
PLTSNPSPTPPSPLPQSLG

SEQ ID NO: 3242740 - protein, 14 aa, Plasmodium falciparum
PMDEEEKKKNYDKL

SEQ ID NO: 3242741 - protein, 55 aa, Plasmodium falciparum
PMEQRREEDRGHMGGRGSRYPEEERYNYNNKRSNSIPEGRNYEENAYERGGGNNK

SEQ ID NO: 3242742 - protein, 4 aa, Plasmodium falciparum
PMST

SEQ ID NO: 3242743 - protein, 7 aa, Plasmodium falciparum
PMSTTEK

SEQ ID NO: 3242744 - protein, 12 aa, Plasmodium falciparum
PNATKQEIQTAY

SEQ ID NO: 3242745 - protein, 5 aa, Plasmodium falciparum
PNDAH

SEQ ID NO: 3242746 - protein, 7 aa, Plasmodium falciparum
PNDCNNN

SEQ ID NO: 3242747 - protein, 6 aa, Plasmodium falciparum
PNDDIE

SEQ ID NO: 3242748 - protein, 9 aa, Plasmodium falciparum
PNDDNKQNK

SEQ ID NO: 3242749 - protein, 9 aa, Plasmodium falciparum
PNDENQNMQ

SEQ ID NO: 3242750 - protein, 16 aa, Plasmodium falciparum
PNDGITNDTIQNNNDI

SEQ ID NO: 3242751 - protein, 19 aa, Plasmodium falciparum
PNDHDNNNNNTNNTNNMSK

SEQ ID NO: 3242752 - protein, 8 aa, Plasmodium falciparum
PNDHQTKC

SEQ ID NO: 3242753 - protein, 10 aa, Plasmodium falciparum
PNDKDDDEKI

SEQ ID NO: 3242754 - protein, 7 aa, Plasmodium falciparum
PNDKEWK

SEQ ID NO: 3242755 - protein, 10 aa, Plasmodium falciparum
PNDKNKKELQ

SEQ ID NO: 3242756 - protein, 5 aa, Plasmodium falciparum
PNDLN

SEQ ID NO: 3242757 - protein, 10 aa, Plasmodium falciparum
PNDNEKNSDK

SEQ ID NO: 3242758 - protein, 5 aa, Plasmodium falciparum
PNDNV

SEQ ID NO: 3242759 - protein, 7 aa, Plasmodium falciparum
PNDQDEV

SEQ ID NO: 3242760 - protein, 11 aa, Plasmodium falciparum
PNDQKDGEPTY

SEQ ID NO: 3242761 - protein, 6 aa, Plasmodium falciparum
PNDYAS

SEQ ID NO: 3242762 - protein, 5 aa, Plasmodium falciparum
PNDYL

SEQ ID NO: 3242763 - protein, 5 aa, Plasmodium falciparum
PNEEE

SEQ ID NO: 3242764 - protein, 10 aa, Plasmodium falciparum
PNEEEEKKKN

SEQ ID NO: 3242765 - protein, 9 aa, Plasmodium falciparum
PNEEKKKNL

SEQ ID NO: 3242766 - protein, 11 aa, Plasmodium falciparum
PNEKSSDKNKN

SEQ ID NO: 3242767 - protein, 5 aa, Plasmodium falciparum
PNEKT

SEQ ID NO: 3242768 - protein, 5 aa, Plasmodium falciparum
PNENY

SEQ ID NO: 3242769 - protein, 4 aa, Plasmodium falciparum
PNEQ

SEQ ID NO: 3242770 - protein, 6 aa, Plasmodium falciparum
PNERKI

SEQ ID NO: 3242771 - protein, 8 aa, Plasmodium falciparum
PNETISQR

SEQ ID NO: 3242772 - protein, 7 aa, Plasmodium falciparum
PNETQES

SEQ ID NO: 3242773 - protein, 9 aa, Plasmodium falciparum
PNEYAKPTN

SEQ ID NO: 3242774 - protein, 8 aa, Plasmodium falciparum
PNFENKNY

SEQ ID NO: 3242775 - protein, 13 aa, Plasmodium falciparum
PNFERNKKKQNDI

SEQ ID NO: 3242776 - protein, 14 aa, Plasmodium falciparum
PNFTTNNPKTKLAQ

SEQ ID NO: 3242777 - protein, 4 aa, Plasmodium falciparum
PNGL

SEQ ID NO: 3242778 - protein, 5 aa, Plasmodium falciparum
PNGLN

SEQ ID NO: 3242779 - protein, 4 aa, Plasmodium falciparum
PNGS

SEQ ID NO: 3242780 - protein, 6 aa, Plasmodium falciparum
PNGSFS

SEQ ID NO: 3242781 - protein, 7 aa, Plasmodium falciparum
PNHITDK

SEQ ID NO: 3242782 - protein, 5 aa, Plasmodium falciparum
PNHKS

SEQ ID NO: 3242783 - protein, 5 aa, Plasmodium falciparum
PNIAT

SEQ ID NO: 3242784 - protein, 4 aa, Plasmodium falciparum
PNIE

SEQ ID NO: 3242785 - protein, 12 aa, Plasmodium falciparum
PNIGKNPNTPPE

SEQ ID NO: 3242786 - protein, 4 aa, Plasmodium falciparum
PNIK

SEQ ID NO: 3242787 - protein, 4 aa, Plasmodium falciparum
PNIN

SEQ ID NO: 3242788 - protein, 23 aa, Plasmodium falciparum
PNINNNNNNNNNNDNFNNNNNTY

SEQ ID NO: 3242789 - protein, 14 aa, Plasmodium falciparum
PNINQDSDDYENDS

SEQ ID NO: 3242790 - protein, 10 aa, Plasmodium falciparum
PNIPSNGNVL

SEQ ID NO: 3242791 - protein, 8 aa, Plasmodium falciparum
PNITKEDL

SEQ ID NO: 3242792 - protein, 18 aa, Plasmodium falciparum
PNKCSSEKKTNNPNSSSI

SEQ ID NO: 3242793 - protein, 7 aa, Plasmodium falciparum
PNKEDDK

SEQ ID NO: 3242794 - protein, 6 aa, Plasmodium falciparum
PNKEID

SEQ ID NO: 3242795 - protein, 23 aa, Plasmodium falciparum
PNKGTNKGGDFHDKKKKKNYYNA

SEQ ID NO: 3242796 - protein, 17 aa, Plasmodium falciparum
PNKKKEDDEEENDTSSY

SEQ ID NO: 3242797 - protein, 19 aa, Plasmodium falciparum
PNKKNKKKIIDKSKSNDYH

SEQ ID NO: 3242798 - protein, 5 aa, Plasmodium falciparum
PNKNF

SEQ ID NO: 3242799 - protein, 19 aa, Plasmodium falciparum
PNKNNANNFRNDKKNADEE

SEQ ID NO: 3242800 - protein, 5 aa, Plasmodium falciparum
PNKNS

SEQ ID NO: 3242801 - protein, 9 aa, Plasmodium falciparum
PNKPNESQS

SEQ ID NO: 3242802 - protein, 4 aa, Plasmodium falciparum
PNKR

SEQ ID NO: 3242803 - protein, 17 aa, Plasmodium falciparum
PNKSKQKVNDMDSPKKM

SEQ ID NO: 3242804 - protein, 54 aa, Plasmodium falciparum
PNKSNTSNNSQKKVENSSNNKNEKEKNKKNNTNDMNKDEKVEMEDDNNKITEGN

SEQ ID NO: 3242805 - protein, 15 aa, Plasmodium falciparum
PNKTTGDIHDKQNAP

SEQ ID NO: 3242806 - protein, 16 aa, Plasmodium falciparum
PNKYEESINNNNNNND

SEQ ID NO: 3242807 - protein, 22 aa, Plasmodium falciparum
PNKYEQNENTKKMNTYKKRGNQ

SEQ ID NO: 3242808 - protein, 7 aa, Plasmodium falciparum
PNKYNTS

SEQ ID NO: 3242809 - protein, 11 aa, Plasmodium falciparum
PNLEDQQNNFN

SEQ ID NO: 3242810 - protein, 8 aa, Plasmodium falciparum
PNLKDTDK

SEQ ID NO: 3242811 - protein, 11 aa, Plasmodium falciparum
PNLNEGTPYLP

SEQ ID NO: 3242812 - protein, 27 aa, Plasmodium falciparum
PNLNNSQENNNKKNHDNMKKKEKKNHS

SEQ ID NO: 3242813 - protein, 4 aa, Plasmodium falciparum
PNMN

SEQ ID NO: 3242814 - protein, 13 aa, Plasmodium falciparum
PNMNSKDSLKAKN

SEQ ID NO: 3242815 - protein, 14 aa, Plasmodium falciparum
PNMNSKDSLKAKND

SEQ ID NO: 3242816 - protein, 13 aa, Plasmodium falciparum
PNMNSKDSSKAKH

SEQ ID NO: 3242817 - protein, 13 aa, Plasmodium falciparum
PNMNSNDSSKAKH

SEQ ID NO: 3242818 - protein, 4 aa, Plasmodium falciparum
PNND

SEQ ID NO: 3242819 - protein, 6 aa, Plasmodium falciparum
PNNDDE

SEQ ID NO: 3242820 - protein, 12 aa, Plasmodium falciparum
PNNDNNNNNNNN

SEQ ID NO: 3242821 - protein, 9 aa, Plasmodium falciparum
PNNEKGEDT

SEQ ID NO: 3242822 - protein, 5 aa, Plasmodium falciparum
PNNGR

SEQ ID NO: 3242823 - protein, 10 aa, Plasmodium falciparum
PNNINKTNEI

SEQ ID NO: 3242824 - protein, 7 aa, Plasmodium falciparum
PNNINNN

SEQ ID NO: 3242825 - protein, 4 aa, Plasmodium falciparum
PNNK

SEQ ID NO: 3242826 - protein, 6 aa, Plasmodium falciparum
PNNKHD

SEQ ID NO: 3242827 - protein, 5 aa, Plasmodium falciparum
PNNKN

SEQ ID NO: 3242828 - protein, 44 aa, Plasmodium falciparum
PNNNDDNKNNDNNKNNDDDKNNDKNNDDDDDDDNMKKRGPSTEY

SEQ ID NO: 3242829 - protein, 10 aa, Plasmodium falciparum
PNNNKNDKKV

SEQ ID NO: 3242830 - protein, 24 aa, Plasmodium falciparum
PNNNNQDNISSEINTNETNNNKSF

SEQ ID NO: 3242831 - protein, 5 aa, Plasmodium falciparum
PNNNQ

SEQ ID NO: 3242832 - protein, 11 aa, Plasmodium falciparum
PNNNYDNEKEK

SEQ ID NO: 3242833 - protein, 14 aa, Plasmodium falciparum
PNNSAKSANGHSRQ

SEQ ID NO: 3242834 - protein, 5 aa, Plasmodium falciparum
PNNVE

SEQ ID NO: 3242835 - protein, 12 aa, Plasmodium falciparum
PNNYQQKNDEKI

SEQ ID NO: 3242836 - protein, 8 aa, Plasmodium falciparum
PNNYSSGG

SEQ ID NO: 3242837 - protein, 12 aa, Plasmodium falciparum
PNPCGDKDATNV

SEQ ID NO: 3242838 - protein, 4 aa, Plasmodium falciparum
PNPF

SEQ ID NO: 3242839 - protein, 7 aa, Plasmodium falciparum
PNPPLNY

SEQ ID NO: 3242840 - protein, 6 aa, Plasmodium falciparum
PNQQIS

SEQ ID NO: 3242841 - protein, 7 aa, Plasmodium falciparum
PNQQTSV

SEQ ID NO: 3242842 - protein, 4 aa, Plasmodium falciparum
PNQV

SEQ ID NO: 3242843 - protein, 12 aa, Plasmodium falciparum
PNRDDNTYDNNY

SEQ ID NO: 3242844 - protein, 9 aa, Plasmodium falciparum
PNRKQSNLN

SEQ ID NO: 3242845 - protein, 6 aa, Plasmodium falciparum
PNSADS

SEQ ID NO: 3242846 - protein, 22 aa, Plasmodium falciparum
PNSDNKKHSGVPSQTGNTTPQT

SEQ ID NO: 3242847 - protein, 4 aa, Plasmodium falciparum
PNSE

SEQ ID NO: 3242848 - protein, 16 aa, Plasmodium falciparum
PNSMKKGLKSSEKKTT

SEQ ID NO: 3242849 - protein, 6 aa, Plasmodium falciparum
PNSPFR

SEQ ID NO: 3242850 - protein, 4 aa, Plasmodium falciparum
PNSS

SEQ ID NO: 3242851 - protein, 5 aa, Plasmodium falciparum
PNSTE

SEQ ID NO: 3242852 - protein, 28 aa, Plasmodium falciparum
PNTEPNNNYRSGNSPTNTNITTTSRHNM

SEQ ID NO: 3242853 - protein, 10 aa, Plasmodium falciparum
PNTKNDDNYV

SEQ ID NO: 3242854 - protein, 6 aa, Plasmodium falciparum
PNTPKY

SEQ ID NO: 3242855 - protein, 9 aa, Plasmodium falciparum
PNTQNTEPN

SEQ ID NO: 3242856 - protein, 11 aa, Plasmodium falciparum
PNVDEKSSTCE

SEQ ID NO: 3242857 - protein, 12 aa, Plasmodium falciparum
PNVDNSNRNQNY

SEQ ID NO: 3242858 - protein, 5 aa, Plasmodium falciparum
PNVKS

SEQ ID NO: 3242859 - protein, 7 aa, Plasmodium falciparum
PNVNNSV

SEQ ID NO: 3242860 - protein, 7 aa, Plasmodium falciparum
PNVPETL

SEQ ID NO: 3242861 - protein, 17 aa, Plasmodium falciparum
PNVQDQNKCSKDGETKC

SEQ ID NO: 3242862 - protein, 8 aa, Plasmodium falciparum
PNVSPPTY

SEQ ID NO: 3242863 - protein, 4 aa, Plasmodium falciparum
PNYD

SEQ ID NO: 3242864 - protein, 7 aa, Plasmodium falciparum
PNYDDPE

SEQ ID NO: 3242865 - protein, 9 aa, Plasmodium falciparum
PNYDNDPEM

SEQ ID NO: 3242866 - protein, 7 aa, Plasmodium falciparum
PNYDNSE

SEQ ID NO: 3242867 - protein, 13 aa, Plasmodium falciparum
PNYEEGENVQEYR

SEQ ID NO: 3242868 - protein, 4 aa, Plasmodium falciparum
PNYN

SEQ ID NO: 3242869 - protein, 9 aa, Plasmodium falciparum
PNYNNDPEM

SEQ ID NO: 3242870 - protein, 5 aa, Plasmodium falciparum
PPALE

SEQ ID NO: 3242871 - protein, 5 aa, Plasmodium falciparum
PPALP

SEQ ID NO: 3242872 - protein, 6 aa, Plasmodium falciparum
PPCPKP

SEQ ID NO: 3242873 - protein, 14 aa, Plasmodium falciparum
PPCTRDQRKNGDHT

SEQ ID NO: 3242874 - protein, 22 aa, Plasmodium falciparum
PPDDVKDECDCKTSKAHDDKVN

SEQ ID NO: 3242875 - protein, 11 aa, Plasmodium falciparum
PPEEKELNNSK

SEQ ID NO: 3242876 - protein, 8 aa, Plasmodium falciparum
PPENKNKG

SEQ ID NO: 3242877 - protein, 5 aa, Plasmodium falciparum
PPGCG

SEQ ID NO: 3242878 - protein, 7 aa, Plasmodium falciparum
PPGCGKS

SEQ ID NO: 3242879 - protein, 8 aa, Plasmodium falciparum
PPGSGKSS

SEQ ID NO: 3242880 - protein, 77 aa, Plasmodium falciparum
PPGSPSESTPGSPSESTPGSPSESTPGSPSESTPGNPSESTPGSPSESTPGNPSESTPGSPSESTPGSPSESTPCSG

SEQ ID NO: 3242881 - protein, 14 aa, Plasmodium falciparum
PPHGAGYSAPYGVP

SEQ ID NO: 3242882 - protein, 7 aa, Plasmodium falciparum
PPIGSYT

SEQ ID NO: 3242883 - protein, 4 aa, Plasmodium falciparum
PPIK

SEQ ID NO: 3242884 - protein, 5 aa, Plasmodium falciparum
PPKEI

SEQ ID NO: 3242885 - protein, 7 aa, Plasmodium falciparum
PPKGYEK

SEQ ID NO: 3242886 - protein, 5 aa, Plasmodium falciparum
PPKHT

SEQ ID NO: 3242887 - protein, 4 aa, Plasmodium falciparum
PPKI

SEQ ID NO: 3242888 - protein, 7 aa, Plasmodium falciparum
PPKKTQD

SEQ ID NO: 3242889 - protein, 8 aa, Plasmodium falciparum
PPKNGTFP

SEQ ID NO: 3242890 - protein, 7 aa, Plasmodium falciparum
PPKSITG

SEQ ID NO: 3242891 - protein, 8 aa, Plasmodium falciparum
PPLEPNKK

SEQ ID NO: 3242892 - protein, 13 aa, Plasmodium falciparum
PPLPTSNNNTNIR

SEQ ID NO: 3242893 - protein, 5 aa, Plasmodium falciparum
PPMTS

SEQ ID NO: 3242894 - protein, 7 aa, Plasmodium falciparum
PPNDNEM

SEQ ID NO: 3242895 - protein, 5 aa, Plasmodium falciparum
PPNIN

SEQ ID NO: 3242896 - protein, 15 aa, Plasmodium falciparum
PPNKEYIKDENKKFQ

SEQ ID NO: 3242897 - protein, 6 aa, Plasmodium falciparum
PPNLSG

SEQ ID NO: 3242898 - protein, 17 aa, Plasmodium falciparum
PPNSDSCDNKSSNRFNS

SEQ ID NO: 3242899 - protein, 5 aa, Plasmodium falciparum
PPNSF

SEQ ID NO: 3242900 - protein, 4 aa, Plasmodium falciparum
PPPH

SEQ ID NO: 3242901 - protein, 4 aa, Plasmodium falciparum
PPPL

SEQ ID NO: 3242902 - protein, 7 aa, Plasmodium falciparum
PPPLSPS

SEQ ID NO: 3242903 - protein, 20 aa, Plasmodium falciparum
PPPNEKYYNNTKEGTTEGTN

SEQ ID NO: 3242904 - protein, 6 aa, Plasmodium falciparum
PPPSLN

SEQ ID NO: 3242905 - protein, 6 aa, Plasmodium falciparum
PPQLTS

SEQ ID NO: 3242906 - protein, 8 aa, Plasmodium falciparum
PPQQNIQN

SEQ ID NO: 3242907 - protein, 15 aa, Plasmodium falciparum
PPQTPAQQEETDGTC

SEQ ID NO: 3242908 - protein, 11 aa, Plasmodium falciparum
PPRGKGVTENP

SEQ ID NO: 3242909 - protein, 7 aa, Plasmodium falciparum
PPRNGLA

SEQ ID NO: 3242910 - protein, 16 aa, Plasmodium falciparum
PPSDLQEHKDDEISSQ

SEQ ID NO: 3242911 - protein, 11 aa, Plasmodium falciparum
PPSDNYNNTSK

SEQ ID NO: 3242912 - protein, 4 aa, Plasmodium falciparum
PPSL

SEQ ID NO: 3242913 - protein, 4 aa, Plasmodium falciparum
PPSN

SEQ ID NO: 3242914 - protein, 4 aa, Plasmodium falciparum
PPSP

SEQ ID NO: 3242915 - protein, 5 aa, Plasmodium falciparum
PPSSE

SEQ ID NO: 3242916 - protein, 10 aa, Plasmodium falciparum
PPTERTNDTI

SEQ ID NO: 3242917 - protein, 10 aa, Plasmodium falciparum
PPTGNDEDQS

SEQ ID NO: 3242918 - protein, 11 aa, Plasmodium falciparum
PPTQPSPPKEV

SEQ ID NO: 3242919 - protein, 7 aa, Plasmodium falciparum
PPTQTAQ

SEQ ID NO: 3242920 - protein, 21 aa, Plasmodium falciparum
PPVNEPIDDRGKEDALSRGGK

SEQ ID NO: 3242921 - protein, 4 aa, Plasmodium falciparum
PPYE

SEQ ID NO: 3242922 - protein, 7 aa, Plasmodium falciparum
PPYEKGT

SEQ ID NO: 3242923 - protein, 5 aa, Plasmodium falciparum
PPYKS

SEQ ID NO: 3242924 - protein, 39 aa, Plasmodium falciparum
PQAEKDASKLTTTYDQTKEVKPQAEKDALAKTENQSGEL

SEQ ID NO: 3242925 - protein, 7 aa, Plasmodium falciparum
PQCNTKE

SEQ ID NO: 3242926 - protein, 7 aa, Plasmodium falciparum
PQDDDAK

SEQ ID NO: 3242927 - protein, 10 aa, Plasmodium falciparum
PQDNESSEYP

SEQ ID NO: 3242928 - protein, 38 aa, Plasmodium falciparum
PQDSNKRKDATSSPSNVSNKSGEIKSSHKKEQRKDNHM

SEQ ID NO: 3242929 - protein, 11 aa, Plasmodium falciparum
PQEEKKKNKNL

SEQ ID NO: 3242930 - protein, 14 aa, Plasmodium falciparum
PQEESRRRAKETKE

SEQ ID NO: 3242931 - protein, 5 aa, Plasmodium falciparum
PQEKP

SEQ ID NO: 3242932 - protein, 8 aa, Plasmodium falciparum
PQGDVKKK

SEQ ID NO: 3242933 - protein, 24 aa, Plasmodium falciparum
PQGQNKSSNNQDDNNNNNNNLNRR

SEQ ID NO: 3242934 - protein, 13 aa, Plasmodium falciparum
PQHQRTNEDSPSQ

SEQ ID NO: 3242935 - protein, 10 aa, Plasmodium falciparum
PQKKEESNIS

SEQ ID NO: 3242936 - protein, 5 aa, Plasmodium falciparum
PQKNE

SEQ ID NO: 3242937 - protein, 10 aa, Plasmodium falciparum
PQLDSDRTIK

SEQ ID NO: 3242938 - protein, 7 aa, Plasmodium falciparum
PQLGRGS

SEQ ID NO: 3242939 - protein, 11 aa, Plasmodium falciparum
PQNDLPQNNIS

SEQ ID NO: 3242940 - protein, 7 aa, Plasmodium falciparum
PQNEDHN

SEQ ID NO: 3242941 - protein, 17 aa, Plasmodium falciparum
PQNGDKPGKTSGTTPQA

SEQ ID NO: 3242942 - protein, 7 aa, Plasmodium falciparum
PQNKPEP

SEQ ID NO: 3242943 - protein, 5 aa, Plasmodium falciparum
PQNNE

SEQ ID NO: 3242944 - protein, 11 aa, Plasmodium falciparum
PQNPSNRKMGN

SEQ ID NO: 3242945 - protein, 6 aa, Plasmodium falciparum
PQNPTY

SEQ ID NO: 3242946 - protein, 10 aa, Plasmodium falciparum
PQNYDNDPEM

SEQ ID NO: 3242947 - protein, 42 aa, Plasmodium falciparum
PQPEPEPEPFPEEDTEQEEKEEKLPAAPDNSEQEETSKEVVP

SEQ ID NO: 3242948 - protein, 4 aa, Plasmodium falciparum
PQQG

SEQ ID NO: 3242949 - protein, 5 aa, Plasmodium falciparum
PQQNN

SEQ ID NO: 3242950 - protein, 7 aa, Plasmodium falciparum
PQQVTNE

SEQ ID NO: 3242951 - protein, 6 aa, Plasmodium falciparum
PQRDTV

SEQ ID NO: 3242952 - protein, 12 aa, Plasmodium falciparum
PQRKTKKLDPSI

SEQ ID NO: 3242953 - protein, 7 aa, Plasmodium falciparum
PQSDQFE

SEQ ID NO: 3242954 - protein, 10 aa, Plasmodium falciparum
PQSEGFKGKG

SEQ ID NO: 3242955 - protein, 4 aa, Plasmodium falciparum
PQSK

SEQ ID NO: 3242956 - protein, 6 aa, Plasmodium falciparum
PQSLDT

SEQ ID NO: 3242957 - protein, 4 aa, Plasmodium falciparum
PQTD

SEQ ID NO: 3242958 - protein, 14 aa, Plasmodium falciparum
PQTENSEDEENYEK

SEQ ID NO: 3242959 - protein, 23 aa, Plasmodium falciparum
PQVNTNGKNVNSNEKANNLSTEW

SEQ ID NO: 3242960 - protein, 19 aa, Plasmodium falciparum
PQYEQQSKKFTTDKVQPEY

SEQ ID NO: 3242961 - protein, 11 aa, Plasmodium falciparum
PRARQGGEREQ

SEQ ID NO: 3242962 - protein, 4 aa, Plasmodium falciparum
PRDV

SEQ ID NO: 3242963 - protein, 53 aa, Plasmodium falciparum
PRDVPGKPSSKDSGVKDKKKDDGSEEEVVKDDNGDTSKGTSSDGDKDKSVEDT

SEQ ID NO: 3242964 - protein, 6 aa, Plasmodium falciparum
PRERGG

SEQ ID NO: 3242965 - protein, 8 aa, Plasmodium falciparum
PRGDEQQS

SEQ ID NO: 3242966 - protein, 7 aa, Plasmodium falciparum
PRGDIET

SEQ ID NO: 3242967 - protein, 13 aa, Plasmodium falciparum
PRGNMDNNDVNAK

SEQ ID NO: 3242968 - protein, 10 aa, Plasmodium falciparum
PRGNSNDDNY

SEQ ID NO: 3242969 - protein, 6 aa, Plasmodium falciparum
PRHKND

SEQ ID NO: 3242970 - protein, 5 aa, Plasmodium falciparum
PRIPS

SEQ ID NO: 3242971 - protein, 9 aa, Plasmodium falciparum
PRKDNNNNN

SEQ ID NO: 3242972 - protein, 24 aa, Plasmodium falciparum
PRKNRNNKKEEIGKKQKNTHKRNC

SEQ ID NO: 3242973 - protein, 6 aa, Plasmodium falciparum
PRNEEE

SEQ ID NO: 3242974 - protein, 5 aa, Plasmodium falciparum
PRNPN

SEQ ID NO: 3242975 - protein, 5 aa, Plasmodium falciparum
PRNSH

SEQ ID NO: 3242976 - protein, 6 aa, Plasmodium falciparum
PRNSYT

SEQ ID NO: 3242977 - protein, 6 aa, Plasmodium falciparum
PRNTEI

SEQ ID NO: 3242978 - protein, 4 aa, Plasmodium falciparum
PRNY

SEQ ID NO: 3242979 - protein, 6 aa, Plasmodium falciparum
PRPINS

SEQ ID NO: 3242980 - protein, 30 aa, Plasmodium falciparum
PRQDSQTNHYGRYTSRTNNQPRQDNQTNYY

SEQ ID NO: 3242981 - protein, 6 aa, Plasmodium falciparum
PRRRTY

SEQ ID NO: 3242982 - protein, 19 aa, Plasmodium falciparum
PRSGSDDKDPETSLKSGTI

SEQ ID NO: 3242983 - protein, 6 aa, Plasmodium falciparum
PRTKRN

SEQ ID NO: 3242984 - protein, 7 aa, Plasmodium falciparum
PRTPEYY

SEQ ID NO: 3242985 - protein, 9 aa, Plasmodium falciparum
PSAENKEEI

SEQ ID NO: 3242986 - protein, 12 aa, Plasmodium falciparum
PSANQTSTTSSN

SEQ ID NO: 3242987 - protein, 7 aa, Plasmodium falciparum
PSASQKN

SEQ ID NO: 3242988 - protein, 8 aa, Plasmodium falciparum
PSATENNS

SEQ ID NO: 3242989 - protein, 4 aa, Plasmodium falciparum
PSCG

SEQ ID NO: 3242990 - protein, 7 aa, Plasmodium falciparum
PSDEDND

SEQ ID NO: 3242991 - protein, 16 aa, Plasmodium falciparum
PSDIPNSDTPPPITDD

SEQ ID NO: 3242992 - protein, 28 aa, Plasmodium falciparum
PSDIPSGKLSDIPSDNNIPSSNKTLNTD

SEQ ID NO: 3242993 - protein, 7 aa, Plasmodium falciparum
PSDKEED

SEQ ID NO: 3242994 - protein, 12 aa, Plasmodium falciparum
PSDLNRKVTEED

SEQ ID NO: 3242995 - protein, 4 aa, Plasmodium falciparum
PSDN

SEQ ID NO: 3242996 - protein, 4 aa, Plasmodium falciparum
PSDP

SEQ ID NO: 3242997 - protein, 22 aa, Plasmodium falciparum
PSDPEPEPEEDPDTSITSSPPD

SEQ ID NO: 3242998 - protein, 55 aa, Plasmodium falciparum
PSDTTKTTGSETAGSRTTRAADGAEPTRDDGNGDGAGGAPAKSGGSGATTTSSGS

SEQ ID NO: 3242999 - protein, 6 aa, Plasmodium falciparum
PSDVEQ

SEQ ID NO: 3243000 - protein, 10 aa, Plasmodium falciparum
PSDVNGNSLA

SEQ ID NO: 3243001 - protein, 7 aa, Plasmodium falciparum
PSDYDND

SEQ ID NO: 3243002 - protein, 9 aa, Plasmodium falciparum
PSDYTSRDD

SEQ ID NO: 3243003 - protein, 6 aa, Plasmodium falciparum
PSEEAK

SEQ ID NO: 3243004 - protein, 8 aa, Plasmodium falciparum
PSEEKTVN

SEQ ID NO: 3243005 - protein, 10 aa, Plasmodium falciparum
PSEEYKDELE

SEQ ID NO: 3243006 - protein, 16 aa, Plasmodium falciparum
PSEGALNNAETLDNLD

SEQ ID NO: 3243007 - protein, 13 aa, Plasmodium falciparum
PSEISISESAWDS

SEQ ID NO: 3243008 - protein, 6 aa, Plasmodium falciparum
PSEKPT

SEQ ID NO: 3243009 - protein, 8 aa, Plasmodium falciparum
PSEKPTFT

SEQ ID NO: 3243010 - protein, 5 aa, Plasmodium falciparum
PSELK

SEQ ID NO: 3243011 - protein, 4 aa, Plasmodium falciparum
PSEN

SEQ ID NO: 3243012 - protein, 7 aa, Plasmodium falciparum
PSENERG

SEQ ID NO: 3243013 - protein, 6 aa, Plasmodium falciparum
PSEQTY

SEQ ID NO: 3243014 - protein, 5 aa, Plasmodium falciparum
PSESD

SEQ ID NO: 3243015 - protein, 5 aa, Plasmodium falciparum
PSETG

SEQ ID NO: 3243016 - protein, 5 aa, Plasmodium falciparum
PSEVP

SEQ ID NO: 3243017 - protein, 7 aa, Plasmodium falciparum
PSEVRER

SEQ ID NO: 3243018 - protein, 13 aa, Plasmodium falciparum
PSGAVGRRAPLNP

SEQ ID NO: 3243019 - protein, 7 aa, Plasmodium falciparum
PSGDEDE

SEQ ID NO: 3243020 - protein, 16 aa, Plasmodium falciparum
PSGDSTTTGEARARRV

SEQ ID NO: 3243021 - protein, 36 aa, Plasmodium falciparum
PSGKNTTASGKNTPIDTQNDIQSDGIPSSKITDNEW

SEQ ID NO: 3243022 - protein, 36 aa, Plasmodium falciparum
PSGKNTTASGKNTPSDTQNDIQSDGIPSSKITDNEW

SEQ ID NO: 3243023 - protein, 58 aa, Plasmodium falciparum
PSGKNTTASGNNTTASGKNTPSDTQNDIQNDGIPSDTPNTPSDIPKTPSDTPPPITDE

SEQ ID NO: 3243024 - protein, 58 aa, Plasmodium falciparum
PSGKNTTASGNNTTASGNNTTASGNNTTASGKNTTASDTQNDIQNDGIPSSKITDNEW

SEQ ID NO: 3243025 - protein, 66 aa, Plasmodium falciparum
PSGKPSDTGSVPTTRSSGDTTTGGESGAEAKSRHKREAPSGPASTASASVNSGNTATTGKDGATGG

SEQ ID NO: 3243026 - protein, 4 aa, Plasmodium falciparum
PSGN

SEQ ID NO: 3243027 - protein, 26 aa, Plasmodium falciparum
PSGNNTPTSDIPSDIPNSDTPPPITD

SEQ ID NO: 3243028 - protein, 34 aa, Plasmodium falciparum
PSGNNTPTSDTPSDTQNDIPSGDTPNNKLTDNEW

SEQ ID NO: 3243029 - protein, 34 aa, Plasmodium falciparum
PSGNNTTASDTPSDTQNDIQNDGIPSSKITDNEW

SEQ ID NO: 3243030 - protein, 30 aa, Plasmodium falciparum
PSGNNTTASDTQNDIQNDGIPSNKFSDNEW

SEQ ID NO: 3243031 - protein, 32 aa, Plasmodium falciparum
PSGNNTTASGKNTPSDTQNDIPTSDTPPPITD

SEQ ID NO: 3243032 - protein, 33 aa, Plasmodium falciparum
PSGNNTTASGKNTPSDTQNDIPTSDTPPPITDD

SEQ ID NO: 3243033 - protein, 51 aa, Plasmodium falciparum
PSGNNTTASGKNTPSDTQNDIQNDGIPSDTPNTPSDIPKTPSDTPPPITDD

SEQ ID NO: 3243034 - protein, 36 aa, Plasmodium falciparum
PSGNNTTASGKNTPSDTQNDIQSDDIPSSKITDNEW

SEQ ID NO: 3243035 - protein, 36 aa, Plasmodium falciparum
PSGNNTTASGKNTPSDTQNDIQSDGIPSSKITDNEW

SEQ ID NO: 3243036 - protein, 41 aa, Plasmodium falciparum
PSGNNTTASGKNTPTSDTPSDTQNDIQNDGIPSSKITDNEW

SEQ ID NO: 3243037 - protein, 55 aa, Plasmodium falciparum
PSGNNTTASGKNTTASGKTQSGNNTTASGKNTPSDTQNDIQNDGIPSNKFSDNEW

SEQ ID NO: 3243038 - protein, 55 aa, Plasmodium falciparum
PSGNNTTASGKNTTASGKTQSGNNTTASGKNTPSDTQNDIQNDGIPSSDIPHTNK

SEQ ID NO: 3243039 - protein, 36 aa, Plasmodium falciparum
PSGNNTTASGNNTPSDTQNDIQNDGIPSSKITDNEW

SEQ ID NO: 3243040 - protein, 44 aa, Plasmodium falciparum
PSGNNTTASGNNTPTSGKNTTASDTQNDIQSDDTPSSKITDNEW

SEQ ID NO: 3243041 - protein, 37 aa, Plasmodium falciparum
PSGNNTTASGNNTTASDTQNDIQNDGIPSNKFSDNEW

SEQ ID NO: 3243042 - protein, 44 aa, Plasmodium falciparum
PSGNNTTASGNNTTASDTQNDIQNDIPSDIPKTPSDTPPPITDD

SEQ ID NO: 3243043 - protein, 43 aa, Plasmodium falciparum
PSGNNTTASGNNTTASGKNTPSDTQNDIPSGDTPNNKLTDNEW

SEQ ID NO: 3243044 - protein, 41 aa, Plasmodium falciparum
PSGNNTTASGNNTTASGKNTPSDTQNDIQNDGIPSSDTPMN

SEQ ID NO: 3243045 - protein, 38 aa, Plasmodium falciparum
PSGNNTTASGNNTTASGNNTTASDIPSDNTPTPQPITD

SEQ ID NO: 3243046 - protein, 50 aa, Plasmodium falciparum
PSGNNTTASGNNTTASGNNTTASGKNTPSDTQNDIQNDDIPSSKITDNEW

SEQ ID NO: 3243047 - protein, 57 aa, Plasmodium falciparum
PSGNNTTASGNNTTASGNNTTASGNNTTASGKNTPSDTQNDIQSDGIPSSKITDNEW

SEQ ID NO: 3243048 - protein, 73 aa, Plasmodium falciparum
PSGNNTTASGNNTTASGNNTTASGNNTTASGNNTTASDTQNDIQNDGIPSDTPNTPSDIPKTPSDTPPPITDD

SEQ ID NO: 3243049 - protein, 58 aa, Plasmodium falciparum
PSGNNTTASGNNTTASGNNTTASGNNTTASGNNTTASDTQNDIQNDGIPSSKITDNEW

SEQ ID NO: 3243050 - protein, 11 aa, Plasmodium falciparum
PSGSDSSSSGA

SEQ ID NO: 3243051 - protein, 8 aa, Plasmodium falciparum
PSGSGKTT

SEQ ID NO: 3243052 - protein, 27 aa, Plasmodium falciparum
PSGSGSTATREGEGSSDGGAKDGVGVN

SEQ ID NO: 3243053 - protein, 14 aa, Plasmodium falciparum
PSGTGSQTSASTNA

SEQ ID NO: 3243054 - protein, 10 aa, Plasmodium falciparum
PSGTTSGKDG

SEQ ID NO: 3243055 - protein, 10 aa, Plasmodium falciparum
PSGVYSEGGS

SEQ ID NO: 3243056 - protein, 5 aa, Plasmodium falciparum
PSHKI

SEQ ID NO: 3243057 - protein, 7 aa, Plasmodium falciparum
PSIDDSD

SEQ ID NO: 3243058 - protein, 18 aa, Plasmodium falciparum
PSIEKSKQYKDSENREDS

SEQ ID NO: 3243059 - protein, 9 aa, Plasmodium falciparum
PSIKDRHKN

SEQ ID NO: 3243060 - protein, 4 aa, Plasmodium falciparum
PSIS

SEQ ID NO: 3243061 - protein, 14 aa, Plasmodium falciparum
PSIYQQKKQQPNYT

SEQ ID NO: 3243062 - protein, 6 aa, Plasmodium falciparum
PSKASN

SEQ ID NO: 3243063 - protein, 9 aa, Plasmodium falciparum
PSKCPPNTT

SEQ ID NO: 3243064 - protein, 5 aa, Plasmodium falciparum
PSKED

SEQ ID NO: 3243065 - protein, 6 aa, Plasmodium falciparum
PSKEEK

SEQ ID NO: 3243066 - protein, 7 aa, Plasmodium falciparum
PSKEKSA

SEQ ID NO: 3243067 - protein, 8 aa, Plasmodium falciparum
PSKGYNNG

SEQ ID NO: 3243068 - protein, 4 aa, Plasmodium falciparum
PSKI

SEQ ID NO: 3243069 - protein, 8 aa, Plasmodium falciparum
PSKKKKRN

SEQ ID NO: 3243070 - protein, 17 aa, Plasmodium falciparum
PSKNEKKQKNKTQNKDV

SEQ ID NO: 3243071 - protein, 9 aa, Plasmodium falciparum
PSKNSISNS

SEQ ID NO: 3243072 - protein, 11 aa, Plasmodium falciparum
PSKNSSENTKC

SEQ ID NO: 3243073 - protein, 4 aa, Plasmodium falciparum
PSKP

SEQ ID NO: 3243074 - protein, 4 aa, Plasmodium falciparum
PSKQ

SEQ ID NO: 3243075 - protein, 16 aa, Plasmodium falciparum
PSKRDTFNTPSGDTFT

SEQ ID NO: 3243076 - protein, 14 aa, Plasmodium falciparum
PSKRDTMSTQSDIP

SEQ ID NO: 3243077 - protein, 14 aa, Plasmodium falciparum
PSKRDTPSSDAPMN

SEQ ID NO: 3243078 - protein, 14 aa, Plasmodium falciparum
PSKRDTQNDIPNDI

SEQ ID NO: 3243079 - protein, 30 aa, Plasmodium falciparum
PSKRDTQNDMPSDDIPSDIPNSDTPPPITD

SEQ ID NO: 3243080 - protein, 26 aa, Plasmodium falciparum
PSKRETNSGDIPNDNTPANKPITDEE

SEQ ID NO: 3243081 - protein, 16 aa, Plasmodium falciparum
PSKSNGNTLGDDIPHT

SEQ ID NO: 3243082 - protein, 19 aa, Plasmodium falciparum
PSKSNGNTPSKGDGNTVGD

SEQ ID NO: 3243083 - protein, 15 aa, Plasmodium falciparum
PSKYASKIGKTSETQ

SEQ ID NO: 3243084 - protein, 5 aa, Plasmodium falciparum
PSKYK

SEQ ID NO: 3243085 - protein, 6 aa, Plasmodium falciparum
PSLFQP

SEQ ID NO: 3243086 - protein, 12 aa, Plasmodium falciparum
PSLKNNNNETYS

SEQ ID NO: 3243087 - protein, 5 aa, Plasmodium falciparum
PSLKP

SEQ ID NO: 3243088 - protein, 12 aa, Plasmodium falciparum
PSLKQRNKRNNI

SEQ ID NO: 3243089 - protein, 4 aa, Plasmodium falciparum
PSLS

SEQ ID NO: 3243090 - protein, 10 aa, Plasmodium falciparum
PSMDSTKKNN

SEQ ID NO: 3243091 - protein, 12 aa, Plasmodium falciparum
PSMSKKNNIKRN

SEQ ID NO: 3243092 - protein, 8 aa, Plasmodium falciparum
PSNASSLT

SEQ ID NO: 3243093 - protein, 14 aa, Plasmodium falciparum
PSNDDSSSSLKYDN

SEQ ID NO: 3243094 - protein, 9 aa, Plasmodium falciparum
PSNDDTTNC

SEQ ID NO: 3243095 - protein, 10 aa, Plasmodium falciparum
PSNDGDPAKE

SEQ ID NO: 3243096 - protein, 5 aa, Plasmodium falciparum
PSNEG

SEQ ID NO: 3243097 - protein, 10 aa, Plasmodium falciparum
PSNGGDKKDD

SEQ ID NO: 3243098 - protein, 7 aa, Plasmodium falciparum
PSNHPHQ

SEQ ID NO: 3243099 - protein, 12 aa, Plasmodium falciparum
PSNLTSSRPRTF

SEQ ID NO: 3243100 - protein, 21 aa, Plasmodium falciparum
PSNNIKRKNIEEQKKKKRNEQ

SEQ ID NO: 3243101 - protein, 26 aa, Plasmodium falciparum
PSNNNNNDGDDNNNDDGDGDDNNRND

SEQ ID NO: 3243102 - protein, 20 aa, Plasmodium falciparum
PSNNNNNNNNNNDNHNNDNT

SEQ ID NO: 3243103 - protein, 16 aa, Plasmodium falciparum
PSNNSQQDNKQNNNTN

SEQ ID NO: 3243104 - protein, 9 aa, Plasmodium falciparum
PSNQLDTNK

SEQ ID NO: 3243105 - protein, 7 aa, Plasmodium falciparum
PSNRKIT

SEQ ID NO: 3243106 - protein, 6 aa, Plasmodium falciparum
PSNRKY

SEQ ID NO: 3243107 - protein, 7 aa, Plasmodium falciparum
PSNSAID

SEQ ID NO: 3243108 - protein, 5 aa, Plasmodium falciparum
PSNSK

SEQ ID NO: 3243109 - protein, 6 aa, Plasmodium falciparum
PSNSNS

SEQ ID NO: 3243110 - protein, 7 aa, Plasmodium falciparum
PSNTTFT

SEQ ID NO: 3243111 - protein, 11 aa, Plasmodium falciparum
PSNYDNDPEMK

SEQ ID NO: 3243112 - protein, 9 aa, Plasmodium falciparum
PSNYDNDPQ

SEQ ID NO: 3243113 - protein, 10 aa, Plasmodium falciparum
PSNYDNDPQL

SEQ ID NO: 3243114 - protein, 10 aa, Plasmodium falciparum
PSNYDNDPQM

SEQ ID NO: 3243115 - protein, 10 aa, Plasmodium falciparum
PSNYDNDQEM

SEQ ID NO: 3243116 - protein, 10 aa, Plasmodium falciparum
PSNYDSDPEM

SEQ ID NO: 3243117 - protein, 10 aa, Plasmodium falciparum
PSNYENDPDM

SEQ ID NO: 3243118 - protein, 10 aa, Plasmodium falciparum
PSNYENDPEM

SEQ ID NO: 3243119 - protein, 10 aa, Plasmodium falciparum
PSNYENDSEM

SEQ ID NO: 3243120 - protein, 10 aa, Plasmodium falciparum
PSNYNNDPEM

SEQ ID NO: 3243121 - protein, 5 aa, Plasmodium falciparum
PSPNY

SEQ ID NO: 3243122 - protein, 5 aa, Plasmodium falciparum
PSPSI

SEQ ID NO: 3243123 - protein, 16 aa, Plasmodium falciparum
PSPSKKKTKKKKKKKK

SEQ ID NO: 3243124 - protein, 9 aa, Plasmodium falciparum
PSPSRDAKA

SEQ ID NO: 3243125 - protein, 5 aa, Plasmodium falciparum
PSPVN

SEQ ID NO: 3243126 - protein, 11 aa, Plasmodium falciparum
PSQDSSRKSHD

SEQ ID NO: 3243127 - protein, 13 aa, Plasmodium falciparum
PSQEEKDDLYSER

SEQ ID NO: 3243128 - protein, 5 aa, Plasmodium falciparum
PSQIK

SEQ ID NO: 3243129 - protein, 13 aa, Plasmodium falciparum
PSQKKNYKHHKQN

SEQ ID NO: 3243130 - protein, 24 aa, Plasmodium falciparum
PSQNNYEEKKEECQQKERTNESIN

SEQ ID NO: 3243131 - protein, 4 aa, Plasmodium falciparum
PSRH

SEQ ID NO: 3243132 - protein, 6 aa, Plasmodium falciparum
PSRKSK

SEQ ID NO: 3243133 - protein, 6 aa, Plasmodium falciparum
PSRTRK

SEQ ID NO: 3243134 - protein, 5 aa, Plasmodium falciparum
PSSAA

SEQ ID NO: 3243135 - protein, 5 aa, Plasmodium falciparum
PSSEG

SEQ ID NO: 3243136 - protein, 11 aa, Plasmodium falciparum
PSSENEHNTLT

SEQ ID NO: 3243137 - protein, 5 aa, Plasmodium falciparum
PSSGV

SEQ ID NO: 3243138 - protein, 22 aa, Plasmodium falciparum
PSSKKLEDNNTMKKSNSKEDEK

SEQ ID NO: 3243139 - protein, 8 aa, Plasmodium falciparum
PSSKPKRS

SEQ ID NO: 3243140 - protein, 5 aa, Plasmodium falciparum
PSSKS

SEQ ID NO: 3243141 - protein, 4 aa, Plasmodium falciparum
PSSN

SEQ ID NO: 3243142 - protein, 10 aa, Plasmodium falciparum
PSSPYHQPTS

SEQ ID NO: 3243143 - protein, 24 aa, Plasmodium falciparum
PSSSTEQINKSQYHKTNDDKNDKS

SEQ ID NO: 3243144 - protein, 4 aa, Plasmodium falciparum
PSSY

SEQ ID NO: 3243145 - protein, 7 aa, Plasmodium falciparum
PSSYNKN

SEQ ID NO: 3243146 - protein, 13 aa, Plasmodium falciparum
PSSYQANSSAPKS

SEQ ID NO: 3243147 - protein, 16 aa, Plasmodium falciparum
PSTCPSKDEDYDTPDD

SEQ ID NO: 3243148 - protein, 11 aa, Plasmodium falciparum
PSTKPTKPNRS

SEQ ID NO: 3243149 - protein, 8 aa, Plasmodium falciparum
PSTKSWPS

SEQ ID NO: 3243150 - protein, 11 aa, Plasmodium falciparum
PSTKVANKGAF

SEQ ID NO: 3243151 - protein, 5 aa, Plasmodium falciparum
PSTLP

SEQ ID NO: 3243152 - protein, 6 aa, Plasmodium falciparum
PSTLPK

SEQ ID NO: 3243153 - protein, 6 aa, Plasmodium falciparum
PSTNMK

SEQ ID NO: 3243154 - protein, 7 aa, Plasmodium falciparum
PSTNNAK

SEQ ID NO: 3243155 - protein, 9 aa, Plasmodium falciparum
PSTNNNEKG

SEQ ID NO: 3243156 - protein, 6 aa, Plasmodium falciparum
PSTPKD

SEQ ID NO: 3243157 - protein, 7 aa, Plasmodium falciparum
PSTSKLE

SEQ ID NO: 3243158 - protein, 5 aa, Plasmodium falciparum
PSTTV

SEQ ID NO: 3243159 - protein, 11 aa, Plasmodium falciparum
PSTVRSSNKIT

SEQ ID NO: 3243160 - protein, 4 aa, Plasmodium falciparum
PSYH

SEQ ID NO: 3243161 - protein, 8 aa, Plasmodium falciparum
PSYNNKNK

SEQ ID NO: 3243162 - protein, 5 aa, Plasmodium falciparum
PSYRT

SEQ ID NO: 3243163 - protein, 7 aa, Plasmodium falciparum
PSYSSNE

SEQ ID NO: 3243164 - protein, 10 aa, Plasmodium falciparum
PTDASQNEIK

SEQ ID NO: 3243165 - protein, 4 aa, Plasmodium falciparum
PTDL

SEQ ID NO: 3243166 - protein, 22 aa, Plasmodium falciparum
PTDNNNNNNNKGKGSNNGISTF

SEQ ID NO: 3243167 - protein, 20 aa, Plasmodium falciparum
PTEDETYDESPEDDTSTTSV

SEQ ID NO: 3243168 - protein, 4 aa, Plasmodium falciparum
PTEH

SEQ ID NO: 3243169 - protein, 9 aa, Plasmodium falciparum
PTEKNIEQE

SEQ ID NO: 3243170 - protein, 6 aa, Plasmodium falciparum
PTENRN

SEQ ID NO: 3243171 - protein, 26 aa, Plasmodium falciparum
PTENTKDTKDTKNTKNRNRNKEKKDI

SEQ ID NO: 3243172 - protein, 27 aa, Plasmodium falciparum
PTEPEEPGETCTPAAAGGGHNPEQTPV

SEQ ID NO: 3243173 - protein, 8 aa, Plasmodium falciparum
PTEPKGSF

SEQ ID NO: 3243174 - protein, 5 aa, Plasmodium falciparum
PTFSS

SEQ ID NO: 3243175 - protein, 6 aa, Plasmodium falciparum
PTGDKN

SEQ ID NO: 3243176 - protein, 6 aa, Plasmodium falciparum
PTGGGK

SEQ ID NO: 3243177 - protein, 4 aa, Plasmodium falciparum
PTHA

SEQ ID NO: 3243178 - protein, 12 aa, Plasmodium falciparum
PTHGYNKEGGRV

SEQ ID NO: 3243179 - protein, 14 aa, Plasmodium falciparum
PTIDNDHNNNNKNL

SEQ ID NO: 3243180 - protein, 7 aa, Plasmodium falciparum
PTINGKE

SEQ ID NO: 3243181 - protein, 7 aa, Plasmodium falciparum
PTISNSL

SEQ ID NO: 3243182 - protein, 9 aa, Plasmodium falciparum
PTKAKDLDD

SEQ ID NO: 3243183 - protein, 6 aa, Plasmodium falciparum
PTKGNN

SEQ ID NO: 3243184 - protein, 7 aa, Plasmodium falciparum
PTKHGDI

SEQ ID NO: 3243185 - protein, 4 aa, Plasmodium falciparum
PTKN

SEQ ID NO: 3243186 - protein, 37 aa, Plasmodium falciparum
PTKPNSDSSTTGGGSDTGVPTTKSGATGKSGGSDTGS

SEQ ID NO: 3243187 - protein, 6 aa, Plasmodium falciparum
PTMETS

SEQ ID NO: 3243188 - protein, 5 aa, Plasmodium falciparum
PTNAT

SEQ ID NO: 3243189 - protein, 64 aa, Plasmodium falciparum
PTNDDNKNSGDNNNNNNGDNINNNDDNKNNVDNNNNNDNNNNRDNNNDDDNINNNDDNNDNNNY

SEQ ID NO: 3243190 - protein, 5 aa, Plasmodium falciparum
PTNDT

SEQ ID NO: 3243191 - protein, 11 aa, Plasmodium falciparum
PTNEETCDDRK

SEQ ID NO: 3243192 - protein, 10 aa, Plasmodium falciparum
PTNGSSNRDS

SEQ ID NO: 3243193 - protein, 4 aa, Plasmodium falciparum
PTNI

SEQ ID NO: 3243194 - protein, 4 aa, Plasmodium falciparum
PTNK

SEQ ID NO: 3243195 - protein, 8 aa, Plasmodium falciparum
PTNNNEKL

SEQ ID NO: 3243196 - protein, 12 aa, Plasmodium falciparum
PTNQAKKFQSTN

SEQ ID NO: 3243197 - protein, 4 aa, Plasmodium falciparum
PTNR

SEQ ID NO: 3243198 - protein, 5 aa, Plasmodium falciparum
PTNSS

SEQ ID NO: 3243199 - protein, 7 aa, Plasmodium falciparum
PTNYDND

SEQ ID NO: 3243200 - protein, 10 aa, Plasmodium falciparum
PTNYDNDPEM

SEQ ID NO: 3243201 - protein, 76 aa, Plasmodium falciparum
PTPEPERELDEGKCEEASSPVVPEQPAKEESGAPPAPPATDSGKETNNEDTPAPEAGPPAPAPPSTPESPLAPSDE

SEQ ID NO: 3243202 - protein, 10 aa, Plasmodium falciparum
PTQKKKMPSK

SEQ ID NO: 3243203 - protein, 23 aa, Plasmodium falciparum
PTQNKDQTINTQNKDQTTNTQND

SEQ ID NO: 3243204 - protein, 22 aa, Plasmodium falciparum
PTQNRISDQMENQKIRKNTSLE

SEQ ID NO: 3243205 - protein, 4 aa, Plasmodium falciparum
PTRN

SEQ ID NO: 3243206 - protein, 5 aa, Plasmodium falciparum
PTRNG

SEQ ID NO: 3243207 - protein, 6 aa, Plasmodium falciparum
PTSDGI

SEQ ID NO: 3243208 - protein, 7 aa, Plasmodium falciparum
PTSEDDI

SEQ ID NO: 3243209 - protein, 21 aa, Plasmodium falciparum
PTSGGDKTATSEGSSESGRRI

SEQ ID NO: 3243210 - protein, 20 aa, Plasmodium falciparum
PTSGGTSHIPDVKPGGALSR

SEQ ID NO: 3243211 - protein, 10 aa, Plasmodium falciparum
PTSGLDSSSA

SEQ ID NO: 3243212 - protein, 19 aa, Plasmodium falciparum
PTSGNKETRGPQNSVNDRQ

SEQ ID NO: 3243213 - protein, 36 aa, Plasmodium falciparum
PTSGSGVTATGGGSGEPKGRHRREANPAKASDSNQG

SEQ ID NO: 3243214 - protein, 13 aa, Plasmodium falciparum
PTSNYNNDEDMKS

SEQ ID NO: 3243215 - protein, 6 aa, Plasmodium falciparum
PTSSGK

SEQ ID NO: 3243216 - protein, 6 aa, Plasmodium falciparum
PTSSLD

SEQ ID NO: 3243217 - protein, 6 aa, Plasmodium falciparum
PTTDDE

SEQ ID NO: 3243218 - protein, 62 aa, Plasmodium falciparum
PTTGPNPNTHGPPSRRISTSRSSGSSNRSSSGTSTRSKGPSSPLRDSSGRSSGRSTTPRVRK

SEQ ID NO: 3243219 - protein, 7 aa, Plasmodium falciparum
PTTINTD

SEQ ID NO: 3243220 - protein, 4 aa, Plasmodium falciparum
PTTK

SEQ ID NO: 3243221 - protein, 30 aa, Plasmodium falciparum
PTTPEVKPKKPAVPEAKKPEVEPLPSDEPF

SEQ ID NO: 3243222 - protein, 6 aa, Plasmodium falciparum
PTTPIH

SEQ ID NO: 3243223 - protein, 15 aa, Plasmodium falciparum
PTTSDKGSEPTARGH

SEQ ID NO: 3243224 - protein, 42 aa, Plasmodium falciparum
PTTSGGDNNTPGETTGSESERAEPTRAKRAAPSSPSGKDTGS

SEQ ID NO: 3243225 - protein, 26 aa, Plasmodium falciparum
PTTSGGSGVTTTAGSSVTTTPPSNSG

SEQ ID NO: 3243226 - protein, 6 aa, Plasmodium falciparum
PTTYDQ

SEQ ID NO: 3243227 - protein, 12 aa, Plasmodium falciparum
PTVEEKNQTLGE

SEQ ID NO: 3243228 - protein, 5 aa, Plasmodium falciparum
PTVVG

SEQ ID NO: 3243229 - protein, 8 aa, Plasmodium falciparum
PTYASKHN

SEQ ID NO: 3243230 - protein, 4 aa, Plasmodium falciparum
PTYQ

SEQ ID NO: 3243231 - protein, 5 aa, Plasmodium falciparum
PTYRS

SEQ ID NO: 3243232 - protein, 14 aa, Plasmodium falciparum
PVAQGSQHKSAAVN

SEQ ID NO: 3243233 - protein, 28 aa, Plasmodium falciparum
PVDDSSSTTTSTGTKLQNVPSNDNNGEL

SEQ ID NO: 3243234 - protein, 6 aa, Plasmodium falciparum
PVDQNS

SEQ ID NO: 3243235 - protein, 31 aa, Plasmodium falciparum
PVEKDNADITYTKGQDNLENNNQVNNNYDTQ

SEQ ID NO: 3243236 - protein, 8 aa, Plasmodium falciparum
PVESEAQI

SEQ ID NO: 3243237 - protein, 12 aa, Plasmodium falciparum
PVKKKKKEYTKN

SEQ ID NO: 3243238 - protein, 31 aa, Plasmodium falciparum
PVKSKSSNGKSKARTVNSEVSPKLDDEKKED

SEQ ID NO: 3243239 - protein, 16 aa, Plasmodium falciparum
PVMDEQEENQTPTFKN

SEQ ID NO: 3243240 - protein, 5 aa, Plasmodium falciparum
PVNIS

SEQ ID NO: 3243241 - protein, 9 aa, Plasmodium falciparum
PVNNNNSQI

SEQ ID NO: 3243242 - protein, 9 aa, Plasmodium falciparum
PVNQEKKNY

SEQ ID NO: 3243243 - protein, 9 aa, Plasmodium falciparum
PVNSQPKKN

SEQ ID NO: 3243244 - protein, 63 aa, Plasmodium falciparum
PVNTTDSSTNNITTNRSNNSNGNNDVPQEGPTTTNSNNNNANNNLSNNNLSSNNLSNNNLSSN

SEQ ID NO: 3243245 - protein, 7 aa, Plasmodium falciparum
PVPGAVR

SEQ ID NO: 3243246 - protein, 5 aa, Plasmodium falciparum
PVPND

SEQ ID NO: 3243247 - protein, 22 aa, Plasmodium falciparum
PVQNGQKMEDDIQTQKSNMNIE

SEQ ID NO: 3243248 - protein, 119 aa, Plasmodium falciparum
PVQQPPVQQPPVQQPPAQPPQQPPQQPPQPPPPAPEGGGLGRSLPRADRNGEITDSEEEEEEEKETPKVDEETVEEETTKEEEKAPQDQEAENPDTKVEDKVEGSGPKEGEAPPKVDGV

SEQ ID NO: 3243249 - protein, 7 aa, Plasmodium falciparum
PVRDTTN

SEQ ID NO: 3243250 - protein, 20 aa, Plasmodium falciparum
PVSNSDDPQSKLQKSGEIPP

SEQ ID NO: 3243251 - protein, 19 aa, Plasmodium falciparum
PVSRRQKRDARNENYDGYE

SEQ ID NO: 3243252 - protein, 4 aa, Plasmodium falciparum
PVTY

SEQ ID NO: 3243253 - protein, 10 aa, Plasmodium falciparum
PVYGNSNRYP

SEQ ID NO: 3243254 - protein, 31 aa, Plasmodium falciparum
PVYPSEKDDDKNIKDPEEGKDEEEEEEDGEV

SEQ ID NO: 3243255 - protein, 11 aa, Plasmodium falciparum
PWKTGTNVKMT

SEQ ID NO: 3243256 - protein, 11 aa, Plasmodium falciparum
PWQSGEKIATA

SEQ ID NO: 3243257 - protein, 8 aa, Plasmodium falciparum
PYADSENP

SEQ ID NO: 3243258 - protein, 28 aa, Plasmodium falciparum
PYAKNEQNKSENDTTQKEKQEEKIEQPT

SEQ ID NO: 3243259 - protein, 55 aa, Plasmodium falciparum
PYDDNTYDDNTCDDNTYDDNTYDDNTYDDNTYDDNTYDDNTYDDNTYDNNTYDNN

SEQ ID NO: 3243260 - protein, 4 aa, Plasmodium falciparum
PYDI

SEQ ID NO: 3243261 - protein, 4 aa, Plasmodium falciparum
PYDK

SEQ ID NO: 3243262 - protein, 5 aa, Plasmodium falciparum
PYDKY

SEQ ID NO: 3243263 - protein, 49 aa, Plasmodium falciparum
PYDSYEDDSYDDEKRKDRKVKDKKRKKKKKKAKKKKKKKKKKKKQKEKL

SEQ ID NO: 3243264 - protein, 4 aa, Plasmodium falciparum
PYDT

SEQ ID NO: 3243265 - protein, 5 aa, Plasmodium falciparum
PYDTL

SEQ ID NO: 3243266 - protein, 12 aa, Plasmodium falciparum
PYDTSNDEATKN

SEQ ID NO: 3243267 - protein, 11 aa, Plasmodium falciparum
PYEENDYEEKS

SEQ ID NO: 3243268 - protein, 5 aa, Plasmodium falciparum
PYEND

SEQ ID NO: 3243269 - protein, 4 aa, Plasmodium falciparum
PYER

SEQ ID NO: 3243270 - protein, 6 aa, Plasmodium falciparum
PYGSTS

SEQ ID NO: 3243271 - protein, 14 aa, Plasmodium falciparum
PYGSTTKSIGSKSI

SEQ ID NO: 3243272 - protein, 28 aa, Plasmodium falciparum
PYHGPNNNVPYNKSNNFEQCNTQDNKHC

SEQ ID NO: 3243273 - protein, 18 aa, Plasmodium falciparum
PYHNEEKKKKHNNNNNNY

SEQ ID NO: 3243274 - protein, 13 aa, Plasmodium falciparum
PYHTTANNNTTNI

SEQ ID NO: 3243275 - protein, 5 aa, Plasmodium falciparum
PYKAI

SEQ ID NO: 3243276 - protein, 5 aa, Plasmodium falciparum
PYKIR

SEQ ID NO: 3243277 - protein, 5 aa, Plasmodium falciparum
PYKKN

SEQ ID NO: 3243278 - protein, 8 aa, Plasmodium falciparum
PYKNKNNS

SEQ ID NO: 3243279 - protein, 11 aa, Plasmodium falciparum
PYKSDDGYNKK

SEQ ID NO: 3243280 - protein, 5 aa, Plasmodium falciparum
PYKTV

SEQ ID NO: 3243281 - protein, 21 aa, Plasmodium falciparum
PYNDGDTHYSSENGSSIDMGD

SEQ ID NO: 3243282 - protein, 74 aa, Plasmodium falciparum
PYNEKQTHAVDRTNESNLEYDDDNNDNNNNEDDDYDDDEEEEEEEDEDVDDTYDDDNNNYNNYYDEENKYNNEN

SEQ ID NO: 3243283 - protein, 4 aa, Plasmodium falciparum
PYNV

SEQ ID NO: 3243284 - protein, 13 aa, Plasmodium falciparum
PYPNDSKNNNNAS

SEQ ID NO: 3243285 - protein, 20 aa, Plasmodium falciparum
PYSENYTHNNENKNDNKSGI

SEQ ID NO: 3243286 - protein, 19 aa, Plasmodium falciparum
PYSKDDHENGKNNNKKKKK

SEQ ID NO: 3243287 - protein, 7 aa, Plasmodium falciparum
PYSVERR

SEQ ID NO: 3243288 - protein, 12 aa, Plasmodium falciparum
PYTEDENEERKK

SEQ ID NO: 3243289 - protein, 17 aa, Plasmodium falciparum
PYTTDGQIGSTKEEDCT

SEQ ID NO: 3243290 - protein, 8 aa, Plasmodium falciparum
PYVDGDDQ

SEQ ID NO: 3243291 - protein, 8 aa, Plasmodium falciparum
PYYNTNEE

SEQ ID NO: 3243292 - protein, 4 aa, Plasmodium falciparum
PYYY

SEQ ID NO: 3243293 - protein, 7 aa, Plasmodium falciparum
QAAAAKL

SEQ ID NO: 3243294 - protein, 18 aa, Plasmodium falciparum
QAAEAAVAAGKAAETAEK

SEQ ID NO: 3243295 - protein, 4 aa, Plasmodium falciparum
QADD

SEQ ID NO: 3243296 - protein, 18 aa, Plasmodium falciparum
QADKAAAHVTKTTSESVT

SEQ ID NO: 3243297 - protein, 17 aa, Plasmodium falciparum
QADKAANEVAKDTSQSV

SEQ ID NO: 3243298 - protein, 58 aa, Plasmodium falciparum
QADYEEEDYEEEDYEEEDYEEDDYEEDDYEEDDYEEDDYQDDAEEQEEEEDSAKSYNY

SEQ ID NO: 3243299 - protein, 6 aa, Plasmodium falciparum
QAEIQT

SEQ ID NO: 3243300 - protein, 6 aa, Plasmodium falciparum
QAEKMN

SEQ ID NO: 3243301 - protein, 7 aa, Plasmodium falciparum
QAETTAA

SEQ ID NO: 3243302 - protein, 8 aa, Plasmodium falciparum
QAGAAAGL

SEQ ID NO: 3243303 - protein, 16 aa, Plasmodium falciparum
QAGANTYEKTLTTETP

SEQ ID NO: 3243304 - protein, 9 aa, Plasmodium falciparum
QAGKPKTIT

SEQ ID NO: 3243305 - protein, 14 aa, Plasmodium falciparum
QAKGAAGDKVAEVT

SEQ ID NO: 3243306 - protein, 16 aa, Plasmodium falciparum
QAKYQSSEGVMNENNE

SEQ ID NO: 3243307 - protein, 4 aa, Plasmodium falciparum
QALS

SEQ ID NO: 3243308 - protein, 30 aa, Plasmodium falciparum
QANDGSSSSTPVSFNEPNKLSNKEKKKLEY

SEQ ID NO: 3243309 - protein, 5 aa, Plasmodium falciparum
QAQDV

SEQ ID NO: 3243310 - protein, 20 aa, Plasmodium falciparum
QAQEAATYAASKAKDVTTAE

SEQ ID NO: 3243311 - protein, 17 aa, Plasmodium falciparum
QAQLQEAGKKKKKRGCC

SEQ ID NO: 3243312 - protein, 20 aa, Plasmodium falciparum
QARYNDNKNVRKKKIREKYE

SEQ ID NO: 3243313 - protein, 5 aa, Plasmodium falciparum
QATNR

SEQ ID NO: 3243314 - protein, 7 aa, Plasmodium falciparum
QAVSQSR

SEQ ID NO: 3243315 - protein, 11 aa, Plasmodium falciparum
QAVTDDKGGRI

SEQ ID NO: 3243316 - protein, 14 aa, Plasmodium falciparum
QAYDKKNITQPNDT

SEQ ID NO: 3243317 - protein, 12 aa, Plasmodium falciparum
QAYNESEKRDNL

SEQ ID NO: 3243318 - protein, 4 aa, Plasmodium falciparum
QAYP

SEQ ID NO: 3243319 - protein, 17 aa, Plasmodium falciparum
QAYSEALTRGRSALQGR

SEQ ID NO: 3243320 - protein, 17 aa, Plasmodium falciparum
QCAANSENNLTNLGEST

SEQ ID NO: 3243321 - protein, 4 aa, Plasmodium falciparum
QCEE

SEQ ID NO: 3243322 - protein, 12 aa, Plasmodium falciparum
QCEERSRDDTED

SEQ ID NO: 3243323 - protein, 14 aa, Plasmodium falciparum
QCGHNNGGAPPTNL

SEQ ID NO: 3243324 - protein, 8 aa, Plasmodium falciparum
QCKKQCDK

SEQ ID NO: 3243325 - protein, 20 aa, Plasmodium falciparum
QCKNYDTNTDEQNQKKEEKL

SEQ ID NO: 3243326 - protein, 8 aa, Plasmodium falciparum
QCNDNKDI

SEQ ID NO: 3243327 - protein, 7 aa, Plasmodium falciparum
QCNDNNN

SEQ ID NO: 3243328 - protein, 6 aa, Plasmodium falciparum
QCPENS

SEQ ID NO: 3243329 - protein, 14 aa, Plasmodium falciparum
QCRGTDASKEPRYC

SEQ ID NO: 3243330 - protein, 7 aa, Plasmodium falciparum
QCSDPEG

SEQ ID NO: 3243331 - protein, 10 aa, Plasmodium falciparum
QCSKKKKSYV

SEQ ID NO: 3243332 - protein, 6 aa, Plasmodium falciparum
QCSSPD

SEQ ID NO: 3243333 - protein, 15 aa, Plasmodium falciparum
QCTKTDQGSTCQNKC

SEQ ID NO: 3243334 - protein, 8 aa, Plasmodium falciparum
QDAEYEKR

SEQ ID NO: 3243335 - protein, 4 aa, Plasmodium falciparum
QDAK

SEQ ID NO: 3243336 - protein, 11 aa, Plasmodium falciparum
QDAQDKNEINK

SEQ ID NO: 3243337 - protein, 6 aa, Plasmodium falciparum
QDASPK

SEQ ID NO: 3243338 - protein, 5 aa, Plasmodium falciparum
QDASS

SEQ ID NO: 3243339 - protein, 7 aa, Plasmodium falciparum
QDDAPTI

SEQ ID NO: 3243340 - protein, 6 aa, Plasmodium falciparum
QDDDAQ

SEQ ID NO: 3243341 - protein, 27 aa, Plasmodium falciparum
QDDESVESKERRKKNSKYTQKEKIQDQ

SEQ ID NO: 3243342 - protein, 6 aa, Plasmodium falciparum
QDDEVD

SEQ ID NO: 3243343 - protein, 6 aa, Plasmodium falciparum
QDDGNF

SEQ ID NO: 3243344 - protein, 18 aa, Plasmodium falciparum
QDDGQEKNIQNESTTKYT

SEQ ID NO: 3243345 - protein, 14 aa, Plasmodium falciparum
QDDKSNDKNDKSCE

SEQ ID NO: 3243346 - protein, 8 aa, Plasmodium falciparum
QDDLSNEG

SEQ ID NO: 3243347 - protein, 90 aa, Plasmodium falciparum
QDDNKKNNDNKKNNDNTNNNNNTNNNDNNNNDNNNNNNGDVKNTNANIQNNTNEKANNIYDSTNNINNKNSSDNINNDKKMYESKNEEKY

SEQ ID NO: 3243348 - protein, 13 aa, Plasmodium falciparum
QDDNNNNNNNNYN

SEQ ID NO: 3243349 - protein, 20 aa, Plasmodium falciparum
QDDNVKAEDYKDENNDNDGD

SEQ ID NO: 3243350 - protein, 9 aa, Plasmodium falciparum
QDDQKEDSN

SEQ ID NO: 3243351 - protein, 32 aa, Plasmodium falciparum
QDDQTQGKQKKDIEESEFSDYTKKNNTTSNID

SEQ ID NO: 3243352 - protein, 9 aa, Plasmodium falciparum
QDDTSIEEN

SEQ ID NO: 3243353 - protein, 18 aa, Plasmodium falciparum
QDEDEPLEETEENPVGKQ

SEQ ID NO: 3243354 - protein, 4 aa, Plasmodium falciparum
QDEE

SEQ ID NO: 3243355 - protein, 10 aa, Plasmodium falciparum
QDEEKNKQNY

SEQ ID NO: 3243356 - protein, 9 aa, Plasmodium falciparum
QDEENRRNL

SEQ ID NO: 3243357 - protein, 6 aa, Plasmodium falciparum
QDEEQN

SEQ ID NO: 3243358 - protein, 8 aa, Plasmodium falciparum
QDEKGKWD

SEQ ID NO: 3243359 - protein, 15 aa, Plasmodium falciparum
QDENDRKINEKKSYD

SEQ ID NO: 3243360 - protein, 7 aa, Plasmodium falciparum
QDENQIS

SEQ ID NO: 3243361 - protein, 9 aa, Plasmodium falciparum
QDENTKRRK

SEQ ID NO: 3243362 - protein, 12 aa, Plasmodium falciparum
QDEQQDKNKNVY

SEQ ID NO: 3243363 - protein, 7 aa, Plasmodium falciparum
QDEQVDK

SEQ ID NO: 3243364 - protein, 4 aa, Plasmodium falciparum
QDER

SEQ ID NO: 3243365 - protein, 5 aa, Plasmodium falciparum
QDEYN

SEQ ID NO: 3243366 - protein, 12 aa, Plasmodium falciparum
QDFGKQGENGVG

SEQ ID NO: 3243367 - protein, 20 aa, Plasmodium falciparum
QDGDKEEEEEEKKKKKSSED

SEQ ID NO: 3243368 - protein, 9 aa, Plasmodium falciparum
QDGKGINTH

SEQ ID NO: 3243369 - protein, 9 aa, Plasmodium falciparum
QDGPQEDET

SEQ ID NO: 3243370 - protein, 9 aa, Plasmodium falciparum
QDGSGTNDF

SEQ ID NO: 3243371 - protein, 6 aa, Plasmodium falciparum
QDHEIN

SEQ ID NO: 3243372 - protein, 7 aa, Plasmodium falciparum
QDHSDGC

SEQ ID NO: 3243373 - protein, 19 aa, Plasmodium falciparum
QDIENDGQDDYKDDVNGSG

SEQ ID NO: 3243374 - protein, 7 aa, Plasmodium falciparum
QDIENKN

SEQ ID NO: 3243375 - protein, 5 aa, Plasmodium falciparum
QDING

SEQ ID NO: 3243376 - protein, 19 aa, Plasmodium falciparum
QDINNKKDSDDIKPSVSKE

SEQ ID NO: 3243377 - protein, 8 aa, Plasmodium falciparum
QDINNQQH

SEQ ID NO: 3243378 - protein, 8 aa, Plasmodium falciparum
QDISPDMP

SEQ ID NO: 3243379 - protein, 7 aa, Plasmodium falciparum
QDKDNQY

SEQ ID NO: 3243380 - protein, 9 aa, Plasmodium falciparum
QDKELKKKY

SEQ ID NO: 3243381 - protein, 9 aa, Plasmodium falciparum
QDKETLNTN

SEQ ID NO: 3243382 - protein, 13 aa, Plasmodium falciparum
QDKGNDSINNKSV

SEQ ID NO: 3243383 - protein, 7 aa, Plasmodium falciparum
QDKKDDI

SEQ ID NO: 3243384 - protein, 19 aa, Plasmodium falciparum
QDKKITQDIKNNDPNNNYD

SEQ ID NO: 3243385 - protein, 11 aa, Plasmodium falciparum
QDKKKERCQDN

SEQ ID NO: 3243386 - protein, 14 aa, Plasmodium falciparum
QDKLANDNNRNNKK

SEQ ID NO: 3243387 - protein, 6 aa, Plasmodium falciparum
QDKLNN

SEQ ID NO: 3243388 - protein, 17 aa, Plasmodium falciparum
QDKNENDIYNTDGNNNM

SEQ ID NO: 3243389 - protein, 5 aa, Plasmodium falciparum
QDKNF

SEQ ID NO: 3243390 - protein, 10 aa, Plasmodium falciparum
QDKNITKDTY

SEQ ID NO: 3243391 - protein, 5 aa, Plasmodium falciparum
QDKNS

SEQ ID NO: 3243392 - protein, 13 aa, Plasmodium falciparum
QDKRQKCKEQCDK

SEQ ID NO: 3243393 - protein, 7 aa, Plasmodium falciparum
QDKRRKT

SEQ ID NO: 3243394 - protein, 11 aa, Plasmodium falciparum
QDLQQKKNRKR

SEQ ID NO: 3243395 - protein, 23 aa, Plasmodium falciparum
QDMNNRNNYPFEPRGSNYGNIDA

SEQ ID NO: 3243396 - protein, 12 aa, Plasmodium falciparum
QDNDLEELAESA

SEQ ID NO: 3243397 - protein, 8 aa, Plasmodium falciparum
QDNDMDES

SEQ ID NO: 3243398 - protein, 6 aa, Plasmodium falciparum
QDNDRK

SEQ ID NO: 3243399 - protein, 37 aa, Plasmodium falciparum
QDNEQNDDNNDQKKNNNKNGNNNDNNSNNKKEDDVNK

SEQ ID NO: 3243400 - protein, 9 aa, Plasmodium falciparum
QDNESEEEK

SEQ ID NO: 3243401 - protein, 10 aa, Plasmodium falciparum
QDNIKSKAKK

SEQ ID NO: 3243402 - protein, 7 aa, Plasmodium falciparum
QDNISKS

SEQ ID NO: 3243403 - protein, 11 aa, Plasmodium falciparum
QDNKQTNITDE

SEQ ID NO: 3243404 - protein, 7 aa, Plasmodium falciparum
QDNNNIN

SEQ ID NO: 3243405 - protein, 14 aa, Plasmodium falciparum
QDNNNNYDNNNYYD

SEQ ID NO: 3243406 - protein, 8 aa, Plasmodium falciparum
QDNNSNTY

SEQ ID NO: 3243407 - protein, 6 aa, Plasmodium falciparum
QDNTNN

SEQ ID NO: 3243408 - protein, 18 aa, Plasmodium falciparum
QDNYDHNNSEDNNNCEKN

SEQ ID NO: 3243409 - protein, 5 aa, Plasmodium falciparum
QDPEL

SEQ ID NO: 3243410 - protein, 4 aa, Plasmodium falciparum
QDPI

SEQ ID NO: 3243411 - protein, 15 aa, Plasmodium falciparum
QDPMNNTKQRSHSSY

SEQ ID NO: 3243412 - protein, 5 aa, Plasmodium falciparum
QDPSD

SEQ ID NO: 3243413 - protein, 14 aa, Plasmodium falciparum
QDQDNMKSKRNKEY

SEQ ID NO: 3243414 - protein, 20 aa, Plasmodium falciparum
QDQNIKNDEQNNNNTNNNNI

SEQ ID NO: 3243415 - protein, 17 aa, Plasmodium falciparum
QDQTYGQLNENNPEQNN

SEQ ID NO: 3243416 - protein, 12 aa, Plasmodium falciparum
QDRERNRKSNFP

SEQ ID NO: 3243417 - protein, 6 aa, Plasmodium falciparum
QDRESY

SEQ ID NO: 3243418 - protein, 10 aa, Plasmodium falciparum
QDRKKKETSM

SEQ ID NO: 3243419 - protein, 9 aa, Plasmodium falciparum
QDRKLSSRV

SEQ ID NO: 3243420 - protein, 7 aa, Plasmodium falciparum
QDSEYGL

SEQ ID NO: 3243421 - protein, 4 aa, Plasmodium falciparum
QDSM

SEQ ID NO: 3243422 - protein, 7 aa, Plasmodium falciparum
QDSNHNE

SEQ ID NO: 3243423 - protein, 7 aa, Plasmodium falciparum
QDTEGGK

SEQ ID NO: 3243424 - protein, 60 aa, Plasmodium falciparum
QDTENDENKEKGIKKEKNDEEKKNDAEKKKKENKKGREKSVKVRKTKNQTQVERENEKEN

SEQ ID NO: 3243425 - protein, 24 aa, Plasmodium falciparum
QDTENDENNSSRNSDNTEGNSKDV

SEQ ID NO: 3243426 - protein, 11 aa, Plasmodium falciparum
QDTNEKREDIQ

SEQ ID NO: 3243427 - protein, 11 aa, Plasmodium falciparum
QDTQKNNKKCN

SEQ ID NO: 3243428 - protein, 6 aa, Plasmodium falciparum
QDTSKT

SEQ ID NO: 3243429 - protein, 9 aa, Plasmodium falciparum
QDVSTVDSN

SEQ ID NO: 3243430 - protein, 6 aa, Plasmodium falciparum
QDYKNE

SEQ ID NO: 3243431 - protein, 12 aa, Plasmodium falciparum
QDYPTNNQTNYM

SEQ ID NO: 3243432 - protein, 7 aa, Plasmodium falciparum
QDYPTNS

SEQ ID NO: 3243433 - protein, 11 aa, Plasmodium falciparum
QDYPTNSQTNY

SEQ ID NO: 3243434 - protein, 12 aa, Plasmodium falciparum
QDYPTNSQTNYM

SEQ ID NO: 3243435 - protein, 4 aa, Plasmodium falciparum
QEAS

SEQ ID NO: 3243436 - protein, 8 aa, Plasmodium falciparum
QEAVSTSP

SEQ ID NO: 3243437 - protein, 4 aa, Plasmodium falciparum
QECD

SEQ ID NO: 3243438 - protein, 8 aa, Plasmodium falciparum
QEDDKTLH

SEQ ID NO: 3243439 - protein, 8 aa, Plasmodium falciparum
QEDGYSKK

SEQ ID NO: 3243440 - protein, 5 aa, Plasmodium falciparum
QEDIK

SEQ ID NO: 3243441 - protein, 5 aa, Plasmodium falciparum
QEDRN

SEQ ID NO: 3243442 - protein, 11 aa, Plasmodium falciparum
QEDSPPKSSFE

SEQ ID NO: 3243443 - protein, 6 aa, Plasmodium falciparum
QEDVQG

SEQ ID NO: 3243444 - protein, 4 aa, Plasmodium falciparum
QEDY

SEQ ID NO: 3243445 - protein, 8 aa, Plasmodium falciparum
QEEDEKSI

SEQ ID NO: 3243446 - protein, 5 aa, Plasmodium falciparum
QEEDK

SEQ ID NO: 3243447 - protein, 5 aa, Plasmodium falciparum
QEEEE

SEQ ID NO: 3243448 - protein, 10 aa, Plasmodium falciparum
QEEENQRDTT

SEQ ID NO: 3243449 - protein, 13 aa, Plasmodium falciparum
QEEERKSTDIKRT

SEQ ID NO: 3243450 - protein, 12 aa, Plasmodium falciparum
QEEEYNKNDDID

SEQ ID NO: 3243451 - protein, 11 aa, Plasmodium falciparum
QEEGNITKKNH

SEQ ID NO: 3243452 - protein, 8 aa, Plasmodium falciparum
QEEGNNAS

SEQ ID NO: 3243453 - protein, 9 aa, Plasmodium falciparum
QEEKEKNDI

SEQ ID NO: 3243454 - protein, 11 aa, Plasmodium falciparum
QEEKKELENET

SEQ ID NO: 3243455 - protein, 9 aa, Plasmodium falciparum
QEEKKKVNW

SEQ ID NO: 3243456 - protein, 15 aa, Plasmodium falciparum
QEEKKYKLKNEQKDV

SEQ ID NO: 3243457 - protein, 5 aa, Plasmodium falciparum
QEENE

SEQ ID NO: 3243458 - protein, 6 aa, Plasmodium falciparum
QEENRN

SEQ ID NO: 3243459 - protein, 5 aa, Plasmodium falciparum
QEEQK

SEQ ID NO: 3243460 - protein, 7 aa, Plasmodium falciparum
QEEREKD

SEQ ID NO: 3243461 - protein, 8 aa, Plasmodium falciparum
QEERNKKN

SEQ ID NO: 3243462 - protein, 9 aa, Plasmodium falciparum
QEESATEEV

SEQ ID NO: 3243463 - protein, 8 aa, Plasmodium falciparum
QEESTTEK

SEQ ID NO: 3243464 - protein, 8 aa, Plasmodium falciparum
QEEYEENK

SEQ ID NO: 3243465 - protein, 7 aa, Plasmodium falciparum
QEEYTKK

SEQ ID NO: 3243466 - protein, 10 aa, Plasmodium falciparum
QEFQNTQKDN

SEQ ID NO: 3243467 - protein, 38 aa, Plasmodium falciparum
QEGDKCVENPNPTCNENNGGCDADATCTEEDSGSSRKK

SEQ ID NO: 3243468 - protein, 10 aa, Plasmodium falciparum
QEGHDTDGIT

SEQ ID NO: 3243469 - protein, 4 aa, Plasmodium falciparum
QEGI

SEQ ID NO: 3243470 - protein, 9 aa, Plasmodium falciparum
QEGKEKALY

SEQ ID NO: 3243471 - protein, 12 aa, Plasmodium falciparum
QEGNGSRLGGGS

SEQ ID NO: 3243472 - protein, 5 aa, Plasmodium falciparum
QEGSS

SEQ ID NO: 3243473 - protein, 16 aa, Plasmodium falciparum
QEHDNDDDNDDDNDDD

SEQ ID NO: 3243474 - protein, 14 aa, Plasmodium falciparum
QEIEEKKQTRDNNK

SEQ ID NO: 3243475 - protein, 7 aa, Plasmodium falciparum
QEIEERT

SEQ ID NO: 3243476 - protein, 8 aa, Plasmodium falciparum
QEIKNDAT

SEQ ID NO: 3243477 - protein, 13 aa, Plasmodium falciparum
QEIQNENLDNNDN

SEQ ID NO: 3243478 - protein, 4 aa, Plasmodium falciparum
QEIS

SEQ ID NO: 3243479 - protein, 9 aa, Plasmodium falciparum
QEITKGNEE

SEQ ID NO: 3243480 - protein, 19 aa, Plasmodium falciparum
QEKAKKCHDQHSDNPQEKC

SEQ ID NO: 3243481 - protein, 16 aa, Plasmodium falciparum
QEKDEEDAEHTEDEED

SEQ ID NO: 3243482 - protein, 9 aa, Plasmodium falciparum
QEKDKKDNT

SEQ ID NO: 3243483 - protein, 9 aa, Plasmodium falciparum
QEKEDISDV

SEQ ID NO: 3243484 - protein, 29 aa, Plasmodium falciparum
QEKEKEKEKEKEKEQKEKKKKKKKKKKKE

SEQ ID NO: 3243485 - protein, 15 aa, Plasmodium falciparum
QEKEKKKKKIKKSHK

SEQ ID NO: 3243486 - protein, 25 aa, Plasmodium falciparum
QEKEKKNKINMNKSEDYKNDEQGKE

SEQ ID NO: 3243487 - protein, 8 aa, Plasmodium falciparum
QEKEKSSK

SEQ ID NO: 3243488 - protein, 5 aa, Plasmodium falciparum
QEKEL

SEQ ID NO: 3243489 - protein, 7 aa, Plasmodium falciparum
QEKENNI

SEQ ID NO: 3243490 - protein, 7 aa, Plasmodium falciparum
QEKENNN

SEQ ID NO: 3243491 - protein, 4 aa, Plasmodium falciparum
QEKK

SEQ ID NO: 3243492 - protein, 7 aa, Plasmodium falciparum
QEKKDIK

SEQ ID NO: 3243493 - protein, 7 aa, Plasmodium falciparum
QEKKDTE

SEQ ID NO: 3243494 - protein, 10 aa, Plasmodium falciparum
QEKKEEGGQM

SEQ ID NO: 3243495 - protein, 8 aa, Plasmodium falciparum
QEKKIENE

SEQ ID NO: 3243496 - protein, 13 aa, Plasmodium falciparum
QEKKKPKNEVGGA

SEQ ID NO: 3243497 - protein, 9 aa, Plasmodium falciparum
QEKKLNEKK

SEQ ID NO: 3243498 - protein, 8 aa, Plasmodium falciparum
QEKKNKDS

SEQ ID NO: 3243499 - protein, 12 aa, Plasmodium falciparum
QEKKPPSEQNAG

SEQ ID NO: 3243500 - protein, 23 aa, Plasmodium falciparum
QEKKSGKDSVTDNDKYTKENKNI

SEQ ID NO: 3243501 - protein, 10 aa, Plasmodium falciparum
QEKKVKTKEI

SEQ ID NO: 3243502 - protein, 8 aa, Plasmodium falciparum
QEKNDKFG

SEQ ID NO: 3243503 - protein, 11 aa, Plasmodium falciparum
QEKNEKQDRNI

SEQ ID NO: 3243504 - protein, 10 aa, Plasmodium falciparum
QEKNNENRTL

SEQ ID NO: 3243505 - protein, 6 aa, Plasmodium falciparum
QEKNNY

SEQ ID NO: 3243506 - protein, 20 aa, Plasmodium falciparum
QEKQNEDNKDNMDNKDNKDF

SEQ ID NO: 3243507 - protein, 11 aa, Plasmodium falciparum
QEKQNEENDKM

SEQ ID NO: 3243508 - protein, 10 aa, Plasmodium falciparum
QEKQNGEHQM

SEQ ID NO: 3243509 - protein, 13 aa, Plasmodium falciparum
QEKRKKCKEQCER

SEQ ID NO: 3243510 - protein, 4 aa, Plasmodium falciparum
QEKV

SEQ ID NO: 3243511 - protein, 4 aa, Plasmodium falciparum
QEKY

SEQ ID NO: 3243512 - protein, 36 aa, Plasmodium falciparum
QELQEEEEEEEGNDNNDDDDDDAVEGKKKKKRREQI

SEQ ID NO: 3243513 - protein, 5 aa, Plasmodium falciparum
QELST

SEQ ID NO: 3243514 - protein, 5 aa, Plasmodium falciparum
QEMTS

SEQ ID NO: 3243515 - protein, 13 aa, Plasmodium falciparum
QENAKTTKQKNYQ

SEQ ID NO: 3243516 - protein, 7 aa, Plasmodium falciparum
QENDKNN

SEQ ID NO: 3243517 - protein, 10 aa, Plasmodium falciparum
QENDTMDSNS

SEQ ID NO: 3243518 - protein, 4 aa, Plasmodium falciparum
QENE

SEQ ID NO: 3243519 - protein, 20 aa, Plasmodium falciparum
QENEDKDGDKPGDVKSNNNM

SEQ ID NO: 3243520 - protein, 8 aa, Plasmodium falciparum
QENEGNQM

SEQ ID NO: 3243521 - protein, 5 aa, Plasmodium falciparum
QENHK

SEQ ID NO: 3243522 - protein, 7 aa, Plasmodium falciparum
QENHPPS

SEQ ID NO: 3243523 - protein, 4 aa, Plasmodium falciparum
QENI

SEQ ID NO: 3243524 - protein, 5 aa, Plasmodium falciparum
QENIT

SEQ ID NO: 3243525 - protein, 4 aa, Plasmodium falciparum
QENK

SEQ ID NO: 3243526 - protein, 14 aa, Plasmodium falciparum
QENKKDNTKYDTNN

SEQ ID NO: 3243527 - protein, 5 aa, Plasmodium falciparum
QENKL

SEQ ID NO: 3243528 - protein, 10 aa, Plasmodium falciparum
QENNDDLLNN

SEQ ID NO: 3243529 - protein, 7 aa, Plasmodium falciparum
QENNEYD

SEQ ID NO: 3243530 - protein, 17 aa, Plasmodium falciparum
QENNGPRYCNKDESKRN

SEQ ID NO: 3243531 - protein, 31 aa, Plasmodium falciparum
QENNNITTHNNNNNNNNNNNNNNNNNNNVYT

SEQ ID NO: 3243532 - protein, 8 aa, Plasmodium falciparum
QENNNNNI

SEQ ID NO: 3243533 - protein, 13 aa, Plasmodium falciparum
QENNYKKNKKKTK

SEQ ID NO: 3243534 - protein, 29 aa, Plasmodium falciparum
QENQKEDNKNTSSQHGNVTNNYDGYNNGA

SEQ ID NO: 3243535 - protein, 34 aa, Plasmodium falciparum
QENQKNNKKNNNNNKKKNNNNNNKKNNNNNNKKE

SEQ ID NO: 3243536 - protein, 9 aa, Plasmodium falciparum
QENQNMKKR

SEQ ID NO: 3243537 - protein, 13 aa, Plasmodium falciparum
QENRQKCKEQCEK

SEQ ID NO: 3243538 - protein, 5 aa, Plasmodium falciparum
QENSY

SEQ ID NO: 3243539 - protein, 8 aa, Plasmodium falciparum
QENTIAKD

SEQ ID NO: 3243540 - protein, 8 aa, Plasmodium falciparum
QENVSSNN

SEQ ID NO: 3243541 - protein, 66 aa, Plasmodium falciparum
QEPKHNVNNKNNDHINSKNNDHINSKNNDNINSKNNDHINNKKNDHINNKKNDHINNKKNDHINNK

SEQ ID NO: 3243542 - protein, 5 aa, Plasmodium falciparum
QEPTI

SEQ ID NO: 3243543 - protein, 9 aa, Plasmodium falciparum
QEQDEQKCE

SEQ ID NO: 3243544 - protein, 6 aa, Plasmodium falciparum
QEQDES

SEQ ID NO: 3243545 - protein, 6 aa, Plasmodium falciparum
QEQEDI

SEQ ID NO: 3243546 - protein, 8 aa, Plasmodium falciparum
QEQEEDAK

SEQ ID NO: 3243547 - protein, 4 aa, Plasmodium falciparum
QEQI

SEQ ID NO: 3243548 - protein, 10 aa, Plasmodium falciparum
QEQKTDNKYI

SEQ ID NO: 3243549 - protein, 4 aa, Plasmodium falciparum
QEQN

SEQ ID NO: 3243550 - protein, 8 aa, Plasmodium falciparum
QEQNNNIS

SEQ ID NO: 3243551 - protein, 7 aa, Plasmodium falciparum
QEQNSWN

SEQ ID NO: 3243552 - protein, 17 aa, Plasmodium falciparum
QERETKMKKTPKKNMNK

SEQ ID NO: 3243553 - protein, 4 aa, Plasmodium falciparum
QERI

SEQ ID NO: 3243554 - protein, 4 aa, Plasmodium falciparum
QERQ

SEQ ID NO: 3243555 - protein, 4 aa, Plasmodium falciparum
QERY

SEQ ID NO: 3243556 - protein, 28 aa, Plasmodium falciparum
QERYNNNNNYNKNNPEGIGNTGKRYESM

SEQ ID NO: 3243557 - protein, 4 aa, Plasmodium falciparum
QESD

SEQ ID NO: 3243558 - protein, 18 aa, Plasmodium falciparum
QESGKKKKKKKVKNIPHD

SEQ ID NO: 3243559 - protein, 5 aa, Plasmodium falciparum
QESHN

SEQ ID NO: 3243560 - protein, 15 aa, Plasmodium falciparum
QESKSNIDHKKQIDD

SEQ ID NO: 3243561 - protein, 8 aa, Plasmodium falciparum
QESNPNCN

SEQ ID NO: 3243562 - protein, 12 aa, Plasmodium falciparum
QESNVNPGTSNL

SEQ ID NO: 3243563 - protein, 20 aa, Plasmodium falciparum
QESPRRGKNYTIDSNEAQHD

SEQ ID NO: 3243564 - protein, 15 aa, Plasmodium falciparum
QESQPENEIKDDNKN

SEQ ID NO: 3243565 - protein, 6 aa, Plasmodium falciparum
QESQRY

SEQ ID NO: 3243566 - protein, 9 aa, Plasmodium falciparum
QESSPFEKE

SEQ ID NO: 3243567 - protein, 4 aa, Plasmodium falciparum
QETE

SEQ ID NO: 3243568 - protein, 6 aa, Plasmodium falciparum
QETEQN

SEQ ID NO: 3243569 - protein, 4 aa, Plasmodium falciparum
QETN

SEQ ID NO: 3243570 - protein, 6 aa, Plasmodium falciparum
QETNIS

SEQ ID NO: 3243571 - protein, 15 aa, Plasmodium falciparum
QETNKDDSLNNTDTK

SEQ ID NO: 3243572 - protein, 14 aa, Plasmodium falciparum
QETPVSNAKKRITN

SEQ ID NO: 3243573 - protein, 94 aa, Plasmodium falciparum
QETQPENPARSLDSVPGSPSPPADPSLDTARGPNHEEEEEDDDSGDDDEVDLQEDQEDQDEAEAEDPDGESSTAETTQQEAVAPTTQDNAEKPC

SEQ ID NO: 3243574 - protein, 6 aa, Plasmodium falciparum
QETSGK

SEQ ID NO: 3243575 - protein, 9 aa, Plasmodium falciparum
QETSYATKN

SEQ ID NO: 3243576 - protein, 5 aa, Plasmodium falciparum
QETTV

SEQ ID NO: 3243577 - protein, 17 aa, Plasmodium falciparum
QEVEQKESDTNEIEETK

SEQ ID NO: 3243578 - protein, 6 aa, Plasmodium falciparum
QEVGEG

SEQ ID NO: 3243579 - protein, 23 aa, Plasmodium falciparum
QEVNENKKRNKGQGHEDERNDNN

SEQ ID NO: 3243580 - protein, 4 aa, Plasmodium falciparum
QEWS

SEQ ID NO: 3243581 - protein, 5 aa, Plasmodium falciparum
QEYEK

SEQ ID NO: 3243582 - protein, 16 aa, Plasmodium falciparum
QEYGSDQHDQRNNSMD

SEQ ID NO: 3243583 - protein, 4 aa, Plasmodium falciparum
QEYK

SEQ ID NO: 3243584 - protein, 9 aa, Plasmodium falciparum
QEYKDPRSN

SEQ ID NO: 3243585 - protein, 12 aa, Plasmodium falciparum
QEYNKTKSTCES

SEQ ID NO: 3243586 - protein, 25 aa, Plasmodium falciparum
QEYPPLPDEEYENEEENDKKVEPPT

SEQ ID NO: 3243587 - protein, 8 aa, Plasmodium falciparum
QEYPQGEF

SEQ ID NO: 3243588 - protein, 6 aa, Plasmodium falciparum
QFDEED

SEQ ID NO: 3243589 - protein, 4 aa, Plasmodium falciparum
QFES

SEQ ID NO: 3243590 - protein, 11 aa, Plasmodium falciparum
QFGSKSKNVKR

SEQ ID NO: 3243591 - protein, 8 aa, Plasmodium falciparum
QFKKDDQK

SEQ ID NO: 3243592 - protein, 18 aa, Plasmodium falciparum
QFNNNNNNLNKDNINKST

SEQ ID NO: 3243593 - protein, 5 aa, Plasmodium falciparum
QFRNS

SEQ ID NO: 3243594 - protein, 9 aa, Plasmodium falciparum
QFSDYSEEE

SEQ ID NO: 3243595 - protein, 7 aa, Plasmodium falciparum
QFSSKES

SEQ ID NO: 3243596 - protein, 6 aa, Plasmodium falciparum
QFSTQE

SEQ ID NO: 3243597 - protein, 5 aa, Plasmodium falciparum
QFTDE

SEQ ID NO: 3243598 - protein, 10 aa, Plasmodium falciparum
QGANKNNHAY

SEQ ID NO: 3243599 - protein, 8 aa, Plasmodium falciparum
QGANKSSD

SEQ ID NO: 3243600 - protein, 4 aa, Plasmodium falciparum
QGDD

SEQ ID NO: 3243601 - protein, 8 aa, Plasmodium falciparum
QGDEELKN

SEQ ID NO: 3243602 - protein, 17 aa, Plasmodium falciparum
QGDIKEEDGNKETKKNI

SEQ ID NO: 3243603 - protein, 56 aa, Plasmodium falciparum
QGDNNNNTLDTTTSETSSSSTTNTNNNNNNNINNNSNSNNNNSNINNNNNINNNNN

SEQ ID NO: 3243604 - protein, 68 aa, Plasmodium falciparum
QGDSAIEQQQGKGPTTSGPTTSGPTRVGPTSADPTNEVGTSTSRARRSIQDPYPKEFSTATTKGNNYN

SEQ ID NO: 3243605 - protein, 5 aa, Plasmodium falciparum
QGDSM

SEQ ID NO: 3243606 - protein, 5 aa, Plasmodium falciparum
QGEAE

SEQ ID NO: 3243607 - protein, 12 aa, Plasmodium falciparum
QGEAPKISASCP

SEQ ID NO: 3243608 - protein, 8 aa, Plasmodium falciparum
QGEDKKCD

SEQ ID NO: 3243609 - protein, 7 aa, Plasmodium falciparum
QGEDKKK

SEQ ID NO: 3243610 - protein, 4 aa, Plasmodium falciparum
QGEE

SEQ ID NO: 3243611 - protein, 9 aa, Plasmodium falciparum
QGEENEEEK

SEQ ID NO: 3243612 - protein, 12 aa, Plasmodium falciparum
QGEHDKKGKNII

SEQ ID NO: 3243613 - protein, 9 aa, Plasmodium falciparum
QGENKNELN

SEQ ID NO: 3243614 - protein, 10 aa, Plasmodium falciparum
QGETNENVNN

SEQ ID NO: 3243615 - protein, 6 aa, Plasmodium falciparum
QGFEEE

SEQ ID NO: 3243616 - protein, 12 aa, Plasmodium falciparum
QGGDKKGNHENI

SEQ ID NO: 3243617 - protein, 9 aa, Plasmodium falciparum
QGGDNLEER

SEQ ID NO: 3243618 - protein, 11 aa, Plasmodium falciparum
QGGDQNTVGQE

SEQ ID NO: 3243619 - protein, 7 aa, Plasmodium falciparum
QGHIKNS

SEQ ID NO: 3243620 - protein, 16 aa, Plasmodium falciparum
QGHNDGDGKGGNNPAE

SEQ ID NO: 3243621 - protein, 15 aa, Plasmodium falciparum
QGHNDGDGKGGSNPL

SEQ ID NO: 3243622 - protein, 15 aa, Plasmodium falciparum
QGHNNGDGKGGSNPL

SEQ ID NO: 3243623 - protein, 20 aa, Plasmodium falciparum
QGHYSSTKHPISSTKSSKYH

SEQ ID NO: 3243624 - protein, 7 aa, Plasmodium falciparum
QGIRNPD

SEQ ID NO: 3243625 - protein, 7 aa, Plasmodium falciparum
QGKASLN

SEQ ID NO: 3243626 - protein, 7 aa, Plasmodium falciparum
QGKRPGV

SEQ ID NO: 3243627 - protein, 8 aa, Plasmodium falciparum
QGKYNNNS

SEQ ID NO: 3243628 - protein, 10 aa, Plasmodium falciparum
QGMQRETHDR

SEQ ID NO: 3243629 - protein, 4 aa, Plasmodium falciparum
QGNF

SEQ ID NO: 3243630 - protein, 7 aa, Plasmodium falciparum
QGNHSVK

SEQ ID NO: 3243631 - protein, 7 aa, Plasmodium falciparum
QGNIDNN

SEQ ID NO: 3243632 - protein, 9 aa, Plasmodium falciparum
QGNLKNKEQ

SEQ ID NO: 3243633 - protein, 13 aa, Plasmodium falciparum
QGNNANGINGKNM

SEQ ID NO: 3243634 - protein, 5 aa, Plasmodium falciparum
QGNNN

SEQ ID NO: 3243635 - protein, 7 aa, Plasmodium falciparum
QGNNNFQ

SEQ ID NO: 3243636 - protein, 7 aa, Plasmodium falciparum
QGNNSKL

SEQ ID NO: 3243637 - protein, 7 aa, Plasmodium falciparum
QGNNTNN

SEQ ID NO: 3243638 - protein, 7 aa, Plasmodium falciparum
QGNTEDY

SEQ ID NO: 3243639 - protein, 8 aa, Plasmodium falciparum
QGNTEIKN

SEQ ID NO: 3243640 - protein, 6 aa, Plasmodium falciparum
QGNTKK

SEQ ID NO: 3243641 - protein, 9 aa, Plasmodium falciparum
QGPPGTGKT

SEQ ID NO: 3243642 - protein, 10 aa, Plasmodium falciparum
QGPPGTGKTK

SEQ ID NO: 3243643 - protein, 5 aa, Plasmodium falciparum
QGQES

SEQ ID NO: 3243644 - protein, 4 aa, Plasmodium falciparum
QGQF

SEQ ID NO: 3243645 - protein, 21 aa, Plasmodium falciparum
QGSEEQKSSVQNNKKKMKKLK

SEQ ID NO: 3243646 - protein, 14 aa, Plasmodium falciparum
QGSKPGEGGELPGY

SEQ ID NO: 3243647 - protein, 5 aa, Plasmodium falciparum
QGSQC

SEQ ID NO: 3243648 - protein, 11 aa, Plasmodium falciparum
QGSRSEEESKC

SEQ ID NO: 3243649 - protein, 15 aa, Plasmodium falciparum
QGSTTEEVVEEDGSA

SEQ ID NO: 3243650 - protein, 4 aa, Plasmodium falciparum
QGSV

SEQ ID NO: 3243651 - protein, 4 aa, Plasmodium falciparum
QGSY

SEQ ID NO: 3243652 - protein, 7 aa, Plasmodium falciparum
QGTCDTA

SEQ ID NO: 3243653 - protein, 9 aa, Plasmodium falciparum
QGTKETNDL

SEQ ID NO: 3243654 - protein, 8 aa, Plasmodium falciparum
QGTNISKE

SEQ ID NO: 3243655 - protein, 18 aa, Plasmodium falciparum
QGVDTANDTWATATTPTT

SEQ ID NO: 3243656 - protein, 5 aa, Plasmodium falciparum
QGVGN

SEQ ID NO: 3243657 - protein, 10 aa, Plasmodium falciparum
QGYNKNSKQF

SEQ ID NO: 3243658 - protein, 7 aa, Plasmodium falciparum
QGYRTER

SEQ ID NO: 3243659 - protein, 5 aa, Plasmodium falciparum
QGYST

SEQ ID NO: 3243660 - protein, 12 aa, Plasmodium falciparum
QGYTHEKNSTCN

SEQ ID NO: 3243661 - protein, 7 aa, Plasmodium falciparum
QGYTNYN

SEQ ID NO: 3243662 - protein, 9 aa, Plasmodium falciparum
QHAKDNTHI

SEQ ID NO: 3243663 - protein, 5 aa, Plasmodium falciparum
QHDKN

SEQ ID NO: 3243664 - protein, 10 aa, Plasmodium falciparum
QHDNENHTIT

SEQ ID NO: 3243665 - protein, 5 aa, Plasmodium falciparum
QHDNK

SEQ ID NO: 3243666 - protein, 11 aa, Plasmodium falciparum
QHDSRKKNKKN

SEQ ID NO: 3243667 - protein, 8 aa, Plasmodium falciparum
QHDSSGNY

SEQ ID NO: 3243668 - protein, 22 aa, Plasmodium falciparum
QHDSVNHNNYNNNNDDDDATIK

SEQ ID NO: 3243669 - protein, 5 aa, Plasmodium falciparum
QHENI

SEQ ID NO: 3243670 - protein, 5 aa, Plasmodium falciparum
QHENN

SEQ ID NO: 3243671 - protein, 4 aa, Plasmodium falciparum
QHEV

SEQ ID NO: 3243672 - protein, 6 aa, Plasmodium falciparum
QHGGIQ

SEQ ID NO: 3243673 - protein, 5 aa, Plasmodium falciparum
QHISD

SEQ ID NO: 3243674 - protein, 10 aa, Plasmodium falciparum
QHKATKGKEC

SEQ ID NO: 3243675 - protein, 29 aa, Plasmodium falciparum
QHKKKKSTIISSDNNNNNNNNAEDDISSR

SEQ ID NO: 3243676 - protein, 10 aa, Plasmodium falciparum
QHKNKKKIKK

SEQ ID NO: 3243677 - protein, 9 aa, Plasmodium falciparum
QHKNYKKQY

SEQ ID NO: 3243678 - protein, 8 aa, Plasmodium falciparum
QHNDTIKE

SEQ ID NO: 3243679 - protein, 7 aa, Plasmodium falciparum
QHNENKN

SEQ ID NO: 3243680 - protein, 12 aa, Plasmodium falciparum
QHNKPKEEKKYE

SEQ ID NO: 3243681 - protein, 12 aa, Plasmodium falciparum
QHNNKYKNKHNN

SEQ ID NO: 3243682 - protein, 12 aa, Plasmodium falciparum
QHQKEEQQHKVD

SEQ ID NO: 3243683 - protein, 10 aa, Plasmodium falciparum
QHSTLQNESQ

SEQ ID NO: 3243684 - protein, 10 aa, Plasmodium falciparum
QHSYDDTVSE

SEQ ID NO: 3243685 - protein, 16 aa, Plasmodium falciparum
QHTNKKKNTTSYKSKE

SEQ ID NO: 3243686 - protein, 39 aa, Plasmodium falciparum
QHTTNKNVNDPNQQHKHDKDDSYDNTYEQMKNNKNKIYP

SEQ ID NO: 3243687 - protein, 6 aa, Plasmodium falciparum
QHYNQQ

SEQ ID NO: 3243688 - protein, 7 aa, Plasmodium falciparum
QIDDSHK

SEQ ID NO: 3243689 - protein, 4 aa, Plasmodium falciparum
QIDS

SEQ ID NO: 3243690 - protein, 48 aa, Plasmodium falciparum
QIEDEYDYDDNDDEFDVSEEGDMENRNYYNDNNELKSKGHYGNSKNIR

SEQ ID NO: 3243691 - protein, 9 aa, Plasmodium falciparum
QIEDTQRKN

SEQ ID NO: 3243692 - protein, 13 aa, Plasmodium falciparum
QIEEGNDKEIEEE

SEQ ID NO: 3243693 - protein, 13 aa, Plasmodium falciparum
QIEKENNKEIKEL

SEQ ID NO: 3243694 - protein, 6 aa, Plasmodium falciparum
QIEKTQ

SEQ ID NO: 3243695 - protein, 12 aa, Plasmodium falciparum
QIENDKKQKEDI

SEQ ID NO: 3243696 - protein, 5 aa, Plasmodium falciparum
QIENE

SEQ ID NO: 3243697 - protein, 25 aa, Plasmodium falciparum
QIENKNKKKTHHQNDDNNREEGHNG

SEQ ID NO: 3243698 - protein, 5 aa, Plasmodium falciparum
QIEQT

SEQ ID NO: 3243699 - protein, 10 aa, Plasmodium falciparum
QIESKKKKTQ

SEQ ID NO: 3243700 - protein, 6 aa, Plasmodium falciparum
QIGDNK

SEQ ID NO: 3243701 - protein, 6 aa, Plasmodium falciparum
QIGTNK

SEQ ID NO: 3243702 - protein, 21 aa, Plasmodium falciparum
QIKGPHQNYNSAKNNNDNKND

SEQ ID NO: 3243703 - protein, 9 aa, Plasmodium falciparum
QIKKKENIH

SEQ ID NO: 3243704 - protein, 13 aa, Plasmodium falciparum
QIKKKSNNTYNTC

SEQ ID NO: 3243705 - protein, 5 aa, Plasmodium falciparum
QIKNQ

SEQ ID NO: 3243706 - protein, 5 aa, Plasmodium falciparum
QIKSQ

SEQ ID NO: 3243707 - protein, 13 aa, Plasmodium falciparum
QILNGKKNKSIEY

SEQ ID NO: 3243708 - protein, 25 aa, Plasmodium falciparum
QINDNDNDDDVDEDDCSLNKNKKQN

SEQ ID NO: 3243709 - protein, 15 aa, Plasmodium falciparum
QINDNSTGTQNNNNI

SEQ ID NO: 3243710 - protein, 101 aa, Plasmodium falciparum
QINEENSKKGVRISGTDMENKNDMENKNDMEKKNDMEKKNDIEKKNDMEKKNDMEKKNDMEKKNDMEKKNDMENENNMENKSDIENENKMNEYKNNMKNEN

SEQ ID NO: 3243711 - protein, 6 aa, Plasmodium falciparum
QINEKQ

SEQ ID NO: 3243712 - protein, 7 aa, Plasmodium falciparum
QINEKTS

SEQ ID NO: 3243713 - protein, 13 aa, Plasmodium falciparum
QINGGERNHTSNI

SEQ ID NO: 3243714 - protein, 13 aa, Plasmodium falciparum
QINKEHTNINNKI

SEQ ID NO: 3243715 - protein, 11 aa, Plasmodium falciparum
QINKQKSSSFL

SEQ ID NO: 3243716 - protein, 7 aa, Plasmodium falciparum
QINKQND

SEQ ID NO: 3243717 - protein, 4 aa, Plasmodium falciparum
QINN

SEQ ID NO: 3243718 - protein, 5 aa, Plasmodium falciparum
QINND

SEQ ID NO: 3243719 - protein, 14 aa, Plasmodium falciparum
QINNNNSNNDISDK

SEQ ID NO: 3243720 - protein, 6 aa, Plasmodium falciparum
QINPYK

SEQ ID NO: 3243721 - protein, 5 aa, Plasmodium falciparum
QINQE

SEQ ID NO: 3243722 - protein, 5 aa, Plasmodium falciparum
QINSN

SEQ ID NO: 3243723 - protein, 12 aa, Plasmodium falciparum
QIPDKNKNNDTM

SEQ ID NO: 3243724 - protein, 12 aa, Plasmodium falciparum
QIPSTSPNNLEQ

SEQ ID NO: 3243725 - protein, 11 aa, Plasmodium falciparum
QIPSVSQPKQY

SEQ ID NO: 3243726 - protein, 11 aa, Plasmodium falciparum
QIPTGSAKPPF

SEQ ID NO: 3243727 - protein, 8 aa, Plasmodium falciparum
QIRDRDDR

SEQ ID NO: 3243728 - protein, 10 aa, Plasmodium falciparum
QIRNSNNNEL

SEQ ID NO: 3243729 - protein, 4 aa, Plasmodium falciparum
QISD

SEQ ID NO: 3243730 - protein, 12 aa, Plasmodium falciparum
QISQENYEHENK

SEQ ID NO: 3243731 - protein, 6 aa, Plasmodium falciparum
QISSVD

SEQ ID NO: 3243732 - protein, 10 aa, Plasmodium falciparum
QISVKGKTHE

SEQ ID NO: 3243733 - protein, 11 aa, Plasmodium falciparum
QITYDEKRTEI

SEQ ID NO: 3243734 - protein, 17 aa, Plasmodium falciparum
QKAGDAAGVAAGEAAGK

SEQ ID NO: 3243735 - protein, 15 aa, Plasmodium falciparum
QKAGEAAGKAAGDIA

SEQ ID NO: 3243736 - protein, 8 aa, Plasmodium falciparum
QKAIEGRK

SEQ ID NO: 3243737 - protein, 8 aa, Plasmodium falciparum
QKAKEQSS

SEQ ID NO: 3243738 - protein, 10 aa, Plasmodium falciparum
QKANGDNNFG

SEQ ID NO: 3243739 - protein, 47 aa, Plasmodium falciparum
QKANRKKTSQKKKTEDNKGEDKQIDDKYHKGRRKKQIDQQNDATYNN

SEQ ID NO: 3243740 - protein, 41 aa, Plasmodium falciparum
QKATSCQEQHSDVDPKTSCETSSPVEDEDDTLDEETEVKAP

SEQ ID NO: 3243741 - protein, 4 aa, Plasmodium falciparum
QKCE

SEQ ID NO: 3243742 - protein, 9 aa, Plasmodium falciparum
QKCKEKCDK

SEQ ID NO: 3243743 - protein, 9 aa, Plasmodium falciparum
QKCKEQCNK

SEQ ID NO: 3243744 - protein, 8 aa, Plasmodium falciparum
QKCKERCD

SEQ ID NO: 3243745 - protein, 14 aa, Plasmodium falciparum
QKCQETQKPQQVDR

SEQ ID NO: 3243746 - protein, 6 aa, Plasmodium falciparum
QKCSDH

SEQ ID NO: 3243747 - protein, 12 aa, Plasmodium falciparum
QKCTNSEKKNKK

SEQ ID NO: 3243748 - protein, 30 aa, Plasmodium falciparum
QKDAQHKVKTYNTKEYKTLKNKKKDENNIK

SEQ ID NO: 3243749 - protein, 8 aa, Plasmodium falciparum
QKDDTYKN

SEQ ID NO: 3243750 - protein, 4 aa, Plasmodium falciparum
QKDE

SEQ ID NO: 3243751 - protein, 9 aa, Plasmodium falciparum
QKDESTHDI

SEQ ID NO: 3243752 - protein, 15 aa, Plasmodium falciparum
QKDEYDNYDDDDNYY

SEQ ID NO: 3243753 - protein, 14 aa, Plasmodium falciparum
QKDEYNNDNNIKKE

SEQ ID NO: 3243754 - protein, 8 aa, Plasmodium falciparum
QKDKGKKK

SEQ ID NO: 3243755 - protein, 8 aa, Plasmodium falciparum
QKDKIKKD

SEQ ID NO: 3243756 - protein, 14 aa, Plasmodium falciparum
QKDKIREYDHTNEQ

SEQ ID NO: 3243757 - protein, 10 aa, Plasmodium falciparum
QKDNNSLQPE

SEQ ID NO: 3243758 - protein, 13 aa, Plasmodium falciparum
QKDNVKKEETNIE

SEQ ID NO: 3243759 - protein, 8 aa, Plasmodium falciparum
QKDPNISP

SEQ ID NO: 3243760 - protein, 10 aa, Plasmodium falciparum
QKDQNTNCTY

SEQ ID NO: 3243761 - protein, 13 aa, Plasmodium falciparum
QKDREDNSSYSYR

SEQ ID NO: 3243762 - protein, 11 aa, Plasmodium falciparum
QKDRKEKEQLQ

SEQ ID NO: 3243763 - protein, 9 aa, Plasmodium falciparum
QKDRTSISY

SEQ ID NO: 3243764 - protein, 11 aa, Plasmodium falciparum
QKDSEIKEYEN

SEQ ID NO: 3243765 - protein, 9 aa, Plasmodium falciparum
QKDTGFSPG

SEQ ID NO: 3243766 - protein, 7 aa, Plasmodium falciparum
QKDTKNA

SEQ ID NO: 3243767 - protein, 9 aa, Plasmodium falciparum
QKDTQNKNI

SEQ ID NO: 3243768 - protein, 8 aa, Plasmodium falciparum
QKDTTMNN

SEQ ID NO: 3243769 - protein, 8 aa, Plasmodium falciparum
QKDTVPPN

SEQ ID NO: 3243770 - protein, 4 aa, Plasmodium falciparum
QKEA

SEQ ID NO: 3243771 - protein, 6 aa, Plasmodium falciparum
QKEAIT

SEQ ID NO: 3243772 - protein, 33 aa, Plasmodium falciparum
QKEAQNCKENNPDKCENTPGVRSQTPPANQDDV

SEQ ID NO: 3243773 - protein, 6 aa, Plasmodium falciparum
QKEAYD

SEQ ID NO: 3243774 - protein, 19 aa, Plasmodium falciparum
QKECKNHPEVKGKNSIDFK

SEQ ID NO: 3243775 - protein, 37 aa, Plasmodium falciparum
QKEDDGNKEEKNEKHISDKNEEYISAQETKNPKEENI

SEQ ID NO: 3243776 - protein, 5 aa, Plasmodium falciparum
QKEDE

SEQ ID NO: 3243777 - protein, 7 aa, Plasmodium falciparum
QKEDEIN

SEQ ID NO: 3243778 - protein, 6 aa, Plasmodium falciparum
QKEDIQ

SEQ ID NO: 3243779 - protein, 9 aa, Plasmodium falciparum
QKEDKEKKI

SEQ ID NO: 3243780 - protein, 7 aa, Plasmodium falciparum
QKEDQNT

SEQ ID NO: 3243781 - protein, 16 aa, Plasmodium falciparum
QKEEESMKKKKKKKAI

SEQ ID NO: 3243782 - protein, 5 aa, Plasmodium falciparum
QKEEY

SEQ ID NO: 3243783 - protein, 8 aa, Plasmodium falciparum
QKEEYTKD

SEQ ID NO: 3243784 - protein, 46 aa, Plasmodium falciparum
QKEGEQSGSNINNNDDDDNDDNDNYSNSNNYSNSNSNNYSHTKSAT

SEQ ID NO: 3243785 - protein, 8 aa, Plasmodium falciparum
QKEGSFNE

SEQ ID NO: 3243786 - protein, 11 aa, Plasmodium falciparum
QKEHGTECGSA

SEQ ID NO: 3243787 - protein, 5 aa, Plasmodium falciparum
QKEIE

SEQ ID NO: 3243788 - protein, 15 aa, Plasmodium falciparum
QKEIKKKKNKSELQN

SEQ ID NO: 3243789 - protein, 4 aa, Plasmodium falciparum
QKEK

SEQ ID NO: 3243790 - protein, 8 aa, Plasmodium falciparum
QKEKDDGL

SEQ ID NO: 3243791 - protein, 9 aa, Plasmodium falciparum
QKEKDHSTI

SEQ ID NO: 3243792 - protein, 25 aa, Plasmodium falciparum
QKEKEKEEKEYKNKQRNKKNDHNET

SEQ ID NO: 3243793 - protein, 6 aa, Plasmodium falciparum
QKEKKK

SEQ ID NO: 3243794 - protein, 8 aa, Plasmodium falciparum
QKEKKRGG

SEQ ID NO: 3243795 - protein, 5 aa, Plasmodium falciparum
QKEKN

SEQ ID NO: 3243796 - protein, 20 aa, Plasmodium falciparum
QKEKQKMDKSDNNSSNKGNV

SEQ ID NO: 3243797 - protein, 7 aa, Plasmodium falciparum
QKEKYTN

SEQ ID NO: 3243798 - protein, 4 aa, Plasmodium falciparum
QKEN

SEQ ID NO: 3243799 - protein, 14 aa, Plasmodium falciparum
QKENDTNNQYDEED

SEQ ID NO: 3243800 - protein, 21 aa, Plasmodium falciparum
QKENHIEKKQNYSTDMQNQEQ

SEQ ID NO: 3243801 - protein, 8 aa, Plasmodium falciparum
QKENTENG

SEQ ID NO: 3243802 - protein, 12 aa, Plasmodium falciparum
QKENTNEEHNNK

SEQ ID NO: 3243803 - protein, 43 aa, Plasmodium falciparum
QKENTNKNIKKGKNIKKEKKKKKEKNIKKEKKKKKKETKKFNN

SEQ ID NO: 3243804 - protein, 4 aa, Plasmodium falciparum
QKEQ

SEQ ID NO: 3243805 - protein, 6 aa, Plasmodium falciparum
QKERER

SEQ ID NO: 3243806 - protein, 7 aa, Plasmodium falciparum
QKERKIK

SEQ ID NO: 3243807 - protein, 8 aa, Plasmodium falciparum
QKERTYDK

SEQ ID NO: 3243808 - protein, 8 aa, Plasmodium falciparum
QKESYDKN

SEQ ID NO: 3243809 - protein, 10 aa, Plasmodium falciparum
QKETSPDEEE

SEQ ID NO: 3243810 - protein, 9 aa, Plasmodium falciparum
QKEYTDPYT

SEQ ID NO: 3243811 - protein, 9 aa, Plasmodium falciparum
QKGDNNKCD

SEQ ID NO: 3243812 - protein, 8 aa, Plasmodium falciparum
QKGEYTER

SEQ ID NO: 3243813 - protein, 7 aa, Plasmodium falciparum
QKGIDAG

SEQ ID NO: 3243814 - protein, 6 aa, Plasmodium falciparum
QKGIQA

SEQ ID NO: 3243815 - protein, 9 aa, Plasmodium falciparum
QKGNKKLNR

SEQ ID NO: 3243816 - protein, 9 aa, Plasmodium falciparum
QKGNLSEAR

SEQ ID NO: 3243817 - protein, 20 aa, Plasmodium falciparum
QKGNTKKIKKNDDSDYSNAD

SEQ ID NO: 3243818 - protein, 4 aa, Plasmodium falciparum
QKGQ

SEQ ID NO: 3243819 - protein, 4 aa, Plasmodium falciparum
QKGR

SEQ ID NO: 3243820 - protein, 8 aa, Plasmodium falciparum
QKGRKDLS

SEQ ID NO: 3243821 - protein, 20 aa, Plasmodium falciparum
QKGYMENNEKNSEKNNEINN

SEQ ID NO: 3243822 - protein, 7 aa, Plasmodium falciparum
QKHKKHK

SEQ ID NO: 3243823 - protein, 4 aa, Plasmodium falciparum
QKHN

SEQ ID NO: 3243824 - protein, 25 aa, Plasmodium falciparum
QKHPQPSANNCTTSPTSDTPPDDEE

SEQ ID NO: 3243825 - protein, 22 aa, Plasmodium falciparum
QKIESESGGEGQVRSRRRRDTP

SEQ ID NO: 3243826 - protein, 5 aa, Plasmodium falciparum
QKIGY

SEQ ID NO: 3243827 - protein, 12 aa, Plasmodium falciparum
QKIKEDNKRINK

SEQ ID NO: 3243828 - protein, 4 aa, Plasmodium falciparum
QKIN

SEQ ID NO: 3243829 - protein, 6 aa, Plasmodium falciparum
QKINDH

SEQ ID NO: 3243830 - protein, 21 aa, Plasmodium falciparum
QKINKKKIKDDINNKIEDDIN

SEQ ID NO: 3243831 - protein, 4 aa, Plasmodium falciparum
QKIR

SEQ ID NO: 3243832 - protein, 8 aa, Plasmodium falciparum
QKIRKSNE

SEQ ID NO: 3243833 - protein, 7 aa, Plasmodium falciparum
QKIYNQN

SEQ ID NO: 3243834 - protein, 12 aa, Plasmodium falciparum
QKKCSHSTTKTR

SEQ ID NO: 3243835 - protein, 4 aa, Plasmodium falciparum
QKKD

SEQ ID NO: 3243836 - protein, 5 aa, Plasmodium falciparum
QKKDE

SEQ ID NO: 3243837 - protein, 10 aa, Plasmodium falciparum
QKKDSSKVKH

SEQ ID NO: 3243838 - protein, 13 aa, Plasmodium falciparum
QKKEKEKRKEKYP

SEQ ID NO: 3243839 - protein, 8 aa, Plasmodium falciparum
QKKEKEWD

SEQ ID NO: 3243840 - protein, 8 aa, Plasmodium falciparum
QKKEKEWE

SEQ ID NO: 3243841 - protein, 8 aa, Plasmodium falciparum
QKKEKEWK

SEQ ID NO: 3243842 - protein, 24 aa, Plasmodium falciparum
QKKEKYGNSNDKDYNKEDKKKVEQ

SEQ ID NO: 3243843 - protein, 12 aa, Plasmodium falciparum
QKKEQNKNNIKN

SEQ ID NO: 3243844 - protein, 7 aa, Plasmodium falciparum
QKKESRR

SEQ ID NO: 3243845 - protein, 9 aa, Plasmodium falciparum
QKKGSNKKI

SEQ ID NO: 3243846 - protein, 9 aa, Plasmodium falciparum
QKKGYKKKQ

SEQ ID NO: 3243847 - protein, 10 aa, Plasmodium falciparum
QKKGYSTHDM

SEQ ID NO: 3243848 - protein, 10 aa, Plasmodium falciparum
QKKHKKKNYD

SEQ ID NO: 3243849 - protein, 14 aa, Plasmodium falciparum
QKKKDNVNKNIKDN

SEQ ID NO: 3243850 - protein, 19 aa, Plasmodium falciparum
QKKKEEGKEKKSEKEPEQF

SEQ ID NO: 3243851 - protein, 8 aa, Plasmodium falciparum
QKKKEETI

SEQ ID NO: 3243852 - protein, 10 aa, Plasmodium falciparum
QKKKEKETYE

SEQ ID NO: 3243853 - protein, 18 aa, Plasmodium falciparum
QKKKEKSDPKSQNEPEQF

SEQ ID NO: 3243854 - protein, 5 aa, Plasmodium falciparum
QKKKK

SEQ ID NO: 3243855 - protein, 10 aa, Plasmodium falciparum
QKKKKDIKYN

SEQ ID NO: 3243856 - protein, 23 aa, Plasmodium falciparum
QKKKKKKKYNNNNDNNNNNNNNN

SEQ ID NO: 3243857 - protein, 27 aa, Plasmodium falciparum
QKKKKKNTNIDEDKKKTTESSTYTEKY

SEQ ID NO: 3243858 - protein, 22 aa, Plasmodium falciparum
QKKKKNSKNSKNKKNKKNKKIP

SEQ ID NO: 3243859 - protein, 9 aa, Plasmodium falciparum
QKKKKTNNN

SEQ ID NO: 3243860 - protein, 15 aa, Plasmodium falciparum
QKKKPKKTDNGSDYT

SEQ ID NO: 3243861 - protein, 18 aa, Plasmodium falciparum
QKKKQNKKKKNEQNKDNI

SEQ ID NO: 3243862 - protein, 9 aa, Plasmodium falciparum
QKKKSDEAQ

SEQ ID NO: 3243863 - protein, 4 aa, Plasmodium falciparum
QKKN

SEQ ID NO: 3243864 - protein, 8 aa, Plasmodium falciparum
QKKNGKLS

SEQ ID NO: 3243865 - protein, 10 aa, Plasmodium falciparum
QKKNHTKQSI

SEQ ID NO: 3243866 - protein, 5 aa, Plasmodium falciparum
QKKNI

SEQ ID NO: 3243867 - protein, 8 aa, Plasmodium falciparum
QKKNISND

SEQ ID NO: 3243868 - protein, 25 aa, Plasmodium falciparum
QKKNISNINENKDKHLNKNNNSKDH

SEQ ID NO: 3243869 - protein, 20 aa, Plasmodium falciparum
QKKNKEEGANTSEKDHDEIQ

SEQ ID NO: 3243870 - protein, 8 aa, Plasmodium falciparum
QKKNKKKP

SEQ ID NO: 3243871 - protein, 63 aa, Plasmodium falciparum
QKKNNDSDTNTDNYVSSSEYDTDSDYDYGYDSNSDGDSKSNSNFDSKSDNISGSDNNMSTTTY

SEQ ID NO: 3243872 - protein, 18 aa, Plasmodium falciparum
QKKNNKINEEKYKGTHGT

SEQ ID NO: 3243873 - protein, 17 aa, Plasmodium falciparum
QKKNNSDLGYRKDGALD

SEQ ID NO: 3243874 - protein, 23 aa, Plasmodium falciparum
QKKNYSESQESKENNKKIKKKNH

SEQ ID NO: 3243875 - protein, 9 aa, Plasmodium falciparum
QKKQKKNNY

SEQ ID NO: 3243876 - protein, 9 aa, Plasmodium falciparum
QKKQQNEPL

SEQ ID NO: 3243877 - protein, 13 aa, Plasmodium falciparum
QKKRDTNKYNNKR

SEQ ID NO: 3243878 - protein, 8 aa, Plasmodium falciparum
QKKREKQI

SEQ ID NO: 3243879 - protein, 7 aa, Plasmodium falciparum
QKKRKNI

SEQ ID NO: 3243880 - protein, 9 aa, Plasmodium falciparum
QKKRNNQNL

SEQ ID NO: 3243881 - protein, 13 aa, Plasmodium falciparum
QKKSDQNKKTKKY

SEQ ID NO: 3243882 - protein, 5 aa, Plasmodium falciparum
QKKSI

SEQ ID NO: 3243883 - protein, 5 aa, Plasmodium falciparum
QKKSN

SEQ ID NO: 3243884 - protein, 11 aa, Plasmodium falciparum
QKKTKEKKKNL

SEQ ID NO: 3243885 - protein, 16 aa, Plasmodium falciparum
QKKYNKDHSSKQKEDI

SEQ ID NO: 3243886 - protein, 6 aa, Plasmodium falciparum
QKLDSE

SEQ ID NO: 3243887 - protein, 9 aa, Plasmodium falciparum
QKLKENKNQ

SEQ ID NO: 3243888 - protein, 15 aa, Plasmodium falciparum
QKLKNNDTTTNNNIN

SEQ ID NO: 3243889 - protein, 9 aa, Plasmodium falciparum
QKLKSKQRY

SEQ ID NO: 3243890 - protein, 7 aa, Plasmodium falciparum
QKLNNEE

SEQ ID NO: 3243891 - protein, 7 aa, Plasmodium falciparum
QKLPRNK

SEQ ID NO: 3243892 - protein, 14 aa, Plasmodium falciparum
QKLYGENEETTYGY

SEQ ID NO: 3243893 - protein, 12 aa, Plasmodium falciparum
QKMEENGSDDGL

SEQ ID NO: 3243894 - protein, 6 aa, Plasmodium falciparum
QKMNTN

SEQ ID NO: 3243895 - protein, 4 aa, Plasmodium falciparum
QKNA

SEQ ID NO: 3243896 - protein, 4 aa, Plasmodium falciparum
QKND

SEQ ID NO: 3243897 - protein, 10 aa, Plasmodium falciparum
QKNDENKCPN

SEQ ID NO: 3243898 - protein, 22 aa, Plasmodium falciparum
QKNDQSNNYNNNNNFDDNDDDD

SEQ ID NO: 3243899 - protein, 6 aa, Plasmodium falciparum
QKNEEK

SEQ ID NO: 3243900 - protein, 11 aa, Plasmodium falciparum
QKNEKEGTNTI

SEQ ID NO: 3243901 - protein, 13 aa, Plasmodium falciparum
QKNENSKQTYTSK

SEQ ID NO: 3243902 - protein, 10 aa, Plasmodium falciparum
QKNEQKEKNI

SEQ ID NO: 3243903 - protein, 4 aa, Plasmodium falciparum
QKNI

SEQ ID NO: 3243904 - protein, 21 aa, Plasmodium falciparum
QKNIPYAQKGEDKIYEREQNS

SEQ ID NO: 3243905 - protein, 7 aa, Plasmodium falciparum
QKNIQEY

SEQ ID NO: 3243906 - protein, 7 aa, Plasmodium falciparum
QKNKEIK

SEQ ID NO: 3243907 - protein, 20 aa, Plasmodium falciparum
QKNKKCSFSQSENMDNEEEQ

SEQ ID NO: 3243908 - protein, 5 aa, Plasmodium falciparum
QKNKN

SEQ ID NO: 3243909 - protein, 12 aa, Plasmodium falciparum
QKNKNKKNDSFQ

SEQ ID NO: 3243910 - protein, 12 aa, Plasmodium falciparum
QKNKNKNKKNDI

SEQ ID NO: 3243911 - protein, 6 aa, Plasmodium falciparum
QKNKQK

SEQ ID NO: 3243912 - protein, 9 aa, Plasmodium falciparum
QKNKYEEDN

SEQ ID NO: 3243913 - protein, 11 aa, Plasmodium falciparum
QKNLEEKENKI

SEQ ID NO: 3243914 - protein, 5 aa, Plasmodium falciparum
QKNND

SEQ ID NO: 3243915 - protein, 10 aa, Plasmodium falciparum
QKNNDEPKTL

SEQ ID NO: 3243916 - protein, 6 aa, Plasmodium falciparum
QKNNIT

SEQ ID NO: 3243917 - protein, 5 aa, Plasmodium falciparum
QKNNN

SEQ ID NO: 3243918 - protein, 12 aa, Plasmodium falciparum
QKNNNDKDDKVK

SEQ ID NO: 3243919 - protein, 7 aa, Plasmodium falciparum
QKNNNKK

SEQ ID NO: 3243920 - protein, 17 aa, Plasmodium falciparum
QKNPNNDGSFNIQFKQN

SEQ ID NO: 3243921 - protein, 8 aa, Plasmodium falciparum
QKNQEEAK

SEQ ID NO: 3243922 - protein, 6 aa, Plasmodium falciparum
QKNQIN

SEQ ID NO: 3243923 - protein, 23 aa, Plasmodium falciparum
QKNQKKLKNQKNQKNFKRKNNQK

SEQ ID NO: 3243924 - protein, 10 aa, Plasmodium falciparum
QKNQKRNKIK

SEQ ID NO: 3243925 - protein, 8 aa, Plasmodium falciparum
QKNRNPVN

SEQ ID NO: 3243926 - protein, 4 aa, Plasmodium falciparum
QKNS

SEQ ID NO: 3243927 - protein, 32 aa, Plasmodium falciparum
QKNSDIPTDQKNINDHDKNRSSDKSHNNNNSN

SEQ ID NO: 3243928 - protein, 12 aa, Plasmodium falciparum
QKNSKDVPPSYN

SEQ ID NO: 3243929 - protein, 7 aa, Plasmodium falciparum
QKNSQIA

SEQ ID NO: 3243930 - protein, 4 aa, Plasmodium falciparum
QKNT

SEQ ID NO: 3243931 - protein, 8 aa, Plasmodium falciparum
QKNTNNNI

SEQ ID NO: 3243932 - protein, 8 aa, Plasmodium falciparum
QKNTRTNK

SEQ ID NO: 3243933 - protein, 4 aa, Plasmodium falciparum
QKNV

SEQ ID NO: 3243934 - protein, 9 aa, Plasmodium falciparum
QKNVQQPTC

SEQ ID NO: 3243935 - protein, 14 aa, Plasmodium falciparum
QKNYEQEKKKKKKN

SEQ ID NO: 3243936 - protein, 9 aa, Plasmodium falciparum
QKPHTTARH

SEQ ID NO: 3243937 - protein, 5 aa, Plasmodium falciparum
QKPKE

SEQ ID NO: 3243938 - protein, 9 aa, Plasmodium falciparum
QKPKGIEDT

SEQ ID NO: 3243939 - protein, 9 aa, Plasmodium falciparum
QKPPNVEDD

SEQ ID NO: 3243940 - protein, 7 aa, Plasmodium falciparum
QKPVTEE

SEQ ID NO: 3243941 - protein, 4 aa, Plasmodium falciparum
QKPY

SEQ ID NO: 3243942 - protein, 10 aa, Plasmodium falciparum
QKQEKRNKNT

SEQ ID NO: 3243943 - protein, 4 aa, Plasmodium falciparum
QKQI

SEQ ID NO: 3243944 - protein, 53 aa, Plasmodium falciparum
QKQITGTSSTSSPGNTTVNTAQSATHSNSQNQQSNASSTNTQNGVAVSSGPAV

SEQ ID NO: 3243945 - protein, 9 aa, Plasmodium falciparum
QKQKEDEQI

SEQ ID NO: 3243946 - protein, 41 aa, Plasmodium falciparum
QKQKELEEAERRKKKLDDEQKRQKDLEDTNRKENDEEQSYK

SEQ ID NO: 3243947 - protein, 6 aa, Plasmodium falciparum
QKQKIT

SEQ ID NO: 3243948 - protein, 7 aa, Plasmodium falciparum
QKQKKKD

SEQ ID NO: 3243949 - protein, 8 aa, Plasmodium falciparum
QKQKKTKN

SEQ ID NO: 3243950 - protein, 58 aa, Plasmodium falciparum
QKQKQEQKQEKKQEQKQEKKQEQKQEKKQEQKQEKKQEKKQEKKQEQKQEKKQEKKQY

SEQ ID NO: 3243951 - protein, 18 aa, Plasmodium falciparum
QKQKRESKDKEDLQNNKN

SEQ ID NO: 3243952 - protein, 10 aa, Plasmodium falciparum
QKQNGYKKTT

SEQ ID NO: 3243953 - protein, 10 aa, Plasmodium falciparum
QKQNKKQNQN

SEQ ID NO: 3243954 - protein, 7 aa, Plasmodium falciparum
QKQPQRI

SEQ ID NO: 3243955 - protein, 116 aa, Plasmodium falciparum
QKQSSDHKKESFKIDTKKNDQIEQNYQNGKNEKNEENEKNGMNEQNGKNEQNGKNEQNGKNEQNEQNDQIEQNYQNDPNDQNDQNDQNEKNDQNEKNDQNKKNEQNIGPKKTNEIS

SEQ ID NO: 3243956 - protein, 11 aa, Plasmodium falciparum
QKQSTKECKEA

SEQ ID NO: 3243957 - protein, 18 aa, Plasmodium falciparum
QKQTKTFDNSSNSNDSLG

SEQ ID NO: 3243958 - protein, 4 aa, Plasmodium falciparum
QKQY

SEQ ID NO: 3243959 - protein, 6 aa, Plasmodium falciparum
QKREYN

SEQ ID NO: 3243960 - protein, 4 aa, Plasmodium falciparum
QKRF

SEQ ID NO: 3243961 - protein, 72 aa, Plasmodium falciparum
QKRGKIRKRGEEVGEEEEEEDEEEEDEEDEYEEEDEYEQEDEYDEEDEYDEEDEYDEEEEEEEGRRRKKSYR

SEQ ID NO: 3243962 - protein, 16 aa, Plasmodium falciparum
QKRISEKTDTLKDKNS

SEQ ID NO: 3243963 - protein, 4 aa, Plasmodium falciparum
QKRN

SEQ ID NO: 3243964 - protein, 4 aa, Plasmodium falciparum
QKRY

SEQ ID NO: 3243965 - protein, 12 aa, Plasmodium falciparum
QKSAIKNINFFI

SEQ ID NO: 3243966 - protein, 6 aa, Plasmodium falciparum
QKSDEC

SEQ ID NO: 3243967 - protein, 16 aa, Plasmodium falciparum
QKSDRNNNINVSNNPN

SEQ ID NO: 3243968 - protein, 8 aa, Plasmodium falciparum
QKSEENNY

SEQ ID NO: 3243969 - protein, 7 aa, Plasmodium falciparum
QKSIREN

SEQ ID NO: 3243970 - protein, 9 aa, Plasmodium falciparum
QKSLEEKVE

SEQ ID NO: 3243971 - protein, 7 aa, Plasmodium falciparum
QKSLSSA

SEQ ID NO: 3243972 - protein, 10 aa, Plasmodium falciparum
QKSPDNKNSY

SEQ ID NO: 3243973 - protein, 11 aa, Plasmodium falciparum
QKSSKNKAFKK

SEQ ID NO: 3243974 - protein, 7 aa, Plasmodium falciparum
QKSTKSM

SEQ ID NO: 3243975 - protein, 20 aa, Plasmodium falciparum
QKTDANEYTKDNNNNNNNNL

SEQ ID NO: 3243976 - protein, 7 aa, Plasmodium falciparum
QKTGKCK

SEQ ID NO: 3243977 - protein, 8 aa, Plasmodium falciparum
QKTHNPYE

SEQ ID NO: 3243978 - protein, 8 aa, Plasmodium falciparum
QKTHNPYK

SEQ ID NO: 3243979 - protein, 10 aa, Plasmodium falciparum
QKTKQNKNVK

SEQ ID NO: 3243980 - protein, 8 aa, Plasmodium falciparum
QKTKRKNI

SEQ ID NO: 3243981 - protein, 10 aa, Plasmodium falciparum
QKTNNNSKAF

SEQ ID NO: 3243982 - protein, 9 aa, Plasmodium falciparum
QKTNTEDNN

SEQ ID NO: 3243983 - protein, 11 aa, Plasmodium falciparum
QKTSNKSNNKY

SEQ ID NO: 3243984 - protein, 6 aa, Plasmodium falciparum
QKTVEG

SEQ ID NO: 3243985 - protein, 6 aa, Plasmodium falciparum
QKTYSQ

SEQ ID NO: 3243986 - protein, 5 aa, Plasmodium falciparum
QKVQK

SEQ ID NO: 3243987 - protein, 5 aa, Plasmodium falciparum
QKWSG

SEQ ID NO: 3243988 - protein, 5 aa, Plasmodium falciparum
QKYCE

SEQ ID NO: 3243989 - protein, 8 aa, Plasmodium falciparum
QKYEEKRQ

SEQ ID NO: 3243990 - protein, 7 aa, Plasmodium falciparum
QKYEKEM

SEQ ID NO: 3243991 - protein, 10 aa, Plasmodium falciparum
QKYEKGREKF

SEQ ID NO: 3243992 - protein, 12 aa, Plasmodium falciparum
QKYENNQSIEKD

SEQ ID NO: 3243993 - protein, 40 aa, Plasmodium falciparum
QKYETEISNSGSCGGSGGVKGRNRKKRGAGVETATNYDGY

SEQ ID NO: 3243994 - protein, 10 aa, Plasmodium falciparum
QKYGPKAPTG

SEQ ID NO: 3243995 - protein, 5 aa, Plasmodium falciparum
QKYIE

SEQ ID NO: 3243996 - protein, 9 aa, Plasmodium falciparum
QKYKEQCEK

SEQ ID NO: 3243997 - protein, 10 aa, Plasmodium falciparum
QKYKEQRDKD

SEQ ID NO: 3243998 - protein, 10 aa, Plasmodium falciparum
QKYNEQRDKD

SEQ ID NO: 3243999 - protein, 12 aa, Plasmodium falciparum
QKYNNKYNTYNN

SEQ ID NO: 3244000 - protein, 4 aa, Plasmodium falciparum
QKYS

SEQ ID NO: 3244001 - protein, 7 aa, Plasmodium falciparum
QKYSAKT

SEQ ID NO: 3244002 - protein, 8 aa, Plasmodium falciparum
QKYSAPNR

SEQ ID NO: 3244003 - protein, 4 aa, Plasmodium falciparum
QKYT

SEQ ID NO: 3244004 - protein, 7 aa, Plasmodium falciparum
QKYYTSR

SEQ ID NO: 3244005 - protein, 14 aa, Plasmodium falciparum
QLDGDDDDDDDNKN

SEQ ID NO: 3244006 - protein, 13 aa, Plasmodium falciparum
QLDTGDHGGYSLD

SEQ ID NO: 3244007 - protein, 15 aa, Plasmodium falciparum
QLEDNDDDDEEMHNT

SEQ ID NO: 3244008 - protein, 7 aa, Plasmodium falciparum
QLEGEEN

SEQ ID NO: 3244009 - protein, 5 aa, Plasmodium falciparum
QLEGK

SEQ ID NO: 3244010 - protein, 13 aa, Plasmodium falciparum
QLEKNEKNIETKD

SEQ ID NO: 3244011 - protein, 12 aa, Plasmodium falciparum
QLGNSSDITNGS

SEQ ID NO: 3244012 - protein, 10 aa, Plasmodium falciparum
QLGSKSLNDD

SEQ ID NO: 3244013 - protein, 11 aa, Plasmodium falciparum
QLKKNDDMSRG

SEQ ID NO: 3244014 - protein, 8 aa, Plasmodium falciparum
QLNKKNKK

SEQ ID NO: 3244015 - protein, 12 aa, Plasmodium falciparum
QLNNKDNTSMSD

SEQ ID NO: 3244016 - protein, 4 aa, Plasmodium falciparum
QLNS

SEQ ID NO: 3244017 - protein, 12 aa, Plasmodium falciparum
QLNTNTKNNTCN

SEQ ID NO: 3244018 - protein, 5 aa, Plasmodium falciparum
QLPKD

SEQ ID NO: 3244019 - protein, 4 aa, Plasmodium falciparum
QLPP

SEQ ID NO: 3244020 - protein, 7 aa, Plasmodium falciparum
QLRKGNK

SEQ ID NO: 3244021 - protein, 27 aa, Plasmodium falciparum
QLRTRGGRNALRANAAEGKYKNNNKEF

SEQ ID NO: 3244022 - protein, 9 aa, Plasmodium falciparum
QLSGDNNLN

SEQ ID NO: 3244023 - protein, 8 aa, Plasmodium falciparum
QLSKKKMN

SEQ ID NO: 3244024 - protein, 5 aa, Plasmodium falciparum
QLTND

SEQ ID NO: 3244025 - protein, 4 aa, Plasmodium falciparum
QLTT

SEQ ID NO: 3244026 - protein, 27 aa, Plasmodium falciparum
QLVNESYNKDQKKNDKEKTKNHNNINN

SEQ ID NO: 3244027 - protein, 5 aa, Plasmodium falciparum
QMDDP

SEQ ID NO: 3244028 - protein, 17 aa, Plasmodium falciparum
QMDEEKNNEKKDENIEG

SEQ ID NO: 3244029 - protein, 11 aa, Plasmodium falciparum
QMDGDDNKNVC

SEQ ID NO: 3244030 - protein, 10 aa, Plasmodium falciparum
QMDKGDDNEN

SEQ ID NO: 3244031 - protein, 4 aa, Plasmodium falciparum
QMGQ

SEQ ID NO: 3244032 - protein, 8 aa, Plasmodium falciparum
QMKQDDDD

SEQ ID NO: 3244033 - protein, 12 aa, Plasmodium falciparum
QMNEDGDKYSDN

SEQ ID NO: 3244034 - protein, 15 aa, Plasmodium falciparum
QMNRNKKDETVGDKN

SEQ ID NO: 3244035 - protein, 6 aa, Plasmodium falciparum
QMQNKE

SEQ ID NO: 3244036 - protein, 4 aa, Plasmodium falciparum
QMRE

SEQ ID NO: 3244037 - protein, 4 aa, Plasmodium falciparum
QMTN

SEQ ID NO: 3244038 - protein, 9 aa, Plasmodium falciparum
QMTNEKNKK

SEQ ID NO: 3244039 - protein, 7 aa, Plasmodium falciparum
QNAEGDT

SEQ ID NO: 3244040 - protein, 7 aa, Plasmodium falciparum
QNASKNY

SEQ ID NO: 3244041 - protein, 21 aa, Plasmodium falciparum
QNATGGVANGSGSGTSGSQKL

SEQ ID NO: 3244042 - protein, 16 aa, Plasmodium falciparum
QNCKRQNKIENKSKRN

SEQ ID NO: 3244043 - protein, 44 aa, Plasmodium falciparum
QNDATNKKMVNDNTKGLSSDNMNSSNDLNAPNKMNEDSKGSSEY

SEQ ID NO: 3244044 - protein, 4 aa, Plasmodium falciparum
QNDC

SEQ ID NO: 3244045 - protein, 31 aa, Plasmodium falciparum
QNDDEKSDKSSSCCTDTNNAKLATTKGKDKY

SEQ ID NO: 3244046 - protein, 10 aa, Plasmodium falciparum
QNDDKDKNKI

SEQ ID NO: 3244047 - protein, 11 aa, Plasmodium falciparum
QNDEEEEMNNR

SEQ ID NO: 3244048 - protein, 11 aa, Plasmodium falciparum
QNDEYSNSIRD

SEQ ID NO: 3244049 - protein, 6 aa, Plasmodium falciparum
QNDGSI

SEQ ID NO: 3244050 - protein, 4 aa, Plasmodium falciparum
QNDH

SEQ ID NO: 3244051 - protein, 16 aa, Plasmodium falciparum
QNDHNNHNKDNNNNNA

SEQ ID NO: 3244052 - protein, 7 aa, Plasmodium falciparum
QNDHPND

SEQ ID NO: 3244053 - protein, 5 aa, Plasmodium falciparum
QNDIL

SEQ ID NO: 3244054 - protein, 4 aa, Plasmodium falciparum
QNDK

SEQ ID NO: 3244055 - protein, 5 aa, Plasmodium falciparum
QNDKN

SEQ ID NO: 3244056 - protein, 6 aa, Plasmodium falciparum
QNDKNN

SEQ ID NO: 3244057 - protein, 7 aa, Plasmodium falciparum
QNDKNNY

SEQ ID NO: 3244058 - protein, 5 aa, Plasmodium falciparum
QNDKS

SEQ ID NO: 3244059 - protein, 6 aa, Plasmodium falciparum
QNDKYN

SEQ ID NO: 3244060 - protein, 7 aa, Plasmodium falciparum
QNDNDNM

SEQ ID NO: 3244061 - protein, 6 aa, Plasmodium falciparum
QNDNFT

SEQ ID NO: 3244062 - protein, 18 aa, Plasmodium falciparum
QNDNIKKKSNRGRKRKKI

SEQ ID NO: 3244063 - protein, 8 aa, Plasmodium falciparum
QNDNINSE

SEQ ID NO: 3244064 - protein, 15 aa, Plasmodium falciparum
QNDNKINVNQNEQEK

SEQ ID NO: 3244065 - protein, 6 aa, Plasmodium falciparum
QNDNNE

SEQ ID NO: 3244066 - protein, 9 aa, Plasmodium falciparum
QNDNTEAIS

SEQ ID NO: 3244067 - protein, 7 aa, Plasmodium falciparum
QNDQKNL

SEQ ID NO: 3244068 - protein, 9 aa, Plasmodium falciparum
QNDQNGNEK

SEQ ID NO: 3244069 - protein, 9 aa, Plasmodium falciparum
QNDTRNNVR

SEQ ID NO: 3244070 - protein, 13 aa, Plasmodium falciparum
QNDTTEQQEEEEN

SEQ ID NO: 3244071 - protein, 12 aa, Plasmodium falciparum
QNDTYDNNNRTS

SEQ ID NO: 3244072 - protein, 10 aa, Plasmodium falciparum
QNDVEKKKKI

SEQ ID NO: 3244073 - protein, 6 aa, Plasmodium falciparum
QNDVLN

SEQ ID NO: 3244074 - protein, 10 aa, Plasmodium falciparum
QNDYDRNTKI

SEQ ID NO: 3244075 - protein, 7 aa, Plasmodium falciparum
QNDYPYS

SEQ ID NO: 3244076 - protein, 77 aa, Plasmodium falciparum
QNECKEQERDGGARSDSQEPTPRSEVKPDSEDLDDDDEDDPDEEKSEEVENPEDQGEEEGTKQGSGEKKVDGTEAVQ

SEQ ID NO: 3244077 - protein, 9 aa, Plasmodium falciparum
QNEDDEYEY

SEQ ID NO: 3244078 - protein, 31 aa, Plasmodium falciparum
QNEDKYNINNNNNNNNKSNCHHNKQNGNKIN

SEQ ID NO: 3244079 - protein, 4 aa, Plasmodium falciparum
QNEE

SEQ ID NO: 3244080 - protein, 8 aa, Plasmodium falciparum
QNEEDISI

SEQ ID NO: 3244081 - protein, 7 aa, Plasmodium falciparum
QNEEERK

SEQ ID NO: 3244082 - protein, 5 aa, Plasmodium falciparum
QNEEK

SEQ ID NO: 3244083 - protein, 18 aa, Plasmodium falciparum
QNEEKDLSSTNNNIKKDN

SEQ ID NO: 3244084 - protein, 37 aa, Plasmodium falciparum
QNEEKKKKKNEQDDVDENINDESINGLEKSDKNISTN

SEQ ID NO: 3244085 - protein, 6 aa, Plasmodium falciparum
QNEEVK

SEQ ID NO: 3244086 - protein, 7 aa, Plasmodium falciparum
QNEGKEN

SEQ ID NO: 3244087 - protein, 4 aa, Plasmodium falciparum
QNEH

SEQ ID NO: 3244088 - protein, 8 aa, Plasmodium falciparum
QNEHKKSK

SEQ ID NO: 3244089 - protein, 5 aa, Plasmodium falciparum
QNEHM

SEQ ID NO: 3244090 - protein, 4 aa, Plasmodium falciparum
QNEI

SEQ ID NO: 3244091 - protein, 5 aa, Plasmodium falciparum
QNEIK

SEQ ID NO: 3244092 - protein, 24 aa, Plasmodium falciparum
QNEKDINNKKKDDDDDNNKKNYYN

SEQ ID NO: 3244093 - protein, 8 aa, Plasmodium falciparum
QNEKDQDY

SEQ ID NO: 3244094 - protein, 19 aa, Plasmodium falciparum
QNEKETLYSNNSYNSDHTS

SEQ ID NO: 3244095 - protein, 9 aa, Plasmodium falciparum
QNEKINEKI

SEQ ID NO: 3244096 - protein, 7 aa, Plasmodium falciparum
QNEKKEI

SEQ ID NO: 3244097 - protein, 19 aa, Plasmodium falciparum
QNEKKKRKYINKQKKKDVY

SEQ ID NO: 3244098 - protein, 9 aa, Plasmodium falciparum
QNEKKNINK

SEQ ID NO: 3244099 - protein, 5 aa, Plasmodium falciparum
QNEKN

SEQ ID NO: 3244100 - protein, 7 aa, Plasmodium falciparum
QNEKNNN

SEQ ID NO: 3244101 - protein, 9 aa, Plasmodium falciparum
QNEKNSSHY

SEQ ID NO: 3244102 - protein, 69 aa, Plasmodium falciparum
QNEKQVHNKNKNDNNKNDNNKNDNNKNENNKNENNKNENNKNENNKNENNKNENNNNNNKNNNNNDTSV

SEQ ID NO: 3244103 - protein, 9 aa, Plasmodium falciparum
QNEKSECEE

SEQ ID NO: 3244104 - protein, 32 aa, Plasmodium falciparum
QNEKYNQNEEDKQYEQIRQNEQNEKNIPNEEC

SEQ ID NO: 3244105 - protein, 7 aa, Plasmodium falciparum
QNENDHT

SEQ ID NO: 3244106 - protein, 15 aa, Plasmodium falciparum
QNENDIRQDAKKDIK

SEQ ID NO: 3244107 - protein, 9 aa, Plasmodium falciparum
QNENGCKNK

SEQ ID NO: 3244108 - protein, 6 aa, Plasmodium falciparum
QNENHN

SEQ ID NO: 3244109 - protein, 17 aa, Plasmodium falciparum
QNENKNNLNNQDNKEYN

SEQ ID NO: 3244110 - protein, 13 aa, Plasmodium falciparum
QNENKQNAEVPNS

SEQ ID NO: 3244111 - protein, 71 aa, Plasmodium falciparum
QNENNDKTNGGDKTNQCDKTNQCDKTNQCDKTNQCDKTNQCDKTNQCDKTNQCDKTNQCDKTNQCGDKLPN

SEQ ID NO: 3244112 - protein, 7 aa, Plasmodium falciparum
QNENNEA

SEQ ID NO: 3244113 - protein, 10 aa, Plasmodium falciparum
QNENQNENSS

SEQ ID NO: 3244114 - protein, 5 aa, Plasmodium falciparum
QNENR

SEQ ID NO: 3244115 - protein, 17 aa, Plasmodium falciparum
QNENYSINQTGNKKENA

SEQ ID NO: 3244116 - protein, 4 aa, Plasmodium falciparum
QNEQ

SEQ ID NO: 3244117 - protein, 7 aa, Plasmodium falciparum
QNEQDDH

SEQ ID NO: 3244118 - protein, 8 aa, Plasmodium falciparum
QNEQETNI

SEQ ID NO: 3244119 - protein, 33 aa, Plasmodium falciparum
QNEQQKDEKNICNNNNNDCNNNNDCNNNNDCNN

SEQ ID NO: 3244120 - protein, 11 aa, Plasmodium falciparum
QNEQQKNNTYK

SEQ ID NO: 3244121 - protein, 8 aa, Plasmodium falciparum
QNESGTEE

SEQ ID NO: 3244122 - protein, 28 aa, Plasmodium falciparum
QNESKYDDNGSKYDDNGSKYDDNGSKYE

SEQ ID NO: 3244123 - protein, 6 aa, Plasmodium falciparum
QNESLK

SEQ ID NO: 3244124 - protein, 23 aa, Plasmodium falciparum
QNESQDNQQFPPSSNKVNTSHSN

SEQ ID NO: 3244125 - protein, 12 aa, Plasmodium falciparum
QNETTNEINNEK

SEQ ID NO: 3244126 - protein, 5 aa, Plasmodium falciparum
QNEYK

SEQ ID NO: 3244127 - protein, 5 aa, Plasmodium falciparum
QNFDK

SEQ ID NO: 3244128 - protein, 6 aa, Plasmodium falciparum
QNFQGT

SEQ ID NO: 3244129 - protein, 5 aa, Plasmodium falciparum
QNGDY

SEQ ID NO: 3244130 - protein, 16 aa, Plasmodium falciparum
QNGKADYKNEQGTVSK

SEQ ID NO: 3244131 - protein, 7 aa, Plasmodium falciparum
QNGKEKI

SEQ ID NO: 3244132 - protein, 14 aa, Plasmodium falciparum
QNGKKDNKQRNVKE

SEQ ID NO: 3244133 - protein, 11 aa, Plasmodium falciparum
QNGKKKCGKKI

SEQ ID NO: 3244134 - protein, 9 aa, Plasmodium falciparum
QNGKLNEEI

SEQ ID NO: 3244135 - protein, 9 aa, Plasmodium falciparum
QNGMNKTKE

SEQ ID NO: 3244136 - protein, 4 aa, Plasmodium falciparum
QNGN

SEQ ID NO: 3244137 - protein, 12 aa, Plasmodium falciparum
QNGNKFEKSVEQ

SEQ ID NO: 3244138 - protein, 47 aa, Plasmodium falciparum
QNGNNIQPNDENQNIQDGNNNNNNIKRRRRTRKRKANDKSGENHTLN

SEQ ID NO: 3244139 - protein, 7 aa, Plasmodium falciparum
QNGNNVI

SEQ ID NO: 3244140 - protein, 9 aa, Plasmodium falciparum
QNGNTNNVN

SEQ ID NO: 3244141 - protein, 6 aa, Plasmodium falciparum
QNGQKL

SEQ ID NO: 3244142 - protein, 26 aa, Plasmodium falciparum
QNGSPNNNNNNNNNNNNNNNNNNSNN

SEQ ID NO: 3244143 - protein, 9 aa, Plasmodium falciparum
QNGTFNSNT

SEQ ID NO: 3244144 - protein, 21 aa, Plasmodium falciparum
QNGTGGVANGSGSGTSDSQKL

SEQ ID NO: 3244145 - protein, 7 aa, Plasmodium falciparum
QNGTLSK

SEQ ID NO: 3244146 - protein, 72 aa, Plasmodium falciparum
QNGVRDNKLDGNHDNDKKDDNKKDGDKKDDNKKDGDKKDDDKKGDDKYDDGDDKYDDDDNKYDDDDDIYDDD

SEQ ID NO: 3244147 - protein, 7 aa, Plasmodium falciparum
QNGVSTS

SEQ ID NO: 3244148 - protein, 4 aa, Plasmodium falciparum
QNHE

SEQ ID NO: 3244149 - protein, 6 aa, Plasmodium falciparum
QNHQLD

SEQ ID NO: 3244150 - protein, 7 aa, Plasmodium falciparum
QNHRKDE

SEQ ID NO: 3244151 - protein, 25 aa, Plasmodium falciparum
QNHSDTNNNNNNNNKNNSNNNNNNI

SEQ ID NO: 3244152 - protein, 11 aa, Plasmodium falciparum
QNHSHQNKKNN

SEQ ID NO: 3244153 - protein, 11 aa, Plasmodium falciparum
QNHYDNGRDTH

SEQ ID NO: 3244154 - protein, 13 aa, Plasmodium falciparum
QNIENNDSSSYNI

SEQ ID NO: 3244155 - protein, 7 aa, Plasmodium falciparum
QNIKEST

SEQ ID NO: 3244156 - protein, 18 aa, Plasmodium falciparum
QNIKKSQEKEINNEHTNS

SEQ ID NO: 3244157 - protein, 29 aa, Plasmodium falciparum
QNIKTNNQINENNVNNNNNNNNDNNSSCS

SEQ ID NO: 3244158 - protein, 4 aa, Plasmodium falciparum
QNIN

SEQ ID NO: 3244159 - protein, 7 aa, Plasmodium falciparum
QNINGTL

SEQ ID NO: 3244160 - protein, 13 aa, Plasmodium falciparum
QNINNNKYTKDNK

SEQ ID NO: 3244161 - protein, 12 aa, Plasmodium falciparum
QNIPPQENSSPE

SEQ ID NO: 3244162 - protein, 19 aa, Plasmodium falciparum
QNIPSFEREKNSNIQENQT

SEQ ID NO: 3244163 - protein, 7 aa, Plasmodium falciparum
QNIQNNK

SEQ ID NO: 3244164 - protein, 11 aa, Plasmodium falciparum
QNIRNNRSYDI

SEQ ID NO: 3244165 - protein, 41 aa, Plasmodium falciparum
QNIRTDSSNNNNNNNINSNNNNNNNNNNNNNNNNNNNNNIY

SEQ ID NO: 3244166 - protein, 4 aa, Plasmodium falciparum
QNIS

SEQ ID NO: 3244167 - protein, 54 aa, Plasmodium falciparum
QNISGSQNINTSQNINTSQNINTNQNISSSQNINTSQNISTNQHISSSQNISTS

SEQ ID NO: 3244168 - protein, 43 aa, Plasmodium falciparum
QNISNTSGNMKNSSNIRSSSNIRSSNNIKSSSNIKSSSNINAN

SEQ ID NO: 3244169 - protein, 22 aa, Plasmodium falciparum
QNISTSNDNINNNTQSINNNNI

SEQ ID NO: 3244170 - protein, 5 aa, Plasmodium falciparum
QNITN

SEQ ID NO: 3244171 - protein, 6 aa, Plasmodium falciparum
QNITYN

SEQ ID NO: 3244172 - protein, 7 aa, Plasmodium falciparum
QNKCNNE

SEQ ID NO: 3244173 - protein, 4 aa, Plasmodium falciparum
QNKD

SEQ ID NO: 3244174 - protein, 9 aa, Plasmodium falciparum
QNKDAERLQ

SEQ ID NO: 3244175 - protein, 23 aa, Plasmodium falciparum
QNKDKNDFSNGNNENEQDNNIEK

SEQ ID NO: 3244176 - protein, 9 aa, Plasmodium falciparum
QNKDNTKRV

SEQ ID NO: 3244177 - protein, 13 aa, Plasmodium falciparum
QNKDQDKTQPSTL

SEQ ID NO: 3244178 - protein, 4 aa, Plasmodium falciparum
QNKE

SEQ ID NO: 3244179 - protein, 27 aa, Plasmodium falciparum
QNKEDKLESNDKYSKVSSKENEENEKI

SEQ ID NO: 3244180 - protein, 5 aa, Plasmodium falciparum
QNKEG

SEQ ID NO: 3244181 - protein, 10 aa, Plasmodium falciparum
QNKEHPNDQH

SEQ ID NO: 3244182 - protein, 33 aa, Plasmodium falciparum
QNKENNNSSNNNNSSNNNNSSSNIKNETKKQPL

SEQ ID NO: 3244183 - protein, 21 aa, Plasmodium falciparum
QNKGKKYNKKGNNINGKKKKY

SEQ ID NO: 3244184 - protein, 13 aa, Plasmodium falciparum
QNKGNNNNNNNNY

SEQ ID NO: 3244185 - protein, 8 aa, Plasmodium falciparum
QNKHNTNN

SEQ ID NO: 3244186 - protein, 5 aa, Plasmodium falciparum
QNKID

SEQ ID NO: 3244187 - protein, 5 aa, Plasmodium falciparum
QNKIE

SEQ ID NO: 3244188 - protein, 74 aa, Plasmodium falciparum
QNKIKNDNNNDDNNDDNNNDDNNNDDNNNDDNNNNNNNNNNNNNNNNNKSDKNKDDHNIQTNNYSQSDIPNKSC

SEQ ID NO: 3244189 - protein, 6 aa, Plasmodium falciparum
QNKINQ

SEQ ID NO: 3244190 - protein, 19 aa, Plasmodium falciparum
QNKKDINDTCEKDYTSNKM

SEQ ID NO: 3244191 - protein, 8 aa, Plasmodium falciparum
QNKKDKKI

SEQ ID NO: 3244192 - protein, 51 aa, Plasmodium falciparum
QNKKGKTSNGGNTKKEQQKNNNKINSNNNEEDENDNENKNERKDEDDNYES

SEQ ID NO: 3244193 - protein, 18 aa, Plasmodium falciparum
QNKKHKDNNNLKNKYSNH

SEQ ID NO: 3244194 - protein, 10 aa, Plasmodium falciparum
QNKKMDVDEN

SEQ ID NO: 3244195 - protein, 15 aa, Plasmodium falciparum
QNKKNEYNKNNGNTE

SEQ ID NO: 3244196 - protein, 9 aa, Plasmodium falciparum
QNKKQFEKN

SEQ ID NO: 3244197 - protein, 10 aa, Plasmodium falciparum
QNKKWTTKGI

SEQ ID NO: 3244198 - protein, 13 aa, Plasmodium falciparum
QNKKYHDEQNEWK

SEQ ID NO: 3244199 - protein, 4 aa, Plasmodium falciparum
QNKN

SEQ ID NO: 3244200 - protein, 15 aa, Plasmodium falciparum
QNKNETSQKNTSRYD

SEQ ID NO: 3244201 - protein, 6 aa, Plasmodium falciparum
QNKNIE

SEQ ID NO: 3244202 - protein, 7 aa, Plasmodium falciparum
QNKNNKH

SEQ ID NO: 3244203 - protein, 8 aa, Plasmodium falciparum
QNKNNKTL

SEQ ID NO: 3244204 - protein, 7 aa, Plasmodium falciparum
QNKNPNN

SEQ ID NO: 3244205 - protein, 8 aa, Plasmodium falciparum
QNKNSSID

SEQ ID NO: 3244206 - protein, 5 aa, Plasmodium falciparum
QNKNT

SEQ ID NO: 3244207 - protein, 15 aa, Plasmodium falciparum
QNKPKHTDNTTNATT

SEQ ID NO: 3244208 - protein, 21 aa, Plasmodium falciparum
QNKPKNKNDPNNNTQNDQTNN

SEQ ID NO: 3244209 - protein, 8 aa, Plasmodium falciparum
QNKQHGTS

SEQ ID NO: 3244210 - protein, 11 aa, Plasmodium falciparum
QNKQHRYGQND

SEQ ID NO: 3244211 - protein, 14 aa, Plasmodium falciparum
QNKRDEDDGASSYQ

SEQ ID NO: 3244212 - protein, 5 aa, Plasmodium falciparum
QNKRE

SEQ ID NO: 3244213 - protein, 10 aa, Plasmodium falciparum
QNKRKNKINT

SEQ ID NO: 3244214 - protein, 9 aa, Plasmodium falciparum
QNKRNEKKK

SEQ ID NO: 3244215 - protein, 17 aa, Plasmodium falciparum
QNKRNSEIEHTNHKEDY

SEQ ID NO: 3244216 - protein, 13 aa, Plasmodium falciparum
QNKSKNKKKDYHN

SEQ ID NO: 3244217 - protein, 10 aa, Plasmodium falciparum
QNKSKNNLTG

SEQ ID NO: 3244218 - protein, 9 aa, Plasmodium falciparum
QNKSNEKKL

SEQ ID NO: 3244219 - protein, 6 aa, Plasmodium falciparum
QNKSNI

SEQ ID NO: 3244220 - protein, 17 aa, Plasmodium falciparum
QNKTKCRKLNNEKQYYN

SEQ ID NO: 3244221 - protein, 8 aa, Plasmodium falciparum
QNKTKNNH

SEQ ID NO: 3244222 - protein, 7 aa, Plasmodium falciparum
QNKVNEE

SEQ ID NO: 3244223 - protein, 8 aa, Plasmodium falciparum
QNKYKNRK

SEQ ID NO: 3244224 - protein, 6 aa, Plasmodium falciparum
QNLNEQ

SEQ ID NO: 3244225 - protein, 9 aa, Plasmodium falciparum
QNLPYPNDY

SEQ ID NO: 3244226 - protein, 5 aa, Plasmodium falciparum
QNLRE

SEQ ID NO: 3244227 - protein, 10 aa, Plasmodium falciparum
QNLSQNMSQN

SEQ ID NO: 3244228 - protein, 8 aa, Plasmodium falciparum
QNLSSKNN

SEQ ID NO: 3244229 - protein, 4 aa, Plasmodium falciparum
QNMN

SEQ ID NO: 3244230 - protein, 15 aa, Plasmodium falciparum
QNNDINTNHTNQNYC

SEQ ID NO: 3244231 - protein, 8 aa, Plasmodium falciparum
QNNDNPNN

SEQ ID NO: 3244232 - protein, 23 aa, Plasmodium falciparum
QNNDPTHEDNNNNNNNNNNEQDA

SEQ ID NO: 3244233 - protein, 7 aa, Plasmodium falciparum
QNNDTIN

SEQ ID NO: 3244234 - protein, 15 aa, Plasmodium falciparum
QNNDTNVKKKRRYNK

SEQ ID NO: 3244235 - protein, 4 aa, Plasmodium falciparum
QNNE

SEQ ID NO: 3244236 - protein, 6 aa, Plasmodium falciparum
QNNEQL

SEQ ID NO: 3244237 - protein, 5 aa, Plasmodium falciparum
QNNER

SEQ ID NO: 3244238 - protein, 7 aa, Plasmodium falciparum
QNNEVNQ

SEQ ID NO: 3244239 - protein, 14 aa, Plasmodium falciparum
QNNHTSQNNHNQPL

SEQ ID NO: 3244240 - protein, 9 aa, Plasmodium falciparum
QNNIQDNGV

SEQ ID NO: 3244241 - protein, 13 aa, Plasmodium falciparum
QNNISNEKISNTF

SEQ ID NO: 3244242 - protein, 4 aa, Plasmodium falciparum
QNNK

SEQ ID NO: 3244243 - protein, 7 aa, Plasmodium falciparum
QNNKDKN

SEQ ID NO: 3244244 - protein, 8 aa, Plasmodium falciparum
QNNKIDNK

SEQ ID NO: 3244245 - protein, 9 aa, Plasmodium falciparum
QNNKKDVNK

SEQ ID NO: 3244246 - protein, 11 aa, Plasmodium falciparum
QNNKKENIHDK

SEQ ID NO: 3244247 - protein, 7 aa, Plasmodium falciparum
QNNKKIK

SEQ ID NO: 3244248 - protein, 17 aa, Plasmodium falciparum
QNNKNEEYAHTKENCDN

SEQ ID NO: 3244249 - protein, 9 aa, Plasmodium falciparum
QNNKNKNKN

SEQ ID NO: 3244250 - protein, 43 aa, Plasmodium falciparum
QNNKNKNNNNKNNNNKNNNNNNNNNNNNNNMDDTLKKDKQTEL

SEQ ID NO: 3244251 - protein, 22 aa, Plasmodium falciparum
QNNKNMKKRRTKRIQNNKNRYT

SEQ ID NO: 3244252 - protein, 11 aa, Plasmodium falciparum
QNNKNNTEEIN

SEQ ID NO: 3244253 - protein, 6 aa, Plasmodium falciparum
QNNKTF

SEQ ID NO: 3244254 - protein, 79 aa, Plasmodium falciparum
QNNKTYVKNNDDQYNVDNNNNNVDNNNNVDNNNNVDDNNNMDDNNNMDNNNNVNNNNNVNNNNNVNNNNNVNNNNNIYN

SEQ ID NO: 3244255 - protein, 6 aa, Plasmodium falciparum
QNNLSN

SEQ ID NO: 3244256 - protein, 18 aa, Plasmodium falciparum
QNNNAKDTVQVQNEKGTM

SEQ ID NO: 3244257 - protein, 5 aa, Plasmodium falciparum
QNNNF

SEQ ID NO: 3244258 - protein, 6 aa, Plasmodium falciparum
QNNNIQ

SEQ ID NO: 3244259 - protein, 11 aa, Plasmodium falciparum
QNNNKVDAENI

SEQ ID NO: 3244260 - protein, 8 aa, Plasmodium falciparum
QNNNNISD

SEQ ID NO: 3244261 - protein, 12 aa, Plasmodium falciparum
QNNNNKENYNEQ

SEQ ID NO: 3244262 - protein, 6 aa, Plasmodium falciparum
QNNNNN

SEQ ID NO: 3244263 - protein, 8 aa, Plasmodium falciparum
QNNNNNEI

SEQ ID NO: 3244264 - protein, 9 aa, Plasmodium falciparum
QNNNNNKYD

SEQ ID NO: 3244265 - protein, 7 aa, Plasmodium falciparum
QNNNNNN

SEQ ID NO: 3244266 - protein, 8 aa, Plasmodium falciparum
QNNNNNNE

SEQ ID NO: 3244267 - protein, 9 aa, Plasmodium falciparum
QNNNNNNNK

SEQ ID NO: 3244268 - protein, 15 aa, Plasmodium falciparum
QNNNNNNNNESEDNY

SEQ ID NO: 3244269 - protein, 14 aa, Plasmodium falciparum
QNNNNNNNNNNMNN

SEQ ID NO: 3244270 - protein, 32 aa, Plasmodium falciparum
QNNNNNNNNNNNNNNNNNNNNNDNNNDNNSNI

SEQ ID NO: 3244271 - protein, 7 aa, Plasmodium falciparum
QNNNNSL

SEQ ID NO: 3244272 - protein, 6 aa, Plasmodium falciparum
QNNNNV

SEQ ID NO: 3244273 - protein, 8 aa, Plasmodium falciparum
QNNNPVEQ

SEQ ID NO: 3244274 - protein, 9 aa, Plasmodium falciparum
QNNNSIEKS

SEQ ID NO: 3244275 - protein, 18 aa, Plasmodium falciparum
QNNNSNNMKSVSGSRYVP

SEQ ID NO: 3244276 - protein, 9 aa, Plasmodium falciparum
QNNNTNKSL

SEQ ID NO: 3244277 - protein, 5 aa, Plasmodium falciparum
QNNNY

SEQ ID NO: 3244278 - protein, 9 aa, Plasmodium falciparum
QNNQENQNN

SEQ ID NO: 3244279 - protein, 8 aa, Plasmodium falciparum
QNNQGELN

SEQ ID NO: 3244280 - protein, 19 aa, Plasmodium falciparum
QNNQKNTKPLNKDDQEKQF

SEQ ID NO: 3244281 - protein, 7 aa, Plasmodium falciparum
QNNQNDK

SEQ ID NO: 3244282 - protein, 12 aa, Plasmodium falciparum
QNNQNNKENDNV

SEQ ID NO: 3244283 - protein, 6 aa, Plasmodium falciparum
QNNQTF

SEQ ID NO: 3244284 - protein, 12 aa, Plasmodium falciparum
QNNRNIKNDQLP

SEQ ID NO: 3244285 - protein, 30 aa, Plasmodium falciparum
QNNSDSYISSNDVNHNSTIQKKKNKQTFKT

SEQ ID NO: 3244286 - protein, 8 aa, Plasmodium falciparum
QNNSEKQI

SEQ ID NO: 3244287 - protein, 10 aa, Plasmodium falciparum
QNNSKDEIME

SEQ ID NO: 3244288 - protein, 13 aa, Plasmodium falciparum
QNNSSDSKKNLNM

SEQ ID NO: 3244289 - protein, 4 aa, Plasmodium falciparum
QNNT

SEQ ID NO: 3244290 - protein, 6 aa, Plasmodium falciparum
QNNTNE

SEQ ID NO: 3244291 - protein, 6 aa, Plasmodium falciparum
QNNVKE

SEQ ID NO: 3244292 - protein, 6 aa, Plasmodium falciparum
QNNYDQ

SEQ ID NO: 3244293 - protein, 12 aa, Plasmodium falciparum
QNPANNNSYLGR

SEQ ID NO: 3244294 - protein, 79 aa, Plasmodium falciparum
QNPEQNPEQNAQQNAQQNAQQNAQQNAQQNAQQNAQQNTQQNTQQKTQQNPQQNAQQNTQQNTQQQSTTKSTTKTVARE

SEQ ID NO: 3244295 - protein, 7 aa, Plasmodium falciparum
QNPNIKN

SEQ ID NO: 3244296 - protein, 5 aa, Plasmodium falciparum
QNPQC

SEQ ID NO: 3244297 - protein, 7 aa, Plasmodium falciparum
QNPSSIH

SEQ ID NO: 3244298 - protein, 10 aa, Plasmodium falciparum
QNQESSNTSV

SEQ ID NO: 3244299 - protein, 8 aa, Plasmodium falciparum
QNQKDTSN

SEQ ID NO: 3244300 - protein, 5 aa, Plasmodium falciparum
QNQKN

SEQ ID NO: 3244301 - protein, 12 aa, Plasmodium falciparum
QNQLNEHNNHNP

SEQ ID NO: 3244302 - protein, 16 aa, Plasmodium falciparum
QNQNKNMSVGHNKNEN

SEQ ID NO: 3244303 - protein, 17 aa, Plasmodium falciparum
QNQNKRAERNDANKNYN

SEQ ID NO: 3244304 - protein, 11 aa, Plasmodium falciparum
QNQNNHSNDEN

SEQ ID NO: 3244305 - protein, 4 aa, Plasmodium falciparum
QNRE

SEQ ID NO: 3244306 - protein, 8 aa, Plasmodium falciparum
QNRISSQH

SEQ ID NO: 3244307 - protein, 56 aa, Plasmodium falciparum
QNRKNKLKEKKKNKKKNKNKKNKNKKNKNKKKINKSRINYNNKKKNNKKNNQNVQN

SEQ ID NO: 3244308 - protein, 12 aa, Plasmodium falciparum
QNRNEKKSKRKT

SEQ ID NO: 3244309 - protein, 4 aa, Plasmodium falciparum
QNRR

SEQ ID NO: 3244310 - protein, 15 aa, Plasmodium falciparum
QNRSYENNNVGNKKN

SEQ ID NO: 3244311 - protein, 5 aa, Plasmodium falciparum
QNRTK

SEQ ID NO: 3244312 - protein, 10 aa, Plasmodium falciparum
QNRTKRSGEI

SEQ ID NO: 3244313 - protein, 8 aa, Plasmodium falciparum
QNRTQQNE

SEQ ID NO: 3244314 - protein, 4 aa, Plasmodium falciparum
QNSF

SEQ ID NO: 3244315 - protein, 6 aa, Plasmodium falciparum
QNSGDI

SEQ ID NO: 3244316 - protein, 7 aa, Plasmodium falciparum
QNSGSIS

SEQ ID NO: 3244317 - protein, 18 aa, Plasmodium falciparum
QNSIRNDNTIDENNNTKY

SEQ ID NO: 3244318 - protein, 7 aa, Plasmodium falciparum
QNSLEGS

SEQ ID NO: 3244319 - protein, 4 aa, Plasmodium falciparum
QNSN

SEQ ID NO: 3244320 - protein, 10 aa, Plasmodium falciparum
QNSNGDEKLQ

SEQ ID NO: 3244321 - protein, 6 aa, Plasmodium falciparum
QNSQMD

SEQ ID NO: 3244322 - protein, 9 aa, Plasmodium falciparum
QNSSNPSDI

SEQ ID NO: 3244323 - protein, 9 aa, Plasmodium falciparum
QNSYDNEDN

SEQ ID NO: 3244324 - protein, 4 aa, Plasmodium falciparum
QNTG

SEQ ID NO: 3244325 - protein, 5 aa, Plasmodium falciparum
QNTGT

SEQ ID NO: 3244326 - protein, 6 aa, Plasmodium falciparum
QNTHHP

SEQ ID NO: 3244327 - protein, 12 aa, Plasmodium falciparum
QNTHKNFKQDKN

SEQ ID NO: 3244328 - protein, 6 aa, Plasmodium falciparum
QNTNEE

SEQ ID NO: 3244329 - protein, 13 aa, Plasmodium falciparum
QNTNEKDHVEGQD

SEQ ID NO: 3244330 - protein, 10 aa, Plasmodium falciparum
QNTNKKDKEM

SEQ ID NO: 3244331 - protein, 14 aa, Plasmodium falciparum
QNTQFPSPKIIKLT

SEQ ID NO: 3244332 - protein, 6 aa, Plasmodium falciparum
QNTRSY

SEQ ID NO: 3244333 - protein, 6 aa, Plasmodium falciparum
QNTSDK

SEQ ID NO: 3244334 - protein, 5 aa, Plasmodium falciparum
QNTSE

SEQ ID NO: 3244335 - protein, 6 aa, Plasmodium falciparum
QNTTET

SEQ ID NO: 3244336 - protein, 12 aa, Plasmodium falciparum
QNVDEIKKNDNH

SEQ ID NO: 3244337 - protein, 13 aa, Plasmodium falciparum
QNVENHTTKDNNN

SEQ ID NO: 3244338 - protein, 20 aa, Plasmodium falciparum
QNVKNGENRFGDKGKKVTFE

SEQ ID NO: 3244339 - protein, 14 aa, Plasmodium falciparum
QNVKTNKKNLPPYN

SEQ ID NO: 3244340 - protein, 6 aa, Plasmodium falciparum
QNVNNS

SEQ ID NO: 3244341 - protein, 12 aa, Plasmodium falciparum
QNVNNVTQNNQV

SEQ ID NO: 3244342 - protein, 8 aa, Plasmodium falciparum
QNVQEEDN

SEQ ID NO: 3244343 - protein, 9 aa, Plasmodium falciparum
QNVQKGIGV

SEQ ID NO: 3244344 - protein, 9 aa, Plasmodium falciparum
QNVQNTNRS

SEQ ID NO: 3244345 - protein, 7 aa, Plasmodium falciparum
QNVQSNT

SEQ ID NO: 3244346 - protein, 6 aa, Plasmodium falciparum
QNVRNE

SEQ ID NO: 3244347 - protein, 8 aa, Plasmodium falciparum
QNVRTKNK

SEQ ID NO: 3244348 - protein, 4 aa, Plasmodium falciparum
QNVS

SEQ ID NO: 3244349 - protein, 16 aa, Plasmodium falciparum
QNVSEQQLKKDNSYGE

SEQ ID NO: 3244350 - protein, 16 aa, Plasmodium falciparum
QNWENKRKYTNDDEYY

SEQ ID NO: 3244351 - protein, 31 aa, Plasmodium falciparum
QNYDNPMKDNHSNCADNNNNNKYNNNKYNNN

SEQ ID NO: 3244352 - protein, 4 aa, Plasmodium falciparum
QNYE

SEQ ID NO: 3244353 - protein, 10 aa, Plasmodium falciparum
QNYEKETDNM

SEQ ID NO: 3244354 - protein, 5 aa, Plasmodium falciparum
QNYGI

SEQ ID NO: 3244355 - protein, 38 aa, Plasmodium falciparum
QNYKNYEANHQKCEQNYKNYESNHQNHEQNYKSYGDNY

SEQ ID NO: 3244356 - protein, 4 aa, Plasmodium falciparum
QNYN

SEQ ID NO: 3244357 - protein, 14 aa, Plasmodium falciparum
QNYRDVNNNPPINI

SEQ ID NO: 3244358 - protein, 7 aa, Plasmodium falciparum
QNYTDKS

SEQ ID NO: 3244359 - protein, 44 aa, Plasmodium falciparum
QPATTGDEGTKELPLTPPAPAPAAPSSTPATPNHQPLPSDNTSD

SEQ ID NO: 3244360 - protein, 6 aa, Plasmodium falciparum
QPDKKS

SEQ ID NO: 3244361 - protein, 5 aa, Plasmodium falciparum
QPDKY

SEQ ID NO: 3244362 - protein, 18 aa, Plasmodium falciparum
QPFDETTEYNKSRLQDNN

SEQ ID NO: 3244363 - protein, 5 aa, Plasmodium falciparum
QPFDP

SEQ ID NO: 3244364 - protein, 11 aa, Plasmodium falciparum
QPIEKGNNEYK

SEQ ID NO: 3244365 - protein, 20 aa, Plasmodium falciparum
QPIPQSHNNFSNNPLDDSKS

SEQ ID NO: 3244366 - protein, 4 aa, Plasmodium falciparum
QPIT

SEQ ID NO: 3244367 - protein, 6 aa, Plasmodium falciparum
QPIYDT

SEQ ID NO: 3244368 - protein, 5 aa, Plasmodium falciparum
QPKKT

SEQ ID NO: 3244369 - protein, 5 aa, Plasmodium falciparum
QPKNK

SEQ ID NO: 3244370 - protein, 16 aa, Plasmodium falciparum
QPKNTNNRSSSSNTID

SEQ ID NO: 3244371 - protein, 6 aa, Plasmodium falciparum
QPKTEL

SEQ ID NO: 3244372 - protein, 9 aa, Plasmodium falciparum
QPLNEDTNK

SEQ ID NO: 3244373 - protein, 12 aa, Plasmodium falciparum
QPLNNNNKEESD

SEQ ID NO: 3244374 - protein, 5 aa, Plasmodium falciparum
QPLPT

SEQ ID NO: 3244375 - protein, 6 aa, Plasmodium falciparum
QPLPVS

SEQ ID NO: 3244376 - protein, 4 aa, Plasmodium falciparum
QPLQ

SEQ ID NO: 3244377 - protein, 4 aa, Plasmodium falciparum
QPNE

SEQ ID NO: 3244378 - protein, 6 aa, Plasmodium falciparum
QPNGSF

SEQ ID NO: 3244379 - protein, 8 aa, Plasmodium falciparum
QPNKEDQQ

SEQ ID NO: 3244380 - protein, 9 aa, Plasmodium falciparum
QPNNEDYNK

SEQ ID NO: 3244381 - protein, 5 aa, Plasmodium falciparum
QPNNI

SEQ ID NO: 3244382 - protein, 9 aa, Plasmodium falciparum
QPNQNNNHV

SEQ ID NO: 3244383 - protein, 13 aa, Plasmodium falciparum
QPNQYNNEYTDQY

SEQ ID NO: 3244384 - protein, 8 aa, Plasmodium falciparum
QPNSNSEY

SEQ ID NO: 3244385 - protein, 6 aa, Plasmodium falciparum
QPNSSS

SEQ ID NO: 3244386 - protein, 7 aa, Plasmodium falciparum
QPPTEHN

SEQ ID NO: 3244387 - protein, 7 aa, Plasmodium falciparum
QPQNDLE

SEQ ID NO: 3244388 - protein, 18 aa, Plasmodium falciparum
QPQQPQGTVANPPSNEPV

SEQ ID NO: 3244389 - protein, 6 aa, Plasmodium falciparum
QPQTDV

SEQ ID NO: 3244390 - protein, 5 aa, Plasmodium falciparum
QPQTE

SEQ ID NO: 3244391 - protein, 6 aa, Plasmodium falciparum
QPQTEL

SEQ ID NO: 3244392 - protein, 5 aa, Plasmodium falciparum
QPQTH

SEQ ID NO: 3244393 - protein, 11 aa, Plasmodium falciparum
QPSDTTQSNTY

SEQ ID NO: 3244394 - protein, 4 aa, Plasmodium falciparum
QPSI

SEQ ID NO: 3244395 - protein, 5 aa, Plasmodium falciparum
QPSNC

SEQ ID NO: 3244396 - protein, 11 aa, Plasmodium falciparum
QPSNQTTPSNN

SEQ ID NO: 3244397 - protein, 5 aa, Plasmodium falciparum
QPSSQ

SEQ ID NO: 3244398 - protein, 6 aa, Plasmodium falciparum
QPSTNN

SEQ ID NO: 3244399 - protein, 5 aa, Plasmodium falciparum
QPTDS

SEQ ID NO: 3244400 - protein, 5 aa, Plasmodium falciparum
QPTHR

SEQ ID NO: 3244401 - protein, 6 aa, Plasmodium falciparum
QPTSPN

SEQ ID NO: 3244402 - protein, 9 aa, Plasmodium falciparum
QPTSTKDCN

SEQ ID NO: 3244403 - protein, 5 aa, Plasmodium falciparum
QPYNK

SEQ ID NO: 3244404 - protein, 10 aa, Plasmodium falciparum
QQAKDIGAGP

SEQ ID NO: 3244405 - protein, 7 aa, Plasmodium falciparum
QQDDSSL

SEQ ID NO: 3244406 - protein, 4 aa, Plasmodium falciparum
QQDE

SEQ ID NO: 3244407 - protein, 11 aa, Plasmodium falciparum
QQDGDINTEQD

SEQ ID NO: 3244408 - protein, 8 aa, Plasmodium falciparum
QQDGDNIS

SEQ ID NO: 3244409 - protein, 12 aa, Plasmodium falciparum
QQDQSHSTHPYS

SEQ ID NO: 3244410 - protein, 4 aa, Plasmodium falciparum
QQEE

SEQ ID NO: 3244411 - protein, 28 aa, Plasmodium falciparum
QQEEHNNNNNNKKKKKKKKKKKKTESDV

SEQ ID NO: 3244412 - protein, 26 aa, Plasmodium falciparum
QQEKENEDDDDEEEEEEKKKKNKITK

SEQ ID NO: 3244413 - protein, 7 aa, Plasmodium falciparum
QQENIPK

SEQ ID NO: 3244414 - protein, 4 aa, Plasmodium falciparum
QQEW

SEQ ID NO: 3244415 - protein, 5 aa, Plasmodium falciparum
QQEYK

SEQ ID NO: 3244416 - protein, 13 aa, Plasmodium falciparum
QQFDDRTSQRSHE

SEQ ID NO: 3244417 - protein, 4 aa, Plasmodium falciparum
QQGE

SEQ ID NO: 3244418 - protein, 8 aa, Plasmodium falciparum
QQGKHPED

SEQ ID NO: 3244419 - protein, 15 aa, Plasmodium falciparum
QQHGYKENVESTTRR

SEQ ID NO: 3244420 - protein, 4 aa, Plasmodium falciparum
QQIY

SEQ ID NO: 3244421 - protein, 10 aa, Plasmodium falciparum
QQKGNMYNDS

SEQ ID NO: 3244422 - protein, 8 aa, Plasmodium falciparum
QQKKEENI

SEQ ID NO: 3244423 - protein, 7 aa, Plasmodium falciparum
QQKKEKK

SEQ ID NO: 3244424 - protein, 9 aa, Plasmodium falciparum
QQKKKKKVN

SEQ ID NO: 3244425 - protein, 6 aa, Plasmodium falciparum
QQKKRI

SEQ ID NO: 3244426 - protein, 5 aa, Plasmodium falciparum
QQKND

SEQ ID NO: 3244427 - protein, 10 aa, Plasmodium falciparum
QQKNENLKND

SEQ ID NO: 3244428 - protein, 14 aa, Plasmodium falciparum
QQKSDTEQKSQRIR

SEQ ID NO: 3244429 - protein, 8 aa, Plasmodium falciparum
QQKSNTKD

SEQ ID NO: 3244430 - protein, 14 aa, Plasmodium falciparum
QQMEPKNNNTPNEE

SEQ ID NO: 3244431 - protein, 9 aa, Plasmodium falciparum
QQNCNQTNN

SEQ ID NO: 3244432 - protein, 12 aa, Plasmodium falciparum
QQNDKYSNNDNC

SEQ ID NO: 3244433 - protein, 11 aa, Plasmodium falciparum
QQNERKIKESN

SEQ ID NO: 3244434 - protein, 12 aa, Plasmodium falciparum
QQNGGKKSVDTV

SEQ ID NO: 3244435 - protein, 6 aa, Plasmodium falciparum
QQNMQN

SEQ ID NO: 3244436 - protein, 5 aa, Plasmodium falciparum
QQNNI

SEQ ID NO: 3244437 - protein, 12 aa, Plasmodium falciparum
QQNNNNNNDNIN

SEQ ID NO: 3244438 - protein, 17 aa, Plasmodium falciparum
QQNNSKNGVIDQNDKET

SEQ ID NO: 3244439 - protein, 8 aa, Plasmodium falciparum
QQNNTAHV

SEQ ID NO: 3244440 - protein, 6 aa, Plasmodium falciparum
QQNRDH

SEQ ID NO: 3244441 - protein, 4 aa, Plasmodium falciparum
QQNS

SEQ ID NO: 3244442 - protein, 5 aa, Plasmodium falciparum
QQNSI

SEQ ID NO: 3244443 - protein, 13 aa, Plasmodium falciparum
QQNTQSNSKDNIL

SEQ ID NO: 3244444 - protein, 4 aa, Plasmodium falciparum
QQNV

SEQ ID NO: 3244445 - protein, 7 aa, Plasmodium falciparum
QQQNKSN

SEQ ID NO: 3244446 - protein, 8 aa, Plasmodium falciparum
QQQQLQGN

SEQ ID NO: 3244447 - protein, 7 aa, Plasmodium falciparum
QQQQQQL

SEQ ID NO: 3244448 - protein, 23 aa, Plasmodium falciparum
QQQQQQQQQGNIPPLSARQSKQG

SEQ ID NO: 3244449 - protein, 8 aa, Plasmodium falciparum
QQRDQNKI

SEQ ID NO: 3244450 - protein, 15 aa, Plasmodium falciparum
QQRQQQKKKNKNTHN

SEQ ID NO: 3244451 - protein, 8 aa, Plasmodium falciparum
QQSGGPDG

SEQ ID NO: 3244452 - protein, 7 aa, Plasmodium falciparum
QQSKTKY

SEQ ID NO: 3244453 - protein, 11 aa, Plasmodium falciparum
QQSNTNKRENS

SEQ ID NO: 3244454 - protein, 4 aa, Plasmodium falciparum
QQTD

SEQ ID NO: 3244455 - protein, 7 aa, Plasmodium falciparum
QQTHEPY

SEQ ID NO: 3244456 - protein, 18 aa, Plasmodium falciparum
QQTQSTTTTTNNNNNNNI

SEQ ID NO: 3244457 - protein, 12 aa, Plasmodium falciparum
QQYHQYEKKIHI

SEQ ID NO: 3244458 - protein, 4 aa, Plasmodium falciparum
QQYP

SEQ ID NO: 3244459 - protein, 8 aa, Plasmodium falciparum
QQYQETNK

SEQ ID NO: 3244460 - protein, 17 aa, Plasmodium falciparum
QRDKEKKNISDEREERD

SEQ ID NO: 3244461 - protein, 10 aa, Plasmodium falciparum
QRDNKSTPVY

SEQ ID NO: 3244462 - protein, 9 aa, Plasmodium falciparum
QREEHTSGH

SEQ ID NO: 3244463 - protein, 4 aa, Plasmodium falciparum
QREI

SEQ ID NO: 3244464 - protein, 24 aa, Plasmodium falciparum
QREKRKDNKGFAAAGTSNYNNKDY

SEQ ID NO: 3244465 - protein, 24 aa, Plasmodium falciparum
QRENKIQSNLDEKYNNKNKNYKRI

SEQ ID NO: 3244466 - protein, 13 aa, Plasmodium falciparum
QRGTCANDENPPV

SEQ ID NO: 3244467 - protein, 5 aa, Plasmodium falciparum
QRGVL

SEQ ID NO: 3244468 - protein, 4 aa, Plasmodium falciparum
QRHN

SEQ ID NO: 3244469 - protein, 35 aa, Plasmodium falciparum
QRIGKDDENTGASSGSHFSRPENFQGTSKTEKNFT

SEQ ID NO: 3244470 - protein, 9 aa, Plasmodium falciparum
QRKKEKQLK

SEQ ID NO: 3244471 - protein, 10 aa, Plasmodium falciparum
QRKKEQKKNR

SEQ ID NO: 3244472 - protein, 15 aa, Plasmodium falciparum
QRKKKKKQNKKKTEH

SEQ ID NO: 3244473 - protein, 6 aa, Plasmodium falciparum
QRKQNY

SEQ ID NO: 3244474 - protein, 16 aa, Plasmodium falciparum
QRKREKDNQNKKYNEY

SEQ ID NO: 3244475 - protein, 5 aa, Plasmodium falciparum
QRKTL

SEQ ID NO: 3244476 - protein, 5 aa, Plasmodium falciparum
QRNHK

SEQ ID NO: 3244477 - protein, 15 aa, Plasmodium falciparum
QRNHKNTTHHTPKIS

SEQ ID NO: 3244478 - protein, 20 aa, Plasmodium falciparum
QRNHKSATFHTSNTKPTKTH

SEQ ID NO: 3244479 - protein, 20 aa, Plasmodium falciparum
QRNHNSTTYHASKTKSIKTH

SEQ ID NO: 3244480 - protein, 5 aa, Plasmodium falciparum
QRNHR

SEQ ID NO: 3244481 - protein, 19 aa, Plasmodium falciparum
QRNISNTSNRSNNNHINNR

SEQ ID NO: 3244482 - protein, 6 aa, Plasmodium falciparum
QRNMKK

SEQ ID NO: 3244483 - protein, 25 aa, Plasmodium falciparum
QRNNKKKKKKKKKIQSDQNSVVGTN

SEQ ID NO: 3244484 - protein, 11 aa, Plasmodium falciparum
QRNNKKKKTVL

SEQ ID NO: 3244485 - protein, 9 aa, Plasmodium falciparum
QRNTENEDE

SEQ ID NO: 3244486 - protein, 24 aa, Plasmodium falciparum
QRNVPKEVTQRKNTEASVNNNVEE

SEQ ID NO: 3244487 - protein, 5 aa, Plasmodium falciparum
QRPDW

SEQ ID NO: 3244488 - protein, 9 aa, Plasmodium falciparum
QRPSQPLSD

SEQ ID NO: 3244489 - protein, 8 aa, Plasmodium falciparum
QRQNENYA

SEQ ID NO: 3244490 - protein, 12 aa, Plasmodium falciparum
QRREANRNSERS

SEQ ID NO: 3244491 - protein, 40 aa, Plasmodium falciparum
QRSALSQASNNNTNDHMSSSNNNNNNNSNSSSNNKIGTHA

SEQ ID NO: 3244492 - protein, 7 aa, Plasmodium falciparum
QRSASDI

SEQ ID NO: 3244493 - protein, 4 aa, Plasmodium falciparum
QRSE

SEQ ID NO: 3244494 - protein, 25 aa, Plasmodium falciparum
QRTEPKGKISESTSAIKNNTEKMQS

SEQ ID NO: 3244495 - protein, 12 aa, Plasmodium falciparum
QRTNEDNQIYKN

SEQ ID NO: 3244496 - protein, 10 aa, Plasmodium falciparum
QRTSTDGMPA

SEQ ID NO: 3244497 - protein, 7 aa, Plasmodium falciparum
QRTTENK

SEQ ID NO: 3244498 - protein, 4 aa, Plasmodium falciparum
QRVP

SEQ ID NO: 3244499 - protein, 11 aa, Plasmodium falciparum
QSAEKKYEDKN

SEQ ID NO: 3244500 - protein, 5 aa, Plasmodium falciparum
QSAKN

SEQ ID NO: 3244501 - protein, 10 aa, Plasmodium falciparum
QSANDTANAI

SEQ ID NO: 3244502 - protein, 6 aa, Plasmodium falciparum
QSANVS

SEQ ID NO: 3244503 - protein, 15 aa, Plasmodium falciparum
QSASKPGQEPNSKRE

SEQ ID NO: 3244504 - protein, 20 aa, Plasmodium falciparum
QSDDDDKCSKPKYVKDRNNC

SEQ ID NO: 3244505 - protein, 10 aa, Plasmodium falciparum
QSDEKGQCPK

SEQ ID NO: 3244506 - protein, 8 aa, Plasmodium falciparum
QSDEKRED

SEQ ID NO: 3244507 - protein, 4 aa, Plasmodium falciparum
QSDG

SEQ ID NO: 3244508 - protein, 5 aa, Plasmodium falciparum
QSDIN

SEQ ID NO: 3244509 - protein, 8 aa, Plasmodium falciparum
QSDKDYEK

SEQ ID NO: 3244510 - protein, 81 aa, Plasmodium falciparum
QSDNEDDYDKEWREQEKKKSKTKKKLLEDNEKLGNEQGDKTDGKNKSNHNNNENDDNNENDDNNENDDDNDNDDDDNINDK

SEQ ID NO: 3244511 - protein, 6 aa, Plasmodium falciparum
QSDPIY

SEQ ID NO: 3244512 - protein, 4 aa, Plasmodium falciparum
QSDS

SEQ ID NO: 3244513 - protein, 5 aa, Plasmodium falciparum
QSDSI

SEQ ID NO: 3244514 - protein, 4 aa, Plasmodium falciparum
QSEA

SEQ ID NO: 3244515 - protein, 49 aa, Plasmodium falciparum
QSEDIDTGGDEEEKHKRESKQKGDDINGGINGGINGGINGGINGGITDK

SEQ ID NO: 3244516 - protein, 5 aa, Plasmodium falciparum
QSEDV

SEQ ID NO: 3244517 - protein, 8 aa, Plasmodium falciparum
QSEKDKVN

SEQ ID NO: 3244518 - protein, 15 aa, Plasmodium falciparum
QSEKKKNQSKNIPYE

SEQ ID NO: 3244519 - protein, 7 aa, Plasmodium falciparum
QSENDHT

SEQ ID NO: 3244520 - protein, 12 aa, Plasmodium falciparum
QSENYKKNKNKV

SEQ ID NO: 3244521 - protein, 17 aa, Plasmodium falciparum
QSENYNEVTNSQCNEDQ

SEQ ID NO: 3244522 - protein, 14 aa, Plasmodium falciparum
QSERSKKNNPSENV

SEQ ID NO: 3244523 - protein, 6 aa, Plasmodium falciparum
QSGDTQ

SEQ ID NO: 3244524 - protein, 9 aa, Plasmodium falciparum
QSGFNSSNF

SEQ ID NO: 3244525 - protein, 6 aa, Plasmodium falciparum
QSGKSS

SEQ ID NO: 3244526 - protein, 4 aa, Plasmodium falciparum
QSGM

SEQ ID NO: 3244527 - protein, 15 aa, Plasmodium falciparum
QSGNKYNFTEKGSKY

SEQ ID NO: 3244528 - protein, 33 aa, Plasmodium falciparum
QSGNNKGTSGTTSRGPQIGSHSPNPDKQQTERE

SEQ ID NO: 3244529 - protein, 6 aa, Plasmodium falciparum
QSGSNN

SEQ ID NO: 3244530 - protein, 20 aa, Plasmodium falciparum
QSGTEATSGAQENSVTTPQQ

SEQ ID NO: 3244531 - protein, 12 aa, Plasmodium falciparum
QSHGLSDGARNQ

SEQ ID NO: 3244532 - protein, 4 aa, Plasmodium falciparum
QSHV

SEQ ID NO: 3244533 - protein, 25 aa, Plasmodium falciparum
QSIKSPRLSKDKSHRSDSNSDSADS

SEQ ID NO: 3244534 - protein, 15 aa, Plasmodium falciparum
QSIPDPGDVEKSKYE

SEQ ID NO: 3244535 - protein, 6 aa, Plasmodium falciparum
QSIQEK

SEQ ID NO: 3244536 - protein, 7 aa, Plasmodium falciparum
QSIQPNT

SEQ ID NO: 3244537 - protein, 6 aa, Plasmodium falciparum
QSISDN

SEQ ID NO: 3244538 - protein, 23 aa, Plasmodium falciparum
QSKASKHLNNNKKNVESGKNNSC

SEQ ID NO: 3244539 - protein, 4 aa, Plasmodium falciparum
QSKE

SEQ ID NO: 3244540 - protein, 5 aa, Plasmodium falciparum
QSKET

SEQ ID NO: 3244541 - protein, 4 aa, Plasmodium falciparum
QSKK

SEQ ID NO: 3244542 - protein, 12 aa, Plasmodium falciparum
QSKMNNSSKENI

SEQ ID NO: 3244543 - protein, 13 aa, Plasmodium falciparum
QSKNEQNETKTNI

SEQ ID NO: 3244544 - protein, 7 aa, Plasmodium falciparum
QSKNKDQ

SEQ ID NO: 3244545 - protein, 6 aa, Plasmodium falciparum
QSKSVA

SEQ ID NO: 3244546 - protein, 31 aa, Plasmodium falciparum
QSKTSSSSNHKQDTHDELQDDHNATNKNNVK

SEQ ID NO: 3244547 - protein, 12 aa, Plasmodium falciparum
QSKVENNTSMTE

SEQ ID NO: 3244548 - protein, 7 aa, Plasmodium falciparum
QSLKGKN

SEQ ID NO: 3244549 - protein, 9 aa, Plasmodium falciparum
QSLNSSAND

SEQ ID NO: 3244550 - protein, 6 aa, Plasmodium falciparum
QSMSQK

SEQ ID NO: 3244551 - protein, 9 aa, Plasmodium falciparum
QSNDENNDM

SEQ ID NO: 3244552 - protein, 5 aa, Plasmodium falciparum
QSNEH

SEQ ID NO: 3244553 - protein, 10 aa, Plasmodium falciparum
QSNENVSNSC

SEQ ID NO: 3244554 - protein, 9 aa, Plasmodium falciparum
QSNFGNDNN

SEQ ID NO: 3244555 - protein, 12 aa, Plasmodium falciparum
QSNIGNTDNSLF

SEQ ID NO: 3244556 - protein, 10 aa, Plasmodium falciparum
QSNNEQHEAP

SEQ ID NO: 3244557 - protein, 5 aa, Plasmodium falciparum
QSNNI

SEQ ID NO: 3244558 - protein, 15 aa, Plasmodium falciparum
QSNNRDNLPSNDNKS

SEQ ID NO: 3244559 - protein, 5 aa, Plasmodium falciparum
QSNNY

SEQ ID NO: 3244560 - protein, 12 aa, Plasmodium falciparum
QSNPTENSPEVD

SEQ ID NO: 3244561 - protein, 29 aa, Plasmodium falciparum
QSNSFSDYDNNNNDNNNDNNNNNNNNNNN

SEQ ID NO: 3244562 - protein, 11 aa, Plasmodium falciparum
QSNSSKQSVNE

SEQ ID NO: 3244563 - protein, 19 aa, Plasmodium falciparum
QSNTSQSSNGKNNDDDDGF

SEQ ID NO: 3244564 - protein, 5 aa, Plasmodium falciparum
QSPAN

SEQ ID NO: 3244565 - protein, 7 aa, Plasmodium falciparum
QSPDRKL

SEQ ID NO: 3244566 - protein, 22 aa, Plasmodium falciparum
QSPKVSINKTDKSYRSHTKNND

SEQ ID NO: 3244567 - protein, 6 aa, Plasmodium falciparum
QSPNDF

SEQ ID NO: 3244568 - protein, 15 aa, Plasmodium falciparum
QSPQSSYSYRTDEKD

SEQ ID NO: 3244569 - protein, 5 aa, Plasmodium falciparum
QSQEY

SEQ ID NO: 3244570 - protein, 10 aa, Plasmodium falciparum
QSQHSLTNNN

SEQ ID NO: 3244571 - protein, 13 aa, Plasmodium falciparum
QSQQNQRKVDNEL

SEQ ID NO: 3244572 - protein, 23 aa, Plasmodium falciparum
QSQVITSEEDSEMKSSCREKNNN

SEQ ID NO: 3244573 - protein, 5 aa, Plasmodium falciparum
QSRKG

SEQ ID NO: 3244574 - protein, 8 aa, Plasmodium falciparum
QSRRDEKG

SEQ ID NO: 3244575 - protein, 6 aa, Plasmodium falciparum
QSSERF

SEQ ID NO: 3244576 - protein, 6 aa, Plasmodium falciparum
QSSHSN

SEQ ID NO: 3244577 - protein, 4 aa, Plasmodium falciparum
QSSI

SEQ ID NO: 3244578 - protein, 18 aa, Plasmodium falciparum
QSSIPLDNERKEKEKKNE

SEQ ID NO: 3244579 - protein, 5 aa, Plasmodium falciparum
QSSIY

SEQ ID NO: 3244580 - protein, 11 aa, Plasmodium falciparum
QSSKLKEHEDE

SEQ ID NO: 3244581 - protein, 21 aa, Plasmodium falciparum
QSSNQRDIKNKLNDDKSKRNM

SEQ ID NO: 3244582 - protein, 9 aa, Plasmodium falciparum
QSSNSDSRK

SEQ ID NO: 3244583 - protein, 6 aa, Plasmodium falciparum
QSSPQK

SEQ ID NO: 3244584 - protein, 33 aa, Plasmodium falciparum
QSSQNNNNNNNNNSHNNNSHSHNSNSHSNNQGD

SEQ ID NO: 3244585 - protein, 5 aa, Plasmodium falciparum
QSSSL

SEQ ID NO: 3244586 - protein, 10 aa, Plasmodium falciparum
QSSSRTNDTF

SEQ ID NO: 3244587 - protein, 8 aa, Plasmodium falciparum
QSSTNNMT

SEQ ID NO: 3244588 - protein, 6 aa, Plasmodium falciparum
QSSYNN

SEQ ID NO: 3244589 - protein, 10 aa, Plasmodium falciparum
QSTKYNSQCY

SEQ ID NO: 3244590 - protein, 4 aa, Plasmodium falciparum
QSTL

SEQ ID NO: 3244591 - protein, 47 aa, Plasmodium falciparum
QSTNSNTNNNINNNNKNEDNMVDNNENNDKNNDKNNDKNNNENKDCD

SEQ ID NO: 3244592 - protein, 8 aa, Plasmodium falciparum
QSTNVQNV

SEQ ID NO: 3244593 - protein, 4 aa, Plasmodium falciparum
QSTP

SEQ ID NO: 3244594 - protein, 30 aa, Plasmodium falciparum
QSTPKEVSKLDSEVKDKIEKKIKKKKRKTP

SEQ ID NO: 3244595 - protein, 7 aa, Plasmodium falciparum
QSTSGGM

SEQ ID NO: 3244596 - protein, 6 aa, Plasmodium falciparum
QSTSYP

SEQ ID NO: 3244597 - protein, 9 aa, Plasmodium falciparum
QSTTSEQQI

SEQ ID NO: 3244598 - protein, 5 aa, Plasmodium falciparum
QSTYQ

SEQ ID NO: 3244599 - protein, 10 aa, Plasmodium falciparum
QSYNEKYETY

SEQ ID NO: 3244600 - protein, 10 aa, Plasmodium falciparum
QSYNNTTNND

SEQ ID NO: 3244601 - protein, 47 aa, Plasmodium falciparum
QSYSSASPNLCESNDNETASHSGKNNTKKEKKKKKKKMGQDEKMNTK

SEQ ID NO: 3244602 - protein, 14 aa, Plasmodium falciparum
QSYTPTQRSNKKGW

SEQ ID NO: 3244603 - protein, 24 aa, Plasmodium falciparum
QSYTTGEKEHTSLRNGNDNPNAAE

SEQ ID NO: 3244604 - protein, 4 aa, Plasmodium falciparum
QTAN

SEQ ID NO: 3244605 - protein, 21 aa, Plasmodium falciparum
QTANNNSSSNSNNSNNETNEG

SEQ ID NO: 3244606 - protein, 4 aa, Plasmodium falciparum
QTCK

SEQ ID NO: 3244607 - protein, 17 aa, Plasmodium falciparum
QTDEENNKIKKKSSVHT

SEQ ID NO: 3244608 - protein, 12 aa, Plasmodium falciparum
QTDGEEEDEISD

SEQ ID NO: 3244609 - protein, 6 aa, Plasmodium falciparum
QTDLYN

SEQ ID NO: 3244610 - protein, 47 aa, Plasmodium falciparum
QTDQTQENDKTYASDTIKTENKDKNYNYEKKDKNYNYEKKDTHNTQN

SEQ ID NO: 3244611 - protein, 6 aa, Plasmodium falciparum
QTDSVT

SEQ ID NO: 3244612 - protein, 8 aa, Plasmodium falciparum
QTDTVSSD

SEQ ID NO: 3244613 - protein, 13 aa, Plasmodium falciparum
QTEDDDQTDGEGK

SEQ ID NO: 3244614 - protein, 9 aa, Plasmodium falciparum
QTEDDQNNI

SEQ ID NO: 3244615 - protein, 6 aa, Plasmodium falciparum
QTEDIK

SEQ ID NO: 3244616 - protein, 7 aa, Plasmodium falciparum
QTEDNYA

SEQ ID NO: 3244617 - protein, 13 aa, Plasmodium falciparum
QTEETKKIRHNES

SEQ ID NO: 3244618 - protein, 9 aa, Plasmodium falciparum
QTEKRRNKK

SEQ ID NO: 3244619 - protein, 10 aa, Plasmodium falciparum
QTEKTQDNVK

SEQ ID NO: 3244620 - protein, 8 aa, Plasmodium falciparum
QTETIKEK

SEQ ID NO: 3244621 - protein, 17 aa, Plasmodium falciparum
QTGEDTKDNIYNTDSTN

SEQ ID NO: 3244622 - protein, 45 aa, Plasmodium falciparum
QTGSTKNEINKYDDDDNNNDDHNNDDHNNDDHNNDDHDKHHQPCD

SEQ ID NO: 3244623 - protein, 5 aa, Plasmodium falciparum
QTHDK

SEQ ID NO: 3244624 - protein, 5 aa, Plasmodium falciparum
QTHLE

SEQ ID NO: 3244625 - protein, 6 aa, Plasmodium falciparum
QTHNDP

SEQ ID NO: 3244626 - protein, 28 aa, Plasmodium falciparum
QTIPQTPIENNPQQNETKNGTPPKNDTS

SEQ ID NO: 3244627 - protein, 19 aa, Plasmodium falciparum
QTISEQAGNAAIKAGETAN

SEQ ID NO: 3244628 - protein, 14 aa, Plasmodium falciparum
QTKDDYSDQKVGDL

SEQ ID NO: 3244629 - protein, 5 aa, Plasmodium falciparum
QTKEE

SEQ ID NO: 3244630 - protein, 19 aa, Plasmodium falciparum
QTKEEEINTYNNTHSSTTI

SEQ ID NO: 3244631 - protein, 8 aa, Plasmodium falciparum
QTKHNDKE

SEQ ID NO: 3244632 - protein, 4 aa, Plasmodium falciparum
QTKK

SEQ ID NO: 3244633 - protein, 8 aa, Plasmodium falciparum
QTKKCESL

SEQ ID NO: 3244634 - protein, 6 aa, Plasmodium falciparum
QTKKYK

SEQ ID NO: 3244635 - protein, 6 aa, Plasmodium falciparum
QTKNCK

SEQ ID NO: 3244636 - protein, 5 aa, Plasmodium falciparum
QTKNK

SEQ ID NO: 3244637 - protein, 9 aa, Plasmodium falciparum
QTKNNKTHF

SEQ ID NO: 3244638 - protein, 12 aa, Plasmodium falciparum
QTKNYNSSNAKH

SEQ ID NO: 3244639 - protein, 6 aa, Plasmodium falciparum
QTKPEE

SEQ ID NO: 3244640 - protein, 4 aa, Plasmodium falciparum
QTKQ

SEQ ID NO: 3244641 - protein, 21 aa, Plasmodium falciparum
QTKQEVSSSSSESRSSSFNNN

SEQ ID NO: 3244642 - protein, 4 aa, Plasmodium falciparum
QTKR

SEQ ID NO: 3244643 - protein, 4 aa, Plasmodium falciparum
QTKS

SEQ ID NO: 3244644 - protein, 4 aa, Plasmodium falciparum
QTLE

SEQ ID NO: 3244645 - protein, 4 aa, Plasmodium falciparum
QTLK

SEQ ID NO: 3244646 - protein, 13 aa, Plasmodium falciparum
QTNEQSLNENNYS

SEQ ID NO: 3244647 - protein, 28 aa, Plasmodium falciparum
QTNGDTTNSVARGGGADGSGSKSNSKEL

SEQ ID NO: 3244648 - protein, 18 aa, Plasmodium falciparum
QTNGSSGDCGGTNSDSSL

SEQ ID NO: 3244649 - protein, 4 aa, Plasmodium falciparum
QTNH

SEQ ID NO: 3244650 - protein, 13 aa, Plasmodium falciparum
QTNIQKQSSEINE

SEQ ID NO: 3244651 - protein, 32 aa, Plasmodium falciparum
QTNKNVKCKKEDIRNNYSPYDTNDEDKEEKIT

SEQ ID NO: 3244652 - protein, 7 aa, Plasmodium falciparum
QTNKSPE

SEQ ID NO: 3244653 - protein, 6 aa, Plasmodium falciparum
QTNLEE

SEQ ID NO: 3244654 - protein, 6 aa, Plasmodium falciparum
QTNNQT

SEQ ID NO: 3244655 - protein, 11 aa, Plasmodium falciparum
QTNNSNNFNND

SEQ ID NO: 3244656 - protein, 11 aa, Plasmodium falciparum
QTNNYNSGNAK

SEQ ID NO: 3244657 - protein, 5 aa, Plasmodium falciparum
QTNQT

SEQ ID NO: 3244658 - protein, 14 aa, Plasmodium falciparum
QTNQTNQTNQTNQT

SEQ ID NO: 3244659 - protein, 21 aa, Plasmodium falciparum
QTNQTNQTNQTNQTNQTNQTN

SEQ ID NO: 3244660 - protein, 4 aa, Plasmodium falciparum
QTNR

SEQ ID NO: 3244661 - protein, 19 aa, Plasmodium falciparum
QTNSPNDNNRVQDYNNKEQ

SEQ ID NO: 3244662 - protein, 6 aa, Plasmodium falciparum
QTNTNE

SEQ ID NO: 3244663 - protein, 13 aa, Plasmodium falciparum
QTNVTKKKKKEEN

SEQ ID NO: 3244664 - protein, 12 aa, Plasmodium falciparum
QTNYQNQSYSKY

SEQ ID NO: 3244665 - protein, 14 aa, Plasmodium falciparum
QTNYTNNNNNINNI

SEQ ID NO: 3244666 - protein, 5 aa, Plasmodium falciparum
QTNYY

SEQ ID NO: 3244667 - protein, 6 aa, Plasmodium falciparum
QTPNKN

SEQ ID NO: 3244668 - protein, 7 aa, Plasmodium falciparum
QTPQQMK

SEQ ID NO: 3244669 - protein, 4 aa, Plasmodium falciparum
QTQK

SEQ ID NO: 3244670 - protein, 9 aa, Plasmodium falciparum
QTQMNNTGD

SEQ ID NO: 3244671 - protein, 12 aa, Plasmodium falciparum
QTQNKNPHYHND

SEQ ID NO: 3244672 - protein, 5 aa, Plasmodium falciparum
QTQQR

SEQ ID NO: 3244673 - protein, 8 aa, Plasmodium falciparum
QTQQYPTN

SEQ ID NO: 3244674 - protein, 7 aa, Plasmodium falciparum
QTRTPEN

SEQ ID NO: 3244675 - protein, 15 aa, Plasmodium falciparum
QTSDGYKDMKPPPGL

SEQ ID NO: 3244676 - protein, 5 aa, Plasmodium falciparum
QTSDS

SEQ ID NO: 3244677 - protein, 6 aa, Plasmodium falciparum
QTSDSQ

SEQ ID NO: 3244678 - protein, 26 aa, Plasmodium falciparum
QTSERYKEYDKRTIKNRKKCKDQCDK

SEQ ID NO: 3244679 - protein, 21 aa, Plasmodium falciparum
QTSIYETPKNKEEDDNDDTNK

SEQ ID NO: 3244680 - protein, 6 aa, Plasmodium falciparum
QTSNTT

SEQ ID NO: 3244681 - protein, 5 aa, Plasmodium falciparum
QTSPG

SEQ ID NO: 3244682 - protein, 9 aa, Plasmodium falciparum
QTSSSSNTN

SEQ ID NO: 3244683 - protein, 7 aa, Plasmodium falciparum
QTSTKWN

SEQ ID NO: 3244684 - protein, 7 aa, Plasmodium falciparum
QTSTNTP

SEQ ID NO: 3244685 - protein, 4 aa, Plasmodium falciparum
QTSV

SEQ ID NO: 3244686 - protein, 5 aa, Plasmodium falciparum
QTSYD

SEQ ID NO: 3244687 - protein, 6 aa, Plasmodium falciparum
QTTEPI

SEQ ID NO: 3244688 - protein, 6 aa, Plasmodium falciparum
QTTKDE

SEQ ID NO: 3244689 - protein, 4 aa, Plasmodium falciparum
QTTN

SEQ ID NO: 3244690 - protein, 4 aa, Plasmodium falciparum
QTTR

SEQ ID NO: 3244691 - protein, 8 aa, Plasmodium falciparum
QTTTDDIR

SEQ ID NO: 3244692 - protein, 4 aa, Plasmodium falciparum
QTTY

SEQ ID NO: 3244693 - protein, 4 aa, Plasmodium falciparum
QTWP

SEQ ID NO: 3244694 - protein, 6 aa, Plasmodium falciparum
QTYEEL

SEQ ID NO: 3244695 - protein, 5 aa, Plasmodium falciparum
QTYGS

SEQ ID NO: 3244696 - protein, 10 aa, Plasmodium falciparum
QTYKDKQKYH

SEQ ID NO: 3244697 - protein, 12 aa, Plasmodium falciparum
QTYKEKNENISD

SEQ ID NO: 3244698 - protein, 4 aa, Plasmodium falciparum
QTYN

SEQ ID NO: 3244699 - protein, 14 aa, Plasmodium falciparum
QTYNTKENSNQPDD

SEQ ID NO: 3244700 - protein, 6 aa, Plasmodium falciparum
QTYPNN

SEQ ID NO: 3244701 - protein, 71 aa, Plasmodium falciparum
QVDDEDENVDEEDEQEEDDQEEDDQEEDYQEEDYQEEDYQEEDYQEEDYQEGDYDEGQNCGRKQNYSKKQN

SEQ ID NO: 3244702 - protein, 14 aa, Plasmodium falciparum
QVDNDSMEKISDKE

SEQ ID NO: 3244703 - protein, 58 aa, Plasmodium falciparum
QVEGGGTGKQSSQLQQQQQQQQEQQQQQQQLKPQSPVASNSTLTTSAKQSPSNPRADD

SEQ ID NO: 3244704 - protein, 6 aa, Plasmodium falciparum
QVENDE

SEQ ID NO: 3244705 - protein, 5 aa, Plasmodium falciparum
QVENK

SEQ ID NO: 3244706 - protein, 5 aa, Plasmodium falciparum
QVENT

SEQ ID NO: 3244707 - protein, 31 aa, Plasmodium falciparum
QVGNPRESESKPSGANGREDPSTESSTYNDG

SEQ ID NO: 3244708 - protein, 24 aa, Plasmodium falciparum
QVGTTQVDGKAAQGDAASKDPKVE

SEQ ID NO: 3244709 - protein, 4 aa, Plasmodium falciparum
QVKD

SEQ ID NO: 3244710 - protein, 52 aa, Plasmodium falciparum
QVKKSAHNKAYGNDDGDDNYDGDDYDDGDDNYDGDDYDDGDDCDDDDNYDDD

SEQ ID NO: 3244711 - protein, 8 aa, Plasmodium falciparum
QVKNNENN

SEQ ID NO: 3244712 - protein, 5 aa, Plasmodium falciparum
QVNNS

SEQ ID NO: 3244713 - protein, 6 aa, Plasmodium falciparum
QVPNTT

SEQ ID NO: 3244714 - protein, 24 aa, Plasmodium falciparum
QVPSEDNTQNTYDSQNPHRDTPNA

SEQ ID NO: 3244715 - protein, 7 aa, Plasmodium falciparum
QVPSKNN

SEQ ID NO: 3244716 - protein, 6 aa, Plasmodium falciparum
QVRRTG

SEQ ID NO: 3244717 - protein, 17 aa, Plasmodium falciparum
QVSDSNSADSKMKYGEQ

SEQ ID NO: 3244718 - protein, 6 aa, Plasmodium falciparum
QVSTPG

SEQ ID NO: 3244719 - protein, 7 aa, Plasmodium falciparum
QVTDNGA

SEQ ID NO: 3244720 - protein, 5 aa, Plasmodium falciparum
QVTPT

SEQ ID NO: 3244721 - protein, 10 aa, Plasmodium falciparum
QVTSEKGNEL

SEQ ID NO: 3244722 - protein, 5 aa, Plasmodium falciparum
QVYPN

SEQ ID NO: 3244723 - protein, 11 aa, Plasmodium falciparum
QWDKQKDNYNK

SEQ ID NO: 3244724 - protein, 29 aa, Plasmodium falciparum
QWENKTHSGNKHSDIPSGKLSDTPSDNNI

SEQ ID NO: 3244725 - protein, 5 aa, Plasmodium falciparum
QWKNE

SEQ ID NO: 3244726 - protein, 21 aa, Plasmodium falciparum
QWNKDNDGGDISSDSNKRLNT

SEQ ID NO: 3244727 - protein, 20 aa, Plasmodium falciparum
QWNKDNDGINVPSDNRSLNT

SEQ ID NO: 3244728 - protein, 38 aa, Plasmodium falciparum
QWNKDNNNSGNINPSGNTPPTSDIPSGKLSDIPSDNNI

SEQ ID NO: 3244729 - protein, 16 aa, Plasmodium falciparum
QWNKDNNVGGDIPNDN

SEQ ID NO: 3244730 - protein, 9 aa, Plasmodium falciparum
QYASSRDVI

SEQ ID NO: 3244731 - protein, 4 aa, Plasmodium falciparum
QYDA

SEQ ID NO: 3244732 - protein, 9 aa, Plasmodium falciparum
QYDEENKKE

SEQ ID NO: 3244733 - protein, 10 aa, Plasmodium falciparum
QYDEQYPSSV

SEQ ID NO: 3244734 - protein, 4 aa, Plasmodium falciparum
QYDG

SEQ ID NO: 3244735 - protein, 7 aa, Plasmodium falciparum
QYDNDDD

SEQ ID NO: 3244736 - protein, 5 aa, Plasmodium falciparum
QYDNL

SEQ ID NO: 3244737 - protein, 11 aa, Plasmodium falciparum
QYDNSNNSNKY

SEQ ID NO: 3244738 - protein, 12 aa, Plasmodium falciparum
QYEEQKERELPS

SEQ ID NO: 3244739 - protein, 4 aa, Plasmodium falciparum
QYEK

SEQ ID NO: 3244740 - protein, 6 aa, Plasmodium falciparum
QYEKDI

SEQ ID NO: 3244741 - protein, 10 aa, Plasmodium falciparum
QYEPPKNDAI

SEQ ID NO: 3244742 - protein, 7 aa, Plasmodium falciparum
QYESENE

SEQ ID NO: 3244743 - protein, 12 aa, Plasmodium falciparum
QYESKDEDVSSK

SEQ ID NO: 3244744 - protein, 13 aa, Plasmodium falciparum
QYHPDSNKNCKDC

SEQ ID NO: 3244745 - protein, 9 aa, Plasmodium falciparum
QYKKPDNYN

SEQ ID NO: 3244746 - protein, 27 aa, Plasmodium falciparum
QYKKQSKKFTTDKEKKEYKDDPDLDGA

SEQ ID NO: 3244747 - protein, 11 aa, Plasmodium falciparum
QYKSENSGDTF

SEQ ID NO: 3244748 - protein, 7 aa, Plasmodium falciparum
QYNDTKN

SEQ ID NO: 3244749 - protein, 18 aa, Plasmodium falciparum
QYNEKEDNNNEKNEEIEK

SEQ ID NO: 3244750 - protein, 7 aa, Plasmodium falciparum
QYNGDTD

SEQ ID NO: 3244751 - protein, 14 aa, Plasmodium falciparum
QYNKSSDDISKGRN

SEQ ID NO: 3244752 - protein, 4 aa, Plasmodium falciparum
QYNL

SEQ ID NO: 3244753 - protein, 5 aa, Plasmodium falciparum
QYNNK

SEQ ID NO: 3244754 - protein, 10 aa, Plasmodium falciparum
QYNNNNNNNI

SEQ ID NO: 3244755 - protein, 11 aa, Plasmodium falciparum
QYNNNNNNNNN

SEQ ID NO: 3244756 - protein, 30 aa, Plasmodium falciparum
QYNNSPEQNKKIKDTQNNTSSEVNINTQNE

SEQ ID NO: 3244757 - protein, 6 aa, Plasmodium falciparum
QYNNTH

SEQ ID NO: 3244758 - protein, 5 aa, Plasmodium falciparum
QYNPS

SEQ ID NO: 3244759 - protein, 10 aa, Plasmodium falciparum
QYNSSNNNRI

SEQ ID NO: 3244760 - protein, 5 aa, Plasmodium falciparum
QYNVN

SEQ ID NO: 3244761 - protein, 15 aa, Plasmodium falciparum
QYRSKANGDGKRYPC

SEQ ID NO: 3244762 - protein, 11 aa, Plasmodium falciparum
QYSGDGEDCDK

SEQ ID NO: 3244763 - protein, 8 aa, Plasmodium falciparum
QYSNNNKN

SEQ ID NO: 3244764 - protein, 17 aa, Plasmodium falciparum
QYSNNNNQKTLNEQTGL

SEQ ID NO: 3244765 - protein, 8 aa, Plasmodium falciparum
QYSQTQKV

SEQ ID NO: 3244766 - protein, 9 aa, Plasmodium falciparum
QYSSKEDMN

SEQ ID NO: 3244767 - protein, 6 aa, Plasmodium falciparum
QYSTDE

SEQ ID NO: 3244768 - protein, 5 aa, Plasmodium falciparum
QYSTR

SEQ ID NO: 3244769 - protein, 13 aa, Plasmodium falciparum
QYTSNATASNVTT

SEQ ID NO: 3244770 - protein, 4 aa, Plasmodium falciparum
RAAH

SEQ ID NO: 3244771 - protein, 9 aa, Plasmodium falciparum
RADRKLDYN

SEQ ID NO: 3244772 - protein, 70 aa, Plasmodium falciparum
RADTPTQATGGPRPATTKNTEDDDAEEDEEDEEEEEEEEEKENADAGGEDGKEEKSEEKEEDPPAAVEDT

SEQ ID NO: 3244773 - protein, 12 aa, Plasmodium falciparum
RADVNNKKKNYL

SEQ ID NO: 3244774 - protein, 5 aa, Plasmodium falciparum
RAEMA

SEQ ID NO: 3244775 - protein, 5 aa, Plasmodium falciparum
RAESL

SEQ ID NO: 3244776 - protein, 10 aa, Plasmodium falciparum
RAGKGRRGYR

SEQ ID NO: 3244777 - protein, 4 aa, Plasmodium falciparum
RAGN

SEQ ID NO: 3244778 - protein, 7 aa, Plasmodium falciparum
RAKGERD

SEQ ID NO: 3244779 - protein, 10 aa, Plasmodium falciparum
RAKGGSSKQH

SEQ ID NO: 3244780 - protein, 11 aa, Plasmodium falciparum
RAKSKLKNKEN

SEQ ID NO: 3244781 - protein, 7 aa, Plasmodium falciparum
RANDTSP

SEQ ID NO: 3244782 - protein, 7 aa, Plasmodium falciparum
RAPNGAN

SEQ ID NO: 3244783 - protein, 4 aa, Plasmodium falciparum
RAPV

SEQ ID NO: 3244784 - protein, 5 aa, Plasmodium falciparum
RARGK

SEQ ID NO: 3244785 - protein, 13 aa, Plasmodium falciparum
RARQRTSRLDRRE

SEQ ID NO: 3244786 - protein, 11 aa, Plasmodium falciparum
RARTGSSSINK

SEQ ID NO: 3244787 - protein, 6 aa, Plasmodium falciparum
RASAKK

SEQ ID NO: 3244788 - protein, 6 aa, Plasmodium falciparum
RASKEV

SEQ ID NO: 3244789 - protein, 10 aa, Plasmodium falciparum
RASTEGGYKK

SEQ ID NO: 3244790 - protein, 4 aa, Plasmodium falciparum
RATD

SEQ ID NO: 3244791 - protein, 4 aa, Plasmodium falciparum
RATK

SEQ ID NO: 3244792 - protein, 12 aa, Plasmodium falciparum
RAYTNNVKRRTD

SEQ ID NO: 3244793 - protein, 6 aa, Plasmodium falciparum
RAYTTD

SEQ ID NO: 3244794 - protein, 16 aa, Plasmodium falciparum
RCDKDKAGKPIKGSGN

SEQ ID NO: 3244795 - protein, 7 aa, Plasmodium falciparum
RCDSGSV

SEQ ID NO: 3244796 - protein, 8 aa, Plasmodium falciparum
RCKDDKVP

SEQ ID NO: 3244797 - protein, 17 aa, Plasmodium falciparum
RCKDENGKKPGSNADQV

SEQ ID NO: 3244798 - protein, 4 aa, Plasmodium falciparum
RCNN

SEQ ID NO: 3244799 - protein, 6 aa, Plasmodium falciparum
RCQPNP

SEQ ID NO: 3244800 - protein, 13 aa, Plasmodium falciparum
RCSSSPSERTHIS

SEQ ID NO: 3244801 - protein, 14 aa, Plasmodium falciparum
RCTKSSGAKVDDQV

SEQ ID NO: 3244802 - protein, 22 aa, Plasmodium falciparum
RDAARNRVKRADGSSATRVTAT

SEQ ID NO: 3244803 - protein, 4 aa, Plasmodium falciparum
RDAG

SEQ ID NO: 3244804 - protein, 9 aa, Plasmodium falciparum
RDAGEDNTM

SEQ ID NO: 3244805 - protein, 8 aa, Plasmodium falciparum
RDDDSISN

SEQ ID NO: 3244806 - protein, 10 aa, Plasmodium falciparum
RDDENNKNMN

SEQ ID NO: 3244807 - protein, 7 aa, Plasmodium falciparum
RDDIKKD

SEQ ID NO: 3244808 - protein, 10 aa, Plasmodium falciparum
RDDKRKKNNV

SEQ ID NO: 3244809 - protein, 11 aa, Plasmodium falciparum
RDDLPDGGASH

SEQ ID NO: 3244810 - protein, 46 aa, Plasmodium falciparum
RDDNKQNEEHDEDKDIKDDNQNNDYCSDDHEGNENDDDNNNNNNNN

SEQ ID NO: 3244811 - protein, 13 aa, Plasmodium falciparum
RDDNPNSITRRKK

SEQ ID NO: 3244812 - protein, 6 aa, Plasmodium falciparum
RDDNRV

SEQ ID NO: 3244813 - protein, 41 aa, Plasmodium falciparum
RDDPCGNGSASDKRFSKESGGECDDKKIEGNKNNSEGGACA

SEQ ID NO: 3244814 - protein, 8 aa, Plasmodium falciparum
RDDTTNKN

SEQ ID NO: 3244815 - protein, 64 aa, Plasmodium falciparum
RDEDENDYDQPPSTSSSNRGRGNERYSQSRDRREERNNYNSDYYTRGNERTYNNSNVTSSSNRE

SEQ ID NO: 3244816 - protein, 11 aa, Plasmodium falciparum
RDEDNNIKKPN

SEQ ID NO: 3244817 - protein, 10 aa, Plasmodium falciparum
RDEGNTNKSI

SEQ ID NO: 3244818 - protein, 14 aa, Plasmodium falciparum
RDEHNYRDEHNYRD

SEQ ID NO: 3244819 - protein, 6 aa, Plasmodium falciparum
RDEKNI

SEQ ID NO: 3244820 - protein, 5 aa, Plasmodium falciparum
RDENS

SEQ ID NO: 3244821 - protein, 4 aa, Plasmodium falciparum
RDES

SEQ ID NO: 3244822 - protein, 70 aa, Plasmodium falciparum
RDEYEDEDGDENYDEDDENDDENYDEDDENDDEDDENDDEYDDDDENDDENDDDDEDDDQYDDEDGYYDS

SEQ ID NO: 3244823 - protein, 5 aa, Plasmodium falciparum
RDEYT

SEQ ID NO: 3244824 - protein, 5 aa, Plasmodium falciparum
RDGLT

SEQ ID NO: 3244825 - protein, 8 aa, Plasmodium falciparum
RDGNEKKN

SEQ ID NO: 3244826 - protein, 9 aa, Plasmodium falciparum
RDGNNMQSS

SEQ ID NO: 3244827 - protein, 9 aa, Plasmodium falciparum
RDIDTNKNV

SEQ ID NO: 3244828 - protein, 7 aa, Plasmodium falciparum
RDIRGTD

SEQ ID NO: 3244829 - protein, 4 aa, Plasmodium falciparum
RDKG

SEQ ID NO: 3244830 - protein, 10 aa, Plasmodium falciparum
RDKNKKNVPL

SEQ ID NO: 3244831 - protein, 11 aa, Plasmodium falciparum
RDKNLSDTELY

SEQ ID NO: 3244832 - protein, 7 aa, Plasmodium falciparum
RDKNNQA

SEQ ID NO: 3244833 - protein, 6 aa, Plasmodium falciparum
RDKQFN

SEQ ID NO: 3244834 - protein, 13 aa, Plasmodium falciparum
RDKSKSKDIEKHK

SEQ ID NO: 3244835 - protein, 14 aa, Plasmodium falciparum
RDKYQGDDRYCSRN

SEQ ID NO: 3244836 - protein, 6 aa, Plasmodium falciparum
RDMDET

SEQ ID NO: 3244837 - protein, 14 aa, Plasmodium falciparum
RDMHDKNNKENCDI

SEQ ID NO: 3244838 - protein, 4 aa, Plasmodium falciparum
RDMS

SEQ ID NO: 3244839 - protein, 11 aa, Plasmodium falciparum
RDNANLDGSNQ

SEQ ID NO: 3244840 - protein, 8 aa, Plasmodium falciparum
RDNASSEY

SEQ ID NO: 3244841 - protein, 27 aa, Plasmodium falciparum
RDNEMSCNNRRSSTNSTSSNNKKYSNV

SEQ ID NO: 3244842 - protein, 5 aa, Plasmodium falciparum
RDNEN

SEQ ID NO: 3244843 - protein, 6 aa, Plasmodium falciparum
RDNEYN

SEQ ID NO: 3244844 - protein, 15 aa, Plasmodium falciparum
RDNGNIYDDEKKNLY

SEQ ID NO: 3244845 - protein, 8 aa, Plasmodium falciparum
RDNKEIKE

SEQ ID NO: 3244846 - protein, 21 aa, Plasmodium falciparum
RDNKGNPTNYNNISGKEKNRN

SEQ ID NO: 3244847 - protein, 10 aa, Plasmodium falciparum
RDNKKEKKNE

SEQ ID NO: 3244848 - protein, 8 aa, Plasmodium falciparum
RDNKNGRN

SEQ ID NO: 3244849 - protein, 8 aa, Plasmodium falciparum
RDNNDNNK

SEQ ID NO: 3244850 - protein, 7 aa, Plasmodium falciparum
RDNNEEI

SEQ ID NO: 3244851 - protein, 11 aa, Plasmodium falciparum
RDNNNNNIKEK

SEQ ID NO: 3244852 - protein, 11 aa, Plasmodium falciparum
RDNNNNNKNNV

SEQ ID NO: 3244853 - protein, 28 aa, Plasmodium falciparum
RDNNSIKPCTYPPNPTPNPCGTNNNGGK

SEQ ID NO: 3244854 - protein, 7 aa, Plasmodium falciparum
RDNVDEK

SEQ ID NO: 3244855 - protein, 6 aa, Plasmodium falciparum
RDNVPK

SEQ ID NO: 3244856 - protein, 7 aa, Plasmodium falciparum
RDPPEGV

SEQ ID NO: 3244857 - protein, 9 aa, Plasmodium falciparum
RDPPKGKDN

SEQ ID NO: 3244858 - protein, 6 aa, Plasmodium falciparum
RDQENN

SEQ ID NO: 3244859 - protein, 6 aa, Plasmodium falciparum
RDQIKS

SEQ ID NO: 3244860 - protein, 9 aa, Plasmodium falciparum
RDQKASNKM

SEQ ID NO: 3244861 - protein, 10 aa, Plasmodium falciparum
RDRINPPERT

SEQ ID NO: 3244862 - protein, 15 aa, Plasmodium falciparum
RDRKHGDQTNTNNYI

SEQ ID NO: 3244863 - protein, 4 aa, Plasmodium falciparum
RDRL

SEQ ID NO: 3244864 - protein, 10 aa, Plasmodium falciparum
RDSAHDEYDN

SEQ ID NO: 3244865 - protein, 17 aa, Plasmodium falciparum
RDSEEKGGTPTQNNTVK

SEQ ID NO: 3244866 - protein, 19 aa, Plasmodium falciparum
RDSEIKKKKNKNINEYTNT

SEQ ID NO: 3244867 - protein, 17 aa, Plasmodium falciparum
RDSGDKGGKPQKVEAAN

SEQ ID NO: 3244868 - protein, 8 aa, Plasmodium falciparum
RDSPPNKM

SEQ ID NO: 3244869 - protein, 8 aa, Plasmodium falciparum
RDSTHNDG

SEQ ID NO: 3244870 - protein, 6 aa, Plasmodium falciparum
RDTKKP

SEQ ID NO: 3244871 - protein, 6 aa, Plasmodium falciparum
RDTLDK

SEQ ID NO: 3244872 - protein, 8 aa, Plasmodium falciparum
RDTMNSDN

SEQ ID NO: 3244873 - protein, 11 aa, Plasmodium falciparum
RDTNKNTSSSV

SEQ ID NO: 3244874 - protein, 7 aa, Plasmodium falciparum
RDTPTSL

SEQ ID NO: 3244875 - protein, 14 aa, Plasmodium falciparum
RDTTNFNNKENFND

SEQ ID NO: 3244876 - protein, 5 aa, Plasmodium falciparum
RDVEN

SEQ ID NO: 3244877 - protein, 9 aa, Plasmodium falciparum
RDVENYDKG

SEQ ID NO: 3244878 - protein, 5 aa, Plasmodium falciparum
RDVET

SEQ ID NO: 3244879 - protein, 5 aa, Plasmodium falciparum
RDVQD

SEQ ID NO: 3244880 - protein, 8 aa, Plasmodium falciparum
RDYRSGKK

SEQ ID NO: 3244881 - protein, 4 aa, Plasmodium falciparum
RDYV

SEQ ID NO: 3244882 - protein, 6 aa, Plasmodium falciparum
RDYYNN

SEQ ID NO: 3244883 - protein, 5 aa, Plasmodium falciparum
READS

SEQ ID NO: 3244884 - protein, 7 aa, Plasmodium falciparum
REDANYR

SEQ ID NO: 3244885 - protein, 7 aa, Plasmodium falciparum
REDATLE

SEQ ID NO: 3244886 - protein, 30 aa, Plasmodium falciparum
REDEHGKALTNKEMNNNNNNNNNNDDNIYN

SEQ ID NO: 3244887 - protein, 10 aa, Plasmodium falciparum
REDEYKNKTL

SEQ ID NO: 3244888 - protein, 8 aa, Plasmodium falciparum
REDGKEKI

SEQ ID NO: 3244889 - protein, 13 aa, Plasmodium falciparum
REDIHNKDEQQNK

SEQ ID NO: 3244890 - protein, 42 aa, Plasmodium falciparum
REDINNKREDINNKREDINNKREDINNKSEDMYNKSKYKDEH

SEQ ID NO: 3244891 - protein, 8 aa, Plasmodium falciparum
REDNSDQN

SEQ ID NO: 3244892 - protein, 16 aa, Plasmodium falciparum
REDNSTPNSKKNCSNT

SEQ ID NO: 3244893 - protein, 9 aa, Plasmodium falciparum
REDPIASET

SEQ ID NO: 3244894 - protein, 14 aa, Plasmodium falciparum
REDQYEYDKNEDEI

SEQ ID NO: 3244895 - protein, 6 aa, Plasmodium falciparum
REDRER

SEQ ID NO: 3244896 - protein, 6 aa, Plasmodium falciparum
REDTSI

SEQ ID NO: 3244897 - protein, 4 aa, Plasmodium falciparum
REDV

SEQ ID NO: 3244898 - protein, 18 aa, Plasmodium falciparum
REECTSEDHKSKEGTSYC

SEQ ID NO: 3244899 - protein, 14 aa, Plasmodium falciparum
REEDEKWSNLEDTD

SEQ ID NO: 3244900 - protein, 11 aa, Plasmodium falciparum
REEEEEEKHTH

SEQ ID NO: 3244901 - protein, 9 aa, Plasmodium falciparum
REEENQNKI

SEQ ID NO: 3244902 - protein, 8 aa, Plasmodium falciparum
REEHNKDR

SEQ ID NO: 3244903 - protein, 4 aa, Plasmodium falciparum
REEI

SEQ ID NO: 3244904 - protein, 8 aa, Plasmodium falciparum
REEISPKS

SEQ ID NO: 3244905 - protein, 10 aa, Plasmodium falciparum
REEKDRDSSI

SEQ ID NO: 3244906 - protein, 7 aa, Plasmodium falciparum
REEKSEY

SEQ ID NO: 3244907 - protein, 21 aa, Plasmodium falciparum
REELRKNEDNYKKEKDKNNNI

SEQ ID NO: 3244908 - protein, 4 aa, Plasmodium falciparum
REEN

SEQ ID NO: 3244909 - protein, 10 aa, Plasmodium falciparum
REENDATECK

SEQ ID NO: 3244910 - protein, 62 aa, Plasmodium falciparum
REENEANKINEENKENEKNEENKEDEKNEENKDEKNEENKEDEKNEENKEDEKNEENNYYDD

SEQ ID NO: 3244911 - protein, 45 aa, Plasmodium falciparum
REENGEKKKNEKNESEKNERNEKNEKNEKHEKHEKHEKNEKNGSV

SEQ ID NO: 3244912 - protein, 18 aa, Plasmodium falciparum
REENGKNKSSQENSDDNI

SEQ ID NO: 3244913 - protein, 12 aa, Plasmodium falciparum
REEPNNSQEIKN

SEQ ID NO: 3244914 - protein, 12 aa, Plasmodium falciparum
REEQNKKNKEKN

SEQ ID NO: 3244915 - protein, 4 aa, Plasmodium falciparum
REER

SEQ ID NO: 3244916 - protein, 4 aa, Plasmodium falciparum
REES

SEQ ID NO: 3244917 - protein, 10 aa, Plasmodium falciparum
REESSEKSCD

SEQ ID NO: 3244918 - protein, 7 aa, Plasmodium falciparum
REFPSTQ

SEQ ID NO: 3244919 - protein, 10 aa, Plasmodium falciparum
REGENGKEKY

SEQ ID NO: 3244920 - protein, 6 aa, Plasmodium falciparum
REGESI

SEQ ID NO: 3244921 - protein, 7 aa, Plasmodium falciparum
REGGPNL

SEQ ID NO: 3244922 - protein, 31 aa, Plasmodium falciparum
REGNEWKEKKKNTDQCTSGKRYKPKNNAEAT

SEQ ID NO: 3244923 - protein, 4 aa, Plasmodium falciparum
REGR

SEQ ID NO: 3244924 - protein, 7 aa, Plasmodium falciparum
REGSINE

SEQ ID NO: 3244925 - protein, 11 aa, Plasmodium falciparum
REGTQTTASTI

SEQ ID NO: 3244926 - protein, 20 aa, Plasmodium falciparum
REHKKDGTVRISEGTNQTTF

SEQ ID NO: 3244927 - protein, 4 aa, Plasmodium falciparum
REIN

SEQ ID NO: 3244928 - protein, 5 aa, Plasmodium falciparum
REIQS

SEQ ID NO: 3244929 - protein, 18 aa, Plasmodium falciparum
REKAYKSRTSLASTNSSI

SEQ ID NO: 3244930 - protein, 24 aa, Plasmodium falciparum
REKDEDELENNKYSNNNKNNNNNY

SEQ ID NO: 3244931 - protein, 11 aa, Plasmodium falciparum
REKDIKADAKV

SEQ ID NO: 3244932 - protein, 8 aa, Plasmodium falciparum
REKDKTKD

SEQ ID NO: 3244933 - protein, 5 aa, Plasmodium falciparum
REKDS

SEQ ID NO: 3244934 - protein, 67 aa, Plasmodium falciparum
REKEGNNIHTKKHKEDKFYEDGHDEGYDDGHDGAYDGAYEDGHDDGLDNGHDGAYDDGLDNGHDDDM

SEQ ID NO: 3244935 - protein, 62 aa, Plasmodium falciparum
REKENKDDIKGDNKKGNDNKTNEDNKKDNDKKTNEDKKKDNDNKTNEDKKKDNDNKTDDDNY

SEQ ID NO: 3244936 - protein, 8 aa, Plasmodium falciparum
REKEQIET

SEQ ID NO: 3244937 - protein, 4 aa, Plasmodium falciparum
REKI

SEQ ID NO: 3244938 - protein, 6 aa, Plasmodium falciparum
REKIQN

SEQ ID NO: 3244939 - protein, 9 aa, Plasmodium falciparum
REKKKGYDN

SEQ ID NO: 3244940 - protein, 13 aa, Plasmodium falciparum
REKKKKKNKWNKD

SEQ ID NO: 3244941 - protein, 21 aa, Plasmodium falciparum
REKKKKNIKTSANYKKKQNYI

SEQ ID NO: 3244942 - protein, 14 aa, Plasmodium falciparum
REKKQKEHPLKDSE

SEQ ID NO: 3244943 - protein, 8 aa, Plasmodium falciparum
REKNITDP

SEQ ID NO: 3244944 - protein, 10 aa, Plasmodium falciparum
REKNSQNEIY

SEQ ID NO: 3244945 - protein, 14 aa, Plasmodium falciparum
REKRENPDGEPLNT

SEQ ID NO: 3244946 - protein, 6 aa, Plasmodium falciparum
REKRKG

SEQ ID NO: 3244947 - protein, 8 aa, Plasmodium falciparum
REKRKYTT

SEQ ID NO: 3244948 - protein, 26 aa, Plasmodium falciparum
REKRRNKKYYTNKNNDFNNLGKNNKV

SEQ ID NO: 3244949 - protein, 6 aa, Plasmodium falciparum
REKSMD

SEQ ID NO: 3244950 - protein, 14 aa, Plasmodium falciparum
REKYNNEEGNDSDL

SEQ ID NO: 3244951 - protein, 9 aa, Plasmodium falciparum
REKYNTDTY

SEQ ID NO: 3244952 - protein, 11 aa, Plasmodium falciparum
RELETREAGRR

SEQ ID NO: 3244953 - protein, 49 aa, Plasmodium falciparum
RELQEKKKAKKIQEEKEKVEKMSAEQQRKYEEKKQKKSLRKMKKIKIIK

SEQ ID NO: 3244954 - protein, 34 aa, Plasmodium falciparum
RELQERTNNINNNNNNNINSSSNNNNNSKNYNSA

SEQ ID NO: 3244955 - protein, 5 aa, Plasmodium falciparum
RELSK

SEQ ID NO: 3244956 - protein, 4 aa, Plasmodium falciparum
REMP

SEQ ID NO: 3244957 - protein, 5 aa, Plasmodium falciparum
RENDK

SEQ ID NO: 3244958 - protein, 11 aa, Plasmodium falciparum
RENDNGNDYKN

SEQ ID NO: 3244959 - protein, 9 aa, Plasmodium falciparum
RENEEGSLK

SEQ ID NO: 3244960 - protein, 6 aa, Plasmodium falciparum
RENIKD

SEQ ID NO: 3244961 - protein, 5 aa, Plasmodium falciparum
RENIN

SEQ ID NO: 3244962 - protein, 5 aa, Plasmodium falciparum
RENIP

SEQ ID NO: 3244963 - protein, 14 aa, Plasmodium falciparum
RENKKIKKNDKEDI

SEQ ID NO: 3244964 - protein, 6 aa, Plasmodium falciparum
RENKYS

SEQ ID NO: 3244965 - protein, 14 aa, Plasmodium falciparum
RENNKNNDNYNENY

SEQ ID NO: 3244966 - protein, 8 aa, Plasmodium falciparum
RENNNNNN

SEQ ID NO: 3244967 - protein, 40 aa, Plasmodium falciparum
RENQNINTTPTNEFSEQQQQQQHHNDLKNKNKNNSEGHNY

SEQ ID NO: 3244968 - protein, 5 aa, Plasmodium falciparum
RENRT

SEQ ID NO: 3244969 - protein, 13 aa, Plasmodium falciparum
RENSNDRNINNPL

SEQ ID NO: 3244970 - protein, 11 aa, Plasmodium falciparum
RENTQKGESNN

SEQ ID NO: 3244971 - protein, 31 aa, Plasmodium falciparum
RENTREDPSNNMDYTNKSTSDSNDIENENKM

SEQ ID NO: 3244972 - protein, 8 aa, Plasmodium falciparum
RENTYKKK

SEQ ID NO: 3244973 - protein, 6 aa, Plasmodium falciparum
RENYPG

SEQ ID NO: 3244974 - protein, 8 aa, Plasmodium falciparum
REPVQNNS

SEQ ID NO: 3244975 - protein, 12 aa, Plasmodium falciparum
REQDKSGNQRYC

SEQ ID NO: 3244976 - protein, 4 aa, Plasmodium falciparum
REQL

SEQ ID NO: 3244977 - protein, 6 aa, Plasmodium falciparum
REQNDY

SEQ ID NO: 3244978 - protein, 66 aa, Plasmodium falciparum
REQQVNQNYNEDDGDGDDNNNDDDNNNDDDNNNDDGDNNNDDDNNNDDNNNDDGDNNNDDDNNNNN

SEQ ID NO: 3244979 - protein, 29 aa, Plasmodium falciparum
REQSSSDNNLSPPHGTPGQPNSVKTPQQT

SEQ ID NO: 3244980 - protein, 27 aa, Plasmodium falciparum
REQSSSDNNPSPRSVKTPSTSDKDPQT

SEQ ID NO: 3244981 - protein, 5 aa, Plasmodium falciparum
REQTE

SEQ ID NO: 3244982 - protein, 8 aa, Plasmodium falciparum
REQYNEEN

SEQ ID NO: 3244983 - protein, 5 aa, Plasmodium falciparum
RERKN

SEQ ID NO: 3244984 - protein, 15 aa, Plasmodium falciparum
RERKNNFYKDKENNP

SEQ ID NO: 3244985 - protein, 30 aa, Plasmodium falciparum
RERKYSKRNTQEQGVQQENNEQVEKGPPDL

SEQ ID NO: 3244986 - protein, 41 aa, Plasmodium falciparum
RERNKKRNNKKRTNIYDSDEESESSEETSKDPYSSGPYTVD

SEQ ID NO: 3244987 - protein, 6 aa, Plasmodium falciparum
RERNNN

SEQ ID NO: 3244988 - protein, 18 aa, Plasmodium falciparum
RERRSSKYENSSYNKKKD

SEQ ID NO: 3244989 - protein, 30 aa, Plasmodium falciparum
RERSDNNNNNNNDDNNNNNNNNNNKINNEG

SEQ ID NO: 3244990 - protein, 9 aa, Plasmodium falciparum
RERSEKNEI

SEQ ID NO: 3244991 - protein, 6 aa, Plasmodium falciparum
RERTDN

SEQ ID NO: 3244992 - protein, 26 aa, Plasmodium falciparum
RERTKSKTKKNSRRNINNNANKHTYT

SEQ ID NO: 3244993 - protein, 9 aa, Plasmodium falciparum
RESANEKEI

SEQ ID NO: 3244994 - protein, 10 aa, Plasmodium falciparum
RESDNGNSEN

SEQ ID NO: 3244995 - protein, 6 aa, Plasmodium falciparum
RESEEP

SEQ ID NO: 3244996 - protein, 18 aa, Plasmodium falciparum
RESIGTKKKDIKKDQNDR

SEQ ID NO: 3244997 - protein, 11 aa, Plasmodium falciparum
RESIHNDNKTI

SEQ ID NO: 3244998 - protein, 6 aa, Plasmodium falciparum
RESKRI

SEQ ID NO: 3244999 - protein, 6 aa, Plasmodium falciparum
RESNNI

SEQ ID NO: 3245000 - protein, 20 aa, Plasmodium falciparum
RESQADAHIEPKNENIQNGK

SEQ ID NO: 3245001 - protein, 8 aa, Plasmodium falciparum
RESQANSN

SEQ ID NO: 3245002 - protein, 4 aa, Plasmodium falciparum
RETE

SEQ ID NO: 3245003 - protein, 6 aa, Plasmodium falciparum
RETKKY

SEQ ID NO: 3245004 - protein, 5 aa, Plasmodium falciparum
RETKP

SEQ ID NO: 3245005 - protein, 9 aa, Plasmodium falciparum
RETQPPRQK

SEQ ID NO: 3245006 - protein, 12 aa, Plasmodium falciparum
RETRHNDKNVQN

SEQ ID NO: 3245007 - protein, 9 aa, Plasmodium falciparum
RETSKKDKV

SEQ ID NO: 3245008 - protein, 10 aa, Plasmodium falciparum
RETVNAENEQ

SEQ ID NO: 3245009 - protein, 85 aa, Plasmodium falciparum
RETVSRRDRDDEDDNYDDDDENYDDDDDNYDDDENYEDDENYDDDDENYDDGENYEDDENYNDDENYDDDENYDDEYDDDDYPFN

SEQ ID NO: 3245010 - protein, 83 aa, Plasmodium falciparum
REYDDNKYNPYNKTNNHNTNQNGSTTYGSNANGTYGPNGTYGSNGTYEPNESYGPNGAYGPNGTYGHNGKYGSKGTYGNNETP

SEQ ID NO: 3245011 - protein, 5 aa, Plasmodium falciparum
REYRD

SEQ ID NO: 3245012 - protein, 4 aa, Plasmodium falciparum
REYS

SEQ ID NO: 3245013 - protein, 6 aa, Plasmodium falciparum
REYTNV

SEQ ID NO: 3245014 - protein, 8 aa, Plasmodium falciparum
REYTSQNE

SEQ ID NO: 3245015 - protein, 16 aa, Plasmodium falciparum
RFENEPEGLQTQGNPC

SEQ ID NO: 3245016 - protein, 27 aa, Plasmodium falciparum
RFKNNAEKKKKDKLKKKKVQTDKILFG

SEQ ID NO: 3245017 - protein, 4 aa, Plasmodium falciparum
RFKQ

SEQ ID NO: 3245018 - protein, 5 aa, Plasmodium falciparum
RFNEK

SEQ ID NO: 3245019 - protein, 6 aa, Plasmodium falciparum
RFNNES

SEQ ID NO: 3245020 - protein, 19 aa, Plasmodium falciparum
RFSNKKKKKGKKKRKNEMV

SEQ ID NO: 3245021 - protein, 5 aa, Plasmodium falciparum
RFSRD

SEQ ID NO: 3245022 - protein, 13 aa, Plasmodium falciparum
RFSTKGYSKYGGN

SEQ ID NO: 3245023 - protein, 4 aa, Plasmodium falciparum
RGAE

SEQ ID NO: 3245024 - protein, 14 aa, Plasmodium falciparum
RGCGSNIAKPSEEY

SEQ ID NO: 3245025 - protein, 11 aa, Plasmodium falciparum
RGDDKKEEGEI

SEQ ID NO: 3245026 - protein, 15 aa, Plasmodium falciparum
RGDENTNRSNDGDGF

SEQ ID NO: 3245027 - protein, 16 aa, Plasmodium falciparum
RGDENTNRSNDGDGFD

SEQ ID NO: 3245028 - protein, 7 aa, Plasmodium falciparum
RGDNVPR

SEQ ID NO: 3245029 - protein, 47 aa, Plasmodium falciparum
RGDPCGKDGTGKEDDSKRFSKESGAECDEKKIKDNKSKGGNNEGACA

SEQ ID NO: 3245030 - protein, 44 aa, Plasmodium falciparum
RGDPCGKGKEHRFSKERGAECDDNKIEGNVRSKGKGGKSAGACA

SEQ ID NO: 3245031 - protein, 14 aa, Plasmodium falciparum
RGDPCKKDTNGNDV

SEQ ID NO: 3245032 - protein, 6 aa, Plasmodium falciparum
RGDSIQ

SEQ ID NO: 3245033 - protein, 7 aa, Plasmodium falciparum
RGDSNKN

SEQ ID NO: 3245034 - protein, 11 aa, Plasmodium falciparum
RGEDPNINSNS

SEQ ID NO: 3245035 - protein, 14 aa, Plasmodium falciparum
RGEEKKRNCEEPDK

SEQ ID NO: 3245036 - protein, 4 aa, Plasmodium falciparum
RGEI

SEQ ID NO: 3245037 - protein, 18 aa, Plasmodium falciparum
RGEQTNSNDEYKKKNSYY

SEQ ID NO: 3245038 - protein, 9 aa, Plasmodium falciparum
RGERDGEKY

SEQ ID NO: 3245039 - protein, 6 aa, Plasmodium falciparum
RGFDKD

SEQ ID NO: 3245040 - protein, 8 aa, Plasmodium falciparum
RGINNGKN

SEQ ID NO: 3245041 - protein, 11 aa, Plasmodium falciparum
RGIPKSSINNG

SEQ ID NO: 3245042 - protein, 6 aa, Plasmodium falciparum
RGISGR

SEQ ID NO: 3245043 - protein, 10 aa, Plasmodium falciparum
RGKDGDRVKN

SEQ ID NO: 3245044 - protein, 11 aa, Plasmodium falciparum
RGKDKNSEERY

SEQ ID NO: 3245045 - protein, 6 aa, Plasmodium falciparum
RGKEAL

SEQ ID NO: 3245046 - protein, 10 aa, Plasmodium falciparum
RGKEDRKQLR

SEQ ID NO: 3245047 - protein, 10 aa, Plasmodium falciparum
RGKKGSNENM

SEQ ID NO: 3245048 - protein, 9 aa, Plasmodium falciparum
RGKKNKSSI

SEQ ID NO: 3245049 - protein, 10 aa, Plasmodium falciparum
RGKNDKKVKR

SEQ ID NO: 3245050 - protein, 15 aa, Plasmodium falciparum
RGKNKNKNKNKKGDI

SEQ ID NO: 3245051 - protein, 35 aa, Plasmodium falciparum
RGKNSSDHKYAQPEEPRPTPKRKEGVRRNNTYSNN

SEQ ID NO: 3245052 - protein, 16 aa, Plasmodium falciparum
RGKPIGSPPSSAIPTK

SEQ ID NO: 3245053 - protein, 6 aa, Plasmodium falciparum
RGKQNR

SEQ ID NO: 3245054 - protein, 8 aa, Plasmodium falciparum
RGKSIGKK

SEQ ID NO: 3245055 - protein, 4 aa, Plasmodium falciparum
RGLP

SEQ ID NO: 3245056 - protein, 5 aa, Plasmodium falciparum
RGNAN

SEQ ID NO: 3245057 - protein, 17 aa, Plasmodium falciparum
RGNDKVCSGDGEDCEEV

SEQ ID NO: 3245058 - protein, 5 aa, Plasmodium falciparum
RGNGL

SEQ ID NO: 3245059 - protein, 8 aa, Plasmodium falciparum
RGNHKEPN

SEQ ID NO: 3245060 - protein, 7 aa, Plasmodium falciparum
RGNNNIQ

SEQ ID NO: 3245061 - protein, 9 aa, Plasmodium falciparum
RGNNNNSSY

SEQ ID NO: 3245062 - protein, 11 aa, Plasmodium falciparum
RGNNRENDKLE

SEQ ID NO: 3245063 - protein, 70 aa, Plasmodium falciparum
RGNRKNPKGKLSTNGKLSTNGKLSTNGKLSTNGKLSTKEKLSTKEKLSTKEKLSTNGKLSIKGKEHTNKI

SEQ ID NO: 3245064 - protein, 7 aa, Plasmodium falciparum
RGNSATN

SEQ ID NO: 3245065 - protein, 7 aa, Plasmodium falciparum
RGNTNIT

SEQ ID NO: 3245066 - protein, 6 aa, Plasmodium falciparum
RGNTPN

SEQ ID NO: 3245067 - protein, 6 aa, Plasmodium falciparum
RGNYTN

SEQ ID NO: 3245068 - protein, 5 aa, Plasmodium falciparum
RGPEE

SEQ ID NO: 3245069 - protein, 7 aa, Plasmodium falciparum
RGPLTNE

SEQ ID NO: 3245070 - protein, 10 aa, Plasmodium falciparum
RGPNNYNDEN

SEQ ID NO: 3245071 - protein, 6 aa, Plasmodium falciparum
RGPSSL

SEQ ID NO: 3245072 - protein, 16 aa, Plasmodium falciparum
RGPVSELNEQNEENDL

SEQ ID NO: 3245073 - protein, 10 aa, Plasmodium falciparum
RGQDISGNQR

SEQ ID NO: 3245074 - protein, 5 aa, Plasmodium falciparum
RGQNR

SEQ ID NO: 3245075 - protein, 7 aa, Plasmodium falciparum
RGQYQDA

SEQ ID NO: 3245076 - protein, 6 aa, Plasmodium falciparum
RGREEK

SEQ ID NO: 3245077 - protein, 8 aa, Plasmodium falciparum
RGRGKSAT

SEQ ID NO: 3245078 - protein, 17 aa, Plasmodium falciparum
RGRKKQKRDSDEGNNIP

SEQ ID NO: 3245079 - protein, 6 aa, Plasmodium falciparum
RGRTNT

SEQ ID NO: 3245080 - protein, 8 aa, Plasmodium falciparum
RGSEDTAG

SEQ ID NO: 3245081 - protein, 17 aa, Plasmodium falciparum
RGSHRSYSTHQSYRTHQ

SEQ ID NO: 3245082 - protein, 8 aa, Plasmodium falciparum
RGSKSPND

SEQ ID NO: 3245083 - protein, 8 aa, Plasmodium falciparum
RGSKTKKK

SEQ ID NO: 3245084 - protein, 8 aa, Plasmodium falciparum
RGSTYNEC

SEQ ID NO: 3245085 - protein, 5 aa, Plasmodium falciparum
RGTDN

SEQ ID NO: 3245086 - protein, 6 aa, Plasmodium falciparum
RGTDSN

SEQ ID NO: 3245087 - protein, 8 aa, Plasmodium falciparum
RGTESANN

SEQ ID NO: 3245088 - protein, 12 aa, Plasmodium falciparum
RGTNMEKAEEKR

SEQ ID NO: 3245089 - protein, 6 aa, Plasmodium falciparum
RGVKTS

SEQ ID NO: 3245090 - protein, 11 aa, Plasmodium falciparum
RGVNGNDKLEK

SEQ ID NO: 3245091 - protein, 9 aa, Plasmodium falciparum
RHEQQSGYI

SEQ ID NO: 3245092 - protein, 4 aa, Plasmodium falciparum
RHGK

SEQ ID NO: 3245093 - protein, 19 aa, Plasmodium falciparum
RHGKNNYKFDESNDISYTS

SEQ ID NO: 3245094 - protein, 12 aa, Plasmodium falciparum
RHHNKRGKGIKH

SEQ ID NO: 3245095 - protein, 5 aa, Plasmodium falciparum
RHHPF

SEQ ID NO: 3245096 - protein, 11 aa, Plasmodium falciparum
RHKNKKKNEED

SEQ ID NO: 3245097 - protein, 20 aa, Plasmodium falciparum
RHNNNDDEQVEDKKKENKNI

SEQ ID NO: 3245098 - protein, 20 aa, Plasmodium falciparum
RHNNQNKPNHQNNMHAQVAA

SEQ ID NO: 3245099 - protein, 5 aa, Plasmodium falciparum
RHNSK

SEQ ID NO: 3245100 - protein, 10 aa, Plasmodium falciparum
RHPNNRVDAP

SEQ ID NO: 3245101 - protein, 6 aa, Plasmodium falciparum
RHPYAG

SEQ ID NO: 3245102 - protein, 6 aa, Plasmodium falciparum
RHPYEG

SEQ ID NO: 3245103 - protein, 65 aa, Plasmodium falciparum
RHSNNKDNSNNNNNNNNNNNSNNNNNNNNSNNNNNSNNNNNSNNNNNNSNKNSNNNNNYNDYYKD

SEQ ID NO: 3245104 - protein, 11 aa, Plasmodium falciparum
RHSRKTYEKRK

SEQ ID NO: 3245105 - protein, 6 aa, Plasmodium falciparum
RHVNNS

SEQ ID NO: 3245106 - protein, 15 aa, Plasmodium falciparum
RIDNSTDPTTDDRSK

SEQ ID NO: 3245107 - protein, 5 aa, Plasmodium falciparum
RIDRK

SEQ ID NO: 3245108 - protein, 5 aa, Plasmodium falciparum
RIEAM

SEQ ID NO: 3245109 - protein, 6 aa, Plasmodium falciparum
RIEESK

SEQ ID NO: 3245110 - protein, 6 aa, Plasmodium falciparum
RIERNS

SEQ ID NO: 3245111 - protein, 29 aa, Plasmodium falciparum
RIESNEQDVQSTPPEDTPTVEGKVGDKAE

SEQ ID NO: 3245112 - protein, 5 aa, Plasmodium falciparum
RIGAN

SEQ ID NO: 3245113 - protein, 4 aa, Plasmodium falciparum
RIGR

SEQ ID NO: 3245114 - protein, 14 aa, Plasmodium falciparum
RIKEDNKNENDSNN

SEQ ID NO: 3245115 - protein, 8 aa, Plasmodium falciparum
RIKEKKEI

SEQ ID NO: 3245116 - protein, 11 aa, Plasmodium falciparum
RIKEKNDDTKI

SEQ ID NO: 3245117 - protein, 19 aa, Plasmodium falciparum
RIKKNKNINKNEKNQKNEN

SEQ ID NO: 3245118 - protein, 17 aa, Plasmodium falciparum
RIKKTNKQRNNKEKLKR

SEQ ID NO: 3245119 - protein, 6 aa, Plasmodium falciparum
RIKNEE

SEQ ID NO: 3245120 - protein, 10 aa, Plasmodium falciparum
RINEKEKDID

SEQ ID NO: 3245121 - protein, 5 aa, Plasmodium falciparum
RINEN

SEQ ID NO: 3245122 - protein, 11 aa, Plasmodium falciparum
RINNKDNSNIK

SEQ ID NO: 3245123 - protein, 10 aa, Plasmodium falciparum
RINNPQKDRD

SEQ ID NO: 3245124 - protein, 10 aa, Plasmodium falciparum
RIPTRGASNN

SEQ ID NO: 3245125 - protein, 14 aa, Plasmodium falciparum
RIQDKRKQFKEQCE

SEQ ID NO: 3245126 - protein, 9 aa, Plasmodium falciparum
RIRKQTKTK

SEQ ID NO: 3245127 - protein, 7 aa, Plasmodium falciparum
RIRSNDN

SEQ ID NO: 3245128 - protein, 8 aa, Plasmodium falciparum
RISHEEKQ

SEQ ID NO: 3245129 - protein, 11 aa, Plasmodium falciparum
RISHENDQEHF

SEQ ID NO: 3245130 - protein, 6 aa, Plasmodium falciparum
RISKDS

SEQ ID NO: 3245131 - protein, 11 aa, Plasmodium falciparum
RISKKRKRELE

SEQ ID NO: 3245132 - protein, 12 aa, Plasmodium falciparum
RISRKKYNNAKY

SEQ ID NO: 3245133 - protein, 5 aa, Plasmodium falciparum
RISTD

SEQ ID NO: 3245134 - protein, 5 aa, Plasmodium falciparum
RITDN

SEQ ID NO: 3245135 - protein, 9 aa, Plasmodium falciparum
RKAEDARRI

SEQ ID NO: 3245136 - protein, 11 aa, Plasmodium falciparum
RKAKKKNKEDI

SEQ ID NO: 3245137 - protein, 6 aa, Plasmodium falciparum
RKANKN

SEQ ID NO: 3245138 - protein, 7 aa, Plasmodium falciparum
RKANSKS

SEQ ID NO: 3245139 - protein, 8 aa, Plasmodium falciparum
RKAQKVNE

SEQ ID NO: 3245140 - protein, 7 aa, Plasmodium falciparum
RKASDSI

SEQ ID NO: 3245141 - protein, 6 aa, Plasmodium falciparum
RKATNR

SEQ ID NO: 3245142 - protein, 40 aa, Plasmodium falciparum
RKATNTKEDKSAYKNEKKEIPYRNNNKRKDKNKKGNDNKK

SEQ ID NO: 3245143 - protein, 5 aa, Plasmodium falciparum
RKCEE

SEQ ID NO: 3245144 - protein, 8 aa, Plasmodium falciparum
RKCEESYD

SEQ ID NO: 3245145 - protein, 12 aa, Plasmodium falciparum
RKCNGKNDDLDN

SEQ ID NO: 3245146 - protein, 8 aa, Plasmodium falciparum
RKDAIKKD

SEQ ID NO: 3245147 - protein, 11 aa, Plasmodium falciparum
RKDDKNNNINH

SEQ ID NO: 3245148 - protein, 9 aa, Plasmodium falciparum
RKDEISEYK

SEQ ID NO: 3245149 - protein, 8 aa, Plasmodium falciparum
RKDKEEDS

SEQ ID NO: 3245150 - protein, 11 aa, Plasmodium falciparum
RKDKGKLNEAN

SEQ ID NO: 3245151 - protein, 20 aa, Plasmodium falciparum
RKDKKHNEINEENKKNNNIN

SEQ ID NO: 3245152 - protein, 25 aa, Plasmodium falciparum
RKDKQKKNKHNNINYNNNDDNVNNS

SEQ ID NO: 3245153 - protein, 4 aa, Plasmodium falciparum
RKDL

SEQ ID NO: 3245154 - protein, 42 aa, Plasmodium falciparum
RKDNHTDHDYDDNNNVKDEYPNNNDKKGQNSREKRNKKKSMN

SEQ ID NO: 3245155 - protein, 7 aa, Plasmodium falciparum
RKDNLSD

SEQ ID NO: 3245156 - protein, 5 aa, Plasmodium falciparum
RKDNN

SEQ ID NO: 3245157 - protein, 7 aa, Plasmodium falciparum
RKDNNSP

SEQ ID NO: 3245158 - protein, 18 aa, Plasmodium falciparum
RKDNQWKEKKNGDCDSDK

SEQ ID NO: 3245159 - protein, 10 aa, Plasmodium falciparum
RKDNTQGSQH

SEQ ID NO: 3245160 - protein, 6 aa, Plasmodium falciparum
RKDPNK

SEQ ID NO: 3245161 - protein, 5 aa, Plasmodium falciparum
RKDQD

SEQ ID NO: 3245162 - protein, 10 aa, Plasmodium falciparum
RKDQSGLNRN

SEQ ID NO: 3245163 - protein, 8 aa, Plasmodium falciparum
RKDQSGTH

SEQ ID NO: 3245164 - protein, 10 aa, Plasmodium falciparum
RKDSKEDNLK

SEQ ID NO: 3245165 - protein, 9 aa, Plasmodium falciparum
RKDTKEKLG

SEQ ID NO: 3245166 - protein, 12 aa, Plasmodium falciparum
RKDTQEDQDNNY

SEQ ID NO: 3245167 - protein, 11 aa, Plasmodium falciparum
RKDVKSKHINK

SEQ ID NO: 3245168 - protein, 5 aa, Plasmodium falciparum
RKDYG

SEQ ID NO: 3245169 - protein, 5 aa, Plasmodium falciparum
RKECT

SEQ ID NO: 3245170 - protein, 4 aa, Plasmodium falciparum
RKED

SEQ ID NO: 3245171 - protein, 23 aa, Plasmodium falciparum
RKEDEGKENNNTRDLNNNNNNIN

SEQ ID NO: 3245172 - protein, 11 aa, Plasmodium falciparum
RKEEKDKKKQM

SEQ ID NO: 3245173 - protein, 8 aa, Plasmodium falciparum
RKEEKKTN

SEQ ID NO: 3245174 - protein, 10 aa, Plasmodium falciparum
RKEENDESID

SEQ ID NO: 3245175 - protein, 10 aa, Plasmodium falciparum
RKEENQNEKD

SEQ ID NO: 3245176 - protein, 8 aa, Plasmodium falciparum
RKEERNTD

SEQ ID NO: 3245177 - protein, 7 aa, Plasmodium falciparum
RKEEYNS

SEQ ID NO: 3245178 - protein, 27 aa, Plasmodium falciparum
RKEFEEQKQEYSKQKTDAEGNNNGNEF

SEQ ID NO: 3245179 - protein, 9 aa, Plasmodium falciparum
RKEGLEDDG

SEQ ID NO: 3245180 - protein, 12 aa, Plasmodium falciparum
RKEGNKRENNTY

SEQ ID NO: 3245181 - protein, 8 aa, Plasmodium falciparum
RKEGTNKM

SEQ ID NO: 3245182 - protein, 11 aa, Plasmodium falciparum
RKEIDKKEKEI

SEQ ID NO: 3245183 - protein, 17 aa, Plasmodium falciparum
RKEIKDKKRMKGRNIDT

SEQ ID NO: 3245184 - protein, 12 aa, Plasmodium falciparum
RKEKAQKEKLEQ

SEQ ID NO: 3245185 - protein, 8 aa, Plasmodium falciparum
RKEKEEEE

SEQ ID NO: 3245186 - protein, 9 aa, Plasmodium falciparum
RKEKEEYKN

SEQ ID NO: 3245187 - protein, 7 aa, Plasmodium falciparum
RKEKEPR

SEQ ID NO: 3245188 - protein, 9 aa, Plasmodium falciparum
RKEKERKKC

SEQ ID NO: 3245189 - protein, 6 aa, Plasmodium falciparum
RKEKES

SEQ ID NO: 3245190 - protein, 10 aa, Plasmodium falciparum
RKEKHEENNG

SEQ ID NO: 3245191 - protein, 9 aa, Plasmodium falciparum
RKEKKKNNI

SEQ ID NO: 3245192 - protein, 9 aa, Plasmodium falciparum
RKEKKKNSA

SEQ ID NO: 3245193 - protein, 15 aa, Plasmodium falciparum
RKEKKNKKNTHNEKK

SEQ ID NO: 3245194 - protein, 13 aa, Plasmodium falciparum
RKEKNDKGVNNGF

SEQ ID NO: 3245195 - protein, 7 aa, Plasmodium falciparum
RKEKNQE

SEQ ID NO: 3245196 - protein, 12 aa, Plasmodium falciparum
RKEKNSKANNIN

SEQ ID NO: 3245197 - protein, 13 aa, Plasmodium falciparum
RKEKQKGDIPAPR

SEQ ID NO: 3245198 - protein, 7 aa, Plasmodium falciparum
RKEKRIE

SEQ ID NO: 3245199 - protein, 9 aa, Plasmodium falciparum
RKEKSKYHM

SEQ ID NO: 3245200 - protein, 10 aa, Plasmodium falciparum
RKEKTTTRGK

SEQ ID NO: 3245201 - protein, 7 aa, Plasmodium falciparum
RKELTST

SEQ ID NO: 3245202 - protein, 4 aa, Plasmodium falciparum
RKEN

SEQ ID NO: 3245203 - protein, 48 aa, Plasmodium falciparum
RKENEEEIKNKVQDKVQDNVEDNVEDNVEDNVEDKIEEKLKEKEEEDH

SEQ ID NO: 3245204 - protein, 6 aa, Plasmodium falciparum
RKENKI

SEQ ID NO: 3245205 - protein, 46 aa, Plasmodium falciparum
RKENKNNNMEKQITKNKNNNNNNNNNNNYHNEQHHNDTLNNNNVGN

SEQ ID NO: 3245206 - protein, 8 aa, Plasmodium falciparum
RKENTKGC

SEQ ID NO: 3245207 - protein, 5 aa, Plasmodium falciparum
RKENV

SEQ ID NO: 3245208 - protein, 53 aa, Plasmodium falciparum
RKEQKVGNNKDNNNDNNNNDNNNNDNNNNDNNNNDNNNNDNNHRNNNQHNNNQ

SEQ ID NO: 3245209 - protein, 8 aa, Plasmodium falciparum
RKEQNTYH

SEQ ID NO: 3245210 - protein, 6 aa, Plasmodium falciparum
RKEQVD

SEQ ID NO: 3245211 - protein, 7 aa, Plasmodium falciparum
RKEQVET

SEQ ID NO: 3245212 - protein, 10 aa, Plasmodium falciparum
RKEQYDDNHK

SEQ ID NO: 3245213 - protein, 7 aa, Plasmodium falciparum
RKERKKL

SEQ ID NO: 3245214 - protein, 16 aa, Plasmodium falciparum
RKERQKKNRKRDKRKH

SEQ ID NO: 3245215 - protein, 27 aa, Plasmodium falciparum
RKERSTLSDKDNSKDSNAQNKEQGDAV

SEQ ID NO: 3245216 - protein, 7 aa, Plasmodium falciparum
RKESKFP

SEQ ID NO: 3245217 - protein, 6 aa, Plasmodium falciparum
RKEWDP

SEQ ID NO: 3245218 - protein, 7 aa, Plasmodium falciparum
RKEYDKQ

SEQ ID NO: 3245219 - protein, 4 aa, Plasmodium falciparum
RKFA

SEQ ID NO: 3245220 - protein, 6 aa, Plasmodium falciparum
RKFNDE

SEQ ID NO: 3245221 - protein, 13 aa, Plasmodium falciparum
RKFQQSYSSTCTT

SEQ ID NO: 3245222 - protein, 10 aa, Plasmodium falciparum
RKGEASSQLN

SEQ ID NO: 3245223 - protein, 33 aa, Plasmodium falciparum
RKGEKQKKKKSKKKKIHVQSSEDENEDDEEYDS

SEQ ID NO: 3245224 - protein, 14 aa, Plasmodium falciparum
RKGETNEDPNKKRN

SEQ ID NO: 3245225 - protein, 15 aa, Plasmodium falciparum
RKGGSGWEEKDKIEK

SEQ ID NO: 3245226 - protein, 4 aa, Plasmodium falciparum
RKGH

SEQ ID NO: 3245227 - protein, 9 aa, Plasmodium falciparum
RKGIDLPDD

SEQ ID NO: 3245228 - protein, 8 aa, Plasmodium falciparum
RKGKEEIQ

SEQ ID NO: 3245229 - protein, 27 aa, Plasmodium falciparum
RKGKGWEPKEKTCGKTKTYDPKKTTNI

SEQ ID NO: 3245230 - protein, 5 aa, Plasmodium falciparum
RKGKK

SEQ ID NO: 3245231 - protein, 6 aa, Plasmodium falciparum
RKGNKN

SEQ ID NO: 3245232 - protein, 14 aa, Plasmodium falciparum
RKGQGKTTKEVPSE

SEQ ID NO: 3245233 - protein, 8 aa, Plasmodium falciparum
RKGQNDKI

SEQ ID NO: 3245234 - protein, 17 aa, Plasmodium falciparum
RKGSSKGNKIGTSSNNK

SEQ ID NO: 3245235 - protein, 8 aa, Plasmodium falciparum
RKGVRSNS

SEQ ID NO: 3245236 - protein, 5 aa, Plasmodium falciparum
RKGWA

SEQ ID NO: 3245237 - protein, 16 aa, Plasmodium falciparum
RKHKGKDKNGTINNNN

SEQ ID NO: 3245238 - protein, 12 aa, Plasmodium falciparum
RKHKKGKLRGTH

SEQ ID NO: 3245239 - protein, 11 aa, Plasmodium falciparum
RKHLENDKREI

SEQ ID NO: 3245240 - protein, 10 aa, Plasmodium falciparum
RKHNDAERGR

SEQ ID NO: 3245241 - protein, 11 aa, Plasmodium falciparum
RKHSDKKCSKN

SEQ ID NO: 3245242 - protein, 6 aa, Plasmodium falciparum
RKHSNT

SEQ ID NO: 3245243 - protein, 15 aa, Plasmodium falciparum
RKHSPNNKKNKNKIG

SEQ ID NO: 3245244 - protein, 6 aa, Plasmodium falciparum
RKHTEK

SEQ ID NO: 3245245 - protein, 21 aa, Plasmodium falciparum
RKIDTDENNQEHIKDEGDNNI

SEQ ID NO: 3245246 - protein, 11 aa, Plasmodium falciparum
RKIKANGSSTV

SEQ ID NO: 3245247 - protein, 13 aa, Plasmodium falciparum
RKIKEEKKKKNIY

SEQ ID NO: 3245248 - protein, 7 aa, Plasmodium falciparum
RKINDNI

SEQ ID NO: 3245249 - protein, 11 aa, Plasmodium falciparum
RKINKKTKQAQ

SEQ ID NO: 3245250 - protein, 12 aa, Plasmodium falciparum
RKINKNKRNIKN

SEQ ID NO: 3245251 - protein, 11 aa, Plasmodium falciparum
RKINVEKQKNK

SEQ ID NO: 3245252 - protein, 5 aa, Plasmodium falciparum
RKIRD

SEQ ID NO: 3245253 - protein, 5 aa, Plasmodium falciparum
RKIRE

SEQ ID NO: 3245254 - protein, 12 aa, Plasmodium falciparum
RKISYDGEDNND

SEQ ID NO: 3245255 - protein, 9 aa, Plasmodium falciparum
RKKAYEQNT

SEQ ID NO: 3245256 - protein, 8 aa, Plasmodium falciparum
RKKDEKNR

SEQ ID NO: 3245257 - protein, 9 aa, Plasmodium falciparum
RKKDKLKKK

SEQ ID NO: 3245258 - protein, 7 aa, Plasmodium falciparum
RKKDKRY

SEQ ID NO: 3245259 - protein, 7 aa, Plasmodium falciparum
RKKDTYT

SEQ ID NO: 3245260 - protein, 4 aa, Plasmodium falciparum
RKKE

SEQ ID NO: 3245261 - protein, 21 aa, Plasmodium falciparum
RKKEENAKSNIRKNDFKSSSQ

SEQ ID NO: 3245262 - protein, 19 aa, Plasmodium falciparum
RKKEKKDARNRKEMERNDH

SEQ ID NO: 3245263 - protein, 10 aa, Plasmodium falciparum
RKKEKNNNEM

SEQ ID NO: 3245264 - protein, 5 aa, Plasmodium falciparum
RKKEL

SEQ ID NO: 3245265 - protein, 6 aa, Plasmodium falciparum
RKKELE

SEQ ID NO: 3245266 - protein, 6 aa, Plasmodium falciparum
RKKENM

SEQ ID NO: 3245267 - protein, 43 aa, Plasmodium falciparum
RKKEQEKKNEEEKLKEEKLKEEKMKEEKMTDVEEKRKKQTNNY

SEQ ID NO: 3245268 - protein, 11 aa, Plasmodium falciparum
RKKEREEKKKS

SEQ ID NO: 3245269 - protein, 12 aa, Plasmodium falciparum
RKKESTKRNYNI

SEQ ID NO: 3245270 - protein, 22 aa, Plasmodium falciparum
RKKFSNDDNKELYNDNSTEKKM

SEQ ID NO: 3245271 - protein, 20 aa, Plasmodium falciparum
RKKGKEGDEGEGEGEGEEEF

SEQ ID NO: 3245272 - protein, 8 aa, Plasmodium falciparum
RKKGNCKY

SEQ ID NO: 3245273 - protein, 39 aa, Plasmodium falciparum
RKKGNTLGDNTKDNKRNKYNKKNIYNKKNKHNKNNNIYN

SEQ ID NO: 3245274 - protein, 15 aa, Plasmodium falciparum
RKKGRSNKNKIYRRK

SEQ ID NO: 3245275 - protein, 26 aa, Plasmodium falciparum
RKKGSVSGSKGKRKKTTSNDKIRGED

SEQ ID NO: 3245276 - protein, 5 aa, Plasmodium falciparum
RKKKE

SEQ ID NO: 3245277 - protein, 12 aa, Plasmodium falciparum
RKKKEEEVERDC

SEQ ID NO: 3245278 - protein, 12 aa, Plasmodium falciparum
RKKKEKSKNTNM

SEQ ID NO: 3245279 - protein, 5 aa, Plasmodium falciparum
RKKKK

SEQ ID NO: 3245280 - protein, 8 aa, Plasmodium falciparum
RKKKKKEK

SEQ ID NO: 3245281 - protein, 11 aa, Plasmodium falciparum
RKKKKKGTKSL

SEQ ID NO: 3245282 - protein, 7 aa, Plasmodium falciparum
RKKKKKK

SEQ ID NO: 3245283 - protein, 19 aa, Plasmodium falciparum
RKKKKKKGKSISNNNNYNN

SEQ ID NO: 3245284 - protein, 27 aa, Plasmodium falciparum
RKKKKKKKKKKGKQDEEPKKKVNKKLA

SEQ ID NO: 3245285 - protein, 10 aa, Plasmodium falciparum
RKKKKRTESY

SEQ ID NO: 3245286 - protein, 8 aa, Plasmodium falciparum
RKKKLEER

SEQ ID NO: 3245287 - protein, 12 aa, Plasmodium falciparum
RKKKRESNKEME

SEQ ID NO: 3245288 - protein, 7 aa, Plasmodium falciparum
RKKKRKN

SEQ ID NO: 3245289 - protein, 15 aa, Plasmodium falciparum
RKKKTKKKKKSHDNI

SEQ ID NO: 3245290 - protein, 16 aa, Plasmodium falciparum
RKKKTKKKLQYIKLLK

SEQ ID NO: 3245291 - protein, 9 aa, Plasmodium falciparum
RKKLNKKKG

SEQ ID NO: 3245292 - protein, 4 aa, Plasmodium falciparum
RKKN

SEQ ID NO: 3245293 - protein, 5 aa, Plasmodium falciparum
RKKNA

SEQ ID NO: 3245294 - protein, 6 aa, Plasmodium falciparum
RKKNIR

SEQ ID NO: 3245295 - protein, 23 aa, Plasmodium falciparum
RKKNKKNIQPNKDHNEQDKTYQR

SEQ ID NO: 3245296 - protein, 12 aa, Plasmodium falciparum
RKKNKSKNMKEK

SEQ ID NO: 3245297 - protein, 5 aa, Plasmodium falciparum
RKKNN

SEQ ID NO: 3245298 - protein, 7 aa, Plasmodium falciparum
RKKNNNI

SEQ ID NO: 3245299 - protein, 18 aa, Plasmodium falciparum
RKKNSSMNSKGDMEKIET

SEQ ID NO: 3245300 - protein, 6 aa, Plasmodium falciparum
RKKNSV

SEQ ID NO: 3245301 - protein, 23 aa, Plasmodium falciparum
RKKQQKKKKKKLPKSERRNAEER

SEQ ID NO: 3245302 - protein, 6 aa, Plasmodium falciparum
RKKREN

SEQ ID NO: 3245303 - protein, 13 aa, Plasmodium falciparum
RKKRKEKKGSQHM

SEQ ID NO: 3245304 - protein, 6 aa, Plasmodium falciparum
RKKRKN

SEQ ID NO: 3245305 - protein, 12 aa, Plasmodium falciparum
RKKRKSNNEIEE

SEQ ID NO: 3245306 - protein, 10 aa, Plasmodium falciparum
RKKRNKSKKQ

SEQ ID NO: 3245307 - protein, 7 aa, Plasmodium falciparum
RKKRNNK

SEQ ID NO: 3245308 - protein, 5 aa, Plasmodium falciparum
RKKSI

SEQ ID NO: 3245309 - protein, 9 aa, Plasmodium falciparum
RKKSQNFDI

SEQ ID NO: 3245310 - protein, 8 aa, Plasmodium falciparum
RKKSSINI

SEQ ID NO: 3245311 - protein, 7 aa, Plasmodium falciparum
RKKSYEK

SEQ ID NO: 3245312 - protein, 8 aa, Plasmodium falciparum
RKKTCQGK

SEQ ID NO: 3245313 - protein, 18 aa, Plasmodium falciparum
RKKTKKGNEMNKKRKGDL

SEQ ID NO: 3245314 - protein, 8 aa, Plasmodium falciparum
RKKTPENI

SEQ ID NO: 3245315 - protein, 8 aa, Plasmodium falciparum
RKKTRSQL

SEQ ID NO: 3245316 - protein, 9 aa, Plasmodium falciparum
RKKVNYKDE

SEQ ID NO: 3245317 - protein, 20 aa, Plasmodium falciparum
RKKYKERKKKMNNSNDKPDN

SEQ ID NO: 3245318 - protein, 22 aa, Plasmodium falciparum
RKLGKQPSRYVTEKNKNNTPKK

SEQ ID NO: 3245319 - protein, 22 aa, Plasmodium falciparum
RKLRKAKTKIKTKIKTKEKMNE

SEQ ID NO: 3245320 - protein, 11 aa, Plasmodium falciparum
RKLSPKKKNQY

SEQ ID NO: 3245321 - protein, 9 aa, Plasmodium falciparum
RKMGKKKKK

SEQ ID NO: 3245322 - protein, 4 aa, Plasmodium falciparum
RKNA

SEQ ID NO: 3245323 - protein, 5 aa, Plasmodium falciparum
RKNDC

SEQ ID NO: 3245324 - protein, 9 aa, Plasmodium falciparum
RKNDEDSNI

SEQ ID NO: 3245325 - protein, 8 aa, Plasmodium falciparum
RKNEETEK

SEQ ID NO: 3245326 - protein, 25 aa, Plasmodium falciparum
RKNEETKLNGKKENDENKNVEEEDD

SEQ ID NO: 3245327 - protein, 11 aa, Plasmodium falciparum
RKNEGKEENVF

SEQ ID NO: 3245328 - protein, 7 aa, Plasmodium falciparum
RKNEKHD

SEQ ID NO: 3245329 - protein, 20 aa, Plasmodium falciparum
RKNEKINEEQHNTTNNNYEE

SEQ ID NO: 3245330 - protein, 8 aa, Plasmodium falciparum
RKNEKYGK

SEQ ID NO: 3245331 - protein, 9 aa, Plasmodium falciparum
RKNENETPI

SEQ ID NO: 3245332 - protein, 7 aa, Plasmodium falciparum
RKNESAY

SEQ ID NO: 3245333 - protein, 9 aa, Plasmodium falciparum
RKNESNDNI

SEQ ID NO: 3245334 - protein, 5 aa, Plasmodium falciparum
RKNGT

SEQ ID NO: 3245335 - protein, 14 aa, Plasmodium falciparum
RKNHNKQKRKQNYK

SEQ ID NO: 3245336 - protein, 15 aa, Plasmodium falciparum
RKNIDNDNVDKNNVD

SEQ ID NO: 3245337 - protein, 5 aa, Plasmodium falciparum
RKNIG

SEQ ID NO: 3245338 - protein, 8 aa, Plasmodium falciparum
RKNKKKKK

SEQ ID NO: 3245339 - protein, 26 aa, Plasmodium falciparum
RKNKKKKKITKDGDGCYSTGPNGQYN

SEQ ID NO: 3245340 - protein, 8 aa, Plasmodium falciparum
RKNKKNGK

SEQ ID NO: 3245341 - protein, 13 aa, Plasmodium falciparum
RKNKKQNDTTNKS

SEQ ID NO: 3245342 - protein, 9 aa, Plasmodium falciparum
RKNKNKQNI

SEQ ID NO: 3245343 - protein, 7 aa, Plasmodium falciparum
RKNKNNK

SEQ ID NO: 3245344 - protein, 10 aa, Plasmodium falciparum
RKNKSNFNQR

SEQ ID NO: 3245345 - protein, 15 aa, Plasmodium falciparum
RKNKSVRRQEMSPKL

SEQ ID NO: 3245346 - protein, 14 aa, Plasmodium falciparum
RKNKYDNNEYSESE

SEQ ID NO: 3245347 - protein, 21 aa, Plasmodium falciparum
RKNKYGKKKGYTSKYADNNNN

SEQ ID NO: 3245348 - protein, 4 aa, Plasmodium falciparum
RKNN

SEQ ID NO: 3245349 - protein, 5 aa, Plasmodium falciparum
RKNNA

SEQ ID NO: 3245350 - protein, 8 aa, Plasmodium falciparum
RKNNDRIS

SEQ ID NO: 3245351 - protein, 20 aa, Plasmodium falciparum
RKNNDTYDDQDKDEQYVDTD

SEQ ID NO: 3245352 - protein, 58 aa, Plasmodium falciparum
RKNNKNNDNDNDNNDNDNNDNNNNDNNNDNDNNDNNNDNYNNDNNNDSYNNNNNYNDS

SEQ ID NO: 3245353 - protein, 18 aa, Plasmodium falciparum
RKNNNEYDTESDDHADQN

SEQ ID NO: 3245354 - protein, 13 aa, Plasmodium falciparum
RKNNNPSKGQEDR

SEQ ID NO: 3245355 - protein, 5 aa, Plasmodium falciparum
RKNNS

SEQ ID NO: 3245356 - protein, 7 aa, Plasmodium falciparum
RKNPNNN

SEQ ID NO: 3245357 - protein, 10 aa, Plasmodium falciparum
RKNQNGQNNM

SEQ ID NO: 3245358 - protein, 4 aa, Plasmodium falciparum
RKNR

SEQ ID NO: 3245359 - protein, 18 aa, Plasmodium falciparum
RKNREIKQKEYNLKDSRI

SEQ ID NO: 3245360 - protein, 5 aa, Plasmodium falciparum
RKNSD

SEQ ID NO: 3245361 - protein, 5 aa, Plasmodium falciparum
RKNSI

SEQ ID NO: 3245362 - protein, 11 aa, Plasmodium falciparum
RKNSISESEAY

SEQ ID NO: 3245363 - protein, 7 aa, Plasmodium falciparum
RKNSISS

SEQ ID NO: 3245364 - protein, 5 aa, Plasmodium falciparum
RKNSL

SEQ ID NO: 3245365 - protein, 7 aa, Plasmodium falciparum
RKNSNDS

SEQ ID NO: 3245366 - protein, 7 aa, Plasmodium falciparum
RKNSQIA

SEQ ID NO: 3245367 - protein, 9 aa, Plasmodium falciparum
RKNSTEQGQ

SEQ ID NO: 3245368 - protein, 14 aa, Plasmodium falciparum
RKNSWKHECKKHLC

SEQ ID NO: 3245369 - protein, 14 aa, Plasmodium falciparum
RKNSWKHECKKYLC

SEQ ID NO: 3245370 - protein, 7 aa, Plasmodium falciparum
RKNTEYI

SEQ ID NO: 3245371 - protein, 8 aa, Plasmodium falciparum
RKNTNRRN

SEQ ID NO: 3245372 - protein, 6 aa, Plasmodium falciparum
RKNTNT

SEQ ID NO: 3245373 - protein, 15 aa, Plasmodium falciparum
RKNTQKKNKNEERTK

SEQ ID NO: 3245374 - protein, 33 aa, Plasmodium falciparum
RKNTTKNKDNISDDNNVDGNNMDNDNNNNNNNS

SEQ ID NO: 3245375 - protein, 7 aa, Plasmodium falciparum
RKNTYNT

SEQ ID NO: 3245376 - protein, 11 aa, Plasmodium falciparum
RKNYKKKKEMD

SEQ ID NO: 3245377 - protein, 9 aa, Plasmodium falciparum
RKPDENEPQ

SEQ ID NO: 3245378 - protein, 18 aa, Plasmodium falciparum
RKPDLEKGELASGANVTR

SEQ ID NO: 3245379 - protein, 5 aa, Plasmodium falciparum
RKPHN

SEQ ID NO: 3245380 - protein, 12 aa, Plasmodium falciparum
RKPKKKKSPFSK

SEQ ID NO: 3245381 - protein, 5 aa, Plasmodium falciparum
RKPKN

SEQ ID NO: 3245382 - protein, 7 aa, Plasmodium falciparum
RKPKNEK

SEQ ID NO: 3245383 - protein, 8 aa, Plasmodium falciparum
RKPNHSYT

SEQ ID NO: 3245384 - protein, 6 aa, Plasmodium falciparum
RKQAKN

SEQ ID NO: 3245385 - protein, 56 aa, Plasmodium falciparum
RKQDCKPPQQSAEEGVAKTGQPRAEDEEDSPRPDAGAGEVDDEDDDADNDDEITPR

SEQ ID NO: 3245386 - protein, 7 aa, Plasmodium falciparum
RKQDYSK

SEQ ID NO: 3245387 - protein, 40 aa, Plasmodium falciparum
RKQFDKQKNKYETEISGGGASGSSRQRRVARGGSNVDGYE

SEQ ID NO: 3245388 - protein, 12 aa, Plasmodium falciparum
RKQKNNKNKKRE

SEQ ID NO: 3245389 - protein, 8 aa, Plasmodium falciparum
RKQKREDK

SEQ ID NO: 3245390 - protein, 11 aa, Plasmodium falciparum
RKQLEAGAGEI

SEQ ID NO: 3245391 - protein, 11 aa, Plasmodium falciparum
RKQLEKRGGEI

SEQ ID NO: 3245392 - protein, 5 aa, Plasmodium falciparum
RKQNT

SEQ ID NO: 3245393 - protein, 9 aa, Plasmodium falciparum
RKQQNYKPT

SEQ ID NO: 3245394 - protein, 5 aa, Plasmodium falciparum
RKQSI

SEQ ID NO: 3245395 - protein, 14 aa, Plasmodium falciparum
RKQTQNGNNNSEIC

SEQ ID NO: 3245396 - protein, 11 aa, Plasmodium falciparum
RKQYKDKCDKE

SEQ ID NO: 3245397 - protein, 10 aa, Plasmodium falciparum
RKQYNKLRND

SEQ ID NO: 3245398 - protein, 11 aa, Plasmodium falciparum
RKQYSYKSNYK

SEQ ID NO: 3245399 - protein, 19 aa, Plasmodium falciparum
RKRDINSEHDQRDGSKNKV

SEQ ID NO: 3245400 - protein, 18 aa, Plasmodium falciparum
RKRDNYIKQQKRKEKNAN

SEQ ID NO: 3245401 - protein, 91 aa, Plasmodium falciparum
RKREEFKETSLTKKKQKKKNDEIKKTGEEKKKTGEEKKKTGEEKKKTGEEKKKTGEEKKKTGEEKKKTGEEKKKTGEEKKKTGEEKKLTND

SEQ ID NO: 3245402 - protein, 8 aa, Plasmodium falciparum
RKREIGKK

SEQ ID NO: 3245403 - protein, 6 aa, Plasmodium falciparum
RKRERP

SEQ ID NO: 3245404 - protein, 4 aa, Plasmodium falciparum
RKRF

SEQ ID NO: 3245405 - protein, 14 aa, Plasmodium falciparum
RKRFGSSDIENEDR

SEQ ID NO: 3245406 - protein, 10 aa, Plasmodium falciparum
RKRKKKEKHI

SEQ ID NO: 3245407 - protein, 7 aa, Plasmodium falciparum
RKRKLEE

SEQ ID NO: 3245408 - protein, 7 aa, Plasmodium falciparum
RKRKQNN

SEQ ID NO: 3245409 - protein, 6 aa, Plasmodium falciparum
RKRKTY

SEQ ID NO: 3245410 - protein, 7 aa, Plasmodium falciparum
RKRLEDA

SEQ ID NO: 3245411 - protein, 9 aa, Plasmodium falciparum
RKRNDGINN

SEQ ID NO: 3245412 - protein, 5 aa, Plasmodium falciparum
RKRNI

SEQ ID NO: 3245413 - protein, 8 aa, Plasmodium falciparum
RKRNSVNN

SEQ ID NO: 3245414 - protein, 6 aa, Plasmodium falciparum
RKRPTQ

SEQ ID NO: 3245415 - protein, 8 aa, Plasmodium falciparum
RKRQSSQI

SEQ ID NO: 3245416 - protein, 12 aa, Plasmodium falciparum
RKRRKRKRKKEK

SEQ ID NO: 3245417 - protein, 25 aa, Plasmodium falciparum
RKRSRKKKGEQDENMASKNIERKSS

SEQ ID NO: 3245418 - protein, 7 aa, Plasmodium falciparum
RKSGTKM

SEQ ID NO: 3245419 - protein, 79 aa, Plasmodium falciparum
RKSIDGKFSGSNYDDKDGKYGEDGKDGEDGKDGKDGKDGKDGKDGKDGKDGKDDDDDDDDDDDDEDGEDDHDDDRTNRI

SEQ ID NO: 3245420 - protein, 19 aa, Plasmodium falciparum
RKSIYNKNNEYNKSERTVE

SEQ ID NO: 3245421 - protein, 35 aa, Plasmodium falciparum
RKSKEKKKESNHKNENSNNSFDGTSNYYNDDNNYN

SEQ ID NO: 3245422 - protein, 14 aa, Plasmodium falciparum
RKSKNEKKNEQQDD

SEQ ID NO: 3245423 - protein, 9 aa, Plasmodium falciparum
RKSKNKRKY

SEQ ID NO: 3245424 - protein, 10 aa, Plasmodium falciparum
RKSKNTPGVT

SEQ ID NO: 3245425 - protein, 21 aa, Plasmodium falciparum
RKSKQKIPIPEKKSDGANKKK

SEQ ID NO: 3245426 - protein, 4 aa, Plasmodium falciparum
RKSN

SEQ ID NO: 3245427 - protein, 7 aa, Plasmodium falciparum
RKSNKMK

SEQ ID NO: 3245428 - protein, 9 aa, Plasmodium falciparum
RKSNNRHES

SEQ ID NO: 3245429 - protein, 8 aa, Plasmodium falciparum
RKSNRPNF

SEQ ID NO: 3245430 - protein, 11 aa, Plasmodium falciparum
RKSQRENKKNI

SEQ ID NO: 3245431 - protein, 7 aa, Plasmodium falciparum
RKSSSYM

SEQ ID NO: 3245432 - protein, 6 aa, Plasmodium falciparum
RKSTDG

SEQ ID NO: 3245433 - protein, 8 aa, Plasmodium falciparum
RKSTEQVN

SEQ ID NO: 3245434 - protein, 6 aa, Plasmodium falciparum
RKSVNK

SEQ ID NO: 3245435 - protein, 15 aa, Plasmodium falciparum
RKSVSGKTKKDTSII

SEQ ID NO: 3245436 - protein, 5 aa, Plasmodium falciparum
RKTDT

SEQ ID NO: 3245437 - protein, 49 aa, Plasmodium falciparum
RKTETGRIEEESKKKEAMKRAEDARRIEEARRAEDARRIEEARRAEDAR

SEQ ID NO: 3245438 - protein, 5 aa, Plasmodium falciparum
RKTKM

SEQ ID NO: 3245439 - protein, 10 aa, Plasmodium falciparum
RKTKRNTKNE

SEQ ID NO: 3245440 - protein, 8 aa, Plasmodium falciparum
RKTKSNHH

SEQ ID NO: 3245441 - protein, 7 aa, Plasmodium falciparum
RKTPYNT

SEQ ID NO: 3245442 - protein, 4 aa, Plasmodium falciparum
RKTQ

SEQ ID NO: 3245443 - protein, 21 aa, Plasmodium falciparum
RKVERKKYGLKKARKKKQYSK

SEQ ID NO: 3245444 - protein, 22 aa, Plasmodium falciparum
RKVPKKNIPLNQQGVSNAKNMQ

SEQ ID NO: 3245445 - protein, 6 aa, Plasmodium falciparum
RKVYDG

SEQ ID NO: 3245446 - protein, 6 aa, Plasmodium falciparum
RKWSSE

SEQ ID NO: 3245447 - protein, 27 aa, Plasmodium falciparum
RKYDHNDEQKKEGTYYSKEENSSYIDS

SEQ ID NO: 3245448 - protein, 7 aa, Plasmodium falciparum
RKYDKEI

SEQ ID NO: 3245449 - protein, 13 aa, Plasmodium falciparum
RKYDRNNHNNDNS

SEQ ID NO: 3245450 - protein, 6 aa, Plasmodium falciparum
RKYEKS

SEQ ID NO: 3245451 - protein, 5 aa, Plasmodium falciparum
RKYEN

SEQ ID NO: 3245452 - protein, 14 aa, Plasmodium falciparum
RKYEYKEGQYLNKG

SEQ ID NO: 3245453 - protein, 19 aa, Plasmodium falciparum
RKYKNKNKNNKDKDKDKDN

SEQ ID NO: 3245454 - protein, 5 aa, Plasmodium falciparum
RKYKS

SEQ ID NO: 3245455 - protein, 35 aa, Plasmodium falciparum
RKYKTEISGGDGGGSSRKKRVARSSSSSDDNGYES

SEQ ID NO: 3245456 - protein, 13 aa, Plasmodium falciparum
RKYNSDGRSKMNN

SEQ ID NO: 3245457 - protein, 6 aa, Plasmodium falciparum
RKYRKN

SEQ ID NO: 3245458 - protein, 6 aa, Plasmodium falciparum
RKYTHK

SEQ ID NO: 3245459 - protein, 9 aa, Plasmodium falciparum
RLATEEEVK

SEQ ID NO: 3245460 - protein, 4 aa, Plasmodium falciparum
RLEE

SEQ ID NO: 3245461 - protein, 4 aa, Plasmodium falciparum
RLEK

SEQ ID NO: 3245462 - protein, 18 aa, Plasmodium falciparum
RLGNENNPLNNNIPNNNR

SEQ ID NO: 3245463 - protein, 5 aa, Plasmodium falciparum
RLKEE

SEQ ID NO: 3245464 - protein, 5 aa, Plasmodium falciparum
RLNKE

SEQ ID NO: 3245465 - protein, 5 aa, Plasmodium falciparum
RLNNN

SEQ ID NO: 3245466 - protein, 6 aa, Plasmodium falciparum
RLNQND

SEQ ID NO: 3245467 - protein, 16 aa, Plasmodium falciparum
RLNRRNDSKKEPKIPD

SEQ ID NO: 3245468 - protein, 5 aa, Plasmodium falciparum
RLNSE

SEQ ID NO: 3245469 - protein, 10 aa, Plasmodium falciparum
RLNSEENERI

SEQ ID NO: 3245470 - protein, 9 aa, Plasmodium falciparum
RLNSTQSTM

SEQ ID NO: 3245471 - protein, 58 aa, Plasmodium falciparum
RLSEHNDNNNDNNNNNNNDNNNDNNNDNNNDSNNNNNDNNDSNNNNNDNNDNNLDPDI

SEQ ID NO: 3245472 - protein, 143 aa, Plasmodium falciparum
RLSSRGVRDPRTKEALKEKQFRDHKRKEALKQKTEKNEKARNALKEKKLKEQKKNDAQKAKDLTKKESQDSSSEKSLKEKVNGEALKEKENKETLKKKELENQKEKEEKNKIKDNNDEALKNKGNDKDDKKIVPKKPESVEKD

SEQ ID NO: 3245473 - protein, 8 aa, Plasmodium falciparum
RMDGNNNV

SEQ ID NO: 3245474 - protein, 6 aa, Plasmodium falciparum
RMDTRY

SEQ ID NO: 3245475 - protein, 4 aa, Plasmodium falciparum
RMEN

SEQ ID NO: 3245476 - protein, 10 aa, Plasmodium falciparum
RMGNKKDEYK

SEQ ID NO: 3245477 - protein, 15 aa, Plasmodium falciparum
RMKEKQQKCKEQCEK

SEQ ID NO: 3245478 - protein, 13 aa, Plasmodium falciparum
RMKKKHQYIKLLE

SEQ ID NO: 3245479 - protein, 7 aa, Plasmodium falciparum
RMKSNKG

SEQ ID NO: 3245480 - protein, 14 aa, Plasmodium falciparum
RMKTTRQKCREQCD

SEQ ID NO: 3245481 - protein, 29 aa, Plasmodium falciparum
RMPSDNNKSNNLLNGSAQNVNTNDSKKTV

SEQ ID NO: 3245482 - protein, 13 aa, Plasmodium falciparum
RMRQQKKKNQNSL

SEQ ID NO: 3245483 - protein, 36 aa, Plasmodium falciparum
RNANSQTDGNVKREVEENVQQNVEQNVQQNVQQNVQ

SEQ ID NO: 3245484 - protein, 6 aa, Plasmodium falciparum
RNAYSN

SEQ ID NO: 3245485 - protein, 6 aa, Plasmodium falciparum
RNCRDE

SEQ ID NO: 3245486 - protein, 4 aa, Plasmodium falciparum
RNDD

SEQ ID NO: 3245487 - protein, 26 aa, Plasmodium falciparum
RNDDNKKKTKKVLNNNSNNNKKNRKV

SEQ ID NO: 3245488 - protein, 11 aa, Plasmodium falciparum
RNDDNNNNNNN

SEQ ID NO: 3245489 - protein, 4 aa, Plasmodium falciparum
RNDE

SEQ ID NO: 3245490 - protein, 23 aa, Plasmodium falciparum
RNDFNERKKYKEQDKIASEKEDQ

SEQ ID NO: 3245491 - protein, 18 aa, Plasmodium falciparum
RNDHYTSDLNNDDNNKYN

SEQ ID NO: 3245492 - protein, 7 aa, Plasmodium falciparum
RNDKEEE

SEQ ID NO: 3245493 - protein, 17 aa, Plasmodium falciparum
RNDKHDENVQCDDEESL

SEQ ID NO: 3245494 - protein, 7 aa, Plasmodium falciparum
RNDMSND

SEQ ID NO: 3245495 - protein, 6 aa, Plasmodium falciparum
RNDNGC

SEQ ID NO: 3245496 - protein, 26 aa, Plasmodium falciparum
RNDNNRRDNKNETDYIKQSDEDYEMN

SEQ ID NO: 3245497 - protein, 4 aa, Plasmodium falciparum
RNDP

SEQ ID NO: 3245498 - protein, 9 aa, Plasmodium falciparum
RNDQISNVE

SEQ ID NO: 3245499 - protein, 88 aa, Plasmodium falciparum
RNDQRNDQRNDQRNDQRNDHRNDHRNDHRNDHRNDHRNDHRNDHRNDHRNDHRNDQRNDHRNSMRNDHRNSMRNDHRNSMRNDQRNSM

SEQ ID NO: 3245500 - protein, 6 aa, Plasmodium falciparum
RNDSSY

SEQ ID NO: 3245501 - protein, 9 aa, Plasmodium falciparum
RNDTRSHSK

SEQ ID NO: 3245502 - protein, 5 aa, Plasmodium falciparum
RNDVK

SEQ ID NO: 3245503 - protein, 85 aa, Plasmodium falciparum
RNEDDKNGLDGDKNGLDGDKNGLDGDKNGLDGDKNGLDGDKNELDGDKNGLDGDKNGLDGDKNGLDGDKNELDDNTKKLDDNTKK

SEQ ID NO: 3245504 - protein, 5 aa, Plasmodium falciparum
RNEDI

SEQ ID NO: 3245505 - protein, 6 aa, Plasmodium falciparum
RNEDIK

SEQ ID NO: 3245506 - protein, 7 aa, Plasmodium falciparum
RNEDKYT

SEQ ID NO: 3245507 - protein, 4 aa, Plasmodium falciparum
RNEE

SEQ ID NO: 3245508 - protein, 9 aa, Plasmodium falciparum
RNEEDAVQK

SEQ ID NO: 3245509 - protein, 7 aa, Plasmodium falciparum
RNEEIEK

SEQ ID NO: 3245510 - protein, 6 aa, Plasmodium falciparum
RNEEKK

SEQ ID NO: 3245511 - protein, 45 aa, Plasmodium falciparum
RNEEKNKKTKNDNYDKSENFNNYRDERSKGHNENQSYYQSTHNSS

SEQ ID NO: 3245512 - protein, 9 aa, Plasmodium falciparum
RNEENERHL

SEQ ID NO: 3245513 - protein, 7 aa, Plasmodium falciparum
RNEEYER

SEQ ID NO: 3245514 - protein, 23 aa, Plasmodium falciparum
RNEGEPFYQNNNDNKSNNNNNNN

SEQ ID NO: 3245515 - protein, 6 aa, Plasmodium falciparum
RNEGER

SEQ ID NO: 3245516 - protein, 7 aa, Plasmodium falciparum
RNEIDED

SEQ ID NO: 3245517 - protein, 6 aa, Plasmodium falciparum
RNEKED

SEQ ID NO: 3245518 - protein, 11 aa, Plasmodium falciparum
RNEKEEEESKY

SEQ ID NO: 3245519 - protein, 32 aa, Plasmodium falciparum
RNEKKEKSKINKNKNNYNKEYNDEEKKDKDHI

SEQ ID NO: 3245520 - protein, 8 aa, Plasmodium falciparum
RNEKKRLT

SEQ ID NO: 3245521 - protein, 32 aa, Plasmodium falciparum
RNEKMNEEGSDSTSSRDDYDSDDSSDYSNSSS

SEQ ID NO: 3245522 - protein, 10 aa, Plasmodium falciparum
RNEKNEIKEK

SEQ ID NO: 3245523 - protein, 30 aa, Plasmodium falciparum
RNEKSTAYSENSDISNNKEDYNSDRKENFD

SEQ ID NO: 3245524 - protein, 14 aa, Plasmodium falciparum
RNEMNNEENGYKER

SEQ ID NO: 3245525 - protein, 10 aa, Plasmodium falciparum
RNENASDYAN

SEQ ID NO: 3245526 - protein, 13 aa, Plasmodium falciparum
RNENEDTRVRDED

SEQ ID NO: 3245527 - protein, 8 aa, Plasmodium falciparum
RNENEEKN

SEQ ID NO: 3245528 - protein, 7 aa, Plasmodium falciparum
RNENKGN

SEQ ID NO: 3245529 - protein, 20 aa, Plasmodium falciparum
RNENRSDNRRLQTETYQAEA

SEQ ID NO: 3245530 - protein, 6 aa, Plasmodium falciparum
RNEPEL

SEQ ID NO: 3245531 - protein, 5 aa, Plasmodium falciparum
RNEPY

SEQ ID NO: 3245532 - protein, 20 aa, Plasmodium falciparum
RNEQKIKDNEKNNLPNKRNM

SEQ ID NO: 3245533 - protein, 8 aa, Plasmodium falciparum
RNEQSKND

SEQ ID NO: 3245534 - protein, 10 aa, Plasmodium falciparum
RNERNERNDR

SEQ ID NO: 3245535 - protein, 4 aa, Plasmodium falciparum
RNES

SEQ ID NO: 3245536 - protein, 33 aa, Plasmodium falciparum
RNESERNVSKKNVSKKNVSKKNVSKKNESKNNF

SEQ ID NO: 3245537 - protein, 5 aa, Plasmodium falciparum
RNESK

SEQ ID NO: 3245538 - protein, 4 aa, Plasmodium falciparum
RNET

SEQ ID NO: 3245539 - protein, 8 aa, Plasmodium falciparum
RNETKGKY

SEQ ID NO: 3245540 - protein, 10 aa, Plasmodium falciparum
RNETNEEKKI

SEQ ID NO: 3245541 - protein, 7 aa, Plasmodium falciparum
RNEYDIK

SEQ ID NO: 3245542 - protein, 9 aa, Plasmodium falciparum
RNFDERNQH

SEQ ID NO: 3245543 - protein, 42 aa, Plasmodium falciparum
RNFDERNQNVNDRRNFDERNQNVNDRRNFDERNQQVNDRRNF

SEQ ID NO: 3245544 - protein, 11 aa, Plasmodium falciparum
RNFTKKSRKIN

SEQ ID NO: 3245545 - protein, 6 aa, Plasmodium falciparum
RNFTNE

SEQ ID NO: 3245546 - protein, 4 aa, Plasmodium falciparum
RNGD

SEQ ID NO: 3245547 - protein, 10 aa, Plasmodium falciparum
RNGDGDGQTN

SEQ ID NO: 3245548 - protein, 41 aa, Plasmodium falciparum
RNGDNDKDTYNDVDTKDEEYKDKPLNDYDKKANNKERPKEN

SEQ ID NO: 3245549 - protein, 15 aa, Plasmodium falciparum
RNGEIPSSDTETDNN

SEQ ID NO: 3245550 - protein, 10 aa, Plasmodium falciparum
RNGEVGKLDG

SEQ ID NO: 3245551 - protein, 57 aa, Plasmodium falciparum
RNGGKEEKNEKNGQHEKYGEHEKNGEHEKYGEHEKYGEHEKNGEREKYGHYNNTTAN

SEQ ID NO: 3245552 - protein, 6 aa, Plasmodium falciparum
RNGINS

SEQ ID NO: 3245553 - protein, 4 aa, Plasmodium falciparum
RNGK

SEQ ID NO: 3245554 - protein, 5 aa, Plasmodium falciparum
RNGKN

SEQ ID NO: 3245555 - protein, 5 aa, Plasmodium falciparum
RNGSN

SEQ ID NO: 3245556 - protein, 7 aa, Plasmodium falciparum
RNGTGKS

SEQ ID NO: 3245557 - protein, 13 aa, Plasmodium falciparum
RNGTYKKYENEIR

SEQ ID NO: 3245558 - protein, 5 aa, Plasmodium falciparum
RNIRR

SEQ ID NO: 3245559 - protein, 4 aa, Plasmodium falciparum
RNIS

SEQ ID NO: 3245560 - protein, 5 aa, Plasmodium falciparum
RNISE

SEQ ID NO: 3245561 - protein, 4 aa, Plasmodium falciparum
RNKD

SEQ ID NO: 3245562 - protein, 10 aa, Plasmodium falciparum
RNKDMGKEKY

SEQ ID NO: 3245563 - protein, 68 aa, Plasmodium falciparum
RNKDNDQVDKMNDDENKDEDNDGNNNNDSYNNDIQNDDLSDENNNIDKKKSSNDEDNINSESDINENN

SEQ ID NO: 3245564 - protein, 4 aa, Plasmodium falciparum
RNKE

SEQ ID NO: 3245565 - protein, 8 aa, Plasmodium falciparum
RNKEESED

SEQ ID NO: 3245566 - protein, 16 aa, Plasmodium falciparum
RNKEKRYTHSKNKGSN

SEQ ID NO: 3245567 - protein, 37 aa, Plasmodium falciparum
RNKENKKERTMKSQNDNHLNNHESDDNNSIENSYEES

SEQ ID NO: 3245568 - protein, 9 aa, Plasmodium falciparum
RNKESRTKR

SEQ ID NO: 3245569 - protein, 7 aa, Plasmodium falciparum
RNKIKTK

SEQ ID NO: 3245570 - protein, 14 aa, Plasmodium falciparum
RNKKEDPKRNADDY

SEQ ID NO: 3245571 - protein, 15 aa, Plasmodium falciparum
RNKKKKKKKKKNKND

SEQ ID NO: 3245572 - protein, 6 aa, Plasmodium falciparum
RNKKKN

SEQ ID NO: 3245573 - protein, 9 aa, Plasmodium falciparum
RNKKNKVHK

SEQ ID NO: 3245574 - protein, 6 aa, Plasmodium falciparum
RNKKNT

SEQ ID NO: 3245575 - protein, 5 aa, Plasmodium falciparum
RNKKS

SEQ ID NO: 3245576 - protein, 6 aa, Plasmodium falciparum
RNKKYS

SEQ ID NO: 3245577 - protein, 8 aa, Plasmodium falciparum
RNKLKERK

SEQ ID NO: 3245578 - protein, 19 aa, Plasmodium falciparum
RNKLNEKDMYESNNKYESN

SEQ ID NO: 3245579 - protein, 8 aa, Plasmodium falciparum
RNKNEKNN

SEQ ID NO: 3245580 - protein, 9 aa, Plasmodium falciparum
RNKNEQKKE

SEQ ID NO: 3245581 - protein, 7 aa, Plasmodium falciparum
RNKNGDN

SEQ ID NO: 3245582 - protein, 9 aa, Plasmodium falciparum
RNKNGDRYI

SEQ ID NO: 3245583 - protein, 10 aa, Plasmodium falciparum
RNKNNNNMSD

SEQ ID NO: 3245584 - protein, 6 aa, Plasmodium falciparum
RNKNYL

SEQ ID NO: 3245585 - protein, 5 aa, Plasmodium falciparum
RNKQI

SEQ ID NO: 3245586 - protein, 7 aa, Plasmodium falciparum
RNKQNDK

SEQ ID NO: 3245587 - protein, 10 aa, Plasmodium falciparum
RNKQNPASQM

SEQ ID NO: 3245588 - protein, 6 aa, Plasmodium falciparum
RNKRDG

SEQ ID NO: 3245589 - protein, 6 aa, Plasmodium falciparum
RNKRLP

SEQ ID NO: 3245590 - protein, 4 aa, Plasmodium falciparum
RNKS

SEQ ID NO: 3245591 - protein, 5 aa, Plasmodium falciparum
RNKSF

SEQ ID NO: 3245592 - protein, 7 aa, Plasmodium falciparum
RNKSNDF

SEQ ID NO: 3245593 - protein, 8 aa, Plasmodium falciparum
RNKSTSVF

SEQ ID NO: 3245594 - protein, 13 aa, Plasmodium falciparum
RNKTDNKKNRTKS

SEQ ID NO: 3245595 - protein, 29 aa, Plasmodium falciparum
RNKVNPKRNNNINNRNKNNGSYKCDTKRV

SEQ ID NO: 3245596 - protein, 8 aa, Plasmodium falciparum
RNKYANDK

SEQ ID NO: 3245597 - protein, 10 aa, Plasmodium falciparum
RNLGANPESI

SEQ ID NO: 3245598 - protein, 4 aa, Plasmodium falciparum
RNME

SEQ ID NO: 3245599 - protein, 7 aa, Plasmodium falciparum
RNMENNY

SEQ ID NO: 3245600 - protein, 7 aa, Plasmodium falciparum
RNMGTSP

SEQ ID NO: 3245601 - protein, 70 aa, Plasmodium falciparum
RNNDTTQMENNNKKEKKNNNNKKGEKNDNKREKKNNNNKKEKKKNNNKKEKKKNNNKKEKKNNNNKKENI

SEQ ID NO: 3245602 - protein, 7 aa, Plasmodium falciparum
RNNEDEY

SEQ ID NO: 3245603 - protein, 5 aa, Plasmodium falciparum
RNNEE

SEQ ID NO: 3245604 - protein, 10 aa, Plasmodium falciparum
RNNEKKDVKH

SEQ ID NO: 3245605 - protein, 7 aa, Plasmodium falciparum
RNNENRC

SEQ ID NO: 3245606 - protein, 5 aa, Plasmodium falciparum
RNNEQ

SEQ ID NO: 3245607 - protein, 6 aa, Plasmodium falciparum
RNNGAL

SEQ ID NO: 3245608 - protein, 15 aa, Plasmodium falciparum
RNNGPHKEGDKEKRK

SEQ ID NO: 3245609 - protein, 6 aa, Plasmodium falciparum
RNNGTR

SEQ ID NO: 3245610 - protein, 42 aa, Plasmodium falciparum
RNNISSNGRSSKKRLGGDSNNDNVATSKNAESSEKNQDQINT

SEQ ID NO: 3245611 - protein, 4 aa, Plasmodium falciparum
RNNK

SEQ ID NO: 3245612 - protein, 5 aa, Plasmodium falciparum
RNNKD

SEQ ID NO: 3245613 - protein, 10 aa, Plasmodium falciparum
RNNKDKESVK

SEQ ID NO: 3245614 - protein, 11 aa, Plasmodium falciparum
RNNKENKENNE

SEQ ID NO: 3245615 - protein, 21 aa, Plasmodium falciparum
RNNKNEAKNTQNVGNDGNAAN

SEQ ID NO: 3245616 - protein, 48 aa, Plasmodium falciparum
RNNKSGYVSTGKGSDPAYEKSDNDDDDDDDDNNNYNNYNNNNNNNNNN

SEQ ID NO: 3245617 - protein, 6 aa, Plasmodium falciparum
RNNLKR

SEQ ID NO: 3245618 - protein, 13 aa, Plasmodium falciparum
RNNLNSSGKTEKL

SEQ ID NO: 3245619 - protein, 8 aa, Plasmodium falciparum
RNNLQGDN

SEQ ID NO: 3245620 - protein, 10 aa, Plasmodium falciparum
RNNLQGDNLR

SEQ ID NO: 3245621 - protein, 14 aa, Plasmodium falciparum
RNNMEDEKQQKANM

SEQ ID NO: 3245622 - protein, 7 aa, Plasmodium falciparum
RNNMSDK

SEQ ID NO: 3245623 - protein, 5 aa, Plasmodium falciparum
RNNMT

SEQ ID NO: 3245624 - protein, 5 aa, Plasmodium falciparum
RNNNI

SEQ ID NO: 3245625 - protein, 30 aa, Plasmodium falciparum
RNNNINRNNNINNNNINNNNINNNNINNNN

SEQ ID NO: 3245626 - protein, 14 aa, Plasmodium falciparum
RNNNNDNDNNDHTD

SEQ ID NO: 3245627 - protein, 6 aa, Plasmodium falciparum
RNNNNI

SEQ ID NO: 3245628 - protein, 16 aa, Plasmodium falciparum
RNNNNNNNNNKNKYNS

SEQ ID NO: 3245629 - protein, 16 aa, Plasmodium falciparum
RNNNNNNSNNNNNNND

SEQ ID NO: 3245630 - protein, 26 aa, Plasmodium falciparum
RNNNNTEIYGTTQNTNVNNIDSNNEK

SEQ ID NO: 3245631 - protein, 5 aa, Plasmodium falciparum
RNNNT

SEQ ID NO: 3245632 - protein, 48 aa, Plasmodium falciparum
RNNNYDDIRNNNYDDIRNNNYDQMENDNYDDIRNNENDRTQKTSEDMP

SEQ ID NO: 3245633 - protein, 9 aa, Plasmodium falciparum
RNNPNEPTP

SEQ ID NO: 3245634 - protein, 4 aa, Plasmodium falciparum
RNNR

SEQ ID NO: 3245635 - protein, 9 aa, Plasmodium falciparum
RNNRKYKDT

SEQ ID NO: 3245636 - protein, 5 aa, Plasmodium falciparum
RNNRS

SEQ ID NO: 3245637 - protein, 10 aa, Plasmodium falciparum
RNNSGDNLMD

SEQ ID NO: 3245638 - protein, 7 aa, Plasmodium falciparum
RNNSKKL

SEQ ID NO: 3245639 - protein, 13 aa, Plasmodium falciparum
RNNSNISSSKSEM

SEQ ID NO: 3245640 - protein, 7 aa, Plasmodium falciparum
RNNSSIN

SEQ ID NO: 3245641 - protein, 4 aa, Plasmodium falciparum
RNNT

SEQ ID NO: 3245642 - protein, 15 aa, Plasmodium falciparum
RNNTQSEYDKYEESD

SEQ ID NO: 3245643 - protein, 17 aa, Plasmodium falciparum
RNPDYDNEKKDSANNKN

SEQ ID NO: 3245644 - protein, 7 aa, Plasmodium falciparum
RNPPKDI

SEQ ID NO: 3245645 - protein, 6 aa, Plasmodium falciparum
RNPSPS

SEQ ID NO: 3245646 - protein, 19 aa, Plasmodium falciparum
RNQDNNEKVNYLNNGDKNI

SEQ ID NO: 3245647 - protein, 11 aa, Plasmodium falciparum
RNQEEKYKEKY

SEQ ID NO: 3245648 - protein, 7 aa, Plasmodium falciparum
RNQINSK

SEQ ID NO: 3245649 - protein, 14 aa, Plasmodium falciparum
RNQKENEQKRNKQR

SEQ ID NO: 3245650 - protein, 11 aa, Plasmodium falciparum
RNQNRGKKKEA

SEQ ID NO: 3245651 - protein, 10 aa, Plasmodium falciparum
RNQNSDHNDD

SEQ ID NO: 3245652 - protein, 7 aa, Plasmodium falciparum
RNQPYDH

SEQ ID NO: 3245653 - protein, 26 aa, Plasmodium falciparum
RNRKNKKNKSKHNNHKNNNKINNNTK

SEQ ID NO: 3245654 - protein, 40 aa, Plasmodium falciparum
RNRKSDKDDDDDDDNNNNNNNNNNNNTPKEKKNENNTKSN

SEQ ID NO: 3245655 - protein, 34 aa, Plasmodium falciparum
RNRKSSELSKNSKPKKKKDNKNVSCGSSPNMDSI

SEQ ID NO: 3245656 - protein, 5 aa, Plasmodium falciparum
RNRME

SEQ ID NO: 3245657 - protein, 5 aa, Plasmodium falciparum
RNRNK

SEQ ID NO: 3245658 - protein, 8 aa, Plasmodium falciparum
RNRNKKTI

SEQ ID NO: 3245659 - protein, 9 aa, Plasmodium falciparum
RNRNKNNDV

SEQ ID NO: 3245660 - protein, 9 aa, Plasmodium falciparum
RNRQSEAST

SEQ ID NO: 3245661 - protein, 21 aa, Plasmodium falciparum
RNRSKPKIKGKNEKKKKEIVK

SEQ ID NO: 3245662 - protein, 8 aa, Plasmodium falciparum
RNSAAARN

SEQ ID NO: 3245663 - protein, 9 aa, Plasmodium falciparum
RNSADYLSN

SEQ ID NO: 3245664 - protein, 21 aa, Plasmodium falciparum
RNSANGDDEDNPEKQLKEGTI

SEQ ID NO: 3245665 - protein, 9 aa, Plasmodium falciparum
RNSDGNFCG

SEQ ID NO: 3245666 - protein, 31 aa, Plasmodium falciparum
RNSDNSYEEEPSNTTKAKKKLKLKNPKRKHK

SEQ ID NO: 3245667 - protein, 6 aa, Plasmodium falciparum
RNSDNY

SEQ ID NO: 3245668 - protein, 14 aa, Plasmodium falciparum
RNSEQNTNLNQNNI

SEQ ID NO: 3245669 - protein, 7 aa, Plasmodium falciparum
RNSESFN

SEQ ID NO: 3245670 - protein, 13 aa, Plasmodium falciparum
RNSHGNDISNDIN

SEQ ID NO: 3245671 - protein, 7 aa, Plasmodium falciparum
RNSKDQF

SEQ ID NO: 3245672 - protein, 9 aa, Plasmodium falciparum
RNSKEKSLY

SEQ ID NO: 3245673 - protein, 7 aa, Plasmodium falciparum
RNSLKEA

SEQ ID NO: 3245674 - protein, 5 aa, Plasmodium falciparum
RNSLN

SEQ ID NO: 3245675 - protein, 7 aa, Plasmodium falciparum
RNSLPNN

SEQ ID NO: 3245676 - protein, 8 aa, Plasmodium falciparum
RNSNDKNL

SEQ ID NO: 3245677 - protein, 18 aa, Plasmodium falciparum
RNSNSVNNNNNNNEKDTL

SEQ ID NO: 3245678 - protein, 8 aa, Plasmodium falciparum
RNSPNDRA

SEQ ID NO: 3245679 - protein, 7 aa, Plasmodium falciparum
RNSQNQY

SEQ ID NO: 3245680 - protein, 7 aa, Plasmodium falciparum
RNSQSEY

SEQ ID NO: 3245681 - protein, 25 aa, Plasmodium falciparum
RNSSYEKKKKKNRRRRRRRRRRRRR

SEQ ID NO: 3245682 - protein, 6 aa, Plasmodium falciparum
RNSTES

SEQ ID NO: 3245683 - protein, 8 aa, Plasmodium falciparum
RNSTINEE

SEQ ID NO: 3245684 - protein, 6 aa, Plasmodium falciparum
RNSYQI

SEQ ID NO: 3245685 - protein, 11 aa, Plasmodium falciparum
RNTDSEKPKVF

SEQ ID NO: 3245686 - protein, 7 aa, Plasmodium falciparum
RNTEETM

SEQ ID NO: 3245687 - protein, 12 aa, Plasmodium falciparum
RNTEKIEQKKKT

SEQ ID NO: 3245688 - protein, 10 aa, Plasmodium falciparum
RNTKDNFEDN

SEQ ID NO: 3245689 - protein, 22 aa, Plasmodium falciparum
RNTKESKRNKNKINKKKKKENE

SEQ ID NO: 3245690 - protein, 24 aa, Plasmodium falciparum
RNTKKKNKQNLDEEEEDTEEDEDM

SEQ ID NO: 3245691 - protein, 15 aa, Plasmodium falciparum
RNTNGYNTMEDTRNR

SEQ ID NO: 3245692 - protein, 6 aa, Plasmodium falciparum
RNTPRN

SEQ ID NO: 3245693 - protein, 6 aa, Plasmodium falciparum
RNTSEF

SEQ ID NO: 3245694 - protein, 5 aa, Plasmodium falciparum
RNTSI

SEQ ID NO: 3245695 - protein, 4 aa, Plasmodium falciparum
RNTT

SEQ ID NO: 3245696 - protein, 14 aa, Plasmodium falciparum
RNTTSSSSSSISTT

SEQ ID NO: 3245697 - protein, 26 aa, Plasmodium falciparum
RNVEETNKKKKNKKKNKNKKIKNKKN

SEQ ID NO: 3245698 - protein, 4 aa, Plasmodium falciparum
RNVH

SEQ ID NO: 3245699 - protein, 4 aa, Plasmodium falciparum
RNVK

SEQ ID NO: 3245700 - protein, 23 aa, Plasmodium falciparum
RNVKTKEEKKMSNTTNKITKDSI

SEQ ID NO: 3245701 - protein, 6 aa, Plasmodium falciparum
RNVNKT

SEQ ID NO: 3245702 - protein, 6 aa, Plasmodium falciparum
RNVPKA

SEQ ID NO: 3245703 - protein, 6 aa, Plasmodium falciparum
RNYENL

SEQ ID NO: 3245704 - protein, 19 aa, Plasmodium falciparum
RNYNHRNGGVGQNNTGDNN

SEQ ID NO: 3245705 - protein, 6 aa, Plasmodium falciparum
RNYNND

SEQ ID NO: 3245706 - protein, 5 aa, Plasmodium falciparum
RNYPE

SEQ ID NO: 3245707 - protein, 6 aa, Plasmodium falciparum
RNYPHP

SEQ ID NO: 3245708 - protein, 6 aa, Plasmodium falciparum
RNYPYN

SEQ ID NO: 3245709 - protein, 14 aa, Plasmodium falciparum
RNYQNDKDPKQVPF

SEQ ID NO: 3245710 - protein, 9 aa, Plasmodium falciparum
RNYTDDDKN

SEQ ID NO: 3245711 - protein, 4 aa, Plasmodium falciparum
RPDI

SEQ ID NO: 3245712 - protein, 4 aa, Plasmodium falciparum
RPEE

SEQ ID NO: 3245713 - protein, 15 aa, Plasmodium falciparum
RPEKKEETKEYPNNG

SEQ ID NO: 3245714 - protein, 4 aa, Plasmodium falciparum
RPEV

SEQ ID NO: 3245715 - protein, 18 aa, Plasmodium falciparum
RPFSSNKKNNKMNRDSSY

SEQ ID NO: 3245716 - protein, 4 aa, Plasmodium falciparum
RPGR

SEQ ID NO: 3245717 - protein, 14 aa, Plasmodium falciparum
RPINTNDKAQVTQD

SEQ ID NO: 3245718 - protein, 14 aa, Plasmodium falciparum
RPKDNKTSDGYNDE

SEQ ID NO: 3245719 - protein, 11 aa, Plasmodium falciparum
RPKGGKDGTPI

SEQ ID NO: 3245720 - protein, 9 aa, Plasmodium falciparum
RPKGRNIKN

SEQ ID NO: 3245721 - protein, 4 aa, Plasmodium falciparum
RPKN

SEQ ID NO: 3245722 - protein, 13 aa, Plasmodium falciparum
RPLKKENDSKFDS

SEQ ID NO: 3245723 - protein, 4 aa, Plasmodium falciparum
RPLN

SEQ ID NO: 3245724 - protein, 6 aa, Plasmodium falciparum
RPLNDE

SEQ ID NO: 3245725 - protein, 5 aa, Plasmodium falciparum
RPLPN

SEQ ID NO: 3245726 - protein, 6 aa, Plasmodium falciparum
RPLSGN

SEQ ID NO: 3245727 - protein, 4 aa, Plasmodium falciparum
RPMS

SEQ ID NO: 3245728 - protein, 5 aa, Plasmodium falciparum
RPNEK

SEQ ID NO: 3245729 - protein, 4 aa, Plasmodium falciparum
RPNN

SEQ ID NO: 3245730 - protein, 9 aa, Plasmodium falciparum
RPNNPHYYN

SEQ ID NO: 3245731 - protein, 11 aa, Plasmodium falciparum
RPNPGESGTPI

SEQ ID NO: 3245732 - protein, 5 aa, Plasmodium falciparum
RPPNP

SEQ ID NO: 3245733 - protein, 4 aa, Plasmodium falciparum
RPQD

SEQ ID NO: 3245734 - protein, 6 aa, Plasmodium falciparum
RPQPHD

SEQ ID NO: 3245735 - protein, 11 aa, Plasmodium falciparum
RPRGTKNRGIP

SEQ ID NO: 3245736 - protein, 6 aa, Plasmodium falciparum
RPSDDF

SEQ ID NO: 3245737 - protein, 5 aa, Plasmodium falciparum
RPSDF

SEQ ID NO: 3245738 - protein, 16 aa, Plasmodium falciparum
RPSEEEKEKKKRTISN

SEQ ID NO: 3245739 - protein, 10 aa, Plasmodium falciparum
RPSKKKTKKF

SEQ ID NO: 3245740 - protein, 13 aa, Plasmodium falciparum
RPSKYSRNIPSDG

SEQ ID NO: 3245741 - protein, 9 aa, Plasmodium falciparum
RPVRSRKAT

SEQ ID NO: 3245742 - protein, 4 aa, Plasmodium falciparum
RPYN

SEQ ID NO: 3245743 - protein, 8 aa, Plasmodium falciparum
RQASQRFD

SEQ ID NO: 3245744 - protein, 24 aa, Plasmodium falciparum
RQDESSDISRVNSPELNNNHKTNI

SEQ ID NO: 3245745 - protein, 6 aa, Plasmodium falciparum
RQDNTG

SEQ ID NO: 3245746 - protein, 8 aa, Plasmodium falciparum
RQEKERDL

SEQ ID NO: 3245747 - protein, 12 aa, Plasmodium falciparum
RQEKKKKKKKID

SEQ ID NO: 3245748 - protein, 7 aa, Plasmodium falciparum
RQENEKH

SEQ ID NO: 3245749 - protein, 17 aa, Plasmodium falciparum
RQENEKKKKKKKKKMEN

SEQ ID NO: 3245750 - protein, 14 aa, Plasmodium falciparum
RQENIDEEEEKNQE

SEQ ID NO: 3245751 - protein, 9 aa, Plasmodium falciparum
RQGDDGKNS

SEQ ID NO: 3245752 - protein, 5 aa, Plasmodium falciparum
RQHKE

SEQ ID NO: 3245753 - protein, 16 aa, Plasmodium falciparum
RQKAQKPIEKKNDCNG

SEQ ID NO: 3245754 - protein, 8 aa, Plasmodium falciparum
RQKDIDKQ

SEQ ID NO: 3245755 - protein, 16 aa, Plasmodium falciparum
RQKDIDKQDPYYFPCF

SEQ ID NO: 3245756 - protein, 9 aa, Plasmodium falciparum
RQKEDNIKE

SEQ ID NO: 3245757 - protein, 7 aa, Plasmodium falciparum
RQKESSN

SEQ ID NO: 3245758 - protein, 7 aa, Plasmodium falciparum
RQKIQKD

SEQ ID NO: 3245759 - protein, 11 aa, Plasmodium falciparum
RQKKKSKYEEN

SEQ ID NO: 3245760 - protein, 6 aa, Plasmodium falciparum
RQKQGT

SEQ ID NO: 3245761 - protein, 5 aa, Plasmodium falciparum
RQKQK

SEQ ID NO: 3245762 - protein, 11 aa, Plasmodium falciparum
RQKRKEQRDKN

SEQ ID NO: 3245763 - protein, 6 aa, Plasmodium falciparum
RQKSHE

SEQ ID NO: 3245764 - protein, 15 aa, Plasmodium falciparum
RQKSSNNSNKSSHSL

SEQ ID NO: 3245765 - protein, 6 aa, Plasmodium falciparum
RQNEMD

SEQ ID NO: 3245766 - protein, 25 aa, Plasmodium falciparum
RQNGNPNIVQEDSSSYYYNDDNNNK

SEQ ID NO: 3245767 - protein, 25 aa, Plasmodium falciparum
RQNHKSAKDKKNKENIKKHKKSNDM

SEQ ID NO: 3245768 - protein, 8 aa, Plasmodium falciparum
RQNKRKAS

SEQ ID NO: 3245769 - protein, 7 aa, Plasmodium falciparum
RQNNKMR

SEQ ID NO: 3245770 - protein, 4 aa, Plasmodium falciparum
RQNS

SEQ ID NO: 3245771 - protein, 7 aa, Plasmodium falciparum
RQQENKS

SEQ ID NO: 3245772 - protein, 5 aa, Plasmodium falciparum
RQQNL

SEQ ID NO: 3245773 - protein, 7 aa, Plasmodium falciparum
RQREKLK

SEQ ID NO: 3245774 - protein, 14 aa, Plasmodium falciparum
RQRKMKKKNKFGYN

SEQ ID NO: 3245775 - protein, 7 aa, Plasmodium falciparum
RQSDNDD

SEQ ID NO: 3245776 - protein, 5 aa, Plasmodium falciparum
RQSSQ

SEQ ID NO: 3245777 - protein, 7 aa, Plasmodium falciparum
RQTEQRF

SEQ ID NO: 3245778 - protein, 5 aa, Plasmodium falciparum
RQTIK

SEQ ID NO: 3245779 - protein, 28 aa, Plasmodium falciparum
RQTSPQKKKNKIKKEENVKDEKKQQNYG

SEQ ID NO: 3245780 - protein, 6 aa, Plasmodium falciparum
RQTSQR

SEQ ID NO: 3245781 - protein, 15 aa, Plasmodium falciparum
RQVQRGKEKYCDRDG

SEQ ID NO: 3245782 - protein, 10 aa, Plasmodium falciparum
RQYGNGDDIK

SEQ ID NO: 3245783 - protein, 7 aa, Plasmodium falciparum
RQYKKYR

SEQ ID NO: 3245784 - protein, 11 aa, Plasmodium falciparum
RRAEDAKRIEA

SEQ ID NO: 3245785 - protein, 11 aa, Plasmodium falciparum
RRDKGEETKLE

SEQ ID NO: 3245786 - protein, 11 aa, Plasmodium falciparum
RRDKGEKKKLE

SEQ ID NO: 3245787 - protein, 5 aa, Plasmodium falciparum
RRDPV

SEQ ID NO: 3245788 - protein, 4 aa, Plasmodium falciparum
RRED

SEQ ID NO: 3245789 - protein, 12 aa, Plasmodium falciparum
RREEEKIKDNED

SEQ ID NO: 3245790 - protein, 26 aa, Plasmodium falciparum
RREENNKKKKDSQQENEQEANSNSYL

SEQ ID NO: 3245791 - protein, 10 aa, Plasmodium falciparum
RREKEKKKKI

SEQ ID NO: 3245792 - protein, 11 aa, Plasmodium falciparum
RRENKEKMDNF

SEQ ID NO: 3245793 - protein, 6 aa, Plasmodium falciparum
RRERRI

SEQ ID NO: 3245794 - protein, 6 aa, Plasmodium falciparum
RRETIG

SEQ ID NO: 3245795 - protein, 7 aa, Plasmodium falciparum
RRGEESK

SEQ ID NO: 3245796 - protein, 18 aa, Plasmodium falciparum
RRGNENAKEGNDNDEKNI

SEQ ID NO: 3245797 - protein, 8 aa, Plasmodium falciparum
RRGQTNRM

SEQ ID NO: 3245798 - protein, 7 aa, Plasmodium falciparum
RRGTNGC

SEQ ID NO: 3245799 - protein, 12 aa, Plasmodium falciparum
RRHRKREKKKRE

SEQ ID NO: 3245800 - protein, 12 aa, Plasmodium falciparum
RRIKNKKSDKNV

SEQ ID NO: 3245801 - protein, 7 aa, Plasmodium falciparum
RRKDKEE

SEQ ID NO: 3245802 - protein, 8 aa, Plasmodium falciparum
RRKDKNDE

SEQ ID NO: 3245803 - protein, 4 aa, Plasmodium falciparum
RRKE

SEQ ID NO: 3245804 - protein, 49 aa, Plasmodium falciparum
RRKEEEAARRIERERRADINRKNQDNNSNKYNNEQNGGYESDGNSPNSR

SEQ ID NO: 3245805 - protein, 18 aa, Plasmodium falciparum
RRKEKYDINNKSDKSNEY

SEQ ID NO: 3245806 - protein, 7 aa, Plasmodium falciparum
RRKERGP

SEQ ID NO: 3245807 - protein, 10 aa, Plasmodium falciparum
RRKGNEKQSN

SEQ ID NO: 3245808 - protein, 15 aa, Plasmodium falciparum
RRKKKQLQKKQRKIL

SEQ ID NO: 3245809 - protein, 9 aa, Plasmodium falciparum
RRKKKQRKY

SEQ ID NO: 3245810 - protein, 26 aa, Plasmodium falciparum
RRKKNKTNENDYDNKGRTNYNDDNTN

SEQ ID NO: 3245811 - protein, 17 aa, Plasmodium falciparum
RRKKNNEKKGNEEDIKT

SEQ ID NO: 3245812 - protein, 18 aa, Plasmodium falciparum
RRKNKNAKAKVKDPRLNN

SEQ ID NO: 3245813 - protein, 4 aa, Plasmodium falciparum
RRKP

SEQ ID NO: 3245814 - protein, 16 aa, Plasmodium falciparum
RRKSNKREDYSSREQN

SEQ ID NO: 3245815 - protein, 16 aa, Plasmodium falciparum
RRKTNNANFKEEENSW

SEQ ID NO: 3245816 - protein, 4 aa, Plasmodium falciparum
RRLE

SEQ ID NO: 3245817 - protein, 4 aa, Plasmodium falciparum
RRMN

SEQ ID NO: 3245818 - protein, 11 aa, Plasmodium falciparum
RRNEKEEFNKV

SEQ ID NO: 3245819 - protein, 5 aa, Plasmodium falciparum
RRNGD

SEQ ID NO: 3245820 - protein, 4 aa, Plasmodium falciparum
RRNH

SEQ ID NO: 3245821 - protein, 7 aa, Plasmodium falciparum
RRNKNTN

SEQ ID NO: 3245822 - protein, 29 aa, Plasmodium falciparum
RRNKSIKMGTTNTNHRRSSSVANRNRSRS

SEQ ID NO: 3245823 - protein, 8 aa, Plasmodium falciparum
RRNNLSEK

SEQ ID NO: 3245824 - protein, 8 aa, Plasmodium falciparum
RRNNQNNK

SEQ ID NO: 3245825 - protein, 23 aa, Plasmodium falciparum
RRNNTKREQDGNNNKNKNKEINN

SEQ ID NO: 3245826 - protein, 9 aa, Plasmodium falciparum
RRPKHAGAG

SEQ ID NO: 3245827 - protein, 13 aa, Plasmodium falciparum
RRQGNHKYERKNK

SEQ ID NO: 3245828 - protein, 14 aa, Plasmodium falciparum
RRQKERTFKTNTNM

SEQ ID NO: 3245829 - protein, 32 aa, Plasmodium falciparum
RRQKSEEEEEEKTNKKNKINNNNHNNNNNNNV

SEQ ID NO: 3245830 - protein, 8 aa, Plasmodium falciparum
RRQNSKAV

SEQ ID NO: 3245831 - protein, 4 aa, Plasmodium falciparum
RRRN

SEQ ID NO: 3245832 - protein, 13 aa, Plasmodium falciparum
RRRNAQKNCMNDK

SEQ ID NO: 3245833 - protein, 6 aa, Plasmodium falciparum
RRRNIT

SEQ ID NO: 3245834 - protein, 15 aa, Plasmodium falciparum
RRRRIGNNGPPSAEE

SEQ ID NO: 3245835 - protein, 13 aa, Plasmodium falciparum
RRRRYDKEGKNAI

SEQ ID NO: 3245836 - protein, 11 aa, Plasmodium falciparum
RRRSNSSTKEI

SEQ ID NO: 3245837 - protein, 5 aa, Plasmodium falciparum
RRSKE

SEQ ID NO: 3245838 - protein, 8 aa, Plasmodium falciparum
RRSKELPT

SEQ ID NO: 3245839 - protein, 10 aa, Plasmodium falciparum
RRSNKYAGTR

SEQ ID NO: 3245840 - protein, 5 aa, Plasmodium falciparum
RRSNY

SEQ ID NO: 3245841 - protein, 7 aa, Plasmodium falciparum
RRSPPTE

SEQ ID NO: 3245842 - protein, 7 aa, Plasmodium falciparum
RRSQNEF

SEQ ID NO: 3245843 - protein, 14 aa, Plasmodium falciparum
RRSRNRRNDNQKEE

SEQ ID NO: 3245844 - protein, 13 aa, Plasmodium falciparum
RRSSSTPKKSTGL

SEQ ID NO: 3245845 - protein, 6 aa, Plasmodium falciparum
RRSTPG

SEQ ID NO: 3245846 - protein, 9 aa, Plasmodium falciparum
RRTEDEDDH

SEQ ID NO: 3245847 - protein, 5 aa, Plasmodium falciparum
RRTKS

SEQ ID NO: 3245848 - protein, 5 aa, Plasmodium falciparum
RRYEK

SEQ ID NO: 3245849 - protein, 10 aa, Plasmodium falciparum
RRYENERRIE

SEQ ID NO: 3245850 - protein, 19 aa, Plasmodium falciparum
RRYSKNSIRNKKDDESRNL

SEQ ID NO: 3245851 - protein, 13 aa, Plasmodium falciparum
RSADGAPSGDKDG

SEQ ID NO: 3245852 - protein, 48 aa, Plasmodium falciparum
RSADPSPDTVDSASEDEDEEDKDHQEETEDTAQDTGQGEEETATEKVA

SEQ ID NO: 3245853 - protein, 11 aa, Plasmodium falciparum
RSAENKSLDDT

SEQ ID NO: 3245854 - protein, 15 aa, Plasmodium falciparum
RSAKKEYKKRDRMND

SEQ ID NO: 3245855 - protein, 6 aa, Plasmodium falciparum
RSAQTR

SEQ ID NO: 3245856 - protein, 11 aa, Plasmodium falciparum
RSASNHDMETE

SEQ ID NO: 3245857 - protein, 5 aa, Plasmodium falciparum
RSASR

SEQ ID NO: 3245858 - protein, 7 aa, Plasmodium falciparum
RSATDNS

SEQ ID NO: 3245859 - protein, 5 aa, Plasmodium falciparum
RSAVR

SEQ ID NO: 3245860 - protein, 10 aa, Plasmodium falciparum
RSCDKNNEEK

SEQ ID NO: 3245861 - protein, 7 aa, Plasmodium falciparum
RSCNTTH

SEQ ID NO: 3245862 - protein, 14 aa, Plasmodium falciparum
RSDEDKEKKAHDKL

SEQ ID NO: 3245863 - protein, 7 aa, Plasmodium falciparum
RSDEPYV

SEQ ID NO: 3245864 - protein, 11 aa, Plasmodium falciparum
RSDKNKQTTFS

SEQ ID NO: 3245865 - protein, 8 aa, Plasmodium falciparum
RSDLQSKR

SEQ ID NO: 3245866 - protein, 7 aa, Plasmodium falciparum
RSDPEQD

SEQ ID NO: 3245867 - protein, 6 aa, Plasmodium falciparum
RSDPNY

SEQ ID NO: 3245868 - protein, 5 aa, Plasmodium falciparum
RSDTM

SEQ ID NO: 3245869 - protein, 68 aa, Plasmodium falciparum
RSEDGEDGPPPPRAPRQSLARSADNPSPRPAPPGGPQPPSGTPDAGGARAETGPSPQQPPKPPAGNGG

SEQ ID NO: 3245870 - protein, 14 aa, Plasmodium falciparum
RSEGKNERKTDFKN

SEQ ID NO: 3245871 - protein, 7 aa, Plasmodium falciparum
RSEGSPY

SEQ ID NO: 3245872 - protein, 7 aa, Plasmodium falciparum
RSELPNN

SEQ ID NO: 3245873 - protein, 11 aa, Plasmodium falciparum
RSENKTTDKVE

SEQ ID NO: 3245874 - protein, 9 aa, Plasmodium falciparum
RSENKYNNM

SEQ ID NO: 3245875 - protein, 7 aa, Plasmodium falciparum
RSENPQT

SEQ ID NO: 3245876 - protein, 5 aa, Plasmodium falciparum
RSFEN

SEQ ID NO: 3245877 - protein, 20 aa, Plasmodium falciparum
RSFGENSVGSSAYENNDYAT

SEQ ID NO: 3245878 - protein, 5 aa, Plasmodium falciparum
RSFSP

SEQ ID NO: 3245879 - protein, 7 aa, Plasmodium falciparum
RSGASES

SEQ ID NO: 3245880 - protein, 33 aa, Plasmodium falciparum
RSGDNYDDDNNYEDDNNYEDDNNHDDDDDNNNY

SEQ ID NO: 3245881 - protein, 4 aa, Plasmodium falciparum
RSGI

SEQ ID NO: 3245882 - protein, 33 aa, Plasmodium falciparum
RSGKNGENENVENENVENKNDVENKNDVDNQNS

SEQ ID NO: 3245883 - protein, 8 aa, Plasmodium falciparum
RSGNEDRR

SEQ ID NO: 3245884 - protein, 118 aa, Plasmodium falciparum
RSGNKDDEDKKDDEYKEEDEYKEEDEYKEEDEYKEEDEYKEEDEYKEEDEYKEEDEDMKKDEDMKKDEDMKKDEYKKGYKDYKKDQSKNDNKTEERKDEGNISTSNEHHASEKTDDED

SEQ ID NO: 3245885 - protein, 7 aa, Plasmodium falciparum
RSHESYV

SEQ ID NO: 3245886 - protein, 9 aa, Plasmodium falciparum
RSHKSTPLE

SEQ ID NO: 3245887 - protein, 19 aa, Plasmodium falciparum
RSHSTSDPKKNEEKSLSDE

SEQ ID NO: 3245888 - protein, 5 aa, Plasmodium falciparum
RSIEN

SEQ ID NO: 3245889 - protein, 4 aa, Plasmodium falciparum
RSIN

SEQ ID NO: 3245890 - protein, 7 aa, Plasmodium falciparum
RSINTKY

SEQ ID NO: 3245891 - protein, 6 aa, Plasmodium falciparum
RSIPTN

SEQ ID NO: 3245892 - protein, 9 aa, Plasmodium falciparum
RSISSNEDV

SEQ ID NO: 3245893 - protein, 8 aa, Plasmodium falciparum
RSKETNEK

SEQ ID NO: 3245894 - protein, 33 aa, Plasmodium falciparum
RSKNNQKNNVEMNKKKNNEYDDHKRNEEAPSYG

SEQ ID NO: 3245895 - protein, 8 aa, Plasmodium falciparum
RSKRTKMT

SEQ ID NO: 3245896 - protein, 8 aa, Plasmodium falciparum
RSKSEGKE

SEQ ID NO: 3245897 - protein, 21 aa, Plasmodium falciparum
RSKTNNEVNTLTKNKKNININ

SEQ ID NO: 3245898 - protein, 18 aa, Plasmodium falciparum
RSLGSDSIYDENGNINEQ

SEQ ID NO: 3245899 - protein, 72 aa, Plasmodium falciparum
RSLSEKQSHVTNSATEVAAQENNSTEEKKNNPPVEQQQQQQQQQQQQQQQQQQQQQQQQQQQQQQQQQPNEL

SEQ ID NO: 3245900 - protein, 5 aa, Plasmodium falciparum
RSNDK

SEQ ID NO: 3245901 - protein, 80 aa, Plasmodium falciparum
RSNDLKKKKENNKCDNMSNDISDSISNNISDSISTNISNNISNNISNNISNNLSNNISNNISNNLSNNISNNTSNNTSHN

SEQ ID NO: 3245902 - protein, 7 aa, Plasmodium falciparum
RSNGEKG

SEQ ID NO: 3245903 - protein, 12 aa, Plasmodium falciparum
RSNGGTGGIDGC

SEQ ID NO: 3245904 - protein, 9 aa, Plasmodium falciparum
RSNIEESNA

SEQ ID NO: 3245905 - protein, 19 aa, Plasmodium falciparum
RSNKDNDNNYKENQKNEVE

SEQ ID NO: 3245906 - protein, 6 aa, Plasmodium falciparum
RSNKHQ

SEQ ID NO: 3245907 - protein, 8 aa, Plasmodium falciparum
RSNKNDCN

SEQ ID NO: 3245908 - protein, 7 aa, Plasmodium falciparum
RSNLKKN

SEQ ID NO: 3245909 - protein, 20 aa, Plasmodium falciparum
RSNNKNMDTTPGADEKQNKK

SEQ ID NO: 3245910 - protein, 5 aa, Plasmodium falciparum
RSNNL

SEQ ID NO: 3245911 - protein, 6 aa, Plasmodium falciparum
RSNRIS

SEQ ID NO: 3245912 - protein, 7 aa, Plasmodium falciparum
RSNRNSN

SEQ ID NO: 3245913 - protein, 6 aa, Plasmodium falciparum
RSNSIN

SEQ ID NO: 3245914 - protein, 82 aa, Plasmodium falciparum
RSNTCEENECKKNKQSDMDKSYKDDDKSGDDKYNDDKYNDDKDNDDKDNDDKYNDDKYNDDKYNDDKHNDDDYSDDYYSDDY

SEQ ID NO: 3245915 - protein, 6 aa, Plasmodium falciparum
RSNTDL

SEQ ID NO: 3245916 - protein, 13 aa, Plasmodium falciparum
RSNTEKNKTYNNM

SEQ ID NO: 3245917 - protein, 6 aa, Plasmodium falciparum
RSNTNM

SEQ ID NO: 3245918 - protein, 10 aa, Plasmodium falciparum
RSNTNTCSNE

SEQ ID NO: 3245919 - protein, 6 aa, Plasmodium falciparum
RSNTSM

SEQ ID NO: 3245920 - protein, 8 aa, Plasmodium falciparum
RSNVKRRK

SEQ ID NO: 3245921 - protein, 21 aa, Plasmodium falciparum
RSNYKEEYTNDENKKNGEYQK

SEQ ID NO: 3245922 - protein, 8 aa, Plasmodium falciparum
RSPEEKND

SEQ ID NO: 3245923 - protein, 4 aa, Plasmodium falciparum
RSPI

SEQ ID NO: 3245924 - protein, 19 aa, Plasmodium falciparum
RSQDNCSPIEKDESNFNNN

SEQ ID NO: 3245925 - protein, 15 aa, Plasmodium falciparum
RSQQHNEDSSDALET

SEQ ID NO: 3245926 - protein, 7 aa, Plasmodium falciparum
RSRHGSL

SEQ ID NO: 3245927 - protein, 4 aa, Plasmodium falciparum
RSRK

SEQ ID NO: 3245928 - protein, 76 aa, Plasmodium falciparum
RSRRRSHNYYSSSEDNKSDNYNINDNNDYHHNDTDTDEDNEYYSDNYKKGGNQNGNKLNDNNNNNNKKNKNEKNKM

SEQ ID NO: 3245929 - protein, 6 aa, Plasmodium falciparum
RSRTGT

SEQ ID NO: 3245930 - protein, 8 aa, Plasmodium falciparum
RSRVSREY

SEQ ID NO: 3245931 - protein, 9 aa, Plasmodium falciparum
RSSAVGTQK

SEQ ID NO: 3245932 - protein, 10 aa, Plasmodium falciparum
RSSEKNGSNM

SEQ ID NO: 3245933 - protein, 12 aa, Plasmodium falciparum
RSSGFSNNNEQC

SEQ ID NO: 3245934 - protein, 6 aa, Plasmodium falciparum
RSSKKL

SEQ ID NO: 3245935 - protein, 12 aa, Plasmodium falciparum
RSSKPGGQNVNK

SEQ ID NO: 3245936 - protein, 10 aa, Plasmodium falciparum
RSSNDDQQQI

SEQ ID NO: 3245937 - protein, 7 aa, Plasmodium falciparum
RSSNHIS

SEQ ID NO: 3245938 - protein, 15 aa, Plasmodium falciparum
RSSNNNNNDNNNDKT

SEQ ID NO: 3245939 - protein, 16 aa, Plasmodium falciparum
RSSQNINKSDSKGKIK

SEQ ID NO: 3245940 - protein, 10 aa, Plasmodium falciparum
RSSSCPPPKN

SEQ ID NO: 3245941 - protein, 7 aa, Plasmodium falciparum
RSSSKRL

SEQ ID NO: 3245942 - protein, 7 aa, Plasmodium falciparum
RSSSRNS

SEQ ID NO: 3245943 - protein, 12 aa, Plasmodium falciparum
RSSTKKKKKKKI

SEQ ID NO: 3245944 - protein, 6 aa, Plasmodium falciparum
RSSTSM

SEQ ID NO: 3245945 - protein, 6 aa, Plasmodium falciparum
RSSWTA

SEQ ID NO: 3245946 - protein, 4 aa, Plasmodium falciparum
RSTN

SEQ ID NO: 3245947 - protein, 10 aa, Plasmodium falciparum
RSTNEPLPKD

SEQ ID NO: 3245948 - protein, 6 aa, Plasmodium falciparum
RSTNSG

SEQ ID NO: 3245949 - protein, 9 aa, Plasmodium falciparum
RSTNTKEDI

SEQ ID NO: 3245950 - protein, 10 aa, Plasmodium falciparum
RSTPDSDSYK

SEQ ID NO: 3245951 - protein, 8 aa, Plasmodium falciparum
RSTRSDKP

SEQ ID NO: 3245952 - protein, 11 aa, Plasmodium falciparum
RSTSYSSQDIE

SEQ ID NO: 3245953 - protein, 6 aa, Plasmodium falciparum
RSTVST

SEQ ID NO: 3245954 - protein, 7 aa, Plasmodium falciparum
RSVDGKT

SEQ ID NO: 3245955 - protein, 21 aa, Plasmodium falciparum
RSVETSGSSGGSGATGKSDGS

SEQ ID NO: 3245956 - protein, 4 aa, Plasmodium falciparum
RSVN

SEQ ID NO: 3245957 - protein, 8 aa, Plasmodium falciparum
RSVPPPPC

SEQ ID NO: 3245958 - protein, 12 aa, Plasmodium falciparum
RSWKHECKKHLC

SEQ ID NO: 3245959 - protein, 6 aa, Plasmodium falciparum
RSYTRP

SEQ ID NO: 3245960 - protein, 4 aa, Plasmodium falciparum
RTAR

SEQ ID NO: 3245961 - protein, 8 aa, Plasmodium falciparum
RTARANRK

SEQ ID NO: 3245962 - protein, 4 aa, Plasmodium falciparum
RTCG

SEQ ID NO: 3245963 - protein, 6 aa, Plasmodium falciparum
RTDEKK

SEQ ID NO: 3245964 - protein, 10 aa, Plasmodium falciparum
RTDENDNKQI

SEQ ID NO: 3245965 - protein, 7 aa, Plasmodium falciparum
RTDESVK

SEQ ID NO: 3245966 - protein, 15 aa, Plasmodium falciparum
RTDGSRGEGPMFWFL

SEQ ID NO: 3245967 - protein, 6 aa, Plasmodium falciparum
RTDKLK

SEQ ID NO: 3245968 - protein, 10 aa, Plasmodium falciparum
RTEDSMSDGV

SEQ ID NO: 3245969 - protein, 7 aa, Plasmodium falciparum
RTEFDEQ

SEQ ID NO: 3245970 - protein, 7 aa, Plasmodium falciparum
RTEGFSG

SEQ ID NO: 3245971 - protein, 14 aa, Plasmodium falciparum
RTESSKIKDGTPKD

SEQ ID NO: 3245972 - protein, 4 aa, Plasmodium falciparum
RTEW

SEQ ID NO: 3245973 - protein, 5 aa, Plasmodium falciparum
RTEWD

SEQ ID NO: 3245974 - protein, 5 aa, Plasmodium falciparum
RTEWT

SEQ ID NO: 3245975 - protein, 13 aa, Plasmodium falciparum
RTFKPGNGVKQGR

SEQ ID NO: 3245976 - protein, 6 aa, Plasmodium falciparum
RTGKDN

SEQ ID NO: 3245977 - protein, 7 aa, Plasmodium falciparum
RTGKPLS

SEQ ID NO: 3245978 - protein, 14 aa, Plasmodium falciparum
RTGNDDNEKKNMTD

SEQ ID NO: 3245979 - protein, 6 aa, Plasmodium falciparum
RTGQGP

SEQ ID NO: 3245980 - protein, 14 aa, Plasmodium falciparum
RTGTEDTSQEGGHI

SEQ ID NO: 3245981 - protein, 5 aa, Plasmodium falciparum
RTHEE

SEQ ID NO: 3245982 - protein, 5 aa, Plasmodium falciparum
RTIEN

SEQ ID NO: 3245983 - protein, 8 aa, Plasmodium falciparum
RTIKNENV

SEQ ID NO: 3245984 - protein, 4 aa, Plasmodium falciparum
RTIL

SEQ ID NO: 3245985 - protein, 10 aa, Plasmodium falciparum
RTINSNSSCK

SEQ ID NO: 3245986 - protein, 12 aa, Plasmodium falciparum
RTISASSNNGNK

SEQ ID NO: 3245987 - protein, 4 aa, Plasmodium falciparum
RTIT

SEQ ID NO: 3245988 - protein, 7 aa, Plasmodium falciparum
RTKANEM

SEQ ID NO: 3245989 - protein, 9 aa, Plasmodium falciparum
RTKGYSSDS

SEQ ID NO: 3245990 - protein, 20 aa, Plasmodium falciparum
RTKKKRMKKKYKEQEDDEES

SEQ ID NO: 3245991 - protein, 42 aa, Plasmodium falciparum
RTKKQKCNNMKDDEVSNINDDEVSNINDDEVSNINDDEVSNI

SEQ ID NO: 3245992 - protein, 20 aa, Plasmodium falciparum
RTKNGGNKWEEKSGGNCKSG

SEQ ID NO: 3245993 - protein, 6 aa, Plasmodium falciparum
RTKNNN

SEQ ID NO: 3245994 - protein, 7 aa, Plasmodium falciparum
RTKPNEI

SEQ ID NO: 3245995 - protein, 15 aa, Plasmodium falciparum
RTKRNVQEKRMSQSA

SEQ ID NO: 3245996 - protein, 9 aa, Plasmodium falciparum
RTKSNGEGL

SEQ ID NO: 3245997 - protein, 7 aa, Plasmodium falciparum
RTKSTDE

SEQ ID NO: 3245998 - protein, 5 aa, Plasmodium falciparum
RTKTF

SEQ ID NO: 3245999 - protein, 8 aa, Plasmodium falciparum
RTKTYEKN

SEQ ID NO: 3246000 - protein, 11 aa, Plasmodium falciparum
RTLNGIGDDPN

SEQ ID NO: 3246001 - protein, 29 aa, Plasmodium falciparum
RTLSDNNAKKEGRSGIEKVKSKSQHSPCS

SEQ ID NO: 3246002 - protein, 4 aa, Plasmodium falciparum
RTNA

SEQ ID NO: 3246003 - protein, 22 aa, Plasmodium falciparum
RTNATNGTSYPCRAGKEERFSD

SEQ ID NO: 3246004 - protein, 8 aa, Plasmodium falciparum
RTNDTNNN

SEQ ID NO: 3246005 - protein, 7 aa, Plasmodium falciparum
RTNISED

SEQ ID NO: 3246006 - protein, 27 aa, Plasmodium falciparum
RTNKEQKNKYSEMEPKKSVGASTLNDE

SEQ ID NO: 3246007 - protein, 5 aa, Plasmodium falciparum
RTNKL

SEQ ID NO: 3246008 - protein, 23 aa, Plasmodium falciparum
RTNKNSEKIRKKEKRKCKSKKYE

SEQ ID NO: 3246009 - protein, 13 aa, Plasmodium falciparum
RTNKSTELDQKDD

SEQ ID NO: 3246010 - protein, 7 aa, Plasmodium falciparum
RTNNEEK

SEQ ID NO: 3246011 - protein, 8 aa, Plasmodium falciparum
RTNNKNYK

SEQ ID NO: 3246012 - protein, 10 aa, Plasmodium falciparum
RTNNSSSINN

SEQ ID NO: 3246013 - protein, 4 aa, Plasmodium falciparum
RTNP

SEQ ID NO: 3246014 - protein, 6 aa, Plasmodium falciparum
RTNQGY

SEQ ID NO: 3246015 - protein, 5 aa, Plasmodium falciparum
RTNRY

SEQ ID NO: 3246016 - protein, 4 aa, Plasmodium falciparum
RTNS

SEQ ID NO: 3246017 - protein, 10 aa, Plasmodium falciparum
RTNSTDEKNY

SEQ ID NO: 3246018 - protein, 5 aa, Plasmodium falciparum
RTNSY

SEQ ID NO: 3246019 - protein, 10 aa, Plasmodium falciparum
RTPKATTRSL

SEQ ID NO: 3246020 - protein, 11 aa, Plasmodium falciparum
RTPKTKPTRTH

SEQ ID NO: 3246021 - protein, 5 aa, Plasmodium falciparum
RTPNK

SEQ ID NO: 3246022 - protein, 7 aa, Plasmodium falciparum
RTPSRFN

SEQ ID NO: 3246023 - protein, 4 aa, Plasmodium falciparum
RTQE

SEQ ID NO: 3246024 - protein, 9 aa, Plasmodium falciparum
RTQIEPNTE

SEQ ID NO: 3246025 - protein, 15 aa, Plasmodium falciparum
RTQKDEEQKSNSSLY

SEQ ID NO: 3246026 - protein, 11 aa, Plasmodium falciparum
RTQKGEKNEIT

SEQ ID NO: 3246027 - protein, 13 aa, Plasmodium falciparum
RTQKSKKKKSINV

SEQ ID NO: 3246028 - protein, 4 aa, Plasmodium falciparum
RTQW

SEQ ID NO: 3246029 - protein, 5 aa, Plasmodium falciparum
RTRKA

SEQ ID NO: 3246030 - protein, 9 aa, Plasmodium falciparum
RTRTEKEEN

SEQ ID NO: 3246031 - protein, 8 aa, Plasmodium falciparum
RTSANTCS

SEQ ID NO: 3246032 - protein, 6 aa, Plasmodium falciparum
RTSEYN

SEQ ID NO: 3246033 - protein, 11 aa, Plasmodium falciparum
RTSGKSNGDNK

SEQ ID NO: 3246034 - protein, 10 aa, Plasmodium falciparum
RTSQDMDKKN

SEQ ID NO: 3246035 - protein, 8 aa, Plasmodium falciparum
RTTFEPPH

SEQ ID NO: 3246036 - protein, 9 aa, Plasmodium falciparum
RTTKEVEGR

SEQ ID NO: 3246037 - protein, 9 aa, Plasmodium falciparum
RTTKTNSKE

SEQ ID NO: 3246038 - protein, 4 aa, Plasmodium falciparum
RTTN

SEQ ID NO: 3246039 - protein, 7 aa, Plasmodium falciparum
RTTNETW

SEQ ID NO: 3246040 - protein, 37 aa, Plasmodium falciparum
RTTQPSVPNEEDKNKEANSENNQAQTNINNTSQSLEN

SEQ ID NO: 3246041 - protein, 6 aa, Plasmodium falciparum
RTTQRF

SEQ ID NO: 3246042 - protein, 5 aa, Plasmodium falciparum
RTTVL

SEQ ID NO: 3246043 - protein, 4 aa, Plasmodium falciparum
RTVE

SEQ ID NO: 3246044 - protein, 5 aa, Plasmodium falciparum
RTVEN

SEQ ID NO: 3246045 - protein, 6 aa, Plasmodium falciparum
RTVRDG

SEQ ID NO: 3246046 - protein, 4 aa, Plasmodium falciparum
RTVY

SEQ ID NO: 3246047 - protein, 114 aa, Plasmodium falciparum
RTYDRNYDRNYDRTYDRNYDRTYDRNYDRNYDRTYDRNYDRTYDRNYDRTYDRNYDRNYDRNYDRNNDRNNDRNNDRNNDRNNDRNHDRNHDRNHERNHERNHERSQDRTHERS

SEQ ID NO: 3246048 - protein, 4 aa, Plasmodium falciparum
RTYE

SEQ ID NO: 3246049 - protein, 11 aa, Plasmodium falciparum
RTYNDSDIREN

SEQ ID NO: 3246050 - protein, 8 aa, Plasmodium falciparum
RTYPDTNS

SEQ ID NO: 3246051 - protein, 7 aa, Plasmodium falciparum
RVDEYDN

SEQ ID NO: 3246052 - protein, 23 aa, Plasmodium falciparum
RVDPNVNKKENEEEKNVSTNSEI

SEQ ID NO: 3246053 - protein, 5 aa, Plasmodium falciparum
RVDTN

SEQ ID NO: 3246054 - protein, 16 aa, Plasmodium falciparum
RVEDGSKNCSGYGEDC

SEQ ID NO: 3246055 - protein, 9 aa, Plasmodium falciparum
RVEENKTNK

SEQ ID NO: 3246056 - protein, 10 aa, Plasmodium falciparum
RVERDESHTK

SEQ ID NO: 3246057 - protein, 4 aa, Plasmodium falciparum
RVGK

SEQ ID NO: 3246058 - protein, 31 aa, Plasmodium falciparum
RVHQKKKNSKVSINKKTNNSLSDDNNYSSDE

SEQ ID NO: 3246059 - protein, 16 aa, Plasmodium falciparum
RVKDKRQKCKEQRDKD

SEQ ID NO: 3246060 - protein, 31 aa, Plasmodium falciparum
RVKKENEEKGCKRDNSKEKHDKSQNKSETVQ

SEQ ID NO: 3246061 - protein, 5 aa, Plasmodium falciparum
RVKRF

SEQ ID NO: 3246062 - protein, 15 aa, Plasmodium falciparum
RVNKNRQKCKEQCDR

SEQ ID NO: 3246063 - protein, 7 aa, Plasmodium falciparum
RVNNNSF

SEQ ID NO: 3246064 - protein, 4 aa, Plasmodium falciparum
RVPL

SEQ ID NO: 3246065 - protein, 15 aa, Plasmodium falciparum
RVQNKRKQCKEQCEK

SEQ ID NO: 3246066 - protein, 8 aa, Plasmodium falciparum
RVSKYDEK

SEQ ID NO: 3246067 - protein, 20 aa, Plasmodium falciparum
RVSKYDEKKIRGSNDGACPP

SEQ ID NO: 3246068 - protein, 6 aa, Plasmodium falciparum
RVSPNN

SEQ ID NO: 3246069 - protein, 12 aa, Plasmodium falciparum
RVTGKKSAGGAC

SEQ ID NO: 3246070 - protein, 8 aa, Plasmodium falciparum
RVTQNNNS

SEQ ID NO: 3246071 - protein, 9 aa, Plasmodium falciparum
RWKNPYESI

SEQ ID NO: 3246072 - protein, 15 aa, Plasmodium falciparum
RWKNPYETLDDTEVK

SEQ ID NO: 3246073 - protein, 8 aa, Plasmodium falciparum
RWNQGKRE

SEQ ID NO: 3246074 - protein, 21 aa, Plasmodium falciparum
RWREKGVTSDEEKEREKQKLE

SEQ ID NO: 3246075 - protein, 6 aa, Plasmodium falciparum
RYEHPL

SEQ ID NO: 3246076 - protein, 10 aa, Plasmodium falciparum
RYEKGTLQTK

SEQ ID NO: 3246077 - protein, 4 aa, Plasmodium falciparum
RYEN

SEQ ID NO: 3246078 - protein, 13 aa, Plasmodium falciparum
RYENDEEKKKKSI

SEQ ID NO: 3246079 - protein, 8 aa, Plasmodium falciparum
RYENDGNN

SEQ ID NO: 3246080 - protein, 5 aa, Plasmodium falciparum
RYETT

SEQ ID NO: 3246081 - protein, 95 aa, Plasmodium falciparum
RYFPNSDKNDYRDDDIKENYSDHDIDDDIKENHSDHDIDDDIKENHSDHDIDDDIKENHSDHDIDDDNDDNNDDDNDDDMSISDDNIDDDDDKCS

SEQ ID NO: 3246082 - protein, 18 aa, Plasmodium falciparum
RYGGRSNIKNDTKESLKQ

SEQ ID NO: 3246083 - protein, 5 aa, Plasmodium falciparum
RYGGT

SEQ ID NO: 3246084 - protein, 7 aa, Plasmodium falciparum
RYGYGSD

SEQ ID NO: 3246085 - protein, 7 aa, Plasmodium falciparum
RYGYQSY

SEQ ID NO: 3246086 - protein, 13 aa, Plasmodium falciparum
RYITPQTRTTTSR

SEQ ID NO: 3246087 - protein, 4 aa, Plasmodium falciparum
RYKE

SEQ ID NO: 3246088 - protein, 4 aa, Plasmodium falciparum
RYKQ

SEQ ID NO: 3246089 - protein, 15 aa, Plasmodium falciparum
RYKQDYTTDWDNPDF

SEQ ID NO: 3246090 - protein, 26 aa, Plasmodium falciparum
RYNDSDDSVDEKDKKRKKRNLENEKS

SEQ ID NO: 3246091 - protein, 13 aa, Plasmodium falciparum
RYNESNNNCSETS

SEQ ID NO: 3246092 - protein, 7 aa, Plasmodium falciparum
RYNGNNE

SEQ ID NO: 3246093 - protein, 9 aa, Plasmodium falciparum
RYNKKEEFN

SEQ ID NO: 3246094 - protein, 44 aa, Plasmodium falciparum
RYNKNKENANIQENNNNNNNNKNYSADNKNNNCNNNYNNNDVRS

SEQ ID NO: 3246095 - protein, 22 aa, Plasmodium falciparum
RYNNNDKCNNDKCNNDKSNNDI

SEQ ID NO: 3246096 - protein, 23 aa, Plasmodium falciparum
RYNNNNNNNNNNNCNNKDEGINY

SEQ ID NO: 3246097 - protein, 5 aa, Plasmodium falciparum
RYNPK

SEQ ID NO: 3246098 - protein, 4 aa, Plasmodium falciparum
RYPN

SEQ ID NO: 3246099 - protein, 6 aa, Plasmodium falciparum
RYPNAN

SEQ ID NO: 3246100 - protein, 6 aa, Plasmodium falciparum
RYPNNN

SEQ ID NO: 3246101 - protein, 8 aa, Plasmodium falciparum
RYPPESYD

SEQ ID NO: 3246102 - protein, 20 aa, Plasmodium falciparum
RYPSSSLSNYDESTSCASTS

SEQ ID NO: 3246103 - protein, 7 aa, Plasmodium falciparum
RYTDNKR

SEQ ID NO: 3246104 - protein, 33 aa, Plasmodium falciparum
RYTNNKNNSDYDNYNNNNNMKNKRYSNKKHNND

SEQ ID NO: 3246105 - protein, 11 aa, Plasmodium falciparum
RYTQENECNEI

SEQ ID NO: 3246106 - protein, 4 aa, Plasmodium falciparum
RYTT

SEQ ID NO: 3246107 - protein, 13 aa, Plasmodium falciparum
RYVPYSSGKYRGK

SEQ ID NO: 3246108 - protein, 11 aa, Plasmodium falciparum
RYYQDEEGNFN

SEQ ID NO: 3246109 - protein, 11 aa, Plasmodium falciparum
SAASTPEQETQ

SEQ ID NO: 3246110 - protein, 7 aa, Plasmodium falciparum
SADDSED

SEQ ID NO: 3246111 - protein, 8 aa, Plasmodium falciparum
SADKGNTY

SEQ ID NO: 3246112 - protein, 10 aa, Plasmodium falciparum
SADKLDNSKD

SEQ ID NO: 3246113 - protein, 7 aa, Plasmodium falciparum
SADLTGN

SEQ ID NO: 3246114 - protein, 15 aa, Plasmodium falciparum
SADNNNNKKKKKNYL

SEQ ID NO: 3246115 - protein, 5 aa, Plasmodium falciparum
SADRG

SEQ ID NO: 3246116 - protein, 8 aa, Plasmodium falciparum
SADVNNSK

SEQ ID NO: 3246117 - protein, 4 aa, Plasmodium falciparum
SAEF

SEQ ID NO: 3246118 - protein, 19 aa, Plasmodium falciparum
SAEGTVSKEFKNQPKTEYE

SEQ ID NO: 3246119 - protein, 9 aa, Plasmodium falciparum
SAEKENDEI

SEQ ID NO: 3246120 - protein, 10 aa, Plasmodium falciparum
SAEKSVIKSS

SEQ ID NO: 3246121 - protein, 33 aa, Plasmodium falciparum
SAENCNKEKKKKKKKKKKELNNDNKDNTLNNET

SEQ ID NO: 3246122 - protein, 5 aa, Plasmodium falciparum
SAEYM

SEQ ID NO: 3246123 - protein, 8 aa, Plasmodium falciparum
SAFNPRGT

SEQ ID NO: 3246124 - protein, 11 aa, Plasmodium falciparum
SAGQKNSVGSK

SEQ ID NO: 3246125 - protein, 7 aa, Plasmodium falciparum
SAGQRGR

SEQ ID NO: 3246126 - protein, 11 aa, Plasmodium falciparum
SAHSPNGKDDA

SEQ ID NO: 3246127 - protein, 9 aa, Plasmodium falciparum
SAHTGDSRA

SEQ ID NO: 3246128 - protein, 8 aa, Plasmodium falciparum
SAINNPQE

SEQ ID NO: 3246129 - protein, 12 aa, Plasmodium falciparum
SAISTNGNEEDA

SEQ ID NO: 3246130 - protein, 13 aa, Plasmodium falciparum
SAKAAAKTAEAAN

SEQ ID NO: 3246131 - protein, 14 aa, Plasmodium falciparum
SAKAAAKTAEVAEK

SEQ ID NO: 3246132 - protein, 6 aa, Plasmodium falciparum
SAKDAK

SEQ ID NO: 3246133 - protein, 7 aa, Plasmodium falciparum
SAKDAKE

SEQ ID NO: 3246134 - protein, 7 aa, Plasmodium falciparum
SAKDDNI

SEQ ID NO: 3246135 - protein, 8 aa, Plasmodium falciparum
SAKDKDDI

SEQ ID NO: 3246136 - protein, 5 aa, Plasmodium falciparum
SAKEV

SEQ ID NO: 3246137 - protein, 8 aa, Plasmodium falciparum
SAKGFDDG

SEQ ID NO: 3246138 - protein, 7 aa, Plasmodium falciparum
SAKKNRH

SEQ ID NO: 3246139 - protein, 13 aa, Plasmodium falciparum
SAKNYFSTIKKWL

SEQ ID NO: 3246140 - protein, 44 aa, Plasmodium falciparum
SAKTELKGKMKNKENNNKADKKKKKKKQKEDEKNKTKGKKMEEH

SEQ ID NO: 3246141 - protein, 14 aa, Plasmodium falciparum
SAKTNSENNKNEDA

SEQ ID NO: 3246142 - protein, 15 aa, Plasmodium falciparum
SAKTPDGDLEQAKEN

SEQ ID NO: 3246143 - protein, 7 aa, Plasmodium falciparum
SAKTPEC

SEQ ID NO: 3246144 - protein, 11 aa, Plasmodium falciparum
SALNDDSESCR

SEQ ID NO: 3246145 - protein, 9 aa, Plasmodium falciparum
SANEKKRRK

SEQ ID NO: 3246146 - protein, 8 aa, Plasmodium falciparum
SANENTNT

SEQ ID NO: 3246147 - protein, 14 aa, Plasmodium falciparum
SANYSSSNYPSSKM

SEQ ID NO: 3246148 - protein, 7 aa, Plasmodium falciparum
SAPCGAC

SEQ ID NO: 3246149 - protein, 6 aa, Plasmodium falciparum
SAPDAK

SEQ ID NO: 3246150 - protein, 7 aa, Plasmodium falciparum
SAPFKNK

SEQ ID NO: 3246151 - protein, 5 aa, Plasmodium falciparum
SAPKT

SEQ ID NO: 3246152 - protein, 4 aa, Plasmodium falciparum
SAPL

SEQ ID NO: 3246153 - protein, 15 aa, Plasmodium falciparum
SAPSKKNGKKNKKNK

SEQ ID NO: 3246154 - protein, 18 aa, Plasmodium falciparum
SAPVSRSEGQSKESKRVE

SEQ ID NO: 3246155 - protein, 5 aa, Plasmodium falciparum
SAPVY

SEQ ID NO: 3246156 - protein, 5 aa, Plasmodium falciparum
SAQEN

SEQ ID NO: 3246157 - protein, 7 aa, Plasmodium falciparum
SAQHEHE

SEQ ID NO: 3246158 - protein, 4 aa, Plasmodium falciparum
SAQK

SEQ ID NO: 3246159 - protein, 11 aa, Plasmodium falciparum
SAQKDNQCTGY

SEQ ID NO: 3246160 - protein, 8 aa, Plasmodium falciparum
SAQKTGVL

SEQ ID NO: 3246161 - protein, 8 aa, Plasmodium falciparum
SAQNGGYL

SEQ ID NO: 3246162 - protein, 6 aa, Plasmodium falciparum
SAQSNI

SEQ ID NO: 3246163 - protein, 19 aa, Plasmodium falciparum
SARDKETVQKTLTNNPSYK

SEQ ID NO: 3246164 - protein, 13 aa, Plasmodium falciparum
SARLNNKSVNSKN

SEQ ID NO: 3246165 - protein, 13 aa, Plasmodium falciparum
SARTMKRGYKNDN

SEQ ID NO: 3246166 - protein, 5 aa, Plasmodium falciparum
SASAQ

SEQ ID NO: 3246167 - protein, 13 aa, Plasmodium falciparum
SASDEYEQYELNK

SEQ ID NO: 3246168 - protein, 19 aa, Plasmodium falciparum
SASDLPGATSSWFNQKIHT

SEQ ID NO: 3246169 - protein, 14 aa, Plasmodium falciparum
SASKHKKKNTKAGL

SEQ ID NO: 3246170 - protein, 4 aa, Plasmodium falciparum
SASN

SEQ ID NO: 3246171 - protein, 15 aa, Plasmodium falciparum
SASQNDNSFENKGNK

SEQ ID NO: 3246172 - protein, 5 aa, Plasmodium falciparum
SASSG

SEQ ID NO: 3246173 - protein, 6 aa, Plasmodium falciparum
SASSGS

SEQ ID NO: 3246174 - protein, 15 aa, Plasmodium falciparum
SASTGYKSVSNTISK

SEQ ID NO: 3246175 - protein, 9 aa, Plasmodium falciparum
SASTTDPCG

SEQ ID NO: 3246176 - protein, 18 aa, Plasmodium falciparum
SASYNSNEINNMNEDSKL

SEQ ID NO: 3246177 - protein, 6 aa, Plasmodium falciparum
SATATA

SEQ ID NO: 3246178 - protein, 14 aa, Plasmodium falciparum
SATGFKGDGLEEAC

SEQ ID NO: 3246179 - protein, 5 aa, Plasmodium falciparum
SATME

SEQ ID NO: 3246180 - protein, 7 aa, Plasmodium falciparum
SATPSKA

SEQ ID NO: 3246181 - protein, 9 aa, Plasmodium falciparum
SATSSISAF

SEQ ID NO: 3246182 - protein, 23 aa, Plasmodium falciparum
SATSSNGFSNNSITNNINQNKNI

SEQ ID NO: 3246183 - protein, 13 aa, Plasmodium falciparum
SATTTAASTSSNI

SEQ ID NO: 3246184 - protein, 8 aa, Plasmodium falciparum
SAVAPAGA

SEQ ID NO: 3246185 - protein, 6 aa, Plasmodium falciparum
SAVPSA

SEQ ID NO: 3246186 - protein, 9 aa, Plasmodium falciparum
SAVSQPRQY

SEQ ID NO: 3246187 - protein, 4 aa, Plasmodium falciparum
SAVT

SEQ ID NO: 3246188 - protein, 13 aa, Plasmodium falciparum
SAYANNGKDVNKM

SEQ ID NO: 3246189 - protein, 6 aa, Plasmodium falciparum
SAYNDL

SEQ ID NO: 3246190 - protein, 11 aa, Plasmodium falciparum
SAYNNDDQHDN

SEQ ID NO: 3246191 - protein, 7 aa, Plasmodium falciparum
SAYQNEG

SEQ ID NO: 3246192 - protein, 6 aa, Plasmodium falciparum
SAYTPP

SEQ ID NO: 3246193 - protein, 6 aa, Plasmodium falciparum
SCATPC

SEQ ID NO: 3246194 - protein, 19 aa, Plasmodium falciparum
SCCTTPKKSNDSKENISYE

SEQ ID NO: 3246195 - protein, 11 aa, Plasmodium falciparum
SCDDKESKRNI

SEQ ID NO: 3246196 - protein, 7 aa, Plasmodium falciparum
SCDKDDH

SEQ ID NO: 3246197 - protein, 10 aa, Plasmodium falciparum
SCDNKGNERF

SEQ ID NO: 3246198 - protein, 5 aa, Plasmodium falciparum
SCDNN

SEQ ID NO: 3246199 - protein, 6 aa, Plasmodium falciparum
SCDQRR

SEQ ID NO: 3246200 - protein, 14 aa, Plasmodium falciparum
SCDSGEGNYYNDES

SEQ ID NO: 3246201 - protein, 7 aa, Plasmodium falciparum
SCDTTTV

SEQ ID NO: 3246202 - protein, 50 aa, Plasmodium falciparum
SCDTYNDEYNDTYNDTYNDTYNDTYNDTHNDTHNDTHNDTYNDEYNDTYN

SEQ ID NO: 3246203 - protein, 19 aa, Plasmodium falciparum
SCEEKNNTKSNSYNNYNNY

SEQ ID NO: 3246204 - protein, 29 aa, Plasmodium falciparum
SCGARGHNINSNENVNQNDLNNNSNYNYN

SEQ ID NO: 3246205 - protein, 11 aa, Plasmodium falciparum
SCKDSSETIDS

SEQ ID NO: 3246206 - protein, 4 aa, Plasmodium falciparum
SCKE

SEQ ID NO: 3246207 - protein, 10 aa, Plasmodium falciparum
SCKEKEQNMK

SEQ ID NO: 3246208 - protein, 18 aa, Plasmodium falciparum
SCKESGGTCNGECKTECK

SEQ ID NO: 3246209 - protein, 13 aa, Plasmodium falciparum
SCKGKQKCTEGDV

SEQ ID NO: 3246210 - protein, 20 aa, Plasmodium falciparum
SCKKKGKEKCTQGDNDCTPC

SEQ ID NO: 3246211 - protein, 4 aa, Plasmodium falciparum
SCKN

SEQ ID NO: 3246212 - protein, 24 aa, Plasmodium falciparum
SCKPQKKKCPLKNSTTQTKESFSQ

SEQ ID NO: 3246213 - protein, 9 aa, Plasmodium falciparum
SCKQGCKGN

SEQ ID NO: 3246214 - protein, 29 aa, Plasmodium falciparum
SCKSSKAIEQERRAKEKLQEQQSDLEQER

SEQ ID NO: 3246215 - protein, 12 aa, Plasmodium falciparum
SCNAPTGESCRE

SEQ ID NO: 3246216 - protein, 32 aa, Plasmodium falciparum
SCNATTTTTTNNNNNNNNNNNNNNNSSSSSSY

SEQ ID NO: 3246217 - protein, 29 aa, Plasmodium falciparum
SCNLKEEEKKKTSKGVTEKSVVGNKGNDI

SEQ ID NO: 3246218 - protein, 5 aa, Plasmodium falciparum
SCNNE

SEQ ID NO: 3246219 - protein, 5 aa, Plasmodium falciparum
SCNSR

SEQ ID NO: 3246220 - protein, 19 aa, Plasmodium falciparum
SCNTRDKKSEAPVTKKEEA

SEQ ID NO: 3246221 - protein, 6 aa, Plasmodium falciparum
SCPLEN

SEQ ID NO: 3246222 - protein, 12 aa, Plasmodium falciparum
SCQNNSNISTNN

SEQ ID NO: 3246223 - protein, 10 aa, Plasmodium falciparum
SCSGNGFEKN

SEQ ID NO: 3246224 - protein, 4 aa, Plasmodium falciparum
SCSM

SEQ ID NO: 3246225 - protein, 4 aa, Plasmodium falciparum
SCSN

SEQ ID NO: 3246226 - protein, 18 aa, Plasmodium falciparum
SCSNNNLKKKKKKKEIHT

SEQ ID NO: 3246227 - protein, 17 aa, Plasmodium falciparum
SCSSENVSSDNHMDDSD

SEQ ID NO: 3246228 - protein, 4 aa, Plasmodium falciparum
SCTD

SEQ ID NO: 3246229 - protein, 5 aa, Plasmodium falciparum
SCTHS

SEQ ID NO: 3246230 - protein, 5 aa, Plasmodium falciparum
SCTSG

SEQ ID NO: 3246231 - protein, 4 aa, Plasmodium falciparum
SCYS

SEQ ID NO: 3246232 - protein, 14 aa, Plasmodium falciparum
SDAAPKIPGKVSST

SEQ ID NO: 3246233 - protein, 8 aa, Plasmodium falciparum
SDADEEGY

SEQ ID NO: 3246234 - protein, 19 aa, Plasmodium falciparum
SDAEPVATAAAQQATEEAI

SEQ ID NO: 3246235 - protein, 7 aa, Plasmodium falciparum
SDAKTIR

SEQ ID NO: 3246236 - protein, 16 aa, Plasmodium falciparum
SDANNPSEKIQKNNDE

SEQ ID NO: 3246237 - protein, 15 aa, Plasmodium falciparum
SDAPKAAETAVETAT

SEQ ID NO: 3246238 - protein, 5 aa, Plasmodium falciparum
SDAQT

SEQ ID NO: 3246239 - protein, 5 aa, Plasmodium falciparum
SDAST

SEQ ID NO: 3246240 - protein, 6 aa, Plasmodium falciparum
SDCSSD

SEQ ID NO: 3246241 - protein, 7 aa, Plasmodium falciparum
SDDAGTG

SEQ ID NO: 3246242 - protein, 20 aa, Plasmodium falciparum
SDDAYSSSYDYNKRQKKKHV

SEQ ID NO: 3246243 - protein, 10 aa, Plasmodium falciparum
SDDCSSSISE

SEQ ID NO: 3246244 - protein, 7 aa, Plasmodium falciparum
SDDDAKN

SEQ ID NO: 3246245 - protein, 26 aa, Plasmodium falciparum
SDDDECKKENKDNISESSKRSNNIGE

SEQ ID NO: 3246246 - protein, 10 aa, Plasmodium falciparum
SDDDHHNSDH

SEQ ID NO: 3246247 - protein, 22 aa, Plasmodium falciparum
SDDDKETKDDANEKYNKGDYEG

SEQ ID NO: 3246248 - protein, 49 aa, Plasmodium falciparum
SDDDMDKKRVPEQNDVDNKNDIKRDNNNNYSNDNNYSNNNNNNNNNNNI

SEQ ID NO: 3246249 - protein, 33 aa, Plasmodium falciparum
SDDDNRDTCNKEGKKDNNSNKYYNDDKNGGTYC

SEQ ID NO: 3246250 - protein, 14 aa, Plasmodium falciparum
SDDDTSEHMFVYAT

SEQ ID NO: 3246251 - protein, 11 aa, Plasmodium falciparum
SDDEKYEDTNN

SEQ ID NO: 3246252 - protein, 45 aa, Plasmodium falciparum
SDDENPKKKQKGEKNEKYNNNNNNKTNGIYDKEEKEEQKKVQERK

SEQ ID NO: 3246253 - protein, 16 aa, Plasmodium falciparum
SDDETQKNIKNKKNKE

SEQ ID NO: 3246254 - protein, 4 aa, Plasmodium falciparum
SDDI

SEQ ID NO: 3246255 - protein, 15 aa, Plasmodium falciparum
SDDINDSIDEKPKED

SEQ ID NO: 3246256 - protein, 13 aa, Plasmodium falciparum
SDDINNNRNDKNI

SEQ ID NO: 3246257 - protein, 4 aa, Plasmodium falciparum
SDDK

SEQ ID NO: 3246258 - protein, 25 aa, Plasmodium falciparum
SDDKKDALKKNSAEVEESSSKNNVT

SEQ ID NO: 3246259 - protein, 6 aa, Plasmodium falciparum
SDDKTA

SEQ ID NO: 3246260 - protein, 4 aa, Plasmodium falciparum
SDDL

SEQ ID NO: 3246261 - protein, 4 aa, Plasmodium falciparum
SDDM

SEQ ID NO: 3246262 - protein, 8 aa, Plasmodium falciparum
SDDNEEKM

SEQ ID NO: 3246263 - protein, 14 aa, Plasmodium falciparum
SDDNKKKEKKRNIK

SEQ ID NO: 3246264 - protein, 9 aa, Plasmodium falciparum
SDDNNALNE

SEQ ID NO: 3246265 - protein, 16 aa, Plasmodium falciparum
SDDNSTHNEGNEDYIS

SEQ ID NO: 3246266 - protein, 7 aa, Plasmodium falciparum
SDDRKYK

SEQ ID NO: 3246267 - protein, 9 aa, Plasmodium falciparum
SDDSDEDVK

SEQ ID NO: 3246268 - protein, 13 aa, Plasmodium falciparum
SDDSKSGSGFDGL

SEQ ID NO: 3246269 - protein, 12 aa, Plasmodium falciparum
SDDSQNDEEKVS

SEQ ID NO: 3246270 - protein, 18 aa, Plasmodium falciparum
SDDSTKSSNSSKSSHKNK

SEQ ID NO: 3246271 - protein, 6 aa, Plasmodium falciparum
SDDSYA

SEQ ID NO: 3246272 - protein, 6 aa, Plasmodium falciparum
SDDTIT

SEQ ID NO: 3246273 - protein, 22 aa, Plasmodium falciparum
SDDVNEENGKKKVEEKQGIEKS

SEQ ID NO: 3246274 - protein, 5 aa, Plasmodium falciparum
SDDVR

SEQ ID NO: 3246275 - protein, 23 aa, Plasmodium falciparum
SDDYEDGEDEEEESDDRNDDNKY

SEQ ID NO: 3246276 - protein, 75 aa, Plasmodium falciparum
SDDYYSDDYDEEDGSSVEKNSSREKSEEYKRGDNNKDDSSYDHSPYDHSSYDHSSYDHSSYDHSSYDDSSYDVSS

SEQ ID NO: 3246277 - protein, 29 aa, Plasmodium falciparum
SDEAAQPKFSDNERDRNSITHEDKNCKEK

SEQ ID NO: 3246278 - protein, 5 aa, Plasmodium falciparum
SDEAQ

SEQ ID NO: 3246279 - protein, 23 aa, Plasmodium falciparum
SDECESYKSEDDDSEEEYYNSTP

SEQ ID NO: 3246280 - protein, 4 aa, Plasmodium falciparum
SDED

SEQ ID NO: 3246281 - protein, 7 aa, Plasmodium falciparum
SDEDESV

SEQ ID NO: 3246282 - protein, 18 aa, Plasmodium falciparum
SDEEEEKQEEKENSQNDT

SEQ ID NO: 3246283 - protein, 7 aa, Plasmodium falciparum
SDEEIND

SEQ ID NO: 3246284 - protein, 8 aa, Plasmodium falciparum
SDEEKRKN

SEQ ID NO: 3246285 - protein, 5 aa, Plasmodium falciparum
SDEFH

SEQ ID NO: 3246286 - protein, 32 aa, Plasmodium falciparum
SDEGDGYQADEDIGGEDDAEDVDGEGDDEDDN

SEQ ID NO: 3246287 - protein, 7 aa, Plasmodium falciparum
SDEGNNY

SEQ ID NO: 3246288 - protein, 9 aa, Plasmodium falciparum
SDEHSDEYS

SEQ ID NO: 3246289 - protein, 9 aa, Plasmodium falciparum
SDEIDHTDN

SEQ ID NO: 3246290 - protein, 6 aa, Plasmodium falciparum
SDEIDK

SEQ ID NO: 3246291 - protein, 5 aa, Plasmodium falciparum
SDEIN

SEQ ID NO: 3246292 - protein, 6 aa, Plasmodium falciparum
SDEKHS

SEQ ID NO: 3246293 - protein, 17 aa, Plasmodium falciparum
SDEKNMEDYKNNKDMNK

SEQ ID NO: 3246294 - protein, 13 aa, Plasmodium falciparum
SDELNSVTKQKNK

SEQ ID NO: 3246295 - protein, 14 aa, Plasmodium falciparum
SDEMSGKQKSIQKD

SEQ ID NO: 3246296 - protein, 4 aa, Plasmodium falciparum
SDEN

SEQ ID NO: 3246297 - protein, 13 aa, Plasmodium falciparum
SDENGSKDHSNGL

SEQ ID NO: 3246298 - protein, 5 aa, Plasmodium falciparum
SDENH

SEQ ID NO: 3246299 - protein, 16 aa, Plasmodium falciparum
SDENTSGEEKKNSSQE

SEQ ID NO: 3246300 - protein, 5 aa, Plasmodium falciparum
SDENY

SEQ ID NO: 3246301 - protein, 7 aa, Plasmodium falciparum
SDENYDE

SEQ ID NO: 3246302 - protein, 16 aa, Plasmodium falciparum
SDENYSDDIQNNNSLN

SEQ ID NO: 3246303 - protein, 4 aa, Plasmodium falciparum
SDEQ

SEQ ID NO: 3246304 - protein, 16 aa, Plasmodium falciparum
SDEQDEQDKKNMKKNM

SEQ ID NO: 3246305 - protein, 5 aa, Plasmodium falciparum
SDEQQ

SEQ ID NO: 3246306 - protein, 5 aa, Plasmodium falciparum
SDEQR

SEQ ID NO: 3246307 - protein, 7 aa, Plasmodium falciparum
SDEQRIR

SEQ ID NO: 3246308 - protein, 10 aa, Plasmodium falciparum
SDEQRKKEKH

SEQ ID NO: 3246309 - protein, 4 aa, Plasmodium falciparum
SDER

SEQ ID NO: 3246310 - protein, 10 aa, Plasmodium falciparum
SDERDKNGII

SEQ ID NO: 3246311 - protein, 23 aa, Plasmodium falciparum
SDERGGAQANDKCRCPNGNNQVP

SEQ ID NO: 3246312 - protein, 16 aa, Plasmodium falciparum
SDERNSSPGPCSREER

SEQ ID NO: 3246313 - protein, 9 aa, Plasmodium falciparum
SDESDTYNC

SEQ ID NO: 3246314 - protein, 7 aa, Plasmodium falciparum
SDESNAS

SEQ ID NO: 3246315 - protein, 9 aa, Plasmodium falciparum
SDESTDYDK

SEQ ID NO: 3246316 - protein, 10 aa, Plasmodium falciparum
SDETYEKNGN

SEQ ID NO: 3246317 - protein, 4 aa, Plasmodium falciparum
SDEY

SEQ ID NO: 3246318 - protein, 5 aa, Plasmodium falciparum
SDEYN

SEQ ID NO: 3246319 - protein, 6 aa, Plasmodium falciparum
SDEYNG

SEQ ID NO: 3246320 - protein, 17 aa, Plasmodium falciparum
SDEYSNKNYNNSNTSCN

SEQ ID NO: 3246321 - protein, 24 aa, Plasmodium falciparum
SDEYSSSIYSETEDEDKNEDDVHK

SEQ ID NO: 3246322 - protein, 21 aa, Plasmodium falciparum
SDFSQDEKYNSYSDSQSTISD

SEQ ID NO: 3246323 - protein, 9 aa, Plasmodium falciparum
SDGGRKRSN

SEQ ID NO: 3246324 - protein, 4 aa, Plasmodium falciparum
SDGI

SEQ ID NO: 3246325 - protein, 7 aa, Plasmodium falciparum
SDGKIDR

SEQ ID NO: 3246326 - protein, 9 aa, Plasmodium falciparum
SDGKKMSKR

SEQ ID NO: 3246327 - protein, 5 aa, Plasmodium falciparum
SDGNI

SEQ ID NO: 3246328 - protein, 5 aa, Plasmodium falciparum
SDGNK

SEQ ID NO: 3246329 - protein, 6 aa, Plasmodium falciparum
SDGSNS

SEQ ID NO: 3246330 - protein, 5 aa, Plasmodium falciparum
SDGTM

SEQ ID NO: 3246331 - protein, 34 aa, Plasmodium falciparum
SDHEKADHHHHNNKKKKKKKKKTKCKIKNNDSII

SEQ ID NO: 3246332 - protein, 9 aa, Plasmodium falciparum
SDHLNDSEQ

SEQ ID NO: 3246333 - protein, 4 aa, Plasmodium falciparum
SDHN

SEQ ID NO: 3246334 - protein, 9 aa, Plasmodium falciparum
SDHNQSPRN

SEQ ID NO: 3246335 - protein, 26 aa, Plasmodium falciparum
SDHSSTSSSFSTDREITTSSRYSTSS

SEQ ID NO: 3246336 - protein, 10 aa, Plasmodium falciparum
SDHSTKQNNV

SEQ ID NO: 3246337 - protein, 6 aa, Plasmodium falciparum
SDIEKN

SEQ ID NO: 3246338 - protein, 5 aa, Plasmodium falciparum
SDIET

SEQ ID NO: 3246339 - protein, 11 aa, Plasmodium falciparum
SDIGKGKDRQF

SEQ ID NO: 3246340 - protein, 5 aa, Plasmodium falciparum
SDIGN

SEQ ID NO: 3246341 - protein, 6 aa, Plasmodium falciparum
SDIHPN

SEQ ID NO: 3246342 - protein, 12 aa, Plasmodium falciparum
SDIISSSEREYE

SEQ ID NO: 3246343 - protein, 17 aa, Plasmodium falciparum
SDILNDDNKKTNKEKKG

SEQ ID NO: 3246344 - protein, 4 aa, Plasmodium falciparum
SDIN

SEQ ID NO: 3246345 - protein, 52 aa, Plasmodium falciparum
SDINNDNNNDINNNDNNNNENNNENINDNNNNNNNNNNNNNNNNSNNNNNNN

SEQ ID NO: 3246346 - protein, 13 aa, Plasmodium falciparum
SDIPGGENSDTSY

SEQ ID NO: 3246347 - protein, 17 aa, Plasmodium falciparum
SDIPNTPSDTPPPITDD

SEQ ID NO: 3246348 - protein, 8 aa, Plasmodium falciparum
SDIPSGKQ

SEQ ID NO: 3246349 - protein, 7 aa, Plasmodium falciparum
SDIPSTN

SEQ ID NO: 3246350 - protein, 21 aa, Plasmodium falciparum
SDISEKHPDNKKGDNTKNGYS

SEQ ID NO: 3246351 - protein, 9 aa, Plasmodium falciparum
SDISQPPMP

SEQ ID NO: 3246352 - protein, 12 aa, Plasmodium falciparum
SDITSSESEYEE

SEQ ID NO: 3246353 - protein, 7 aa, Plasmodium falciparum
SDKAKPT

SEQ ID NO: 3246354 - protein, 10 aa, Plasmodium falciparum
SDKDDSTSIR

SEQ ID NO: 3246355 - protein, 7 aa, Plasmodium falciparum
SDKDDTL

SEQ ID NO: 3246356 - protein, 10 aa, Plasmodium falciparum
SDKDKSSNNI

SEQ ID NO: 3246357 - protein, 9 aa, Plasmodium falciparum
SDKDNINNN

SEQ ID NO: 3246358 - protein, 23 aa, Plasmodium falciparum
SDKDSPNKNSSDNKEEKNKKMEE

SEQ ID NO: 3246359 - protein, 26 aa, Plasmodium falciparum
SDKEDDSPMDESINEPKGEVEQTNKT

SEQ ID NO: 3246360 - protein, 8 aa, Plasmodium falciparum
SDKEDETI

SEQ ID NO: 3246361 - protein, 7 aa, Plasmodium falciparum
SDKEGYQ

SEQ ID NO: 3246362 - protein, 8 aa, Plasmodium falciparum
SDKEHSFS

SEQ ID NO: 3246363 - protein, 40 aa, Plasmodium falciparum
SDKEKDEEKKLGESNKYSNIEQNNVNNNKLENNVDDVNND

SEQ ID NO: 3246364 - protein, 37 aa, Plasmodium falciparum
SDKENDRPMSSKRKRESKYKKVEKKKNSKEKCDKKIT

SEQ ID NO: 3246365 - protein, 10 aa, Plasmodium falciparum
SDKENIKDKD

SEQ ID NO: 3246366 - protein, 7 aa, Plasmodium falciparum
SDKEVSE

SEQ ID NO: 3246367 - protein, 7 aa, Plasmodium falciparum
SDKFPND

SEQ ID NO: 3246368 - protein, 29 aa, Plasmodium falciparum
SDKHNSNSKESNKNKQTNSGCTTRKNKNA

SEQ ID NO: 3246369 - protein, 6 aa, Plasmodium falciparum
SDKIKP

SEQ ID NO: 3246370 - protein, 8 aa, Plasmodium falciparum
SDKIQTQK

SEQ ID NO: 3246371 - protein, 4 aa, Plasmodium falciparum
SDKK

SEQ ID NO: 3246372 - protein, 10 aa, Plasmodium falciparum
SDKKDKYKYK

SEQ ID NO: 3246373 - protein, 18 aa, Plasmodium falciparum
SDKKEKKLNNNNNNNNMK

SEQ ID NO: 3246374 - protein, 9 aa, Plasmodium falciparum
SDKKKEPVF

SEQ ID NO: 3246375 - protein, 10 aa, Plasmodium falciparum
SDKKKSLNKD

SEQ ID NO: 3246376 - protein, 12 aa, Plasmodium falciparum
SDKKKTDIKREL

SEQ ID NO: 3246377 - protein, 7 aa, Plasmodium falciparum
SDKLKNN

SEQ ID NO: 3246378 - protein, 20 aa, Plasmodium falciparum
SDKNKELDEKEKKIKTYNGD

SEQ ID NO: 3246379 - protein, 16 aa, Plasmodium falciparum
SDKQSNNDKLNNDSSI

SEQ ID NO: 3246380 - protein, 6 aa, Plasmodium falciparum
SDKSAE

SEQ ID NO: 3246381 - protein, 7 aa, Plasmodium falciparum
SDKSNDN

SEQ ID NO: 3246382 - protein, 222 aa, Plasmodium falciparum
SDKSNNLSYRNKKSQSYSNEKKNKKSKTNDRDESSKKETKKKDNSSGPYSDLESDSDDEVDQDKDLDDDEKQDEEEQMDDNQREDRDDKDEEDDEENEKNDKEEGKEEDDEGDDDYDDDDYDDDDYDDDDYDDDDYDNDDYDDDDDDDNDDNDDDEGDNDDDEDDEDDDDDDDDDDDDDNDDDEDDNDDEDEDEDDDENDDEEDDDDDDEEEDTREETDDNI

SEQ ID NO: 3246383 - protein, 7 aa, Plasmodium falciparum
SDKSNNY

SEQ ID NO: 3246384 - protein, 7 aa, Plasmodium falciparum
SDKTIGK

SEQ ID NO: 3246385 - protein, 10 aa, Plasmodium falciparum
SDKTKKRNSL

SEQ ID NO: 3246386 - protein, 9 aa, Plasmodium falciparum
SDKYDSNLE

SEQ ID NO: 3246387 - protein, 5 aa, Plasmodium falciparum
SDLDG

SEQ ID NO: 3246388 - protein, 13 aa, Plasmodium falciparum
SDLEKPSCAKPCS

SEQ ID NO: 3246389 - protein, 4 aa, Plasmodium falciparum
SDLG

SEQ ID NO: 3246390 - protein, 14 aa, Plasmodium falciparum
SDLNKTKNKNEERS

SEQ ID NO: 3246391 - protein, 6 aa, Plasmodium falciparum
SDLNST

SEQ ID NO: 3246392 - protein, 7 aa, Plasmodium falciparum
SDLPQQK

SEQ ID NO: 3246393 - protein, 13 aa, Plasmodium falciparum
SDLQKQIDTHKNN

SEQ ID NO: 3246394 - protein, 8 aa, Plasmodium falciparum
SDLRTDEN

SEQ ID NO: 3246395 - protein, 4 aa, Plasmodium falciparum
SDME

SEQ ID NO: 3246396 - protein, 11 aa, Plasmodium falciparum
SDMEEVGNNND

SEQ ID NO: 3246397 - protein, 5 aa, Plasmodium falciparum
SDMET

SEQ ID NO: 3246398 - protein, 6 aa, Plasmodium falciparum
SDMGPN

SEQ ID NO: 3246399 - protein, 12 aa, Plasmodium falciparum
SDMPPKKKEKNI

SEQ ID NO: 3246400 - protein, 4 aa, Plasmodium falciparum
SDNA

SEQ ID NO: 3246401 - protein, 8 aa, Plasmodium falciparum
SDNDDESF

SEQ ID NO: 3246402 - protein, 12 aa, Plasmodium falciparum
SDNDVNSNTEYE

SEQ ID NO: 3246403 - protein, 110 aa, Plasmodium falciparum
SDNEHDENVEEKKQNDVKEVQSNDNKDKSVVTSKNEDNTEKNEDNVNITNDKKEDNVENLTEEKQNNVNVSTQDKEDNVEDLTEEKQNNIKDSTQEKEDNIKDSTQDIED

SEQ ID NO: 3246404 - protein, 5 aa, Plasmodium falciparum
SDNEK

SEQ ID NO: 3246405 - protein, 7 aa, Plasmodium falciparum
SDNEMKK

SEQ ID NO: 3246406 - protein, 20 aa, Plasmodium falciparum
SDNFSDSNSTSTSKNESNNY

SEQ ID NO: 3246407 - protein, 9 aa, Plasmodium falciparum
SDNGEKGFG

SEQ ID NO: 3246408 - protein, 5 aa, Plasmodium falciparum
SDNIE

SEQ ID NO: 3246409 - protein, 5 aa, Plasmodium falciparum
SDNII

SEQ ID NO: 3246410 - protein, 7 aa, Plasmodium falciparum
SDNIKNN

SEQ ID NO: 3246411 - protein, 18 aa, Plasmodium falciparum
SDNKHDNNNNDNNSDNNC

SEQ ID NO: 3246412 - protein, 16 aa, Plasmodium falciparum
SDNKKNDDIKNAISTR

SEQ ID NO: 3246413 - protein, 7 aa, Plasmodium falciparum
SDNKSND

SEQ ID NO: 3246414 - protein, 5 aa, Plasmodium falciparum
SDNKY

SEQ ID NO: 3246415 - protein, 12 aa, Plasmodium falciparum
SDNMNSDNINSD

SEQ ID NO: 3246416 - protein, 14 aa, Plasmodium falciparum
SDNMNSDNMNSDNI

SEQ ID NO: 3246417 - protein, 5 aa, Plasmodium falciparum
SDNMY

SEQ ID NO: 3246418 - protein, 5 aa, Plasmodium falciparum
SDNNF

SEQ ID NO: 3246419 - protein, 13 aa, Plasmodium falciparum
SDNNINKSDNNNN

SEQ ID NO: 3246420 - protein, 10 aa, Plasmodium falciparum
SDNNRGQHTS

SEQ ID NO: 3246421 - protein, 9 aa, Plasmodium falciparum
SDNNRTNNK

SEQ ID NO: 3246422 - protein, 8 aa, Plasmodium falciparum
SDNNVGKN

SEQ ID NO: 3246423 - protein, 8 aa, Plasmodium falciparum
SDNPNIVE

SEQ ID NO: 3246424 - protein, 14 aa, Plasmodium falciparum
SDNPSEKKHEPSES

SEQ ID NO: 3246425 - protein, 10 aa, Plasmodium falciparum
SDNRNGPDLE

SEQ ID NO: 3246426 - protein, 26 aa, Plasmodium falciparum
SDNSNNLYEENRRNYDDHNKKRESIC

SEQ ID NO: 3246427 - protein, 8 aa, Plasmodium falciparum
SDNSSRDK

SEQ ID NO: 3246428 - protein, 9 aa, Plasmodium falciparum
SDNSTITCS

SEQ ID NO: 3246429 - protein, 9 aa, Plasmodium falciparum
SDNSTSYDK

SEQ ID NO: 3246430 - protein, 22 aa, Plasmodium falciparum
SDNSYEDEDEEYINDKNGTDDI

SEQ ID NO: 3246431 - protein, 9 aa, Plasmodium falciparum
SDNSYSYDN

SEQ ID NO: 3246432 - protein, 8 aa, Plasmodium falciparum
SDNTHTKG

SEQ ID NO: 3246433 - protein, 5 aa, Plasmodium falciparum
SDNTI

SEQ ID NO: 3246434 - protein, 23 aa, Plasmodium falciparum
SDNTKNLEDTHNYNNRDYKNTRS

SEQ ID NO: 3246435 - protein, 6 aa, Plasmodium falciparum
SDNTPN

SEQ ID NO: 3246436 - protein, 64 aa, Plasmodium falciparum
SDNYDQKKKNKYNPSEYNNKRNNNTYNNLSKRRSSTHMNSSPRTHEKDENIRKNTQKKKVESFD

SEQ ID NO: 3246437 - protein, 6 aa, Plasmodium falciparum
SDNYKT

SEQ ID NO: 3246438 - protein, 6 aa, Plasmodium falciparum
SDPGYN

SEQ ID NO: 3246439 - protein, 8 aa, Plasmodium falciparum
SDPIGPAE

SEQ ID NO: 3246440 - protein, 5 aa, Plasmodium falciparum
SDPLD

SEQ ID NO: 3246441 - protein, 7 aa, Plasmodium falciparum
SDPSKDE

SEQ ID NO: 3246442 - protein, 6 aa, Plasmodium falciparum
SDPSYD

SEQ ID NO: 3246443 - protein, 6 aa, Plasmodium falciparum
SDQDEL

SEQ ID NO: 3246444 - protein, 7 aa, Plasmodium falciparum
SDQPKYS

SEQ ID NO: 3246445 - protein, 6 aa, Plasmodium falciparum
SDQRFN

SEQ ID NO: 3246446 - protein, 4 aa, Plasmodium falciparum
SDQS

SEQ ID NO: 3246447 - protein, 9 aa, Plasmodium falciparum
SDQSKHLET

SEQ ID NO: 3246448 - protein, 8 aa, Plasmodium falciparum
SDQVEDNK

SEQ ID NO: 3246449 - protein, 11 aa, Plasmodium falciparum
SDQYKNNESKL

SEQ ID NO: 3246450 - protein, 7 aa, Plasmodium falciparum
SDQYPIK

SEQ ID NO: 3246451 - protein, 7 aa, Plasmodium falciparum
SDRHKGK

SEQ ID NO: 3246452 - protein, 8 aa, Plasmodium falciparum
SDRNTVGQ

SEQ ID NO: 3246453 - protein, 5 aa, Plasmodium falciparum
SDRQS

SEQ ID NO: 3246454 - protein, 4 aa, Plasmodium falciparum
SDRS

SEQ ID NO: 3246455 - protein, 40 aa, Plasmodium falciparum
  misc_feature (27)..(27): Xaa can be any naturally occurring amino acid
SDSDSEDNNNNDIENYEPEKYVYMENXIRMNILTDEGLTE

SEQ ID NO: 3246456 - protein, 17 aa, Plasmodium falciparum
SDSEETKKNEEENDITQ

SEQ ID NO: 3246457 - protein, 30 aa, Plasmodium falciparum
SDSHRSGTFSQAKDKCRCKDENGKNETDQV

SEQ ID NO: 3246458 - protein, 9 aa, Plasmodium falciparum
SDSIPSTEC

SEQ ID NO: 3246459 - protein, 6 aa, Plasmodium falciparum
SDSKKK

SEQ ID NO: 3246460 - protein, 5 aa, Plasmodium falciparum
SDSLE

SEQ ID NO: 3246461 - protein, 12 aa, Plasmodium falciparum
SDSLNEDDNMGS

SEQ ID NO: 3246462 - protein, 7 aa, Plasmodium falciparum
SDSLNSD

SEQ ID NO: 3246463 - protein, 15 aa, Plasmodium falciparum
SDSLTDEKKNDSNKK

SEQ ID NO: 3246464 - protein, 14 aa, Plasmodium falciparum
SDSMDYTNKEYDDA

SEQ ID NO: 3246465 - protein, 7 aa, Plasmodium falciparum
SDSNDTF

SEQ ID NO: 3246466 - protein, 10 aa, Plasmodium falciparum
SDSNENNNNN

SEQ ID NO: 3246467 - protein, 5 aa, Plasmodium falciparum
SDSNI

SEQ ID NO: 3246468 - protein, 12 aa, Plasmodium falciparum
SDSNKSANDNDT

SEQ ID NO: 3246469 - protein, 6 aa, Plasmodium falciparum
SDSNNR

SEQ ID NO: 3246470 - protein, 9 aa, Plasmodium falciparum
SDSNQKCKR

SEQ ID NO: 3246471 - protein, 14 aa, Plasmodium falciparum
SDSRGNNLTKEDEE

SEQ ID NO: 3246472 - protein, 4 aa, Plasmodium falciparum
SDSS

SEQ ID NO: 3246473 - protein, 8 aa, Plasmodium falciparum
SDSSIKDE

SEQ ID NO: 3246474 - protein, 10 aa, Plasmodium falciparum
SDSSNDMDEQ

SEQ ID NO: 3246475 - protein, 23 aa, Plasmodium falciparum
SDSSNDMKHKNNNNNNNNKSHTK

SEQ ID NO: 3246476 - protein, 22 aa, Plasmodium falciparum
SDSSNNDSECSDIPYSDDSDIS

SEQ ID NO: 3246477 - protein, 25 aa, Plasmodium falciparum
SDSSNNNNSSCYSASSYNSSINSNY

SEQ ID NO: 3246478 - protein, 11 aa, Plasmodium falciparum
SDSSNSNNYYN

SEQ ID NO: 3246479 - protein, 18 aa, Plasmodium falciparum
SDSSTQEQKKNKTNKKNY

SEQ ID NO: 3246480 - protein, 10 aa, Plasmodium falciparum
SDSSYKTYNT

SEQ ID NO: 3246481 - protein, 58 aa, Plasmodium falciparum
SDSTHVPDEDNEAQDEEDEKQEIEDDEEEKEDDEEEKEEETTSQPKDVDDNGPNDPFY

SEQ ID NO: 3246482 - protein, 7 aa, Plasmodium falciparum
SDSTSAL

SEQ ID NO: 3246483 - protein, 14 aa, Plasmodium falciparum
SDSTSYDDGSNNED

SEQ ID NO: 3246484 - protein, 12 aa, Plasmodium falciparum
SDSYEKNNFSNE

SEQ ID NO: 3246485 - protein, 13 aa, Plasmodium falciparum
SDSYNNNNNVKTN

SEQ ID NO: 3246486 - protein, 12 aa, Plasmodium falciparum
SDTCGPKNNWKK

SEQ ID NO: 3246487 - protein, 22 aa, Plasmodium falciparum
SDTEGAQCDKKKIKDNSEGACA

SEQ ID NO: 3246488 - protein, 28 aa, Plasmodium falciparum
SDTEGAQCDKSKIKDNKGKSEGACAPYR

SEQ ID NO: 3246489 - protein, 5 aa, Plasmodium falciparum
SDTES

SEQ ID NO: 3246490 - protein, 8 aa, Plasmodium falciparum
SDTKYDPH

SEQ ID NO: 3246491 - protein, 4 aa, Plasmodium falciparum
SDTN

SEQ ID NO: 3246492 - protein, 10 aa, Plasmodium falciparum
SDTNKNEELG

SEQ ID NO: 3246493 - protein, 13 aa, Plasmodium falciparum
SDTNNNRNNNNNN

SEQ ID NO: 3246494 - protein, 9 aa, Plasmodium falciparum
SDTNRQKSN

SEQ ID NO: 3246495 - protein, 6 aa, Plasmodium falciparum
SDTRVN

SEQ ID NO: 3246496 - protein, 8 aa, Plasmodium falciparum
SDTSNDEN

SEQ ID NO: 3246497 - protein, 17 aa, Plasmodium falciparum
SDTSPLAKTLNKNSRLS

SEQ ID NO: 3246498 - protein, 8 aa, Plasmodium falciparum
SDTSSNYS

SEQ ID NO: 3246499 - protein, 9 aa, Plasmodium falciparum
SDTSSSKNV

SEQ ID NO: 3246500 - protein, 5 aa, Plasmodium falciparum
SDTST

SEQ ID NO: 3246501 - protein, 10 aa, Plasmodium falciparum
SDTSTNKTNT

SEQ ID NO: 3246502 - protein, 8 aa, Plasmodium falciparum
SDTTQKGL

SEQ ID NO: 3246503 - protein, 5 aa, Plasmodium falciparum
SDTYF

SEQ ID NO: 3246504 - protein, 7 aa, Plasmodium falciparum
SDTYKGK

SEQ ID NO: 3246505 - protein, 10 aa, Plasmodium falciparum
SDVDDAETEW

SEQ ID NO: 3246506 - protein, 12 aa, Plasmodium falciparum
SDVKEIKNDEYM

SEQ ID NO: 3246507 - protein, 12 aa, Plasmodium falciparum
SDVKNESHNSAR

SEQ ID NO: 3246508 - protein, 7 aa, Plasmodium falciparum
SDVNDYD

SEQ ID NO: 3246509 - protein, 4 aa, Plasmodium falciparum
SDVQ

SEQ ID NO: 3246510 - protein, 41 aa, Plasmodium falciparum
SDVSTENSYTHNNSRDDEPQNGKRTYNNQSNNNLPYDNSSY

SEQ ID NO: 3246511 - protein, 6 aa, Plasmodium falciparum
SDYDIP

SEQ ID NO: 3246512 - protein, 14 aa, Plasmodium falciparum
SDYDIPTKRSPNRY

SEQ ID NO: 3246513 - protein, 6 aa, Plasmodium falciparum
SDYDND

SEQ ID NO: 3246514 - protein, 31 aa, Plasmodium falciparum
SDYDSATNNNNNNNDDDDKDYKDYNKKNKKN

SEQ ID NO: 3246515 - protein, 4 aa, Plasmodium falciparum
SDYE

SEQ ID NO: 3246516 - protein, 6 aa, Plasmodium falciparum
SDYEKK

SEQ ID NO: 3246517 - protein, 5 aa, Plasmodium falciparum
SDYGN

SEQ ID NO: 3246518 - protein, 8 aa, Plasmodium falciparum
SDYKNKSE

SEQ ID NO: 3246519 - protein, 6 aa, Plasmodium falciparum
SDYNNC

SEQ ID NO: 3246520 - protein, 8 aa, Plasmodium falciparum
SDYNSDSD

SEQ ID NO: 3246521 - protein, 5 aa, Plasmodium falciparum
SDYSS

SEQ ID NO: 3246522 - protein, 5 aa, Plasmodium falciparum
SDYTE

SEQ ID NO: 3246523 - protein, 12 aa, Plasmodium falciparum
SDYYSNENPNSF

SEQ ID NO: 3246524 - protein, 23 aa, Plasmodium falciparum
SEAANEENETEQISYKSDFLESI

SEQ ID NO: 3246525 - protein, 13 aa, Plasmodium falciparum
SEADNAHSEEKEE

SEQ ID NO: 3246526 - protein, 11 aa, Plasmodium falciparum
SEAEKNNNRKK

SEQ ID NO: 3246527 - protein, 7 aa, Plasmodium falciparum
SEALDGK

SEQ ID NO: 3246528 - protein, 5 aa, Plasmodium falciparum
SEAPD

SEQ ID NO: 3246529 - protein, 5 aa, Plasmodium falciparum
SEAPK

SEQ ID NO: 3246530 - protein, 11 aa, Plasmodium falciparum
SEAQKCDDKMN

SEQ ID NO: 3246531 - protein, 5 aa, Plasmodium falciparum
SEASG

SEQ ID NO: 3246532 - protein, 19 aa, Plasmodium falciparum
SEATYPGDENPNKTTPPNP

SEQ ID NO: 3246533 - protein, 8 aa, Plasmodium falciparum
SECNRFST

SEQ ID NO: 3246534 - protein, 31 aa, Plasmodium falciparum
SECTSQSSGSDCTLSTENPSTTLDDEEPLEE

SEQ ID NO: 3246535 - protein, 6 aa, Plasmodium falciparum
SEDDID

SEQ ID NO: 3246536 - protein, 6 aa, Plasmodium falciparum
SEDDKN

SEQ ID NO: 3246537 - protein, 36 aa, Plasmodium falciparum
SEDEEDKSDSVEERNDVEHQKKIEEEKDDENSNSGK

SEQ ID NO: 3246538 - protein, 17 aa, Plasmodium falciparum
SEDEGKNKNHKNDENDI

SEQ ID NO: 3246539 - protein, 7 aa, Plasmodium falciparum
SEDEGTI

SEQ ID NO: 3246540 - protein, 8 aa, Plasmodium falciparum
SEDGHKND

SEQ ID NO: 3246541 - protein, 10 aa, Plasmodium falciparum
SEDGKTKNSL

SEQ ID NO: 3246542 - protein, 6 aa, Plasmodium falciparum
SEDINK

SEQ ID NO: 3246543 - protein, 6 aa, Plasmodium falciparum
SEDITS

SEQ ID NO: 3246544 - protein, 7 aa, Plasmodium falciparum
SEDKSGD

SEQ ID NO: 3246545 - protein, 10 aa, Plasmodium falciparum
SEDLNKDQEN

SEQ ID NO: 3246546 - protein, 17 aa, Plasmodium falciparum
SEDNALSTKYRDDHHNN

SEQ ID NO: 3246547 - protein, 6 aa, Plasmodium falciparum
SEDTQK

SEQ ID NO: 3246548 - protein, 4 aa, Plasmodium falciparum
SEDY

SEQ ID NO: 3246549 - protein, 7 aa, Plasmodium falciparum
SEEAKTK

SEQ ID NO: 3246550 - protein, 6 aa, Plasmodium falciparum
SEECEP

SEQ ID NO: 3246551 - protein, 7 aa, Plasmodium falciparum
SEECSEC

SEQ ID NO: 3246552 - protein, 7 aa, Plasmodium falciparum
SEEDKEI

SEQ ID NO: 3246553 - protein, 4 aa, Plasmodium falciparum
SEEE

SEQ ID NO: 3246554 - protein, 12 aa, Plasmodium falciparum
SEEEEEDEDKRK

SEQ ID NO: 3246555 - protein, 7 aa, Plasmodium falciparum
SEEEEKY

SEQ ID NO: 3246556 - protein, 8 aa, Plasmodium falciparum
SEEEKKNK

SEQ ID NO: 3246557 - protein, 5 aa, Plasmodium falciparum
SEEEL

SEQ ID NO: 3246558 - protein, 9 aa, Plasmodium falciparum
SEEEQDNIE

SEQ ID NO: 3246559 - protein, 6 aa, Plasmodium falciparum
SEEEQI

SEQ ID NO: 3246560 - protein, 34 aa, Plasmodium falciparum
SEEEQNDSQEGEQLNDEDEQKQKDQQTNEQDDEM

SEQ ID NO: 3246561 - protein, 32 aa, Plasmodium falciparum
SEEESEEDYSYSDNMSDNNSSSSTSECTIESE

SEQ ID NO: 3246562 - protein, 5 aa, Plasmodium falciparum
SEEEY

SEQ ID NO: 3246563 - protein, 6 aa, Plasmodium falciparum
SEEGNE

SEQ ID NO: 3246564 - protein, 4 aa, Plasmodium falciparum
SEEK

SEQ ID NO: 3246565 - protein, 235 aa, Plasmodium falciparum
SEEKAEDDYKKSSSCSSLASTTKRSPSTASTSTSLRSASTASTASTLRSASTASTASTASTASTASTASTASTASTASAASTTRSASAASTTRSASAASTTRSASAASTTRSASTASTARSASTASTASAASAASTTRSASAASTTRSASAASTTRSASAASTTRSASAASTASTASTGSTSTTQSPSTSTSTTQSPSTSTSTTQSPSTSTSTTQSPSTGSTSGSTTRLPSTGST

SEQ ID NO: 3246566 - protein, 17 aa, Plasmodium falciparum
SEEKSQTGDEDANEKKR

SEQ ID NO: 3246567 - protein, 6 aa, Plasmodium falciparum
SEEKSS

SEQ ID NO: 3246568 - protein, 32 aa, Plasmodium falciparum
SEELSKGDAHKNETVRNEPSNDITNNQGIDNH

SEQ ID NO: 3246569 - protein, 22 aa, Plasmodium falciparum
SEEMDNSHRDERKKQASSIDTE

SEQ ID NO: 3246570 - protein, 68 aa, Plasmodium falciparum
SEENITKDECSKESNKSNDECIQESNKSNDEFSKESKDINDECTQESKDINDECSKESKDINDECTQE

SEQ ID NO: 3246571 - protein, 11 aa, Plasmodium falciparum
SEENLKSGKIN

SEQ ID NO: 3246572 - protein, 18 aa, Plasmodium falciparum
SEENQGDEADASGTGKKT

SEQ ID NO: 3246573 - protein, 5 aa, Plasmodium falciparum
SEERI

SEQ ID NO: 3246574 - protein, 5 aa, Plasmodium falciparum
SEERL

SEQ ID NO: 3246575 - protein, 23 aa, Plasmodium falciparum
SEERSKTKIDEKSKMYSKNDEFN

SEQ ID NO: 3246576 - protein, 25 aa, Plasmodium falciparum
SEESASQCSTSRISGNNSDSGSCAP

SEQ ID NO: 3246577 - protein, 9 aa, Plasmodium falciparum
SEESGDSDY

SEQ ID NO: 3246578 - protein, 6 aa, Plasmodium falciparum
SEESNE

SEQ ID NO: 3246579 - protein, 16 aa, Plasmodium falciparum
SEETNLEKDNEEDNKY

SEQ ID NO: 3246580 - protein, 7 aa, Plasmodium falciparum
SEEVTNF

SEQ ID NO: 3246581 - protein, 4 aa, Plasmodium falciparum
SEEY

SEQ ID NO: 3246582 - protein, 6 aa, Plasmodium falciparum
SEEYNI

SEQ ID NO: 3246583 - protein, 6 aa, Plasmodium falciparum
SEFNEK

SEQ ID NO: 3246584 - protein, 14 aa, Plasmodium falciparum
SEFNKEEKDEKKEL

SEQ ID NO: 3246585 - protein, 10 aa, Plasmodium falciparum
SEFNQQGENK

SEQ ID NO: 3246586 - protein, 10 aa, Plasmodium falciparum
SEFSPSEKTY

SEQ ID NO: 3246587 - protein, 6 aa, Plasmodium falciparum
SEGAGE

SEQ ID NO: 3246588 - protein, 10 aa, Plasmodium falciparum
SEGASETLGD

SEQ ID NO: 3246589 - protein, 8 aa, Plasmodium falciparum
SEGDEEGK

SEQ ID NO: 3246590 - protein, 37 aa, Plasmodium falciparum
SEGDNNQNENENQNENENKNENENENKNNDHNNNKYN

SEQ ID NO: 3246591 - protein, 4 aa, Plasmodium falciparum
SEGK

SEQ ID NO: 3246592 - protein, 34 aa, Plasmodium falciparum
SEGKDSNDDKKKKKKKNKQKKGRKEENIKYSSDK

SEQ ID NO: 3246593 - protein, 101 aa, Plasmodium falciparum
SEGKYNYDGEDEQDEQDEQDEQDEQDEQEEEDEQEEEDEQEEEDEQEEEDDEDDEDDEEEDDEDDDNDNDDDDEDDNDNDDDDDDEYDDHYDKPSDDATQN

SEQ ID NO: 3246594 - protein, 11 aa, Plasmodium falciparum
SEGNESEKSTI

SEQ ID NO: 3246595 - protein, 5 aa, Plasmodium falciparum
SEGNI

SEQ ID NO: 3246596 - protein, 7 aa, Plasmodium falciparum
SEGQSSI

SEQ ID NO: 3246597 - protein, 17 aa, Plasmodium falciparum
SEGQSTDEYSESSSEYV

SEQ ID NO: 3246598 - protein, 33 aa, Plasmodium falciparum
SEGTYNNESDMNKKPSTSTNINSENKQNAHTRS

SEQ ID NO: 3246599 - protein, 11 aa, Plasmodium falciparum
SEGVKSKMSDF

SEQ ID NO: 3246600 - protein, 7 aa, Plasmodium falciparum
SEGYTKE

SEQ ID NO: 3246601 - protein, 6 aa, Plasmodium falciparum
SEHACN

SEQ ID NO: 3246602 - protein, 28 aa, Plasmodium falciparum
SEHIGTEKTTYNNNTTTSTFNRDTTNNV

SEQ ID NO: 3246603 - protein, 5 aa, Plasmodium falciparum
SEHKA

SEQ ID NO: 3246604 - protein, 17 aa, Plasmodium falciparum
SEHKELKTQKKADENKI

SEQ ID NO: 3246605 - protein, 8 aa, Plasmodium falciparum
SEHNMNNK

SEQ ID NO: 3246606 - protein, 5 aa, Plasmodium falciparum
SEHNT

SEQ ID NO: 3246607 - protein, 4 aa, Plasmodium falciparum
SEHR

SEQ ID NO: 3246608 - protein, 7 aa, Plasmodium falciparum
SEHRKTK

SEQ ID NO: 3246609 - protein, 4 aa, Plasmodium falciparum
SEHT

SEQ ID NO: 3246610 - protein, 28 aa, Plasmodium falciparum
SEHTNNTNQEKKSQKKKKSSKKKKKQKK

SEQ ID NO: 3246611 - protein, 8 aa, Plasmodium falciparum
SEHVQENE

SEQ ID NO: 3246612 - protein, 6 aa, Plasmodium falciparum
SEIDKT

SEQ ID NO: 3246613 - protein, 4 aa, Plasmodium falciparum
SEIE

SEQ ID NO: 3246614 - protein, 18 aa, Plasmodium falciparum
SEIEPEPKPEPSTPTHCQ

SEQ ID NO: 3246615 - protein, 7 aa, Plasmodium falciparum
SEIHDNN

SEQ ID NO: 3246616 - protein, 12 aa, Plasmodium falciparum
SEIKKKENDVKN

SEQ ID NO: 3246617 - protein, 13 aa, Plasmodium falciparum
SEINDNQKAQEIK

SEQ ID NO: 3246618 - protein, 5 aa, Plasmodium falciparum
SEINQ

SEQ ID NO: 3246619 - protein, 7 aa, Plasmodium falciparum
SEIPEEY

SEQ ID NO: 3246620 - protein, 6 aa, Plasmodium falciparum
SEISSQ

SEQ ID NO: 3246621 - protein, 7 aa, Plasmodium falciparum
SEISTPL

SEQ ID NO: 3246622 - protein, 4 aa, Plasmodium falciparum
SEIT

SEQ ID NO: 3246623 - protein, 11 aa, Plasmodium falciparum
SEITKKKKKSI

SEQ ID NO: 3246624 - protein, 13 aa, Plasmodium falciparum
SEIYTDPSKRSIL

SEQ ID NO: 3246625 - protein, 8 aa, Plasmodium falciparum
SEIYTSSE

SEQ ID NO: 3246626 - protein, 10 aa, Plasmodium falciparum
SEKAQDNIKN

SEQ ID NO: 3246627 - protein, 4 aa, Plasmodium falciparum
SEKC

SEQ ID NO: 3246628 - protein, 4 aa, Plasmodium falciparum
SEKD

SEQ ID NO: 3246629 - protein, 11 aa, Plasmodium falciparum
SEKDEGNKNDL

SEQ ID NO: 3246630 - protein, 9 aa, Plasmodium falciparum
SEKDENGNI

SEQ ID NO: 3246631 - protein, 7 aa, Plasmodium falciparum
SEKDENR

SEQ ID NO: 3246632 - protein, 22 aa, Plasmodium falciparum
SEKDNKKKSGKNKALKTKKDYN

SEQ ID NO: 3246633 - protein, 16 aa, Plasmodium falciparum
SEKDNLSNSLEQNGEP

SEQ ID NO: 3246634 - protein, 9 aa, Plasmodium falciparum
SEKDSYKEQ

SEQ ID NO: 3246635 - protein, 28 aa, Plasmodium falciparum
SEKEENKNDDKCVDEKKNNNKENETHGF

SEQ ID NO: 3246636 - protein, 7 aa, Plasmodium falciparum
SEKEHNE

SEQ ID NO: 3246637 - protein, 5 aa, Plasmodium falciparum
SEKEI

SEQ ID NO: 3246638 - protein, 129 aa, Plasmodium falciparum
SEKEIDPSKSDINKDKDKKENKQNDSTEGKEENKEESKEESKEESKEESKEENKKESKEQSKEENKEENKEENNEKNNEKNKEENKEESKEDNKEENKEENKDNNKEVCENSTGDKKEGNEHELNNRSG

SEQ ID NO: 3246639 - protein, 6 aa, Plasmodium falciparum
SEKEKF

SEQ ID NO: 3246640 - protein, 31 aa, Plasmodium falciparum
SEKENESKDKNNEPNQNQKEKNDKNEPTYNT

SEQ ID NO: 3246641 - protein, 5 aa, Plasmodium falciparum
SEKES

SEQ ID NO: 3246642 - protein, 6 aa, Plasmodium falciparum
SEKESF

SEQ ID NO: 3246643 - protein, 31 aa, Plasmodium falciparum
SEKGACTTNNNKNNNDNNNDNNDNNDNNNDN

SEQ ID NO: 3246644 - protein, 24 aa, Plasmodium falciparum
SEKGDNNNNNHQNNNGNDNKKRLG

SEQ ID NO: 3246645 - protein, 15 aa, Plasmodium falciparum
SEKGNGETVRGEKND

SEQ ID NO: 3246646 - protein, 4 aa, Plasmodium falciparum
SEKI

SEQ ID NO: 3246647 - protein, 15 aa, Plasmodium falciparum
SEKIKDDKKASDKYE

SEQ ID NO: 3246648 - protein, 6 aa, Plasmodium falciparum
SEKKED

SEQ ID NO: 3246649 - protein, 16 aa, Plasmodium falciparum
SEKKENDDLIELEEPL

SEQ ID NO: 3246650 - protein, 7 aa, Plasmodium falciparum
SEKKNKN

SEQ ID NO: 3246651 - protein, 18 aa, Plasmodium falciparum
SEKKQEWDKQKTKYENKY

SEQ ID NO: 3246652 - protein, 6 aa, Plasmodium falciparum
SEKKQK

SEQ ID NO: 3246653 - protein, 11 aa, Plasmodium falciparum
SEKKRASRRRT

SEQ ID NO: 3246654 - protein, 9 aa, Plasmodium falciparum
SEKKRRKTY

SEQ ID NO: 3246655 - protein, 5 aa, Plasmodium falciparum
SEKLL

SEQ ID NO: 3246656 - protein, 8 aa, Plasmodium falciparum
SEKLSKNI

SEQ ID NO: 3246657 - protein, 10 aa, Plasmodium falciparum
SEKMGKNKND

SEQ ID NO: 3246658 - protein, 13 aa, Plasmodium falciparum
SEKMSNNNEENKY

SEQ ID NO: 3246659 - protein, 4 aa, Plasmodium falciparum
SEKN

SEQ ID NO: 3246660 - protein, 17 aa, Plasmodium falciparum
SEKNAKKDKNEKAKWRP

SEQ ID NO: 3246661 - protein, 6 aa, Plasmodium falciparum
SEKNDT

SEQ ID NO: 3246662 - protein, 37 aa, Plasmodium falciparum
SEKNEKNEKNEKDNQYEKNSQNEKNEQNEKDKQYEQI

SEQ ID NO: 3246663 - protein, 8 aa, Plasmodium falciparum
SEKNESLS

SEQ ID NO: 3246664 - protein, 5 aa, Plasmodium falciparum
SEKNN

SEQ ID NO: 3246665 - protein, 9 aa, Plasmodium falciparum
SEKNNQTNM

SEQ ID NO: 3246666 - protein, 14 aa, Plasmodium falciparum
SEKNNTSNKTVTHK

SEQ ID NO: 3246667 - protein, 8 aa, Plasmodium falciparum
SEKNNYKD

SEQ ID NO: 3246668 - protein, 8 aa, Plasmodium falciparum
SEKPDKYR

SEQ ID NO: 3246669 - protein, 6 aa, Plasmodium falciparum
SEKPEN

SEQ ID NO: 3246670 - protein, 4 aa, Plasmodium falciparum
SEKQ

SEQ ID NO: 3246671 - protein, 4 aa, Plasmodium falciparum
SEKR

SEQ ID NO: 3246672 - protein, 17 aa, Plasmodium falciparum
SEKRNDNKKENTNEQIN

SEQ ID NO: 3246673 - protein, 9 aa, Plasmodium falciparum
SEKRNNINK

SEQ ID NO: 3246674 - protein, 7 aa, Plasmodium falciparum
SEKSNEW

SEQ ID NO: 3246675 - protein, 11 aa, Plasmodium falciparum
SEKSRNNEKNF

SEQ ID NO: 3246676 - protein, 21 aa, Plasmodium falciparum
SEKTKKNEKNRNDRKNTKQCD

SEQ ID NO: 3246677 - protein, 6 aa, Plasmodium falciparum
SEKTTN

SEQ ID NO: 3246678 - protein, 9 aa, Plasmodium falciparum
SEKVNSSSI

SEQ ID NO: 3246679 - protein, 11 aa, Plasmodium falciparum
SEKYKKSPYTL

SEQ ID NO: 3246680 - protein, 17 aa, Plasmodium falciparum
SEKYNCDNDNCHNNNNE

SEQ ID NO: 3246681 - protein, 4 aa, Plasmodium falciparum
SELA

SEQ ID NO: 3246682 - protein, 11 aa, Plasmodium falciparum
SELNKSVRSNI

SEQ ID NO: 3246683 - protein, 7 aa, Plasmodium falciparum
SELPTNN

SEQ ID NO: 3246684 - protein, 6 aa, Plasmodium falciparum
SELRDG

SEQ ID NO: 3246685 - protein, 11 aa, Plasmodium falciparum
SELSEGSQGNK

SEQ ID NO: 3246686 - protein, 6 aa, Plasmodium falciparum
SELSLS

SEQ ID NO: 3246687 - protein, 17 aa, Plasmodium falciparum
SELSSYEKDNMKEDDPL

SEQ ID NO: 3246688 - protein, 5 aa, Plasmodium falciparum
SEMTD

SEQ ID NO: 3246689 - protein, 24 aa, Plasmodium falciparum
SENAAERGSSIKSNSYNPDTHDNK

SEQ ID NO: 3246690 - protein, 9 aa, Plasmodium falciparum
SENDEISEK

SEQ ID NO: 3246691 - protein, 7 aa, Plasmodium falciparum
SENDENN

SEQ ID NO: 3246692 - protein, 31 aa, Plasmodium falciparum
SENDKQPNTQQHYETNNIDTDNQRNKNNECN

SEQ ID NO: 3246693 - protein, 13 aa, Plasmodium falciparum
SENDMNSEKSYSS

SEQ ID NO: 3246694 - protein, 7 aa, Plasmodium falciparum
SENDYKN

SEQ ID NO: 3246695 - protein, 14 aa, Plasmodium falciparum
SENEEKSENFKNSD

SEQ ID NO: 3246696 - protein, 6 aa, Plasmodium falciparum
SENEES

SEQ ID NO: 3246697 - protein, 6 aa, Plasmodium falciparum
SENEFA

SEQ ID NO: 3246698 - protein, 7 aa, Plasmodium falciparum
SENEIQT

SEQ ID NO: 3246699 - protein, 5 aa, Plasmodium falciparum
SENER

SEQ ID NO: 3246700 - protein, 8 aa, Plasmodium falciparum
SENGKYTL

SEQ ID NO: 3246701 - protein, 14 aa, Plasmodium falciparum
SENGNGEKVNGIEN

SEQ ID NO: 3246702 - protein, 8 aa, Plasmodium falciparum
SENGRISK

SEQ ID NO: 3246703 - protein, 7 aa, Plasmodium falciparum
SENIDQT

SEQ ID NO: 3246704 - protein, 19 aa, Plasmodium falciparum
SENIQGAGKIEEGSRISSG

SEQ ID NO: 3246705 - protein, 13 aa, Plasmodium falciparum
SENITKDAADKLN

SEQ ID NO: 3246706 - protein, 7 aa, Plasmodium falciparum
SENKDTH

SEQ ID NO: 3246707 - protein, 9 aa, Plasmodium falciparum
SENKSVNVG

SEQ ID NO: 3246708 - protein, 7 aa, Plasmodium falciparum
SENKTQE

SEQ ID NO: 3246709 - protein, 4 aa, Plasmodium falciparum
SENN

SEQ ID NO: 3246710 - protein, 11 aa, Plasmodium falciparum
SENNKTKTSQL

SEQ ID NO: 3246711 - protein, 7 aa, Plasmodium falciparum
SENNLQG

SEQ ID NO: 3246712 - protein, 9 aa, Plasmodium falciparum
SENNYSSKN

SEQ ID NO: 3246713 - protein, 6 aa, Plasmodium falciparum
SENQDL

SEQ ID NO: 3246714 - protein, 8 aa, Plasmodium falciparum
SENQKKTI

SEQ ID NO: 3246715 - protein, 8 aa, Plasmodium falciparum
SENSHNKI

SEQ ID NO: 3246716 - protein, 8 aa, Plasmodium falciparum
SENTSGKP

SEQ ID NO: 3246717 - protein, 7 aa, Plasmodium falciparum
SENTYSN

SEQ ID NO: 3246718 - protein, 4 aa, Plasmodium falciparum
SENY

SEQ ID NO: 3246719 - protein, 27 aa, Plasmodium falciparum
SENYMTTKDKNSEDKISDDKSSDDIKL

SEQ ID NO: 3246720 - protein, 15 aa, Plasmodium falciparum
SEPEFVSPKKQNING

SEQ ID NO: 3246721 - protein, 33 aa, Plasmodium falciparum
SEPIHNTKNSSSVDYRNEEKGGQKKKKKTEKYD

SEQ ID NO: 3246722 - protein, 10 aa, Plasmodium falciparum
SEPTTNNSKF

SEQ ID NO: 3246723 - protein, 12 aa, Plasmodium falciparum
SEQDQNKCNEQF

SEQ ID NO: 3246724 - protein, 40 aa, Plasmodium falciparum
SEQGKISKNNNYGDNNIYGDNNSCGNKFNGKGLGKNKREK

SEQ ID NO: 3246725 - protein, 4 aa, Plasmodium falciparum
SEQI

SEQ ID NO: 3246726 - protein, 5 aa, Plasmodium falciparum
SEQIK

SEQ ID NO: 3246727 - protein, 28 aa, Plasmodium falciparum
SEQINNKKGKKKPEQFRKNKSQKKKKKK

SEQ ID NO: 3246728 - protein, 6 aa, Plasmodium falciparum
SEQISE

SEQ ID NO: 3246729 - protein, 6 aa, Plasmodium falciparum
SEQKEF

SEQ ID NO: 3246730 - protein, 42 aa, Plasmodium falciparum
SEQKKKKEQSSNNIKKVEKQKNYNVDNDGNTTNNDHKNENEN

SEQ ID NO: 3246731 - protein, 6 aa, Plasmodium falciparum
SEQKNT

SEQ ID NO: 3246732 - protein, 6 aa, Plasmodium falciparum
SEQLEN

SEQ ID NO: 3246733 - protein, 8 aa, Plasmodium falciparum
SEQNENSN

SEQ ID NO: 3246734 - protein, 22 aa, Plasmodium falciparum
SEQPKDVPNDYKSGDIPFNTQP

SEQ ID NO: 3246735 - protein, 23 aa, Plasmodium falciparum
SEQPKDVPNDYKSGDIPLNTQPN

SEQ ID NO: 3246736 - protein, 32 aa, Plasmodium falciparum
SEQPKDVPNDYKSGNSSTNTNITTTSRDNMEE

SEQ ID NO: 3246737 - protein, 17 aa, Plasmodium falciparum
SEQPKDVPNDYSSGDIP

SEQ ID NO: 3246738 - protein, 23 aa, Plasmodium falciparum
SEQPKDVPNDYSSGDIPLNTQPN

SEQ ID NO: 3246739 - protein, 7 aa, Plasmodium falciparum
SEQPKKG

SEQ ID NO: 3246740 - protein, 38 aa, Plasmodium falciparum
SEQPNDIPNDYSSGTIPTNTNNTTPSHDNVDNNTHPTM

SEQ ID NO: 3246741 - protein, 44 aa, Plasmodium falciparum
SEQPNDIPNDYTSGTIPTNTNITTTSRHNVDNNTNTTMSRDNME

SEQ ID NO: 3246742 - protein, 20 aa, Plasmodium falciparum
SEQPNDLPNDYKSGNVTLNT

SEQ ID NO: 3246743 - protein, 23 aa, Plasmodium falciparum
SEQPNDVPNDYKSGNSSTNTNIT

SEQ ID NO: 3246744 - protein, 31 aa, Plasmodium falciparum
SEQPNDVPNDYKSGNSSTNTNITTTSRHNVE

SEQ ID NO: 3246745 - protein, 22 aa, Plasmodium falciparum
SEQPNDVPNDYSSGDIPFNTQP

SEQ ID NO: 3246746 - protein, 23 aa, Plasmodium falciparum
SEQPNDVPNDYTSGNSSTNTNIT

SEQ ID NO: 3246747 - protein, 31 aa, Plasmodium falciparum
SEQPNDVPNDYTSGNSSTNTNITTTSRHNVE

SEQ ID NO: 3246748 - protein, 19 aa, Plasmodium falciparum
SEQPNDYKNGNIPLNTQPN

SEQ ID NO: 3246749 - protein, 22 aa, Plasmodium falciparum
SEQPNDYKSGNSSTNTNITTTS

SEQ ID NO: 3246750 - protein, 4 aa, Plasmodium falciparum
SEQT

SEQ ID NO: 3246751 - protein, 39 aa, Plasmodium falciparum
SEQTNIRNDNNNNNNNNNNNSNNNNNNNNNNKDNSVASL

SEQ ID NO: 3246752 - protein, 10 aa, Plasmodium falciparum
SEQVKNKNTK

SEQ ID NO: 3246753 - protein, 13 aa, Plasmodium falciparum
SEQYKSKESNNIC

SEQ ID NO: 3246754 - protein, 8 aa, Plasmodium falciparum
SERDRRKQ

SEQ ID NO: 3246755 - protein, 4 aa, Plasmodium falciparum
SERE

SEQ ID NO: 3246756 - protein, 41 aa, Plasmodium falciparum
SEREDIKQDDDYISERDEIKQDDSFAGDKDQNFEDDNYVSE

SEQ ID NO: 3246757 - protein, 48 aa, Plasmodium falciparum
SEREEIKQDDDYISEREEIKQDDDYISEREEIKQDDDYISEREEFKQD

SEQ ID NO: 3246758 - protein, 27 aa, Plasmodium falciparum
SEREEIKQDDDYVSEREEIKQDESFVG

SEQ ID NO: 3246759 - protein, 6 aa, Plasmodium falciparum
SEREKF

SEQ ID NO: 3246760 - protein, 4 aa, Plasmodium falciparum
SERF

SEQ ID NO: 3246761 - protein, 5 aa, Plasmodium falciparum
SERKH

SEQ ID NO: 3246762 - protein, 6 aa, Plasmodium falciparum
SERKNK

SEQ ID NO: 3246763 - protein, 7 aa, Plasmodium falciparum
SERNEKL

SEQ ID NO: 3246764 - protein, 10 aa, Plasmodium falciparum
SERNGGCSQA

SEQ ID NO: 3246765 - protein, 29 aa, Plasmodium falciparum
SERNGGCSQANDKCRCPKTSDGKANDQVP

SEQ ID NO: 3246766 - protein, 5 aa, Plasmodium falciparum
SERQG

SEQ ID NO: 3246767 - protein, 17 aa, Plasmodium falciparum
SERSVTSRLSPSIPGET

SEQ ID NO: 3246768 - protein, 4 aa, Plasmodium falciparum
SESD

SEQ ID NO: 3246769 - protein, 5 aa, Plasmodium falciparum
SESED

SEQ ID NO: 3246770 - protein, 9 aa, Plasmodium falciparum
SESENKSNL

SEQ ID NO: 3246771 - protein, 11 aa, Plasmodium falciparum
SESESNELPNR

SEQ ID NO: 3246772 - protein, 67 aa, Plasmodium falciparum
SESETDVYDESEENDEIEENDESEENDESEDNDESEDNDESEDNDEIQQNDNSQHNDEIQQNDECDD

SEQ ID NO: 3246773 - protein, 4 aa, Plasmodium falciparum
SESI

SEQ ID NO: 3246774 - protein, 6 aa, Plasmodium falciparum
SESKSM

SEQ ID NO: 3246775 - protein, 33 aa, Plasmodium falciparum
SESKSVKNKGLRNKSEKNKLKNGVDEKNDSTPL

SEQ ID NO: 3246776 - protein, 13 aa, Plasmodium falciparum
SESLKRSNNDEKH

SEQ ID NO: 3246777 - protein, 4 aa, Plasmodium falciparum
SESN

SEQ ID NO: 3246778 - protein, 7 aa, Plasmodium falciparum
SESNSLN

SEQ ID NO: 3246779 - protein, 7 aa, Plasmodium falciparum
SESRGNV

SEQ ID NO: 3246780 - protein, 24 aa, Plasmodium falciparum
SESSDEDYNKMEPHGSYDDSDMDH

SEQ ID NO: 3246781 - protein, 16 aa, Plasmodium falciparum
SESSDSFNHDNNRNVE

SEQ ID NO: 3246782 - protein, 52 aa, Plasmodium falciparum
SESSSTSASTSASASTSASTSASTSVSTSVSTSVSTSASTTMNSPRPSDNHI

SEQ ID NO: 3246783 - protein, 25 aa, Plasmodium falciparum
SESTEQKNNPEKEKSKKNKNNNNMK

SEQ ID NO: 3246784 - protein, 9 aa, Plasmodium falciparum
SESTNSLKE

SEQ ID NO: 3246785 - protein, 11 aa, Plasmodium falciparum
SESTTRPGNSF

SEQ ID NO: 3246786 - protein, 4 aa, Plasmodium falciparum
SESW

SEQ ID NO: 3246787 - protein, 6 aa, Plasmodium falciparum
SESYIK

SEQ ID NO: 3246788 - protein, 5 aa, Plasmodium falciparum
SETKD

SEQ ID NO: 3246789 - protein, 12 aa, Plasmodium falciparum
SETKENKMKNKN

SEQ ID NO: 3246790 - protein, 11 aa, Plasmodium falciparum
SETKNIETQDD

SEQ ID NO: 3246791 - protein, 5 aa, Plasmodium falciparum
SETKQ

SEQ ID NO: 3246792 - protein, 22 aa, Plasmodium falciparum
SETNANGNDGNLENDKEASSNI

SEQ ID NO: 3246793 - protein, 7 aa, Plasmodium falciparum
SETNEGL

SEQ ID NO: 3246794 - protein, 7 aa, Plasmodium falciparum
SETNNEM

SEQ ID NO: 3246795 - protein, 4 aa, Plasmodium falciparum
SETP

SEQ ID NO: 3246796 - protein, 21 aa, Plasmodium falciparum
SETPINNNNNNNNNNNNNNNK

SEQ ID NO: 3246797 - protein, 6 aa, Plasmodium falciparum
SETQDE

SEQ ID NO: 3246798 - protein, 16 aa, Plasmodium falciparum
SETQREKKKEKCIKRK

SEQ ID NO: 3246799 - protein, 14 aa, Plasmodium falciparum
SETSSGASSDISRA

SEQ ID NO: 3246800 - protein, 15 aa, Plasmodium falciparum
SETSSSISSGNKNER

SEQ ID NO: 3246801 - protein, 36 aa, Plasmodium falciparum
SETTEDGGHSTHTLSQSGETEVTEETEETEETVGHT

SEQ ID NO: 3246802 - protein, 12 aa, Plasmodium falciparum
SEVEKTHGEHTV

SEQ ID NO: 3246803 - protein, 9 aa, Plasmodium falciparum
SEVSPPVDD

SEQ ID NO: 3246804 - protein, 13 aa, Plasmodium falciparum
SEWENQKNKYTEL

SEQ ID NO: 3246805 - protein, 4 aa, Plasmodium falciparum
SEYD

SEQ ID NO: 3246806 - protein, 6 aa, Plasmodium falciparum
SEYDHT

SEQ ID NO: 3246807 - protein, 6 aa, Plasmodium falciparum
SEYDSQ

SEQ ID NO: 3246808 - protein, 7 aa, Plasmodium falciparum
SEYEKQV

SEQ ID NO: 3246809 - protein, 5 aa, Plasmodium falciparum
SEYKE

SEQ ID NO: 3246810 - protein, 6 aa, Plasmodium falciparum
SEYKKE

SEQ ID NO: 3246811 - protein, 8 aa, Plasmodium falciparum
SEYKYDRP

SEQ ID NO: 3246812 - protein, 4 aa, Plasmodium falciparum
SEYN

SEQ ID NO: 3246813 - protein, 5 aa, Plasmodium falciparum
SEYNN

SEQ ID NO: 3246814 - protein, 17 aa, Plasmodium falciparum
SEYNSVNNKTNEQNNIS

SEQ ID NO: 3246815 - protein, 31 aa, Plasmodium falciparum
SEYSEPSVHNRQQEESQNNNSVSKSDKDSNF

SEQ ID NO: 3246816 - protein, 6 aa, Plasmodium falciparum
SEYSKI

SEQ ID NO: 3246817 - protein, 6 aa, Plasmodium falciparum
SEYSNY

SEQ ID NO: 3246818 - protein, 7 aa, Plasmodium falciparum
SEYSPET

SEQ ID NO: 3246819 - protein, 5 aa, Plasmodium falciparum
SFDDD

SEQ ID NO: 3246820 - protein, 22 aa, Plasmodium falciparum
SFDDSSSINNISDNQRSSFSKN

SEQ ID NO: 3246821 - protein, 9 aa, Plasmodium falciparum
SFDSDYENG

SEQ ID NO: 3246822 - protein, 12 aa, Plasmodium falciparum
SFEDETDNYSTD

SEQ ID NO: 3246823 - protein, 58 aa, Plasmodium falciparum
SFEENENQNKEKKNKKNIKRKNKAKNKHNNDNNDNNDDNDNNNDNNNDNNKININSKD

SEQ ID NO: 3246824 - protein, 5 aa, Plasmodium falciparum
SFENT

SEQ ID NO: 3246825 - protein, 21 aa, Plasmodium falciparum
SFESKSENVQNKNKKKHLSSR

SEQ ID NO: 3246826 - protein, 13 aa, Plasmodium falciparum
SFHTSNEKCTQRT

SEQ ID NO: 3246827 - protein, 6 aa, Plasmodium falciparum
SFKDER

SEQ ID NO: 3246828 - protein, 12 aa, Plasmodium falciparum
SFKGQGPTDNVS

SEQ ID NO: 3246829 - protein, 13 aa, Plasmodium falciparum
SFKGTNKKENDIC

SEQ ID NO: 3246830 - protein, 4 aa, Plasmodium falciparum
SFKK

SEQ ID NO: 3246831 - protein, 10 aa, Plasmodium falciparum
SFKKDRDNEI

SEQ ID NO: 3246832 - protein, 4 aa, Plasmodium falciparum
SFND

SEQ ID NO: 3246833 - protein, 8 aa, Plasmodium falciparum
SFNDESTN

SEQ ID NO: 3246834 - protein, 7 aa, Plasmodium falciparum
SFNKDKN

SEQ ID NO: 3246835 - protein, 14 aa, Plasmodium falciparum
SFNNSSKFQRRSYL

SEQ ID NO: 3246836 - protein, 10 aa, Plasmodium falciparum
SFNPQQSETC

SEQ ID NO: 3246837 - protein, 4 aa, Plasmodium falciparum
SFNQ

SEQ ID NO: 3246838 - protein, 13 aa, Plasmodium falciparum
SFNVEEKDEEQST

SEQ ID NO: 3246839 - protein, 6 aa, Plasmodium falciparum
SFPDEN

SEQ ID NO: 3246840 - protein, 7 aa, Plasmodium falciparum
SFPTKGI

SEQ ID NO: 3246841 - protein, 7 aa, Plasmodium falciparum
SFQDDKN

SEQ ID NO: 3246842 - protein, 6 aa, Plasmodium falciparum
SFQNSR

SEQ ID NO: 3246843 - protein, 6 aa, Plasmodium falciparum
SFSAVK

SEQ ID NO: 3246844 - protein, 11 aa, Plasmodium falciparum
SFSKEYSNDSI

SEQ ID NO: 3246845 - protein, 4 aa, Plasmodium falciparum
SFSN

SEQ ID NO: 3246846 - protein, 5 aa, Plasmodium falciparum
SFSNN

SEQ ID NO: 3246847 - protein, 13 aa, Plasmodium falciparum
SFSQQNKEQEYNN

SEQ ID NO: 3246848 - protein, 8 aa, Plasmodium falciparum
SFSSDDDS

SEQ ID NO: 3246849 - protein, 5 aa, Plasmodium falciparum
SFSSE

SEQ ID NO: 3246850 - protein, 6 aa, Plasmodium falciparum
SFSSEE

SEQ ID NO: 3246851 - protein, 13 aa, Plasmodium falciparum
SFSSQNKERNKIK

SEQ ID NO: 3246852 - protein, 6 aa, Plasmodium falciparum
SFSSSF

SEQ ID NO: 3246853 - protein, 18 aa, Plasmodium falciparum
SFSSSRNDTFDGKNLNTS

SEQ ID NO: 3246854 - protein, 16 aa, Plasmodium falciparum
SFSSSSQKENLTSSSE

SEQ ID NO: 3246855 - protein, 5 aa, Plasmodium falciparum
SFTAY

SEQ ID NO: 3246856 - protein, 8 aa, Plasmodium falciparum
SFTDENES

SEQ ID NO: 3246857 - protein, 17 aa, Plasmodium falciparum
SFVPQNEVSSKNKKKYI

SEQ ID NO: 3246858 - protein, 6 aa, Plasmodium falciparum
SFYTSG

SEQ ID NO: 3246859 - protein, 23 aa, Plasmodium falciparum
SGAGGGPELTGSGSDDPNDPNNI

SEQ ID NO: 3246860 - protein, 7 aa, Plasmodium falciparum
SGAPISP

SEQ ID NO: 3246861 - protein, 7 aa, Plasmodium falciparum
SGAPSIK

SEQ ID NO: 3246862 - protein, 5 aa, Plasmodium falciparum
SGCAG

SEQ ID NO: 3246863 - protein, 8 aa, Plasmodium falciparum
SGCGDITS

SEQ ID NO: 3246864 - protein, 6 aa, Plasmodium falciparum
SGCGKS

SEQ ID NO: 3246865 - protein, 24 aa, Plasmodium falciparum
SGCLRSGENETNVKSSSSQTDSVL

SEQ ID NO: 3246866 - protein, 34 aa, Plasmodium falciparum
SGCTNGCANGYTNGYTNRYTKGCTKGCTNEYSND

SEQ ID NO: 3246867 - protein, 5 aa, Plasmodium falciparum
SGDEN

SEQ ID NO: 3246868 - protein, 9 aa, Plasmodium falciparum
SGDEPTEIG

SEQ ID NO: 3246869 - protein, 21 aa, Plasmodium falciparum
SGDGMNAGNYSSALQDNSTEI

SEQ ID NO: 3246870 - protein, 9 aa, Plasmodium falciparum
SGDGQTEIE

SEQ ID NO: 3246871 - protein, 6 aa, Plasmodium falciparum
SGDGYD

SEQ ID NO: 3246872 - protein, 6 aa, Plasmodium falciparum
SGDHKD

SEQ ID NO: 3246873 - protein, 6 aa, Plasmodium falciparum
SGDHLN

SEQ ID NO: 3246874 - protein, 5 aa, Plasmodium falciparum
SGDKK

SEQ ID NO: 3246875 - protein, 9 aa, Plasmodium falciparum
SGDKQDEMK

SEQ ID NO: 3246876 - protein, 15 aa, Plasmodium falciparum
SGDKTAPSSDSNQGS

SEQ ID NO: 3246877 - protein, 42 aa, Plasmodium falciparum
SGDKTATSSGNGERPSRSKRGAEPTSDGVPTTGGKDGATGGS

SEQ ID NO: 3246878 - protein, 34 aa, Plasmodium falciparum
SGDKTDTRERAGRSRRDTSGENTTTGSSGDTNGS

SEQ ID NO: 3246879 - protein, 25 aa, Plasmodium falciparum
SGDKTDTSSESESPPRQRRDTTSGV

SEQ ID NO: 3246880 - protein, 7 aa, Plasmodium falciparum
SGDKTTN

SEQ ID NO: 3246881 - protein, 18 aa, Plasmodium falciparum
SGDKYTTDSQKSDTANEL

SEQ ID NO: 3246882 - protein, 12 aa, Plasmodium falciparum
SGDMQPEKEYYE

SEQ ID NO: 3246883 - protein, 9 aa, Plasmodium falciparum
SGDNEEKGI

SEQ ID NO: 3246884 - protein, 10 aa, Plasmodium falciparum
SGDNKMNGEN

SEQ ID NO: 3246885 - protein, 68 aa, Plasmodium falciparum
SGDNKNDDDKNDDNKNDDDKNDDDKNDDDKNDDDKNDDDKNDDDKNDDDDDNKNDNHNNNISSSSSSC

SEQ ID NO: 3246886 - protein, 21 aa, Plasmodium falciparum
SGDNNSVTNSSNINTARNNNS

SEQ ID NO: 3246887 - protein, 40 aa, Plasmodium falciparum
SGDNSTTREGSESGLRRSRRDADSQTPGEKTTPPSGTNQG

SEQ ID NO: 3246888 - protein, 39 aa, Plasmodium falciparum
SGDNSTTSSEGGDRGGQSRAKRAAPRESTTSSGDTTGGS

SEQ ID NO: 3246889 - protein, 32 aa, Plasmodium falciparum
SGDNTTTREGSGEATKSGATTGSGKDGATGGS

SEQ ID NO: 3246890 - protein, 10 aa, Plasmodium falciparum
SGDQNGNINK

SEQ ID NO: 3246891 - protein, 10 aa, Plasmodium falciparum
SGDSNKKSSF

SEQ ID NO: 3246892 - protein, 34 aa, Plasmodium falciparum
SGDSTTTSSVNGDRSQRHRRAAGEATGKSDASGS

SEQ ID NO: 3246893 - protein, 22 aa, Plasmodium falciparum
SGDTISGEQNPQSKLEKGEIPD

SEQ ID NO: 3246894 - protein, 9 aa, Plasmodium falciparum
SGEEEKDIE

SEQ ID NO: 3246895 - protein, 11 aa, Plasmodium falciparum
SGEEGQKNKCA

SEQ ID NO: 3246896 - protein, 6 aa, Plasmodium falciparum
SGEEHS

SEQ ID NO: 3246897 - protein, 10 aa, Plasmodium falciparum
SGEGEKEIKE

SEQ ID NO: 3246898 - protein, 9 aa, Plasmodium falciparum
SGEGETEIE

SEQ ID NO: 3246899 - protein, 9 aa, Plasmodium falciparum
SGEGETEIK

SEQ ID NO: 3246900 - protein, 9 aa, Plasmodium falciparum
SGEGHEDIE

SEQ ID NO: 3246901 - protein, 9 aa, Plasmodium falciparum
SGEGKEEIK

SEQ ID NO: 3246902 - protein, 5 aa, Plasmodium falciparum
SGEIE

SEQ ID NO: 3246903 - protein, 9 aa, Plasmodium falciparum
SGEKHDDIK

SEQ ID NO: 3246904 - protein, 18 aa, Plasmodium falciparum
SGEKNAIKKYKGDKVYAG

SEQ ID NO: 3246905 - protein, 5 aa, Plasmodium falciparum
SGELE

SEQ ID NO: 3246906 - protein, 23 aa, Plasmodium falciparum
SGEMEEKDRKKKKKNKNKNNDIN

SEQ ID NO: 3246907 - protein, 20 aa, Plasmodium falciparum
SGENCDPNGDISKGKDRYIQ

SEQ ID NO: 3246908 - protein, 9 aa, Plasmodium falciparum
SGENHDDIE

SEQ ID NO: 3246909 - protein, 9 aa, Plasmodium falciparum
SGENHDDIK

SEQ ID NO: 3246910 - protein, 13 aa, Plasmodium falciparum
SGENMQKKDEKNI

SEQ ID NO: 3246911 - protein, 14 aa, Plasmodium falciparum
SGENYNNDDDDNYL

SEQ ID NO: 3246912 - protein, 6 aa, Plasmodium falciparum
SGEQGK

SEQ ID NO: 3246913 - protein, 5 aa, Plasmodium falciparum
SGEQR

SEQ ID NO: 3246914 - protein, 4 aa, Plasmodium falciparum
SGER

SEQ ID NO: 3246915 - protein, 9 aa, Plasmodium falciparum
SGESLENNE

SEQ ID NO: 3246916 - protein, 15 aa, Plasmodium falciparum
SGESYSSTKEVETCE

SEQ ID NO: 3246917 - protein, 7 aa, Plasmodium falciparum
SGETPSS

SEQ ID NO: 3246918 - protein, 7 aa, Plasmodium falciparum
SGEYKGK

SEQ ID NO: 3246919 - protein, 4 aa, Plasmodium falciparum
SGGA

SEQ ID NO: 3246920 - protein, 18 aa, Plasmodium falciparum
SGGAESAAAFGEETASAE

SEQ ID NO: 3246921 - protein, 11 aa, Plasmodium falciparum
SGGALKKTTSK

SEQ ID NO: 3246922 - protein, 8 aa, Plasmodium falciparum
SGGDSSHD

SEQ ID NO: 3246923 - protein, 9 aa, Plasmodium falciparum
SGGEAEGAR

SEQ ID NO: 3246924 - protein, 18 aa, Plasmodium falciparum
SGGECDEKKIKGSNGGAC

SEQ ID NO: 3246925 - protein, 7 aa, Plasmodium falciparum
SGGEEDA

SEQ ID NO: 3246926 - protein, 9 aa, Plasmodium falciparum
SGGENKTTI

SEQ ID NO: 3246927 - protein, 10 aa, Plasmodium falciparum
SGGKTPTQGK

SEQ ID NO: 3246928 - protein, 8 aa, Plasmodium falciparum
SGGPIGNT

SEQ ID NO: 3246929 - protein, 7 aa, Plasmodium falciparum
SGGQRKR

SEQ ID NO: 3246930 - protein, 8 aa, Plasmodium falciparum
SGGQTGKN

SEQ ID NO: 3246931 - protein, 6 aa, Plasmodium falciparum
SGGRSI

SEQ ID NO: 3246932 - protein, 9 aa, Plasmodium falciparum
SGGSSFGNL

SEQ ID NO: 3246933 - protein, 7 aa, Plasmodium falciparum
SGGTGWE

SEQ ID NO: 3246934 - protein, 4 aa, Plasmodium falciparum
SGHI

SEQ ID NO: 3246935 - protein, 7 aa, Plasmodium falciparum
SGHNNTK

SEQ ID NO: 3246936 - protein, 10 aa, Plasmodium falciparum
SGHNQSEHTL

SEQ ID NO: 3246937 - protein, 6 aa, Plasmodium falciparum
SGIASV

SEQ ID NO: 3246938 - protein, 4 aa, Plasmodium falciparum
SGIG

SEQ ID NO: 3246939 - protein, 117 aa, Plasmodium falciparum
SGIGNNMDDNNISGENNMSRENNMSRENNMSRENNMSSENNMSSENNMSSENNMSSENNMSSENNMSSENNISGENNISGENNISGENNISGENNISGENNISGENNMSRENNMSRE

SEQ ID NO: 3246940 - protein, 6 aa, Plasmodium falciparum
SGIHGK

SEQ ID NO: 3246941 - protein, 73 aa, Plasmodium falciparum
SGIKKKNTKKKEKKNKKLNEECKENMDEESKEKIDEEKKEKIDEEKKEKIDEEKKEKTNEEKKDKINEEKNNK

SEQ ID NO: 3246942 - protein, 5 aa, Plasmodium falciparum
SGIPT

SEQ ID NO: 3246943 - protein, 10 aa, Plasmodium falciparum
SGKAFSQKNE

SEQ ID NO: 3246944 - protein, 34 aa, Plasmodium falciparum
SGKEDVSVSAEKKEISKREMSSNDNVNNNEKKKG

SEQ ID NO: 3246945 - protein, 17 aa, Plasmodium falciparum
SGKEEDVRKPKQRNIRS

SEQ ID NO: 3246946 - protein, 9 aa, Plasmodium falciparum
SGKEKASIK

SEQ ID NO: 3246947 - protein, 9 aa, Plasmodium falciparum
SGKETNENI

SEQ ID NO: 3246948 - protein, 4 aa, Plasmodium falciparum
SGKF

SEQ ID NO: 3246949 - protein, 9 aa, Plasmodium falciparum
SGKGHKDIE

SEQ ID NO: 3246950 - protein, 8 aa, Plasmodium falciparum
SGKGKCTS

SEQ ID NO: 3246951 - protein, 14 aa, Plasmodium falciparum
SGKHSSGGDGNKTF

SEQ ID NO: 3246952 - protein, 4 aa, Plasmodium falciparum
SGKK

SEQ ID NO: 3246953 - protein, 11 aa, Plasmodium falciparum
SGKKGKRKSLP

SEQ ID NO: 3246954 - protein, 5 aa, Plasmodium falciparum
SGKKI

SEQ ID NO: 3246955 - protein, 22 aa, Plasmodium falciparum
SGKKKNIKNNNKTDNENNYEDD

SEQ ID NO: 3246956 - protein, 17 aa, Plasmodium falciparum
SGKKSRESSEEDTDCGR

SEQ ID NO: 3246957 - protein, 9 aa, Plasmodium falciparum
SGKMGENRF

SEQ ID NO: 3246958 - protein, 9 aa, Plasmodium falciparum
SGKNENLEN

SEQ ID NO: 3246959 - protein, 7 aa, Plasmodium falciparum
SGKNLGN

SEQ ID NO: 3246960 - protein, 7 aa, Plasmodium falciparum
SGKNNHK

SEQ ID NO: 3246961 - protein, 8 aa, Plasmodium falciparum
SGKNNYKY

SEQ ID NO: 3246962 - protein, 12 aa, Plasmodium falciparum
SGKNTPQNEKYQ

SEQ ID NO: 3246963 - protein, 5 aa, Plasmodium falciparum
SGKNY

SEQ ID NO: 3246964 - protein, 7 aa, Plasmodium falciparum
SGKNYPD

SEQ ID NO: 3246965 - protein, 6 aa, Plasmodium falciparum
SGKPNI

SEQ ID NO: 3246966 - protein, 7 aa, Plasmodium falciparum
SGKQPMG

SEQ ID NO: 3246967 - protein, 5 aa, Plasmodium falciparum
SGKRE

SEQ ID NO: 3246968 - protein, 27 aa, Plasmodium falciparum
SGKRKEEKSRDKDKHKDKEKKPSDISE

SEQ ID NO: 3246969 - protein, 19 aa, Plasmodium falciparum
SGKSDIGFEERTDAGIAGK

SEQ ID NO: 3246970 - protein, 6 aa, Plasmodium falciparum
SGKSLS

SEQ ID NO: 3246971 - protein, 6 aa, Plasmodium falciparum
SGKSQI

SEQ ID NO: 3246972 - protein, 48 aa, Plasmodium falciparum
SGKSSNNFSSQTYSNSTSQYTNKQTTQKDKKKDTSSNKSNKQTNRKPT

SEQ ID NO: 3246973 - protein, 9 aa, Plasmodium falciparum
SGKVSSTYE

SEQ ID NO: 3246974 - protein, 7 aa, Plasmodium falciparum
SGKYRGK

SEQ ID NO: 3246975 - protein, 13 aa, Plasmodium falciparum
SGLGGTTTNDEAY

SEQ ID NO: 3246976 - protein, 8 aa, Plasmodium falciparum
SGLKGTYG

SEQ ID NO: 3246977 - protein, 14 aa, Plasmodium falciparum
SGLNNDGNNIRNNT

SEQ ID NO: 3246978 - protein, 10 aa, Plasmodium falciparum
SGLQGTTASH

SEQ ID NO: 3246979 - protein, 5 aa, Plasmodium falciparum
SGLRS

SEQ ID NO: 3246980 - protein, 11 aa, Plasmodium falciparum
SGLSEKKNNAL

SEQ ID NO: 3246981 - protein, 7 aa, Plasmodium falciparum
SGLTGPN

SEQ ID NO: 3246982 - protein, 13 aa, Plasmodium falciparum
SGMYGTKSNYNNK

SEQ ID NO: 3246983 - protein, 12 aa, Plasmodium falciparum
SGNCSSNSKCKQ

SEQ ID NO: 3246984 - protein, 17 aa, Plasmodium falciparum
SGNDKLKHDKNDHMNKT

SEQ ID NO: 3246985 - protein, 5 aa, Plasmodium falciparum
SGNEK

SEQ ID NO: 3246986 - protein, 5 aa, Plasmodium falciparum
SGNET

SEQ ID NO: 3246987 - protein, 26 aa, Plasmodium falciparum
SGNGTTSSEGRSPRVARSAPSGDKDG

SEQ ID NO: 3246988 - protein, 5 aa, Plasmodium falciparum
SGNGY

SEQ ID NO: 3246989 - protein, 22 aa, Plasmodium falciparum
SGNHNNNNINNDHNDNHNSSNN

SEQ ID NO: 3246990 - protein, 12 aa, Plasmodium falciparum
SGNKDEKQKMEK

SEQ ID NO: 3246991 - protein, 8 aa, Plasmodium falciparum
SGNKEDME

SEQ ID NO: 3246992 - protein, 12 aa, Plasmodium falciparum
SGNKNPENPKNI

SEQ ID NO: 3246993 - protein, 9 aa, Plasmodium falciparum
SGNKQDMDK

SEQ ID NO: 3246994 - protein, 7 aa, Plasmodium falciparum
SGNKQKE

SEQ ID NO: 3246995 - protein, 11 aa, Plasmodium falciparum
SGNKSNDNDIS

SEQ ID NO: 3246996 - protein, 6 aa, Plasmodium falciparum
SGNMSG

SEQ ID NO: 3246997 - protein, 4 aa, Plasmodium falciparum
SGNN

SEQ ID NO: 3246998 - protein, 18 aa, Plasmodium falciparum
SGNNNNNNKTLGKSEISG

SEQ ID NO: 3246999 - protein, 5 aa, Plasmodium falciparum
SGNNS

SEQ ID NO: 3247000 - protein, 9 aa, Plasmodium falciparum
SGNNSTTLE

SEQ ID NO: 3247001 - protein, 5 aa, Plasmodium falciparum
SGNNY

SEQ ID NO: 3247002 - protein, 7 aa, Plasmodium falciparum
SGNPGDY

SEQ ID NO: 3247003 - protein, 8 aa, Plasmodium falciparum
SGNREEND

SEQ ID NO: 3247004 - protein, 8 aa, Plasmodium falciparum
SGNRPIGS

SEQ ID NO: 3247005 - protein, 5 aa, Plasmodium falciparum
SGNST

SEQ ID NO: 3247006 - protein, 6 aa, Plasmodium falciparum
SGNVQS

SEQ ID NO: 3247007 - protein, 7 aa, Plasmodium falciparum
SGNYNDD

SEQ ID NO: 3247008 - protein, 17 aa, Plasmodium falciparum
SGPCKKENGKDNQEDEI

SEQ ID NO: 3247009 - protein, 14 aa, Plasmodium falciparum
SGPCKNESGEGPIK

SEQ ID NO: 3247010 - protein, 27 aa, Plasmodium falciparum
SGPCKNNENVEDNGKDKLDFSKPNETF

SEQ ID NO: 3247011 - protein, 9 aa, Plasmodium falciparum
SGPGKCNRK

SEQ ID NO: 3247012 - protein, 6 aa, Plasmodium falciparum
SGPISE

SEQ ID NO: 3247013 - protein, 16 aa, Plasmodium falciparum
SGPNGMTNINNNDDNN

SEQ ID NO: 3247014 - protein, 44 aa, Plasmodium falciparum
SGPPNNTNNNDDNNTNNNDDNNTNNNDDNNTNNNDDDDNNNNNC

SEQ ID NO: 3247015 - protein, 7 aa, Plasmodium falciparum
SGPSIVK

SEQ ID NO: 3247016 - protein, 7 aa, Plasmodium falciparum
SGPSPLY

SEQ ID NO: 3247017 - protein, 9 aa, Plasmodium falciparum
SGPSSQNID

SEQ ID NO: 3247018 - protein, 39 aa, Plasmodium falciparum
SGPSTVDGEQQPQDPSVVPRAGADHESSGSPGSQNNYSS

SEQ ID NO: 3247019 - protein, 8 aa, Plasmodium falciparum
SGQAPVSE

SEQ ID NO: 3247020 - protein, 10 aa, Plasmodium falciparum
SGQIKNQGSI

SEQ ID NO: 3247021 - protein, 8 aa, Plasmodium falciparum
SGQKAEIQ

SEQ ID NO: 3247022 - protein, 7 aa, Plasmodium falciparum
SGQYKGK

SEQ ID NO: 3247023 - protein, 6 aa, Plasmodium falciparum
SGQYNG

SEQ ID NO: 3247024 - protein, 11 aa, Plasmodium falciparum
SGRDNKNMKEK

SEQ ID NO: 3247025 - protein, 48 aa, Plasmodium falciparum
SGRGGVTARGDPCGKDGTGKEHRFSKERGAECDKNKISGSNDNEGACA

SEQ ID NO: 3247026 - protein, 11 aa, Plasmodium falciparum
SGRRSDNYSYE

SEQ ID NO: 3247027 - protein, 6 aa, Plasmodium falciparum
SGRSGY

SEQ ID NO: 3247028 - protein, 7 aa, Plasmodium falciparum
SGSASPV

SEQ ID NO: 3247029 - protein, 9 aa, Plasmodium falciparum
SGSDNPPTL

SEQ ID NO: 3247030 - protein, 39 aa, Plasmodium falciparum
SGSDTGSTTKQNDSEGSEGGHRSKRHTESSDSTTTSSGS

SEQ ID NO: 3247031 - protein, 5 aa, Plasmodium falciparum
SGSEF

SEQ ID NO: 3247032 - protein, 4 aa, Plasmodium falciparum
SGSF

SEQ ID NO: 3247033 - protein, 13 aa, Plasmodium falciparum
SGSGSGVAARGHP

SEQ ID NO: 3247034 - protein, 6 aa, Plasmodium falciparum
SGSGSS

SEQ ID NO: 3247035 - protein, 4 aa, Plasmodium falciparum
SGSI

SEQ ID NO: 3247036 - protein, 6 aa, Plasmodium falciparum
SGSKDM

SEQ ID NO: 3247037 - protein, 14 aa, Plasmodium falciparum
SGSMSQGKSGMKNS

SEQ ID NO: 3247038 - protein, 14 aa, Plasmodium falciparum
SGSNDDNTKSSTYN

SEQ ID NO: 3247039 - protein, 13 aa, Plasmodium falciparum
SGSNDNTKSSTYN

SEQ ID NO: 3247040 - protein, 19 aa, Plasmodium falciparum
SGSNNYYNETQTSLQNEEN

SEQ ID NO: 3247041 - protein, 4 aa, Plasmodium falciparum
SGSS

SEQ ID NO: 3247042 - protein, 11 aa, Plasmodium falciparum
SGSSAKDVAKQ

SEQ ID NO: 3247043 - protein, 7 aa, Plasmodium falciparum
SGSSASS

SEQ ID NO: 3247044 - protein, 17 aa, Plasmodium falciparum
SGSSGSTKEETQIPTSG

SEQ ID NO: 3247045 - protein, 6 aa, Plasmodium falciparum
SGSSLA

SEQ ID NO: 3247046 - protein, 4 aa, Plasmodium falciparum
SGSY

SEQ ID NO: 3247047 - protein, 7 aa, Plasmodium falciparum
SGSYKGK

SEQ ID NO: 3247048 - protein, 6 aa, Plasmodium falciparum
SGSYNN

SEQ ID NO: 3247049 - protein, 5 aa, Plasmodium falciparum
SGTCI

SEQ ID NO: 3247050 - protein, 5 aa, Plasmodium falciparum
SGTEF

SEQ ID NO: 3247051 - protein, 4 aa, Plasmodium falciparum
SGTF

SEQ ID NO: 3247052 - protein, 9 aa, Plasmodium falciparum
SGTHQRDGY

SEQ ID NO: 3247053 - protein, 67 aa, Plasmodium falciparum
SGTKINSKNNDKSDDKNDDKNDKKNDGKNDKNDEKDDNKTGEKGDNKIGEKDDNKINEKDDNKINDK

SEQ ID NO: 3247054 - protein, 9 aa, Plasmodium falciparum
SGTLGTKGN

SEQ ID NO: 3247055 - protein, 6 aa, Plasmodium falciparum
SGTLPK

SEQ ID NO: 3247056 - protein, 7 aa, Plasmodium falciparum
SGTNASD

SEQ ID NO: 3247057 - protein, 5 aa, Plasmodium falciparum
SGTPH

SEQ ID NO: 3247058 - protein, 7 aa, Plasmodium falciparum
SGTSNDI

SEQ ID NO: 3247059 - protein, 5 aa, Plasmodium falciparum
SGTTD

SEQ ID NO: 3247060 - protein, 38 aa, Plasmodium falciparum
SGTTGSTPMGTLTTPNSTTTATTGLTGTGVGGTSGTSN

SEQ ID NO: 3247061 - protein, 5 aa, Plasmodium falciparum
SGTTK

SEQ ID NO: 3247062 - protein, 6 aa, Plasmodium falciparum
SGTTSK

SEQ ID NO: 3247063 - protein, 7 aa, Plasmodium falciparum
SGTYKGK

SEQ ID NO: 3247064 - protein, 9 aa, Plasmodium falciparum
SGVDEENKN

SEQ ID NO: 3247065 - protein, 12 aa, Plasmodium falciparum
SGVKNKENDNNG

SEQ ID NO: 3247066 - protein, 4 aa, Plasmodium falciparum
SGVL

SEQ ID NO: 3247067 - protein, 6 aa, Plasmodium falciparum
SGVPEA

SEQ ID NO: 3247068 - protein, 7 aa, Plasmodium falciparum
SGVSYSG

SEQ ID NO: 3247069 - protein, 5 aa, Plasmodium falciparum
SGVTS

SEQ ID NO: 3247070 - protein, 10 aa, Plasmodium falciparum
SGVTSQNDNI

SEQ ID NO: 3247071 - protein, 4 aa, Plasmodium falciparum
SGYD

SEQ ID NO: 3247072 - protein, 17 aa, Plasmodium falciparum
SGYGENCDDQLKDNPSI

SEQ ID NO: 3247073 - protein, 9 aa, Plasmodium falciparum
SGYGKPEDI

SEQ ID NO: 3247074 - protein, 12 aa, Plasmodium falciparum
SGYGNVKETEGI

SEQ ID NO: 3247075 - protein, 4 aa, Plasmodium falciparum
SGYP

SEQ ID NO: 3247076 - protein, 22 aa, Plasmodium falciparum
SGYSSLDESSDDNTSDNTNNDN

SEQ ID NO: 3247077 - protein, 14 aa, Plasmodium falciparum
SHCEEDPDKGVSKN

SEQ ID NO: 3247078 - protein, 9 aa, Plasmodium falciparum
SHDDDNDWN

SEQ ID NO: 3247079 - protein, 12 aa, Plasmodium falciparum
SHDEDNTKQELQ

SEQ ID NO: 3247080 - protein, 9 aa, Plasmodium falciparum
SHDEEKGKY

SEQ ID NO: 3247081 - protein, 11 aa, Plasmodium falciparum
SHDGPSVRDMD

SEQ ID NO: 3247082 - protein, 13 aa, Plasmodium falciparum
SHDIDNNNKTYED

SEQ ID NO: 3247083 - protein, 9 aa, Plasmodium falciparum
SHDSAKEEK

SEQ ID NO: 3247084 - protein, 28 aa, Plasmodium falciparum
SHDSLQNKRKKNKHLSLGTNDEKEYLIK

SEQ ID NO: 3247085 - protein, 8 aa, Plasmodium falciparum
SHEENKNE

SEQ ID NO: 3247086 - protein, 9 aa, Plasmodium falciparum
SHENQNGDV

SEQ ID NO: 3247087 - protein, 6 aa, Plasmodium falciparum
SHERNT

SEQ ID NO: 3247088 - protein, 10 aa, Plasmodium falciparum
SHEVKRDKGV

SEQ ID NO: 3247089 - protein, 6 aa, Plasmodium falciparum
SHFSSD

SEQ ID NO: 3247090 - protein, 9 aa, Plasmodium falciparum
SHGHTGKGI

SEQ ID NO: 3247091 - protein, 6 aa, Plasmodium falciparum
SHGKKM

SEQ ID NO: 3247092 - protein, 8 aa, Plasmodium falciparum
SHIEKKEP

SEQ ID NO: 3247093 - protein, 5 aa, Plasmodium falciparum
SHINS

SEQ ID NO: 3247094 - protein, 5 aa, Plasmodium falciparum
SHKDN

SEQ ID NO: 3247095 - protein, 10 aa, Plasmodium falciparum
SHKEGEQNVQ

SEQ ID NO: 3247096 - protein, 9 aa, Plasmodium falciparum
SHKEGGNNY

SEQ ID NO: 3247097 - protein, 31 aa, Plasmodium falciparum
SHKETSSIQNKGKEKSNNNIKSDDNNNNNDN

SEQ ID NO: 3247098 - protein, 5 aa, Plasmodium falciparum
SHKEY

SEQ ID NO: 3247099 - protein, 6 aa, Plasmodium falciparum
SHKGTR

SEQ ID NO: 3247100 - protein, 16 aa, Plasmodium falciparum
SHKIKSRQNEMNEQKS

SEQ ID NO: 3247101 - protein, 4 aa, Plasmodium falciparum
SHKN

SEQ ID NO: 3247102 - protein, 9 aa, Plasmodium falciparum
SHKNDNQNL

SEQ ID NO: 3247103 - protein, 7 aa, Plasmodium falciparum
SHKQHNN

SEQ ID NO: 3247104 - protein, 14 aa, Plasmodium falciparum
SHLDNTKNKTGKGL

SEQ ID NO: 3247105 - protein, 10 aa, Plasmodium falciparum
SHNDTQENNI

SEQ ID NO: 3247106 - protein, 8 aa, Plasmodium falciparum
SHNMTQDG

SEQ ID NO: 3247107 - protein, 6 aa, Plasmodium falciparum
SHNNLS

SEQ ID NO: 3247108 - protein, 5 aa, Plasmodium falciparum
SHNNN

SEQ ID NO: 3247109 - protein, 12 aa, Plasmodium falciparum
SHNNNNNNNKTE

SEQ ID NO: 3247110 - protein, 22 aa, Plasmodium falciparum
SHNNNTNNNNNNNNKDKEKENL

SEQ ID NO: 3247111 - protein, 6 aa, Plasmodium falciparum
SHNNTD

SEQ ID NO: 3247112 - protein, 14 aa, Plasmodium falciparum
SHNNYRNDCSTSSS

SEQ ID NO: 3247113 - protein, 20 aa, Plasmodium falciparum
SHNQDVNQSHNQDVNQTHNQ

SEQ ID NO: 3247114 - protein, 11 aa, Plasmodium falciparum
SHNVNDSELST

SEQ ID NO: 3247115 - protein, 34 aa, Plasmodium falciparum
SHNYDNEEITHEQKNNFNKNKNTKRYRKSINDKE

SEQ ID NO: 3247116 - protein, 10 aa, Plasmodium falciparum
SHPTQTSETN

SEQ ID NO: 3247117 - protein, 15 aa, Plasmodium falciparum
SHQNSNSNSNINEKD

SEQ ID NO: 3247118 - protein, 19 aa, Plasmodium falciparum
SHQSTYNAETKKRKSLTNT

SEQ ID NO: 3247119 - protein, 6 aa, Plasmodium falciparum
SHRDSQ

SEQ ID NO: 3247120 - protein, 21 aa, Plasmodium falciparum
SHSASSYDKINKKTEDNNINE

SEQ ID NO: 3247121 - protein, 17 aa, Plasmodium falciparum
SHSEQDQRKKKKKKKEK

SEQ ID NO: 3247122 - protein, 4 aa, Plasmodium falciparum
SHSG

SEQ ID NO: 3247123 - protein, 11 aa, Plasmodium falciparum
SHSIEQNSQNI

SEQ ID NO: 3247124 - protein, 56 aa, Plasmodium falciparum
SHSNSHSNSHSHSNSHSNSHSHSNSHSNSHSHSNSHSHSHSNSHSNSHSHSSTQNS

SEQ ID NO: 3247125 - protein, 17 aa, Plasmodium falciparum
SHSNSTNNSQKSTSNCT

SEQ ID NO: 3247126 - protein, 5 aa, Plasmodium falciparum
SHSSY

SEQ ID NO: 3247127 - protein, 10 aa, Plasmodium falciparum
SHSTSSTNVE

SEQ ID NO: 3247128 - protein, 9 aa, Plasmodium falciparum
SHTPTTTSR

SEQ ID NO: 3247129 - protein, 7 aa, Plasmodium falciparum
SHTQNEK

SEQ ID NO: 3247130 - protein, 16 aa, Plasmodium falciparum
SHTSSQQNDSSASGNK

SEQ ID NO: 3247131 - protein, 44 aa, Plasmodium falciparum
SHTTSETTGKSESATSSSGATTAPAPSLTSPQATASANSANSVS

SEQ ID NO: 3247132 - protein, 7 aa, Plasmodium falciparum
SHVNPSK

SEQ ID NO: 3247133 - protein, 11 aa, Plasmodium falciparum
SHYEESNKRAK

SEQ ID NO: 3247134 - protein, 5 aa, Plasmodium falciparum
SHYGQ

SEQ ID NO: 3247135 - protein, 6 aa, Plasmodium falciparum
SHYKSS

SEQ ID NO: 3247136 - protein, 16 aa, Plasmodium falciparum
SIDDEGDKNNKNKAKG

SEQ ID NO: 3247137 - protein, 10 aa, Plasmodium falciparum
SIDDNVDNNE

SEQ ID NO: 3247138 - protein, 13 aa, Plasmodium falciparum
SIDEDDKNDVENY

SEQ ID NO: 3247139 - protein, 5 aa, Plasmodium falciparum
SIDHN

SEQ ID NO: 3247140 - protein, 21 aa, Plasmodium falciparum
SIDKEINNNNVKNKKQKECIN

SEQ ID NO: 3247141 - protein, 11 aa, Plasmodium falciparum
SIDKSGIEKKK

SEQ ID NO: 3247142 - protein, 10 aa, Plasmodium falciparum
SIDQNTKGTV

SEQ ID NO: 3247143 - protein, 10 aa, Plasmodium falciparum
SIDSTSPSIN

SEQ ID NO: 3247144 - protein, 10 aa, Plasmodium falciparum
SIDTKGKKKI

SEQ ID NO: 3247145 - protein, 7 aa, Plasmodium falciparum
SIDVDSN

SEQ ID NO: 3247146 - protein, 72 aa, Plasmodium falciparum
SIEDDNKGGDNKGGDNKGGDKKGGDNKGGDKKGDDKKGDDNKDDDNDDDDDDDDNDDDDDDESTISYSKSDL

SEQ ID NO: 3247147 - protein, 12 aa, Plasmodium falciparum
SIEEQESNTFNT

SEQ ID NO: 3247148 - protein, 16 aa, Plasmodium falciparum
SIEKNDCNKNMNEYKS

SEQ ID NO: 3247149 - protein, 9 aa, Plasmodium falciparum
SIEKNRDNL

SEQ ID NO: 3247150 - protein, 4 aa, Plasmodium falciparum
SIEN

SEQ ID NO: 3247151 - protein, 5 aa, Plasmodium falciparum
SIEPS

SEQ ID NO: 3247152 - protein, 5 aa, Plasmodium falciparum
SIESY

SEQ ID NO: 3247153 - protein, 7 aa, Plasmodium falciparum
SIETNCS

SEQ ID NO: 3247154 - protein, 5 aa, Plasmodium falciparum
SIGGK

SEQ ID NO: 3247155 - protein, 5 aa, Plasmodium falciparum
SIGGV

SEQ ID NO: 3247156 - protein, 31 aa, Plasmodium falciparum
SIGNGKASSSSNFSSSNDNNNNNNNNNNNNS

SEQ ID NO: 3247157 - protein, 7 aa, Plasmodium falciparum
SIGNSQK

SEQ ID NO: 3247158 - protein, 5 aa, Plasmodium falciparum
SIGPG

SEQ ID NO: 3247159 - protein, 12 aa, Plasmodium falciparum
SIGSNEEIKNEY

SEQ ID NO: 3247160 - protein, 4 aa, Plasmodium falciparum
SIGY

SEQ ID NO: 3247161 - protein, 6 aa, Plasmodium falciparum
SIHNNN

SEQ ID NO: 3247162 - protein, 9 aa, Plasmodium falciparum
SIHSNNNNN

SEQ ID NO: 3247163 - protein, 10 aa, Plasmodium falciparum
SIKDREEKLE

SEQ ID NO: 3247164 - protein, 4 aa, Plasmodium falciparum
SIKE

SEQ ID NO: 3247165 - protein, 8 aa, Plasmodium falciparum
SIKEKDDQ

SEQ ID NO: 3247166 - protein, 19 aa, Plasmodium falciparum
SIKKGKEQNGSLQKNEDKE

SEQ ID NO: 3247167 - protein, 14 aa, Plasmodium falciparum
SIKKKKKQIKNEEY

SEQ ID NO: 3247168 - protein, 8 aa, Plasmodium falciparum
SIKKPKRN

SEQ ID NO: 3247169 - protein, 17 aa, Plasmodium falciparum
SIKKSADKKDKSKKDIK

SEQ ID NO: 3247170 - protein, 11 aa, Plasmodium falciparum
SIKNDKEHKNK

SEQ ID NO: 3247171 - protein, 5 aa, Plasmodium falciparum
SIKNE

SEQ ID NO: 3247172 - protein, 11 aa, Plasmodium falciparum
SIKNKKEYLED

SEQ ID NO: 3247173 - protein, 8 aa, Plasmodium falciparum
SIKNNNDR

SEQ ID NO: 3247174 - protein, 9 aa, Plasmodium falciparum
SIKNNSIEQ

SEQ ID NO: 3247175 - protein, 11 aa, Plasmodium falciparum
SIKNSKNTYKK

SEQ ID NO: 3247176 - protein, 14 aa, Plasmodium falciparum
SIKRKKKSKENDQF

SEQ ID NO: 3247177 - protein, 5 aa, Plasmodium falciparum
SIKSN

SEQ ID NO: 3247178 - protein, 4 aa, Plasmodium falciparum
SILS

SEQ ID NO: 3247179 - protein, 8 aa, Plasmodium falciparum
SINDSTKL

SEQ ID NO: 3247180 - protein, 14 aa, Plasmodium falciparum
SINEEKDERNDKRD

SEQ ID NO: 3247181 - protein, 13 aa, Plasmodium falciparum
SINGKRKHDELEQ

SEQ ID NO: 3247182 - protein, 4 aa, Plasmodium falciparum
SINK

SEQ ID NO: 3247183 - protein, 9 aa, Plasmodium falciparum
SINKSSSSE

SEQ ID NO: 3247184 - protein, 6 aa, Plasmodium falciparum
SINNED

SEQ ID NO: 3247185 - protein, 17 aa, Plasmodium falciparum
SINNNNDNNNNINNKKE

SEQ ID NO: 3247186 - protein, 13 aa, Plasmodium falciparum
SINNNNNNSNNNS

SEQ ID NO: 3247187 - protein, 12 aa, Plasmodium falciparum
SINNSKNSYEQY

SEQ ID NO: 3247188 - protein, 13 aa, Plasmodium falciparum
SINNSNNNNYIND

SEQ ID NO: 3247189 - protein, 10 aa, Plasmodium falciparum
SINNTYKNSI

SEQ ID NO: 3247190 - protein, 23 aa, Plasmodium falciparum
SINRNNNNNNNNNNNNSNNNNNC

SEQ ID NO: 3247191 - protein, 28 aa, Plasmodium falciparum
SINSDNKNNSYNNNNNNNIQTSNNTGRK

SEQ ID NO: 3247192 - protein, 10 aa, Plasmodium falciparum
SINSTKHNNN

SEQ ID NO: 3247193 - protein, 40 aa, Plasmodium falciparum
SINTNNSSSVPLGRGESVDEVASDGIARDYSTNTKHENGK

SEQ ID NO: 3247194 - protein, 4 aa, Plasmodium falciparum
SIPD

SEQ ID NO: 3247195 - protein, 5 aa, Plasmodium falciparum
SIPDN

SEQ ID NO: 3247196 - protein, 6 aa, Plasmodium falciparum
SIPPLD

SEQ ID NO: 3247197 - protein, 8 aa, Plasmodium falciparum
SIPSSEEN

SEQ ID NO: 3247198 - protein, 4 aa, Plasmodium falciparum
SIPT

SEQ ID NO: 3247199 - protein, 6 aa, Plasmodium falciparum
SIPYEN

SEQ ID NO: 3247200 - protein, 6 aa, Plasmodium falciparum
SIQENV

SEQ ID NO: 3247201 - protein, 8 aa, Plasmodium falciparum
SIQETTNT

SEQ ID NO: 3247202 - protein, 15 aa, Plasmodium falciparum
SIQKNENNNSTNHSN

SEQ ID NO: 3247203 - protein, 21 aa, Plasmodium falciparum
SIQKQAKDAAEKRSNGELQGD

SEQ ID NO: 3247204 - protein, 18 aa, Plasmodium falciparum
SIQSPPLPESLDEQPYTV

SEQ ID NO: 3247205 - protein, 18 aa, Plasmodium falciparum
SIQSSTSPQKKKKNNNLQ

SEQ ID NO: 3247206 - protein, 10 aa, Plasmodium falciparum
SIRDNSNDEQ

SEQ ID NO: 3247207 - protein, 4 aa, Plasmodium falciparum
SIRS

SEQ ID NO: 3247208 - protein, 5 aa, Plasmodium falciparum
SISDV

SEQ ID NO: 3247209 - protein, 6 aa, Plasmodium falciparum
SISGNQ

SEQ ID NO: 3247210 - protein, 7 aa, Plasmodium falciparum
SISGTKP

SEQ ID NO: 3247211 - protein, 12 aa, Plasmodium falciparum
SISNDLEKRTEE

SEQ ID NO: 3247212 - protein, 73 aa, Plasmodium falciparum
SISNKASVKDEGQNNNSNKSNNNNNNNNNNNNNNNNNNNNNNNNNNNNNNNNNNNNNNNNNNNNNNTSGLSVK

SEQ ID NO: 3247213 - protein, 26 aa, Plasmodium falciparum
SISNNNKYDKKKDEENVQKNNEDVGL

SEQ ID NO: 3247214 - protein, 7 aa, Plasmodium falciparum
SISNNRN

SEQ ID NO: 3247215 - protein, 5 aa, Plasmodium falciparum
SISNQ

SEQ ID NO: 3247216 - protein, 16 aa, Plasmodium falciparum
SISNQYSNKRLSRNSL

SEQ ID NO: 3247217 - protein, 25 aa, Plasmodium falciparum
SISNSNIDSPSNNNNNNNNNNHGKQ

SEQ ID NO: 3247218 - protein, 108 aa, Plasmodium falciparum
SISNSNKSNNNERDYYNNNERNYYNNNERDYYNNNERDYYNNNERDYYNNNERDYHNNNERDYHNNNKSNYHNNNKSNYHNNNKSNYHNNNKSNYHNNNKSNYHNSSI

SEQ ID NO: 3247219 - protein, 9 aa, Plasmodium falciparum
SISQENDDC

SEQ ID NO: 3247220 - protein, 4 aa, Plasmodium falciparum
SISS

SEQ ID NO: 3247221 - protein, 10 aa, Plasmodium falciparum
SISSSAYSQE

SEQ ID NO: 3247222 - protein, 15 aa, Plasmodium falciparum
SISSSNKENLKNENY

SEQ ID NO: 3247223 - protein, 6 aa, Plasmodium falciparum
SISSSQ

SEQ ID NO: 3247224 - protein, 13 aa, Plasmodium falciparum
SISSSSSNDETNI

SEQ ID NO: 3247225 - protein, 4 aa, Plasmodium falciparum
SIST

SEQ ID NO: 3247226 - protein, 5 aa, Plasmodium falciparum
SITEE

SEQ ID NO: 3247227 - protein, 15 aa, Plasmodium falciparum
SITEEALEKEGSVSE

SEQ ID NO: 3247228 - protein, 43 aa, Plasmodium falciparum
SITKGDSEAEAGGNDSRNTSEKAVSSSNDDNNTNDEGKDKRKL

SEQ ID NO: 3247229 - protein, 14 aa, Plasmodium falciparum
SITNTIKTSEYDVE

SEQ ID NO: 3247230 - protein, 6 aa, Plasmodium falciparum
SITNTQ

SEQ ID NO: 3247231 - protein, 6 aa, Plasmodium falciparum
SITSNN

SEQ ID NO: 3247232 - protein, 5 aa, Plasmodium falciparum
SIVPD

SEQ ID NO: 3247233 - protein, 24 aa, Plasmodium falciparum
SIYKDKDESLLSTDENSSTYDSDY

SEQ ID NO: 3247234 - protein, 20 aa, Plasmodium falciparum
SIYNNKDNKCISKKSNINKI

SEQ ID NO: 3247235 - protein, 4 aa, Plasmodium falciparum
SKAC

SEQ ID NO: 3247236 - protein, 6 aa, Plasmodium falciparum
SKAEED

SEQ ID NO: 3247237 - protein, 8 aa, Plasmodium falciparum
SKAEEKHK

SEQ ID NO: 3247238 - protein, 13 aa, Plasmodium falciparum
SKAIGDANSERHP

SEQ ID NO: 3247239 - protein, 11 aa, Plasmodium falciparum
SKAKRPPPPLP

SEQ ID NO: 3247240 - protein, 4 aa, Plasmodium falciparum
SKAN

SEQ ID NO: 3247241 - protein, 8 aa, Plasmodium falciparum
SKANGGDM

SEQ ID NO: 3247242 - protein, 6 aa, Plasmodium falciparum
SKANNV

SEQ ID NO: 3247243 - protein, 7 aa, Plasmodium falciparum
SKAQKEN

SEQ ID NO: 3247244 - protein, 8 aa, Plasmodium falciparum
SKAQTYIN

SEQ ID NO: 3247245 - protein, 23 aa, Plasmodium falciparum
SKATFEGNVDDDDTVYDENEENY

SEQ ID NO: 3247246 - protein, 20 aa, Plasmodium falciparum
SKATYKKDKNPEGTTPPNPC

SEQ ID NO: 3247247 - protein, 20 aa, Plasmodium falciparum
SKATYPNDKHPEGSTENNPC

SEQ ID NO: 3247248 - protein, 8 aa, Plasmodium falciparum
SKCEESSN

SEQ ID NO: 3247249 - protein, 5 aa, Plasmodium falciparum
SKCKN

SEQ ID NO: 3247250 - protein, 9 aa, Plasmodium falciparum
SKCKPNSTS

SEQ ID NO: 3247251 - protein, 9 aa, Plasmodium falciparum
SKDAKNGVN

SEQ ID NO: 3247252 - protein, 8 aa, Plasmodium falciparum
SKDDEKNK

SEQ ID NO: 3247253 - protein, 5 aa, Plasmodium falciparum
SKDDI

SEQ ID NO: 3247254 - protein, 5 aa, Plasmodium falciparum
SKDDQ

SEQ ID NO: 3247255 - protein, 9 aa, Plasmodium falciparum
SKDDQNNED

SEQ ID NO: 3247256 - protein, 9 aa, Plasmodium falciparum
SKDDSNKHQ

SEQ ID NO: 3247257 - protein, 14 aa, Plasmodium falciparum
SKDEETNGYQPPES

SEQ ID NO: 3247258 - protein, 8 aa, Plasmodium falciparum
SKDEINEE

SEQ ID NO: 3247259 - protein, 14 aa, Plasmodium falciparum
SKDENETTNSNKVN

SEQ ID NO: 3247260 - protein, 7 aa, Plasmodium falciparum
SKDGDRL

SEQ ID NO: 3247261 - protein, 7 aa, Plasmodium falciparum
SKDGEME

SEQ ID NO: 3247262 - protein, 19 aa, Plasmodium falciparum
SKDGNKKRKKKRKKNEQPF

SEQ ID NO: 3247263 - protein, 16 aa, Plasmodium falciparum
SKDHNLKKNKNTCEKK

SEQ ID NO: 3247264 - protein, 9 aa, Plasmodium falciparum
SKDINENNQ

SEQ ID NO: 3247265 - protein, 6 aa, Plasmodium falciparum
SKDISK

SEQ ID NO: 3247266 - protein, 5 aa, Plasmodium falciparum
SKDIT

SEQ ID NO: 3247267 - protein, 6 aa, Plasmodium falciparum
SKDITS

SEQ ID NO: 3247268 - protein, 5 aa, Plasmodium falciparum
SKDKD

SEQ ID NO: 3247269 - protein, 89 aa, Plasmodium falciparum
SKDKGGEKKKVNKKTDSSEKRDKPKDTNYKKRDSKSKDSVDKKKGESKQKDNNEKKRDSKGSPTNDKKRDNKTNGIHDKRKDTKRDMKN

SEQ ID NO: 3247270 - protein, 6 aa, Plasmodium falciparum
SKDKKY

SEQ ID NO: 3247271 - protein, 7 aa, Plasmodium falciparum
SKDLEEK

SEQ ID NO: 3247272 - protein, 4 aa, Plasmodium falciparum
SKDN

SEQ ID NO: 3247273 - protein, 10 aa, Plasmodium falciparum
SKDNDEVPND

SEQ ID NO: 3247274 - protein, 9 aa, Plasmodium falciparum
SKDNEKKKN

SEQ ID NO: 3247275 - protein, 8 aa, Plasmodium falciparum
SKDNINKK

SEQ ID NO: 3247276 - protein, 7 aa, Plasmodium falciparum
SKDNKKT

SEQ ID NO: 3247277 - protein, 8 aa, Plasmodium falciparum
SKDNKSNF

SEQ ID NO: 3247278 - protein, 6 aa, Plasmodium falciparum
SKDNNK

SEQ ID NO: 3247279 - protein, 8 aa, Plasmodium falciparum
SKDNNTSD

SEQ ID NO: 3247280 - protein, 9 aa, Plasmodium falciparum
SKDNQNDNN

SEQ ID NO: 3247281 - protein, 6 aa, Plasmodium falciparum
SKDNYL

SEQ ID NO: 3247282 - protein, 18 aa, Plasmodium falciparum
SKDNYQPDHNDKGYKTNN

SEQ ID NO: 3247283 - protein, 4 aa, Plasmodium falciparum
SKDQ

SEQ ID NO: 3247284 - protein, 8 aa, Plasmodium falciparum
SKDQSKED

SEQ ID NO: 3247285 - protein, 19 aa, Plasmodium falciparum
SKDSDEIYNNNNNNNIGDM

SEQ ID NO: 3247286 - protein, 17 aa, Plasmodium falciparum
SKDSLEEKSNSKKNIAE

SEQ ID NO: 3247287 - protein, 6 aa, Plasmodium falciparum
SKDSNY

SEQ ID NO: 3247288 - protein, 4 aa, Plasmodium falciparum
SKDT

SEQ ID NO: 3247289 - protein, 72 aa, Plasmodium falciparum
SKDTKSKNKHDQVKNKDDQVKNKDDKIKNKHDKVKNKHDKVKNKKDKIKNKKDKVKNKDDKIKNNNDERQNK

SEQ ID NO: 3247290 - protein, 5 aa, Plasmodium falciparum
SKDVK

SEQ ID NO: 3247291 - protein, 6 aa, Plasmodium falciparum
SKDYEK

SEQ ID NO: 3247292 - protein, 14 aa, Plasmodium falciparum
SKECNEVKGKGATW

SEQ ID NO: 3247293 - protein, 10 aa, Plasmodium falciparum
SKEDEENKNI

SEQ ID NO: 3247294 - protein, 10 aa, Plasmodium falciparum
SKEDKLEEQT

SEQ ID NO: 3247295 - protein, 7 aa, Plasmodium falciparum
SKEDVDN

SEQ ID NO: 3247296 - protein, 8 aa, Plasmodium falciparum
SKEEECYR

SEQ ID NO: 3247297 - protein, 21 aa, Plasmodium falciparum
SKEEKANEFESSDKNEKEEDI

SEQ ID NO: 3247298 - protein, 9 aa, Plasmodium falciparum
SKEEKKKEY

SEQ ID NO: 3247299 - protein, 8 aa, Plasmodium falciparum
SKEELKSL

SEQ ID NO: 3247300 - protein, 5 aa, Plasmodium falciparum
SKEEN

SEQ ID NO: 3247301 - protein, 8 aa, Plasmodium falciparum
SKEENGVG

SEQ ID NO: 3247302 - protein, 9 aa, Plasmodium falciparum
SKEEQNNTA

SEQ ID NO: 3247303 - protein, 16 aa, Plasmodium falciparum
SKEETNSVYDNSSISS

SEQ ID NO: 3247304 - protein, 12 aa, Plasmodium falciparum
SKEFKRNTYYNN

SEQ ID NO: 3247305 - protein, 5 aa, Plasmodium falciparum
SKEFY

SEQ ID NO: 3247306 - protein, 9 aa, Plasmodium falciparum
SKEGDGSDR

SEQ ID NO: 3247307 - protein, 6 aa, Plasmodium falciparum
SKEGKY

SEQ ID NO: 3247308 - protein, 6 aa, Plasmodium falciparum
SKEGML

SEQ ID NO: 3247309 - protein, 13 aa, Plasmodium falciparum
SKEGMNDEDFNSN

SEQ ID NO: 3247310 - protein, 132 aa, Plasmodium falciparum
SKEGSDKKNNNRKRSSGSCDNSNNKNNKCYNKKNNNKNKNNNNNNYNNNYYNNNNNNNNNNNNNNNNNSNNNPNDDNNEDDKNNSNKNTDNNNKNNNINNKKKRRKRNNDDNDKQINKRNKNINKKATTGNI

SEQ ID NO: 3247311 - protein, 6 aa, Plasmodium falciparum
SKEHIS

SEQ ID NO: 3247312 - protein, 7 aa, Plasmodium falciparum
SKEISSY

SEQ ID NO: 3247313 - protein, 15 aa, Plasmodium falciparum
SKEKDRKGSKVKRKS

SEQ ID NO: 3247314 - protein, 9 aa, Plasmodium falciparum
SKEKENDID

SEQ ID NO: 3247315 - protein, 5 aa, Plasmodium falciparum
SKEKH

SEQ ID NO: 3247316 - protein, 15 aa, Plasmodium falciparum
SKEKKTNKPNIVQGQ

SEQ ID NO: 3247317 - protein, 8 aa, Plasmodium falciparum
SKEKNELR

SEQ ID NO: 3247318 - protein, 9 aa, Plasmodium falciparum
SKEKRSEKS

SEQ ID NO: 3247319 - protein, 10 aa, Plasmodium falciparum
SKEKTTGQMN

SEQ ID NO: 3247320 - protein, 8 aa, Plasmodium falciparum
SKEKVEQH

SEQ ID NO: 3247321 - protein, 6 aa, Plasmodium falciparum
SKEKYK

SEQ ID NO: 3247322 - protein, 4 aa, Plasmodium falciparum
SKEL

SEQ ID NO: 3247323 - protein, 6 aa, Plasmodium falciparum
SKELEG

SEQ ID NO: 3247324 - protein, 36 aa, Plasmodium falciparum
SKEMKKKKKDEKKSKEKNENKKKDNIKDNMKNKKHR

SEQ ID NO: 3247325 - protein, 11 aa, Plasmodium falciparum
SKENEETPNQN

SEQ ID NO: 3247326 - protein, 5 aa, Plasmodium falciparum
SKENF

SEQ ID NO: 3247327 - protein, 24 aa, Plasmodium falciparum
SKENINNNNNNNMNNNMNEKKNKS

SEQ ID NO: 3247328 - protein, 5 aa, Plasmodium falciparum
SKENK

SEQ ID NO: 3247329 - protein, 15 aa, Plasmodium falciparum
SKENKNWEKDQEADI

SEQ ID NO: 3247330 - protein, 14 aa, Plasmodium falciparum
SKENNDDNRKIDEQ

SEQ ID NO: 3247331 - protein, 8 aa, Plasmodium falciparum
SKENNPFY

SEQ ID NO: 3247332 - protein, 15 aa, Plasmodium falciparum
SKENNQPYKQNDNTI

SEQ ID NO: 3247333 - protein, 6 aa, Plasmodium falciparum
SKENNS

SEQ ID NO: 3247334 - protein, 7 aa, Plasmodium falciparum
SKENSQN

SEQ ID NO: 3247335 - protein, 9 aa, Plasmodium falciparum
SKENVTKKT

SEQ ID NO: 3247336 - protein, 6 aa, Plasmodium falciparum
SKEPDD

SEQ ID NO: 3247337 - protein, 6 aa, Plasmodium falciparum
SKEPKN

SEQ ID NO: 3247338 - protein, 4 aa, Plasmodium falciparum
SKEQ

SEQ ID NO: 3247339 - protein, 7 aa, Plasmodium falciparum
SKEQEDV

SEQ ID NO: 3247340 - protein, 7 aa, Plasmodium falciparum
SKERKEK

SEQ ID NO: 3247341 - protein, 16 aa, Plasmodium falciparum
SKERTDKKNESEKTNY

SEQ ID NO: 3247342 - protein, 16 aa, Plasmodium falciparum
SKESGKNYFISVWNAL

SEQ ID NO: 3247343 - protein, 16 aa, Plasmodium falciparum
SKESGKYDSYNDETNN

SEQ ID NO: 3247344 - protein, 7 aa, Plasmodium falciparum
SKETGQP

SEQ ID NO: 3247345 - protein, 6 aa, Plasmodium falciparum
SKETKK

SEQ ID NO: 3247346 - protein, 31 aa, Plasmodium falciparum
SKETKNNKQSNNNNNNDNNYSNNNNNNSSNH

SEQ ID NO: 3247347 - protein, 5 aa, Plasmodium falciparum
SKETR

SEQ ID NO: 3247348 - protein, 20 aa, Plasmodium falciparum
SKETSATYNDNNNNNNKENY

SEQ ID NO: 3247349 - protein, 5 aa, Plasmodium falciparum
SKEVD

SEQ ID NO: 3247350 - protein, 8 aa, Plasmodium falciparum
SKEVNNNS

SEQ ID NO: 3247351 - protein, 7 aa, Plasmodium falciparum
SKEYENK

SEQ ID NO: 3247352 - protein, 5 aa, Plasmodium falciparum
SKEYI

SEQ ID NO: 3247353 - protein, 7 aa, Plasmodium falciparum
SKEYNMS

SEQ ID NO: 3247354 - protein, 4 aa, Plasmodium falciparum
SKFN

SEQ ID NO: 3247355 - protein, 12 aa, Plasmodium falciparum
SKFNKNKKKNEN

SEQ ID NO: 3247356 - protein, 8 aa, Plasmodium falciparum
SKFNNNDD

SEQ ID NO: 3247357 - protein, 6 aa, Plasmodium falciparum
SKFSYN

SEQ ID NO: 3247358 - protein, 25 aa, Plasmodium falciparum
SKGDDEKSGRGERRINKKRGRGGKR

SEQ ID NO: 3247359 - protein, 13 aa, Plasmodium falciparum
SKGDEKKNQRKNI

SEQ ID NO: 3247360 - protein, 5 aa, Plasmodium falciparum
SKGDF

SEQ ID NO: 3247361 - protein, 8 aa, Plasmodium falciparum
SKGDINNT

SEQ ID NO: 3247362 - protein, 14 aa, Plasmodium falciparum
SKGFEEKDSSNSCD

SEQ ID NO: 3247363 - protein, 7 aa, Plasmodium falciparum
SKGGDEI

SEQ ID NO: 3247364 - protein, 15 aa, Plasmodium falciparum
SKGKERERKNDKEKN

SEQ ID NO: 3247365 - protein, 13 aa, Plasmodium falciparum
SKGLSNSSIASNS

SEQ ID NO: 3247366 - protein, 5 aa, Plasmodium falciparum
SKGNL

SEQ ID NO: 3247367 - protein, 7 aa, Plasmodium falciparum
SKGNNKI

SEQ ID NO: 3247368 - protein, 7 aa, Plasmodium falciparum
SKGNPDM

SEQ ID NO: 3247369 - protein, 8 aa, Plasmodium falciparum
SKGPVEDE

SEQ ID NO: 3247370 - protein, 10 aa, Plasmodium falciparum
SKGSDTVDTN

SEQ ID NO: 3247371 - protein, 6 aa, Plasmodium falciparum
SKGSFS

SEQ ID NO: 3247372 - protein, 6 aa, Plasmodium falciparum
SKGSLN

SEQ ID NO: 3247373 - protein, 8 aa, Plasmodium falciparum
SKGTKNKF

SEQ ID NO: 3247374 - protein, 6 aa, Plasmodium falciparum
SKGTNH

SEQ ID NO: 3247375 - protein, 7 aa, Plasmodium falciparum
SKGYMSN

SEQ ID NO: 3247376 - protein, 20 aa, Plasmodium falciparum
SKHDDNYNDNNNNNNNCNNN

SEQ ID NO: 3247377 - protein, 12 aa, Plasmodium falciparum
SKHDEDNENDYS

SEQ ID NO: 3247378 - protein, 6 aa, Plasmodium falciparum
SKHNKN

SEQ ID NO: 3247379 - protein, 8 aa, Plasmodium falciparum
SKHNTIQQ

SEQ ID NO: 3247380 - protein, 35 aa, Plasmodium falciparum
SKIASTNGNNNNNNNNNNNNNNNNSKSNLKDEDNT

SEQ ID NO: 3247381 - protein, 7 aa, Plasmodium falciparum
SKIDKER

SEQ ID NO: 3247382 - protein, 4 aa, Plasmodium falciparum
SKIE

SEQ ID NO: 3247383 - protein, 12 aa, Plasmodium falciparum
SKIGNTSQSNTK

SEQ ID NO: 3247384 - protein, 9 aa, Plasmodium falciparum
SKIKEEKYQ

SEQ ID NO: 3247385 - protein, 11 aa, Plasmodium falciparum
SKIKGNENKIN

SEQ ID NO: 3247386 - protein, 14 aa, Plasmodium falciparum
SKIKNKKNKVNNKS

SEQ ID NO: 3247387 - protein, 7 aa, Plasmodium falciparum
SKIKTEN

SEQ ID NO: 3247388 - protein, 21 aa, Plasmodium falciparum
SKINNNDNEDNNTNSDTSSNY

SEQ ID NO: 3247389 - protein, 7 aa, Plasmodium falciparum
SKINNYE

SEQ ID NO: 3247390 - protein, 10 aa, Plasmodium falciparum
SKINSYNSGE

SEQ ID NO: 3247391 - protein, 12 aa, Plasmodium falciparum
SKISDNGKLEEI

SEQ ID NO: 3247392 - protein, 8 aa, Plasmodium falciparum
SKISNAAE

SEQ ID NO: 3247393 - protein, 11 aa, Plasmodium falciparum
SKISSKNYSFN

SEQ ID NO: 3247394 - protein, 32 aa, Plasmodium falciparum
SKISSKSGKNDKDSQNIEKEQTKLKNIKSSNN

SEQ ID NO: 3247395 - protein, 6 aa, Plasmodium falciparum
SKISSL

SEQ ID NO: 3247396 - protein, 7 aa, Plasmodium falciparum
SKKATDI

SEQ ID NO: 3247397 - protein, 8 aa, Plasmodium falciparum
SKKCSPDD

SEQ ID NO: 3247398 - protein, 9 aa, Plasmodium falciparum
SKKDECTKS

SEQ ID NO: 3247399 - protein, 9 aa, Plasmodium falciparum
SKKDEKGYI

SEQ ID NO: 3247400 - protein, 8 aa, Plasmodium falciparum
SKKDEWEE

SEQ ID NO: 3247401 - protein, 6 aa, Plasmodium falciparum
SKKDGY

SEQ ID NO: 3247402 - protein, 7 aa, Plasmodium falciparum
SKKDKNK

SEQ ID NO: 3247403 - protein, 8 aa, Plasmodium falciparum
SKKDNSKE

SEQ ID NO: 3247404 - protein, 9 aa, Plasmodium falciparum
SKKDTESIK

SEQ ID NO: 3247405 - protein, 9 aa, Plasmodium falciparum
SKKEDITSS

SEQ ID NO: 3247406 - protein, 9 aa, Plasmodium falciparum
SKKEEEGVS

SEQ ID NO: 3247407 - protein, 9 aa, Plasmodium falciparum
SKKEENNDI

SEQ ID NO: 3247408 - protein, 12 aa, Plasmodium falciparum
SKKEEQNDESSE

SEQ ID NO: 3247409 - protein, 7 aa, Plasmodium falciparum
SKKEIRE

SEQ ID NO: 3247410 - protein, 5 aa, Plasmodium falciparum
SKKEK

SEQ ID NO: 3247411 - protein, 23 aa, Plasmodium falciparum
SKKEKKKKKKKTDNKNEKKKGHM

SEQ ID NO: 3247412 - protein, 9 aa, Plasmodium falciparum
SKKEKKNNF

SEQ ID NO: 3247413 - protein, 15 aa, Plasmodium falciparum
SKKEKTNLYNNNNNM

SEQ ID NO: 3247414 - protein, 7 aa, Plasmodium falciparum
SKKEPLL

SEQ ID NO: 3247415 - protein, 15 aa, Plasmodium falciparum
SKKEQPQNKQENNLN

SEQ ID NO: 3247416 - protein, 6 aa, Plasmodium falciparum
SKKERN

SEQ ID NO: 3247417 - protein, 6 aa, Plasmodium falciparum
SKKESQ

SEQ ID NO: 3247418 - protein, 9 aa, Plasmodium falciparum
SKKGAETLQ

SEQ ID NO: 3247419 - protein, 5 aa, Plasmodium falciparum
SKKGE

SEQ ID NO: 3247420 - protein, 8 aa, Plasmodium falciparum
SKKHENDL

SEQ ID NO: 3247421 - protein, 6 aa, Plasmodium falciparum
SKKHIE

SEQ ID NO: 3247422 - protein, 5 aa, Plasmodium falciparum
SKKIT

SEQ ID NO: 3247423 - protein, 6 aa, Plasmodium falciparum
SKKKDL

SEQ ID NO: 3247424 - protein, 15 aa, Plasmodium falciparum
SKKKDNENDKIQDTS

SEQ ID NO: 3247425 - protein, 10 aa, Plasmodium falciparum
SKKKEAKYNY

SEQ ID NO: 3247426 - protein, 13 aa, Plasmodium falciparum
SKKKKKKKKGTNY

SEQ ID NO: 3247427 - protein, 11 aa, Plasmodium falciparum
SKKKKKKKKKI

SEQ ID NO: 3247428 - protein, 8 aa, Plasmodium falciparum
SKKKKKKL

SEQ ID NO: 3247429 - protein, 10 aa, Plasmodium falciparum
SKKKKKKNNI

SEQ ID NO: 3247430 - protein, 12 aa, Plasmodium falciparum
SKKKKKNKTKIN

SEQ ID NO: 3247431 - protein, 10 aa, Plasmodium falciparum
SKKKKKNSEI

SEQ ID NO: 3247432 - protein, 12 aa, Plasmodium falciparum
SKKKKNDNNMDN

SEQ ID NO: 3247433 - protein, 9 aa, Plasmodium falciparum
SKKKLEDTL

SEQ ID NO: 3247434 - protein, 14 aa, Plasmodium falciparum
SKKKNDLPVSPNGY

SEQ ID NO: 3247435 - protein, 8 aa, Plasmodium falciparum
SKKKQNKE

SEQ ID NO: 3247436 - protein, 14 aa, Plasmodium falciparum
SKKKRRTNNKLQEE

SEQ ID NO: 3247437 - protein, 10 aa, Plasmodium falciparum
SKKKSMDEKS

SEQ ID NO: 3247438 - protein, 8 aa, Plasmodium falciparum
SKKKSSDD

SEQ ID NO: 3247439 - protein, 9 aa, Plasmodium falciparum
SKKKTPDNL

SEQ ID NO: 3247440 - protein, 5 aa, Plasmodium falciparum
SKKMT

SEQ ID NO: 3247441 - protein, 8 aa, Plasmodium falciparum
SKKNDVNT

SEQ ID NO: 3247442 - protein, 8 aa, Plasmodium falciparum
SKKNDYSY

SEQ ID NO: 3247443 - protein, 29 aa, Plasmodium falciparum
SKKNKKENKENNIHDDGDNDNDEKKKDLS

SEQ ID NO: 3247444 - protein, 8 aa, Plasmodium falciparum
SKKNKNQA

SEQ ID NO: 3247445 - protein, 7 aa, Plasmodium falciparum
SKKNLHK

SEQ ID NO: 3247446 - protein, 9 aa, Plasmodium falciparum
SKKNNHTKK

SEQ ID NO: 3247447 - protein, 14 aa, Plasmodium falciparum
SKKNQEKNKRKRKY

SEQ ID NO: 3247448 - protein, 10 aa, Plasmodium falciparum
SKKNSNNSTN

SEQ ID NO: 3247449 - protein, 8 aa, Plasmodium falciparum
SKKNWEAR

SEQ ID NO: 3247450 - protein, 9 aa, Plasmodium falciparum
SKKPPELSN

SEQ ID NO: 3247451 - protein, 9 aa, Plasmodium falciparum
SKKPQNKEI

SEQ ID NO: 3247452 - protein, 6 aa, Plasmodium falciparum
SKKPQY

SEQ ID NO: 3247453 - protein, 8 aa, Plasmodium falciparum
SKKQDYGH

SEQ ID NO: 3247454 - protein, 9 aa, Plasmodium falciparum
SKKQNKKGR

SEQ ID NO: 3247455 - protein, 6 aa, Plasmodium falciparum
SKKQRD

SEQ ID NO: 3247456 - protein, 13 aa, Plasmodium falciparum
SKKREKKKKGQGI

SEQ ID NO: 3247457 - protein, 9 aa, Plasmodium falciparum
SKKRGEKKN

SEQ ID NO: 3247458 - protein, 25 aa, Plasmodium falciparum
SKKRGVQHPTNSYHKNEKNEKNEKD

SEQ ID NO: 3247459 - protein, 6 aa, Plasmodium falciparum
SKKRQN

SEQ ID NO: 3247460 - protein, 8 aa, Plasmodium falciparum
SKKRTKMS

SEQ ID NO: 3247461 - protein, 13 aa, Plasmodium falciparum
SKKSGGEGGNEDG

SEQ ID NO: 3247462 - protein, 8 aa, Plasmodium falciparum
SKKSGRVQ

SEQ ID NO: 3247463 - protein, 33 aa, Plasmodium falciparum
SKKSGTNVNTKYNSENTNTNNNIPESSSTYTNT

SEQ ID NO: 3247464 - protein, 9 aa, Plasmodium falciparum
SKKSHNSVN

SEQ ID NO: 3247465 - protein, 11 aa, Plasmodium falciparum
SKKSNDNNTLP

SEQ ID NO: 3247466 - protein, 13 aa, Plasmodium falciparum
SKKSNEEEHEETL

SEQ ID NO: 3247467 - protein, 8 aa, Plasmodium falciparum
SKKSPIKE

SEQ ID NO: 3247468 - protein, 6 aa, Plasmodium falciparum
SKKSSL

SEQ ID NO: 3247469 - protein, 10 aa, Plasmodium falciparum
SKKSSSQKEF

SEQ ID NO: 3247470 - protein, 19 aa, Plasmodium falciparum
SKKTIDQNKNADNEEGKKK

SEQ ID NO: 3247471 - protein, 9 aa, Plasmodium falciparum
SKKTKKKDV

SEQ ID NO: 3247472 - protein, 14 aa, Plasmodium falciparum
SKKTKNQKKGKTSY

SEQ ID NO: 3247473 - protein, 5 aa, Plasmodium falciparum
SKKTM

SEQ ID NO: 3247474 - protein, 17 aa, Plasmodium falciparum
SKKTTAIVGETGSGKST

SEQ ID NO: 3247475 - protein, 13 aa, Plasmodium falciparum
SKKVDKEIKQNDS

SEQ ID NO: 3247476 - protein, 7 aa, Plasmodium falciparum
SKKVENV

SEQ ID NO: 3247477 - protein, 6 aa, Plasmodium falciparum
SKKWGN

SEQ ID NO: 3247478 - protein, 5 aa, Plasmodium falciparum
SKLEE

SEQ ID NO: 3247479 - protein, 14 aa, Plasmodium falciparum
SKLKYDNDKKDGAI

SEQ ID NO: 3247480 - protein, 21 aa, Plasmodium falciparum
SKLPKKKKLRNRRKSNPNNEI

SEQ ID NO: 3247481 - protein, 14 aa, Plasmodium falciparum
SKLRNKKKQDMKKA

SEQ ID NO: 3247482 - protein, 7 aa, Plasmodium falciparum
SKLTDKK

SEQ ID NO: 3247483 - protein, 7 aa, Plasmodium falciparum
SKLTNKE

SEQ ID NO: 3247484 - protein, 8 aa, Plasmodium falciparum
SKLTNNNI

SEQ ID NO: 3247485 - protein, 7 aa, Plasmodium falciparum
SKLVTGN

SEQ ID NO: 3247486 - protein, 39 aa, Plasmodium falciparum
SKMDVKSQQIKEQQNEHTQKCNNKNKNNNNNNNNDDDDV

SEQ ID NO: 3247487 - protein, 14 aa, Plasmodium falciparum
SKMEYKEGEVGNTK

SEQ ID NO: 3247488 - protein, 8 aa, Plasmodium falciparum
SKMSDDNK

SEQ ID NO: 3247489 - protein, 7 aa, Plasmodium falciparum
SKNAKGL

SEQ ID NO: 3247490 - protein, 7 aa, Plasmodium falciparum
SKNDAST

SEQ ID NO: 3247491 - protein, 30 aa, Plasmodium falciparum
SKNDDEEDKKEDNHEDEQEDNQHDEQHGKY

SEQ ID NO: 3247492 - protein, 7 aa, Plasmodium falciparum
SKNDDGY

SEQ ID NO: 3247493 - protein, 6 aa, Plasmodium falciparum
SKNDDH

SEQ ID NO: 3247494 - protein, 11 aa, Plasmodium falciparum
SKNDDTGNDSN

SEQ ID NO: 3247495 - protein, 5 aa, Plasmodium falciparum
SKNDL

SEQ ID NO: 3247496 - protein, 6 aa, Plasmodium falciparum
SKNDLK

SEQ ID NO: 3247497 - protein, 7 aa, Plasmodium falciparum
SKNDMNE

SEQ ID NO: 3247498 - protein, 7 aa, Plasmodium falciparum
SKNDNME

SEQ ID NO: 3247499 - protein, 29 aa, Plasmodium falciparum
SKNDNNDNNNNNNNKSKSKCKSKKEKTNI

SEQ ID NO: 3247500 - protein, 9 aa, Plasmodium falciparum
SKNDNSHIT

SEQ ID NO: 3247501 - protein, 11 aa, Plasmodium falciparum
SKNDYKAMTES

SEQ ID NO: 3247502 - protein, 9 aa, Plasmodium falciparum
SKNEDGKYK

SEQ ID NO: 3247503 - protein, 7 aa, Plasmodium falciparum
SKNEDQN

SEQ ID NO: 3247504 - protein, 6 aa, Plasmodium falciparum
SKNEDT

SEQ ID NO: 3247505 - protein, 7 aa, Plasmodium falciparum
SKNEEDN

SEQ ID NO: 3247506 - protein, 8 aa, Plasmodium falciparum
SKNEEMKK

SEQ ID NO: 3247507 - protein, 9 aa, Plasmodium falciparum
SKNEERENI

SEQ ID NO: 3247508 - protein, 9 aa, Plasmodium falciparum
SKNEGSIED

SEQ ID NO: 3247509 - protein, 7 aa, Plasmodium falciparum
SKNEKKN

SEQ ID NO: 3247510 - protein, 7 aa, Plasmodium falciparum
SKNEKLQ

SEQ ID NO: 3247511 - protein, 14 aa, Plasmodium falciparum
SKNEKNEAKKREQN

SEQ ID NO: 3247512 - protein, 6 aa, Plasmodium falciparum
SKNENK

SEQ ID NO: 3247513 - protein, 46 aa, Plasmodium falciparum
SKNENQATTGVNQSSSGGVPSSSGHSSSSTVTPPGPPQTSGTTPKT

SEQ ID NO: 3247514 - protein, 9 aa, Plasmodium falciparum
SKNERTEKI

SEQ ID NO: 3247515 - protein, 9 aa, Plasmodium falciparum
SKNETSEKK

SEQ ID NO: 3247516 - protein, 8 aa, Plasmodium falciparum
SKNEYNDV

SEQ ID NO: 3247517 - protein, 8 aa, Plasmodium falciparum
SKNFKHTA

SEQ ID NO: 3247518 - protein, 19 aa, Plasmodium falciparum
SKNFTNNRYSSTNTERASD

SEQ ID NO: 3247519 - protein, 18 aa, Plasmodium falciparum
SKNGCSSKSRKNNKSFSK

SEQ ID NO: 3247520 - protein, 10 aa, Plasmodium falciparum
SKNGGENLQT

SEQ ID NO: 3247521 - protein, 6 aa, Plasmodium falciparum
SKNGNG

SEQ ID NO: 3247522 - protein, 14 aa, Plasmodium falciparum
SKNGNHTNSNINNR

SEQ ID NO: 3247523 - protein, 10 aa, Plasmodium falciparum
SKNGSEETEE

SEQ ID NO: 3247524 - protein, 11 aa, Plasmodium falciparum
SKNGSMSSIPS

SEQ ID NO: 3247525 - protein, 8 aa, Plasmodium falciparum
SKNITNNN

SEQ ID NO: 3247526 - protein, 18 aa, Plasmodium falciparum
SKNKDTFTQEYEENNVNT

SEQ ID NO: 3247527 - protein, 5 aa, Plasmodium falciparum
SKNKI

SEQ ID NO: 3247528 - protein, 10 aa, Plasmodium falciparum
SKNKKDENET

SEQ ID NO: 3247529 - protein, 7 aa, Plasmodium falciparum
SKNKKEN

SEQ ID NO: 3247530 - protein, 34 aa, Plasmodium falciparum
SKNKKKKKPSSNDQNNTENEDMQNSSSDNPYDDS

SEQ ID NO: 3247531 - protein, 8 aa, Plasmodium falciparum
SKNKKNAI

SEQ ID NO: 3247532 - protein, 9 aa, Plasmodium falciparum
SKNKKRTLK

SEQ ID NO: 3247533 - protein, 19 aa, Plasmodium falciparum
SKNKKYEKIKKEKKHIDDT

SEQ ID NO: 3247534 - protein, 8 aa, Plasmodium falciparum
SKNKLDPH

SEQ ID NO: 3247535 - protein, 36 aa, Plasmodium falciparum
SKNKMKNKHRNDKNYYDKDDTRNNVHTSDDSNNSSM

SEQ ID NO: 3247536 - protein, 26 aa, Plasmodium falciparum
SKNKNENEFNKNKKKTSVEKKEGDIM

SEQ ID NO: 3247537 - protein, 9 aa, Plasmodium falciparum
SKNKNKERG

SEQ ID NO: 3247538 - protein, 8 aa, Plasmodium falciparum
SKNKSKEA

SEQ ID NO: 3247539 - protein, 21 aa, Plasmodium falciparum
SKNKSYSNVDRYNNSDNAYYD

SEQ ID NO: 3247540 - protein, 8 aa, Plasmodium falciparum
SKNKTRGR

SEQ ID NO: 3247541 - protein, 12 aa, Plasmodium falciparum
SKNLNQKNEDDN

SEQ ID NO: 3247542 - protein, 4 aa, Plasmodium falciparum
SKNM

SEQ ID NO: 3247543 - protein, 4 aa, Plasmodium falciparum
SKNN

SEQ ID NO: 3247544 - protein, 11 aa, Plasmodium falciparum
SKNNDDNNKNV

SEQ ID NO: 3247545 - protein, 7 aa, Plasmodium falciparum
SKNNDDY

SEQ ID NO: 3247546 - protein, 7 aa, Plasmodium falciparum
SKNNEHQ

SEQ ID NO: 3247547 - protein, 8 aa, Plasmodium falciparum
SKNNENEQ

SEQ ID NO: 3247548 - protein, 8 aa, Plasmodium falciparum
SKNNKKYD

SEQ ID NO: 3247549 - protein, 7 aa, Plasmodium falciparum
SKNNLYK

SEQ ID NO: 3247550 - protein, 11 aa, Plasmodium falciparum
SKNNPTQLNKS

SEQ ID NO: 3247551 - protein, 6 aa, Plasmodium falciparum
SKNNQH

SEQ ID NO: 3247552 - protein, 5 aa, Plasmodium falciparum
SKNNT

SEQ ID NO: 3247553 - protein, 10 aa, Plasmodium falciparum
SKNNTTEGNH

SEQ ID NO: 3247554 - protein, 14 aa, Plasmodium falciparum
SKNNYDKNKDHFNQ

SEQ ID NO: 3247555 - protein, 4 aa, Plasmodium falciparum
SKNP

SEQ ID NO: 3247556 - protein, 6 aa, Plasmodium falciparum
SKNQEN

SEQ ID NO: 3247557 - protein, 9 aa, Plasmodium falciparum
SKNQKKKEE

SEQ ID NO: 3247558 - protein, 6 aa, Plasmodium falciparum
SKNRYN

SEQ ID NO: 3247559 - protein, 5 aa, Plasmodium falciparum
SKNSD

SEQ ID NO: 3247560 - protein, 5 aa, Plasmodium falciparum
SKNSF

SEQ ID NO: 3247561 - protein, 10 aa, Plasmodium falciparum
SKNSFGNKID

SEQ ID NO: 3247562 - protein, 6 aa, Plasmodium falciparum
SKNSGG

SEQ ID NO: 3247563 - protein, 6 aa, Plasmodium falciparum
SKNSIN

SEQ ID NO: 3247564 - protein, 7 aa, Plasmodium falciparum
SKNTDKN

SEQ ID NO: 3247565 - protein, 5 aa, Plasmodium falciparum
SKNTL

SEQ ID NO: 3247566 - protein, 7 aa, Plasmodium falciparum
SKNVDTN

SEQ ID NO: 3247567 - protein, 18 aa, Plasmodium falciparum
SKNVNENLNGDSNPNDNI

SEQ ID NO: 3247568 - protein, 7 aa, Plasmodium falciparum
SKNYETH

SEQ ID NO: 3247569 - protein, 5 aa, Plasmodium falciparum
SKNYK

SEQ ID NO: 3247570 - protein, 9 aa, Plasmodium falciparum
SKNYKNKEN

SEQ ID NO: 3247571 - protein, 28 aa, Plasmodium falciparum
SKNYSDDEDSNNRMEESEYSENSNDLSY

SEQ ID NO: 3247572 - protein, 10 aa, Plasmodium falciparum
SKPDDQYGIK

SEQ ID NO: 3247573 - protein, 4 aa, Plasmodium falciparum
SKPE

SEQ ID NO: 3247574 - protein, 5 aa, Plasmodium falciparum
SKPEI

SEQ ID NO: 3247575 - protein, 10 aa, Plasmodium falciparum
SKPEQSITNK

SEQ ID NO: 3247576 - protein, 4 aa, Plasmodium falciparum
SKPF

SEQ ID NO: 3247577 - protein, 7 aa, Plasmodium falciparum
SKPHEEP

SEQ ID NO: 3247578 - protein, 6 aa, Plasmodium falciparum
SKPHGG

SEQ ID NO: 3247579 - protein, 7 aa, Plasmodium falciparum
SKPNEEI

SEQ ID NO: 3247580 - protein, 9 aa, Plasmodium falciparum
SKPNQVDDT

SEQ ID NO: 3247581 - protein, 6 aa, Plasmodium falciparum
SKPSET

SEQ ID NO: 3247582 - protein, 17 aa, Plasmodium falciparum
SKPSNAGNFSDVEFEPS

SEQ ID NO: 3247583 - protein, 4 aa, Plasmodium falciparum
SKPT

SEQ ID NO: 3247584 - protein, 4 aa, Plasmodium falciparum
SKPV

SEQ ID NO: 3247585 - protein, 10 aa, Plasmodium falciparum
SKQDDKYHDM

SEQ ID NO: 3247586 - protein, 5 aa, Plasmodium falciparum
SKQDI

SEQ ID NO: 3247587 - protein, 12 aa, Plasmodium falciparum
SKQEDIQNILHH

SEQ ID NO: 3247588 - protein, 6 aa, Plasmodium falciparum
SKQIDD

SEQ ID NO: 3247589 - protein, 34 aa, Plasmodium falciparum
SKQINDNNNINSINSNNSINSINSNNSINSNNSI

SEQ ID NO: 3247590 - protein, 7 aa, Plasmodium falciparum
SKQIRKE

SEQ ID NO: 3247591 - protein, 6 aa, Plasmodium falciparum
SKQKER

SEQ ID NO: 3247592 - protein, 7 aa, Plasmodium falciparum
SKQKEYS

SEQ ID NO: 3247593 - protein, 19 aa, Plasmodium falciparum
SKQKKGQCKNNETKEKYLK

SEQ ID NO: 3247594 - protein, 52 aa, Plasmodium falciparum
SKQNKEENVTKKNKKNNNNNNNNNKNNNSYSSRCSSRCSSRCSSSRCSSSSF

SEQ ID NO: 3247595 - protein, 7 aa, Plasmodium falciparum
SKQNSFN

SEQ ID NO: 3247596 - protein, 14 aa, Plasmodium falciparum
SKQPGGKFESSPAY

SEQ ID NO: 3247597 - protein, 5 aa, Plasmodium falciparum
SKQSA

SEQ ID NO: 3247598 - protein, 8 aa, Plasmodium falciparum
SKQSHSDP

SEQ ID NO: 3247599 - protein, 8 aa, Plasmodium falciparum
SKQTPSDP

SEQ ID NO: 3247600 - protein, 9 aa, Plasmodium falciparum
SKQTPSDPI

SEQ ID NO: 3247601 - protein, 7 aa, Plasmodium falciparum
SKQTQQR

SEQ ID NO: 3247602 - protein, 8 aa, Plasmodium falciparum
SKQTQQRF

SEQ ID NO: 3247603 - protein, 10 aa, Plasmodium falciparum
SKQTSLHSNN

SEQ ID NO: 3247604 - protein, 18 aa, Plasmodium falciparum
SKQYAGSTAHKKYTPGQH

SEQ ID NO: 3247605 - protein, 8 aa, Plasmodium falciparum
SKRDDPIN

SEQ ID NO: 3247606 - protein, 25 aa, Plasmodium falciparum
SKRDIPSDDIPNNDTPSSKITDNEW

SEQ ID NO: 3247607 - protein, 18 aa, Plasmodium falciparum
SKRDIPSDDIPSSDTPMN

SEQ ID NO: 3247608 - protein, 15 aa, Plasmodium falciparum
SKRDIPSGDIPHTNK

SEQ ID NO: 3247609 - protein, 8 aa, Plasmodium falciparum
SKRDMNRA

SEQ ID NO: 3247610 - protein, 18 aa, Plasmodium falciparum
SKRDNNDAQMKSLSIELR

SEQ ID NO: 3247611 - protein, 16 aa, Plasmodium falciparum
SKRDTFNTSSGDTFTN

SEQ ID NO: 3247612 - protein, 32 aa, Plasmodium falciparum
SKRDTQNDIPSGDINSDIPNTPSDTPSPITDE

SEQ ID NO: 3247613 - protein, 18 aa, Plasmodium falciparum
SKRENKSELSSSQYNQIG

SEQ ID NO: 3247614 - protein, 8 aa, Plasmodium falciparum
SKRETWEK

SEQ ID NO: 3247615 - protein, 8 aa, Plasmodium falciparum
SKRGGCRE

SEQ ID NO: 3247616 - protein, 22 aa, Plasmodium falciparum
SKRHTSESSADSAPSGDTTGGS

SEQ ID NO: 3247617 - protein, 7 aa, Plasmodium falciparum
SKRKELR

SEQ ID NO: 3247618 - protein, 11 aa, Plasmodium falciparum
SKRKESNNMKN

SEQ ID NO: 3247619 - protein, 31 aa, Plasmodium falciparum
SKRKRKSKNDGKYESKSKSKSNGKNKGEDTN

SEQ ID NO: 3247620 - protein, 9 aa, Plasmodium falciparum
SKRNEEKKN

SEQ ID NO: 3247621 - protein, 8 aa, Plasmodium falciparum
SKRNENSY

SEQ ID NO: 3247622 - protein, 7 aa, Plasmodium falciparum
SKRNKNC

SEQ ID NO: 3247623 - protein, 7 aa, Plasmodium falciparum
SKRRKEA

SEQ ID NO: 3247624 - protein, 16 aa, Plasmodium falciparum
SKRSESYNIDNSKKNI

SEQ ID NO: 3247625 - protein, 8 aa, Plasmodium falciparum
SKRTNKGR

SEQ ID NO: 3247626 - protein, 5 aa, Plasmodium falciparum
SKRTT

SEQ ID NO: 3247627 - protein, 8 aa, Plasmodium falciparum
SKRYKDGN

SEQ ID NO: 3247628 - protein, 10 aa, Plasmodium falciparum
SKSAPSGEYL

SEQ ID NO: 3247629 - protein, 6 aa, Plasmodium falciparum
SKSDSI

SEQ ID NO: 3247630 - protein, 4 aa, Plasmodium falciparum
SKSE

SEQ ID NO: 3247631 - protein, 69 aa, Plasmodium falciparum
SKSEIKTEDNIYPDKKNNPKDNNNNNNNNNNNNNNNNNNNNNNNSNNNNSNNNNSNNNNSNNNNNNNIN

SEQ ID NO: 3247632 - protein, 9 aa, Plasmodium falciparum
SKSEKNEEL

SEQ ID NO: 3247633 - protein, 8 aa, Plasmodium falciparum
SKSENFQN

SEQ ID NO: 3247634 - protein, 7 aa, Plasmodium falciparum
SKSFDNK

SEQ ID NO: 3247635 - protein, 10 aa, Plasmodium falciparum
SKSFENKGGY

SEQ ID NO: 3247636 - protein, 8 aa, Plasmodium falciparum
SKSFSDSI

SEQ ID NO: 3247637 - protein, 7 aa, Plasmodium falciparum
SKSGDDV

SEQ ID NO: 3247638 - protein, 7 aa, Plasmodium falciparum
SKSGFRK

SEQ ID NO: 3247639 - protein, 14 aa, Plasmodium falciparum
SKSGLYKRKGRSCL

SEQ ID NO: 3247640 - protein, 9 aa, Plasmodium falciparum
SKSGSVNSL

SEQ ID NO: 3247641 - protein, 4 aa, Plasmodium falciparum
SKSH

SEQ ID NO: 3247642 - protein, 9 aa, Plasmodium falciparum
SKSINTNNM

SEQ ID NO: 3247643 - protein, 6 aa, Plasmodium falciparum
SKSIQE

SEQ ID NO: 3247644 - protein, 6 aa, Plasmodium falciparum
SKSKAK

SEQ ID NO: 3247645 - protein, 19 aa, Plasmodium falciparum
SKSKKFNSPSQETRNKISK

SEQ ID NO: 3247646 - protein, 15 aa, Plasmodium falciparum
SKSKLNDTDIKNDNI

SEQ ID NO: 3247647 - protein, 8 aa, Plasmodium falciparum
SKSKLSSL

SEQ ID NO: 3247648 - protein, 6 aa, Plasmodium falciparum
SKSKNK

SEQ ID NO: 3247649 - protein, 16 aa, Plasmodium falciparum
SKSKNVKRNKDKIKQN

SEQ ID NO: 3247650 - protein, 7 aa, Plasmodium falciparum
SKSKTKQ

SEQ ID NO: 3247651 - protein, 7 aa, Plasmodium falciparum
SKSLTDI

SEQ ID NO: 3247652 - protein, 5 aa, Plasmodium falciparum
SKSNE

SEQ ID NO: 3247653 - protein, 14 aa, Plasmodium falciparum
SKSNENKNDRNSMS

SEQ ID NO: 3247654 - protein, 28 aa, Plasmodium falciparum
SKSNEPHTETNSSIDKDDVNKNNNKNND

SEQ ID NO: 3247655 - protein, 9 aa, Plasmodium falciparum
SKSNNMNGV

SEQ ID NO: 3247656 - protein, 6 aa, Plasmodium falciparum
SKSPQH

SEQ ID NO: 3247657 - protein, 8 aa, Plasmodium falciparum
SKSPYPSN

SEQ ID NO: 3247658 - protein, 9 aa, Plasmodium falciparum
SKSQGKGEM

SEQ ID NO: 3247659 - protein, 8 aa, Plasmodium falciparum
SKSRHDKT

SEQ ID NO: 3247660 - protein, 4 aa, Plasmodium falciparum
SKSS

SEQ ID NO: 3247661 - protein, 6 aa, Plasmodium falciparum
SKSSDP

SEQ ID NO: 3247662 - protein, 25 aa, Plasmodium falciparum
SKSSEDINDSSYQDNNDYKNESKKK

SEQ ID NO: 3247663 - protein, 9 aa, Plasmodium falciparum
SKSSEKNKE

SEQ ID NO: 3247664 - protein, 9 aa, Plasmodium falciparum
SKSSGAGNH

SEQ ID NO: 3247665 - protein, 9 aa, Plasmodium falciparum
SKSSLDTSK

SEQ ID NO: 3247666 - protein, 12 aa, Plasmodium falciparum
SKSSQNKESKYS

SEQ ID NO: 3247667 - protein, 8 aa, Plasmodium falciparum
SKSSTNCV

SEQ ID NO: 3247668 - protein, 4 aa, Plasmodium falciparum
SKST

SEQ ID NO: 3247669 - protein, 7 aa, Plasmodium falciparum
SKSYPEH

SEQ ID NO: 3247670 - protein, 9 aa, Plasmodium falciparum
SKTEEEKHI

SEQ ID NO: 3247671 - protein, 5 aa, Plasmodium falciparum
SKTEI

SEQ ID NO: 3247672 - protein, 37 aa, Plasmodium falciparum
SKTENTESKYSLTKNDSNSVGIKSSSNNTNNMTSNEI

SEQ ID NO: 3247673 - protein, 5 aa, Plasmodium falciparum
SKTEY

SEQ ID NO: 3247674 - protein, 8 aa, Plasmodium falciparum
SKTIKNKN

SEQ ID NO: 3247675 - protein, 7 aa, Plasmodium falciparum
SKTKNES

SEQ ID NO: 3247676 - protein, 7 aa, Plasmodium falciparum
SKTKNLG

SEQ ID NO: 3247677 - protein, 4 aa, Plasmodium falciparum
SKTN

SEQ ID NO: 3247678 - protein, 5 aa, Plasmodium falciparum
SKTND

SEQ ID NO: 3247679 - protein, 12 aa, Plasmodium falciparum
SKTNLERKYSDD

SEQ ID NO: 3247680 - protein, 5 aa, Plasmodium falciparum
SKTPA

SEQ ID NO: 3247681 - protein, 5 aa, Plasmodium falciparum
SKTPI

SEQ ID NO: 3247682 - protein, 7 aa, Plasmodium falciparum
SKTPKLI

SEQ ID NO: 3247683 - protein, 10 aa, Plasmodium falciparum
SKTPKPIKSN

SEQ ID NO: 3247684 - protein, 5 aa, Plasmodium falciparum
SKTQM

SEQ ID NO: 3247685 - protein, 7 aa, Plasmodium falciparum
SKTSISY

SEQ ID NO: 3247686 - protein, 7 aa, Plasmodium falciparum
SKTTGKG

SEQ ID NO: 3247687 - protein, 5 aa, Plasmodium falciparum
SKTTS

SEQ ID NO: 3247688 - protein, 6 aa, Plasmodium falciparum
SKTTTY

SEQ ID NO: 3247689 - protein, 7 aa, Plasmodium falciparum
SKVENDL

SEQ ID NO: 3247690 - protein, 10 aa, Plasmodium falciparum
SKVESNTCDD

SEQ ID NO: 3247691 - protein, 10 aa, Plasmodium falciparum
SKVGNYDDKN

SEQ ID NO: 3247692 - protein, 6 aa, Plasmodium falciparum
SKVKQD

SEQ ID NO: 3247693 - protein, 9 aa, Plasmodium falciparum
SKVNGKKLK

SEQ ID NO: 3247694 - protein, 13 aa, Plasmodium falciparum
SKVNNKEVDVNNR

SEQ ID NO: 3247695 - protein, 6 aa, Plasmodium falciparum
SKVPSA

SEQ ID NO: 3247696 - protein, 24 aa, Plasmodium falciparum
SKVSKGSNLPSEKSSDNNNDNDYS

SEQ ID NO: 3247697 - protein, 8 aa, Plasmodium falciparum
SKYARTGA

SEQ ID NO: 3247698 - protein, 7 aa, Plasmodium falciparum
SKYAYKN

SEQ ID NO: 3247699 - protein, 5 aa, Plasmodium falciparum
SKYDV

SEQ ID NO: 3247700 - protein, 9 aa, Plasmodium falciparum
SKYENDPEM

SEQ ID NO: 3247701 - protein, 14 aa, Plasmodium falciparum
SKYERKEPGTMKVE

SEQ ID NO: 3247702 - protein, 8 aa, Plasmodium falciparum
SKYGQPNI

SEQ ID NO: 3247703 - protein, 7 aa, Plasmodium falciparum
SKYKDTQ

SEQ ID NO: 3247704 - protein, 5 aa, Plasmodium falciparum
SKYNI

SEQ ID NO: 3247705 - protein, 7 aa, Plasmodium falciparum
SKYNNNK

SEQ ID NO: 3247706 - protein, 9 aa, Plasmodium falciparum
SKYNNNNNN

SEQ ID NO: 3247707 - protein, 55 aa, Plasmodium falciparum
SKYPTKVGNEGKKSKDNNNNNNNNMMGDDDNKVNKNEEGNEQNESAQIKEGKEKK

SEQ ID NO: 3247708 - protein, 9 aa, Plasmodium falciparum
SKYSDYKKR

SEQ ID NO: 3247709 - protein, 6 aa, Plasmodium falciparum
SKYSSC

SEQ ID NO: 3247710 - protein, 19 aa, Plasmodium falciparum
SKYSSCKHTSNSKTTKPHR

SEQ ID NO: 3247711 - protein, 4 aa, Plasmodium falciparum
SKYT

SEQ ID NO: 3247712 - protein, 7 aa, Plasmodium falciparum
SLADKTE

SEQ ID NO: 3247713 - protein, 27 aa, Plasmodium falciparum
SLAEKTNKGTGSGVSSKKKNKKGSGEP

SEQ ID NO: 3247714 - protein, 15 aa, Plasmodium falciparum
SLAGATDAGGTAAGA

SEQ ID NO: 3247715 - protein, 25 aa, Plasmodium falciparum
SLANKKKKKINMNTNTNTSTNNDIK

SEQ ID NO: 3247716 - protein, 31 aa, Plasmodium falciparum
SLANQIRKKEDDDDISYEKTAKVNKKIEDSL

SEQ ID NO: 3247717 - protein, 8 aa, Plasmodium falciparum
SLAQNQEY

SEQ ID NO: 3247718 - protein, 13 aa, Plasmodium falciparum
SLASGGAARGHPC

SEQ ID NO: 3247719 - protein, 8 aa, Plasmodium falciparum
SLDDDERI

SEQ ID NO: 3247720 - protein, 9 aa, Plasmodium falciparum
SLDDNQNNS

SEQ ID NO: 3247721 - protein, 7 aa, Plasmodium falciparum
SLDGETN

SEQ ID NO: 3247722 - protein, 4 aa, Plasmodium falciparum
SLDI

SEQ ID NO: 3247723 - protein, 4 aa, Plasmodium falciparum
SLDN

SEQ ID NO: 3247724 - protein, 9 aa, Plasmodium falciparum
SLDNNNSFT

SEQ ID NO: 3247725 - protein, 9 aa, Plasmodium falciparum
SLDPKTSIQ

SEQ ID NO: 3247726 - protein, 33 aa, Plasmodium falciparum
SLDSEKKKSIKQSSLKQKQLTNDNLKHSSSDLR

SEQ ID NO: 3247727 - protein, 9 aa, Plasmodium falciparum
SLDSNEKEK

SEQ ID NO: 3247728 - protein, 24 aa, Plasmodium falciparum
SLEDAENNINSNCEKGDENNDSKK

SEQ ID NO: 3247729 - protein, 7 aa, Plasmodium falciparum
SLEDNRK

SEQ ID NO: 3247730 - protein, 11 aa, Plasmodium falciparum
SLEEGKKDNDS

SEQ ID NO: 3247731 - protein, 9 aa, Plasmodium falciparum
SLEESNKKY

SEQ ID NO: 3247732 - protein, 13 aa, Plasmodium falciparum
SLEEYDEENYTSE

SEQ ID NO: 3247733 - protein, 24 aa, Plasmodium falciparum
SLEGEEKTNKKGTVKSPINNSSKL

SEQ ID NO: 3247734 - protein, 28 aa, Plasmodium falciparum
SLEGEKKKTQDELKDDEQEKHENMNEEE

SEQ ID NO: 3247735 - protein, 8 aa, Plasmodium falciparum
SLEGKKEK

SEQ ID NO: 3247736 - protein, 17 aa, Plasmodium falciparum
SLEHKKSTTSEGSKIKS

SEQ ID NO: 3247737 - protein, 21 aa, Plasmodium falciparum
SLEKGNKKNDTHNNDDENVSL

SEQ ID NO: 3247738 - protein, 7 aa, Plasmodium falciparum
SLENNYS

SEQ ID NO: 3247739 - protein, 9 aa, Plasmodium falciparum
SLENQHTPA

SEQ ID NO: 3247740 - protein, 7 aa, Plasmodium falciparum
SLEQKTN

SEQ ID NO: 3247741 - protein, 66 aa, Plasmodium falciparum
SLERNDSNTNIQEKVPKESKNTRKDVRTKNVNTSKRNEGLNDINESEKTRTRRPSTKSNNNNVSYE

SEQ ID NO: 3247742 - protein, 16 aa, Plasmodium falciparum
SLESSDIKSEKTCNNH

SEQ ID NO: 3247743 - protein, 6 aa, Plasmodium falciparum
SLETKQ

SEQ ID NO: 3247744 - protein, 9 aa, Plasmodium falciparum
SLGKNSTKL

SEQ ID NO: 3247745 - protein, 13 aa, Plasmodium falciparum
SLHNNNPNNKEED

SEQ ID NO: 3247746 - protein, 8 aa, Plasmodium falciparum
SLIEGQNN

SEQ ID NO: 3247747 - protein, 10 aa, Plasmodium falciparum
SLKDEENKKM

SEQ ID NO: 3247748 - protein, 16 aa, Plasmodium falciparum
SLKEQTEHVSQKGFKK

SEQ ID NO: 3247749 - protein, 22 aa, Plasmodium falciparum
SLKETDQENLNDNKKKGNKKYN

SEQ ID NO: 3247750 - protein, 9 aa, Plasmodium falciparum
SLKGSNKLS

SEQ ID NO: 3247751 - protein, 19 aa, Plasmodium falciparum
SLKKSKKQNISYKDEGKAY

SEQ ID NO: 3247752 - protein, 5 aa, Plasmodium falciparum
SLKKT

SEQ ID NO: 3247753 - protein, 18 aa, Plasmodium falciparum
SLKNATKNTGDISTEKIK

SEQ ID NO: 3247754 - protein, 10 aa, Plasmodium falciparum
SLKNDKEYID

SEQ ID NO: 3247755 - protein, 7 aa, Plasmodium falciparum
SLKNNTN

SEQ ID NO: 3247756 - protein, 9 aa, Plasmodium falciparum
SLKNQESEN

SEQ ID NO: 3247757 - protein, 16 aa, Plasmodium falciparum
SLKRGRDNSDENVQSD

SEQ ID NO: 3247758 - protein, 12 aa, Plasmodium falciparum
SLKSQKKNINNN

SEQ ID NO: 3247759 - protein, 7 aa, Plasmodium falciparum
SLKSTSG

SEQ ID NO: 3247760 - protein, 9 aa, Plasmodium falciparum
SLKTSNTLS

SEQ ID NO: 3247761 - protein, 8 aa, Plasmodium falciparum
SLLSPPSL

SEQ ID NO: 3247762 - protein, 10 aa, Plasmodium falciparum
SLLTGESEDI

SEQ ID NO: 3247763 - protein, 6 aa, Plasmodium falciparum
SLNDEN

SEQ ID NO: 3247764 - protein, 12 aa, Plasmodium falciparum
SLNDQEDQQYNK

SEQ ID NO: 3247765 - protein, 15 aa, Plasmodium falciparum
SLNDSSSYNDDSINE

SEQ ID NO: 3247766 - protein, 7 aa, Plasmodium falciparum
SLNENKS

SEQ ID NO: 3247767 - protein, 8 aa, Plasmodium falciparum
SLNETNHL

SEQ ID NO: 3247768 - protein, 6 aa, Plasmodium falciparum
SLNGKS

SEQ ID NO: 3247769 - protein, 13 aa, Plasmodium falciparum
SLNGPTSGQINEP

SEQ ID NO: 3247770 - protein, 6 aa, Plasmodium falciparum
SLNIQP

SEQ ID NO: 3247771 - protein, 4 aa, Plasmodium falciparum
SLNN

SEQ ID NO: 3247772 - protein, 5 aa, Plasmodium falciparum
SLNND

SEQ ID NO: 3247773 - protein, 5 aa, Plasmodium falciparum
SLNNP

SEQ ID NO: 3247774 - protein, 8 aa, Plasmodium falciparum
SLNNSEKY

SEQ ID NO: 3247775 - protein, 12 aa, Plasmodium falciparum
SLNNSRKEEKGV

SEQ ID NO: 3247776 - protein, 6 aa, Plasmodium falciparum
SLNRSD

SEQ ID NO: 3247777 - protein, 6 aa, Plasmodium falciparum
SLNRTN

SEQ ID NO: 3247778 - protein, 7 aa, Plasmodium falciparum
SLNSGNE

SEQ ID NO: 3247779 - protein, 47 aa, Plasmodium falciparum
SLNSHKQNGHRYDDNNNDDNNDDNNNDDDNNDDNNNDDDNNNNHNNH

SEQ ID NO: 3247780 - protein, 6 aa, Plasmodium falciparum
SLNSNK

SEQ ID NO: 3247781 - protein, 6 aa, Plasmodium falciparum
SLNSPD

SEQ ID NO: 3247782 - protein, 37 aa, Plasmodium falciparum
SLNSVASNETQLTQAHNNTSNGTKQNQVGNGTKSNNN

SEQ ID NO: 3247783 - protein, 9 aa, Plasmodium falciparum
SLNTKTNAE

SEQ ID NO: 3247784 - protein, 7 aa, Plasmodium falciparum
SLNTSNN

SEQ ID NO: 3247785 - protein, 4 aa, Plasmodium falciparum
SLPN

SEQ ID NO: 3247786 - protein, 6 aa, Plasmodium falciparum
SLPNDE

SEQ ID NO: 3247787 - protein, 48 aa, Plasmodium falciparum
SLPPEKKKKDEETSVDVSSTKKCEREGCDTEQITKPRSQETERRRKRR

SEQ ID NO: 3247788 - protein, 6 aa, Plasmodium falciparum
SLPPLN

SEQ ID NO: 3247789 - protein, 5 aa, Plasmodium falciparum
SLPQS

SEQ ID NO: 3247790 - protein, 9 aa, Plasmodium falciparum
SLPSEDNKI

SEQ ID NO: 3247791 - protein, 6 aa, Plasmodium falciparum
SLPSLS

SEQ ID NO: 3247792 - protein, 62 aa, Plasmodium falciparum
SLPTPEDSSSRPTQDADTGTDDIDDDDEEDEEDDVDPEEEADLGEENHQEESEDKDDANEAA

SEQ ID NO: 3247793 - protein, 13 aa, Plasmodium falciparum
SLPYEEDEKYTSN

SEQ ID NO: 3247794 - protein, 15 aa, Plasmodium falciparum
SLQEGKNSSNINDNY

SEQ ID NO: 3247795 - protein, 5 aa, Plasmodium falciparum
SLQNG

SEQ ID NO: 3247796 - protein, 8 aa, Plasmodium falciparum
SLQPNDRS

SEQ ID NO: 3247797 - protein, 5 aa, Plasmodium falciparum
SLQSK

SEQ ID NO: 3247798 - protein, 15 aa, Plasmodium falciparum
SLQSKRKQCKDQCDK

SEQ ID NO: 3247799 - protein, 8 aa, Plasmodium falciparum
SLQSSNYS

SEQ ID NO: 3247800 - protein, 27 aa, Plasmodium falciparum
SLQSSSNNSSDSSYSISSTCSSSSSYV

SEQ ID NO: 3247801 - protein, 7 aa, Plasmodium falciparum
SLRNKKE

SEQ ID NO: 3247802 - protein, 5 aa, Plasmodium falciparum
SLRNN

SEQ ID NO: 3247803 - protein, 9 aa, Plasmodium falciparum
SLRSNNKME

SEQ ID NO: 3247804 - protein, 6 aa, Plasmodium falciparum
SLSDRL

SEQ ID NO: 3247805 - protein, 5 aa, Plasmodium falciparum
SLSET

SEQ ID NO: 3247806 - protein, 8 aa, Plasmodium falciparum
SLSGGEPI

SEQ ID NO: 3247807 - protein, 8 aa, Plasmodium falciparum
SLSGGKPI

SEQ ID NO: 3247808 - protein, 6 aa, Plasmodium falciparum
SLSGNK

SEQ ID NO: 3247809 - protein, 6 aa, Plasmodium falciparum
SLSGNQ

SEQ ID NO: 3247810 - protein, 74 aa, Plasmodium falciparum
SLSGSTQGRKNKSLEIKNDDEIKNDDEIKNDDEIKNDDDIKNDDEIKNDDEIKNDDNINNCNNTNGCDDNTYKP

SEQ ID NO: 3247811 - protein, 6 aa, Plasmodium falciparum
SLSKDR

SEQ ID NO: 3247812 - protein, 7 aa, Plasmodium falciparum
SLSKGSI

SEQ ID NO: 3247813 - protein, 5 aa, Plasmodium falciparum
SLSKQ

SEQ ID NO: 3247814 - protein, 9 aa, Plasmodium falciparum
SLSNNDKED

SEQ ID NO: 3247815 - protein, 11 aa, Plasmodium falciparum
SLSNNKNNTTY

SEQ ID NO: 3247816 - protein, 11 aa, Plasmodium falciparum
SLSNNSTINKE

SEQ ID NO: 3247817 - protein, 8 aa, Plasmodium falciparum
SLSNSKEN

SEQ ID NO: 3247818 - protein, 10 aa, Plasmodium falciparum
SLSNSSDSSV

SEQ ID NO: 3247819 - protein, 8 aa, Plasmodium falciparum
SLSNYSST

SEQ ID NO: 3247820 - protein, 14 aa, Plasmodium falciparum
SLSQDEEEEEKKNI

SEQ ID NO: 3247821 - protein, 16 aa, Plasmodium falciparum
SLSQQNDKKKNNNDPN

SEQ ID NO: 3247822 - protein, 8 aa, Plasmodium falciparum
SLSRSTSL

SEQ ID NO: 3247823 - protein, 4 aa, Plasmodium falciparum
SLSS

SEQ ID NO: 3247824 - protein, 7 aa, Plasmodium falciparum
SLSSDED

SEQ ID NO: 3247825 - protein, 17 aa, Plasmodium falciparum
SLSSGISNIDDTHNNTY

SEQ ID NO: 3247826 - protein, 8 aa, Plasmodium falciparum
SLSSNNEQ

SEQ ID NO: 3247827 - protein, 8 aa, Plasmodium falciparum
SLSSPLPS

SEQ ID NO: 3247828 - protein, 16 aa, Plasmodium falciparum
SLSSSDEEDSDDGSYE

SEQ ID NO: 3247829 - protein, 9 aa, Plasmodium falciparum
SLSSSKKNN

SEQ ID NO: 3247830 - protein, 5 aa, Plasmodium falciparum
SLSTD

SEQ ID NO: 3247831 - protein, 5 aa, Plasmodium falciparum
SLSTE

SEQ ID NO: 3247832 - protein, 13 aa, Plasmodium falciparum
SLSTNNDIDSSYV

SEQ ID NO: 3247833 - protein, 11 aa, Plasmodium falciparum
SLSYDKKSEIM

SEQ ID NO: 3247834 - protein, 12 aa, Plasmodium falciparum
SLTDKTKNQLTY

SEQ ID NO: 3247835 - protein, 9 aa, Plasmodium falciparum
SLTKKGTSS

SEQ ID NO: 3247836 - protein, 4 aa, Plasmodium falciparum
SLTP

SEQ ID NO: 3247837 - protein, 4 aa, Plasmodium falciparum
SLVD

SEQ ID NO: 3247838 - protein, 8 aa, Plasmodium falciparum
SLVQPSDV

SEQ ID NO: 3247839 - protein, 6 aa, Plasmodium falciparum
SLYDSE

SEQ ID NO: 3247840 - protein, 7 aa, Plasmodium falciparum
SLYSNNS

SEQ ID NO: 3247841 - protein, 10 aa, Plasmodium falciparum
SMCTDSNPAF

SEQ ID NO: 3247842 - protein, 7 aa, Plasmodium falciparum
SMDENNK

SEQ ID NO: 3247843 - protein, 28 aa, Plasmodium falciparum
SMEDEKKEQSKDYNEDKNNNNNNNNDNL

SEQ ID NO: 3247844 - protein, 4 aa, Plasmodium falciparum
SMEG

SEQ ID NO: 3247845 - protein, 10 aa, Plasmodium falciparum
SMEKSKKEIT

SEQ ID NO: 3247846 - protein, 9 aa, Plasmodium falciparum
SMKDQKERY

SEQ ID NO: 3247847 - protein, 5 aa, Plasmodium falciparum
SMKNN

SEQ ID NO: 3247848 - protein, 6 aa, Plasmodium falciparum
SMKQGG

SEQ ID NO: 3247849 - protein, 4 aa, Plasmodium falciparum
SMKS

SEQ ID NO: 3247850 - protein, 4 aa, Plasmodium falciparum
SMND

SEQ ID NO: 3247851 - protein, 10 aa, Plasmodium falciparum
SMNENDENVK

SEQ ID NO: 3247852 - protein, 9 aa, Plasmodium falciparum
SMNSTNNVN

SEQ ID NO: 3247853 - protein, 6 aa, Plasmodium falciparum
SMPPPL

SEQ ID NO: 3247854 - protein, 29 aa, Plasmodium falciparum
SMQNTQKRNENKLQDDKRGENKIENDEMK

SEQ ID NO: 3247855 - protein, 4 aa, Plasmodium falciparum
SMQT

SEQ ID NO: 3247856 - protein, 4 aa, Plasmodium falciparum
SMSD

SEQ ID NO: 3247857 - protein, 29 aa, Plasmodium falciparum
SMSPKKKKAKYNNTGKDKNEDDNSNNCNN

SEQ ID NO: 3247858 - protein, 9 aa, Plasmodium falciparum
SMTDEEIDK

SEQ ID NO: 3247859 - protein, 6 aa, Plasmodium falciparum
SMTSEQ

SEQ ID NO: 3247860 - protein, 12 aa, Plasmodium falciparum
SNADQKNLSSIN

SEQ ID NO: 3247861 - protein, 6 aa, Plasmodium falciparum
SNAENE

SEQ ID NO: 3247862 - protein, 6 aa, Plasmodium falciparum
SNANNE

SEQ ID NO: 3247863 - protein, 15 aa, Plasmodium falciparum
SNANSNARSDSRSDS

SEQ ID NO: 3247864 - protein, 12 aa, Plasmodium falciparum
SNATKNTNPSVT

SEQ ID NO: 3247865 - protein, 4 aa, Plasmodium falciparum
SNAY

SEQ ID NO: 3247866 - protein, 7 aa, Plasmodium falciparum
SNCKNNS

SEQ ID NO: 3247867 - protein, 4 aa, Plasmodium falciparum
SNCN

SEQ ID NO: 3247868 - protein, 19 aa, Plasmodium falciparum
SNDAEKNYQENRNQSFSNS

SEQ ID NO: 3247869 - protein, 8 aa, Plasmodium falciparum
SNDASEKK

SEQ ID NO: 3247870 - protein, 4 aa, Plasmodium falciparum
SNDD

SEQ ID NO: 3247871 - protein, 49 aa, Plasmodium falciparum
SNDDDGDVPKSNNNNNNNDDNNDDDEDVLKSNNNNNNNNNNDNNNDHHN

SEQ ID NO: 3247872 - protein, 10 aa, Plasmodium falciparum
SNDDKKEPLI

SEQ ID NO: 3247873 - protein, 7 aa, Plasmodium falciparum
SNDDKNA

SEQ ID NO: 3247874 - protein, 9 aa, Plasmodium falciparum
SNDDNSGEC

SEQ ID NO: 3247875 - protein, 7 aa, Plasmodium falciparum
SNDDNSN

SEQ ID NO: 3247876 - protein, 5 aa, Plasmodium falciparum
SNDDP

SEQ ID NO: 3247877 - protein, 15 aa, Plasmodium falciparum
SNDDPYEEKDDDSMK

SEQ ID NO: 3247878 - protein, 5 aa, Plasmodium falciparum
SNDDQ

SEQ ID NO: 3247879 - protein, 6 aa, Plasmodium falciparum
SNDDRE

SEQ ID NO: 3247880 - protein, 9 aa, Plasmodium falciparum
SNDEHKNEH

SEQ ID NO: 3247881 - protein, 10 aa, Plasmodium falciparum
SNDEKKKKMN

SEQ ID NO: 3247882 - protein, 8 aa, Plasmodium falciparum
SNDEKNIQ

SEQ ID NO: 3247883 - protein, 9 aa, Plasmodium falciparum
SNDEKNRKS

SEQ ID NO: 3247884 - protein, 7 aa, Plasmodium falciparum
SNDEPDY

SEQ ID NO: 3247885 - protein, 7 aa, Plasmodium falciparum
SNDEQDN

SEQ ID NO: 3247886 - protein, 10 aa, Plasmodium falciparum
SNDERNNETN

SEQ ID NO: 3247887 - protein, 7 aa, Plasmodium falciparum
SNDFTPH

SEQ ID NO: 3247888 - protein, 11 aa, Plasmodium falciparum
SNDHDKRKESE

SEQ ID NO: 3247889 - protein, 26 aa, Plasmodium falciparum
SNDIKKEEKDIYSSEDEQNNSKQEEL

SEQ ID NO: 3247890 - protein, 6 aa, Plasmodium falciparum
SNDING

SEQ ID NO: 3247891 - protein, 7 aa, Plasmodium falciparum
SNDINNK

SEQ ID NO: 3247892 - protein, 17 aa, Plasmodium falciparum
SNDINNNDIKNTEENNP

SEQ ID NO: 3247893 - protein, 6 aa, Plasmodium falciparum
SNDISN

SEQ ID NO: 3247894 - protein, 19 aa, Plasmodium falciparum
SNDITNDYKNEEKASRDNL

SEQ ID NO: 3247895 - protein, 8 aa, Plasmodium falciparum
SNDKCNKK

SEQ ID NO: 3247896 - protein, 10 aa, Plasmodium falciparum
SNDKDLNKNM

SEQ ID NO: 3247897 - protein, 10 aa, Plasmodium falciparum
SNDKEKKEMR

SEQ ID NO: 3247898 - protein, 5 aa, Plasmodium falciparum
SNDKH

SEQ ID NO: 3247899 - protein, 13 aa, Plasmodium falciparum
SNDKINNNEQKKK

SEQ ID NO: 3247900 - protein, 10 aa, Plasmodium falciparum
SNDKKKKKRK

SEQ ID NO: 3247901 - protein, 6 aa, Plasmodium falciparum
SNDKKS

SEQ ID NO: 3247902 - protein, 8 aa, Plasmodium falciparum
SNDKLNDH

SEQ ID NO: 3247903 - protein, 6 aa, Plasmodium falciparum
SNDKNN

SEQ ID NO: 3247904 - protein, 8 aa, Plasmodium falciparum
SNDKPMDT

SEQ ID NO: 3247905 - protein, 11 aa, Plasmodium falciparum
SNDKVSNTSDD

SEQ ID NO: 3247906 - protein, 26 aa, Plasmodium falciparum
SNDLDKGTKKIGSKKGNVVSSKKETI

SEQ ID NO: 3247907 - protein, 18 aa, Plasmodium falciparum
SNDLSSGHKNVNNNEKIR

SEQ ID NO: 3247908 - protein, 4 aa, Plasmodium falciparum
SNDN

SEQ ID NO: 3247909 - protein, 9 aa, Plasmodium falciparum
SNDNDPDMK

SEQ ID NO: 3247910 - protein, 5 aa, Plasmodium falciparum
SNDNK

SEQ ID NO: 3247911 - protein, 7 aa, Plasmodium falciparum
SNDNKNN

SEQ ID NO: 3247912 - protein, 12 aa, Plasmodium falciparum
SNDNLSKENTSY

SEQ ID NO: 3247913 - protein, 7 aa, Plasmodium falciparum
SNDNMST

SEQ ID NO: 3247914 - protein, 5 aa, Plasmodium falciparum
SNDNN

SEQ ID NO: 3247915 - protein, 19 aa, Plasmodium falciparum
SNDNNNNNNNNNKINNDDD

SEQ ID NO: 3247916 - protein, 11 aa, Plasmodium falciparum
SNDNPINKDDR

SEQ ID NO: 3247917 - protein, 5 aa, Plasmodium falciparum
SNDNS

SEQ ID NO: 3247918 - protein, 8 aa, Plasmodium falciparum
SNDNVENG

SEQ ID NO: 3247919 - protein, 4 aa, Plasmodium falciparum
SNDP

SEQ ID NO: 3247920 - protein, 7 aa, Plasmodium falciparum
SNDPHKK

SEQ ID NO: 3247921 - protein, 6 aa, Plasmodium falciparum
SNDPKN

SEQ ID NO: 3247922 - protein, 5 aa, Plasmodium falciparum
SNDPN

SEQ ID NO: 3247923 - protein, 17 aa, Plasmodium falciparum
SNDPRGSASTYKGNSSI

SEQ ID NO: 3247924 - protein, 7 aa, Plasmodium falciparum
SNDPYDN

SEQ ID NO: 3247925 - protein, 16 aa, Plasmodium falciparum
SNDQHNKDNHNPNNHN

SEQ ID NO: 3247926 - protein, 12 aa, Plasmodium falciparum
SNDQLKNDNINN

SEQ ID NO: 3247927 - protein, 17 aa, Plasmodium falciparum
SNDRGKKKDAKTFTGLE

SEQ ID NO: 3247928 - protein, 28 aa, Plasmodium falciparum
SNDRREDGSGNDKYGGPCTGKGTGENDQ

SEQ ID NO: 3247929 - protein, 5 aa, Plasmodium falciparum
SNDSI

SEQ ID NO: 3247930 - protein, 9 aa, Plasmodium falciparum
SNDSKEGRN

SEQ ID NO: 3247931 - protein, 7 aa, Plasmodium falciparum
SNDSNIS

SEQ ID NO: 3247932 - protein, 10 aa, Plasmodium falciparum
SNDSQSEYSA

SEQ ID NO: 3247933 - protein, 7 aa, Plasmodium falciparum
SNDSSIN

SEQ ID NO: 3247934 - protein, 7 aa, Plasmodium falciparum
SNDTKKL

SEQ ID NO: 3247935 - protein, 17 aa, Plasmodium falciparum
SNDTRLRKNESKKYEGE

SEQ ID NO: 3247936 - protein, 11 aa, Plasmodium falciparum
SNDTSYKNSSL

SEQ ID NO: 3247937 - protein, 6 aa, Plasmodium falciparum
SNDTYI

SEQ ID NO: 3247938 - protein, 5 aa, Plasmodium falciparum
SNDVH

SEQ ID NO: 3247939 - protein, 4 aa, Plasmodium falciparum
SNDY

SEQ ID NO: 3247940 - protein, 6 aa, Plasmodium falciparum
SNDYHH

SEQ ID NO: 3247941 - protein, 13 aa, Plasmodium falciparum
SNDYNSDNNTNKD

SEQ ID NO: 3247942 - protein, 5 aa, Plasmodium falciparum
SNEAH

SEQ ID NO: 3247943 - protein, 7 aa, Plasmodium falciparum
SNEATHH

SEQ ID NO: 3247944 - protein, 8 aa, Plasmodium falciparum
SNECYSGG

SEQ ID NO: 3247945 - protein, 12 aa, Plasmodium falciparum
SNEEDEKDEKKW

SEQ ID NO: 3247946 - protein, 6 aa, Plasmodium falciparum
SNEEDK

SEQ ID NO: 3247947 - protein, 7 aa, Plasmodium falciparum
SNEEHNK

SEQ ID NO: 3247948 - protein, 7 aa, Plasmodium falciparum
SNEEKEK

SEQ ID NO: 3247949 - protein, 5 aa, Plasmodium falciparum
SNEEN

SEQ ID NO: 3247950 - protein, 6 aa, Plasmodium falciparum
SNEENN

SEQ ID NO: 3247951 - protein, 6 aa, Plasmodium falciparum
SNEFKD

SEQ ID NO: 3247952 - protein, 10 aa, Plasmodium falciparum
SNEGKNANKI

SEQ ID NO: 3247953 - protein, 30 aa, Plasmodium falciparum
SNEGNDPNNNYDNEHDLDDDDDDDDNDDDS

SEQ ID NO: 3247954 - protein, 7 aa, Plasmodium falciparum
SNEHDTK

SEQ ID NO: 3247955 - protein, 5 aa, Plasmodium falciparum
SNEHF

SEQ ID NO: 3247956 - protein, 8 aa, Plasmodium falciparum
SNEHKKEL

SEQ ID NO: 3247957 - protein, 7 aa, Plasmodium falciparum
SNEHSNN

SEQ ID NO: 3247958 - protein, 4 aa, Plasmodium falciparum
SNEI

SEQ ID NO: 3247959 - protein, 13 aa, Plasmodium falciparum
SNEIEESNKIEES

SEQ ID NO: 3247960 - protein, 5 aa, Plasmodium falciparum
SNEIK

SEQ ID NO: 3247961 - protein, 24 aa, Plasmodium falciparum
SNEKDTSINEKEKYINDKSSVEKN

SEQ ID NO: 3247962 - protein, 8 aa, Plasmodium falciparum
SNEKGKKI

SEQ ID NO: 3247963 - protein, 8 aa, Plasmodium falciparum
SNEKKEEI

SEQ ID NO: 3247964 - protein, 8 aa, Plasmodium falciparum
SNEKKTDD

SEQ ID NO: 3247965 - protein, 17 aa, Plasmodium falciparum
SNEKNEINQKNQKNQNI

SEQ ID NO: 3247966 - protein, 8 aa, Plasmodium falciparum
SNEKRKNL

SEQ ID NO: 3247967 - protein, 5 aa, Plasmodium falciparum
SNEKT

SEQ ID NO: 3247968 - protein, 7 aa, Plasmodium falciparum
SNENGDV

SEQ ID NO: 3247969 - protein, 5 aa, Plasmodium falciparum
SNENH

SEQ ID NO: 3247970 - protein, 5 aa, Plasmodium falciparum
SNENI

SEQ ID NO: 3247971 - protein, 5 aa, Plasmodium falciparum
SNENK

SEQ ID NO: 3247972 - protein, 11 aa, Plasmodium falciparum
SNENKPDKGKK

SEQ ID NO: 3247973 - protein, 15 aa, Plasmodium falciparum
SNENMKKKKKKKKNT

SEQ ID NO: 3247974 - protein, 5 aa, Plasmodium falciparum
SNENS

SEQ ID NO: 3247975 - protein, 12 aa, Plasmodium falciparum
SNENTEGKENAS

SEQ ID NO: 3247976 - protein, 7 aa, Plasmodium falciparum
SNENTHN

SEQ ID NO: 3247977 - protein, 8 aa, Plasmodium falciparum
SNEPIGEA

SEQ ID NO: 3247978 - protein, 6 aa, Plasmodium falciparum
SNEPQK

SEQ ID NO: 3247979 - protein, 7 aa, Plasmodium falciparum
SNEPSPL

SEQ ID NO: 3247980 - protein, 15 aa, Plasmodium falciparum
SNEQEKGNKKNSCVN

SEQ ID NO: 3247981 - protein, 7 aa, Plasmodium falciparum
SNEQLEN

SEQ ID NO: 3247982 - protein, 5 aa, Plasmodium falciparum
SNEQN

SEQ ID NO: 3247983 - protein, 30 aa, Plasmodium falciparum
SNEQSNHKEVQEYQDSDIYDDDNDEDVDQY

SEQ ID NO: 3247984 - protein, 12 aa, Plasmodium falciparum
SNERDEQINEEA

SEQ ID NO: 3247985 - protein, 5 aa, Plasmodium falciparum
SNERH

SEQ ID NO: 3247986 - protein, 5 aa, Plasmodium falciparum
SNESK

SEQ ID NO: 3247987 - protein, 5 aa, Plasmodium falciparum
SNESN

SEQ ID NO: 3247988 - protein, 24 aa, Plasmodium falciparum
SNESSAQDNINNTYSSLSKQNNKN

SEQ ID NO: 3247989 - protein, 8 aa, Plasmodium falciparum
SNETHISS

SEQ ID NO: 3247990 - protein, 7 aa, Plasmodium falciparum
SNETKKH

SEQ ID NO: 3247991 - protein, 6 aa, Plasmodium falciparum
SNETNL

SEQ ID NO: 3247992 - protein, 10 aa, Plasmodium falciparum
SNETQNKKFS

SEQ ID NO: 3247993 - protein, 4 aa, Plasmodium falciparum
SNEY

SEQ ID NO: 3247994 - protein, 10 aa, Plasmodium falciparum
SNEYEEEQEE

SEQ ID NO: 3247995 - protein, 6 aa, Plasmodium falciparum
SNEYEY

SEQ ID NO: 3247996 - protein, 6 aa, Plasmodium falciparum
SNEYTN

SEQ ID NO: 3247997 - protein, 7 aa, Plasmodium falciparum
SNFNESE

SEQ ID NO: 3247998 - protein, 7 aa, Plasmodium falciparum
SNFPKQN

SEQ ID NO: 3247999 - protein, 7 aa, Plasmodium falciparum
SNFSNGG

SEQ ID NO: 3248000 - protein, 8 aa, Plasmodium falciparum
SNFSSASA

SEQ ID NO: 3248001 - protein, 6 aa, Plasmodium falciparum
SNFTSQ

SEQ ID NO: 3248002 - protein, 7 aa, Plasmodium falciparum
SNGEPTF

SEQ ID NO: 3248003 - protein, 4 aa, Plasmodium falciparum
SNGF

SEQ ID NO: 3248004 - protein, 11 aa, Plasmodium falciparum
SNGIKGASKSF

SEQ ID NO: 3248005 - protein, 7 aa, Plasmodium falciparum
SNGIPGK

SEQ ID NO: 3248006 - protein, 8 aa, Plasmodium falciparum
SNGKGGNT

SEQ ID NO: 3248007 - protein, 12 aa, Plasmodium falciparum
SNGKGLGENIPS

SEQ ID NO: 3248008 - protein, 9 aa, Plasmodium falciparum
SNGKQEDTD

SEQ ID NO: 3248009 - protein, 5 aa, Plasmodium falciparum
SNGLK

SEQ ID NO: 3248010 - protein, 4 aa, Plasmodium falciparum
SNGN

SEQ ID NO: 3248011 - protein, 16 aa, Plasmodium falciparum
SNGNDEEEEEEEEYTL

SEQ ID NO: 3248012 - protein, 7 aa, Plasmodium falciparum
SNGNYES

SEQ ID NO: 3248013 - protein, 8 aa, Plasmodium falciparum
SNGPHTNE

SEQ ID NO: 3248014 - protein, 6 aa, Plasmodium falciparum
SNGRAS

SEQ ID NO: 3248015 - protein, 6 aa, Plasmodium falciparum
SNGYGD

SEQ ID NO: 3248016 - protein, 10 aa, Plasmodium falciparum
SNHEKKNKMK

SEQ ID NO: 3248017 - protein, 8 aa, Plasmodium falciparum
SNHEQGTM

SEQ ID NO: 3248018 - protein, 5 aa, Plasmodium falciparum
SNHEY

SEQ ID NO: 3248019 - protein, 8 aa, Plasmodium falciparum
SNHKKNDP

SEQ ID NO: 3248020 - protein, 26 aa, Plasmodium falciparum
SNHNNDDHNGDHNNDLNNDHNNDHNN

SEQ ID NO: 3248021 - protein, 7 aa, Plasmodium falciparum
SNHPNDI

SEQ ID NO: 3248022 - protein, 11 aa, Plasmodium falciparum
SNHREYPYNNN

SEQ ID NO: 3248023 - protein, 9 aa, Plasmodium falciparum
SNHYENENN

SEQ ID NO: 3248024 - protein, 6 aa, Plasmodium falciparum
SNIDDS

SEQ ID NO: 3248025 - protein, 8 aa, Plasmodium falciparum
SNIDETTD

SEQ ID NO: 3248026 - protein, 30 aa, Plasmodium falciparum
SNIDNDERFTTSYNNNNEGKKTKKIKGKGN

SEQ ID NO: 3248027 - protein, 17 aa, Plasmodium falciparum
SNIDNINNNPNSSISNN

SEQ ID NO: 3248028 - protein, 4 aa, Plasmodium falciparum
SNIE

SEQ ID NO: 3248029 - protein, 17 aa, Plasmodium falciparum
SNIEGGEEEEEDANTLK

SEQ ID NO: 3248030 - protein, 6 aa, Plasmodium falciparum
SNIGSA

SEQ ID NO: 3248031 - protein, 4 aa, Plasmodium falciparum
SNIH

SEQ ID NO: 3248032 - protein, 7 aa, Plasmodium falciparum
SNIHNNS

SEQ ID NO: 3248033 - protein, 18 aa, Plasmodium falciparum
SNIHTNQSYTADSISDDL

SEQ ID NO: 3248034 - protein, 4 aa, Plasmodium falciparum
SNII

SEQ ID NO: 3248035 - protein, 6 aa, Plasmodium falciparum
SNIINQ

SEQ ID NO: 3248036 - protein, 5 aa, Plasmodium falciparum
SNIKD

SEQ ID NO: 3248037 - protein, 10 aa, Plasmodium falciparum
SNIKDKNENT

SEQ ID NO: 3248038 - protein, 22 aa, Plasmodium falciparum
SNIKENKKYSNKTIQQEENTEH

SEQ ID NO: 3248039 - protein, 6 aa, Plasmodium falciparum
SNIKNN

SEQ ID NO: 3248040 - protein, 9 aa, Plasmodium falciparum
SNIKTDQQY

SEQ ID NO: 3248041 - protein, 4 aa, Plasmodium falciparum
SNIN

SEQ ID NO: 3248042 - protein, 11 aa, Plasmodium falciparum
SNINKKDDNVT

SEQ ID NO: 3248043 - protein, 11 aa, Plasmodium falciparum
SNINNSSYSNI

SEQ ID NO: 3248044 - protein, 6 aa, Plasmodium falciparum
SNINSI

SEQ ID NO: 3248045 - protein, 47 aa, Plasmodium falciparum
SNINSRGSYTSSHYNKGDVTNSSYDKSNSYSDDDYNDSDTSKFQENR

SEQ ID NO: 3248046 - protein, 8 aa, Plasmodium falciparum
SNINSSKT

SEQ ID NO: 3248047 - protein, 8 aa, Plasmodium falciparum
SNINTECN

SEQ ID NO: 3248048 - protein, 8 aa, Plasmodium falciparum
SNIPDGPN

SEQ ID NO: 3248049 - protein, 6 aa, Plasmodium falciparum
SNIPKN

SEQ ID NO: 3248050 - protein, 14 aa, Plasmodium falciparum
SNIPKNKKDMNNSM

SEQ ID NO: 3248051 - protein, 6 aa, Plasmodium falciparum
SNIPND

SEQ ID NO: 3248052 - protein, 15 aa, Plasmodium falciparum
SNIPSTNEENDNSEF

SEQ ID NO: 3248053 - protein, 5 aa, Plasmodium falciparum
SNIQS

SEQ ID NO: 3248054 - protein, 10 aa, Plasmodium falciparum
SNIREPEPRT

SEQ ID NO: 3248055 - protein, 4 aa, Plasmodium falciparum
SNIS

SEQ ID NO: 3248056 - protein, 15 aa, Plasmodium falciparum
SNISNNMNSNINNNM

SEQ ID NO: 3248057 - protein, 14 aa, Plasmodium falciparum
SNISSDENENNMND

SEQ ID NO: 3248058 - protein, 6 aa, Plasmodium falciparum
SNITDE

SEQ ID NO: 3248059 - protein, 74 aa, Plasmodium falciparum
SNKCYDDDNNNDDNNNDDNNNDDNNNDDNNNDDNNSSNNNNDDNNNDDNNSSNNNNDDNNNDDNNSSNNNNDDD

SEQ ID NO: 3248060 - protein, 5 aa, Plasmodium falciparum
SNKDD

SEQ ID NO: 3248061 - protein, 6 aa, Plasmodium falciparum
SNKDEC

SEQ ID NO: 3248062 - protein, 5 aa, Plasmodium falciparum
SNKDN

SEQ ID NO: 3248063 - protein, 6 aa, Plasmodium falciparum
SNKDPD

SEQ ID NO: 3248064 - protein, 9 aa, Plasmodium falciparum
SNKDPKRVS

SEQ ID NO: 3248065 - protein, 4 aa, Plasmodium falciparum
SNKE

SEQ ID NO: 3248066 - protein, 12 aa, Plasmodium falciparum
SNKEGGTPTKIS

SEQ ID NO: 3248067 - protein, 12 aa, Plasmodium falciparum
SNKEKTKQNNKN

SEQ ID NO: 3248068 - protein, 5 aa, Plasmodium falciparum
SNKEN

SEQ ID NO: 3248069 - protein, 12 aa, Plasmodium falciparum
SNKENASMNKEN

SEQ ID NO: 3248070 - protein, 6 aa, Plasmodium falciparum
SNKENC

SEQ ID NO: 3248071 - protein, 9 aa, Plasmodium falciparum
SNKENVKAN

SEQ ID NO: 3248072 - protein, 9 aa, Plasmodium falciparum
SNKESNSFI

SEQ ID NO: 3248073 - protein, 9 aa, Plasmodium falciparum
SNKESQNIT

SEQ ID NO: 3248074 - protein, 6 aa, Plasmodium falciparum
SNKESY

SEQ ID NO: 3248075 - protein, 8 aa, Plasmodium falciparum
SNKETFNP

SEQ ID NO: 3248076 - protein, 4 aa, Plasmodium falciparum
SNKF

SEQ ID NO: 3248077 - protein, 12 aa, Plasmodium falciparum
SNKGPKNQGKKQ

SEQ ID NO: 3248078 - protein, 11 aa, Plasmodium falciparum
SNKGRNNNGNM

SEQ ID NO: 3248079 - protein, 36 aa, Plasmodium falciparum
SNKHKNNNNNNNNNDYHNNNKSNYHSHSSAKCQTQR

SEQ ID NO: 3248080 - protein, 6 aa, Plasmodium falciparum
SNKHTH

SEQ ID NO: 3248081 - protein, 13 aa, Plasmodium falciparum
SNKIEESNKIEEP

SEQ ID NO: 3248082 - protein, 25 aa, Plasmodium falciparum
SNKIKGGDNEKLKEEKKQSDISTNV

SEQ ID NO: 3248083 - protein, 31 aa, Plasmodium falciparum
SNKKDQLPLEEKKNKNGDLNNTLTESDGKKI

SEQ ID NO: 3248084 - protein, 5 aa, Plasmodium falciparum
SNKKF

SEQ ID NO: 3248085 - protein, 9 aa, Plasmodium falciparum
SNKKGKKNV

SEQ ID NO: 3248086 - protein, 9 aa, Plasmodium falciparum
SNKKKITQI

SEQ ID NO: 3248087 - protein, 10 aa, Plasmodium falciparum
SNKKKRKKLK

SEQ ID NO: 3248088 - protein, 6 aa, Plasmodium falciparum
SNKKND

SEQ ID NO: 3248089 - protein, 7 aa, Plasmodium falciparum
SNKKNED

SEQ ID NO: 3248090 - protein, 8 aa, Plasmodium falciparum
SNKKNNKQ

SEQ ID NO: 3248091 - protein, 15 aa, Plasmodium falciparum
SNKKRKNKKNMDNEN

SEQ ID NO: 3248092 - protein, 9 aa, Plasmodium falciparum
SNKKTEKKN

SEQ ID NO: 3248093 - protein, 35 aa, Plasmodium falciparum
SNKMKKKKKNNNNINSDNNNDNNNDNDNNCNSNSN

SEQ ID NO: 3248094 - protein, 37 aa, Plasmodium falciparum
SNKMNSSNLQNDKNVGFDSSNLNNKKINEQDRNYTDY

SEQ ID NO: 3248095 - protein, 7 aa, Plasmodium falciparum
SNKNCKN

SEQ ID NO: 3248096 - protein, 9 aa, Plasmodium falciparum
SNKNEVENE

SEQ ID NO: 3248097 - protein, 9 aa, Plasmodium falciparum
SNKNKNENF

SEQ ID NO: 3248098 - protein, 12 aa, Plasmodium falciparum
SNKNKNKSINNN

SEQ ID NO: 3248099 - protein, 5 aa, Plasmodium falciparum
SNKNN

SEQ ID NO: 3248100 - protein, 9 aa, Plasmodium falciparum
SNKNNDHVN

SEQ ID NO: 3248101 - protein, 7 aa, Plasmodium falciparum
SNKNNNI

SEQ ID NO: 3248102 - protein, 25 aa, Plasmodium falciparum
SNKNNNNDNNNNDNDNNDNDNNNNV

SEQ ID NO: 3248103 - protein, 7 aa, Plasmodium falciparum
SNKNTSF

SEQ ID NO: 3248104 - protein, 9 aa, Plasmodium falciparum
SNKNTSNNE

SEQ ID NO: 3248105 - protein, 18 aa, Plasmodium falciparum
SNKQHNNVQTSTSSYQQS

SEQ ID NO: 3248106 - protein, 20 aa, Plasmodium falciparum
SNKQKYKNKKNKKKNKNNDY

SEQ ID NO: 3248107 - protein, 8 aa, Plasmodium falciparum
SNKQQNIN

SEQ ID NO: 3248108 - protein, 10 aa, Plasmodium falciparum
SNKQTAPYEK

SEQ ID NO: 3248109 - protein, 9 aa, Plasmodium falciparum
SNKREPSSI

SEQ ID NO: 3248110 - protein, 12 aa, Plasmodium falciparum
SNKRKGKMGEGY

SEQ ID NO: 3248111 - protein, 7 aa, Plasmodium falciparum
SNKRTRK

SEQ ID NO: 3248112 - protein, 11 aa, Plasmodium falciparum
SNKRYDKRGRI

SEQ ID NO: 3248113 - protein, 4 aa, Plasmodium falciparum
SNKS

SEQ ID NO: 3248114 - protein, 5 aa, Plasmodium falciparum
SNKSD

SEQ ID NO: 3248115 - protein, 14 aa, Plasmodium falciparum
SNKSENISDEEEYT

SEQ ID NO: 3248116 - protein, 15 aa, Plasmodium falciparum
SNKSGDSNTENNSDC

SEQ ID NO: 3248117 - protein, 16 aa, Plasmodium falciparum
SNKSKDKHDAYTTKKQ

SEQ ID NO: 3248118 - protein, 9 aa, Plasmodium falciparum
SNKSKIKKD

SEQ ID NO: 3248119 - protein, 7 aa, Plasmodium falciparum
SNKSNNK

SEQ ID NO: 3248120 - protein, 9 aa, Plasmodium falciparum
SNKSNNKSC

SEQ ID NO: 3248121 - protein, 8 aa, Plasmodium falciparum
SNKSTSNF

SEQ ID NO: 3248122 - protein, 5 aa, Plasmodium falciparum
SNKTA

SEQ ID NO: 3248123 - protein, 5 aa, Plasmodium falciparum
SNKTI

SEQ ID NO: 3248124 - protein, 7 aa, Plasmodium falciparum
SNKTIRN

SEQ ID NO: 3248125 - protein, 13 aa, Plasmodium falciparum
SNKTKKTSSDKIK

SEQ ID NO: 3248126 - protein, 9 aa, Plasmodium falciparum
SNKTYNEKN

SEQ ID NO: 3248127 - protein, 5 aa, Plasmodium falciparum
SNKYI

SEQ ID NO: 3248128 - protein, 13 aa, Plasmodium falciparum
SNLDNENKKAIEK

SEQ ID NO: 3248129 - protein, 5 aa, Plasmodium falciparum
SNLER

SEQ ID NO: 3248130 - protein, 17 aa, Plasmodium falciparum
SNLKTVKDNNKNTSHED

SEQ ID NO: 3248131 - protein, 15 aa, Plasmodium falciparum
SNLNATNKIKKKKVN

SEQ ID NO: 3248132 - protein, 5 aa, Plasmodium falciparum
SNLNR

SEQ ID NO: 3248133 - protein, 12 aa, Plasmodium falciparum
SNLPGSESHAGT

SEQ ID NO: 3248134 - protein, 9 aa, Plasmodium falciparum
SNLRNSENK

SEQ ID NO: 3248135 - protein, 4 aa, Plasmodium falciparum
SNLS

SEQ ID NO: 3248136 - protein, 5 aa, Plasmodium falciparum
SNLSE

SEQ ID NO: 3248137 - protein, 17 aa, Plasmodium falciparum
SNLSGTTPTLSKTKSVK

SEQ ID NO: 3248138 - protein, 6 aa, Plasmodium falciparum
SNLSNS

SEQ ID NO: 3248139 - protein, 8 aa, Plasmodium falciparum
SNLSPTSQ

SEQ ID NO: 3248140 - protein, 4 aa, Plasmodium falciparum
SNLT

SEQ ID NO: 3248141 - protein, 19 aa, Plasmodium falciparum
SNLTSEKIKKKKKKGDHTC

SEQ ID NO: 3248142 - protein, 10 aa, Plasmodium falciparum
SNLTTDGVSY

SEQ ID NO: 3248143 - protein, 22 aa, Plasmodium falciparum
SNLYNEQDYDEENEKEKEMEST

SEQ ID NO: 3248144 - protein, 19 aa, Plasmodium falciparum
SNMEKQKRIRRRKKGRGTE

SEQ ID NO: 3248145 - protein, 60 aa, Plasmodium falciparum
SNMGNNKNNTTANNNNNNHNNNNNNHSNNHSNNHSISHSNNHSNNHNNNHSNNHNKSHDV

SEQ ID NO: 3248146 - protein, 5 aa, Plasmodium falciparum
SNMKN

SEQ ID NO: 3248147 - protein, 5 aa, Plasmodium falciparum
SNMND

SEQ ID NO: 3248148 - protein, 5 aa, Plasmodium falciparum
SNMNE

SEQ ID NO: 3248149 - protein, 33 aa, Plasmodium falciparum
SNMNEKTKRENDSVYEKQNNSTFNKNNYSNKNY

SEQ ID NO: 3248150 - protein, 5 aa, Plasmodium falciparum
SNMNN

SEQ ID NO: 3248151 - protein, 36 aa, Plasmodium falciparum
SNNAEGGDGGYNNHSNSNYRNNGNNNIGNYNNNGSN

SEQ ID NO: 3248152 - protein, 24 aa, Plasmodium falciparum
SNNCNNSNSNNSNSNNNNNNNNNI

SEQ ID NO: 3248153 - protein, 5 aa, Plasmodium falciparum
SNNDE

SEQ ID NO: 3248154 - protein, 17 aa, Plasmodium falciparum
SNNDEKYSFTKKKESIK

SEQ ID NO: 3248155 - protein, 9 aa, Plasmodium falciparum
SNNDGNQES

SEQ ID NO: 3248156 - protein, 4 aa, Plasmodium falciparum
SNNE

SEQ ID NO: 3248157 - protein, 8 aa, Plasmodium falciparum
SNNEDNKN

SEQ ID NO: 3248158 - protein, 15 aa, Plasmodium falciparum
SNNEESSICKTKSTN

SEQ ID NO: 3248159 - protein, 10 aa, Plasmodium falciparum
SNNEEYDNMG

SEQ ID NO: 3248160 - protein, 5 aa, Plasmodium falciparum
SNNEI

SEQ ID NO: 3248161 - protein, 19 aa, Plasmodium falciparum
SNNEKDESSDENEKEKKYN

SEQ ID NO: 3248162 - protein, 11 aa, Plasmodium falciparum
SNNEKEINKKK

SEQ ID NO: 3248163 - protein, 8 aa, Plasmodium falciparum
SNNEKNVC

SEQ ID NO: 3248164 - protein, 5 aa, Plasmodium falciparum
SNNEM

SEQ ID NO: 3248165 - protein, 7 aa, Plasmodium falciparum
SNNENNI

SEQ ID NO: 3248166 - protein, 16 aa, Plasmodium falciparum
SNNEPTNDSYNNRENK

SEQ ID NO: 3248167 - protein, 5 aa, Plasmodium falciparum
SNNER

SEQ ID NO: 3248168 - protein, 6 aa, Plasmodium falciparum
SNNESG

SEQ ID NO: 3248169 - protein, 9 aa, Plasmodium falciparum
SNNEVASRN

SEQ ID NO: 3248170 - protein, 8 aa, Plasmodium falciparum
SNNFPKDD

SEQ ID NO: 3248171 - protein, 6 aa, Plasmodium falciparum
SNNGSI

SEQ ID NO: 3248172 - protein, 7 aa, Plasmodium falciparum
SNNHDNN

SEQ ID NO: 3248173 - protein, 4 aa, Plasmodium falciparum
SNNI

SEQ ID NO: 3248174 - protein, 8 aa, Plasmodium falciparum
SNNIDTNK

SEQ ID NO: 3248175 - protein, 18 aa, Plasmodium falciparum
SNNIGNDDINNKKDNFEF

SEQ ID NO: 3248176 - protein, 10 aa, Plasmodium falciparum
SNNIKEYDDE

SEQ ID NO: 3248177 - protein, 5 aa, Plasmodium falciparum
SNNIN

SEQ ID NO: 3248178 - protein, 7 aa, Plasmodium falciparum
SNNINES

SEQ ID NO: 3248179 - protein, 10 aa, Plasmodium falciparum
SNNINNSNHP

SEQ ID NO: 3248180 - protein, 13 aa, Plasmodium falciparum
SNNINTDSYNNNN

SEQ ID NO: 3248181 - protein, 5 aa, Plasmodium falciparum
SNNIS

SEQ ID NO: 3248182 - protein, 7 aa, Plasmodium falciparum
SNNISNN

SEQ ID NO: 3248183 - protein, 7 aa, Plasmodium falciparum
SNNISTN

SEQ ID NO: 3248184 - protein, 4 aa, Plasmodium falciparum
SNNK

SEQ ID NO: 3248185 - protein, 6 aa, Plasmodium falciparum
SNNKEE

SEQ ID NO: 3248186 - protein, 5 aa, Plasmodium falciparum
SNNKH

SEQ ID NO: 3248187 - protein, 5 aa, Plasmodium falciparum
SNNKK

SEQ ID NO: 3248188 - protein, 19 aa, Plasmodium falciparum
SNNKKKKKNDKKKKKKFNK

SEQ ID NO: 3248189 - protein, 7 aa, Plasmodium falciparum
SNNKNKD

SEQ ID NO: 3248190 - protein, 8 aa, Plasmodium falciparum
SNNKNTNN

SEQ ID NO: 3248191 - protein, 10 aa, Plasmodium falciparum
SNNKRDDKFN

SEQ ID NO: 3248192 - protein, 11 aa, Plasmodium falciparum
SNNKYINNNNN

SEQ ID NO: 3248193 - protein, 10 aa, Plasmodium falciparum
SNNLEENKNS

SEQ ID NO: 3248194 - protein, 6 aa, Plasmodium falciparum
SNNMNK

SEQ ID NO: 3248195 - protein, 7 aa, Plasmodium falciparum
SNNNAMN

SEQ ID NO: 3248196 - protein, 6 aa, Plasmodium falciparum
SNNNDI

SEQ ID NO: 3248197 - protein, 6 aa, Plasmodium falciparum
SNNNGR

SEQ ID NO: 3248198 - protein, 7 aa, Plasmodium falciparum
SNNNINN

SEQ ID NO: 3248199 - protein, 20 aa, Plasmodium falciparum
SNNNKGNNNNTLDEKGGEVD

SEQ ID NO: 3248200 - protein, 10 aa, Plasmodium falciparum
SNNNKTNNND

SEQ ID NO: 3248201 - protein, 6 aa, Plasmodium falciparum
SNNNKW

SEQ ID NO: 3248202 - protein, 5 aa, Plasmodium falciparum
SNNNL

SEQ ID NO: 3248203 - protein, 9 aa, Plasmodium falciparum
SNNNMDDNN

SEQ ID NO: 3248204 - protein, 7 aa, Plasmodium falciparum
SNNNMRG

SEQ ID NO: 3248205 - protein, 14 aa, Plasmodium falciparum
SNNNNDNKNNDNYF

SEQ ID NO: 3248206 - protein, 9 aa, Plasmodium falciparum
SNNNNFNNI

SEQ ID NO: 3248207 - protein, 8 aa, Plasmodium falciparum
SNNNNIST

SEQ ID NO: 3248208 - protein, 19 aa, Plasmodium falciparum
SNNNNNNKNNNDNNKKKLY

SEQ ID NO: 3248209 - protein, 9 aa, Plasmodium falciparum
SNNNNNNND

SEQ ID NO: 3248210 - protein, 30 aa, Plasmodium falciparum
SNNNNNNNDSNNNTVYDKKKQKDDQEENEL

SEQ ID NO: 3248211 - protein, 13 aa, Plasmodium falciparum
SNNNNNNNINCSN

SEQ ID NO: 3248212 - protein, 10 aa, Plasmodium falciparum
SNNNNNNNIP

SEQ ID NO: 3248213 - protein, 10 aa, Plasmodium falciparum
SNNNNNNNNI

SEQ ID NO: 3248214 - protein, 43 aa, Plasmodium falciparum
SNNNNNNNNNNNNDSNNNNNNNNNNNNNNNSNSYGYKKDNNFK

SEQ ID NO: 3248215 - protein, 26 aa, Plasmodium falciparum
SNNNNNNNNNNNNNNNNNNNNNNNNI

SEQ ID NO: 3248216 - protein, 28 aa, Plasmodium falciparum
SNNNNNTTTTTNNNNNSSNNNSSSGNNH

SEQ ID NO: 3248217 - protein, 14 aa, Plasmodium falciparum
SNNNNSNNNNNNFS

SEQ ID NO: 3248218 - protein, 14 aa, Plasmodium falciparum
SNNNNSSYNENENI

SEQ ID NO: 3248219 - protein, 14 aa, Plasmodium falciparum
SNNNSTDDEESNIN

SEQ ID NO: 3248220 - protein, 6 aa, Plasmodium falciparum
SNNNTF

SEQ ID NO: 3248221 - protein, 7 aa, Plasmodium falciparum
SNNNTPI

SEQ ID NO: 3248222 - protein, 4 aa, Plasmodium falciparum
SNNP

SEQ ID NO: 3248223 - protein, 5 aa, Plasmodium falciparum
SNNPI

SEQ ID NO: 3248224 - protein, 11 aa, Plasmodium falciparum
SNNPNDRTKNN

SEQ ID NO: 3248225 - protein, 17 aa, Plasmodium falciparum
SNNPPKNVTNKNDDTYE

SEQ ID NO: 3248226 - protein, 7 aa, Plasmodium falciparum
SNNPSNF

SEQ ID NO: 3248227 - protein, 5 aa, Plasmodium falciparum
SNNPV

SEQ ID NO: 3248228 - protein, 4 aa, Plasmodium falciparum
SNNQ

SEQ ID NO: 3248229 - protein, 6 aa, Plasmodium falciparum
SNNQEK

SEQ ID NO: 3248230 - protein, 6 aa, Plasmodium falciparum
SNNQNN

SEQ ID NO: 3248231 - protein, 19 aa, Plasmodium falciparum
SNNQQKFPNQPGAHKQSNA

SEQ ID NO: 3248232 - protein, 5 aa, Plasmodium falciparum
SNNRN

SEQ ID NO: 3248233 - protein, 6 aa, Plasmodium falciparum
SNNRYN

SEQ ID NO: 3248234 - protein, 11 aa, Plasmodium falciparum
SNNSASLSPVH

SEQ ID NO: 3248235 - protein, 13 aa, Plasmodium falciparum
SNNSFDESSSNDI

SEQ ID NO: 3248236 - protein, 8 aa, Plasmodium falciparum
SNNSFNST

SEQ ID NO: 3248237 - protein, 10 aa, Plasmodium falciparum
SNNSHAPNKI

SEQ ID NO: 3248238 - protein, 7 aa, Plasmodium falciparum
SNNSHNT

SEQ ID NO: 3248239 - protein, 25 aa, Plasmodium falciparum
SNNSKGQEKRKNKIKEKENTEFYTD

SEQ ID NO: 3248240 - protein, 13 aa, Plasmodium falciparum
SNNSKSSGEKAPN

SEQ ID NO: 3248241 - protein, 6 aa, Plasmodium falciparum
SNNSNN

SEQ ID NO: 3248242 - protein, 9 aa, Plasmodium falciparum
SNNSNTRES

SEQ ID NO: 3248243 - protein, 7 aa, Plasmodium falciparum
SNNSSST

SEQ ID NO: 3248244 - protein, 7 aa, Plasmodium falciparum
SNNTCNN

SEQ ID NO: 3248245 - protein, 11 aa, Plasmodium falciparum
SNNTEKDTKEY

SEQ ID NO: 3248246 - protein, 5 aa, Plasmodium falciparum
SNNTI

SEQ ID NO: 3248247 - protein, 6 aa, Plasmodium falciparum
SNNTMN

SEQ ID NO: 3248248 - protein, 7 aa, Plasmodium falciparum
SNNTNNM

SEQ ID NO: 3248249 - protein, 7 aa, Plasmodium falciparum
SNNTTNY

SEQ ID NO: 3248250 - protein, 17 aa, Plasmodium falciparum
SNNTYNKITEENETNSS

SEQ ID NO: 3248251 - protein, 9 aa, Plasmodium falciparum
SNNVNKNEI

SEQ ID NO: 3248252 - protein, 6 aa, Plasmodium falciparum
SNNVQS

SEQ ID NO: 3248253 - protein, 7 aa, Plasmodium falciparum
SNNYEKQ

SEQ ID NO: 3248254 - protein, 5 aa, Plasmodium falciparum
SNNYN

SEQ ID NO: 3248255 - protein, 14 aa, Plasmodium falciparum
SNNYNDNSSSSDNS

SEQ ID NO: 3248256 - protein, 6 aa, Plasmodium falciparum
SNNYNT

SEQ ID NO: 3248257 - protein, 5 aa, Plasmodium falciparum
SNNYS

SEQ ID NO: 3248258 - protein, 6 aa, Plasmodium falciparum
SNNYYN

SEQ ID NO: 3248259 - protein, 6 aa, Plasmodium falciparum
SNNYYQ

SEQ ID NO: 3248260 - protein, 18 aa, Plasmodium falciparum
SNPFKKKRFDKSKHRSYK

SEQ ID NO: 3248261 - protein, 5 aa, Plasmodium falciparum
SNPGN

SEQ ID NO: 3248262 - protein, 5 aa, Plasmodium falciparum
SNPHN

SEQ ID NO: 3248263 - protein, 9 aa, Plasmodium falciparum
SNPKEDDYY

SEQ ID NO: 3248264 - protein, 8 aa, Plasmodium falciparum
SNPKNPIG

SEQ ID NO: 3248265 - protein, 5 aa, Plasmodium falciparum
SNPKY

SEQ ID NO: 3248266 - protein, 5 aa, Plasmodium falciparum
SNPLR

SEQ ID NO: 3248267 - protein, 8 aa, Plasmodium falciparum
SNPNQVDD

SEQ ID NO: 3248268 - protein, 7 aa, Plasmodium falciparum
SNPPFAP

SEQ ID NO: 3248269 - protein, 5 aa, Plasmodium falciparum
SNPPV

SEQ ID NO: 3248270 - protein, 18 aa, Plasmodium falciparum
SNPPYNNNNNNNNNMVKE

SEQ ID NO: 3248271 - protein, 8 aa, Plasmodium falciparum
SNPQSKTH

SEQ ID NO: 3248272 - protein, 5 aa, Plasmodium falciparum
SNPSL

SEQ ID NO: 3248273 - protein, 6 aa, Plasmodium falciparum
SNPSLG

SEQ ID NO: 3248274 - protein, 6 aa, Plasmodium falciparum
SNPSSY

SEQ ID NO: 3248275 - protein, 6 aa, Plasmodium falciparum
SNPVKT

SEQ ID NO: 3248276 - protein, 23 aa, Plasmodium falciparum
SNPYLDDTNHEYKNTQKKKKIND

SEQ ID NO: 3248277 - protein, 7 aa, Plasmodium falciparum
SNPYNDI

SEQ ID NO: 3248278 - protein, 9 aa, Plasmodium falciparum
SNQDENQND

SEQ ID NO: 3248279 - protein, 11 aa, Plasmodium falciparum
SNQEKKPDTNI

SEQ ID NO: 3248280 - protein, 11 aa, Plasmodium falciparum
SNQEKKTDTNI

SEQ ID NO: 3248281 - protein, 9 aa, Plasmodium falciparum
SNQHTSDNN

SEQ ID NO: 3248282 - protein, 22 aa, Plasmodium falciparum
SNQKNKEQINKQINTQNKIKNT

SEQ ID NO: 3248283 - protein, 8 aa, Plasmodium falciparum
SNQLNDSS

SEQ ID NO: 3248284 - protein, 20 aa, Plasmodium falciparum
SNQMDNKNNDVDKKKNISNE

SEQ ID NO: 3248285 - protein, 6 aa, Plasmodium falciparum
SNQMNN

SEQ ID NO: 3248286 - protein, 42 aa, Plasmodium falciparum
SNQNDEQDGSYEPNEIKEESCTKKKKNIINNNNNNENNNNQD

SEQ ID NO: 3248287 - protein, 7 aa, Plasmodium falciparum
SNQNDRH

SEQ ID NO: 3248288 - protein, 7 aa, Plasmodium falciparum
SNQNDYQ

SEQ ID NO: 3248289 - protein, 14 aa, Plasmodium falciparum
SNQPLNKSQDNDPN

SEQ ID NO: 3248290 - protein, 6 aa, Plasmodium falciparum
SNQQYD

SEQ ID NO: 3248291 - protein, 7 aa, Plasmodium falciparum
SNQRIDK

SEQ ID NO: 3248292 - protein, 46 aa, Plasmodium falciparum
SNQRRENTGEKNNTTTTNNNNNNNNNNNNSGYNNNNSGYNNNNSGH

SEQ ID NO: 3248293 - protein, 5 aa, Plasmodium falciparum
SNQSL

SEQ ID NO: 3248294 - protein, 27 aa, Plasmodium falciparum
SNQSNKKKKIKKNKNNNNNNNNTKDDF

SEQ ID NO: 3248295 - protein, 8 aa, Plasmodium falciparum
SNRCTNNL

SEQ ID NO: 3248296 - protein, 8 aa, Plasmodium falciparum
SNRGPHGV

SEQ ID NO: 3248297 - protein, 8 aa, Plasmodium falciparum
SNRKEAPK

SEQ ID NO: 3248298 - protein, 8 aa, Plasmodium falciparum
SNRKSGRH

SEQ ID NO: 3248299 - protein, 7 aa, Plasmodium falciparum
SNRLNSE

SEQ ID NO: 3248300 - protein, 7 aa, Plasmodium falciparum
SNRNKEK

SEQ ID NO: 3248301 - protein, 14 aa, Plasmodium falciparum
SNRNNIENDTNTQY

SEQ ID NO: 3248302 - protein, 17 aa, Plasmodium falciparum
SNRNTSRSQRPCYGKDG

SEQ ID NO: 3248303 - protein, 13 aa, Plasmodium falciparum
SNRQSDNKEEGTS

SEQ ID NO: 3248304 - protein, 4 aa, Plasmodium falciparum
SNRS

SEQ ID NO: 3248305 - protein, 5 aa, Plasmodium falciparum
SNRSN

SEQ ID NO: 3248306 - protein, 6 aa, Plasmodium falciparum
SNRSPN

SEQ ID NO: 3248307 - protein, 20 aa, Plasmodium falciparum
SNRSYSNNNNTNSANNAQRN

SEQ ID NO: 3248308 - protein, 5 aa, Plasmodium falciparum
SNRTN

SEQ ID NO: 3248309 - protein, 66 aa, Plasmodium falciparum
SNRYNKENHKNKKRKTKGNHSKYSGTSMESTLTNTSPSSTPDNLSESHITSNSNKNNYSSKKKNKC

SEQ ID NO: 3248310 - protein, 17 aa, Plasmodium falciparum
SNSDDNTSISDDNSDTC

SEQ ID NO: 3248311 - protein, 10 aa, Plasmodium falciparum
SNSDISDEKA

SEQ ID NO: 3248312 - protein, 7 aa, Plasmodium falciparum
SNSDKFE

SEQ ID NO: 3248313 - protein, 19 aa, Plasmodium falciparum
SNSDSSNTSSINKQNNNQI

SEQ ID NO: 3248314 - protein, 4 aa, Plasmodium falciparum
SNSE

SEQ ID NO: 3248315 - protein, 10 aa, Plasmodium falciparum
SNSEDTQTPL

SEQ ID NO: 3248316 - protein, 6 aa, Plasmodium falciparum
SNSEKF

SEQ ID NO: 3248317 - protein, 6 aa, Plasmodium falciparum
SNSFPT

SEQ ID NO: 3248318 - protein, 19 aa, Plasmodium falciparum
SNSGTTPTPPVKPSVTTPQ

SEQ ID NO: 3248319 - protein, 22 aa, Plasmodium falciparum
SNSGTTPTPVTQPSGQKTTPKD

SEQ ID NO: 3248320 - protein, 10 aa, Plasmodium falciparum
SNSHSNIPSD

SEQ ID NO: 3248321 - protein, 39 aa, Plasmodium falciparum
SNSINSEEIEESDYENSEAHSRYYEETDEEESNNNDIDD

SEQ ID NO: 3248322 - protein, 19 aa, Plasmodium falciparum
SNSKDANAVERDDNKEGKK

SEQ ID NO: 3248323 - protein, 31 aa, Plasmodium falciparum
SNSKEKKKNYKNHEHSQYDNYNKNKKKEHYN

SEQ ID NO: 3248324 - protein, 9 aa, Plasmodium falciparum
SNSKKNESN

SEQ ID NO: 3248325 - protein, 9 aa, Plasmodium falciparum
SNSKTTKDY

SEQ ID NO: 3248326 - protein, 11 aa, Plasmodium falciparum
SNSKTTKGDMD

SEQ ID NO: 3248327 - protein, 11 aa, Plasmodium falciparum
SNSKYSSNSKC

SEQ ID NO: 3248328 - protein, 9 aa, Plasmodium falciparum
SNSLDDDER

SEQ ID NO: 3248329 - protein, 17 aa, Plasmodium falciparum
SNSMNNSPGKRRKNEDN

SEQ ID NO: 3248330 - protein, 4 aa, Plasmodium falciparum
SNSN

SEQ ID NO: 3248331 - protein, 8 aa, Plasmodium falciparum
SNSNDKDK

SEQ ID NO: 3248332 - protein, 27 aa, Plasmodium falciparum
SNSNEELMDNTSKKRSIEKTKGKKGDN

SEQ ID NO: 3248333 - protein, 9 aa, Plasmodium falciparum
SNSNEKKLN

SEQ ID NO: 3248334 - protein, 9 aa, Plasmodium falciparum
SNSNMSNSN

SEQ ID NO: 3248335 - protein, 7 aa, Plasmodium falciparum
SNSNNDN

SEQ ID NO: 3248336 - protein, 9 aa, Plasmodium falciparum
SNSNNSSGY

SEQ ID NO: 3248337 - protein, 13 aa, Plasmodium falciparum
SNSNNYNVEEQTQ

SEQ ID NO: 3248338 - protein, 20 aa, Plasmodium falciparum
SNSNSNSNRNSNNNNNNNNK

SEQ ID NO: 3248339 - protein, 25 aa, Plasmodium falciparum
SNSNTEKEEGKNAEINENNDPNTQL

SEQ ID NO: 3248340 - protein, 8 aa, Plasmodium falciparum
SNSNYNSF

SEQ ID NO: 3248341 - protein, 8 aa, Plasmodium falciparum
SNSNYYSP

SEQ ID NO: 3248342 - protein, 7 aa, Plasmodium falciparum
SNSPLKR

SEQ ID NO: 3248343 - protein, 8 aa, Plasmodium falciparum
SNSRCSNS

SEQ ID NO: 3248344 - protein, 17 aa, Plasmodium falciparum
SNSSINNKQDKHEDQNE

SEQ ID NO: 3248345 - protein, 27 aa, Plasmodium falciparum
SNSSLSSDDSTSTNYLPSSKKRKNINE

SEQ ID NO: 3248346 - protein, 8 aa, Plasmodium falciparum
SNSSSFNN

SEQ ID NO: 3248347 - protein, 15 aa, Plasmodium falciparum
SNSTDCSKQRRQTMN

SEQ ID NO: 3248348 - protein, 19 aa, Plasmodium falciparum
SNSTYRSEKPCAGKNTGRF

SEQ ID NO: 3248349 - protein, 6 aa, Plasmodium falciparum
SNSVDS

SEQ ID NO: 3248350 - protein, 17 aa, Plasmodium falciparum
SNSYGERDRAKEKKVQM

SEQ ID NO: 3248351 - protein, 9 aa, Plasmodium falciparum
SNTCSNDKN

SEQ ID NO: 3248352 - protein, 9 aa, Plasmodium falciparum
SNTDDYNSV

SEQ ID NO: 3248353 - protein, 8 aa, Plasmodium falciparum
SNTEEGNK

SEQ ID NO: 3248354 - protein, 12 aa, Plasmodium falciparum
SNTEGGTPTKIS

SEQ ID NO: 3248355 - protein, 11 aa, Plasmodium falciparum
SNTEGKKNSTI

SEQ ID NO: 3248356 - protein, 5 aa, Plasmodium falciparum
SNTEK

SEQ ID NO: 3248357 - protein, 8 aa, Plasmodium falciparum
SNTELSAQ

SEQ ID NO: 3248358 - protein, 8 aa, Plasmodium falciparum
SNTHDGMN

SEQ ID NO: 3248359 - protein, 8 aa, Plasmodium falciparum
SNTHGGMN

SEQ ID NO: 3248360 - protein, 6 aa, Plasmodium falciparum
SNTHNV

SEQ ID NO: 3248361 - protein, 9 aa, Plasmodium falciparum
SNTIEEQNK

SEQ ID NO: 3248362 - protein, 13 aa, Plasmodium falciparum
SNTINKNQKDDSL

SEQ ID NO: 3248363 - protein, 8 aa, Plasmodium falciparum
SNTINTDK

SEQ ID NO: 3248364 - protein, 4 aa, Plasmodium falciparum
SNTK

SEQ ID NO: 3248365 - protein, 12 aa, Plasmodium falciparum
SNTKKNNNNNNE

SEQ ID NO: 3248366 - protein, 9 aa, Plasmodium falciparum
SNTKKTNDI

SEQ ID NO: 3248367 - protein, 9 aa, Plasmodium falciparum
SNTNENIYK

SEQ ID NO: 3248368 - protein, 13 aa, Plasmodium falciparum
SNTNENYKTKNID

SEQ ID NO: 3248369 - protein, 5 aa, Plasmodium falciparum
SNTNI

SEQ ID NO: 3248370 - protein, 6 aa, Plasmodium falciparum
SNTNLD

SEQ ID NO: 3248371 - protein, 7 aa, Plasmodium falciparum
SNTNPRI

SEQ ID NO: 3248372 - protein, 4 aa, Plasmodium falciparum
SNTP

SEQ ID NO: 3248373 - protein, 6 aa, Plasmodium falciparum
SNTQEF

SEQ ID NO: 3248374 - protein, 4 aa, Plasmodium falciparum
SNTR

SEQ ID NO: 3248375 - protein, 12 aa, Plasmodium falciparum
SNTRSEESAYPG

SEQ ID NO: 3248376 - protein, 4 aa, Plasmodium falciparum
SNTS

SEQ ID NO: 3248377 - protein, 10 aa, Plasmodium falciparum
SNTSSTNHND

SEQ ID NO: 3248378 - protein, 8 aa, Plasmodium falciparum
SNTSTTVS

SEQ ID NO: 3248379 - protein, 16 aa, Plasmodium falciparum
SNTTTTNNNNNNNNNI

SEQ ID NO: 3248380 - protein, 13 aa, Plasmodium falciparum
SNTTYENEPYDKF

SEQ ID NO: 3248381 - protein, 5 aa, Plasmodium falciparum
SNTVN

SEQ ID NO: 3248382 - protein, 4 aa, Plasmodium falciparum
SNTY

SEQ ID NO: 3248383 - protein, 11 aa, Plasmodium falciparum
SNTYKDKGRNE

SEQ ID NO: 3248384 - protein, 7 aa, Plasmodium falciparum
SNTYKRG

SEQ ID NO: 3248385 - protein, 14 aa, Plasmodium falciparum
SNTYNNNNNNKKKD

SEQ ID NO: 3248386 - protein, 29 aa, Plasmodium falciparum
SNTYNTHEEDIQENNIPSEPIKNDKNYYD

SEQ ID NO: 3248387 - protein, 5 aa, Plasmodium falciparum
SNTYS

SEQ ID NO: 3248388 - protein, 6 aa, Plasmodium falciparum
SNTYTP

SEQ ID NO: 3248389 - protein, 9 aa, Plasmodium falciparum
SNVEPKKYN

SEQ ID NO: 3248390 - protein, 42 aa, Plasmodium falciparum
SNVGPNMGSPMGSPMGPSMGSPMGPSMGSPMGPNMGSPMSSP

SEQ ID NO: 3248391 - protein, 18 aa, Plasmodium falciparum
SNVKKEEQKNKQTKNSGL

SEQ ID NO: 3248392 - protein, 11 aa, Plasmodium falciparum
SNVPNRRSNSV

SEQ ID NO: 3248393 - protein, 9 aa, Plasmodium falciparum
SNVQNNNET

SEQ ID NO: 3248394 - protein, 30 aa, Plasmodium falciparum
SNVRSSFENDNPCYGREEKRFSDSRSGQCT

SEQ ID NO: 3248395 - protein, 48 aa, Plasmodium falciparum
SNVSNTNNMNNNNNNNNNNSISSSSNNNSSSSSSNITSTTNRNINGSN

SEQ ID NO: 3248396 - protein, 10 aa, Plasmodium falciparum
SNVSSKHTFT

SEQ ID NO: 3248397 - protein, 5 aa, Plasmodium falciparum
SNVSY

SEQ ID NO: 3248398 - protein, 4 aa, Plasmodium falciparum
SNVT

SEQ ID NO: 3248399 - protein, 27 aa, Plasmodium falciparum
SNVTTSKETPLEKPSNTVENKEGKNPF

SEQ ID NO: 3248400 - protein, 23 aa, Plasmodium falciparum
SNVYNNNNTNIYNNNNNNENNAF

SEQ ID NO: 3248401 - protein, 9 aa, Plasmodium falciparum
SNYARSYEQ

SEQ ID NO: 3248402 - protein, 16 aa, Plasmodium falciparum
SNYDDGINKGSYTTKS

SEQ ID NO: 3248403 - protein, 7 aa, Plasmodium falciparum
SNYDDSS

SEQ ID NO: 3248404 - protein, 16 aa, Plasmodium falciparum
SNYDGGINKESYTTKS

SEQ ID NO: 3248405 - protein, 14 aa, Plasmodium falciparum
SNYDIPTKRSPNRY

SEQ ID NO: 3248406 - protein, 17 aa, Plasmodium falciparum
SNYDKNSIGRNTYNSNN

SEQ ID NO: 3248407 - protein, 5 aa, Plasmodium falciparum
SNYDN

SEQ ID NO: 3248408 - protein, 9 aa, Plasmodium falciparum
SNYENDQEM

SEQ ID NO: 3248409 - protein, 6 aa, Plasmodium falciparum
SNYEPS

SEQ ID NO: 3248410 - protein, 7 aa, Plasmodium falciparum
SNYEQAK

SEQ ID NO: 3248411 - protein, 7 aa, Plasmodium falciparum
SNYGDSS

SEQ ID NO: 3248412 - protein, 9 aa, Plasmodium falciparum
SNYKSAKGL

SEQ ID NO: 3248413 - protein, 6 aa, Plasmodium falciparum
SNYKTY

SEQ ID NO: 3248414 - protein, 5 aa, Plasmodium falciparum
SNYMN

SEQ ID NO: 3248415 - protein, 10 aa, Plasmodium falciparum
SNYNKGLENN

SEQ ID NO: 3248416 - protein, 13 aa, Plasmodium falciparum
SNYNKKEEKGTFE

SEQ ID NO: 3248417 - protein, 6 aa, Plasmodium falciparum
SNYNKT

SEQ ID NO: 3248418 - protein, 6 aa, Plasmodium falciparum
SNYNNE

SEQ ID NO: 3248419 - protein, 21 aa, Plasmodium falciparum
SNYNNNNNNNNNNNTYKNNNE

SEQ ID NO: 3248420 - protein, 8 aa, Plasmodium falciparum
SNYNSNAR

SEQ ID NO: 3248421 - protein, 6 aa, Plasmodium falciparum
SNYNTV

SEQ ID NO: 3248422 - protein, 10 aa, Plasmodium falciparum
SNYPPETNNN

SEQ ID NO: 3248423 - protein, 7 aa, Plasmodium falciparum
SNYQGST

SEQ ID NO: 3248424 - protein, 17 aa, Plasmodium falciparum
SNYSKHDRRNKNLRNGE

SEQ ID NO: 3248425 - protein, 9 aa, Plasmodium falciparum
SNYSQNKDD

SEQ ID NO: 3248426 - protein, 6 aa, Plasmodium falciparum
SNYTKE

SEQ ID NO: 3248427 - protein, 11 aa, Plasmodium falciparum
SNYTKNNSEQY

SEQ ID NO: 3248428 - protein, 10 aa, Plasmodium falciparum
SNYTNDSKNI

SEQ ID NO: 3248429 - protein, 35 aa, Plasmodium falciparum
SNYYNYDDDDDDNNNDDSIDHNNEDYEYEENDPYC

SEQ ID NO: 3248430 - protein, 14 aa, Plasmodium falciparum
SPAHKNNDPKDEYE

SEQ ID NO: 3248431 - protein, 11 aa, Plasmodium falciparum
SPANNDNDAEM

SEQ ID NO: 3248432 - protein, 9 aa, Plasmodium falciparum
SPASEKEYK

SEQ ID NO: 3248433 - protein, 7 aa, Plasmodium falciparum
SPATSEQ

SEQ ID NO: 3248434 - protein, 5 aa, Plasmodium falciparum
SPAYQ

SEQ ID NO: 3248435 - protein, 8 aa, Plasmodium falciparum
SPCSPRKR

SEQ ID NO: 3248436 - protein, 11 aa, Plasmodium falciparum
SPDADSSEIKR

SEQ ID NO: 3248437 - protein, 7 aa, Plasmodium falciparum
SPDEKAT

SEQ ID NO: 3248438 - protein, 12 aa, Plasmodium falciparum
SPDENSESDEMN

SEQ ID NO: 3248439 - protein, 8 aa, Plasmodium falciparum
SPDKPNDN

SEQ ID NO: 3248440 - protein, 6 aa, Plasmodium falciparum
SPDKSV

SEQ ID NO: 3248441 - protein, 5 aa, Plasmodium falciparum
SPDKY

SEQ ID NO: 3248442 - protein, 9 aa, Plasmodium falciparum
SPDNNSLPC

SEQ ID NO: 3248443 - protein, 10 aa, Plasmodium falciparum
SPDPTLEKDY

SEQ ID NO: 3248444 - protein, 6 aa, Plasmodium falciparum
SPECEE

SEQ ID NO: 3248445 - protein, 7 aa, Plasmodium falciparum
SPEENRK

SEQ ID NO: 3248446 - protein, 7 aa, Plasmodium falciparum
SPEESVT

SEQ ID NO: 3248447 - protein, 4 aa, Plasmodium falciparum
SPEH

SEQ ID NO: 3248448 - protein, 4 aa, Plasmodium falciparum
SPEI

SEQ ID NO: 3248449 - protein, 7 aa, Plasmodium falciparum
SPESSIQ

SEQ ID NO: 3248450 - protein, 4 aa, Plasmodium falciparum
SPFF

SEQ ID NO: 3248451 - protein, 8 aa, Plasmodium falciparum
SPFKSKSI

SEQ ID NO: 3248452 - protein, 8 aa, Plasmodium falciparum
SPGGSINE

SEQ ID NO: 3248453 - protein, 5 aa, Plasmodium falciparum
SPGLN

SEQ ID NO: 3248454 - protein, 5 aa, Plasmodium falciparum
SPGLT

SEQ ID NO: 3248455 - protein, 5 aa, Plasmodium falciparum
SPGYN

SEQ ID NO: 3248456 - protein, 26 aa, Plasmodium falciparum
SPHATDNSESESGLNPTDDIKTTDGV

SEQ ID NO: 3248457 - protein, 6 aa, Plasmodium falciparum
SPHEHA

SEQ ID NO: 3248458 - protein, 4 aa, Plasmodium falciparum
SPHS

SEQ ID NO: 3248459 - protein, 8 aa, Plasmodium falciparum
SPIGPYKK

SEQ ID NO: 3248460 - protein, 4 aa, Plasmodium falciparum
SPIN

SEQ ID NO: 3248461 - protein, 5 aa, Plasmodium falciparum
SPING

SEQ ID NO: 3248462 - protein, 24 aa, Plasmodium falciparum
SPINSNSVHEKKNDDEQNDTTHIQ

SEQ ID NO: 3248463 - protein, 5 aa, Plasmodium falciparum
SPIPE

SEQ ID NO: 3248464 - protein, 5 aa, Plasmodium falciparum
SPIPR

SEQ ID NO: 3248465 - protein, 6 aa, Plasmodium falciparum
SPIRHE

SEQ ID NO: 3248466 - protein, 4 aa, Plasmodium falciparum
SPIS

SEQ ID NO: 3248467 - protein, 5 aa, Plasmodium falciparum
SPKHH

SEQ ID NO: 3248468 - protein, 4 aa, Plasmodium falciparum
SPKI

SEQ ID NO: 3248469 - protein, 15 aa, Plasmodium falciparum
SPKKNPSITQKRPTR

SEQ ID NO: 3248470 - protein, 8 aa, Plasmodium falciparum
SPKKYTTK

SEQ ID NO: 3248471 - protein, 4 aa, Plasmodium falciparum
SPKN

SEQ ID NO: 3248472 - protein, 24 aa, Plasmodium falciparum
SPKYYTPDNNKKKKNNNNNNNNNN

SEQ ID NO: 3248473 - protein, 6 aa, Plasmodium falciparum
SPLAPS

SEQ ID NO: 3248474 - protein, 13 aa, Plasmodium falciparum
SPLEEDDNPTLQE

SEQ ID NO: 3248475 - protein, 12 aa, Plasmodium falciparum
SPLEEENSYMEK

SEQ ID NO: 3248476 - protein, 9 aa, Plasmodium falciparum
SPLGNTPHG

SEQ ID NO: 3248477 - protein, 14 aa, Plasmodium falciparum
SPLKEKDTSYKGEH

SEQ ID NO: 3248478 - protein, 6 aa, Plasmodium falciparum
SPLKEP

SEQ ID NO: 3248479 - protein, 10 aa, Plasmodium falciparum
SPLLTTDSKG

SEQ ID NO: 3248480 - protein, 13 aa, Plasmodium falciparum
SPLNNKKDNTYDT

SEQ ID NO: 3248481 - protein, 13 aa, Plasmodium falciparum
SPLSSKRRRQKEK

SEQ ID NO: 3248482 - protein, 12 aa, Plasmodium falciparum
SPNADEKSSTCE

SEQ ID NO: 3248483 - protein, 7 aa, Plasmodium falciparum
SPNDPGL

SEQ ID NO: 3248484 - protein, 11 aa, Plasmodium falciparum
SPNEEKDKTDA

SEQ ID NO: 3248485 - protein, 14 aa, Plasmodium falciparum
SPNENKNDESVKGA

SEQ ID NO: 3248486 - protein, 8 aa, Plasmodium falciparum
SPNESCSL

SEQ ID NO: 3248487 - protein, 12 aa, Plasmodium falciparum
SPNIINSSNDNK

SEQ ID NO: 3248488 - protein, 4 aa, Plasmodium falciparum
SPNN

SEQ ID NO: 3248489 - protein, 6 aa, Plasmodium falciparum
SPNNET

SEQ ID NO: 3248490 - protein, 4 aa, Plasmodium falciparum
SPNP

SEQ ID NO: 3248491 - protein, 6 aa, Plasmodium falciparum
SPNVQN

SEQ ID NO: 3248492 - protein, 7 aa, Plasmodium falciparum
SPNYEKG

SEQ ID NO: 3248493 - protein, 7 aa, Plasmodium falciparum
SPPDPLS

SEQ ID NO: 3248494 - protein, 4 aa, Plasmodium falciparum
SPPI

SEQ ID NO: 3248495 - protein, 20 aa, Plasmodium falciparum
SPPKDMNDDSHDNHNNHNNN

SEQ ID NO: 3248496 - protein, 58 aa, Plasmodium falciparum
SPPKNNNVNSMNNNNDDDNDDNNDDNNDDNNNNNHNNNNHNNNNHNNNHNNNNNNHNN

SEQ ID NO: 3248497 - protein, 20 aa, Plasmodium falciparum
SPPNDIDTNVNKKRDTISKE

SEQ ID NO: 3248498 - protein, 5 aa, Plasmodium falciparum
SPPSY

SEQ ID NO: 3248499 - protein, 6 aa, Plasmodium falciparum
SPPVSY

SEQ ID NO: 3248500 - protein, 5 aa, Plasmodium falciparum
SPPYK

SEQ ID NO: 3248501 - protein, 7 aa, Plasmodium falciparum
SPQKNPS

SEQ ID NO: 3248502 - protein, 9 aa, Plasmodium falciparum
SPQKRYSYN

SEQ ID NO: 3248503 - protein, 11 aa, Plasmodium falciparum
SPQMNTSNNNN

SEQ ID NO: 3248504 - protein, 10 aa, Plasmodium falciparum
SPQNSSSYAE

SEQ ID NO: 3248505 - protein, 9 aa, Plasmodium falciparum
SPQQKEENI

SEQ ID NO: 3248506 - protein, 9 aa, Plasmodium falciparum
SPQTTGNNE

SEQ ID NO: 3248507 - protein, 5 aa, Plasmodium falciparum
SPQTY

SEQ ID NO: 3248508 - protein, 15 aa, Plasmodium falciparum
SPQYKKTKGKNDKYE

SEQ ID NO: 3248509 - protein, 4 aa, Plasmodium falciparum
SPRS

SEQ ID NO: 3248510 - protein, 5 aa, Plasmodium falciparum
SPSAD

SEQ ID NO: 3248511 - protein, 6 aa, Plasmodium falciparum
SPSFDY

SEQ ID NO: 3248512 - protein, 5 aa, Plasmodium falciparum
SPSHL

SEQ ID NO: 3248513 - protein, 11 aa, Plasmodium falciparum
SPSKYDEIKDK

SEQ ID NO: 3248514 - protein, 6 aa, Plasmodium falciparum
SPSNNV

SEQ ID NO: 3248515 - protein, 13 aa, Plasmodium falciparum
SPSNSFENKQNSS

SEQ ID NO: 3248516 - protein, 44 aa, Plasmodium falciparum
SPSNSHNNNNEPQTTPHHTQTNRSLYESDTESSIYDKDEDMESV

SEQ ID NO: 3248517 - protein, 6 aa, Plasmodium falciparum
SPSSSN

SEQ ID NO: 3248518 - protein, 13 aa, Plasmodium falciparum
SPSTSPPSAVSNS

SEQ ID NO: 3248519 - protein, 12 aa, Plasmodium falciparum
SPSVSSKDNCQS

SEQ ID NO: 3248520 - protein, 45 aa, Plasmodium falciparum
SPTDSNINVSNNKNDHPLSSTNKDDHHGNNHHNNKDDHHNSSNNK

SEQ ID NO: 3248521 - protein, 6 aa, Plasmodium falciparum
SPTENV

SEQ ID NO: 3248522 - protein, 5 aa, Plasmodium falciparum
SPTNI

SEQ ID NO: 3248523 - protein, 7 aa, Plasmodium falciparum
SPTSSYD

SEQ ID NO: 3248524 - protein, 6 aa, Plasmodium falciparum
SPTYQQ

SEQ ID NO: 3248525 - protein, 4 aa, Plasmodium falciparum
SPVN

SEQ ID NO: 3248526 - protein, 16 aa, Plasmodium falciparum
SPVYPKGNNIFSSIIR

SEQ ID NO: 3248527 - protein, 5 aa, Plasmodium falciparum
SPYER

SEQ ID NO: 3248528 - protein, 6 aa, Plasmodium falciparum
SPYNNN

SEQ ID NO: 3248529 - protein, 5 aa, Plasmodium falciparum
SPYQK

SEQ ID NO: 3248530 - protein, 5 aa, Plasmodium falciparum
SPYSY

SEQ ID NO: 3248531 - protein, 5 aa, Plasmodium falciparum
SPYTD

SEQ ID NO: 3248532 - protein, 19 aa, Plasmodium falciparum
SPYYKNDDTNYNDKNYDHE

SEQ ID NO: 3248533 - protein, 5 aa, Plasmodium falciparum
SQAAY

SEQ ID NO: 3248534 - protein, 34 aa, Plasmodium falciparum
SQAGGDKATQEGDGNGGSETQPQGGTPSQPDPKV

SEQ ID NO: 3248535 - protein, 8 aa, Plasmodium falciparum
SQASQYHK

SEQ ID NO: 3248536 - protein, 6 aa, Plasmodium falciparum
SQAYET

SEQ ID NO: 3248537 - protein, 5 aa, Plasmodium falciparum
SQCGQ

SEQ ID NO: 3248538 - protein, 5 aa, Plasmodium falciparum
SQCKN

SEQ ID NO: 3248539 - protein, 5 aa, Plasmodium falciparum
SQDAK

SEQ ID NO: 3248540 - protein, 9 aa, Plasmodium falciparum
SQDKKKISD

SEQ ID NO: 3248541 - protein, 7 aa, Plasmodium falciparum
SQDKNID

SEQ ID NO: 3248542 - protein, 11 aa, Plasmodium falciparum
SQDNKLNDNYQ

SEQ ID NO: 3248543 - protein, 8 aa, Plasmodium falciparum
SQDNLTSR

SEQ ID NO: 3248544 - protein, 5 aa, Plasmodium falciparum
SQDNN

SEQ ID NO: 3248545 - protein, 9 aa, Plasmodium falciparum
SQDNNENAK

SEQ ID NO: 3248546 - protein, 9 aa, Plasmodium falciparum
SQDQNNEKN

SEQ ID NO: 3248547 - protein, 9 aa, Plasmodium falciparum
SQDVTERVS

SEQ ID NO: 3248548 - protein, 6 aa, Plasmodium falciparum
SQEEIN

SEQ ID NO: 3248549 - protein, 5 aa, Plasmodium falciparum
SQEEL

SEQ ID NO: 3248550 - protein, 4 aa, Plasmodium falciparum
SQEI

SEQ ID NO: 3248551 - protein, 11 aa, Plasmodium falciparum
SQEKKKNPINN

SEQ ID NO: 3248552 - protein, 13 aa, Plasmodium falciparum
SQENDDKKKKEWY

SEQ ID NO: 3248553 - protein, 9 aa, Plasmodium falciparum
SQENQDEPN

SEQ ID NO: 3248554 - protein, 7 aa, Plasmodium falciparum
SQENVNN

SEQ ID NO: 3248555 - protein, 5 aa, Plasmodium falciparum
SQEQY

SEQ ID NO: 3248556 - protein, 6 aa, Plasmodium falciparum
SQERDL

SEQ ID NO: 3248557 - protein, 17 aa, Plasmodium falciparum
SQFDEKELNTNKNIRSI

SEQ ID NO: 3248558 - protein, 8 aa, Plasmodium falciparum
SQFNESQS

SEQ ID NO: 3248559 - protein, 11 aa, Plasmodium falciparum
SQFRQSKISPE

SEQ ID NO: 3248560 - protein, 11 aa, Plasmodium falciparum
SQGKEEQQQDD

SEQ ID NO: 3248561 - protein, 4 aa, Plasmodium falciparum
SQGY

SEQ ID NO: 3248562 - protein, 4 aa, Plasmodium falciparum
SQHD

SEQ ID NO: 3248563 - protein, 7 aa, Plasmodium falciparum
SQHPPSS

SEQ ID NO: 3248564 - protein, 11 aa, Plasmodium falciparum
SQIGSINKQDN

SEQ ID NO: 3248565 - protein, 6 aa, Plasmodium falciparum
SQINNT

SEQ ID NO: 3248566 - protein, 5 aa, Plasmodium falciparum
SQISK

SEQ ID NO: 3248567 - protein, 16 aa, Plasmodium falciparum
SQITSSDKNNDPNREK

SEQ ID NO: 3248568 - protein, 17 aa, Plasmodium falciparum
SQKEEENDNNNNNNDDS

SEQ ID NO: 3248569 - protein, 12 aa, Plasmodium falciparum
SQKENDASEIDE

SEQ ID NO: 3248570 - protein, 51 aa, Plasmodium falciparum
SQKENQNDQEKKNKNKKKKKKEKENNDTDNNTKIASQNEEIENVKKSNDIH

SEQ ID NO: 3248571 - protein, 5 aa, Plasmodium falciparum
SQKHR

SEQ ID NO: 3248572 - protein, 5 aa, Plasmodium falciparum
SQKIR

SEQ ID NO: 3248573 - protein, 8 aa, Plasmodium falciparum
SQKKKTKI

SEQ ID NO: 3248574 - protein, 8 aa, Plasmodium falciparum
SQKNQVER

SEQ ID NO: 3248575 - protein, 11 aa, Plasmodium falciparum
SQKNSDEQEHF

SEQ ID NO: 3248576 - protein, 26 aa, Plasmodium falciparum
SQKTAKVAADAGQAAKTAAANETAKF

SEQ ID NO: 3248577 - protein, 10 aa, Plasmodium falciparum
SQKVSENSED

SEQ ID NO: 3248578 - protein, 12 aa, Plasmodium falciparum
SQLDNDKFDETY

SEQ ID NO: 3248579 - protein, 14 aa, Plasmodium falciparum
SQLKKSSKGSKLTP

SEQ ID NO: 3248580 - protein, 6 aa, Plasmodium falciparum
SQLPEE

SEQ ID NO: 3248581 - protein, 11 aa, Plasmodium falciparum
SQLTRKKRAKG

SEQ ID NO: 3248582 - protein, 6 aa, Plasmodium falciparum
SQMNSD

SEQ ID NO: 3248583 - protein, 26 aa, Plasmodium falciparum
SQMRKEKNKSKNKKKNKKQKKNQMNQ

SEQ ID NO: 3248584 - protein, 10 aa, Plasmodium falciparum
SQNDEKDNKL

SEQ ID NO: 3248585 - protein, 10 aa, Plasmodium falciparum
SQNDNNNDRI

SEQ ID NO: 3248586 - protein, 22 aa, Plasmodium falciparum
SQNDNYDDIDNTSESSTFTDSS

SEQ ID NO: 3248587 - protein, 8 aa, Plasmodium falciparum
SQNDQKYK

SEQ ID NO: 3248588 - protein, 7 aa, Plasmodium falciparum
SQNDVLN

SEQ ID NO: 3248589 - protein, 4 aa, Plasmodium falciparum
SQNG

SEQ ID NO: 3248590 - protein, 8 aa, Plasmodium falciparum
SQNGLSSK

SEQ ID NO: 3248591 - protein, 4 aa, Plasmodium falciparum
SQNI

SEQ ID NO: 3248592 - protein, 5 aa, Plasmodium falciparum
SQNID

SEQ ID NO: 3248593 - protein, 4 aa, Plasmodium falciparum
SQNK

SEQ ID NO: 3248594 - protein, 7 aa, Plasmodium falciparum
SQNKDLK

SEQ ID NO: 3248595 - protein, 6 aa, Plasmodium falciparum
SQNKEL

SEQ ID NO: 3248596 - protein, 7 aa, Plasmodium falciparum
SQNKTLN

SEQ ID NO: 3248597 - protein, 13 aa, Plasmodium falciparum
SQNLEGRSNFDER

SEQ ID NO: 3248598 - protein, 5 aa, Plasmodium falciparum
SQNMS

SEQ ID NO: 3248599 - protein, 4 aa, Plasmodium falciparum
SQNN

SEQ ID NO: 3248600 - protein, 65 aa, Plasmodium falciparum
SQNNDNKNERDDNKNKCDDNKNNCDDNKNKCDDNKNKCDDNKNKCDDNKNKCDDNKNKCDDNNNN

SEQ ID NO: 3248601 - protein, 7 aa, Plasmodium falciparum
SQNNHKV

SEQ ID NO: 3248602 - protein, 8 aa, Plasmodium falciparum
SQNNKIED

SEQ ID NO: 3248603 - protein, 5 aa, Plasmodium falciparum
SQNNL

SEQ ID NO: 3248604 - protein, 5 aa, Plasmodium falciparum
SQNNN

SEQ ID NO: 3248605 - protein, 40 aa, Plasmodium falciparum
SQNNTTTITTTTNSNDSNDSSDNNNNNNNNNNNNNNYNNN

SEQ ID NO: 3248606 - protein, 7 aa, Plasmodium falciparum
SQNNYSI

SEQ ID NO: 3248607 - protein, 5 aa, Plasmodium falciparum
SQNQK

SEQ ID NO: 3248608 - protein, 8 aa, Plasmodium falciparum
SQNRNGYE

SEQ ID NO: 3248609 - protein, 4 aa, Plasmodium falciparum
SQNS

SEQ ID NO: 3248610 - protein, 9 aa, Plasmodium falciparum
SQNSQNEEL

SEQ ID NO: 3248611 - protein, 7 aa, Plasmodium falciparum
SQNSYIT

SEQ ID NO: 3248612 - protein, 8 aa, Plasmodium falciparum
SQPDPCPT

SEQ ID NO: 3248613 - protein, 9 aa, Plasmodium falciparum
SQPKRKKIK

SEQ ID NO: 3248614 - protein, 13 aa, Plasmodium falciparum
SQPNNDMNNDKKM

SEQ ID NO: 3248615 - protein, 5 aa, Plasmodium falciparum
SQPQA

SEQ ID NO: 3248616 - protein, 24 aa, Plasmodium falciparum
SQPTVGNQKADAANFTKDNPAKTF

SEQ ID NO: 3248617 - protein, 12 aa, Plasmodium falciparum
SQPYNKKGYYNN

SEQ ID NO: 3248618 - protein, 9 aa, Plasmodium falciparum
SQQKKENDF

SEQ ID NO: 3248619 - protein, 7 aa, Plasmodium falciparum
SQQNRSN

SEQ ID NO: 3248620 - protein, 11 aa, Plasmodium falciparum
SQQSEEKKQKL

SEQ ID NO: 3248621 - protein, 6 aa, Plasmodium falciparum
SQRAKD

SEQ ID NO: 3248622 - protein, 6 aa, Plasmodium falciparum
SQRDDL

SEQ ID NO: 3248623 - protein, 4 aa, Plasmodium falciparum
SQRF

SEQ ID NO: 3248624 - protein, 5 aa, Plasmodium falciparum
SQRGE

SEQ ID NO: 3248625 - protein, 5 aa, Plasmodium falciparum
SQRGQ

SEQ ID NO: 3248626 - protein, 8 aa, Plasmodium falciparum
SQRGQYIS

SEQ ID NO: 3248627 - protein, 7 aa, Plasmodium falciparum
SQRKSNN

SEQ ID NO: 3248628 - protein, 4 aa, Plasmodium falciparum
SQRP

SEQ ID NO: 3248629 - protein, 12 aa, Plasmodium falciparum
SQRTQGGTSSQI

SEQ ID NO: 3248630 - protein, 6 aa, Plasmodium falciparum
SQRYKG

SEQ ID NO: 3248631 - protein, 10 aa, Plasmodium falciparum
SQSEKKKKNV

SEQ ID NO: 3248632 - protein, 6 aa, Plasmodium falciparum
SQSGFH

SEQ ID NO: 3248633 - protein, 5 aa, Plasmodium falciparum
SQSHP

SEQ ID NO: 3248634 - protein, 4 aa, Plasmodium falciparum
SQSK

SEQ ID NO: 3248635 - protein, 20 aa, Plasmodium falciparum
SQSKGNTNNLDPSASSLESA

SEQ ID NO: 3248636 - protein, 7 aa, Plasmodium falciparum
SQSNLNT

SEQ ID NO: 3248637 - protein, 7 aa, Plasmodium falciparum
SQSNNHV

SEQ ID NO: 3248638 - protein, 47 aa, Plasmodium falciparum
SQSNNNNNDNNNDNNNDNNNDNNNDNNNNNNNDNNQQSEGNTEKDEI

SEQ ID NO: 3248639 - protein, 10 aa, Plasmodium falciparum
SQSNNSTYED

SEQ ID NO: 3248640 - protein, 7 aa, Plasmodium falciparum
SQSNTHE

SEQ ID NO: 3248641 - protein, 8 aa, Plasmodium falciparum
SQSSGKST

SEQ ID NO: 3248642 - protein, 7 aa, Plasmodium falciparum
SQSYDMN

SEQ ID NO: 3248643 - protein, 7 aa, Plasmodium falciparum
SQTCSNN

SEQ ID NO: 3248644 - protein, 14 aa, Plasmodium falciparum
SQTCTNDIDENVEN

SEQ ID NO: 3248645 - protein, 24 aa, Plasmodium falciparum
SQTDGIISSSSDYSSSSEDSNKNV

SEQ ID NO: 3248646 - protein, 27 aa, Plasmodium falciparum
SQTKKENDKNVEEQNEQKKKKKDKMDN

SEQ ID NO: 3248647 - protein, 5 aa, Plasmodium falciparum
SQTKQ

SEQ ID NO: 3248648 - protein, 7 aa, Plasmodium falciparum
SQTYDYE

SEQ ID NO: 3248649 - protein, 12 aa, Plasmodium falciparum
SQVGEKKIQQDN

SEQ ID NO: 3248650 - protein, 7 aa, Plasmodium falciparum
SQVGNQD

SEQ ID NO: 3248651 - protein, 5 aa, Plasmodium falciparum
SQVNN

SEQ ID NO: 3248652 - protein, 18 aa, Plasmodium falciparum
SQVTPTQSSLANSTGAGD

SEQ ID NO: 3248653 - protein, 6 aa, Plasmodium falciparum
SQYDSK

SEQ ID NO: 3248654 - protein, 8 aa, Plasmodium falciparum
SQYEENKS

SEQ ID NO: 3248655 - protein, 14 aa, Plasmodium falciparum
SQYHNEENKTISNN

SEQ ID NO: 3248656 - protein, 5 aa, Plasmodium falciparum
SQYKK

SEQ ID NO: 3248657 - protein, 41 aa, Plasmodium falciparum
SQYKNTSNENKNKNINNNNNNNNNNSNNKSSINCKENTSIN

SEQ ID NO: 3248658 - protein, 18 aa, Plasmodium falciparum
SQYSSEGIGSSTSQGQHI

SEQ ID NO: 3248659 - protein, 5 aa, Plasmodium falciparum
SRDAT

SEQ ID NO: 3248660 - protein, 5 aa, Plasmodium falciparum
SRDEY

SEQ ID NO: 3248661 - protein, 7 aa, Plasmodium falciparum
SRDIKNT

SEQ ID NO: 3248662 - protein, 14 aa, Plasmodium falciparum
SRDKGIQSTPQKDD

SEQ ID NO: 3248663 - protein, 18 aa, Plasmodium falciparum
SRDNKMNTYNGKDNKNKY

SEQ ID NO: 3248664 - protein, 5 aa, Plasmodium falciparum
SRDRT

SEQ ID NO: 3248665 - protein, 23 aa, Plasmodium falciparum
SREDKEKHRINNNNNNNNNNINT

SEQ ID NO: 3248666 - protein, 5 aa, Plasmodium falciparum
SREDM

SEQ ID NO: 3248667 - protein, 7 aa, Plasmodium falciparum
SREEDKE

SEQ ID NO: 3248668 - protein, 13 aa, Plasmodium falciparum
SREGKLNDDTTIN

SEQ ID NO: 3248669 - protein, 9 aa, Plasmodium falciparum
SREGKVQKH

SEQ ID NO: 3248670 - protein, 6 aa, Plasmodium falciparum
SREIES

SEQ ID NO: 3248671 - protein, 21 aa, Plasmodium falciparum
SREPPNDDNMKTPPRPKKQPI

SEQ ID NO: 3248672 - protein, 9 aa, Plasmodium falciparum
SRESRATEQ

SEQ ID NO: 3248673 - protein, 7 aa, Plasmodium falciparum
SRESSFL

SEQ ID NO: 3248674 - protein, 4 aa, Plasmodium falciparum
SRGN

SEQ ID NO: 3248675 - protein, 13 aa, Plasmodium falciparum
SRGPKINKKKKIN

SEQ ID NO: 3248676 - protein, 6 aa, Plasmodium falciparum
SRGPTY

SEQ ID NO: 3248677 - protein, 7 aa, Plasmodium falciparum
SRGSYNE

SEQ ID NO: 3248678 - protein, 5 aa, Plasmodium falciparum
SRGVE

SEQ ID NO: 3248679 - protein, 16 aa, Plasmodium falciparum
SRHQDGVRKKTSICKN

SEQ ID NO: 3248680 - protein, 8 aa, Plasmodium falciparum
SRHRNSYG

SEQ ID NO: 3248681 - protein, 16 aa, Plasmodium falciparum
SRIKPKTKKKKRNENR

SEQ ID NO: 3248682 - protein, 5 aa, Plasmodium falciparum
SRKDM

SEQ ID NO: 3248683 - protein, 7 aa, Plasmodium falciparum
SRKEKKQ

SEQ ID NO: 3248684 - protein, 10 aa, Plasmodium falciparum
SRKKKNNNEV

SEQ ID NO: 3248685 - protein, 22 aa, Plasmodium falciparum
SRKNEKGVPRENVDSTTTSYNS

SEQ ID NO: 3248686 - protein, 15 aa, Plasmodium falciparum
SRKNHEAKVKIYKPE

SEQ ID NO: 3248687 - protein, 5 aa, Plasmodium falciparum
SRKNK

SEQ ID NO: 3248688 - protein, 8 aa, Plasmodium falciparum
SRKNKHRY

SEQ ID NO: 3248689 - protein, 6 aa, Plasmodium falciparum
SRKNPI

SEQ ID NO: 3248690 - protein, 8 aa, Plasmodium falciparum
SRKNQELH

SEQ ID NO: 3248691 - protein, 5 aa, Plasmodium falciparum
SRKNR

SEQ ID NO: 3248692 - protein, 10 aa, Plasmodium falciparum
SRKPGPPAYN

SEQ ID NO: 3248693 - protein, 5 aa, Plasmodium falciparum
SRKPI

SEQ ID NO: 3248694 - protein, 16 aa, Plasmodium falciparum
SRKSLGNIKSNNTNIK

SEQ ID NO: 3248695 - protein, 5 aa, Plasmodium falciparum
SRKTY

SEQ ID NO: 3248696 - protein, 7 aa, Plasmodium falciparum
SRLPTTK

SEQ ID NO: 3248697 - protein, 14 aa, Plasmodium falciparum
SRMGKSNEEYDIGE

SEQ ID NO: 3248698 - protein, 4 aa, Plasmodium falciparum
SRMT

SEQ ID NO: 3248699 - protein, 10 aa, Plasmodium falciparum
SRNDTNSNIN

SEQ ID NO: 3248700 - protein, 6 aa, Plasmodium falciparum
SRNEKD

SEQ ID NO: 3248701 - protein, 8 aa, Plasmodium falciparum
SRNEKRKY

SEQ ID NO: 3248702 - protein, 12 aa, Plasmodium falciparum
SRNERRNITTSL

SEQ ID NO: 3248703 - protein, 9 aa, Plasmodium falciparum
SRNETNNSK

SEQ ID NO: 3248704 - protein, 5 aa, Plasmodium falciparum
SRNGI

SEQ ID NO: 3248705 - protein, 6 aa, Plasmodium falciparum
SRNGNG

SEQ ID NO: 3248706 - protein, 7 aa, Plasmodium falciparum
SRNGYNK

SEQ ID NO: 3248707 - protein, 17 aa, Plasmodium falciparum
SRNIKEQEINNNNNDNI

SEQ ID NO: 3248708 - protein, 4 aa, Plasmodium falciparum
SRNK

SEQ ID NO: 3248709 - protein, 5 aa, Plasmodium falciparum
SRNKN

SEQ ID NO: 3248710 - protein, 27 aa, Plasmodium falciparum
SRNNHPQNTSDSQKECTDGNKENCGAA

SEQ ID NO: 3248711 - protein, 10 aa, Plasmodium falciparum
SRNNNPSDNY

SEQ ID NO: 3248712 - protein, 5 aa, Plasmodium falciparum
SRNPM

SEQ ID NO: 3248713 - protein, 7 aa, Plasmodium falciparum
SRNPSIS

SEQ ID NO: 3248714 - protein, 8 aa, Plasmodium falciparum
SRNQRLEQ

SEQ ID NO: 3248715 - protein, 4 aa, Plasmodium falciparum
SRNS

SEQ ID NO: 3248716 - protein, 5 aa, Plasmodium falciparum
SRNVQ

SEQ ID NO: 3248717 - protein, 7 aa, Plasmodium falciparum
SRNYKKR

SEQ ID NO: 3248718 - protein, 5 aa, Plasmodium falciparum
SRNYS

SEQ ID NO: 3248719 - protein, 10 aa, Plasmodium falciparum
SRPAPTPPEF

SEQ ID NO: 3248720 - protein, 5 aa, Plasmodium falciparum
SRPEN

SEQ ID NO: 3248721 - protein, 5 aa, Plasmodium falciparum
SRPFS

SEQ ID NO: 3248722 - protein, 8 aa, Plasmodium falciparum
SRPGVSNQ

SEQ ID NO: 3248723 - protein, 9 aa, Plasmodium falciparum
SRPKRTTTF

SEQ ID NO: 3248724 - protein, 6 aa, Plasmodium falciparum
SRQDKE

SEQ ID NO: 3248725 - protein, 24 aa, Plasmodium falciparum
SRQPQTSACSQQQQQQNKSSTQNH

SEQ ID NO: 3248726 - protein, 5 aa, Plasmodium falciparum
SRQYS

SEQ ID NO: 3248727 - protein, 32 aa, Plasmodium falciparum
SRRNINNNDNNDDNNDENNDDDNNDKDNLFSD

SEQ ID NO: 3248728 - protein, 8 aa, Plasmodium falciparum
SRRNSTRS

SEQ ID NO: 3248729 - protein, 9 aa, Plasmodium falciparum
SRRSNNTNI

SEQ ID NO: 3248730 - protein, 6 aa, Plasmodium falciparum
SRSEES

SEQ ID NO: 3248731 - protein, 18 aa, Plasmodium falciparum
SRSLSQEKYESKKRKLER

SEQ ID NO: 3248732 - protein, 17 aa, Plasmodium falciparum
SRSLTERKQRNNGKPSV

SEQ ID NO: 3248733 - protein, 5 aa, Plasmodium falciparum
SRSNL

SEQ ID NO: 3248734 - protein, 13 aa, Plasmodium falciparum
SRSNRKNDTSERL

SEQ ID NO: 3248735 - protein, 11 aa, Plasmodium falciparum
SRSNTNNNVSR

SEQ ID NO: 3248736 - protein, 4 aa, Plasmodium falciparum
SRSP

SEQ ID NO: 3248737 - protein, 4 aa, Plasmodium falciparum
SRSQ

SEQ ID NO: 3248738 - protein, 8 aa, Plasmodium falciparum
SRSRRGIP

SEQ ID NO: 3248739 - protein, 5 aa, Plasmodium falciparum
SRSSE

SEQ ID NO: 3248740 - protein, 5 aa, Plasmodium falciparum
SRSSI

SEQ ID NO: 3248741 - protein, 13 aa, Plasmodium falciparum
SRSSISSVTNTTN

SEQ ID NO: 3248742 - protein, 19 aa, Plasmodium falciparum
SRSSPTTNVQKKDVKEETM

SEQ ID NO: 3248743 - protein, 5 aa, Plasmodium falciparum
SRTEE

SEQ ID NO: 3248744 - protein, 5 aa, Plasmodium falciparum
SRTGN

SEQ ID NO: 3248745 - protein, 4 aa, Plasmodium falciparum
SRTH

SEQ ID NO: 3248746 - protein, 6 aa, Plasmodium falciparum
SRTKTD

SEQ ID NO: 3248747 - protein, 8 aa, Plasmodium falciparum
SRTPNKSN

SEQ ID NO: 3248748 - protein, 8 aa, Plasmodium falciparum
SRTSTYEK

SEQ ID NO: 3248749 - protein, 7 aa, Plasmodium falciparum
SRYESQY

SEQ ID NO: 3248750 - protein, 4 aa, Plasmodium falciparum
SRYG

SEQ ID NO: 3248751 - protein, 4 aa, Plasmodium falciparum
SRYK

SEQ ID NO: 3248752 - protein, 4 aa, Plasmodium falciparum
SRYS

SEQ ID NO: 3248753 - protein, 19 aa, Plasmodium falciparum
SRYTSPGGSNTGEAINGSD

SEQ ID NO: 3248754 - protein, 42 aa, Plasmodium falciparum
SSADNEEDEESSFSSNDSKSYQGSQDYDDKESVNSSSQQYSV

SEQ ID NO: 3248755 - protein, 7 aa, Plasmodium falciparum
SSAEDYP

SEQ ID NO: 3248756 - protein, 4 aa, Plasmodium falciparum
SSAN

SEQ ID NO: 3248757 - protein, 9 aa, Plasmodium falciparum
SSANKKNKF

SEQ ID NO: 3248758 - protein, 10 aa, Plasmodium falciparum
SSAQSKPTSN

SEQ ID NO: 3248759 - protein, 23 aa, Plasmodium falciparum
SSASEQYEMSDKTSKENTSDEDM

SEQ ID NO: 3248760 - protein, 19 aa, Plasmodium falciparum
SSASKKKEFCEDSNDITKE

SEQ ID NO: 3248761 - protein, 8 aa, Plasmodium falciparum
SSASSKEG

SEQ ID NO: 3248762 - protein, 9 aa, Plasmodium falciparum
SSAYKNGPF

SEQ ID NO: 3248763 - protein, 4 aa, Plasmodium falciparum
SSCA

SEQ ID NO: 3248764 - protein, 11 aa, Plasmodium falciparum
SSCDSSTQDDY

SEQ ID NO: 3248765 - protein, 73 aa, Plasmodium falciparum
SSCEKKKKKINKNKSEKRINRKKCDKKDCLKDDENISMNKKNNDVKTKQKGNKVNKTNEKNNINNKNLPNGEY

SEQ ID NO: 3248766 - protein, 9 aa, Plasmodium falciparum
SSCENNPAV

SEQ ID NO: 3248767 - protein, 21 aa, Plasmodium falciparum
SSCPNEYKNNVDESNEQQEDS

SEQ ID NO: 3248768 - protein, 21 aa, Plasmodium falciparum
SSCSHSKTLTGEENNNYSNEF

SEQ ID NO: 3248769 - protein, 9 aa, Plasmodium falciparum
SSCTSIGNT

SEQ ID NO: 3248770 - protein, 24 aa, Plasmodium falciparum
SSCVDGEKENEEENEKKENEVSKD

SEQ ID NO: 3248771 - protein, 5 aa, Plasmodium falciparum
SSDAP

SEQ ID NO: 3248772 - protein, 7 aa, Plasmodium falciparum
SSDATPC

SEQ ID NO: 3248773 - protein, 4 aa, Plasmodium falciparum
SSDC

SEQ ID NO: 3248774 - protein, 5 aa, Plasmodium falciparum
SSDDA

SEQ ID NO: 3248775 - protein, 5 aa, Plasmodium falciparum
SSDDH

SEQ ID NO: 3248776 - protein, 5 aa, Plasmodium falciparum
SSDDI

SEQ ID NO: 3248777 - protein, 9 aa, Plasmodium falciparum
SSDDKNPWT

SEQ ID NO: 3248778 - protein, 8 aa, Plasmodium falciparum
SSDEDNID

SEQ ID NO: 3248779 - protein, 63 aa, Plasmodium falciparum
SSDEEFENRYNSNSSTQKKKKKRSKVPDSRKHSRTLRKRDDNNDDDDNDDDVNNDDDVNNDDI

SEQ ID NO: 3248780 - protein, 9 aa, Plasmodium falciparum
SSDEEGEVN

SEQ ID NO: 3248781 - protein, 5 aa, Plasmodium falciparum
SSDEK

SEQ ID NO: 3248782 - protein, 6 aa, Plasmodium falciparum
SSDEKK

SEQ ID NO: 3248783 - protein, 10 aa, Plasmodium falciparum
SSDEKTEEEI

SEQ ID NO: 3248784 - protein, 21 aa, Plasmodium falciparum
SSDEPENSKNIGKKKKKKKKN

SEQ ID NO: 3248785 - protein, 9 aa, Plasmodium falciparum
SSDEYEEEQ

SEQ ID NO: 3248786 - protein, 9 aa, Plasmodium falciparum
SSDEYNNDK

SEQ ID NO: 3248787 - protein, 6 aa, Plasmodium falciparum
SSDGDI

SEQ ID NO: 3248788 - protein, 10 aa, Plasmodium falciparum
SSDGNNSPLA

SEQ ID NO: 3248789 - protein, 34 aa, Plasmodium falciparum
SSDHNNNSSNNSSNNSSNNSSNNSSSGRNNSSDE

SEQ ID NO: 3248790 - protein, 9 aa, Plasmodium falciparum
SSDHNYDKP

SEQ ID NO: 3248791 - protein, 4 aa, Plasmodium falciparum
SSDI

SEQ ID NO: 3248792 - protein, 13 aa, Plasmodium falciparum
SSDITSSESEYEE

SEQ ID NO: 3248793 - protein, 11 aa, Plasmodium falciparum
SSDITSSSESM

SEQ ID NO: 3248794 - protein, 8 aa, Plasmodium falciparum
SSDKCEYK

SEQ ID NO: 3248795 - protein, 8 aa, Plasmodium falciparum
SSDKHDKY

SEQ ID NO: 3248796 - protein, 24 aa, Plasmodium falciparum
SSDLKNKNKKNKRLSDSKHTNEKT

SEQ ID NO: 3248797 - protein, 4 aa, Plasmodium falciparum
SSDN

SEQ ID NO: 3248798 - protein, 30 aa, Plasmodium falciparum
SSDNCRKKPDKSCDEQITDKEYPPENTTKI

SEQ ID NO: 3248799 - protein, 12 aa, Plasmodium falciparum
SSDNDIDENNIN

SEQ ID NO: 3248800 - protein, 35 aa, Plasmodium falciparum
SSDNEEENLHKPNDFDKNSDIYTDGKSAKSSSRKV

SEQ ID NO: 3248801 - protein, 20 aa, Plasmodium falciparum
SSDNEYSSDNEYSSDSEKYY

SEQ ID NO: 3248802 - protein, 14 aa, Plasmodium falciparum
SSDNMNSVSSVEED

SEQ ID NO: 3248803 - protein, 9 aa, Plasmodium falciparum
SSDNNTNLS

SEQ ID NO: 3248804 - protein, 10 aa, Plasmodium falciparum
SSDNNTRTTK

SEQ ID NO: 3248805 - protein, 6 aa, Plasmodium falciparum
SSDNNY

SEQ ID NO: 3248806 - protein, 13 aa, Plasmodium falciparum
SSDQNNNEKKNSP

SEQ ID NO: 3248807 - protein, 5 aa, Plasmodium falciparum
SSDQY

SEQ ID NO: 3248808 - protein, 11 aa, Plasmodium falciparum
SSDRNRSTNKD

SEQ ID NO: 3248809 - protein, 20 aa, Plasmodium falciparum
SSDSDEYAQKKKKKKNNKIK

SEQ ID NO: 3248810 - protein, 39 aa, Plasmodium falciparum
SSDSHISKDEHNHSHSSRESEENLSRQNSQLSSTNITND

SEQ ID NO: 3248811 - protein, 5 aa, Plasmodium falciparum
SSDSI

SEQ ID NO: 3248812 - protein, 45 aa, Plasmodium falciparum
SSDSKNQTKQKEDKSRDKSRDKSRDKSRDKSKDKNKDKNKSINNN

SEQ ID NO: 3248813 - protein, 9 aa, Plasmodium falciparum
SSDTDDEHI

SEQ ID NO: 3248814 - protein, 15 aa, Plasmodium falciparum
SSDTEDNSVNNKNGI

SEQ ID NO: 3248815 - protein, 8 aa, Plasmodium falciparum
SSDTNNLY

SEQ ID NO: 3248816 - protein, 61 aa, Plasmodium falciparum
SSDVGKGQCECEEQKMKKQEKVKEEQEKVKEEQEKVKEQMKEQDGENSNFKDMNPNNNLHT

SEQ ID NO: 3248817 - protein, 5 aa, Plasmodium falciparum
SSDVL

SEQ ID NO: 3248818 - protein, 25 aa, Plasmodium falciparum
SSDVSKNSGSSNDSYSYTDSGKEMN

SEQ ID NO: 3248819 - protein, 4 aa, Plasmodium falciparum
SSDY

SEQ ID NO: 3248820 - protein, 14 aa, Plasmodium falciparum
SSDYGNASSISSTK

SEQ ID NO: 3248821 - protein, 4 aa, Plasmodium falciparum
SSEA

SEQ ID NO: 3248822 - protein, 6 aa, Plasmodium falciparum
SSEARK

SEQ ID NO: 3248823 - protein, 5 aa, Plasmodium falciparum
SSEAS

SEQ ID NO: 3248824 - protein, 7 aa, Plasmodium falciparum
SSECSCD

SEQ ID NO: 3248825 - protein, 17 aa, Plasmodium falciparum
SSECSNRSHEKKKKKLY

SEQ ID NO: 3248826 - protein, 9 aa, Plasmodium falciparum
SSEDIKDRL

SEQ ID NO: 3248827 - protein, 7 aa, Plasmodium falciparum
SSEDINN

SEQ ID NO: 3248828 - protein, 5 aa, Plasmodium falciparum
SSEDY

SEQ ID NO: 3248829 - protein, 34 aa, Plasmodium falciparum
SSEEEKTPTSNNIRKKRKTKRSHKNKDSNTSYDN

SEQ ID NO: 3248830 - protein, 18 aa, Plasmodium falciparum
SSEEFSDLEKKNKNIYSK

SEQ ID NO: 3248831 - protein, 7 aa, Plasmodium falciparum
SSEEIEK

SEQ ID NO: 3248832 - protein, 21 aa, Plasmodium falciparum
SSEEKMEQYNNRDASKDREEI

SEQ ID NO: 3248833 - protein, 13 aa, Plasmodium falciparum
SSEETTVTEEDTF

SEQ ID NO: 3248834 - protein, 6 aa, Plasmodium falciparum
SSEGSE

SEQ ID NO: 3248835 - protein, 7 aa, Plasmodium falciparum
SSEGYPQ

SEQ ID NO: 3248836 - protein, 7 aa, Plasmodium falciparum
SSEHERV

SEQ ID NO: 3248837 - protein, 13 aa, Plasmodium falciparum
SSEHMNKGSHDNV

SEQ ID NO: 3248838 - protein, 6 aa, Plasmodium falciparum
SSEHTS

SEQ ID NO: 3248839 - protein, 6 aa, Plasmodium falciparum
SSEKKD

SEQ ID NO: 3248840 - protein, 8 aa, Plasmodium falciparum
SSEKKIES

SEQ ID NO: 3248841 - protein, 7 aa, Plasmodium falciparum
SSEKKKL

SEQ ID NO: 3248842 - protein, 6 aa, Plasmodium falciparum
SSEKRA

SEQ ID NO: 3248843 - protein, 7 aa, Plasmodium falciparum
SSEMSDQ

SEQ ID NO: 3248844 - protein, 5 aa, Plasmodium falciparum
SSENF

SEQ ID NO: 3248845 - protein, 7 aa, Plasmodium falciparum
SSENGNL

SEQ ID NO: 3248846 - protein, 5 aa, Plasmodium falciparum
SSENI

SEQ ID NO: 3248847 - protein, 8 aa, Plasmodium falciparum
SSENKIPL

SEQ ID NO: 3248848 - protein, 19 aa, Plasmodium falciparum
SSEPINSNEIKNTVEDISA

SEQ ID NO: 3248849 - protein, 5 aa, Plasmodium falciparum
SSEPL

SEQ ID NO: 3248850 - protein, 6 aa, Plasmodium falciparum
SSEQKN

SEQ ID NO: 3248851 - protein, 10 aa, Plasmodium falciparum
SSEQSLDTSG

SEQ ID NO: 3248852 - protein, 11 aa, Plasmodium falciparum
SSEQSSNNNLG

SEQ ID NO: 3248853 - protein, 5 aa, Plasmodium falciparum
SSERK

SEQ ID NO: 3248854 - protein, 7 aa, Plasmodium falciparum
SSESSMN

SEQ ID NO: 3248855 - protein, 5 aa, Plasmodium falciparum
SSESV

SEQ ID NO: 3248856 - protein, 6 aa, Plasmodium falciparum
SSETKY

SEQ ID NO: 3248857 - protein, 13 aa, Plasmodium falciparum
SSETNVNNVTNDN

SEQ ID NO: 3248858 - protein, 5 aa, Plasmodium falciparum
SSETR

SEQ ID NO: 3248859 - protein, 4 aa, Plasmodium falciparum
SSEV

SEQ ID NO: 3248860 - protein, 5 aa, Plasmodium falciparum
SSFDN

SEQ ID NO: 3248861 - protein, 5 aa, Plasmodium falciparum
SSFEK

SEQ ID NO: 3248862 - protein, 9 aa, Plasmodium falciparum
SSFEKQNTF

SEQ ID NO: 3248863 - protein, 15 aa, Plasmodium falciparum
SSFHTSNGHQSNDGD

SEQ ID NO: 3248864 - protein, 40 aa, Plasmodium falciparum
SSFKKNTNRRKYNSNNNKNNNNNNNNNDNNDDNNCGNNHG

SEQ ID NO: 3248865 - protein, 5 aa, Plasmodium falciparum
SSFNE

SEQ ID NO: 3248866 - protein, 5 aa, Plasmodium falciparum
SSFNT

SEQ ID NO: 3248867 - protein, 13 aa, Plasmodium falciparum
SSFSNTKNEEYNR

SEQ ID NO: 3248868 - protein, 31 aa, Plasmodium falciparum
SSFSSDEDTSYASKKPNSLSCSENTENTKMD

SEQ ID NO: 3248869 - protein, 4 aa, Plasmodium falciparum
SSGA

SEQ ID NO: 3248870 - protein, 14 aa, Plasmodium falciparum
SSGCEAEKQKKECY

SEQ ID NO: 3248871 - protein, 35 aa, Plasmodium falciparum
SSGDNNNNNNNNAKRGMGHKNSTFTSYNNKKSDIC

SEQ ID NO: 3248872 - protein, 23 aa, Plasmodium falciparum
SSGEKSVATAGSSGATGKSGDKG

SEQ ID NO: 3248873 - protein, 8 aa, Plasmodium falciparum
SSGFNNNV

SEQ ID NO: 3248874 - protein, 6 aa, Plasmodium falciparum
SSGFPK

SEQ ID NO: 3248875 - protein, 10 aa, Plasmodium falciparum
SSGIGKENKN

SEQ ID NO: 3248876 - protein, 6 aa, Plasmodium falciparum
SSGIKK

SEQ ID NO: 3248877 - protein, 11 aa, Plasmodium falciparum
SSGKEGGLQKE

SEQ ID NO: 3248878 - protein, 6 aa, Plasmodium falciparum
SSGKEH

SEQ ID NO: 3248879 - protein, 5 aa, Plasmodium falciparum
SSGKT

SEQ ID NO: 3248880 - protein, 4 aa, Plasmodium falciparum
SSGN

SEQ ID NO: 3248881 - protein, 5 aa, Plasmodium falciparum
SSGNL

SEQ ID NO: 3248882 - protein, 5 aa, Plasmodium falciparum
SSGSC

SEQ ID NO: 3248883 - protein, 9 aa, Plasmodium falciparum
SSGVDHKST

SEQ ID NO: 3248884 - protein, 14 aa, Plasmodium falciparum
SSGVNTSVDPNKAN

SEQ ID NO: 3248885 - protein, 8 aa, Plasmodium falciparum
SSGYEKKE

SEQ ID NO: 3248886 - protein, 6 aa, Plasmodium falciparum
SSHDYD

SEQ ID NO: 3248887 - protein, 6 aa, Plasmodium falciparum
SSHELN

SEQ ID NO: 3248888 - protein, 8 aa, Plasmodium falciparum
SSHENDYK

SEQ ID NO: 3248889 - protein, 7 aa, Plasmodium falciparum
SSHEQKN

SEQ ID NO: 3248890 - protein, 29 aa, Plasmodium falciparum
SSHESSINDKKKDNNDNNNDDDNNKNNSV

SEQ ID NO: 3248891 - protein, 30 aa, Plasmodium falciparum
SSHGHNISSTNKTNNVISEGDELDNNTGTI

SEQ ID NO: 3248892 - protein, 8 aa, Plasmodium falciparum
SSHLSKSK

SEQ ID NO: 3248893 - protein, 9 aa, Plasmodium falciparum
SSHNKETKI

SEQ ID NO: 3248894 - protein, 16 aa, Plasmodium falciparum
SSHQNGKDKKKKIKNN

SEQ ID NO: 3248895 - protein, 4 aa, Plasmodium falciparum
SSHS

SEQ ID NO: 3248896 - protein, 8 aa, Plasmodium falciparum
SSHSDDSY

SEQ ID NO: 3248897 - protein, 8 aa, Plasmodium falciparum
SSHSEEEN

SEQ ID NO: 3248898 - protein, 6 aa, Plasmodium falciparum
SSHSTN

SEQ ID NO: 3248899 - protein, 4 aa, Plasmodium falciparum
SSHT

SEQ ID NO: 3248900 - protein, 14 aa, Plasmodium falciparum
SSHTNKYDQDVSSN

SEQ ID NO: 3248901 - protein, 5 aa, Plasmodium falciparum
SSIAT

SEQ ID NO: 3248902 - protein, 12 aa, Plasmodium falciparum
SSIDSDDSDATY

SEQ ID NO: 3248903 - protein, 6 aa, Plasmodium falciparum
SSIDSK

SEQ ID NO: 3248904 - protein, 18 aa, Plasmodium falciparum
SSIENSNNNNNNNTIPST

SEQ ID NO: 3248905 - protein, 13 aa, Plasmodium falciparum
SSIERINNTKEKK

SEQ ID NO: 3248906 - protein, 11 aa, Plasmodium falciparum
SSIESDEGDMY

SEQ ID NO: 3248907 - protein, 13 aa, Plasmodium falciparum
SSIETNSKRLPSH

SEQ ID NO: 3248908 - protein, 7 aa, Plasmodium falciparum
SSIGNKE

SEQ ID NO: 3248909 - protein, 4 aa, Plasmodium falciparum
SSIK

SEQ ID NO: 3248910 - protein, 58 aa, Plasmodium falciparum
SSIKKTKTKTNKKKKREKEKENNPVSNINNSNINKQIKPNDIHNKETYNNKLKTNNNL

SEQ ID NO: 3248911 - protein, 9 aa, Plasmodium falciparum
SSIKPENVD

SEQ ID NO: 3248912 - protein, 5 aa, Plasmodium falciparum
SSIKS

SEQ ID NO: 3248913 - protein, 5 aa, Plasmodium falciparum
SSINI

SEQ ID NO: 3248914 - protein, 12 aa, Plasmodium falciparum
SSIQNEDTNMDE

SEQ ID NO: 3248915 - protein, 4 aa, Plasmodium falciparum
SSIR

SEQ ID NO: 3248916 - protein, 5 aa, Plasmodium falciparum
SSIRI

SEQ ID NO: 3248917 - protein, 4 aa, Plasmodium falciparum
SSIS

SEQ ID NO: 3248918 - protein, 12 aa, Plasmodium falciparum
SSISSNNTMNSD

SEQ ID NO: 3248919 - protein, 11 aa, Plasmodium falciparum
SSITAAGKINP

SEQ ID NO: 3248920 - protein, 11 aa, Plasmodium falciparum
SSITSSGESVR

SEQ ID NO: 3248921 - protein, 9 aa, Plasmodium falciparum
SSKANSFNS

SEQ ID NO: 3248922 - protein, 10 aa, Plasmodium falciparum
SSKASTTKTR

SEQ ID NO: 3248923 - protein, 5 aa, Plasmodium falciparum
SSKDH

SEQ ID NO: 3248924 - protein, 8 aa, Plasmodium falciparum
SSKDIGDE

SEQ ID NO: 3248925 - protein, 5 aa, Plasmodium falciparum
SSKDL

SEQ ID NO: 3248926 - protein, 13 aa, Plasmodium falciparum
SSKDNRPPSEGIK

SEQ ID NO: 3248927 - protein, 9 aa, Plasmodium falciparum
SSKDSEAIT

SEQ ID NO: 3248928 - protein, 11 aa, Plasmodium falciparum
SSKDSNIQRDD

SEQ ID NO: 3248929 - protein, 8 aa, Plasmodium falciparum
SSKEEFTK

SEQ ID NO: 3248930 - protein, 8 aa, Plasmodium falciparum
SSKEKNYI

SEQ ID NO: 3248931 - protein, 16 aa, Plasmodium falciparum
SSKGKNKKEGKKNNKN

SEQ ID NO: 3248932 - protein, 4 aa, Plasmodium falciparum
SSKK

SEQ ID NO: 3248933 - protein, 5 aa, Plasmodium falciparum
SSKKA

SEQ ID NO: 3248934 - protein, 9 aa, Plasmodium falciparum
SSKKDNYNN

SEQ ID NO: 3248935 - protein, 63 aa, Plasmodium falciparum
SSKKKHTSNNNSDGHINNNNSNSDDHINNNNNNSDVPSHMNNPGNNHNESSSQNNYEQKKKKM

SEQ ID NO: 3248936 - protein, 11 aa, Plasmodium falciparum
SSKKKSKERRK

SEQ ID NO: 3248937 - protein, 6 aa, Plasmodium falciparum
SSKKPF

SEQ ID NO: 3248938 - protein, 7 aa, Plasmodium falciparum
SSKKQKK

SEQ ID NO: 3248939 - protein, 13 aa, Plasmodium falciparum
SSKLSDNSNISNT

SEQ ID NO: 3248940 - protein, 6 aa, Plasmodium falciparum
SSKLYS

SEQ ID NO: 3248941 - protein, 6 aa, Plasmodium falciparum
SSKMND

SEQ ID NO: 3248942 - protein, 5 aa, Plasmodium falciparum
SSKMQ

SEQ ID NO: 3248943 - protein, 9 aa, Plasmodium falciparum
SSKMSPMET

SEQ ID NO: 3248944 - protein, 7 aa, Plasmodium falciparum
SSKNENI

SEQ ID NO: 3248945 - protein, 31 aa, Plasmodium falciparum
SSKNKKKKKGIEKNNKEAKGIKKKKNTPITK

SEQ ID NO: 3248946 - protein, 7 aa, Plasmodium falciparum
SSKNKND

SEQ ID NO: 3248947 - protein, 8 aa, Plasmodium falciparum
SSKNKTNK

SEQ ID NO: 3248948 - protein, 8 aa, Plasmodium falciparum
SSKNNIKK

SEQ ID NO: 3248949 - protein, 6 aa, Plasmodium falciparum
SSKNNL

SEQ ID NO: 3248950 - protein, 7 aa, Plasmodium falciparum
SSKNNQE

SEQ ID NO: 3248951 - protein, 11 aa, Plasmodium falciparum
SSKNPPNPLKS

SEQ ID NO: 3248952 - protein, 6 aa, Plasmodium falciparum
SSKNRK

SEQ ID NO: 3248953 - protein, 5 aa, Plasmodium falciparum
SSKNV

SEQ ID NO: 3248954 - protein, 4 aa, Plasmodium falciparum
SSKP

SEQ ID NO: 3248955 - protein, 5 aa, Plasmodium falciparum
SSKQN

SEQ ID NO: 3248956 - protein, 9 aa, Plasmodium falciparum
SSKQNESVT

SEQ ID NO: 3248957 - protein, 8 aa, Plasmodium falciparum
SSKQTKKK

SEQ ID NO: 3248958 - protein, 9 aa, Plasmodium falciparum
SSKRTRSEA

SEQ ID NO: 3248959 - protein, 7 aa, Plasmodium falciparum
SSKRTYD

SEQ ID NO: 3248960 - protein, 8 aa, Plasmodium falciparum
SSKSDLSY

SEQ ID NO: 3248961 - protein, 13 aa, Plasmodium falciparum
SSKSFAKGKKEDF

SEQ ID NO: 3248962 - protein, 10 aa, Plasmodium falciparum
SSKSKKKKNA

SEQ ID NO: 3248963 - protein, 10 aa, Plasmodium falciparum
SSKSNEDTNH

SEQ ID NO: 3248964 - protein, 4 aa, Plasmodium falciparum
SSKT

SEQ ID NO: 3248965 - protein, 8 aa, Plasmodium falciparum
SSKTLQKD

SEQ ID NO: 3248966 - protein, 4 aa, Plasmodium falciparum
SSKV

SEQ ID NO: 3248967 - protein, 7 aa, Plasmodium falciparum
SSKYGCN

SEQ ID NO: 3248968 - protein, 24 aa, Plasmodium falciparum
SSKYHRNNQEEYSHNNKTNDNSVS

SEQ ID NO: 3248969 - protein, 6 aa, Plasmodium falciparum
SSKYKE

SEQ ID NO: 3248970 - protein, 14 aa, Plasmodium falciparum
SSKYKINEKPSTYA

SEQ ID NO: 3248971 - protein, 8 aa, Plasmodium falciparum
SSKYSNTV

SEQ ID NO: 3248972 - protein, 9 aa, Plasmodium falciparum
SSKYTNPHL

SEQ ID NO: 3248973 - protein, 4 aa, Plasmodium falciparum
SSLE

SEQ ID NO: 3248974 - protein, 17 aa, Plasmodium falciparum
SSLEEDKNKIEEATHRT

SEQ ID NO: 3248975 - protein, 7 aa, Plasmodium falciparum
SSLITGP

SEQ ID NO: 3248976 - protein, 14 aa, Plasmodium falciparum
SSLKDDKSKNNITL

SEQ ID NO: 3248977 - protein, 9 aa, Plasmodium falciparum
SSLKEDQEN

SEQ ID NO: 3248978 - protein, 14 aa, Plasmodium falciparum
SSLKEGSHNTNSNN

SEQ ID NO: 3248979 - protein, 17 aa, Plasmodium falciparum
SSLMTGNQTSSTKDVGG

SEQ ID NO: 3248980 - protein, 10 aa, Plasmodium falciparum
SSLNKKENER

SEQ ID NO: 3248981 - protein, 8 aa, Plasmodium falciparum
SSLPGSIQ

SEQ ID NO: 3248982 - protein, 16 aa, Plasmodium falciparum
SSLPQDNRGNSRDSKE

SEQ ID NO: 3248983 - protein, 5 aa, Plasmodium falciparum
SSLQD

SEQ ID NO: 3248984 - protein, 8 aa, Plasmodium falciparum
SSLQSSTS

SEQ ID NO: 3248985 - protein, 10 aa, Plasmodium falciparum
SSLSDENNKL

SEQ ID NO: 3248986 - protein, 5 aa, Plasmodium falciparum
SSLSE

SEQ ID NO: 3248987 - protein, 5 aa, Plasmodium falciparum
SSLSS

SEQ ID NO: 3248988 - protein, 4 aa, Plasmodium falciparum
SSMD

SEQ ID NO: 3248989 - protein, 12 aa, Plasmodium falciparum
SSMEQRKGRCGR

SEQ ID NO: 3248990 - protein, 6 aa, Plasmodium falciparum
SSMHSS

SEQ ID NO: 3248991 - protein, 28 aa, Plasmodium falciparum
SSMNQTNGISKENVSEKVYSEDDKNTSC

SEQ ID NO: 3248992 - protein, 6 aa, Plasmodium falciparum
SSMNSS

SEQ ID NO: 3248993 - protein, 6 aa, Plasmodium falciparum
SSMPDK

SEQ ID NO: 3248994 - protein, 22 aa, Plasmodium falciparum
SSMSRSGSINRSTSRSKRIGEK

SEQ ID NO: 3248995 - protein, 6 aa, Plasmodium falciparum
SSNAEK

SEQ ID NO: 3248996 - protein, 10 aa, Plasmodium falciparum
SSNAHSKNKT

SEQ ID NO: 3248997 - protein, 15 aa, Plasmodium falciparum
SSNAQNTNTDNSNNN

SEQ ID NO: 3248998 - protein, 4 aa, Plasmodium falciparum
SSND

SEQ ID NO: 3248999 - protein, 6 aa, Plasmodium falciparum
SSNDLT

SEQ ID NO: 3249000 - protein, 44 aa, Plasmodium falciparum
SSNDNNKNKNNNDNNKNKNSNDNNQNNNDNDNSNNISSNSIHGS

SEQ ID NO: 3249001 - protein, 5 aa, Plasmodium falciparum
SSNDQ

SEQ ID NO: 3249002 - protein, 4 aa, Plasmodium falciparum
SSNE

SEQ ID NO: 3249003 - protein, 9 aa, Plasmodium falciparum
SSNEKKKIK

SEQ ID NO: 3249004 - protein, 27 aa, Plasmodium falciparum
SSNETNDTNHTNRTNRTNEMKEENGLS

SEQ ID NO: 3249005 - protein, 4 aa, Plasmodium falciparum
SSNF

SEQ ID NO: 3249006 - protein, 6 aa, Plasmodium falciparum
SSNGDM

SEQ ID NO: 3249007 - protein, 13 aa, Plasmodium falciparum
SSNHMRGDSLNKN

SEQ ID NO: 3249008 - protein, 11 aa, Plasmodium falciparum
SSNINDDSNSY

SEQ ID NO: 3249009 - protein, 7 aa, Plasmodium falciparum
SSNINQS

SEQ ID NO: 3249010 - protein, 7 aa, Plasmodium falciparum
SSNISKD

SEQ ID NO: 3249011 - protein, 11 aa, Plasmodium falciparum
SSNIYSEDPNI

SEQ ID NO: 3249012 - protein, 9 aa, Plasmodium falciparum
SSNKKNSSI

SEQ ID NO: 3249013 - protein, 5 aa, Plasmodium falciparum
SSNKN

SEQ ID NO: 3249014 - protein, 14 aa, Plasmodium falciparum
SSNKNDIETKRART

SEQ ID NO: 3249015 - protein, 7 aa, Plasmodium falciparum
SSNKNNE

SEQ ID NO: 3249016 - protein, 7 aa, Plasmodium falciparum
SSNKNRN

SEQ ID NO: 3249017 - protein, 8 aa, Plasmodium falciparum
SSNKTAKN

SEQ ID NO: 3249018 - protein, 9 aa, Plasmodium falciparum
SSNLKSEKN

SEQ ID NO: 3249019 - protein, 5 aa, Plasmodium falciparum
SSNMD

SEQ ID NO: 3249020 - protein, 6 aa, Plasmodium falciparum
SSNMNE

SEQ ID NO: 3249021 - protein, 4 aa, Plasmodium falciparum
SSNN

SEQ ID NO: 3249022 - protein, 7 aa, Plasmodium falciparum
SSNNAKI

SEQ ID NO: 3249023 - protein, 5 aa, Plasmodium falciparum
SSNND

SEQ ID NO: 3249024 - protein, 8 aa, Plasmodium falciparum
SSNNEEKE

SEQ ID NO: 3249025 - protein, 10 aa, Plasmodium falciparum
SSNNENENFV

SEQ ID NO: 3249026 - protein, 5 aa, Plasmodium falciparum
SSNNI

SEQ ID NO: 3249027 - protein, 7 aa, Plasmodium falciparum
SSNNISP

SEQ ID NO: 3249028 - protein, 7 aa, Plasmodium falciparum
SSNNKDT

SEQ ID NO: 3249029 - protein, 9 aa, Plasmodium falciparum
SSNNKNEEI

SEQ ID NO: 3249030 - protein, 7 aa, Plasmodium falciparum
SSNNKNI

SEQ ID NO: 3249031 - protein, 6 aa, Plasmodium falciparum
SSNNKQ

SEQ ID NO: 3249032 - protein, 9 aa, Plasmodium falciparum
SSNNKTRTD

SEQ ID NO: 3249033 - protein, 10 aa, Plasmodium falciparum
SSNNLKKTNI

SEQ ID NO: 3249034 - protein, 5 aa, Plasmodium falciparum
SSNNN

SEQ ID NO: 3249035 - protein, 21 aa, Plasmodium falciparum
SSNNNEEIKSVENDKNGGNSY

SEQ ID NO: 3249036 - protein, 12 aa, Plasmodium falciparum
SSNNNKEKDEEY

SEQ ID NO: 3249037 - protein, 21 aa, Plasmodium falciparum
SSNNNNNNNNNNNNQSNHQEN

SEQ ID NO: 3249038 - protein, 12 aa, Plasmodium falciparum
SSNNNTVTTEKL

SEQ ID NO: 3249039 - protein, 10 aa, Plasmodium falciparum
SSNNPNISSN

SEQ ID NO: 3249040 - protein, 9 aa, Plasmodium falciparum
SSNNRSSTL

SEQ ID NO: 3249041 - protein, 6 aa, Plasmodium falciparum
SSNNST

SEQ ID NO: 3249042 - protein, 8 aa, Plasmodium falciparum
SSNNVSKL

SEQ ID NO: 3249043 - protein, 6 aa, Plasmodium falciparum
SSNNYF

SEQ ID NO: 3249044 - protein, 6 aa, Plasmodium falciparum
SSNPDL

SEQ ID NO: 3249045 - protein, 7 aa, Plasmodium falciparum
SSNPSSP

SEQ ID NO: 3249046 - protein, 11 aa, Plasmodium falciparum
SSNQAKPTNSL

SEQ ID NO: 3249047 - protein, 11 aa, Plasmodium falciparum
SSNQAKPTSSL

SEQ ID NO: 3249048 - protein, 5 aa, Plasmodium falciparum
SSNQI

SEQ ID NO: 3249049 - protein, 28 aa, Plasmodium falciparum
SSNQNTQNEYNKSEKTKNVNDSKEEEDY

SEQ ID NO: 3249050 - protein, 9 aa, Plasmodium falciparum
SSNQTNSSN

SEQ ID NO: 3249051 - protein, 13 aa, Plasmodium falciparum
SSNQYDKNIQSTN

SEQ ID NO: 3249052 - protein, 10 aa, Plasmodium falciparum
SSNSKNFDDG

SEQ ID NO: 3249053 - protein, 16 aa, Plasmodium falciparum
SSNSKNNDNNNDNNNH

SEQ ID NO: 3249054 - protein, 14 aa, Plasmodium falciparum
SSNSKNSSNDNVSN

SEQ ID NO: 3249055 - protein, 6 aa, Plasmodium falciparum
SSNSLD

SEQ ID NO: 3249056 - protein, 16 aa, Plasmodium falciparum
SSNSQEYTYSRREDNI

SEQ ID NO: 3249057 - protein, 12 aa, Plasmodium falciparum
SSNSSSKKLQHT

SEQ ID NO: 3249058 - protein, 7 aa, Plasmodium falciparum
SSNTDVQ

SEQ ID NO: 3249059 - protein, 7 aa, Plasmodium falciparum
SSNTEGR

SEQ ID NO: 3249060 - protein, 15 aa, Plasmodium falciparum
SSNTEKYNNSDDNIQ

SEQ ID NO: 3249061 - protein, 36 aa, Plasmodium falciparum
SSNTGNIHTTNDKENIGENNIDSYNKDKKKESNNED

SEQ ID NO: 3249062 - protein, 6 aa, Plasmodium falciparum
SSNTIQ

SEQ ID NO: 3249063 - protein, 11 aa, Plasmodium falciparum
SSNTQNKSDVQ

SEQ ID NO: 3249064 - protein, 13 aa, Plasmodium falciparum
SSNTSCSNNDFNT

SEQ ID NO: 3249065 - protein, 20 aa, Plasmodium falciparum
SSNTSDTTGKETPSSSNDNL

SEQ ID NO: 3249066 - protein, 6 aa, Plasmodium falciparum
SSNVKN

SEQ ID NO: 3249067 - protein, 32 aa, Plasmodium falciparum
SSNVNLSEGTEDNVKKKKKKKKKKKKKENREI

SEQ ID NO: 3249068 - protein, 8 aa, Plasmodium falciparum
SSNVNPSS

SEQ ID NO: 3249069 - protein, 23 aa, Plasmodium falciparum
SSNVSPREGENEHNSRETSNINN

SEQ ID NO: 3249070 - protein, 4 aa, Plasmodium falciparum
SSNY

SEQ ID NO: 3249071 - protein, 15 aa, Plasmodium falciparum
SSNYDDSACKSNDDL

SEQ ID NO: 3249072 - protein, 7 aa, Plasmodium falciparum
SSNYKEY

SEQ ID NO: 3249073 - protein, 7 aa, Plasmodium falciparum
SSNYQSN

SEQ ID NO: 3249074 - protein, 6 aa, Plasmodium falciparum
SSPCSK

SEQ ID NO: 3249075 - protein, 19 aa, Plasmodium falciparum
SSPDNFQGSLKTKENSGVL

SEQ ID NO: 3249076 - protein, 5 aa, Plasmodium falciparum
SSPED

SEQ ID NO: 3249077 - protein, 12 aa, Plasmodium falciparum
SSPGHDDGGDDH

SEQ ID NO: 3249078 - protein, 4 aa, Plasmodium falciparum
SSPH

SEQ ID NO: 3249079 - protein, 7 aa, Plasmodium falciparum
SSPIYSN

SEQ ID NO: 3249080 - protein, 7 aa, Plasmodium falciparum
SSPKKNN

SEQ ID NO: 3249081 - protein, 4 aa, Plasmodium falciparum
SSPL

SEQ ID NO: 3249082 - protein, 6 aa, Plasmodium falciparum
SSPLDD

SEQ ID NO: 3249083 - protein, 6 aa, Plasmodium falciparum
SSPLNR

SEQ ID NO: 3249084 - protein, 8 aa, Plasmodium falciparum
SSPLSHPI

SEQ ID NO: 3249085 - protein, 58 aa, Plasmodium falciparum
SSPNEDNLEREQNKINDNNCDEKNNNCDEKNNSCDEKNNSCDEKNNSCDEKNNNCDKT

SEQ ID NO: 3249086 - protein, 88 aa, Plasmodium falciparum
SSPNKEEESMSSDNHNKDINSSDNQNKDINSSDHNMNDSTNESTTTSLSTSINNTNRNKKNRKKNNININNNNNNSNNINSSSNNNSG

SEQ ID NO: 3249087 - protein, 6 aa, Plasmodium falciparum
SSPNNL

SEQ ID NO: 3249088 - protein, 5 aa, Plasmodium falciparum
SSPNQ

SEQ ID NO: 3249089 - protein, 16 aa, Plasmodium falciparum
SSPNTPGLRDNQEAGK

SEQ ID NO: 3249090 - protein, 8 aa, Plasmodium falciparum
SSPSDGAM

SEQ ID NO: 3249091 - protein, 10 aa, Plasmodium falciparum
SSPSPSRISS

SEQ ID NO: 3249092 - protein, 14 aa, Plasmodium falciparum
SSPSPSSSSSTHNN

SEQ ID NO: 3249093 - protein, 7 aa, Plasmodium falciparum
SSPSSYE

SEQ ID NO: 3249094 - protein, 4 aa, Plasmodium falciparum
SSPV

SEQ ID NO: 3249095 - protein, 5 aa, Plasmodium falciparum
SSQAR

SEQ ID NO: 3249096 - protein, 29 aa, Plasmodium falciparum
SSQDEEKSKSFDSSDSCSVDEKESSKGLY

SEQ ID NO: 3249097 - protein, 5 aa, Plasmodium falciparum
SSQED

SEQ ID NO: 3249098 - protein, 5 aa, Plasmodium falciparum
SSQEK

SEQ ID NO: 3249099 - protein, 16 aa, Plasmodium falciparum
SSQEKNKNGHETQISQ

SEQ ID NO: 3249100 - protein, 10 aa, Plasmodium falciparum
SSQGTTPRGE

SEQ ID NO: 3249101 - protein, 6 aa, Plasmodium falciparum
SSQKDK

SEQ ID NO: 3249102 - protein, 6 aa, Plasmodium falciparum
SSQKEE

SEQ ID NO: 3249103 - protein, 9 aa, Plasmodium falciparum
SSQKKSDHI

SEQ ID NO: 3249104 - protein, 8 aa, Plasmodium falciparum
SSQKPDSN

SEQ ID NO: 3249105 - protein, 4 aa, Plasmodium falciparum
SSQN

SEQ ID NO: 3249106 - protein, 6 aa, Plasmodium falciparum
SSQNNN

SEQ ID NO: 3249107 - protein, 12 aa, Plasmodium falciparum
SSQNNNDHNNQV

SEQ ID NO: 3249108 - protein, 6 aa, Plasmodium falciparum
SSQQRN

SEQ ID NO: 3249109 - protein, 28 aa, Plasmodium falciparum
SSQRKVPKKEKKKEKCEKCDEKVGSQVN

SEQ ID NO: 3249110 - protein, 72 aa, Plasmodium falciparum
SSQSKSSSQLSSPLSSPLSSPSPSSSPSSSPSSSPSSSPSSSPSPSSSPSPSSSPSSSPSSSPSSPPSPLSY

SEQ ID NO: 3249111 - protein, 4 aa, Plasmodium falciparum
SSQT

SEQ ID NO: 3249112 - protein, 5 aa, Plasmodium falciparum
SSQTD

SEQ ID NO: 3249113 - protein, 7 aa, Plasmodium falciparum
SSQTEID

SEQ ID NO: 3249114 - protein, 8 aa, Plasmodium falciparum
SSQTNVPF

SEQ ID NO: 3249115 - protein, 11 aa, Plasmodium falciparum
SSQTYSDGSEY

SEQ ID NO: 3249116 - protein, 8 aa, Plasmodium falciparum
SSRAGDNI

SEQ ID NO: 3249117 - protein, 5 aa, Plasmodium falciparum
SSRCN

SEQ ID NO: 3249118 - protein, 5 aa, Plasmodium falciparum
SSRDI

SEQ ID NO: 3249119 - protein, 4 aa, Plasmodium falciparum
SSRK

SEQ ID NO: 3249120 - protein, 6 aa, Plasmodium falciparum
SSRKKN

SEQ ID NO: 3249121 - protein, 4 aa, Plasmodium falciparum
SSRN

SEQ ID NO: 3249122 - protein, 10 aa, Plasmodium falciparum
SSRPEKIEEE

SEQ ID NO: 3249123 - protein, 4 aa, Plasmodium falciparum
SSRQ

SEQ ID NO: 3249124 - protein, 17 aa, Plasmodium falciparum
SSRQDNMEKQKSGENKQ

SEQ ID NO: 3249125 - protein, 6 aa, Plasmodium falciparum
SSRQRE

SEQ ID NO: 3249126 - protein, 5 aa, Plasmodium falciparum
SSRRA

SEQ ID NO: 3249127 - protein, 12 aa, Plasmodium falciparum
SSRRKSNEKENL

SEQ ID NO: 3249128 - protein, 9 aa, Plasmodium falciparum
SSSADEKTK

SEQ ID NO: 3249129 - protein, 6 aa, Plasmodium falciparum
SSSALG

SEQ ID NO: 3249130 - protein, 7 aa, Plasmodium falciparum
SSSCPKS

SEQ ID NO: 3249131 - protein, 9 aa, Plasmodium falciparum
SSSCSSSSI

SEQ ID NO: 3249132 - protein, 13 aa, Plasmodium falciparum
SSSDDSDMDDNEK

SEQ ID NO: 3249133 - protein, 7 aa, Plasmodium falciparum
SSSDIKN

SEQ ID NO: 3249134 - protein, 15 aa, Plasmodium falciparum
SSSDITSSSESEYEE

SEQ ID NO: 3249135 - protein, 7 aa, Plasmodium falciparum
SSSDKEA

SEQ ID NO: 3249136 - protein, 7 aa, Plasmodium falciparum
SSSDTVR

SEQ ID NO: 3249137 - protein, 5 aa, Plasmodium falciparum
SSSDV

SEQ ID NO: 3249138 - protein, 4 aa, Plasmodium falciparum
SSSE

SEQ ID NO: 3249139 - protein, 6 aa, Plasmodium falciparum
SSSEDE

SEQ ID NO: 3249140 - protein, 14 aa, Plasmodium falciparum
SSSEFSPSHSYTSK

SEQ ID NO: 3249141 - protein, 9 aa, Plasmodium falciparum
SSSENKRNL

SEQ ID NO: 3249142 - protein, 15 aa, Plasmodium falciparum
SSSEREDDEKDGDHE

SEQ ID NO: 3249143 - protein, 11 aa, Plasmodium falciparum
SSSESSNYNED

SEQ ID NO: 3249144 - protein, 5 aa, Plasmodium falciparum
SSSEV

SEQ ID NO: 3249145 - protein, 6 aa, Plasmodium falciparum
SSSFST

SEQ ID NO: 3249146 - protein, 15 aa, Plasmodium falciparum
SSSGLNNQTSNLGNK

SEQ ID NO: 3249147 - protein, 6 aa, Plasmodium falciparum
SSSGSK

SEQ ID NO: 3249148 - protein, 16 aa, Plasmodium falciparum
SSSGSSYEKLNQSNDD

SEQ ID NO: 3249149 - protein, 5 aa, Plasmodium falciparum
SSSHY

SEQ ID NO: 3249150 - protein, 7 aa, Plasmodium falciparum
SSSIDPT

SEQ ID NO: 3249151 - protein, 43 aa, Plasmodium falciparum
SSSIETNDEENESIDNNEENMSDRPNSLSHDKDQHLDETHNEQ

SEQ ID NO: 3249152 - protein, 8 aa, Plasmodium falciparum
SSSITRRS

SEQ ID NO: 3249153 - protein, 13 aa, Plasmodium falciparum
SSSKENTLYPDDH

SEQ ID NO: 3249154 - protein, 11 aa, Plasmodium falciparum
SSSKKPEQSKL

SEQ ID NO: 3249155 - protein, 6 aa, Plasmodium falciparum
SSSKPK

SEQ ID NO: 3249156 - protein, 24 aa, Plasmodium falciparum
SSSKTYNKQDTPDSHTSNKLTDNE

SEQ ID NO: 3249157 - protein, 6 aa, Plasmodium falciparum
SSSKVK

SEQ ID NO: 3249158 - protein, 7 aa, Plasmodium falciparum
SSSMKST

SEQ ID NO: 3249159 - protein, 14 aa, Plasmodium falciparum
SSSNINSSSNDPSA

SEQ ID NO: 3249160 - protein, 8 aa, Plasmodium falciparum
SSSNKGEE

SEQ ID NO: 3249161 - protein, 17 aa, Plasmodium falciparum
SSSNKLEQKEKEKKKNY

SEQ ID NO: 3249162 - protein, 21 aa, Plasmodium falciparum
SSSNNNMNTTTDGNNNNGTKL

SEQ ID NO: 3249163 - protein, 13 aa, Plasmodium falciparum
SSSNNPSDPSSNM

SEQ ID NO: 3249164 - protein, 10 aa, Plasmodium falciparum
SSSNNYKKKS

SEQ ID NO: 3249165 - protein, 23 aa, Plasmodium falciparum
SSSNQKEDYTNGMTTQDVDNISD

SEQ ID NO: 3249166 - protein, 6 aa, Plasmodium falciparum
SSSNRC

SEQ ID NO: 3249167 - protein, 8 aa, Plasmodium falciparum
SSSNSNTI

SEQ ID NO: 3249168 - protein, 10 aa, Plasmodium falciparum
SSSNVNDQSN

SEQ ID NO: 3249169 - protein, 5 aa, Plasmodium falciparum
SSSNY

SEQ ID NO: 3249170 - protein, 4 aa, Plasmodium falciparum
SSSP

SEQ ID NO: 3249171 - protein, 11 aa, Plasmodium falciparum
SSSPSASSSCG

SEQ ID NO: 3249172 - protein, 8 aa, Plasmodium falciparum
SSSPYEKK

SEQ ID NO: 3249173 - protein, 7 aa, Plasmodium falciparum
SSSPYEQ

SEQ ID NO: 3249174 - protein, 9 aa, Plasmodium falciparum
SSSSDDKSR

SEQ ID NO: 3249175 - protein, 11 aa, Plasmodium falciparum
SSSSDKDESSV

SEQ ID NO: 3249176 - protein, 15 aa, Plasmodium falciparum
SSSSEKMSKKSKPKI

SEQ ID NO: 3249177 - protein, 12 aa, Plasmodium falciparum
SSSSGDTKEKRN

SEQ ID NO: 3249178 - protein, 9 aa, Plasmodium falciparum
SSSSLDENL

SEQ ID NO: 3249179 - protein, 9 aa, Plasmodium falciparum
SSSSLNRNK

SEQ ID NO: 3249180 - protein, 7 aa, Plasmodium falciparum
SSSSMPN

SEQ ID NO: 3249181 - protein, 8 aa, Plasmodium falciparum
SSSSNDLN

SEQ ID NO: 3249182 - protein, 14 aa, Plasmodium falciparum
SSSSNNENYISNNN

SEQ ID NO: 3249183 - protein, 13 aa, Plasmodium falciparum
SSSSNSFSDSDQD

SEQ ID NO: 3249184 - protein, 18 aa, Plasmodium falciparum
SSSSSASFTSDISSTTTL

SEQ ID NO: 3249185 - protein, 9 aa, Plasmodium falciparum
SSSSSNAKK

SEQ ID NO: 3249186 - protein, 9 aa, Plasmodium falciparum
SSSSSSYDM

SEQ ID NO: 3249187 - protein, 10 aa, Plasmodium falciparum
SSSSSTSSNS

SEQ ID NO: 3249188 - protein, 5 aa, Plasmodium falciparum
SSSSV

SEQ ID NO: 3249189 - protein, 16 aa, Plasmodium falciparum
SSSSVDVNKKGNNNKS

SEQ ID NO: 3249190 - protein, 13 aa, Plasmodium falciparum
SSSTCYDNNNNNN

SEQ ID NO: 3249191 - protein, 7 aa, Plasmodium falciparum
SSSTDEY

SEQ ID NO: 3249192 - protein, 6 aa, Plasmodium falciparum
SSSTEV

SEQ ID NO: 3249193 - protein, 6 aa, Plasmodium falciparum
SSSTIS

SEQ ID NO: 3249194 - protein, 8 aa, Plasmodium falciparum
SSSTSCSH

SEQ ID NO: 3249195 - protein, 7 aa, Plasmodium falciparum
SSSVEKS

SEQ ID NO: 3249196 - protein, 7 aa, Plasmodium falciparum
SSSVKGR

SEQ ID NO: 3249197 - protein, 6 aa, Plasmodium falciparum
SSSVNQ

SEQ ID NO: 3249198 - protein, 7 aa, Plasmodium falciparum
SSSVSAQ

SEQ ID NO: 3249199 - protein, 16 aa, Plasmodium falciparum
SSSVSSSCVSSSGLSP

SEQ ID NO: 3249200 - protein, 6 aa, Plasmodium falciparum
SSSYEY

SEQ ID NO: 3249201 - protein, 5 aa, Plasmodium falciparum
SSTAN

SEQ ID NO: 3249202 - protein, 10 aa, Plasmodium falciparum
SSTCDTDSPI

SEQ ID NO: 3249203 - protein, 8 aa, Plasmodium falciparum
SSTCGEGS

SEQ ID NO: 3249204 - protein, 121 aa, Plasmodium falciparum
SSTDHKRKDNKINQKKNDENSTYGENSTYGENSTHGENSTHGENSTHGENSTHGENSTHGENSTYGENGTYDENSTYDENCTYDKNRTYDENRTYDENRTYDKNRTYDENRTYDENRTYDD

SEQ ID NO: 3249205 - protein, 7 aa, Plasmodium falciparum
SSTDNKY

SEQ ID NO: 3249206 - protein, 6 aa, Plasmodium falciparum
SSTEEV

SEQ ID NO: 3249207 - protein, 7 aa, Plasmodium falciparum
SSTENVG

SEQ ID NO: 3249208 - protein, 10 aa, Plasmodium falciparum
SSTFDSDEYE

SEQ ID NO: 3249209 - protein, 5 aa, Plasmodium falciparum
SSTGH

SEQ ID NO: 3249210 - protein, 5 aa, Plasmodium falciparum
SSTHT

SEQ ID NO: 3249211 - protein, 6 aa, Plasmodium falciparum
SSTKDN

SEQ ID NO: 3249212 - protein, 12 aa, Plasmodium falciparum
SSTKNDNTGNNH

SEQ ID NO: 3249213 - protein, 6 aa, Plasmodium falciparum
SSTKNI

SEQ ID NO: 3249214 - protein, 12 aa, Plasmodium falciparum
SSTKYKSKRKKK

SEQ ID NO: 3249215 - protein, 4 aa, Plasmodium falciparum
SSTN

SEQ ID NO: 3249216 - protein, 6 aa, Plasmodium falciparum
SSTNIS

SEQ ID NO: 3249217 - protein, 6 aa, Plasmodium falciparum
SSTNKK

SEQ ID NO: 3249218 - protein, 6 aa, Plasmodium falciparum
SSTNNE

SEQ ID NO: 3249219 - protein, 16 aa, Plasmodium falciparum
SSTNNNIEKDKLTNKS

SEQ ID NO: 3249220 - protein, 13 aa, Plasmodium falciparum
SSTNQASTSSSNM

SEQ ID NO: 3249221 - protein, 13 aa, Plasmodium falciparum
SSTNQASTSSTSM

SEQ ID NO: 3249222 - protein, 11 aa, Plasmodium falciparum
SSTNSGGAWDN

SEQ ID NO: 3249223 - protein, 7 aa, Plasmodium falciparum
SSTPQNL

SEQ ID NO: 3249224 - protein, 12 aa, Plasmodium falciparum
SSTPSNYPPSYT

SEQ ID NO: 3249225 - protein, 6 aa, Plasmodium falciparum
SSTQIL

SEQ ID NO: 3249226 - protein, 6 aa, Plasmodium falciparum
SSTQNS

SEQ ID NO: 3249227 - protein, 21 aa, Plasmodium falciparum
SSTSGEQTETECQEHTPLPDD

SEQ ID NO: 3249228 - protein, 11 aa, Plasmodium falciparum
SSTSQNKSNSI

SEQ ID NO: 3249229 - protein, 8 aa, Plasmodium falciparum
SSTSSCNT

SEQ ID NO: 3249230 - protein, 20 aa, Plasmodium falciparum
SSTSSNSPSSHFPSPHSQPS

SEQ ID NO: 3249231 - protein, 4 aa, Plasmodium falciparum
SSTT

SEQ ID NO: 3249232 - protein, 12 aa, Plasmodium falciparum
SSTTDDSSSYVD

SEQ ID NO: 3249233 - protein, 6 aa, Plasmodium falciparum
SSTYDN

SEQ ID NO: 3249234 - protein, 15 aa, Plasmodium falciparum
SSTYERHKNEKTHNI

SEQ ID NO: 3249235 - protein, 5 aa, Plasmodium falciparum
SSTYG

SEQ ID NO: 3249236 - protein, 17 aa, Plasmodium falciparum
SSVEKDPQEELQRGDIP

SEQ ID NO: 3249237 - protein, 5 aa, Plasmodium falciparum
SSVNP

SEQ ID NO: 3249238 - protein, 17 aa, Plasmodium falciparum
SSVQPSLPTSSKKSNNN

SEQ ID NO: 3249239 - protein, 12 aa, Plasmodium falciparum
SSVSLTKTETNN

SEQ ID NO: 3249240 - protein, 10 aa, Plasmodium falciparum
SSVSNDKKNR

SEQ ID NO: 3249241 - protein, 7 aa, Plasmodium falciparum
SSVSSNS

SEQ ID NO: 3249242 - protein, 6 aa, Plasmodium falciparum
SSVSTN

SEQ ID NO: 3249243 - protein, 7 aa, Plasmodium falciparum
SSVTKGR

SEQ ID NO: 3249244 - protein, 7 aa, Plasmodium falciparum
SSYDQKE

SEQ ID NO: 3249245 - protein, 7 aa, Plasmodium falciparum
SSYDSKK

SEQ ID NO: 3249246 - protein, 16 aa, Plasmodium falciparum
SSYEENKKTKNKEESY

SEQ ID NO: 3249247 - protein, 6 aa, Plasmodium falciparum
SSYEKN

SEQ ID NO: 3249248 - protein, 6 aa, Plasmodium falciparum
SSYGTK

SEQ ID NO: 3249249 - protein, 9 aa, Plasmodium falciparum
SSYITPGQA

SEQ ID NO: 3249250 - protein, 5 aa, Plasmodium falciparum
SSYKE

SEQ ID NO: 3249251 - protein, 6 aa, Plasmodium falciparum
SSYKNR

SEQ ID NO: 3249252 - protein, 30 aa, Plasmodium falciparum
SSYKVGSSNKYHKKNYTDNEKDKKKYRSYK

SEQ ID NO: 3249253 - protein, 4 aa, Plasmodium falciparum
SSYL

SEQ ID NO: 3249254 - protein, 35 aa, Plasmodium falciparum
SSYLDSNSNNNSDGHEDDNKNRCTDVKTNKQEEEF

SEQ ID NO: 3249255 - protein, 5 aa, Plasmodium falciparum
SSYNC

SEQ ID NO: 3249256 - protein, 15 aa, Plasmodium falciparum
SSYNITTKGHTNQLE

SEQ ID NO: 3249257 - protein, 10 aa, Plasmodium falciparum
SSYNKKKEQI

SEQ ID NO: 3249258 - protein, 6 aa, Plasmodium falciparum
SSYNPQ

SEQ ID NO: 3249259 - protein, 6 aa, Plasmodium falciparum
SSYPNN

SEQ ID NO: 3249260 - protein, 7 aa, Plasmodium falciparum
SSYSKPK

SEQ ID NO: 3249261 - protein, 31 aa, Plasmodium falciparum
SSYSNDNNKYDNNNNTYDNNNNKYDNNNNNF

SEQ ID NO: 3249262 - protein, 7 aa, Plasmodium falciparum
SSYSRRK

SEQ ID NO: 3249263 - protein, 10 aa, Plasmodium falciparum
SSYSSSNDIT

SEQ ID NO: 3249264 - protein, 10 aa, Plasmodium falciparum
SSYTNTPENE

SEQ ID NO: 3249265 - protein, 5 aa, Plasmodium falciparum
SSYTP

SEQ ID NO: 3249266 - protein, 4 aa, Plasmodium falciparum
SSYY

SEQ ID NO: 3249267 - protein, 17 aa, Plasmodium falciparum
SSYYNEEHEKHKNTNND

SEQ ID NO: 3249268 - protein, 11 aa, Plasmodium falciparum
STAAAESTYAG

SEQ ID NO: 3249269 - protein, 11 aa, Plasmodium falciparum
STAAANVQRSS

SEQ ID NO: 3249270 - protein, 42 aa, Plasmodium falciparum
STAAANVQRSSVSFNDLIIKLNIVSNAKNAAGEASKKATEEV

SEQ ID NO: 3249271 - protein, 14 aa, Plasmodium falciparum
STAATQKGTYESKY

SEQ ID NO: 3249272 - protein, 6 aa, Plasmodium falciparum
STASDH

SEQ ID NO: 3249273 - protein, 10 aa, Plasmodium falciparum
STASNSHSIE

SEQ ID NO: 3249274 - protein, 4 aa, Plasmodium falciparum
STAT

SEQ ID NO: 3249275 - protein, 5 aa, Plasmodium falciparum
STCEE

SEQ ID NO: 3249276 - protein, 9 aa, Plasmodium falciparum
STCENGKKE

SEQ ID NO: 3249277 - protein, 14 aa, Plasmodium falciparum
STCTGSDDSTCLDN

SEQ ID NO: 3249278 - protein, 9 aa, Plasmodium falciparum
STDAVESTY

SEQ ID NO: 3249279 - protein, 8 aa, Plasmodium falciparum
STDDQDRN

SEQ ID NO: 3249280 - protein, 10 aa, Plasmodium falciparum
STDDRTKQVG

SEQ ID NO: 3249281 - protein, 4 aa, Plasmodium falciparum
STDE

SEQ ID NO: 3249282 - protein, 12 aa, Plasmodium falciparum
STDEHKDRGTYA

SEQ ID NO: 3249283 - protein, 4 aa, Plasmodium falciparum
STDI

SEQ ID NO: 3249284 - protein, 19 aa, Plasmodium falciparum
STDNSYNSDNSSNNETAYY

SEQ ID NO: 3249285 - protein, 4 aa, Plasmodium falciparum
STDP

SEQ ID NO: 3249286 - protein, 8 aa, Plasmodium falciparum
STDPGKVP

SEQ ID NO: 3249287 - protein, 7 aa, Plasmodium falciparum
STDPPTY

SEQ ID NO: 3249288 - protein, 21 aa, Plasmodium falciparum
STDQRDASSHGSSNRDDDEIS

SEQ ID NO: 3249289 - protein, 14 aa, Plasmodium falciparum
STDQTKSKACSNIT

SEQ ID NO: 3249290 - protein, 28 aa, Plasmodium falciparum
STDQVPSREEIKSPDSLSTLDARGSTHN

SEQ ID NO: 3249291 - protein, 7 aa, Plasmodium falciparum
STDRKNA

SEQ ID NO: 3249292 - protein, 6 aa, Plasmodium falciparum
STDRNK

SEQ ID NO: 3249293 - protein, 28 aa, Plasmodium falciparum
STDSSDSNNSNNSNNSSNSSYDNNNNME

SEQ ID NO: 3249294 - protein, 29 aa, Plasmodium falciparum
STDTDDSETDAEKTSNNSNTLHKKETPAM

SEQ ID NO: 3249295 - protein, 15 aa, Plasmodium falciparum
STDYDDEEKDPQEEL

SEQ ID NO: 3249296 - protein, 5 aa, Plasmodium falciparum
STEDH

SEQ ID NO: 3249297 - protein, 14 aa, Plasmodium falciparum
STEENKKNNNKNNH

SEQ ID NO: 3249298 - protein, 7 aa, Plasmodium falciparum
STEENNK

SEQ ID NO: 3249299 - protein, 5 aa, Plasmodium falciparum
STEKN

SEQ ID NO: 3249300 - protein, 5 aa, Plasmodium falciparum
STEKY

SEQ ID NO: 3249301 - protein, 8 aa, Plasmodium falciparum
STEMNNPN

SEQ ID NO: 3249302 - protein, 8 aa, Plasmodium falciparum
STEPEQVR

SEQ ID NO: 3249303 - protein, 5 aa, Plasmodium falciparum
STEQL

SEQ ID NO: 3249304 - protein, 8 aa, Plasmodium falciparum
STEQVKGY

SEQ ID NO: 3249305 - protein, 15 aa, Plasmodium falciparum
STESLNREKTNTEKT

SEQ ID NO: 3249306 - protein, 5 aa, Plasmodium falciparum
STETN

SEQ ID NO: 3249307 - protein, 7 aa, Plasmodium falciparum
STEYEKN

SEQ ID NO: 3249308 - protein, 14 aa, Plasmodium falciparum
STEYGDYDNEYKDN

SEQ ID NO: 3249309 - protein, 7 aa, Plasmodium falciparum
STEYSDN

SEQ ID NO: 3249310 - protein, 6 aa, Plasmodium falciparum
STFKNG

SEQ ID NO: 3249311 - protein, 5 aa, Plasmodium falciparum
STFPI

SEQ ID NO: 3249312 - protein, 5 aa, Plasmodium falciparum
STFPS

SEQ ID NO: 3249313 - protein, 6 aa, Plasmodium falciparum
STFSNK

SEQ ID NO: 3249314 - protein, 13 aa, Plasmodium falciparum
STFTTKTNEQSID

SEQ ID NO: 3249315 - protein, 5 aa, Plasmodium falciparum
STGGY

SEQ ID NO: 3249316 - protein, 9 aa, Plasmodium falciparum
STGQGGTVT

SEQ ID NO: 3249317 - protein, 12 aa, Plasmodium falciparum
STGSDKYGEQEN

SEQ ID NO: 3249318 - protein, 5 aa, Plasmodium falciparum
STHEK

SEQ ID NO: 3249319 - protein, 20 aa, Plasmodium falciparum
STHEKKDKMATKKNNKEESI

SEQ ID NO: 3249320 - protein, 79 aa, Plasmodium falciparum
STHENKKNDNINGDKINGDKISGDKINGDKISGDKINGDKINGDKINGDKINGDKINGDKINGDNINGDQINGDKINSN

SEQ ID NO: 3249321 - protein, 8 aa, Plasmodium falciparum
STHENTYP

SEQ ID NO: 3249322 - protein, 4 aa, Plasmodium falciparum
STHN

SEQ ID NO: 3249323 - protein, 11 aa, Plasmodium falciparum
STHNNSSVNNN

SEQ ID NO: 3249324 - protein, 8 aa, Plasmodium falciparum
STHSETRP

SEQ ID NO: 3249325 - protein, 5 aa, Plasmodium falciparum
STHSN

SEQ ID NO: 3249326 - protein, 9 aa, Plasmodium falciparum
STHTTHDKK

SEQ ID NO: 3249327 - protein, 18 aa, Plasmodium falciparum
STIEEKTYKKKKKYKSNI

SEQ ID NO: 3249328 - protein, 5 aa, Plasmodium falciparum
STIEN

SEQ ID NO: 3249329 - protein, 7 aa, Plasmodium falciparum
STIEQNE

SEQ ID NO: 3249330 - protein, 5 aa, Plasmodium falciparum
STIGD

SEQ ID NO: 3249331 - protein, 11 aa, Plasmodium falciparum
STIKNKNVGNN

SEQ ID NO: 3249332 - protein, 6 aa, Plasmodium falciparum
STINKN

SEQ ID NO: 3249333 - protein, 5 aa, Plasmodium falciparum
STINP

SEQ ID NO: 3249334 - protein, 6 aa, Plasmodium falciparum
STIQTE

SEQ ID NO: 3249335 - protein, 6 aa, Plasmodium falciparum
STISDT

SEQ ID NO: 3249336 - protein, 6 aa, Plasmodium falciparum
STISQD

SEQ ID NO: 3249337 - protein, 4 aa, Plasmodium falciparum
STKE

SEQ ID NO: 3249338 - protein, 6 aa, Plasmodium falciparum
STKEER

SEQ ID NO: 3249339 - protein, 8 aa, Plasmodium falciparum
STKGTNDK

SEQ ID NO: 3249340 - protein, 7 aa, Plasmodium falciparum
STKIDDN

SEQ ID NO: 3249341 - protein, 18 aa, Plasmodium falciparum
STKIEKSDKKKNKKHNNK

SEQ ID NO: 3249342 - protein, 5 aa, Plasmodium falciparum
STKIK

SEQ ID NO: 3249343 - protein, 10 aa, Plasmodium falciparum
STKKAKEELI

SEQ ID NO: 3249344 - protein, 8 aa, Plasmodium falciparum
STKKGSLH

SEQ ID NO: 3249345 - protein, 6 aa, Plasmodium falciparum
STKKND

SEQ ID NO: 3249346 - protein, 5 aa, Plasmodium falciparum
STKNK

SEQ ID NO: 3249347 - protein, 9 aa, Plasmodium falciparum
STKNPSNIY

SEQ ID NO: 3249348 - protein, 7 aa, Plasmodium falciparum
STKSKHV

SEQ ID NO: 3249349 - protein, 18 aa, Plasmodium falciparum
STKVQNKEDMENKEEKQL

SEQ ID NO: 3249350 - protein, 15 aa, Plasmodium falciparum
STKYNGDNGDDDAAI

SEQ ID NO: 3249351 - protein, 5 aa, Plasmodium falciparum
STLEK

SEQ ID NO: 3249352 - protein, 23 aa, Plasmodium falciparum
STLKTNNTSIYDTKSRSKNEDTK

SEQ ID NO: 3249353 - protein, 29 aa, Plasmodium falciparum
STLNENDKNLKNANHSNYTTAQATTNGYE

SEQ ID NO: 3249354 - protein, 6 aa, Plasmodium falciparum
STNAKK

SEQ ID NO: 3249355 - protein, 5 aa, Plasmodium falciparum
STNDN

SEQ ID NO: 3249356 - protein, 8 aa, Plasmodium falciparum
STNDSGTS

SEQ ID NO: 3249357 - protein, 4 aa, Plasmodium falciparum
STNE

SEQ ID NO: 3249358 - protein, 8 aa, Plasmodium falciparum
STNEKDKT

SEQ ID NO: 3249359 - protein, 5 aa, Plasmodium falciparum
STNEM

SEQ ID NO: 3249360 - protein, 7 aa, Plasmodium falciparum
STNGQNV

SEQ ID NO: 3249361 - protein, 9 aa, Plasmodium falciparum
STNGSSRDL

SEQ ID NO: 3249362 - protein, 4 aa, Plasmodium falciparum
STNI

SEQ ID NO: 3249363 - protein, 27 aa, Plasmodium falciparum
STNITNSTNSTNIKNNSNNNSSNNNNI

SEQ ID NO: 3249364 - protein, 4 aa, Plasmodium falciparum
STNK

SEQ ID NO: 3249365 - protein, 6 aa, Plasmodium falciparum
STNKES

SEQ ID NO: 3249366 - protein, 74 aa, Plasmodium falciparum
STNKNEHEGEHKGEHKNEHKGEHKGEHKGEHKGEHKGEHKGEQKNEQKNEHKGEQKNEQKNEHKGEQKNERGSK

SEQ ID NO: 3249367 - protein, 4 aa, Plasmodium falciparum
STNL

SEQ ID NO: 3249368 - protein, 22 aa, Plasmodium falciparum
STNMKKPKKKYKYKHKSSYNKN

SEQ ID NO: 3249369 - protein, 14 aa, Plasmodium falciparum
STNNHIKNQDNNKK

SEQ ID NO: 3249370 - protein, 14 aa, Plasmodium falciparum
STNNKKRNSLGKDK

SEQ ID NO: 3249371 - protein, 6 aa, Plasmodium falciparum
STNNNL

SEQ ID NO: 3249372 - protein, 6 aa, Plasmodium falciparum
STNNNV

SEQ ID NO: 3249373 - protein, 12 aa, Plasmodium falciparum
STNNTKTKNKSC

SEQ ID NO: 3249374 - protein, 10 aa, Plasmodium falciparum
STNPDSQNKI

SEQ ID NO: 3249375 - protein, 9 aa, Plasmodium falciparum
STNPSSVTT

SEQ ID NO: 3249376 - protein, 11 aa, Plasmodium falciparum
STNQAKPTSSL

SEQ ID NO: 3249377 - protein, 12 aa, Plasmodium falciparum
STNQKNEPQGIN

SEQ ID NO: 3249378 - protein, 4 aa, Plasmodium falciparum
STNS

SEQ ID NO: 3249379 - protein, 14 aa, Plasmodium falciparum
STNSIESQQRQSEI

SEQ ID NO: 3249380 - protein, 9 aa, Plasmodium falciparum
STNSMDDRQ

SEQ ID NO: 3249381 - protein, 5 aa, Plasmodium falciparum
STNSN

SEQ ID NO: 3249382 - protein, 10 aa, Plasmodium falciparum
STNSNKSNTI

SEQ ID NO: 3249383 - protein, 6 aa, Plasmodium falciparum
STNSNN

SEQ ID NO: 3249384 - protein, 31 aa, Plasmodium falciparum
STNSSNSDDDDDDGDNNNNKNDNMDDDSYYE

SEQ ID NO: 3249385 - protein, 5 aa, Plasmodium falciparum
STNST

SEQ ID NO: 3249386 - protein, 11 aa, Plasmodium falciparum
STNTKDNPTYL

SEQ ID NO: 3249387 - protein, 6 aa, Plasmodium falciparum
STNTYK

SEQ ID NO: 3249388 - protein, 4 aa, Plasmodium falciparum
STNV

SEQ ID NO: 3249389 - protein, 14 aa, Plasmodium falciparum
STNVSNNTQGNMGG

SEQ ID NO: 3249390 - protein, 4 aa, Plasmodium falciparum
STPE

SEQ ID NO: 3249391 - protein, 13 aa, Plasmodium falciparum
STPENQEQNQNYE

SEQ ID NO: 3249392 - protein, 4 aa, Plasmodium falciparum
STPF

SEQ ID NO: 3249393 - protein, 6 aa, Plasmodium falciparum
STPFES

SEQ ID NO: 3249394 - protein, 4 aa, Plasmodium falciparum
STPL

SEQ ID NO: 3249395 - protein, 5 aa, Plasmodium falciparum
STPLY

SEQ ID NO: 3249396 - protein, 5 aa, Plasmodium falciparum
STPMY

SEQ ID NO: 3249397 - protein, 7 aa, Plasmodium falciparum
STPPPNL

SEQ ID NO: 3249398 - protein, 6 aa, Plasmodium falciparum
STPQKP

SEQ ID NO: 3249399 - protein, 5 aa, Plasmodium falciparum
STPSN

SEQ ID NO: 3249400 - protein, 5 aa, Plasmodium falciparum
STQDT

SEQ ID NO: 3249401 - protein, 16 aa, Plasmodium falciparum
STQFSSDQDDEENLNE

SEQ ID NO: 3249402 - protein, 6 aa, Plasmodium falciparum
STQGNI

SEQ ID NO: 3249403 - protein, 5 aa, Plasmodium falciparum
STQHV

SEQ ID NO: 3249404 - protein, 38 aa, Plasmodium falciparum
STQINNEQINEKSISNIEDNNNSINRKDNEKEETNQSI

SEQ ID NO: 3249405 - protein, 8 aa, Plasmodium falciparum
STQNTEPN

SEQ ID NO: 3249406 - protein, 6 aa, Plasmodium falciparum
STQPLT

SEQ ID NO: 3249407 - protein, 9 aa, Plasmodium falciparum
STQPNQKDQ

SEQ ID NO: 3249408 - protein, 5 aa, Plasmodium falciparum
STQQV

SEQ ID NO: 3249409 - protein, 4 aa, Plasmodium falciparum
STQV

SEQ ID NO: 3249410 - protein, 38 aa, Plasmodium falciparum
STQVEKKMENNTNTCNNNNDKEKIYKDSSSSNISISSN

SEQ ID NO: 3249411 - protein, 4 aa, Plasmodium falciparum
STRE

SEQ ID NO: 3249412 - protein, 7 aa, Plasmodium falciparum
STRGKEY

SEQ ID NO: 3249413 - protein, 5 aa, Plasmodium falciparum
STRHN

SEQ ID NO: 3249414 - protein, 5 aa, Plasmodium falciparum
STRKY

SEQ ID NO: 3249415 - protein, 4 aa, Plasmodium falciparum
STRN

SEQ ID NO: 3249416 - protein, 5 aa, Plasmodium falciparum
STRNK

SEQ ID NO: 3249417 - protein, 8 aa, Plasmodium falciparum
STRPNTEY

SEQ ID NO: 3249418 - protein, 9 aa, Plasmodium falciparum
STRQPQVGD

SEQ ID NO: 3249419 - protein, 5 aa, Plasmodium falciparum
STRSY

SEQ ID NO: 3249420 - protein, 15 aa, Plasmodium falciparum
STRTLNGNNCKDEQN

SEQ ID NO: 3249421 - protein, 5 aa, Plasmodium falciparum
STRTR

SEQ ID NO: 3249422 - protein, 22 aa, Plasmodium falciparum
STRTYREGKNLSKDINESDEEY

SEQ ID NO: 3249423 - protein, 7 aa, Plasmodium falciparum
STRVTHK

SEQ ID NO: 3249424 - protein, 6 aa, Plasmodium falciparum
STSAAT

SEQ ID NO: 3249425 - protein, 9 aa, Plasmodium falciparum
STSAIDKDN

SEQ ID NO: 3249426 - protein, 5 aa, Plasmodium falciparum
STSAN

SEQ ID NO: 3249427 - protein, 9 aa, Plasmodium falciparum
STSANAKNV

SEQ ID NO: 3249428 - protein, 7 aa, Plasmodium falciparum
STSASDK

SEQ ID NO: 3249429 - protein, 7 aa, Plasmodium falciparum
STSDKSS

SEQ ID NO: 3249430 - protein, 9 aa, Plasmodium falciparum
STSECSTDE

SEQ ID NO: 3249431 - protein, 8 aa, Plasmodium falciparum
STSEDSEH

SEQ ID NO: 3249432 - protein, 10 aa, Plasmodium falciparum
STSGSNGRAL

SEQ ID NO: 3249433 - protein, 6 aa, Plasmodium falciparum
STSHET

SEQ ID NO: 3249434 - protein, 10 aa, Plasmodium falciparum
STSHPNDDQH

SEQ ID NO: 3249435 - protein, 9 aa, Plasmodium falciparum
STSIGSKAI

SEQ ID NO: 3249436 - protein, 35 aa, Plasmodium falciparum
STSITTKKLENQKKKTNKNESYSNVNDKYEHNNNT

SEQ ID NO: 3249437 - protein, 11 aa, Plasmodium falciparum
STSKTAKSAIN

SEQ ID NO: 3249438 - protein, 5 aa, Plasmodium falciparum
STSNE

SEQ ID NO: 3249439 - protein, 54 aa, Plasmodium falciparum
STSNNENINNNSTTTTTNNNNNNNNKNKNNINDKDYDDDDDDNDDNVDKDKDVN

SEQ ID NO: 3249440 - protein, 48 aa, Plasmodium falciparum
STSNNNNNNNNMNGKCSDNENEYKNKNKNKNENENKNENKNKNENKND

SEQ ID NO: 3249441 - protein, 5 aa, Plasmodium falciparum
STSPY

SEQ ID NO: 3249442 - protein, 17 aa, Plasmodium falciparum
STSQNKKSNNKSKNVEA

SEQ ID NO: 3249443 - protein, 19 aa, Plasmodium falciparum
STSSCSSNTSCSNSSDDDV

SEQ ID NO: 3249444 - protein, 14 aa, Plasmodium falciparum
STSSKGDESNNMNY

SEQ ID NO: 3249445 - protein, 12 aa, Plasmodium falciparum
STSSTPVTGGPE

SEQ ID NO: 3249446 - protein, 9 aa, Plasmodium falciparum
STTDNKNTK

SEQ ID NO: 3249447 - protein, 5 aa, Plasmodium falciparum
STTEL

SEQ ID NO: 3249448 - protein, 4 aa, Plasmodium falciparum
STTH

SEQ ID NO: 3249449 - protein, 6 aa, Plasmodium falciparum
STTHDI

SEQ ID NO: 3249450 - protein, 10 aa, Plasmodium falciparum
STTKSELTKT

SEQ ID NO: 3249451 - protein, 5 aa, Plasmodium falciparum
STTLD

SEQ ID NO: 3249452 - protein, 5 aa, Plasmodium falciparum
STTNN

SEQ ID NO: 3249453 - protein, 22 aa, Plasmodium falciparum
STTNNSYSNIGDTSENTYQPNN

SEQ ID NO: 3249454 - protein, 25 aa, Plasmodium falciparum
STTQRSEQRMEDRDEEDGKSGEDTR

SEQ ID NO: 3249455 - protein, 16 aa, Plasmodium falciparum
STTTNNNNNNSTAINP

SEQ ID NO: 3249456 - protein, 6 aa, Plasmodium falciparum
STTYKN

SEQ ID NO: 3249457 - protein, 10 aa, Plasmodium falciparum
STVPGSSQNK

SEQ ID NO: 3249458 - protein, 7 aa, Plasmodium falciparum
STVPSNI

SEQ ID NO: 3249459 - protein, 4 aa, Plasmodium falciparum
STVQ

SEQ ID NO: 3249460 - protein, 6 aa, Plasmodium falciparum
STVRKK

SEQ ID NO: 3249461 - protein, 18 aa, Plasmodium falciparum
STVSSSDNYYEDEENEKR

SEQ ID NO: 3249462 - protein, 11 aa, Plasmodium falciparum
STYDIKQKKKE

SEQ ID NO: 3249463 - protein, 11 aa, Plasmodium falciparum
STYDKKTKNID

SEQ ID NO: 3249464 - protein, 11 aa, Plasmodium falciparum
STYDNKREERK

SEQ ID NO: 3249465 - protein, 4 aa, Plasmodium falciparum
STYE

SEQ ID NO: 3249466 - protein, 6 aa, Plasmodium falciparum
STYKEN

SEQ ID NO: 3249467 - protein, 12 aa, Plasmodium falciparum
STYKENKNNDIN

SEQ ID NO: 3249468 - protein, 10 aa, Plasmodium falciparum
STYKNGSALV

SEQ ID NO: 3249469 - protein, 4 aa, Plasmodium falciparum
STYN

SEQ ID NO: 3249470 - protein, 8 aa, Plasmodium falciparum
STYNDKDK

SEQ ID NO: 3249471 - protein, 6 aa, Plasmodium falciparum
STYNDS

SEQ ID NO: 3249472 - protein, 9 aa, Plasmodium falciparum
STYSDSSKI

SEQ ID NO: 3249473 - protein, 5 aa, Plasmodium falciparum
STYYD

SEQ ID NO: 3249474 - protein, 6 aa, Plasmodium falciparum
STYYKT

SEQ ID NO: 3249475 - protein, 4 aa, Plasmodium falciparum
SVAE

SEQ ID NO: 3249476 - protein, 55 aa, Plasmodium falciparum
SVASDSSSTICDSDNNDNNDNGNNNDNNGDNNDNNGDNNDNNGDNNDNNDDNNNN

SEQ ID NO: 3249477 - protein, 29 aa, Plasmodium falciparum
SVASGNKEIEKSKDEKQPEKEAKQTNGTL

SEQ ID NO: 3249478 - protein, 7 aa, Plasmodium falciparum
SVCPGTN

SEQ ID NO: 3249479 - protein, 7 aa, Plasmodium falciparum
SVDDGST

SEQ ID NO: 3249480 - protein, 16 aa, Plasmodium falciparum
SVDEKPQNKLNGGDIP

SEQ ID NO: 3249481 - protein, 20 aa, Plasmodium falciparum
SVDGRKSLYPKKCSRKSRSL

SEQ ID NO: 3249482 - protein, 12 aa, Plasmodium falciparum
SVDQENGKESNT

SEQ ID NO: 3249483 - protein, 5 aa, Plasmodium falciparum
SVDTE

SEQ ID NO: 3249484 - protein, 7 aa, Plasmodium falciparum
SVEDKVG

SEQ ID NO: 3249485 - protein, 9 aa, Plasmodium falciparum
SVEDSTSRC

SEQ ID NO: 3249486 - protein, 11 aa, Plasmodium falciparum
SVEEKRKKKKI

SEQ ID NO: 3249487 - protein, 6 aa, Plasmodium falciparum
SVEEQN

SEQ ID NO: 3249488 - protein, 5 aa, Plasmodium falciparum
SVEER

SEQ ID NO: 3249489 - protein, 6 aa, Plasmodium falciparum
SVEGSL

SEQ ID NO: 3249490 - protein, 11 aa, Plasmodium falciparum
SVEKGNSNDIM

SEQ ID NO: 3249491 - protein, 4 aa, Plasmodium falciparum
SVEN

SEQ ID NO: 3249492 - protein, 9 aa, Plasmodium falciparum
SVENKKDFQ

SEQ ID NO: 3249493 - protein, 11 aa, Plasmodium falciparum
SVEQIKDNNPM

SEQ ID NO: 3249494 - protein, 10 aa, Plasmodium falciparum
SVEQTPENQL

SEQ ID NO: 3249495 - protein, 5 aa, Plasmodium falciparum
SVESQ

SEQ ID NO: 3249496 - protein, 7 aa, Plasmodium falciparum
SVGGPYY

SEQ ID NO: 3249497 - protein, 10 aa, Plasmodium falciparum
SVGNRKPSKY

SEQ ID NO: 3249498 - protein, 10 aa, Plasmodium falciparum
SVGSSNNSRE

SEQ ID NO: 3249499 - protein, 6 aa, Plasmodium falciparum
SVIEES

SEQ ID NO: 3249500 - protein, 12 aa, Plasmodium falciparum
SVITSSEKGVTK

SEQ ID NO: 3249501 - protein, 6 aa, Plasmodium falciparum
SVKDGK

SEQ ID NO: 3249502 - protein, 14 aa, Plasmodium falciparum
SVKDQKQESPNSNF

SEQ ID NO: 3249503 - protein, 11 aa, Plasmodium falciparum
SVKEEDQETEY

SEQ ID NO: 3249504 - protein, 11 aa, Plasmodium falciparum
SVKEKKNTRRR

SEQ ID NO: 3249505 - protein, 10 aa, Plasmodium falciparum
SVKKRRKKKK

SEQ ID NO: 3249506 - protein, 23 aa, Plasmodium falciparum
SVKNCQNNDEMSTQANSNAENKT

SEQ ID NO: 3249507 - protein, 13 aa, Plasmodium falciparum
SVKTPSTSGNDAK

SEQ ID NO: 3249508 - protein, 24 aa, Plasmodium falciparum
SVLKSASDSNIDEQTNKNNDNYKK

SEQ ID NO: 3249509 - protein, 4 aa, Plasmodium falciparum
SVLN

SEQ ID NO: 3249510 - protein, 12 aa, Plasmodium falciparum
SVLNNNDDHKLG

SEQ ID NO: 3249511 - protein, 5 aa, Plasmodium falciparum
SVLSE

SEQ ID NO: 3249512 - protein, 9 aa, Plasmodium falciparum
SVNEKKENI

SEQ ID NO: 3249513 - protein, 5 aa, Plasmodium falciparum
SVNEN

SEQ ID NO: 3249514 - protein, 24 aa, Plasmodium falciparum
SVNENDKIDEYKENSFEDSSTYND

SEQ ID NO: 3249515 - protein, 8 aa, Plasmodium falciparum
SVNGVNSV

SEQ ID NO: 3249516 - protein, 4 aa, Plasmodium falciparum
SVNN

SEQ ID NO: 3249517 - protein, 13 aa, Plasmodium falciparum
SVNNDSINEETNK

SEQ ID NO: 3249518 - protein, 10 aa, Plasmodium falciparum
SVNNKNETSY

SEQ ID NO: 3249519 - protein, 9 aa, Plasmodium falciparum
SVNNNESSI

SEQ ID NO: 3249520 - protein, 12 aa, Plasmodium falciparum
SVNTNKKSYEDA

SEQ ID NO: 3249521 - protein, 8 aa, Plasmodium falciparum
SVNVTSNE

SEQ ID NO: 3249522 - protein, 47 aa, Plasmodium falciparum
SVPAETEKEKKKDSPLKPHTEPKPAPPKKPEVPPPPPVQPPPANQPF

SEQ ID NO: 3249523 - protein, 13 aa, Plasmodium falciparum
SVPKEEGLRKDTT

SEQ ID NO: 3249524 - protein, 6 aa, Plasmodium falciparum
SVPNDN

SEQ ID NO: 3249525 - protein, 6 aa, Plasmodium falciparum
SVPSKG

SEQ ID NO: 3249526 - protein, 36 aa, Plasmodium falciparum
SVPTNTSKNTNTKEKSKQTNNNNNNNNNNNVNNTNN

SEQ ID NO: 3249527 - protein, 12 aa, Plasmodium falciparum
SVPTSQNNDRHI

SEQ ID NO: 3249528 - protein, 8 aa, Plasmodium falciparum
SVQGENNV

SEQ ID NO: 3249529 - protein, 11 aa, Plasmodium falciparum
SVQSPPNVEDV

SEQ ID NO: 3249530 - protein, 9 aa, Plasmodium falciparum
SVRGQQGTY

SEQ ID NO: 3249531 - protein, 73 aa, Plasmodium falciparum
SVRKEEDKKKKNKKKKINNNKKKKKKKNTNNNNNNNNNNQNNNQNNNNNNNNQNNNNYNNNNYNSPNQEQCDD

SEQ ID NO: 3249532 - protein, 7 aa, Plasmodium falciparum
SVRKKSE

SEQ ID NO: 3249533 - protein, 17 aa, Plasmodium falciparum
SVRPKNAYSSNDNKEDP

SEQ ID NO: 3249534 - protein, 8 aa, Plasmodium falciparum
SVSASGGV

SEQ ID NO: 3249535 - protein, 6 aa, Plasmodium falciparum
SVSEEN

SEQ ID NO: 3249536 - protein, 49 aa, Plasmodium falciparum
SVSKENIHNTNNFNENAEDIKNNNYINNNNNNYNNNNNNNYNNYNNDGQ

SEQ ID NO: 3249537 - protein, 4 aa, Plasmodium falciparum
SVSN

SEQ ID NO: 3249538 - protein, 18 aa, Plasmodium falciparum
SVSPENSRPETDAKDTSN

SEQ ID NO: 3249539 - protein, 9 aa, Plasmodium falciparum
SVSPSQEQY

SEQ ID NO: 3249540 - protein, 16 aa, Plasmodium falciparum
SVSSDYETWSPTSGNF

SEQ ID NO: 3249541 - protein, 22 aa, Plasmodium falciparum
SVSYSDEGEPLKYGANDNNYDS

SEQ ID NO: 3249542 - protein, 6 aa, Plasmodium falciparum
SVTCSD

SEQ ID NO: 3249543 - protein, 14 aa, Plasmodium falciparum
SVTDSENDKSSIGT

SEQ ID NO: 3249544 - protein, 11 aa, Plasmodium falciparum
SVTENDKASHS

SEQ ID NO: 3249545 - protein, 14 aa, Plasmodium falciparum
SVTERAAKKATEDV

SEQ ID NO: 3249546 - protein, 11 aa, Plasmodium falciparum
SVTKEDKASHS

SEQ ID NO: 3249547 - protein, 6 aa, Plasmodium falciparum
SVTKQN

SEQ ID NO: 3249548 - protein, 9 aa, Plasmodium falciparum
SVTSGSGKG

SEQ ID NO: 3249549 - protein, 11 aa, Plasmodium falciparum
SVVDGDNKLEG

SEQ ID NO: 3249550 - protein, 4 aa, Plasmodium falciparum
SVYD

SEQ ID NO: 3249551 - protein, 5 aa, Plasmodium falciparum
SWGGK

SEQ ID NO: 3249552 - protein, 13 aa, Plasmodium falciparum
SWKKPDETKCRPA

SEQ ID NO: 3249553 - protein, 31 aa, Plasmodium falciparum
SWKNKNKSKDKVNDGSDSEELDSSKEDKDKD

SEQ ID NO: 3249554 - protein, 4 aa, Plasmodium falciparum
SWNN

SEQ ID NO: 3249555 - protein, 4 aa, Plasmodium falciparum
SWPE

SEQ ID NO: 3249556 - protein, 6 aa, Plasmodium falciparum
SYAEEN

SEQ ID NO: 3249557 - protein, 17 aa, Plasmodium falciparum
SYAEGKNTTKDTSKYPP

SEQ ID NO: 3249558 - protein, 21 aa, Plasmodium falciparum
SYANGASKDPCNGKGNGKDQR

SEQ ID NO: 3249559 - protein, 9 aa, Plasmodium falciparum
SYAPKSSYF

SEQ ID NO: 3249560 - protein, 5 aa, Plasmodium falciparum
SYASS

SEQ ID NO: 3249561 - protein, 12 aa, Plasmodium falciparum
SYCEEEKSTDNY

SEQ ID NO: 3249562 - protein, 9 aa, Plasmodium falciparum
SYCSSREGI

SEQ ID NO: 3249563 - protein, 14 aa, Plasmodium falciparum
SYDDENEPKENNDN

SEQ ID NO: 3249564 - protein, 11 aa, Plasmodium falciparum
SYDDNRKGADI

SEQ ID NO: 3249565 - protein, 15 aa, Plasmodium falciparum
SYDDPHDDKHNERRR

SEQ ID NO: 3249566 - protein, 8 aa, Plasmodium falciparum
SYDDYTKR

SEQ ID NO: 3249567 - protein, 6 aa, Plasmodium falciparum
SYDEIN

SEQ ID NO: 3249568 - protein, 6 aa, Plasmodium falciparum
SYDEYN

SEQ ID NO: 3249569 - protein, 4 aa, Plasmodium falciparum
SYDG

SEQ ID NO: 3249570 - protein, 7 aa, Plasmodium falciparum
SYDKISR

SEQ ID NO: 3249571 - protein, 18 aa, Plasmodium falciparum
SYDKNQEKNKYNTNQQSV

SEQ ID NO: 3249572 - protein, 4 aa, Plasmodium falciparum
SYDN

SEQ ID NO: 3249573 - protein, 5 aa, Plasmodium falciparum
SYDTY

SEQ ID NO: 3249574 - protein, 10 aa, Plasmodium falciparum
SYEANSNNSS

SEQ ID NO: 3249575 - protein, 5 aa, Plasmodium falciparum
SYEEG

SEQ ID NO: 3249576 - protein, 5 aa, Plasmodium falciparum
SYEEY

SEQ ID NO: 3249577 - protein, 17 aa, Plasmodium falciparum
SYEEYEDEDKDVEDEYE

SEQ ID NO: 3249578 - protein, 19 aa, Plasmodium falciparum
SYEGSLKNEKKKKTNAENY

SEQ ID NO: 3249579 - protein, 10 aa, Plasmodium falciparum
SYEKKEKIKD

SEQ ID NO: 3249580 - protein, 8 aa, Plasmodium falciparum
SYEKNKKK

SEQ ID NO: 3249581 - protein, 12 aa, Plasmodium falciparum
SYEKTKNNENNK

SEQ ID NO: 3249582 - protein, 4 aa, Plasmodium falciparum
SYEN

SEQ ID NO: 3249583 - protein, 9 aa, Plasmodium falciparum
SYENENDRN

SEQ ID NO: 3249584 - protein, 10 aa, Plasmodium falciparum
SYENGKKGQV

SEQ ID NO: 3249585 - protein, 8 aa, Plasmodium falciparum
SYENGNDS

SEQ ID NO: 3249586 - protein, 7 aa, Plasmodium falciparum
SYENNKN

SEQ ID NO: 3249587 - protein, 18 aa, Plasmodium falciparum
SYENNNKLDSEKKKKKKE

SEQ ID NO: 3249588 - protein, 10 aa, Plasmodium falciparum
SYENSDSSDN

SEQ ID NO: 3249589 - protein, 7 aa, Plasmodium falciparum
SYEPTKS

SEQ ID NO: 3249590 - protein, 4 aa, Plasmodium falciparum
SYGE

SEQ ID NO: 3249591 - protein, 6 aa, Plasmodium falciparum
SYGEDD

SEQ ID NO: 3249592 - protein, 22 aa, Plasmodium falciparum
SYGGEEKVNRDKKKKKNNNNIN

SEQ ID NO: 3249593 - protein, 6 aa, Plasmodium falciparum
SYGKEN

SEQ ID NO: 3249594 - protein, 8 aa, Plasmodium falciparum
SYGNYGNY

SEQ ID NO: 3249595 - protein, 6 aa, Plasmodium falciparum
SYGTNQ

SEQ ID NO: 3249596 - protein, 9 aa, Plasmodium falciparum
SYGTPDNID

SEQ ID NO: 3249597 - protein, 4 aa, Plasmodium falciparum
SYHN

SEQ ID NO: 3249598 - protein, 7 aa, Plasmodium falciparum
SYHPGND

SEQ ID NO: 3249599 - protein, 14 aa, Plasmodium falciparum
SYINEKKGNTQGSL

SEQ ID NO: 3249600 - protein, 19 aa, Plasmodium falciparum
SYISNSNNNDNKRNSSNLS

SEQ ID NO: 3249601 - protein, 8 aa, Plasmodium falciparum
SYKDKYKT

SEQ ID NO: 3249602 - protein, 8 aa, Plasmodium falciparum
SYKEESDV

SEQ ID NO: 3249603 - protein, 8 aa, Plasmodium falciparum
SYKEKNKE

SEQ ID NO: 3249604 - protein, 11 aa, Plasmodium falciparum
SYKEKNNNINS

SEQ ID NO: 3249605 - protein, 12 aa, Plasmodium falciparum
SYKEYKDESNRN

SEQ ID NO: 3249606 - protein, 14 aa, Plasmodium falciparum
SYKKEIKSNTYESF

SEQ ID NO: 3249607 - protein, 10 aa, Plasmodium falciparum
SYKKKTPVPE

SEQ ID NO: 3249608 - protein, 7 aa, Plasmodium falciparum
SYKKYET

SEQ ID NO: 3249609 - protein, 4 aa, Plasmodium falciparum
SYKL

SEQ ID NO: 3249610 - protein, 8 aa, Plasmodium falciparum
SYKNKKKD

SEQ ID NO: 3249611 - protein, 7 aa, Plasmodium falciparum
SYKNSSI

SEQ ID NO: 3249612 - protein, 16 aa, Plasmodium falciparum
SYKQKKRQHKYRKQKI

SEQ ID NO: 3249613 - protein, 5 aa, Plasmodium falciparum
SYKTL

SEQ ID NO: 3249614 - protein, 7 aa, Plasmodium falciparum
SYKTNES

SEQ ID NO: 3249615 - protein, 13 aa, Plasmodium falciparum
SYKTNKELKKEKY

SEQ ID NO: 3249616 - protein, 4 aa, Plasmodium falciparum
SYLD

SEQ ID NO: 3249617 - protein, 11 aa, Plasmodium falciparum
SYLNDEKNTFD

SEQ ID NO: 3249618 - protein, 13 aa, Plasmodium falciparum
SYLSKNKKNIKND

SEQ ID NO: 3249619 - protein, 13 aa, Plasmodium falciparum
SYNDDYNKNNTNN

SEQ ID NO: 3249620 - protein, 5 aa, Plasmodium falciparum
SYNDK

SEQ ID NO: 3249621 - protein, 11 aa, Plasmodium falciparum
SYNEGRKRKNK

SEQ ID NO: 3249622 - protein, 5 aa, Plasmodium falciparum
SYNEN

SEQ ID NO: 3249623 - protein, 6 aa, Plasmodium falciparum
SYNGTT

SEQ ID NO: 3249624 - protein, 5 aa, Plasmodium falciparum
SYNHN

SEQ ID NO: 3249625 - protein, 8 aa, Plasmodium falciparum
SYNKDNEI

SEQ ID NO: 3249626 - protein, 19 aa, Plasmodium falciparum
SYNKKVSKGSISSNINNNI

SEQ ID NO: 3249627 - protein, 5 aa, Plasmodium falciparum
SYNKP

SEQ ID NO: 3249628 - protein, 5 aa, Plasmodium falciparum
SYNNG

SEQ ID NO: 3249629 - protein, 12 aa, Plasmodium falciparum
SYNNNDEDDKYG

SEQ ID NO: 3249630 - protein, 9 aa, Plasmodium falciparum
SYNNNEDNF

SEQ ID NO: 3249631 - protein, 12 aa, Plasmodium falciparum
SYNNNEEEEDIN

SEQ ID NO: 3249632 - protein, 6 aa, Plasmodium falciparum
SYNNNN

SEQ ID NO: 3249633 - protein, 12 aa, Plasmodium falciparum
SYNNNNDNDIKK

SEQ ID NO: 3249634 - protein, 5 aa, Plasmodium falciparum
SYNNQ

SEQ ID NO: 3249635 - protein, 7 aa, Plasmodium falciparum
SYNNSDI

SEQ ID NO: 3249636 - protein, 4 aa, Plasmodium falciparum
SYNQ

SEQ ID NO: 3249637 - protein, 19 aa, Plasmodium falciparum
SYNRNSDINNSSSNNEYND

SEQ ID NO: 3249638 - protein, 6 aa, Plasmodium falciparum
SYNSEN

SEQ ID NO: 3249639 - protein, 18 aa, Plasmodium falciparum
SYNSTNNVDEYKNKYKNN

SEQ ID NO: 3249640 - protein, 18 aa, Plasmodium falciparum
SYNSYKNNNYNKKEEKNK

SEQ ID NO: 3249641 - protein, 35 aa, Plasmodium falciparum
SYNTEAPERKENPKVPSGSFSYRSENKQDSFENEG

SEQ ID NO: 3249642 - protein, 32 aa, Plasmodium falciparum
SYNYSSSNINKNCSSSSTSSSISSSSISSSSI

SEQ ID NO: 3249643 - protein, 6 aa, Plasmodium falciparum
SYPKEG

SEQ ID NO: 3249644 - protein, 6 aa, Plasmodium falciparum
SYPKNN

SEQ ID NO: 3249645 - protein, 8 aa, Plasmodium falciparum
SYPKYEKK

SEQ ID NO: 3249646 - protein, 19 aa, Plasmodium falciparum
SYPSTDYISSQKSDSSEIT

SEQ ID NO: 3249647 - protein, 7 aa, Plasmodium falciparum
SYPSTEI

SEQ ID NO: 3249648 - protein, 31 aa, Plasmodium falciparum
SYQNGRSKKQDNNNKKKRKKLNNKNKSNVEK

SEQ ID NO: 3249649 - protein, 8 aa, Plasmodium falciparum
SYQNNQTK

SEQ ID NO: 3249650 - protein, 11 aa, Plasmodium falciparum
SYQSNDDIQKR

SEQ ID NO: 3249651 - protein, 5 aa, Plasmodium falciparum
SYRDK

SEQ ID NO: 3249652 - protein, 5 aa, Plasmodium falciparum
SYREG

SEQ ID NO: 3249653 - protein, 15 aa, Plasmodium falciparum
SYRQNNQTQKNNSEI

SEQ ID NO: 3249654 - protein, 4 aa, Plasmodium falciparum
SYRT

SEQ ID NO: 3249655 - protein, 6 aa, Plasmodium falciparum
SYRTHR

SEQ ID NO: 3249656 - protein, 39 aa, Plasmodium falciparum
SYSEREESEKKKKKKKKKKTNRINNQCEDNSEGDTHMEG

SEQ ID NO: 3249657 - protein, 8 aa, Plasmodium falciparum
SYSKLKES

SEQ ID NO: 3249658 - protein, 21 aa, Plasmodium falciparum
SYSKRNSSLKKKVTNDKNDNS

SEQ ID NO: 3249659 - protein, 4 aa, Plasmodium falciparum
SYSL

SEQ ID NO: 3249660 - protein, 23 aa, Plasmodium falciparum
SYSLSHKRKEKNEEDIDKEEEVY

SEQ ID NO: 3249661 - protein, 8 aa, Plasmodium falciparum
SYSNEKKI

SEQ ID NO: 3249662 - protein, 6 aa, Plasmodium falciparum
SYSNES

SEQ ID NO: 3249663 - protein, 13 aa, Plasmodium falciparum
SYSNKKENDKSEY

SEQ ID NO: 3249664 - protein, 15 aa, Plasmodium falciparum
SYSNQQSNKNKSNLG

SEQ ID NO: 3249665 - protein, 5 aa, Plasmodium falciparum
SYSNV

SEQ ID NO: 3249666 - protein, 13 aa, Plasmodium falciparum
SYSPSNYENDPEM

SEQ ID NO: 3249667 - protein, 4 aa, Plasmodium falciparum
SYSQ

SEQ ID NO: 3249668 - protein, 10 aa, Plasmodium falciparum
SYSRASYRNE

SEQ ID NO: 3249669 - protein, 8 aa, Plasmodium falciparum
SYSSDSEN

SEQ ID NO: 3249670 - protein, 5 aa, Plasmodium falciparum
SYSSF

SEQ ID NO: 3249671 - protein, 9 aa, Plasmodium falciparum
SYSSKGTEY

SEQ ID NO: 3249672 - protein, 15 aa, Plasmodium falciparum
SYSSKLERTTNGNKY

SEQ ID NO: 3249673 - protein, 16 aa, Plasmodium falciparum
SYSSNEDNKNETSTNY

SEQ ID NO: 3249674 - protein, 22 aa, Plasmodium falciparum
SYSSNEDNQISQCSQNSSTNTL

SEQ ID NO: 3249675 - protein, 7 aa, Plasmodium falciparum
SYSSNSY

SEQ ID NO: 3249676 - protein, 7 aa, Plasmodium falciparum
SYSSSSC

SEQ ID NO: 3249677 - protein, 4 aa, Plasmodium falciparum
SYSV

SEQ ID NO: 3249678 - protein, 4 aa, Plasmodium falciparum
SYSY

SEQ ID NO: 3249679 - protein, 12 aa, Plasmodium falciparum
SYSYNNTMSEKN

SEQ ID NO: 3249680 - protein, 8 aa, Plasmodium falciparum
SYSYNQGE

SEQ ID NO: 3249681 - protein, 7 aa, Plasmodium falciparum
SYSYNSD

SEQ ID NO: 3249682 - protein, 5 aa, Plasmodium falciparum
SYSYR

SEQ ID NO: 3249683 - protein, 4 aa, Plasmodium falciparum
SYTK

SEQ ID NO: 3249684 - protein, 11 aa, Plasmodium falciparum
SYTKDKENKLN

SEQ ID NO: 3249685 - protein, 5 aa, Plasmodium falciparum
SYTKV

SEQ ID NO: 3249686 - protein, 6 aa, Plasmodium falciparum
SYTNKK

SEQ ID NO: 3249687 - protein, 24 aa, Plasmodium falciparum
SYTNNNKSLKTSHIKKNTKRNEIK

SEQ ID NO: 3249688 - protein, 5 aa, Plasmodium falciparum
SYTRN

SEQ ID NO: 3249689 - protein, 21 aa, Plasmodium falciparum
SYTSSNSSINNKKKNENTQKE

SEQ ID NO: 3249690 - protein, 8 aa, Plasmodium falciparum
SYTTQSKE

SEQ ID NO: 3249691 - protein, 30 aa, Plasmodium falciparum
SYVNSKESFSISNTNSSMSSEGSNVSSNYD

SEQ ID NO: 3249692 - protein, 4 aa, Plasmodium falciparum
SYVP

SEQ ID NO: 3249693 - protein, 33 aa, Plasmodium falciparum
SYYGSKNSNDKKLEKSDNEGGEEKYDNSNKEQN

SEQ ID NO: 3249694 - protein, 11 aa, Plasmodium falciparum
SYYNKREKESI

SEQ ID NO: 3249695 - protein, 23 aa, Plasmodium falciparum
SYYNNTSDDYPTNNHKDHIDEKK

SEQ ID NO: 3249696 - protein, 7 aa, Plasmodium falciparum
SYYPTGE

SEQ ID NO: 3249697 - protein, 17 aa, Plasmodium falciparum
SYYSKSDQLKNEREEKA

SEQ ID NO: 3249698 - protein, 13 aa, Plasmodium falciparum
TAAATAETATEEA

SEQ ID NO: 3249699 - protein, 16 aa, Plasmodium falciparum
TAAKGAAISTAGAGSK

SEQ ID NO: 3249700 - protein, 8 aa, Plasmodium falciparum
TAAVESTY

SEQ ID NO: 3249701 - protein, 12 aa, Plasmodium falciparum
TACESQPYDEPR

SEQ ID NO: 3249702 - protein, 12 aa, Plasmodium falciparum
TACKQQPYDEPR

SEQ ID NO: 3249703 - protein, 12 aa, Plasmodium falciparum
TACQKHPKVEGE

SEQ ID NO: 3249704 - protein, 9 aa, Plasmodium falciparum
TADGNIDED

SEQ ID NO: 3249705 - protein, 4 aa, Plasmodium falciparum
TADI

SEQ ID NO: 3249706 - protein, 6 aa, Plasmodium falciparum
TADKEK

SEQ ID NO: 3249707 - protein, 4 aa, Plasmodium falciparum
TADN

SEQ ID NO: 3249708 - protein, 15 aa, Plasmodium falciparum
TADNSLNKNINKEGT

SEQ ID NO: 3249709 - protein, 15 aa, Plasmodium falciparum
TAEATAQTAAEEATN

SEQ ID NO: 3249710 - protein, 5 aa, Plasmodium falciparum
TAEDE

SEQ ID NO: 3249711 - protein, 4 aa, Plasmodium falciparum
TAEE

SEQ ID NO: 3249712 - protein, 5 aa, Plasmodium falciparum
TAENK

SEQ ID NO: 3249713 - protein, 9 aa, Plasmodium falciparum
TAEPSKMNK

SEQ ID NO: 3249714 - protein, 12 aa, Plasmodium falciparum
TAHNDTIGENDY

SEQ ID NO: 3249715 - protein, 9 aa, Plasmodium falciparum
TAKDESMNE

SEQ ID NO: 3249716 - protein, 4 aa, Plasmodium falciparum
TAKE

SEQ ID NO: 3249717 - protein, 4 aa, Plasmodium falciparum
TAKK

SEQ ID NO: 3249718 - protein, 6 aa, Plasmodium falciparum
TAKNKN

SEQ ID NO: 3249719 - protein, 30 aa, Plasmodium falciparum
TAKTSSHGRNKWTSNKSKSSYKKKKKNLVN

SEQ ID NO: 3249720 - protein, 10 aa, Plasmodium falciparum
TANVTEENRP

SEQ ID NO: 3249721 - protein, 6 aa, Plasmodium falciparum
TAPNRE

SEQ ID NO: 3249722 - protein, 7 aa, Plasmodium falciparum
TARHNGP

SEQ ID NO: 3249723 - protein, 6 aa, Plasmodium falciparum
TARPKK

SEQ ID NO: 3249724 - protein, 6 aa, Plasmodium falciparum
TASENK

SEQ ID NO: 3249725 - protein, 14 aa, Plasmodium falciparum
TASGETGGTNKPCD

SEQ ID NO: 3249726 - protein, 17 aa, Plasmodium falciparum
TASTSLSPSVGTSLGQN

SEQ ID NO: 3249727 - protein, 5 aa, Plasmodium falciparum
TATDN

SEQ ID NO: 3249728 - protein, 5 aa, Plasmodium falciparum
TATDS

SEQ ID NO: 3249729 - protein, 5 aa, Plasmodium falciparum
TATNF

SEQ ID NO: 3249730 - protein, 4 aa, Plasmodium falciparum
TATT

SEQ ID NO: 3249731 - protein, 11 aa, Plasmodium falciparum
TAYGVDSKTSD

SEQ ID NO: 3249732 - protein, 39 aa, Plasmodium falciparum
TCATESSLSNHDTENYNASPNTSDDNVNADISNDHSRNV

SEQ ID NO: 3249733 - protein, 4 aa, Plasmodium falciparum
TCDK

SEQ ID NO: 3249734 - protein, 7 aa, Plasmodium falciparum
TCDPNDR

SEQ ID NO: 3249735 - protein, 11 aa, Plasmodium falciparum
TCEENYQDDAN

SEQ ID NO: 3249736 - protein, 18 aa, Plasmodium falciparum
TCEETKNEQHVQEDERGR

SEQ ID NO: 3249737 - protein, 6 aa, Plasmodium falciparum
TCEQKK

SEQ ID NO: 3249738 - protein, 13 aa, Plasmodium falciparum
TCGGDDEKTGTQA

SEQ ID NO: 3249739 - protein, 8 aa, Plasmodium falciparum
TCGYSTRS

SEQ ID NO: 3249740 - protein, 7 aa, Plasmodium falciparum
TCKNDEH

SEQ ID NO: 3249741 - protein, 12 aa, Plasmodium falciparum
TCKTIGDEKEKI

SEQ ID NO: 3249742 - protein, 6 aa, Plasmodium falciparum
TCNGSE

SEQ ID NO: 3249743 - protein, 6 aa, Plasmodium falciparum
TCNKNN

SEQ ID NO: 3249744 - protein, 4 aa, Plasmodium falciparum
TCNN

SEQ ID NO: 3249745 - protein, 7 aa, Plasmodium falciparum
TCNNGDV

SEQ ID NO: 3249746 - protein, 5 aa, Plasmodium falciparum
TCNNN

SEQ ID NO: 3249747 - protein, 9 aa, Plasmodium falciparum
TCNPNDGTI

SEQ ID NO: 3249748 - protein, 5 aa, Plasmodium falciparum
TCPGK

SEQ ID NO: 3249749 - protein, 4 aa, Plasmodium falciparum
TCQN

SEQ ID NO: 3249750 - protein, 4 aa, Plasmodium falciparum
TCRS

SEQ ID NO: 3249751 - protein, 14 aa, Plasmodium falciparum
TCSDGDDDEENDTI

SEQ ID NO: 3249752 - protein, 4 aa, Plasmodium falciparum
TCSE

SEQ ID NO: 3249753 - protein, 9 aa, Plasmodium falciparum
TCSGGESIA

SEQ ID NO: 3249754 - protein, 5 aa, Plasmodium falciparum
TCSNL

SEQ ID NO: 3249755 - protein, 11 aa, Plasmodium falciparum
TCTNNENRKKH

SEQ ID NO: 3249756 - protein, 11 aa, Plasmodium falciparum
TDAEIAESTKL

SEQ ID NO: 3249757 - protein, 46 aa, Plasmodium falciparum
TDDDNNNNNNNTNDLNTNDLNTNDLNTNELNTNELNTNNHNNRMKG

SEQ ID NO: 3249758 - protein, 8 aa, Plasmodium falciparum
TDDEESIL

SEQ ID NO: 3249759 - protein, 10 aa, Plasmodium falciparum
TDDEKRKEWK

SEQ ID NO: 3249760 - protein, 19 aa, Plasmodium falciparum
TDDENDTNGNSINNNKNIY

SEQ ID NO: 3249761 - protein, 5 aa, Plasmodium falciparum
TDDIQ

SEQ ID NO: 3249762 - protein, 5 aa, Plasmodium falciparum
TDDIS

SEQ ID NO: 3249763 - protein, 16 aa, Plasmodium falciparum
TDDKNREDITKNYPDR

SEQ ID NO: 3249764 - protein, 6 aa, Plasmodium falciparum
TDDKSA

SEQ ID NO: 3249765 - protein, 16 aa, Plasmodium falciparum
TDDNDNVKDNEKNTKE

SEQ ID NO: 3249766 - protein, 4 aa, Plasmodium falciparum
TDDS

SEQ ID NO: 3249767 - protein, 6 aa, Plasmodium falciparum
TDDSGN

SEQ ID NO: 3249768 - protein, 5 aa, Plasmodium falciparum
TDDSK

SEQ ID NO: 3249769 - protein, 10 aa, Plasmodium falciparum
TDDSSSNSMS

SEQ ID NO: 3249770 - protein, 52 aa, Plasmodium falciparum
TDDSYTDSSYKNKKKSKYKKGDTNQTDKTSKKNKNDKTNKTNKTNVSIKRKS

SEQ ID NO: 3249771 - protein, 16 aa, Plasmodium falciparum
TDDTSDDNDMMNSNNN

SEQ ID NO: 3249772 - protein, 5 aa, Plasmodium falciparum
TDDYN

SEQ ID NO: 3249773 - protein, 7 aa, Plasmodium falciparum
TDDYTND

SEQ ID NO: 3249774 - protein, 8 aa, Plasmodium falciparum
TDECSGTK

SEQ ID NO: 3249775 - protein, 4 aa, Plasmodium falciparum
TDED

SEQ ID NO: 3249776 - protein, 4 aa, Plasmodium falciparum
TDEH

SEQ ID NO: 3249777 - protein, 6 aa, Plasmodium falciparum
TDEKEN

SEQ ID NO: 3249778 - protein, 9 aa, Plasmodium falciparum
TDEKPPKYY

SEQ ID NO: 3249779 - protein, 7 aa, Plasmodium falciparum
TDEKTNE

SEQ ID NO: 3249780 - protein, 7 aa, Plasmodium falciparum
TDENEEK

SEQ ID NO: 3249781 - protein, 24 aa, Plasmodium falciparum
TDENEKINKDDIERSNNNMKGNNN

SEQ ID NO: 3249782 - protein, 23 aa, Plasmodium falciparum
TDENFQEDDYNNKKENDCNTYDD

SEQ ID NO: 3249783 - protein, 8 aa, Plasmodium falciparum
TDENGYKK

SEQ ID NO: 3249784 - protein, 8 aa, Plasmodium falciparum
TDENSIST

SEQ ID NO: 3249785 - protein, 7 aa, Plasmodium falciparum
TDENSKY

SEQ ID NO: 3249786 - protein, 4 aa, Plasmodium falciparum
TDEP

SEQ ID NO: 3249787 - protein, 14 aa, Plasmodium falciparum
TDEQNQNEDNKTTN

SEQ ID NO: 3249788 - protein, 8 aa, Plasmodium falciparum
TDEQQNDH

SEQ ID NO: 3249789 - protein, 19 aa, Plasmodium falciparum
TDERDEENTINNKKNVYDD

SEQ ID NO: 3249790 - protein, 20 aa, Plasmodium falciparum
TDERKGDKSLSSNNKNNLSK

SEQ ID NO: 3249791 - protein, 8 aa, Plasmodium falciparum
TDESSTIK

SEQ ID NO: 3249792 - protein, 7 aa, Plasmodium falciparum
TDETDDD

SEQ ID NO: 3249793 - protein, 6 aa, Plasmodium falciparum
TDEYEK

SEQ ID NO: 3249794 - protein, 17 aa, Plasmodium falciparum
TDEYNGNNNMPSVNSNS

SEQ ID NO: 3249795 - protein, 8 aa, Plasmodium falciparum
TDGEPYYN

SEQ ID NO: 3249796 - protein, 6 aa, Plasmodium falciparum
TDGERR

SEQ ID NO: 3249797 - protein, 5 aa, Plasmodium falciparum
TDGKN

SEQ ID NO: 3249798 - protein, 4 aa, Plasmodium falciparum
TDGL

SEQ ID NO: 3249799 - protein, 6 aa, Plasmodium falciparum
TDGSIT

SEQ ID NO: 3249800 - protein, 5 aa, Plasmodium falciparum
TDGSY

SEQ ID NO: 3249801 - protein, 23 aa, Plasmodium falciparum
TDGTAVSSEATQAGTPSQSPKGD

SEQ ID NO: 3249802 - protein, 22 aa, Plasmodium falciparum
TDGTAVSSETTSATSSHASNGD

SEQ ID NO: 3249803 - protein, 23 aa, Plasmodium falciparum
TDGTSVSSEPTTATSSPSPKGDS

SEQ ID NO: 3249804 - protein, 5 aa, Plasmodium falciparum
TDGVQ

SEQ ID NO: 3249805 - protein, 6 aa, Plasmodium falciparum
TDGYIN

SEQ ID NO: 3249806 - protein, 10 aa, Plasmodium falciparum
TDIDPNHHSE

SEQ ID NO: 3249807 - protein, 39 aa, Plasmodium falciparum
TDIDTEKKKHEKDNYKNKKIKNTKLKDANIDNEEKDDHH

SEQ ID NO: 3249808 - protein, 9 aa, Plasmodium falciparum
TDIGYEQET

SEQ ID NO: 3249809 - protein, 12 aa, Plasmodium falciparum
TDINSSSKYTYT

SEQ ID NO: 3249810 - protein, 5 aa, Plasmodium falciparum
TDKDQ

SEQ ID NO: 3249811 - protein, 11 aa, Plasmodium falciparum
TDKDTKKKDKH

SEQ ID NO: 3249812 - protein, 4 aa, Plasmodium falciparum
TDKF

SEQ ID NO: 3249813 - protein, 11 aa, Plasmodium falciparum
TDKKEQYEKQA

SEQ ID NO: 3249814 - protein, 6 aa, Plasmodium falciparum
TDKKGN

SEQ ID NO: 3249815 - protein, 9 aa, Plasmodium falciparum
TDKKNEGLN

SEQ ID NO: 3249816 - protein, 21 aa, Plasmodium falciparum
TDKNRKRKMDSEHDENRSDGR

SEQ ID NO: 3249817 - protein, 24 aa, Plasmodium falciparum
TDKNVKDESVENKRQKKNEENDSN

SEQ ID NO: 3249818 - protein, 18 aa, Plasmodium falciparum
TDKPQTMDEASYEETVDE

SEQ ID NO: 3249819 - protein, 25 aa, Plasmodium falciparum
TDKQNENINVSNNDNNMEETKNNEI

SEQ ID NO: 3249820 - protein, 23 aa, Plasmodium falciparum
TDKSNTVDDASKNKKKDKEEIPK

SEQ ID NO: 3249821 - protein, 12 aa, Plasmodium falciparum
TDKSNYILFFNL

SEQ ID NO: 3249822 - protein, 5 aa, Plasmodium falciparum
TDKTF

SEQ ID NO: 3249823 - protein, 7 aa, Plasmodium falciparum
TDKTTNK

SEQ ID NO: 3249824 - protein, 8 aa, Plasmodium falciparum
TDLATQAG

SEQ ID NO: 3249825 - protein, 21 aa, Plasmodium falciparum
TDLKDNKKEIKSSKKNVKDIK

SEQ ID NO: 3249826 - protein, 29 aa, Plasmodium falciparum
TDLNANKTADLNSDKTTDLNSDKTTNFNT

SEQ ID NO: 3249827 - protein, 11 aa, Plasmodium falciparum
TDLNSEELNEK

SEQ ID NO: 3249828 - protein, 4 aa, Plasmodium falciparum
TDLQ

SEQ ID NO: 3249829 - protein, 5 aa, Plasmodium falciparum
TDNDN

SEQ ID NO: 3249830 - protein, 8 aa, Plasmodium falciparum
TDNDNNTD

SEQ ID NO: 3249831 - protein, 7 aa, Plasmodium falciparum
TDNEKND

SEQ ID NO: 3249832 - protein, 4 aa, Plasmodium falciparum
TDNF

SEQ ID NO: 3249833 - protein, 8 aa, Plasmodium falciparum
TDNHNQTE

SEQ ID NO: 3249834 - protein, 4 aa, Plasmodium falciparum
TDNI

SEQ ID NO: 3249835 - protein, 26 aa, Plasmodium falciparum
TDNIRENKNYKDKSKMNEKKNEIDEE

SEQ ID NO: 3249836 - protein, 5 aa, Plasmodium falciparum
TDNKE

SEQ ID NO: 3249837 - protein, 12 aa, Plasmodium falciparum
TDNLDNSEYEDT

SEQ ID NO: 3249838 - protein, 11 aa, Plasmodium falciparum
TDNQNVENADP

SEQ ID NO: 3249839 - protein, 19 aa, Plasmodium falciparum
TDNSDTVAKGKASITQDTD

SEQ ID NO: 3249840 - protein, 8 aa, Plasmodium falciparum
TDNVDEPL

SEQ ID NO: 3249841 - protein, 6 aa, Plasmodium falciparum
TDPLGE

SEQ ID NO: 3249842 - protein, 7 aa, Plasmodium falciparum
TDPPSYE

SEQ ID NO: 3249843 - protein, 6 aa, Plasmodium falciparum
TDPPTY

SEQ ID NO: 3249844 - protein, 7 aa, Plasmodium falciparum
TDQDKQN

SEQ ID NO: 3249845 - protein, 6 aa, Plasmodium falciparum
TDQEDD

SEQ ID NO: 3249846 - protein, 6 aa, Plasmodium falciparum
TDQEER

SEQ ID NO: 3249847 - protein, 7 aa, Plasmodium falciparum
TDQEERK

SEQ ID NO: 3249848 - protein, 12 aa, Plasmodium falciparum
TDQGPLKNSDGK

SEQ ID NO: 3249849 - protein, 10 aa, Plasmodium falciparum
TDQGPNEDTL

SEQ ID NO: 3249850 - protein, 21 aa, Plasmodium falciparum
TDQNKNTNEQADIKKKKKFNS

SEQ ID NO: 3249851 - protein, 71 aa, Plasmodium falciparum
TDQNYKERKQIQNEDITKKKKEIVSDDNDNDNDNDNDNNNNNNNNNNNNDGDAIYSSSSSSSCSNSCSSGA

SEQ ID NO: 3249852 - protein, 8 aa, Plasmodium falciparum
TDQQNINT

SEQ ID NO: 3249853 - protein, 8 aa, Plasmodium falciparum
TDQSIENG

SEQ ID NO: 3249854 - protein, 7 aa, Plasmodium falciparum
TDRAKKN

SEQ ID NO: 3249855 - protein, 10 aa, Plasmodium falciparum
TDRGKSARKY

SEQ ID NO: 3249856 - protein, 7 aa, Plasmodium falciparum
TDRGKTK

SEQ ID NO: 3249857 - protein, 7 aa, Plasmodium falciparum
TDRIPTP

SEQ ID NO: 3249858 - protein, 9 aa, Plasmodium falciparum
TDRKNCGKS

SEQ ID NO: 3249859 - protein, 12 aa, Plasmodium falciparum
TDRRNSESSSRI

SEQ ID NO: 3249860 - protein, 17 aa, Plasmodium falciparum
TDRSTCSDNTYDDSNSK

SEQ ID NO: 3249861 - protein, 6 aa, Plasmodium falciparum
TDRYSE

SEQ ID NO: 3249862 - protein, 4 aa, Plasmodium falciparum
TDSD

SEQ ID NO: 3249863 - protein, 13 aa, Plasmodium falciparum
TDSDEEKTLQKRR

SEQ ID NO: 3249864 - protein, 5 aa, Plasmodium falciparum
TDSDN

SEQ ID NO: 3249865 - protein, 5 aa, Plasmodium falciparum
TDSDY

SEQ ID NO: 3249866 - protein, 14 aa, Plasmodium falciparum
TDSEAKEQPPIQDK

SEQ ID NO: 3249867 - protein, 15 aa, Plasmodium falciparum
TDSEKKDGKPQHNES

SEQ ID NO: 3249868 - protein, 8 aa, Plasmodium falciparum
TDSELPEV

SEQ ID NO: 3249869 - protein, 4 aa, Plasmodium falciparum
TDSG

SEQ ID NO: 3249870 - protein, 17 aa, Plasmodium falciparum
TDSGEKGELPKEDDKVK

SEQ ID NO: 3249871 - protein, 5 aa, Plasmodium falciparum
TDSGG

SEQ ID NO: 3249872 - protein, 6 aa, Plasmodium falciparum
TDSGLD

SEQ ID NO: 3249873 - protein, 15 aa, Plasmodium falciparum
TDSINKKKNKDTDPS

SEQ ID NO: 3249874 - protein, 7 aa, Plasmodium falciparum
TDSKGMP

SEQ ID NO: 3249875 - protein, 15 aa, Plasmodium falciparum
TDSNEVETSADPEGQ

SEQ ID NO: 3249876 - protein, 25 aa, Plasmodium falciparum
TDSNTSHLKERKNQKAPPGEHKPEV

SEQ ID NO: 3249877 - protein, 14 aa, Plasmodium falciparum
TDSRNQNSNNMNSN

SEQ ID NO: 3249878 - protein, 9 aa, Plasmodium falciparum
TDSRSSNNI

SEQ ID NO: 3249879 - protein, 15 aa, Plasmodium falciparum
TDSSEVKTSADPEGQ

SEQ ID NO: 3249880 - protein, 21 aa, Plasmodium falciparum
TDSSHSNDDSTSKEQNYPKPR

SEQ ID NO: 3249881 - protein, 12 aa, Plasmodium falciparum
TDSSNNKGKNYE

SEQ ID NO: 3249882 - protein, 8 aa, Plasmodium falciparum
TDSSNNTI

SEQ ID NO: 3249883 - protein, 8 aa, Plasmodium falciparum
TDSSPNYE

SEQ ID NO: 3249884 - protein, 17 aa, Plasmodium falciparum
TDSSQHEKDINNNVETY

SEQ ID NO: 3249885 - protein, 13 aa, Plasmodium falciparum
TDSSSNDCSDHGD

SEQ ID NO: 3249886 - protein, 13 aa, Plasmodium falciparum
TDTASGTAPTQIQ

SEQ ID NO: 3249887 - protein, 7 aa, Plasmodium falciparum
TDTDSTT

SEQ ID NO: 3249888 - protein, 17 aa, Plasmodium falciparum
TDTGKISRKKVSESIEE

SEQ ID NO: 3249889 - protein, 16 aa, Plasmodium falciparum
TDTGLTKPNKKLESKE

SEQ ID NO: 3249890 - protein, 11 aa, Plasmodium falciparum
TDTGSEGIYNS

SEQ ID NO: 3249891 - protein, 6 aa, Plasmodium falciparum
TDTITN

SEQ ID NO: 3249892 - protein, 23 aa, Plasmodium falciparum
TDTKEKFQKTRKIKTNNNAYYDK

SEQ ID NO: 3249893 - protein, 8 aa, Plasmodium falciparum
TDTKGYNN

SEQ ID NO: 3249894 - protein, 10 aa, Plasmodium falciparum
TDTKQGKHDM

SEQ ID NO: 3249895 - protein, 4 aa, Plasmodium falciparum
TDTL

SEQ ID NO: 3249896 - protein, 6 aa, Plasmodium falciparum
TDVETK

SEQ ID NO: 3249897 - protein, 25 aa, Plasmodium falciparum
TDYEGSESDADLSEQGNNMSTLNDE

SEQ ID NO: 3249898 - protein, 8 aa, Plasmodium falciparum
TDYSSEDE

SEQ ID NO: 3249899 - protein, 13 aa, Plasmodium falciparum
TDYSSNRSNCETE

SEQ ID NO: 3249900 - protein, 4 aa, Plasmodium falciparum
TDYT

SEQ ID NO: 3249901 - protein, 4 aa, Plasmodium falciparum
TEAC

SEQ ID NO: 3249902 - protein, 17 aa, Plasmodium falciparum
TEAGAAAGVAAGEAAGK

SEQ ID NO: 3249903 - protein, 12 aa, Plasmodium falciparum
TEATASGDNTPL

SEQ ID NO: 3249904 - protein, 8 aa, Plasmodium falciparum
TEAVSQSR

SEQ ID NO: 3249905 - protein, 53 aa, Plasmodium falciparum
TEDDTNSMNKKVDSAENNSNKKSITNDTMDDHNKNMNDHNNTNDHNNINDHNN

SEQ ID NO: 3249906 - protein, 9 aa, Plasmodium falciparum
TEDGVAEQD

SEQ ID NO: 3249907 - protein, 4 aa, Plasmodium falciparum
TEDT

SEQ ID NO: 3249908 - protein, 8 aa, Plasmodium falciparum
TEEANNKS

SEQ ID NO: 3249909 - protein, 10 aa, Plasmodium falciparum
TEEDQSVTKE

SEQ ID NO: 3249910 - protein, 26 aa, Plasmodium falciparum
TEEDYTEKHDYDKHEDFNNERYSNHN

SEQ ID NO: 3249911 - protein, 4 aa, Plasmodium falciparum
TEEE

SEQ ID NO: 3249912 - protein, 13 aa, Plasmodium falciparum
TEEENKKKSILEG

SEQ ID NO: 3249913 - protein, 6 aa, Plasmodium falciparum
TEEGQK

SEQ ID NO: 3249914 - protein, 6 aa, Plasmodium falciparum
TEEGSV

SEQ ID NO: 3249915 - protein, 7 aa, Plasmodium falciparum
TEEKEEN

SEQ ID NO: 3249916 - protein, 5 aa, Plasmodium falciparum
TEEKN

SEQ ID NO: 3249917 - protein, 61 aa, Plasmodium falciparum
TEEKNDTGDIKKEENKSKPSQLDGNNHSETSSHQGEKNNENETEKKTDQNETGTKKPSKYT

SEQ ID NO: 3249918 - protein, 10 aa, Plasmodium falciparum
TEEKPEEAKK

SEQ ID NO: 3249919 - protein, 11 aa, Plasmodium falciparum
TEEKPEEAKKN

SEQ ID NO: 3249920 - protein, 13 aa, Plasmodium falciparum
TEENDETSSSMSS

SEQ ID NO: 3249921 - protein, 5 aa, Plasmodium falciparum
TEENF

SEQ ID NO: 3249922 - protein, 15 aa, Plasmodium falciparum
TEENNIYGDNNKKNF

SEQ ID NO: 3249923 - protein, 9 aa, Plasmodium falciparum
TEESSKDPL

SEQ ID NO: 3249924 - protein, 12 aa, Plasmodium falciparum
TEETNDDEYNKT

SEQ ID NO: 3249925 - protein, 6 aa, Plasmodium falciparum
TEEVPK

SEQ ID NO: 3249926 - protein, 7 aa, Plasmodium falciparum
TEEYERR

SEQ ID NO: 3249927 - protein, 5 aa, Plasmodium falciparum
TEEYV

SEQ ID NO: 3249928 - protein, 12 aa, Plasmodium falciparum
TEFGDKKNNWGG

SEQ ID NO: 3249929 - protein, 14 aa, Plasmodium falciparum
TEGAAKGAIAGNAQ

SEQ ID NO: 3249930 - protein, 7 aa, Plasmodium falciparum
TEGEGWD

SEQ ID NO: 3249931 - protein, 12 aa, Plasmodium falciparum
TEGLNVGKTEDL

SEQ ID NO: 3249932 - protein, 5 aa, Plasmodium falciparum
TEGRK

SEQ ID NO: 3249933 - protein, 8 aa, Plasmodium falciparum
TEGRLTSD

SEQ ID NO: 3249934 - protein, 5 aa, Plasmodium falciparum
TEGTA

SEQ ID NO: 3249935 - protein, 17 aa, Plasmodium falciparum
TEHKTHKESSNSSINEL

SEQ ID NO: 3249936 - protein, 6 aa, Plasmodium falciparum
TEHSQD

SEQ ID NO: 3249937 - protein, 5 aa, Plasmodium falciparum
TEIKE

SEQ ID NO: 3249938 - protein, 14 aa, Plasmodium falciparum
TEIKTEIKKKRSNL

SEQ ID NO: 3249939 - protein, 4 aa, Plasmodium falciparum
TEIM

SEQ ID NO: 3249940 - protein, 5 aa, Plasmodium falciparum
TEIND

SEQ ID NO: 3249941 - protein, 10 aa, Plasmodium falciparum
TEINKNKCNV

SEQ ID NO: 3249942 - protein, 5 aa, Plasmodium falciparum
TEINN

SEQ ID NO: 3249943 - protein, 18 aa, Plasmodium falciparum
TEITTKTYPTSNQNKQSS

SEQ ID NO: 3249944 - protein, 8 aa, Plasmodium falciparum
TEKEGNME

SEQ ID NO: 3249945 - protein, 37 aa, Plasmodium falciparum
TEKEIRGVAGANDDSEDNDDSEDNDDTEDYDDYEDYE

SEQ ID NO: 3249946 - protein, 34 aa, Plasmodium falciparum
TEKEKEKENKKNKKLKLKDGDSINYDNEQGLEYT

SEQ ID NO: 3249947 - protein, 10 aa, Plasmodium falciparum
TEKEKKKEKI

SEQ ID NO: 3249948 - protein, 11 aa, Plasmodium falciparum
TEKEKKKKNRI

SEQ ID NO: 3249949 - protein, 15 aa, Plasmodium falciparum
TEKELEGNKKENNVL

SEQ ID NO: 3249950 - protein, 9 aa, Plasmodium falciparum
TEKERKQKA

SEQ ID NO: 3249951 - protein, 20 aa, Plasmodium falciparum
TEKIKNEEKFNNSKENIQND

SEQ ID NO: 3249952 - protein, 7 aa, Plasmodium falciparum
TEKKNNN

SEQ ID NO: 3249953 - protein, 9 aa, Plasmodium falciparum
TEKKSQNIS

SEQ ID NO: 3249954 - protein, 9 aa, Plasmodium falciparum
TEKNETNGS

SEQ ID NO: 3249955 - protein, 18 aa, Plasmodium falciparum
TEKNGKDKSSEENANDNI

SEQ ID NO: 3249956 - protein, 37 aa, Plasmodium falciparum
TEKNGKDKSSEENANDNVMTEKNGKNKSSEENADDNI

SEQ ID NO: 3249957 - protein, 17 aa, Plasmodium falciparum
TEKNGKNKSSEENADDN

SEQ ID NO: 3249958 - protein, 15 aa, Plasmodium falciparum
TEKNGKNKSSQGNID

SEQ ID NO: 3249959 - protein, 18 aa, Plasmodium falciparum
TEKNGKNNNSQENSDDNI

SEQ ID NO: 3249960 - protein, 8 aa, Plasmodium falciparum
TEKQIPYS

SEQ ID NO: 3249961 - protein, 8 aa, Plasmodium falciparum
TEKSNSVK

SEQ ID NO: 3249962 - protein, 6 aa, Plasmodium falciparum
TEKTFG

SEQ ID NO: 3249963 - protein, 5 aa, Plasmodium falciparum
TEKTY

SEQ ID NO: 3249964 - protein, 7 aa, Plasmodium falciparum
TELGNSW

SEQ ID NO: 3249965 - protein, 14 aa, Plasmodium falciparum
TELNNEGIKEETKE

SEQ ID NO: 3249966 - protein, 4 aa, Plasmodium falciparum
TELS

SEQ ID NO: 3249967 - protein, 4 aa, Plasmodium falciparum
TELT

SEQ ID NO: 3249968 - protein, 6 aa, Plasmodium falciparum
TEMNSY

SEQ ID NO: 3249969 - protein, 24 aa, Plasmodium falciparum
TEMNTTSNNNNNNNNISGSDNNNN

SEQ ID NO: 3249970 - protein, 6 aa, Plasmodium falciparum
TENDEK

SEQ ID NO: 3249971 - protein, 8 aa, Plasmodium falciparum
TENEENKR

SEQ ID NO: 3249972 - protein, 15 aa, Plasmodium falciparum
TENGTGDSNSDPSLY

SEQ ID NO: 3249973 - protein, 47 aa, Plasmodium falciparum
TENKKNKALNSNMSNNNNNNNNSNNNNNNNSNNNNNNYNNNYNNNNN

SEQ ID NO: 3249974 - protein, 10 aa, Plasmodium falciparum
TENKTKVEEN

SEQ ID NO: 3249975 - protein, 11 aa, Plasmodium falciparum
TENLQNSNNSN

SEQ ID NO: 3249976 - protein, 8 aa, Plasmodium falciparum
TENNKNKN

SEQ ID NO: 3249977 - protein, 5 aa, Plasmodium falciparum
TENNN

SEQ ID NO: 3249978 - protein, 13 aa, Plasmodium falciparum
TENNNENRIEDNE

SEQ ID NO: 3249979 - protein, 14 aa, Plasmodium falciparum
TENNQQNEKYDNHK

SEQ ID NO: 3249980 - protein, 9 aa, Plasmodium falciparum
TENPVDPPK

SEQ ID NO: 3249981 - protein, 12 aa, Plasmodium falciparum
TENPVGKQQPSF

SEQ ID NO: 3249982 - protein, 5 aa, Plasmodium falciparum
TENQE

SEQ ID NO: 3249983 - protein, 5 aa, Plasmodium falciparum
TENRN

SEQ ID NO: 3249984 - protein, 10 aa, Plasmodium falciparum
TENSESEDID

SEQ ID NO: 3249985 - protein, 10 aa, Plasmodium falciparum
TENTPSARAA

SEQ ID NO: 3249986 - protein, 5 aa, Plasmodium falciparum
TENTS

SEQ ID NO: 3249987 - protein, 13 aa, Plasmodium falciparum
TEPNSSSSRSLYE

SEQ ID NO: 3249988 - protein, 6 aa, Plasmodium falciparum
TEPPHS

SEQ ID NO: 3249989 - protein, 5 aa, Plasmodium falciparum
TEPPM

SEQ ID NO: 3249990 - protein, 11 aa, Plasmodium falciparum
TEQEKKNLGKI

SEQ ID NO: 3249991 - protein, 14 aa, Plasmodium falciparum
TEQEQNIDNHTKYN

SEQ ID NO: 3249992 - protein, 65 aa, Plasmodium falciparum
TEQKRENKNIQQKKDNNNTIQQKKENNTNEQKKDNNNTIQQKKENNNTIQEKNSENNLNNSNRKE

SEQ ID NO: 3249993 - protein, 16 aa, Plasmodium falciparum
TEQMENKNDGKNQFKE

SEQ ID NO: 3249994 - protein, 34 aa, Plasmodium falciparum
TEQNPHKSATSEQLDVTPEDNKKKKDSEHENNEK

SEQ ID NO: 3249995 - protein, 6 aa, Plasmodium falciparum
TEQQTA

SEQ ID NO: 3249996 - protein, 5 aa, Plasmodium falciparum
TEQRF

SEQ ID NO: 3249997 - protein, 5 aa, Plasmodium falciparum
TEQRG

SEQ ID NO: 3249998 - protein, 13 aa, Plasmodium falciparum
TEQTFKDADNCKP

SEQ ID NO: 3249999 - protein, 12 aa, Plasmodium falciparum
TERGKNKLNDSG

SEQ ID NO: 3250000 - protein, 4 aa, Plasmodium falciparum
TERI

SEQ ID NO: 3250001 - protein, 6 aa, Plasmodium falciparum
TERKTY

SEQ ID NO: 3250002 - protein, 7 aa, Plasmodium falciparum
TERNKKK

SEQ ID NO: 3250003 - protein, 6 aa, Plasmodium falciparum
TERPYN

SEQ ID NO: 3250004 - protein, 12 aa, Plasmodium falciparum
TERTKNDKQQCN

SEQ ID NO: 3250005 - protein, 13 aa, Plasmodium falciparum
TESDVSSLTENEK

SEQ ID NO: 3250006 - protein, 4 aa, Plasmodium falciparum
TESG

SEQ ID NO: 3250007 - protein, 4 aa, Plasmodium falciparum
TESI

SEQ ID NO: 3250008 - protein, 7 aa, Plasmodium falciparum
TESMNSP

SEQ ID NO: 3250009 - protein, 6 aa, Plasmodium falciparum
TESSKE

SEQ ID NO: 3250010 - protein, 14 aa, Plasmodium falciparum
TESSKEKKKDHTNF

SEQ ID NO: 3250011 - protein, 7 aa, Plasmodium falciparum
TESSKSH

SEQ ID NO: 3250012 - protein, 8 aa, Plasmodium falciparum
TESSTEKV

SEQ ID NO: 3250013 - protein, 5 aa, Plasmodium falciparum
TESYR

SEQ ID NO: 3250014 - protein, 31 aa, Plasmodium falciparum
TESYSADNNSVENNLRQPQYQYAQGSGNTFY

SEQ ID NO: 3250015 - protein, 19 aa, Plasmodium falciparum
TETATIKAAEEKTIETAST

SEQ ID NO: 3250016 - protein, 12 aa, Plasmodium falciparum
TETGEATPNIQE

SEQ ID NO: 3250017 - protein, 11 aa, Plasmodium falciparum
TETQKNALNDE

SEQ ID NO: 3250018 - protein, 5 aa, Plasmodium falciparum
TETSF

SEQ ID NO: 3250019 - protein, 16 aa, Plasmodium falciparum
TETTGTDDPCSSDYTT

SEQ ID NO: 3250020 - protein, 29 aa, Plasmodium falciparum
TETTSTTSSSSSSSSSSPSSSSPSSDDDL

SEQ ID NO: 3250021 - protein, 5 aa, Plasmodium falciparum
TETYT

SEQ ID NO: 3250022 - protein, 7 aa, Plasmodium falciparum
TEVAKEA

SEQ ID NO: 3250023 - protein, 7 aa, Plasmodium falciparum
TEVAKGA

SEQ ID NO: 3250024 - protein, 13 aa, Plasmodium falciparum
TEVEDNINNDKQK

SEQ ID NO: 3250025 - protein, 13 aa, Plasmodium falciparum
TEVGPSGPATPVD

SEQ ID NO: 3250026 - protein, 22 aa, Plasmodium falciparum
TEVSSNAVSEIQNNKDKKKNGT

SEQ ID NO: 3250027 - protein, 4 aa, Plasmodium falciparum
TEWE

SEQ ID NO: 3250028 - protein, 9 aa, Plasmodium falciparum
TEYGNNDDV

SEQ ID NO: 3250029 - protein, 4 aa, Plasmodium falciparum
TEYH

SEQ ID NO: 3250030 - protein, 6 aa, Plasmodium falciparum
TEYNSS

SEQ ID NO: 3250031 - protein, 4 aa, Plasmodium falciparum
TEYQ

SEQ ID NO: 3250032 - protein, 17 aa, Plasmodium falciparum
TEYQHGEKEKSKSTYDE

SEQ ID NO: 3250033 - protein, 9 aa, Plasmodium falciparum
TFDESNEQP

SEQ ID NO: 3250034 - protein, 7 aa, Plasmodium falciparum
TFDSAGE

SEQ ID NO: 3250035 - protein, 6 aa, Plasmodium falciparum
TFEDEK

SEQ ID NO: 3250036 - protein, 16 aa, Plasmodium falciparum
TFEESYDKNKNEYKTN

SEQ ID NO: 3250037 - protein, 10 aa, Plasmodium falciparum
TFEPNAQQTM

SEQ ID NO: 3250038 - protein, 8 aa, Plasmodium falciparum
TFGDGTPI

SEQ ID NO: 3250039 - protein, 6 aa, Plasmodium falciparum
TFGGED

SEQ ID NO: 3250040 - protein, 4 aa, Plasmodium falciparum
TFGS

SEQ ID NO: 3250041 - protein, 4 aa, Plasmodium falciparum
TFIK

SEQ ID NO: 3250042 - protein, 4 aa, Plasmodium falciparum
TFIN

SEQ ID NO: 3250043 - protein, 21 aa, Plasmodium falciparum
TFKDYEDDENNIMSEDEEDDL

SEQ ID NO: 3250044 - protein, 5 aa, Plasmodium falciparum
TFKEE

SEQ ID NO: 3250045 - protein, 4 aa, Plasmodium falciparum
TFKK

SEQ ID NO: 3250046 - protein, 7 aa, Plasmodium falciparum
TFKSKTK

SEQ ID NO: 3250047 - protein, 5 aa, Plasmodium falciparum
TFNHT

SEQ ID NO: 3250048 - protein, 7 aa, Plasmodium falciparum
TFNSYEQ

SEQ ID NO: 3250049 - protein, 5 aa, Plasmodium falciparum
TFPDL

SEQ ID NO: 3250050 - protein, 12 aa, Plasmodium falciparum
TFPSKTNPNKVI

SEQ ID NO: 3250051 - protein, 10 aa, Plasmodium falciparum
TFPSNPNPAY

SEQ ID NO: 3250052 - protein, 14 aa, Plasmodium falciparum
TFPTDNTGGNYDDD

SEQ ID NO: 3250053 - protein, 11 aa, Plasmodium falciparum
TFQGPNAKAGS

SEQ ID NO: 3250054 - protein, 6 aa, Plasmodium falciparum
TFQRPR

SEQ ID NO: 3250055 - protein, 8 aa, Plasmodium falciparum
TFSKNPND

SEQ ID NO: 3250056 - protein, 10 aa, Plasmodium falciparum
TFSTKKDVTS

SEQ ID NO: 3250057 - protein, 5 aa, Plasmodium falciparum
TFTPE

SEQ ID NO: 3250058 - protein, 7 aa, Plasmodium falciparum
TFTRNNQ

SEQ ID NO: 3250059 - protein, 11 aa, Plasmodium falciparum
TGANKSDPKTI

SEQ ID NO: 3250060 - protein, 9 aa, Plasmodium falciparum
TGDEINDPN

SEQ ID NO: 3250061 - protein, 7 aa, Plasmodium falciparum
TGDGEKK

SEQ ID NO: 3250062 - protein, 8 aa, Plasmodium falciparum
TGDINPNN

SEQ ID NO: 3250063 - protein, 9 aa, Plasmodium falciparum
TGDKKNEVN

SEQ ID NO: 3250064 - protein, 24 aa, Plasmodium falciparum
TGDSVDGEEEEQPPQNELNGGKIP

SEQ ID NO: 3250065 - protein, 8 aa, Plasmodium falciparum
TGDYENNN

SEQ ID NO: 3250066 - protein, 6 aa, Plasmodium falciparum
TGEDKE

SEQ ID NO: 3250067 - protein, 10 aa, Plasmodium falciparum
TGEENNSFTS

SEQ ID NO: 3250068 - protein, 6 aa, Plasmodium falciparum
TGEKND

SEQ ID NO: 3250069 - protein, 5 aa, Plasmodium falciparum
TGERE

SEQ ID NO: 3250070 - protein, 8 aa, Plasmodium falciparum
TGEREKEL

SEQ ID NO: 3250071 - protein, 6 aa, Plasmodium falciparum
TGESRP

SEQ ID NO: 3250072 - protein, 4 aa, Plasmodium falciparum
TGEV

SEQ ID NO: 3250073 - protein, 11 aa, Plasmodium falciparum
TGFDGGSGIGV

SEQ ID NO: 3250074 - protein, 7 aa, Plasmodium falciparum
TGFSNDY

SEQ ID NO: 3250075 - protein, 46 aa, Plasmodium falciparum
TGGDSTTQASQASEVQTQARGSNTDKSPGSSEAAQGDGVSKDPQKA

SEQ ID NO: 3250076 - protein, 11 aa, Plasmodium falciparum
TGGFDKNNPCA

SEQ ID NO: 3250077 - protein, 5 aa, Plasmodium falciparum
TGGLS

SEQ ID NO: 3250078 - protein, 8 aa, Plasmodium falciparum
TGGTDAYT

SEQ ID NO: 3250079 - protein, 5 aa, Plasmodium falciparum
TGHPG

SEQ ID NO: 3250080 - protein, 6 aa, Plasmodium falciparum
TGIKKG

SEQ ID NO: 3250081 - protein, 15 aa, Plasmodium falciparum
TGIQTECQEERTQEL

SEQ ID NO: 3250082 - protein, 6 aa, Plasmodium falciparum
TGITQK

SEQ ID NO: 3250083 - protein, 8 aa, Plasmodium falciparum
TGKADPRF

SEQ ID NO: 3250084 - protein, 4 aa, Plasmodium falciparum
TGKD

SEQ ID NO: 3250085 - protein, 8 aa, Plasmodium falciparum
TGKDNYED

SEQ ID NO: 3250086 - protein, 4 aa, Plasmodium falciparum
TGKE

SEQ ID NO: 3250087 - protein, 9 aa, Plasmodium falciparum
TGKEKEFQG

SEQ ID NO: 3250088 - protein, 5 aa, Plasmodium falciparum
TGKGN

SEQ ID NO: 3250089 - protein, 4 aa, Plasmodium falciparum
TGKN

SEQ ID NO: 3250090 - protein, 8 aa, Plasmodium falciparum
TGKNRYQD

SEQ ID NO: 3250091 - protein, 11 aa, Plasmodium falciparum
TGLETNSVSPI

SEQ ID NO: 3250092 - protein, 6 aa, Plasmodium falciparum
TGLNSE

SEQ ID NO: 3250093 - protein, 4 aa, Plasmodium falciparum
TGND

SEQ ID NO: 3250094 - protein, 6 aa, Plasmodium falciparum
TGNDQN

SEQ ID NO: 3250095 - protein, 25 aa, Plasmodium falciparum
TGNDSNSDNSNQNIFPDGSELAGGI

SEQ ID NO: 3250096 - protein, 4 aa, Plasmodium falciparum
TGNE

SEQ ID NO: 3250097 - protein, 9 aa, Plasmodium falciparum
TGNEDTSDV

SEQ ID NO: 3250098 - protein, 7 aa, Plasmodium falciparum
TGNEEAA

SEQ ID NO: 3250099 - protein, 7 aa, Plasmodium falciparum
TGNHGPR

SEQ ID NO: 3250100 - protein, 8 aa, Plasmodium falciparum
TGNIDSKC

SEQ ID NO: 3250101 - protein, 7 aa, Plasmodium falciparum
TGNKSES

SEQ ID NO: 3250102 - protein, 10 aa, Plasmodium falciparum
TGNKTEHGAC

SEQ ID NO: 3250103 - protein, 6 aa, Plasmodium falciparum
TGNLQS

SEQ ID NO: 3250104 - protein, 13 aa, Plasmodium falciparum
TGNMSIPNNKRKN

SEQ ID NO: 3250105 - protein, 5 aa, Plasmodium falciparum
TGNQY

SEQ ID NO: 3250106 - protein, 5 aa, Plasmodium falciparum
TGNRT

SEQ ID NO: 3250107 - protein, 6 aa, Plasmodium falciparum
TGNTEK

SEQ ID NO: 3250108 - protein, 22 aa, Plasmodium falciparum
TGNTNTQSSPKDLDGDHYPNKQ

SEQ ID NO: 3250109 - protein, 17 aa, Plasmodium falciparum
TGNTSNDNKGENSGNGA

SEQ ID NO: 3250110 - protein, 36 aa, Plasmodium falciparum
TGNTSNEGAATDSEGSDAKSRHKRDLAPSSGSNQGS

SEQ ID NO: 3250111 - protein, 4 aa, Plasmodium falciparum
TGPE

SEQ ID NO: 3250112 - protein, 5 aa, Plasmodium falciparum
TGPIR

SEQ ID NO: 3250113 - protein, 6 aa, Plasmodium falciparum
TGPSSI

SEQ ID NO: 3250114 - protein, 6 aa, Plasmodium falciparum
TGQNSC

SEQ ID NO: 3250115 - protein, 8 aa, Plasmodium falciparum
TGQSSTKD

SEQ ID NO: 3250116 - protein, 7 aa, Plasmodium falciparum
TGSGKSL

SEQ ID NO: 3250117 - protein, 7 aa, Plasmodium falciparum
TGSIGTN

SEQ ID NO: 3250118 - protein, 4 aa, Plasmodium falciparum
TGSL

SEQ ID NO: 3250119 - protein, 9 aa, Plasmodium falciparum
TGSSNLAIP

SEQ ID NO: 3250120 - protein, 11 aa, Plasmodium falciparum
TGSSSNHDNEK

SEQ ID NO: 3250121 - protein, 23 aa, Plasmodium falciparum
TGSTPTGTAATPNGTTGTYTTQY

SEQ ID NO: 3250122 - protein, 13 aa, Plasmodium falciparum
TGSVNEKKNQQGI

SEQ ID NO: 3250123 - protein, 9 aa, Plasmodium falciparum
TGTAASAAT

SEQ ID NO: 3250124 - protein, 6 aa, Plasmodium falciparum
TGTAEG

SEQ ID NO: 3250125 - protein, 5 aa, Plasmodium falciparum
TGTEE

SEQ ID NO: 3250126 - protein, 4 aa, Plasmodium falciparum
TGTG

SEQ ID NO: 3250127 - protein, 10 aa, Plasmodium falciparum
TGTGLTSSTP

SEQ ID NO: 3250128 - protein, 5 aa, Plasmodium falciparum
TGTGS

SEQ ID NO: 3250129 - protein, 5 aa, Plasmodium falciparum
TGTLT

SEQ ID NO: 3250130 - protein, 6 aa, Plasmodium falciparum
TGTLTE

SEQ ID NO: 3250131 - protein, 6 aa, Plasmodium falciparum
TGTLTN

SEQ ID NO: 3250132 - protein, 11 aa, Plasmodium falciparum
TGTQSNSLINQ

SEQ ID NO: 3250133 - protein, 5 aa, Plasmodium falciparum
TGVEE

SEQ ID NO: 3250134 - protein, 4 aa, Plasmodium falciparum
TGVS

SEQ ID NO: 3250135 - protein, 5 aa, Plasmodium falciparum
TGVSN

SEQ ID NO: 3250136 - protein, 6 aa, Plasmodium falciparum
TGVTNN

SEQ ID NO: 3250137 - protein, 10 aa, Plasmodium falciparum
TGYDDNNTLE

SEQ ID NO: 3250138 - protein, 10 aa, Plasmodium falciparum
TGYDEKSHID

SEQ ID NO: 3250139 - protein, 17 aa, Plasmodium falciparum
TGYEDEKNNIGKGNNSY

SEQ ID NO: 3250140 - protein, 7 aa, Plasmodium falciparum
TGYGGTI

SEQ ID NO: 3250141 - protein, 4 aa, Plasmodium falciparum
TGYN

SEQ ID NO: 3250142 - protein, 4 aa, Plasmodium falciparum
THAP

SEQ ID NO: 3250143 - protein, 5 aa, Plasmodium falciparum
THCTN

SEQ ID NO: 3250144 - protein, 16 aa, Plasmodium falciparum
THDEDDKTRKCTDENI

SEQ ID NO: 3250145 - protein, 10 aa, Plasmodium falciparum
THDEGCDRKN

SEQ ID NO: 3250146 - protein, 6 aa, Plasmodium falciparum
THDEIT

SEQ ID NO: 3250147 - protein, 8 aa, Plasmodium falciparum
THDKNDNT

SEQ ID NO: 3250148 - protein, 12 aa, Plasmodium falciparum
THDNNTNDNLST

SEQ ID NO: 3250149 - protein, 11 aa, Plasmodium falciparum
THEEFNKSSSM

SEQ ID NO: 3250150 - protein, 6 aa, Plasmodium falciparum
THEKEN

SEQ ID NO: 3250151 - protein, 10 aa, Plasmodium falciparum
THEKETHNLN

SEQ ID NO: 3250152 - protein, 5 aa, Plasmodium falciparum
THESR

SEQ ID NO: 3250153 - protein, 44 aa, Plasmodium falciparum
THETKEANNINKYDETNNIKKDGETKNINKYDETNNTIKYDETN

SEQ ID NO: 3250154 - protein, 15 aa, Plasmodium falciparum
THETKNSNNPDDKKE

SEQ ID NO: 3250155 - protein, 5 aa, Plasmodium falciparum
THHKS

SEQ ID NO: 3250156 - protein, 4 aa, Plasmodium falciparum
THHN

SEQ ID NO: 3250157 - protein, 7 aa, Plasmodium falciparum
THHTNNN

SEQ ID NO: 3250158 - protein, 10 aa, Plasmodium falciparum
THKHNKRKSM

SEQ ID NO: 3250159 - protein, 12 aa, Plasmodium falciparum
THKKKSNEFTKE

SEQ ID NO: 3250160 - protein, 11 aa, Plasmodium falciparum
THKTSEENISE

SEQ ID NO: 3250161 - protein, 8 aa, Plasmodium falciparum
THNDENNN

SEQ ID NO: 3250162 - protein, 12 aa, Plasmodium falciparum
THNGNIKNKRNI

SEQ ID NO: 3250163 - protein, 8 aa, Plasmodium falciparum
THNKSKNN

SEQ ID NO: 3250164 - protein, 9 aa, Plasmodium falciparum
THNNKKNNL

SEQ ID NO: 3250165 - protein, 12 aa, Plasmodium falciparum
THNNKKQNMNNQ

SEQ ID NO: 3250166 - protein, 13 aa, Plasmodium falciparum
THNNNNNNISINE

SEQ ID NO: 3250167 - protein, 10 aa, Plasmodium falciparum
THNNNPSNNY

SEQ ID NO: 3250168 - protein, 8 aa, Plasmodium falciparum
THNNNSKN

SEQ ID NO: 3250169 - protein, 6 aa, Plasmodium falciparum
THNNSK

SEQ ID NO: 3250170 - protein, 12 aa, Plasmodium falciparum
THNNSNNNSESD

SEQ ID NO: 3250171 - protein, 5 aa, Plasmodium falciparum
THNSQ

SEQ ID NO: 3250172 - protein, 11 aa, Plasmodium falciparum
THNTSNNVTPP

SEQ ID NO: 3250173 - protein, 6 aa, Plasmodium falciparum
THPFQT

SEQ ID NO: 3250174 - protein, 24 aa, Plasmodium falciparum
THPKQQDGHKNHPEENKNYTYDDK

SEQ ID NO: 3250175 - protein, 4 aa, Plasmodium falciparum
THQD

SEQ ID NO: 3250176 - protein, 6 aa, Plasmodium falciparum
THQNSE

SEQ ID NO: 3250177 - protein, 6 aa, Plasmodium falciparum
THQNYG

SEQ ID NO: 3250178 - protein, 8 aa, Plasmodium falciparum
THRGSTNI

SEQ ID NO: 3250179 - protein, 9 aa, Plasmodium falciparum
THSANGSLE

SEQ ID NO: 3250180 - protein, 5 aa, Plasmodium falciparum
THSDN

SEQ ID NO: 3250181 - protein, 4 aa, Plasmodium falciparum
THSN

SEQ ID NO: 3250182 - protein, 6 aa, Plasmodium falciparum
THTSQT

SEQ ID NO: 3250183 - protein, 24 aa, Plasmodium falciparum
TIDERQKYNNNDDDDDDDDDRRAY

SEQ ID NO: 3250184 - protein, 9 aa, Plasmodium falciparum
TIDKSYKEG

SEQ ID NO: 3250185 - protein, 9 aa, Plasmodium falciparum
TIDNDDNTK

SEQ ID NO: 3250186 - protein, 8 aa, Plasmodium falciparum
TIDNTPNK

SEQ ID NO: 3250187 - protein, 36 aa, Plasmodium falciparum
TIEEEGEGEGEEEEEGEGNNQNRNDHNNDARLNHEQ

SEQ ID NO: 3250188 - protein, 10 aa, Plasmodium falciparum
TIEEESPKKV

SEQ ID NO: 3250189 - protein, 4 aa, Plasmodium falciparum
TIEK

SEQ ID NO: 3250190 - protein, 12 aa, Plasmodium falciparum
TIENKEKENYTS

SEQ ID NO: 3250191 - protein, 31 aa, Plasmodium falciparum
TIENKNNKSIITKEENGLEEKSKSSNKDDEM

SEQ ID NO: 3250192 - protein, 5 aa, Plasmodium falciparum
TIESG

SEQ ID NO: 3250193 - protein, 10 aa, Plasmodium falciparum
TIESTATTCT

SEQ ID NO: 3250194 - protein, 5 aa, Plasmodium falciparum
TIESV

SEQ ID NO: 3250195 - protein, 29 aa, Plasmodium falciparum
TIESYRNKTKRSLSKDKNAGDLSNDNTEE

SEQ ID NO: 3250196 - protein, 15 aa, Plasmodium falciparum
TIGAKYARDDPPYTN

SEQ ID NO: 3250197 - protein, 5 aa, Plasmodium falciparum
TIGPY

SEQ ID NO: 3250198 - protein, 11 aa, Plasmodium falciparum
TIHDKNSNKSR

SEQ ID NO: 3250199 - protein, 4 aa, Plasmodium falciparum
TIHN

SEQ ID NO: 3250200 - protein, 12 aa, Plasmodium falciparum
TIHNKENKDSFK

SEQ ID NO: 3250201 - protein, 8 aa, Plasmodium falciparum
TIHSNNSN

SEQ ID NO: 3250202 - protein, 8 aa, Plasmodium falciparum
TIIKDNDG

SEQ ID NO: 3250203 - protein, 4 aa, Plasmodium falciparum
TIKK

SEQ ID NO: 3250204 - protein, 9 aa, Plasmodium falciparum
TIKKDKKKI

SEQ ID NO: 3250205 - protein, 6 aa, Plasmodium falciparum
TIKNKN

SEQ ID NO: 3250206 - protein, 48 aa, Plasmodium falciparum
TINDDEKKNDEKKNDDKINDDKINDDKINDDKINDDKINDDDKINDDE

SEQ ID NO: 3250207 - protein, 14 aa, Plasmodium falciparum
TINDNKKKNVNSND

SEQ ID NO: 3250208 - protein, 11 aa, Plasmodium falciparum
TINEITQGENY

SEQ ID NO: 3250209 - protein, 12 aa, Plasmodium falciparum
TINENNNNINNR

SEQ ID NO: 3250210 - protein, 9 aa, Plasmodium falciparum
TINGNNNNK

SEQ ID NO: 3250211 - protein, 11 aa, Plasmodium falciparum
TINGSTNKYDN

SEQ ID NO: 3250212 - protein, 35 aa, Plasmodium falciparum
TINKNNNNNNKKDNNNKKDNNNKKDNNNNNNNNYY

SEQ ID NO: 3250213 - protein, 15 aa, Plasmodium falciparum
TINKNNNNNNYQKNR

SEQ ID NO: 3250214 - protein, 34 aa, Plasmodium falciparum
TINKSKVENKINTDDDLSNSKKSKNEKADKNDYY

SEQ ID NO: 3250215 - protein, 7 aa, Plasmodium falciparum
TINNGKK

SEQ ID NO: 3250216 - protein, 5 aa, Plasmodium falciparum
TINNN

SEQ ID NO: 3250217 - protein, 29 aa, Plasmodium falciparum
TINNNNNNIYRGNNSSYKNTCDKNYKDMN

SEQ ID NO: 3250218 - protein, 14 aa, Plasmodium falciparum
TINNNNNNNNFSNH

SEQ ID NO: 3250219 - protein, 33 aa, Plasmodium falciparum
TINNNNNNNNNNNNNNNNNNNNNNNNNNNVDEM

SEQ ID NO: 3250220 - protein, 20 aa, Plasmodium falciparum
TINNNNNNNNNTSSSNHNNN

SEQ ID NO: 3250221 - protein, 9 aa, Plasmodium falciparum
TINNNSNTC

SEQ ID NO: 3250222 - protein, 12 aa, Plasmodium falciparum
TINSNGNYSSTD

SEQ ID NO: 3250223 - protein, 6 aa, Plasmodium falciparum
TINSNR

SEQ ID NO: 3250224 - protein, 14 aa, Plasmodium falciparum
TINYQKNDKNINTN

SEQ ID NO: 3250225 - protein, 6 aa, Plasmodium falciparum
TIPPVT

SEQ ID NO: 3250226 - protein, 5 aa, Plasmodium falciparum
TIPYP

SEQ ID NO: 3250227 - protein, 7 aa, Plasmodium falciparum
TIPYTNA

SEQ ID NO: 3250228 - protein, 5 aa, Plasmodium falciparum
TIQCS

SEQ ID NO: 3250229 - protein, 11 aa, Plasmodium falciparum
TIQKSKEKTDL

SEQ ID NO: 3250230 - protein, 5 aa, Plasmodium falciparum
TIQYE

SEQ ID NO: 3250231 - protein, 10 aa, Plasmodium falciparum
TIQYPKKRSN

SEQ ID NO: 3250232 - protein, 10 aa, Plasmodium falciparum
TIRDGNNNIC

SEQ ID NO: 3250233 - protein, 11 aa, Plasmodium falciparum
TIRKKYKKNNK

SEQ ID NO: 3250234 - protein, 16 aa, Plasmodium falciparum
TIRNEGTANENIPEDE

SEQ ID NO: 3250235 - protein, 7 aa, Plasmodium falciparum
TISKGDK

SEQ ID NO: 3250236 - protein, 6 aa, Plasmodium falciparum
TISNDP

SEQ ID NO: 3250237 - protein, 12 aa, Plasmodium falciparum
TISSNNNNNNIN

SEQ ID NO: 3250238 - protein, 7 aa, Plasmodium falciparum
TITKNDN

SEQ ID NO: 3250239 - protein, 13 aa, Plasmodium falciparum
TITNNKNEGSSNI

SEQ ID NO: 3250240 - protein, 24 aa, Plasmodium falciparum
TITNNNDNNINNQNQNYDDGKKKY

SEQ ID NO: 3250241 - protein, 6 aa, Plasmodium falciparum
TITQEE

SEQ ID NO: 3250242 - protein, 4 aa, Plasmodium falciparum
TITV

SEQ ID NO: 3250243 - protein, 5 aa, Plasmodium falciparum
TIYSK

SEQ ID NO: 3250244 - protein, 22 aa, Plasmodium falciparum
TKAAEEGAKAGALASQNAEANT

SEQ ID NO: 3250245 - protein, 6 aa, Plasmodium falciparum
TKAAID

SEQ ID NO: 3250246 - protein, 9 aa, Plasmodium falciparum
TKAATAAAV

SEQ ID NO: 3250247 - protein, 6 aa, Plasmodium falciparum
TKADKN

SEQ ID NO: 3250248 - protein, 33 aa, Plasmodium falciparum
TKAKKCEENHKPSGNQQQPCQESPSVEDDEEDL

SEQ ID NO: 3250249 - protein, 17 aa, Plasmodium falciparum
TKAKTCPNQANGENQTC

SEQ ID NO: 3250250 - protein, 4 aa, Plasmodium falciparum
TKAN

SEQ ID NO: 3250251 - protein, 21 aa, Plasmodium falciparum
TKANGKKGQKPAKDHYGDDEN

SEQ ID NO: 3250252 - protein, 21 aa, Plasmodium falciparum
TKANGMKGNDIKQNGIKQNEI

SEQ ID NO: 3250253 - protein, 9 aa, Plasmodium falciparum
TKANGNTFK

SEQ ID NO: 3250254 - protein, 22 aa, Plasmodium falciparum
TKASADQENYVPEDDANDESDD

SEQ ID NO: 3250255 - protein, 5 aa, Plasmodium falciparum
TKAST

SEQ ID NO: 3250256 - protein, 30 aa, Plasmodium falciparum
TKATSCQTQHQPSGKPGQTCENPITPPDDE

SEQ ID NO: 3250257 - protein, 5 aa, Plasmodium falciparum
TKATT

SEQ ID NO: 3250258 - protein, 95 aa, Plasmodium falciparum
TKCNSNNCVGNDNKNNDGNNNGNNQNNGGNNKKYNDGNNNGNNQNNGGNNKKYNDGNNNGNNQNNGGNGYDSGDSNNSDKKGSSKKNDKKDEKRN

SEQ ID NO: 3250259 - protein, 8 aa, Plasmodium falciparum
TKCPPRYP

SEQ ID NO: 3250260 - protein, 17 aa, Plasmodium falciparum
TKDAQNYYEDNDTDKNY

SEQ ID NO: 3250261 - protein, 6 aa, Plasmodium falciparum
TKDDIN

SEQ ID NO: 3250262 - protein, 7 aa, Plasmodium falciparum
TKDDKMS

SEQ ID NO: 3250263 - protein, 5 aa, Plasmodium falciparum
TKDDN

SEQ ID NO: 3250264 - protein, 6 aa, Plasmodium falciparum
TKDECE

SEQ ID NO: 3250265 - protein, 9 aa, Plasmodium falciparum
TKDEGNRKI

SEQ ID NO: 3250266 - protein, 9 aa, Plasmodium falciparum
TKDETNGTF

SEQ ID NO: 3250267 - protein, 13 aa, Plasmodium falciparum
TKDGQEGMDDPDY

SEQ ID NO: 3250268 - protein, 5 aa, Plasmodium falciparum
TKDIE

SEQ ID NO: 3250269 - protein, 6 aa, Plasmodium falciparum
TKDIKN

SEQ ID NO: 3250270 - protein, 22 aa, Plasmodium falciparum
TKDKDTTEDKKKNKNKEDTQIN

SEQ ID NO: 3250271 - protein, 29 aa, Plasmodium falciparum
TKDKKKNKKKKKKKNKNKNYNNNNNNNKI

SEQ ID NO: 3250272 - protein, 6 aa, Plasmodium falciparum
TKDNEE

SEQ ID NO: 3250273 - protein, 6 aa, Plasmodium falciparum
TKDNIN

SEQ ID NO: 3250274 - protein, 19 aa, Plasmodium falciparum
TKDNKAGGEDDEDDDDYDG

SEQ ID NO: 3250275 - protein, 6 aa, Plasmodium falciparum
TKDNKK

SEQ ID NO: 3250276 - protein, 13 aa, Plasmodium falciparum
TKDNNSNKSSLKS

SEQ ID NO: 3250277 - protein, 6 aa, Plasmodium falciparum
TKDPNM

SEQ ID NO: 3250278 - protein, 8 aa, Plasmodium falciparum
TKDQARKL

SEQ ID NO: 3250279 - protein, 18 aa, Plasmodium falciparum
TKDQEHTQHEQPNDSAHG

SEQ ID NO: 3250280 - protein, 8 aa, Plasmodium falciparum
TKDQESFS

SEQ ID NO: 3250281 - protein, 5 aa, Plasmodium falciparum
TKDQK

SEQ ID NO: 3250282 - protein, 13 aa, Plasmodium falciparum
TKDQKEGGEDDLD

SEQ ID NO: 3250283 - protein, 15 aa, Plasmodium falciparum
TKDQKEGGEDDPVYD

SEQ ID NO: 3250284 - protein, 7 aa, Plasmodium falciparum
TKDSDNL

SEQ ID NO: 3250285 - protein, 8 aa, Plasmodium falciparum
TKDSKNSD

SEQ ID NO: 3250286 - protein, 6 aa, Plasmodium falciparum
TKDSNI

SEQ ID NO: 3250287 - protein, 8 aa, Plasmodium falciparum
TKDTNARS

SEQ ID NO: 3250288 - protein, 9 aa, Plasmodium falciparum
TKECKNEYE

SEQ ID NO: 3250289 - protein, 7 aa, Plasmodium falciparum
TKEDDHE

SEQ ID NO: 3250290 - protein, 10 aa, Plasmodium falciparum
TKEDKDNVTS

SEQ ID NO: 3250291 - protein, 41 aa, Plasmodium falciparum
TKEEEEEKEEEKDKGDEEEEEEEEEEDEEEEEEAEEEELDD

SEQ ID NO: 3250292 - protein, 7 aa, Plasmodium falciparum
TKEEEYY

SEQ ID NO: 3250293 - protein, 8 aa, Plasmodium falciparum
TKEEKDSM

SEQ ID NO: 3250294 - protein, 11 aa, Plasmodium falciparum
TKEEKKNDINI

SEQ ID NO: 3250295 - protein, 8 aa, Plasmodium falciparum
TKEEKNNI

SEQ ID NO: 3250296 - protein, 13 aa, Plasmodium falciparum
TKEELKKKSKTKI

SEQ ID NO: 3250297 - protein, 5 aa, Plasmodium falciparum
TKEEN

SEQ ID NO: 3250298 - protein, 9 aa, Plasmodium falciparum
TKEENHNVN

SEQ ID NO: 3250299 - protein, 6 aa, Plasmodium falciparum
TKEENK

SEQ ID NO: 3250300 - protein, 4 aa, Plasmodium falciparum
TKEG

SEQ ID NO: 3250301 - protein, 19 aa, Plasmodium falciparum
TKEGGTCTDVNRNKKNTSM

SEQ ID NO: 3250302 - protein, 14 aa, Plasmodium falciparum
TKEGQEGEDDVDDR

SEQ ID NO: 3250303 - protein, 4 aa, Plasmodium falciparum
TKEK

SEQ ID NO: 3250304 - protein, 8 aa, Plasmodium falciparum
TKEKADPM

SEQ ID NO: 3250305 - protein, 11 aa, Plasmodium falciparum
TKEKDKIKKDD

SEQ ID NO: 3250306 - protein, 8 aa, Plasmodium falciparum
TKEKIEEE

SEQ ID NO: 3250307 - protein, 7 aa, Plasmodium falciparum
TKEKNHE

SEQ ID NO: 3250308 - protein, 6 aa, Plasmodium falciparum
TKEKNL

SEQ ID NO: 3250309 - protein, 13 aa, Plasmodium falciparum
TKEKSDVRNSDEF

SEQ ID NO: 3250310 - protein, 6 aa, Plasmodium falciparum
TKEKTR

SEQ ID NO: 3250311 - protein, 7 aa, Plasmodium falciparum
TKELNNK

SEQ ID NO: 3250312 - protein, 4 aa, Plasmodium falciparum
TKEM

SEQ ID NO: 3250313 - protein, 6 aa, Plasmodium falciparum
TKENNI

SEQ ID NO: 3250314 - protein, 7 aa, Plasmodium falciparum
TKENNIK

SEQ ID NO: 3250315 - protein, 70 aa, Plasmodium falciparum
TKENRTLGHEENEKGTPKYNNNNNNNNNNNINNSKGSDSSNGRDSSNGRDSSNGRNSRNGRNGRNGPNNS

SEQ ID NO: 3250316 - protein, 10 aa, Plasmodium falciparum
TKENSYNETD

SEQ ID NO: 3250317 - protein, 6 aa, Plasmodium falciparum
TKENTN

SEQ ID NO: 3250318 - protein, 7 aa, Plasmodium falciparum
TKEPEEK

SEQ ID NO: 3250319 - protein, 10 aa, Plasmodium falciparum
TKEQEKNKEK

SEQ ID NO: 3250320 - protein, 6 aa, Plasmodium falciparum
TKEQID

SEQ ID NO: 3250321 - protein, 7 aa, Plasmodium falciparum
TKEQTTA

SEQ ID NO: 3250322 - protein, 4 aa, Plasmodium falciparum
TKES

SEQ ID NO: 3250323 - protein, 10 aa, Plasmodium falciparum
TKESNIPRDS

SEQ ID NO: 3250324 - protein, 12 aa, Plasmodium falciparum
TKESNNENCRYK

SEQ ID NO: 3250325 - protein, 23 aa, Plasmodium falciparum
TKESSNKEKEKTKKKKERKEKDF

SEQ ID NO: 3250326 - protein, 4 aa, Plasmodium falciparum
TKEW

SEQ ID NO: 3250327 - protein, 12 aa, Plasmodium falciparum
TKEYGKYNNNND

SEQ ID NO: 3250328 - protein, 8 aa, Plasmodium falciparum
TKFEGDGL

SEQ ID NO: 3250329 - protein, 16 aa, Plasmodium falciparum
TKFKENEKQKKNIYTQ

SEQ ID NO: 3250330 - protein, 31 aa, Plasmodium falciparum
TKFKQKEKKNKYEKNDTVTQNSNNTEITKQN

SEQ ID NO: 3250331 - protein, 8 aa, Plasmodium falciparum
TKFNQSNK

SEQ ID NO: 3250332 - protein, 23 aa, Plasmodium falciparum
TKGDNHNDYNDDDINKDKENILN

SEQ ID NO: 3250333 - protein, 14 aa, Plasmodium falciparum
TKGENNEEKKKRSI

SEQ ID NO: 3250334 - protein, 9 aa, Plasmodium falciparum
TKGGEIGTS

SEQ ID NO: 3250335 - protein, 7 aa, Plasmodium falciparum
TKGISQN

SEQ ID NO: 3250336 - protein, 11 aa, Plasmodium falciparum
TKGKKKKPKHI

SEQ ID NO: 3250337 - protein, 5 aa, Plasmodium falciparum
TKGKS

SEQ ID NO: 3250338 - protein, 4 aa, Plasmodium falciparum
TKGL

SEQ ID NO: 3250339 - protein, 7 aa, Plasmodium falciparum
TKGNTHY

SEQ ID NO: 3250340 - protein, 7 aa, Plasmodium falciparum
TKGNTYV

SEQ ID NO: 3250341 - protein, 4 aa, Plasmodium falciparum
TKGR

SEQ ID NO: 3250342 - protein, 8 aa, Plasmodium falciparum
TKGSPINN

SEQ ID NO: 3250343 - protein, 8 aa, Plasmodium falciparum
TKGSYRNI

SEQ ID NO: 3250344 - protein, 9 aa, Plasmodium falciparum
TKGTQRNEK

SEQ ID NO: 3250345 - protein, 5 aa, Plasmodium falciparum
TKGYD

SEQ ID NO: 3250346 - protein, 26 aa, Plasmodium falciparum
TKHKETSGNTCSPPPNPDTQTDTPLP

SEQ ID NO: 3250347 - protein, 7 aa, Plasmodium falciparum
TKHTNTY

SEQ ID NO: 3250348 - protein, 8 aa, Plasmodium falciparum
TKHTTTNR

SEQ ID NO: 3250349 - protein, 17 aa, Plasmodium falciparum
TKHTTTNSIAKQTHTDP

SEQ ID NO: 3250350 - protein, 17 aa, Plasmodium falciparum
TKHTTTNSITKKTHNDP

SEQ ID NO: 3250351 - protein, 22 aa, Plasmodium falciparum
TKHYKKETKKKHLNKNKNNITS

SEQ ID NO: 3250352 - protein, 70 aa, Plasmodium falciparum
TKIEKNKKHEEKNNKHEEKNKKHEEKNKKHEEKNKKHEEKNKKHEEKNKKHEEKNPHESDDEEEEEEDNI

SEQ ID NO: 3250353 - protein, 7 aa, Plasmodium falciparum
TKIENTP

SEQ ID NO: 3250354 - protein, 49 aa, Plasmodium falciparum
TKIKTNNNNDEDNNNDEDNNNDEDNNNDDDNNNNDDHNNNYDNNSNNNL

SEQ ID NO: 3250355 - protein, 13 aa, Plasmodium falciparum
TKIKYKNKKCKGV

SEQ ID NO: 3250356 - protein, 6 aa, Plasmodium falciparum
TKINKS

SEQ ID NO: 3250357 - protein, 5 aa, Plasmodium falciparum
TKINN

SEQ ID NO: 3250358 - protein, 13 aa, Plasmodium falciparum
TKIPSTLNSGDKL

SEQ ID NO: 3250359 - protein, 8 aa, Plasmodium falciparum
TKIQDSKK

SEQ ID NO: 3250360 - protein, 36 aa, Plasmodium falciparum
TKIQGEDEESEDENEHTNGHQNKHQNKHQNKHQNKH

SEQ ID NO: 3250361 - protein, 13 aa, Plasmodium falciparum
TKISAEDKDSFSC

SEQ ID NO: 3250362 - protein, 15 aa, Plasmodium falciparum
TKKCSNNLSNKNESV

SEQ ID NO: 3250363 - protein, 4 aa, Plasmodium falciparum
TKKD

SEQ ID NO: 3250364 - protein, 15 aa, Plasmodium falciparum
TKKEGKDKNESHENF

SEQ ID NO: 3250365 - protein, 25 aa, Plasmodium falciparum
TKKEINEEKENTNEEEKEKKEVEDA

SEQ ID NO: 3250366 - protein, 5 aa, Plasmodium falciparum
TKKEN

SEQ ID NO: 3250367 - protein, 13 aa, Plasmodium falciparum
TKKERIKDVTTSN

SEQ ID NO: 3250368 - protein, 16 aa, Plasmodium falciparum
TKKERQKIKSRERKYE

SEQ ID NO: 3250369 - protein, 6 aa, Plasmodium falciparum
TKKEST

SEQ ID NO: 3250370 - protein, 13 aa, Plasmodium falciparum
TKKGGKKIPAPPP

SEQ ID NO: 3250371 - protein, 13 aa, Plasmodium falciparum
TKKGKDKDNKKTH

SEQ ID NO: 3250372 - protein, 21 aa, Plasmodium falciparum
TKKGNTNMRNNNNINNNNRNH

SEQ ID NO: 3250373 - protein, 20 aa, Plasmodium falciparum
TKKINEKKSHELSNKNMDDI

SEQ ID NO: 3250374 - protein, 15 aa, Plasmodium falciparum
TKKINRSNNNYNNSS

SEQ ID NO: 3250375 - protein, 22 aa, Plasmodium falciparum
TKKKGRNGKKSALQERYNDPKG

SEQ ID NO: 3250376 - protein, 12 aa, Plasmodium falciparum
TKKKKDGSNKNK

SEQ ID NO: 3250377 - protein, 9 aa, Plasmodium falciparum
TKKKKEGDF

SEQ ID NO: 3250378 - protein, 9 aa, Plasmodium falciparum
TKKKKNIDN

SEQ ID NO: 3250379 - protein, 7 aa, Plasmodium falciparum
TKKKKNK

SEQ ID NO: 3250380 - protein, 13 aa, Plasmodium falciparum
TKKKKRKKKKKRI

SEQ ID NO: 3250381 - protein, 19 aa, Plasmodium falciparum
TKKKNNNNNNIKNDSQDNH

SEQ ID NO: 3250382 - protein, 6 aa, Plasmodium falciparum
TKKKRK

SEQ ID NO: 3250383 - protein, 8 aa, Plasmodium falciparum
TKKKSFPS

SEQ ID NO: 3250384 - protein, 9 aa, Plasmodium falciparum
TKKKTKNIS

SEQ ID NO: 3250385 - protein, 6 aa, Plasmodium falciparum
TKKLYS

SEQ ID NO: 3250386 - protein, 12 aa, Plasmodium falciparum
TKKMRKSDISEK

SEQ ID NO: 3250387 - protein, 8 aa, Plasmodium falciparum
TKKNDQDI

SEQ ID NO: 3250388 - protein, 20 aa, Plasmodium falciparum
TKKNENDYIDDNEKSKNYMD

SEQ ID NO: 3250389 - protein, 12 aa, Plasmodium falciparum
TKKNESEKKKRK

SEQ ID NO: 3250390 - protein, 8 aa, Plasmodium falciparum
TKKNETKI

SEQ ID NO: 3250391 - protein, 5 aa, Plasmodium falciparum
TKKNL

SEQ ID NO: 3250392 - protein, 29 aa, Plasmodium falciparum
TKKNNKINDHNNNNNKMDYSTTSRDSSTC

SEQ ID NO: 3250393 - protein, 11 aa, Plasmodium falciparum
TKKNNKKKNMN

SEQ ID NO: 3250394 - protein, 18 aa, Plasmodium falciparum
TKKNNKNNLRKDKDNALY

SEQ ID NO: 3250395 - protein, 9 aa, Plasmodium falciparum
TKKNNNHNE

SEQ ID NO: 3250396 - protein, 8 aa, Plasmodium falciparum
TKKNTPFD

SEQ ID NO: 3250397 - protein, 8 aa, Plasmodium falciparum
TKKNVKKT

SEQ ID NO: 3250398 - protein, 8 aa, Plasmodium falciparum
TKKQECEN

SEQ ID NO: 3250399 - protein, 8 aa, Plasmodium falciparum
TKKQYKNR

SEQ ID NO: 3250400 - protein, 5 aa, Plasmodium falciparum
TKKRG

SEQ ID NO: 3250401 - protein, 8 aa, Plasmodium falciparum
TKKRHKEA

SEQ ID NO: 3250402 - protein, 11 aa, Plasmodium falciparum
TKKRIKDRAQL

SEQ ID NO: 3250403 - protein, 12 aa, Plasmodium falciparum
TKKRKAHEQNES

SEQ ID NO: 3250404 - protein, 11 aa, Plasmodium falciparum
TKKRKKKTNYI

SEQ ID NO: 3250405 - protein, 8 aa, Plasmodium falciparum
TKKRKNKN

SEQ ID NO: 3250406 - protein, 9 aa, Plasmodium falciparum
TKKRNSNDL

SEQ ID NO: 3250407 - protein, 9 aa, Plasmodium falciparum
TKKSKERKQ

SEQ ID NO: 3250408 - protein, 5 aa, Plasmodium falciparum
TKKSN

SEQ ID NO: 3250409 - protein, 8 aa, Plasmodium falciparum
TKKSSPYV

SEQ ID NO: 3250410 - protein, 33 aa, Plasmodium falciparum
TKKTEYDKQKSAYEQQQGKCEKENNGAEGNDHD

SEQ ID NO: 3250411 - protein, 6 aa, Plasmodium falciparum
TKKYNE

SEQ ID NO: 3250412 - protein, 6 aa, Plasmodium falciparum
TKLDKR

SEQ ID NO: 3250413 - protein, 4 aa, Plasmodium falciparum
TKLE

SEQ ID NO: 3250414 - protein, 4 aa, Plasmodium falciparum
TKLI

SEQ ID NO: 3250415 - protein, 6 aa, Plasmodium falciparum
TKLKKD

SEQ ID NO: 3250416 - protein, 12 aa, Plasmodium falciparum
TKLSEKEKQVYD

SEQ ID NO: 3250417 - protein, 12 aa, Plasmodium falciparum
TKLTKTKGKDKY

SEQ ID NO: 3250418 - protein, 17 aa, Plasmodium falciparum
TKMKPNNNNNNNNNNTY

SEQ ID NO: 3250419 - protein, 8 aa, Plasmodium falciparum
TKNDENGT

SEQ ID NO: 3250420 - protein, 5 aa, Plasmodium falciparum
TKNEA

SEQ ID NO: 3250421 - protein, 9 aa, Plasmodium falciparum
TKNEEGDDE

SEQ ID NO: 3250422 - protein, 8 aa, Plasmodium falciparum
TKNEHEEH

SEQ ID NO: 3250423 - protein, 6 aa, Plasmodium falciparum
TKNEHV

SEQ ID NO: 3250424 - protein, 28 aa, Plasmodium falciparum
TKNEKIKNDKKKIEKIKNEKEKNEKTKN

SEQ ID NO: 3250425 - protein, 6 aa, Plasmodium falciparum
TKNESN

SEQ ID NO: 3250426 - protein, 5 aa, Plasmodium falciparum
TKNGD

SEQ ID NO: 3250427 - protein, 9 aa, Plasmodium falciparum
TKNGKGSKC

SEQ ID NO: 3250428 - protein, 24 aa, Plasmodium falciparum
TKNGNKSSSEQEDYEKYSYSNNIS

SEQ ID NO: 3250429 - protein, 21 aa, Plasmodium falciparum
TKNGSVVGGGSGGGNSDSKEL

SEQ ID NO: 3250430 - protein, 5 aa, Plasmodium falciparum
TKNGT

SEQ ID NO: 3250431 - protein, 5 aa, Plasmodium falciparum
TKNHE

SEQ ID NO: 3250432 - protein, 11 aa, Plasmodium falciparum
TKNISEGKNSF

SEQ ID NO: 3250433 - protein, 14 aa, Plasmodium falciparum
TKNKEQNENYKKTS

SEQ ID NO: 3250434 - protein, 21 aa, Plasmodium falciparum
TKNKITDKNKNDHNNTKDEIE

SEQ ID NO: 3250435 - protein, 6 aa, Plasmodium falciparum
TKNKKG

SEQ ID NO: 3250436 - protein, 10 aa, Plasmodium falciparum
TKNKKKKKNY

SEQ ID NO: 3250437 - protein, 10 aa, Plasmodium falciparum
TKNKKYSNNC

SEQ ID NO: 3250438 - protein, 16 aa, Plasmodium falciparum
TKNKLDTLKREKKDME

SEQ ID NO: 3250439 - protein, 20 aa, Plasmodium falciparum
TKNKREKKDEDDDEDNKTNK

SEQ ID NO: 3250440 - protein, 8 aa, Plasmodium falciparum
TKNLKKEG

SEQ ID NO: 3250441 - protein, 6 aa, Plasmodium falciparum
TKNLSD

SEQ ID NO: 3250442 - protein, 18 aa, Plasmodium falciparum
TKNMTNKKHGNKQKNKNT

SEQ ID NO: 3250443 - protein, 9 aa, Plasmodium falciparum
TKNNKNEAI

SEQ ID NO: 3250444 - protein, 7 aa, Plasmodium falciparum
TKNNNNI

SEQ ID NO: 3250445 - protein, 16 aa, Plasmodium falciparum
TKNNNNNNNNNNNDSV

SEQ ID NO: 3250446 - protein, 11 aa, Plasmodium falciparum
TKNNNVKKKNN

SEQ ID NO: 3250447 - protein, 7 aa, Plasmodium falciparum
TKNNPRH

SEQ ID NO: 3250448 - protein, 7 aa, Plasmodium falciparum
TKNNRQE

SEQ ID NO: 3250449 - protein, 6 aa, Plasmodium falciparum
TKNNTS

SEQ ID NO: 3250450 - protein, 9 aa, Plasmodium falciparum
TKNNTYDKI

SEQ ID NO: 3250451 - protein, 4 aa, Plasmodium falciparum
TKNP

SEQ ID NO: 3250452 - protein, 7 aa, Plasmodium falciparum
TKNPRGY

SEQ ID NO: 3250453 - protein, 4 aa, Plasmodium falciparum
TKNQ

SEQ ID NO: 3250454 - protein, 7 aa, Plasmodium falciparum
TKNRRTY

SEQ ID NO: 3250455 - protein, 8 aa, Plasmodium falciparum
TKNRSNSI

SEQ ID NO: 3250456 - protein, 11 aa, Plasmodium falciparum
TKNSKHNSTHT

SEQ ID NO: 3250457 - protein, 8 aa, Plasmodium falciparum
TKNSKIPC

SEQ ID NO: 3250458 - protein, 8 aa, Plasmodium falciparum
TKNSNREN

SEQ ID NO: 3250459 - protein, 5 aa, Plasmodium falciparum
TKNSR

SEQ ID NO: 3250460 - protein, 7 aa, Plasmodium falciparum
TKNTRNK

SEQ ID NO: 3250461 - protein, 9 aa, Plasmodium falciparum
TKNTVKGDY

SEQ ID NO: 3250462 - protein, 7 aa, Plasmodium falciparum
TKNYKKT

SEQ ID NO: 3250463 - protein, 6 aa, Plasmodium falciparum
TKNYNV

SEQ ID NO: 3250464 - protein, 6 aa, Plasmodium falciparum
TKPDSY

SEQ ID NO: 3250465 - protein, 8 aa, Plasmodium falciparum
TKPEKTNK

SEQ ID NO: 3250466 - protein, 11 aa, Plasmodium falciparum
TKPFLRPTSEQ

SEQ ID NO: 3250467 - protein, 5 aa, Plasmodium falciparum
TKPGN

SEQ ID NO: 3250468 - protein, 9 aa, Plasmodium falciparum
TKPKGKGIY

SEQ ID NO: 3250469 - protein, 4 aa, Plasmodium falciparum
TKPN

SEQ ID NO: 3250470 - protein, 15 aa, Plasmodium falciparum
TKPNKIQKDINESND

SEQ ID NO: 3250471 - protein, 9 aa, Plasmodium falciparum
TKPNKKEYT

SEQ ID NO: 3250472 - protein, 23 aa, Plasmodium falciparum
TKPNNNSSEESHQNEQMKEQNKN

SEQ ID NO: 3250473 - protein, 28 aa, Plasmodium falciparum
TKPNSDNKGEVGSAGRVARSAPSGEKGS

SEQ ID NO: 3250474 - protein, 11 aa, Plasmodium falciparum
TKPNTIRTPQN

SEQ ID NO: 3250475 - protein, 11 aa, Plasmodium falciparum
TKPQENSTSIL

SEQ ID NO: 3250476 - protein, 7 aa, Plasmodium falciparum
TKPTERR

SEQ ID NO: 3250477 - protein, 15 aa, Plasmodium falciparum
TKQAKEEHTKKKHIS

SEQ ID NO: 3250478 - protein, 12 aa, Plasmodium falciparum
TKQEELKNRTVE

SEQ ID NO: 3250479 - protein, 15 aa, Plasmodium falciparum
TKQEHEEKKRKKIQE

SEQ ID NO: 3250480 - protein, 6 aa, Plasmodium falciparum
TKQKDI

SEQ ID NO: 3250481 - protein, 11 aa, Plasmodium falciparum
TKQKEGKENCS

SEQ ID NO: 3250482 - protein, 7 aa, Plasmodium falciparum
TKQKKKK

SEQ ID NO: 3250483 - protein, 10 aa, Plasmodium falciparum
TKQKKNSDHN

SEQ ID NO: 3250484 - protein, 5 aa, Plasmodium falciparum
TKQNN

SEQ ID NO: 3250485 - protein, 7 aa, Plasmodium falciparum
TKQNNSI

SEQ ID NO: 3250486 - protein, 8 aa, Plasmodium falciparum
TKQNYEAE

SEQ ID NO: 3250487 - protein, 77 aa, Plasmodium falciparum
TKQPQPEKEDGCEAAPTTAEETSPTATSEGTENQSPPPPPPAPAPAPAPAPEKSQPKEDKKVEPQPKPQPTNPPPNL

SEQ ID NO: 3250488 - protein, 9 aa, Plasmodium falciparum
TKQTKNLKN

SEQ ID NO: 3250489 - protein, 4 aa, Plasmodium falciparum
TKQY

SEQ ID NO: 3250490 - protein, 6 aa, Plasmodium falciparum
TKRATI

SEQ ID NO: 3250491 - protein, 4 aa, Plasmodium falciparum
TKRC

SEQ ID NO: 3250492 - protein, 7 aa, Plasmodium falciparum
TKREETL

SEQ ID NO: 3250493 - protein, 6 aa, Plasmodium falciparum
TKRGIT

SEQ ID NO: 3250494 - protein, 7 aa, Plasmodium falciparum
TKRGNVN

SEQ ID NO: 3250495 - protein, 10 aa, Plasmodium falciparum
TKRKNEKKEK

SEQ ID NO: 3250496 - protein, 9 aa, Plasmodium falciparum
TKRKNTNIN

SEQ ID NO: 3250497 - protein, 22 aa, Plasmodium falciparum
TKRKRKKKRKKKRKKKRKTKGK

SEQ ID NO: 3250498 - protein, 5 aa, Plasmodium falciparum
TKRLD

SEQ ID NO: 3250499 - protein, 7 aa, Plasmodium falciparum
TKRNNSA

SEQ ID NO: 3250500 - protein, 9 aa, Plasmodium falciparum
TKRPKNEHI

SEQ ID NO: 3250501 - protein, 6 aa, Plasmodium falciparum
TKRRDN

SEQ ID NO: 3250502 - protein, 16 aa, Plasmodium falciparum
TKRRKKKKKKKKKKKK

SEQ ID NO: 3250503 - protein, 6 aa, Plasmodium falciparum
TKRTTI

SEQ ID NO: 3250504 - protein, 4 aa, Plasmodium falciparum
TKRV

SEQ ID NO: 3250505 - protein, 6 aa, Plasmodium falciparum
TKSDAE

SEQ ID NO: 3250506 - protein, 17 aa, Plasmodium falciparum
TKSDKYDEKENKSNDNI

SEQ ID NO: 3250507 - protein, 5 aa, Plasmodium falciparum
TKSDN

SEQ ID NO: 3250508 - protein, 14 aa, Plasmodium falciparum
TKSFTNPKCGHGDN

SEQ ID NO: 3250509 - protein, 4 aa, Plasmodium falciparum
TKSG

SEQ ID NO: 3250510 - protein, 4 aa, Plasmodium falciparum
TKSI

SEQ ID NO: 3250511 - protein, 5 aa, Plasmodium falciparum
TKSKD

SEQ ID NO: 3250512 - protein, 14 aa, Plasmodium falciparum
TKSKEIEKKENMSS

SEQ ID NO: 3250513 - protein, 17 aa, Plasmodium falciparum
TKSKGRNKKNVKKKKQV

SEQ ID NO: 3250514 - protein, 20 aa, Plasmodium falciparum
TKSKNQGTSENKSPEVTTSP

SEQ ID NO: 3250515 - protein, 6 aa, Plasmodium falciparum
TKSKSD

SEQ ID NO: 3250516 - protein, 5 aa, Plasmodium falciparum
TKSLE

SEQ ID NO: 3250517 - protein, 5 aa, Plasmodium falciparum
TKSLG

SEQ ID NO: 3250518 - protein, 8 aa, Plasmodium falciparum
TKSLYENG

SEQ ID NO: 3250519 - protein, 5 aa, Plasmodium falciparum
TKSNE

SEQ ID NO: 3250520 - protein, 9 aa, Plasmodium falciparum
TKSNGRKNS

SEQ ID NO: 3250521 - protein, 12 aa, Plasmodium falciparum
TKSNKKKISENT

SEQ ID NO: 3250522 - protein, 7 aa, Plasmodium falciparum
TKSNNDE

SEQ ID NO: 3250523 - protein, 14 aa, Plasmodium falciparum
TKSNNEQKKKQPVL

SEQ ID NO: 3250524 - protein, 15 aa, Plasmodium falciparum
TKSNNIYNNNNNQLS

SEQ ID NO: 3250525 - protein, 8 aa, Plasmodium falciparum
TKSNNNIN

SEQ ID NO: 3250526 - protein, 117 aa, Plasmodium falciparum
TKSNNNRNDFGGEDSDSSHNKNNEEYSYDESEEEEKKNEKEKKKKKEKEKEKEKEKEKEREKEKEKEREKEREKEREKEREKEREKEREKEREKEREKQNNDNIQNENYSNKPNISD

SEQ ID NO: 3250527 - protein, 8 aa, Plasmodium falciparum
TKSRHDIG

SEQ ID NO: 3250528 - protein, 9 aa, Plasmodium falciparum
TKSRTKKKR

SEQ ID NO: 3250529 - protein, 8 aa, Plasmodium falciparum
TKSSFASD

SEQ ID NO: 3250530 - protein, 17 aa, Plasmodium falciparum
TKSSGGKPGKNETDQVP

SEQ ID NO: 3250531 - protein, 9 aa, Plasmodium falciparum
TKSSLTSYN

SEQ ID NO: 3250532 - protein, 6 aa, Plasmodium falciparum
TKSSLY

SEQ ID NO: 3250533 - protein, 8 aa, Plasmodium falciparum
TKSTLDKA

SEQ ID NO: 3250534 - protein, 5 aa, Plasmodium falciparum
TKSTM

SEQ ID NO: 3250535 - protein, 6 aa, Plasmodium falciparum
TKTAEF

SEQ ID NO: 3250536 - protein, 6 aa, Plasmodium falciparum
TKTAEI

SEQ ID NO: 3250537 - protein, 5 aa, Plasmodium falciparum
TKTAT

SEQ ID NO: 3250538 - protein, 15 aa, Plasmodium falciparum
TKTCSNKNIEPTEDN

SEQ ID NO: 3250539 - protein, 6 aa, Plasmodium falciparum
TKTDTH

SEQ ID NO: 3250540 - protein, 10 aa, Plasmodium falciparum
TKTEDDKRED

SEQ ID NO: 3250541 - protein, 5 aa, Plasmodium falciparum
TKTEN

SEQ ID NO: 3250542 - protein, 24 aa, Plasmodium falciparum
TKTENDDKKNKKQTNTGATTPSFT

SEQ ID NO: 3250543 - protein, 8 aa, Plasmodium falciparum
TKTESEKM

SEQ ID NO: 3250544 - protein, 6 aa, Plasmodium falciparum
TKTGEI

SEQ ID NO: 3250545 - protein, 6 aa, Plasmodium falciparum
TKTGNK

SEQ ID NO: 3250546 - protein, 8 aa, Plasmodium falciparum
TKTGSYPK

SEQ ID NO: 3250547 - protein, 23 aa, Plasmodium falciparum
TKTKEDEEKKKKKKKKKNLYKDE

SEQ ID NO: 3250548 - protein, 8 aa, Plasmodium falciparum
TKTKENEN

SEQ ID NO: 3250549 - protein, 6 aa, Plasmodium falciparum
TKTKHN

SEQ ID NO: 3250550 - protein, 9 aa, Plasmodium falciparum
TKTKIKNEE

SEQ ID NO: 3250551 - protein, 4 aa, Plasmodium falciparum
TKTL

SEQ ID NO: 3250552 - protein, 7 aa, Plasmodium falciparum
TKTNESV

SEQ ID NO: 3250553 - protein, 8 aa, Plasmodium falciparum
TKTQSGSL

SEQ ID NO: 3250554 - protein, 6 aa, Plasmodium falciparum
TKTRIG

SEQ ID NO: 3250555 - protein, 4 aa, Plasmodium falciparum
TKTS

SEQ ID NO: 3250556 - protein, 16 aa, Plasmodium falciparum
TKTSENPTQGNEQERQ

SEQ ID NO: 3250557 - protein, 14 aa, Plasmodium falciparum
TKTSNDVCYTLISN

SEQ ID NO: 3250558 - protein, 6 aa, Plasmodium falciparum
TKTTDI

SEQ ID NO: 3250559 - protein, 20 aa, Plasmodium falciparum
TKTTTEKVTTELTTEKTGEI

SEQ ID NO: 3250560 - protein, 4 aa, Plasmodium falciparum
TKTY

SEQ ID NO: 3250561 - protein, 5 aa, Plasmodium falciparum
TKVER

SEQ ID NO: 3250562 - protein, 7 aa, Plasmodium falciparum
TKVGAEN

SEQ ID NO: 3250563 - protein, 5 aa, Plasmodium falciparum
TKVKN

SEQ ID NO: 3250564 - protein, 4 aa, Plasmodium falciparum
TKYA

SEQ ID NO: 3250565 - protein, 7 aa, Plasmodium falciparum
TKYAPPE

SEQ ID NO: 3250566 - protein, 11 aa, Plasmodium falciparum
TKYDKYGKEKF

SEQ ID NO: 3250567 - protein, 10 aa, Plasmodium falciparum
TKYEKGREKF

SEQ ID NO: 3250568 - protein, 10 aa, Plasmodium falciparum
TKYGPKAPTS

SEQ ID NO: 3250569 - protein, 9 aa, Plasmodium falciparum
TKYKDSGST

SEQ ID NO: 3250570 - protein, 11 aa, Plasmodium falciparum
TKYKNGKEKYT

SEQ ID NO: 3250571 - protein, 4 aa, Plasmodium falciparum
TKYN

SEQ ID NO: 3250572 - protein, 7 aa, Plasmodium falciparum
TKYPKKK

SEQ ID NO: 3250573 - protein, 4 aa, Plasmodium falciparum
TKYS

SEQ ID NO: 3250574 - protein, 4 aa, Plasmodium falciparum
TKYT

SEQ ID NO: 3250575 - protein, 5 aa, Plasmodium falciparum
TKYTD

SEQ ID NO: 3250576 - protein, 6 aa, Plasmodium falciparum
TKYTND

SEQ ID NO: 3250577 - protein, 13 aa, Plasmodium falciparum
TKYTQPKRNERKL

SEQ ID NO: 3250578 - protein, 6 aa, Plasmodium falciparum
TLAQKQ

SEQ ID NO: 3250579 - protein, 10 aa, Plasmodium falciparum
TLDDQPEEDM

SEQ ID NO: 3250580 - protein, 18 aa, Plasmodium falciparum
TLDDTLPNNTPVLSPTDL

SEQ ID NO: 3250581 - protein, 16 aa, Plasmodium falciparum
TLEATQKLDEQSKNIA

SEQ ID NO: 3250582 - protein, 11 aa, Plasmodium falciparum
TLEEKKKNKNK

SEQ ID NO: 3250583 - protein, 5 aa, Plasmodium falciparum
TLEGQ

SEQ ID NO: 3250584 - protein, 11 aa, Plasmodium falciparum
TLEKKENKSCN

SEQ ID NO: 3250585 - protein, 17 aa, Plasmodium falciparum
TLEKKKKEKGANISEEK

SEQ ID NO: 3250586 - protein, 14 aa, Plasmodium falciparum
TLENINPNDNIKEK

SEQ ID NO: 3250587 - protein, 12 aa, Plasmodium falciparum
TLENNESACSSH

SEQ ID NO: 3250588 - protein, 21 aa, Plasmodium falciparum
TLENSGEQNPQKKLQESGEIP

SEQ ID NO: 3250589 - protein, 9 aa, Plasmodium falciparum
TLENTRDDT

SEQ ID NO: 3250590 - protein, 11 aa, Plasmodium falciparum
TLESKNKTSDI

SEQ ID NO: 3250591 - protein, 8 aa, Plasmodium falciparum
TLGDSEVT

SEQ ID NO: 3250592 - protein, 4 aa, Plasmodium falciparum
TLGG

SEQ ID NO: 3250593 - protein, 5 aa, Plasmodium falciparum
TLGGN

SEQ ID NO: 3250594 - protein, 5 aa, Plasmodium falciparum
TLGGQ

SEQ ID NO: 3250595 - protein, 10 aa, Plasmodium falciparum
TLGSAGKVPT

SEQ ID NO: 3250596 - protein, 5 aa, Plasmodium falciparum
TLKDG

SEQ ID NO: 3250597 - protein, 4 aa, Plasmodium falciparum
TLKE

SEQ ID NO: 3250598 - protein, 4 aa, Plasmodium falciparum
TLKN

SEQ ID NO: 3250599 - protein, 26 aa, Plasmodium falciparum
TLMNNDNDKINTKTTKKTKKEKTTKC

SEQ ID NO: 3250600 - protein, 13 aa, Plasmodium falciparum
TLNDESKNVNVNN

SEQ ID NO: 3250601 - protein, 7 aa, Plasmodium falciparum
TLNDNNI

SEQ ID NO: 3250602 - protein, 27 aa, Plasmodium falciparum
TLNKKDKKKISSNKKKGISKRDSNQFS

SEQ ID NO: 3250603 - protein, 9 aa, Plasmodium falciparum
TLNKKKKKK

SEQ ID NO: 3250604 - protein, 34 aa, Plasmodium falciparum
TLNNNDNNLGGKENQNVVQSKEDDTYINRSNNNK

SEQ ID NO: 3250605 - protein, 20 aa, Plasmodium falciparum
TLNNNLNKNEMNKVDDDPKG

SEQ ID NO: 3250606 - protein, 10 aa, Plasmodium falciparum
TLNPEEKKNY

SEQ ID NO: 3250607 - protein, 12 aa, Plasmodium falciparum
TLNSENCTNNVN

SEQ ID NO: 3250608 - protein, 5 aa, Plasmodium falciparum
TLNSN

SEQ ID NO: 3250609 - protein, 6 aa, Plasmodium falciparum
TLNTQY

SEQ ID NO: 3250610 - protein, 4 aa, Plasmodium falciparum
TLPQ

SEQ ID NO: 3250611 - protein, 19 aa, Plasmodium falciparum
TLPRNNTADFTPQRYDTDQ

SEQ ID NO: 3250612 - protein, 7 aa, Plasmodium falciparum
TLPSQMD

SEQ ID NO: 3250613 - protein, 8 aa, Plasmodium falciparum
TLPTKTAA

SEQ ID NO: 3250614 - protein, 6 aa, Plasmodium falciparum
TLPTTD

SEQ ID NO: 3250615 - protein, 11 aa, Plasmodium falciparum
TLQGNSQTGST

SEQ ID NO: 3250616 - protein, 9 aa, Plasmodium falciparum
TLQKEQEQI

SEQ ID NO: 3250617 - protein, 6 aa, Plasmodium falciparum
TLQPEK

SEQ ID NO: 3250618 - protein, 5 aa, Plasmodium falciparum
TLRED

SEQ ID NO: 3250619 - protein, 6 aa, Plasmodium falciparum
TLRKSN

SEQ ID NO: 3250620 - protein, 30 aa, Plasmodium falciparum
TLRNDSNNSNYDHNNTCESINSSNEYNNNY

SEQ ID NO: 3250621 - protein, 16 aa, Plasmodium falciparum
TLRSKKKGSNENISKE

SEQ ID NO: 3250622 - protein, 8 aa, Plasmodium falciparum
TLSDDDNK

SEQ ID NO: 3250623 - protein, 6 aa, Plasmodium falciparum
TLSDKN

SEQ ID NO: 3250624 - protein, 6 aa, Plasmodium falciparum
TLSGEE

SEQ ID NO: 3250625 - protein, 11 aa, Plasmodium falciparum
TLSGGESAFTE

SEQ ID NO: 3250626 - protein, 12 aa, Plasmodium falciparum
TLSGGESAFTEN

SEQ ID NO: 3250627 - protein, 7 aa, Plasmodium falciparum
TLSGNKN

SEQ ID NO: 3250628 - protein, 7 aa, Plasmodium falciparum
TLSKDKS

SEQ ID NO: 3250629 - protein, 55 aa, Plasmodium falciparum
TLSKKNRYDDDKDINDYTTKYNRKNNKKNNRKNNKKNNRKNNRKNNKNNDNNNIN

SEQ ID NO: 3250630 - protein, 4 aa, Plasmodium falciparum
TLSN

SEQ ID NO: 3250631 - protein, 6 aa, Plasmodium falciparum
TLSNTS

SEQ ID NO: 3250632 - protein, 4 aa, Plasmodium falciparum
TLSP

SEQ ID NO: 3250633 - protein, 7 aa, Plasmodium falciparum
TLSSGIT

SEQ ID NO: 3250634 - protein, 9 aa, Plasmodium falciparum
TLSSHEKSY

SEQ ID NO: 3250635 - protein, 5 aa, Plasmodium falciparum
TLSTP

SEQ ID NO: 3250636 - protein, 6 aa, Plasmodium falciparum
TLTEQI

SEQ ID NO: 3250637 - protein, 9 aa, Plasmodium falciparum
TLTKDKAKK

SEQ ID NO: 3250638 - protein, 4 aa, Plasmodium falciparum
TLTN

SEQ ID NO: 3250639 - protein, 10 aa, Plasmodium falciparum
TLTNTNNLDN

SEQ ID NO: 3250640 - protein, 10 aa, Plasmodium falciparum
TLTPKNDKKD

SEQ ID NO: 3250641 - protein, 5 aa, Plasmodium falciparum
TLTSE

SEQ ID NO: 3250642 - protein, 7 aa, Plasmodium falciparum
TLTTKSS

SEQ ID NO: 3250643 - protein, 14 aa, Plasmodium falciparum
TLYNSGGVTTTEST

SEQ ID NO: 3250644 - protein, 14 aa, Plasmodium falciparum
TMENQTYDQKCTSI

SEQ ID NO: 3250645 - protein, 6 aa, Plasmodium falciparum
TMEREN

SEQ ID NO: 3250646 - protein, 70 aa, Plasmodium falciparum
TMGGNNPMGGYNPMGGNNPMGGYNPMGGNNTMGGNNPMGGYNPMGGYNPMGGYNPMGGYNPMGGNTNEAN

SEQ ID NO: 3250647 - protein, 8 aa, Plasmodium falciparum
TMGQPTED

SEQ ID NO: 3250648 - protein, 13 aa, Plasmodium falciparum
TMKNKTKKNTRRK

SEQ ID NO: 3250649 - protein, 4 aa, Plasmodium falciparum
TMKR

SEQ ID NO: 3250650 - protein, 20 aa, Plasmodium falciparum
TMNNKISSSPYHNEQPDDVY

SEQ ID NO: 3250651 - protein, 9 aa, Plasmodium falciparum
TMSSGKKEL

SEQ ID NO: 3250652 - protein, 9 aa, Plasmodium falciparum
TMSSSDMNN

SEQ ID NO: 3250653 - protein, 9 aa, Plasmodium falciparum
TMSTELETQ

SEQ ID NO: 3250654 - protein, 14 aa, Plasmodium falciparum
TNADEEDSEECDQY

SEQ ID NO: 3250655 - protein, 4 aa, Plasmodium falciparum
TNAE

SEQ ID NO: 3250656 - protein, 14 aa, Plasmodium falciparum
TNANANANANANAN

SEQ ID NO: 3250657 - protein, 10 aa, Plasmodium falciparum
TNANDNKNHL

SEQ ID NO: 3250658 - protein, 12 aa, Plasmodium falciparum
TNAPDKGSYDRD

SEQ ID NO: 3250659 - protein, 10 aa, Plasmodium falciparum
TNASSPTSSI

SEQ ID NO: 3250660 - protein, 5 aa, Plasmodium falciparum
TNASV

SEQ ID NO: 3250661 - protein, 19 aa, Plasmodium falciparum
TNATNGKSYPCRTGKEERF

SEQ ID NO: 3250662 - protein, 6 aa, Plasmodium falciparum
TNATNV

SEQ ID NO: 3250663 - protein, 5 aa, Plasmodium falciparum
TNCDQ

SEQ ID NO: 3250664 - protein, 6 aa, Plasmodium falciparum
TNCEKN

SEQ ID NO: 3250665 - protein, 20 aa, Plasmodium falciparum
TNCHTNSDTNNDTNNDTQNN

SEQ ID NO: 3250666 - protein, 12 aa, Plasmodium falciparum
TNCRNDEEQRYC

SEQ ID NO: 3250667 - protein, 9 aa, Plasmodium falciparum
TNCSENDEK

SEQ ID NO: 3250668 - protein, 13 aa, Plasmodium falciparum
TNCTSQEKKENNT

SEQ ID NO: 3250669 - protein, 6 aa, Plasmodium falciparum
TNDDEM

SEQ ID NO: 3250670 - protein, 9 aa, Plasmodium falciparum
TNDDEMNNH

SEQ ID NO: 3250671 - protein, 17 aa, Plasmodium falciparum
TNDDEMNNHAKNDDEQI

SEQ ID NO: 3250672 - protein, 8 aa, Plasmodium falciparum
TNDDKENE

SEQ ID NO: 3250673 - protein, 5 aa, Plasmodium falciparum
TNDDN

SEQ ID NO: 3250674 - protein, 4 aa, Plasmodium falciparum
TNDE

SEQ ID NO: 3250675 - protein, 7 aa, Plasmodium falciparum
TNDEKEI

SEQ ID NO: 3250676 - protein, 133 aa, Plasmodium falciparum
TNDETYRNDGDVNNKNGYNNNEHSNSSNERSNNNGDNNNNNHNNNNHNNNHHNNGSNNHNGNNNSNNDDNDKDDDKKGNDKKNEDKDDENKSDDDNDDDKKNGDGLNRSLDTKKRKEKSKNKNKMKPDNTLNE

SEQ ID NO: 3250677 - protein, 18 aa, Plasmodium falciparum
TNDIHNNNNNNNNNSGIS

SEQ ID NO: 3250678 - protein, 5 aa, Plasmodium falciparum
TNDIR

SEQ ID NO: 3250679 - protein, 8 aa, Plasmodium falciparum
TNDIRTND

SEQ ID NO: 3250680 - protein, 10 aa, Plasmodium falciparum
TNDKESKNEI

SEQ ID NO: 3250681 - protein, 16 aa, Plasmodium falciparum
TNDKGGPNKVTDKNNN

SEQ ID NO: 3250682 - protein, 9 aa, Plasmodium falciparum
TNDKKKIKD

SEQ ID NO: 3250683 - protein, 45 aa, Plasmodium falciparum
TNDKREYGKGDDKYHGPCTGKGTSQKRFEIETPWETKNDDVNQNH

SEQ ID NO: 3250684 - protein, 44 aa, Plasmodium falciparum
TNDKREYGKGDDKYHRPCTGKGTGQKRFEIGTPWETKKDDINQN

SEQ ID NO: 3250685 - protein, 10 aa, Plasmodium falciparum
TNDKTSDIIN

SEQ ID NO: 3250686 - protein, 11 aa, Plasmodium falciparum
TNDNESKLKHQ

SEQ ID NO: 3250687 - protein, 9 aa, Plasmodium falciparum
TNDNKNKMF

SEQ ID NO: 3250688 - protein, 7 aa, Plasmodium falciparum
TNDNNEG

SEQ ID NO: 3250689 - protein, 10 aa, Plasmodium falciparum
TNDNNTNNNI

SEQ ID NO: 3250690 - protein, 21 aa, Plasmodium falciparum
TNDPHGNNQQYNEENTNPNIS

SEQ ID NO: 3250691 - protein, 10 aa, Plasmodium falciparum
TNDPPDENTN

SEQ ID NO: 3250692 - protein, 10 aa, Plasmodium falciparum
TNDPYQETHA

SEQ ID NO: 3250693 - protein, 5 aa, Plasmodium falciparum
TNDRN

SEQ ID NO: 3250694 - protein, 5 aa, Plasmodium falciparum
TNDSD

SEQ ID NO: 3250695 - protein, 12 aa, Plasmodium falciparum
TNDSHIKSEQND

SEQ ID NO: 3250696 - protein, 6 aa, Plasmodium falciparum
TNDSIG

SEQ ID NO: 3250697 - protein, 5 aa, Plasmodium falciparum
TNDSS

SEQ ID NO: 3250698 - protein, 4 aa, Plasmodium falciparum
TNDT

SEQ ID NO: 3250699 - protein, 10 aa, Plasmodium falciparum
TNDVQRNDKG

SEQ ID NO: 3250700 - protein, 17 aa, Plasmodium falciparum
TNDYEENEKRSSQNKTN

SEQ ID NO: 3250701 - protein, 12 aa, Plasmodium falciparum
TNDYNKEKKIKE

SEQ ID NO: 3250702 - protein, 13 aa, Plasmodium falciparum
TNEAKYTPTVDNS

SEQ ID NO: 3250703 - protein, 9 aa, Plasmodium falciparum
TNEAPTGFK

SEQ ID NO: 3250704 - protein, 11 aa, Plasmodium falciparum
TNECTEKEKNV

SEQ ID NO: 3250705 - protein, 8 aa, Plasmodium falciparum
TNEEDVTV

SEQ ID NO: 3250706 - protein, 9 aa, Plasmodium falciparum
TNEEENKKY

SEQ ID NO: 3250707 - protein, 6 aa, Plasmodium falciparum
TNEEHN

SEQ ID NO: 3250708 - protein, 11 aa, Plasmodium falciparum
TNEEKKPLEEN

SEQ ID NO: 3250709 - protein, 11 aa, Plasmodium falciparum
TNEESEKNSLL

SEQ ID NO: 3250710 - protein, 9 aa, Plasmodium falciparum
TNEGKSDDF

SEQ ID NO: 3250711 - protein, 6 aa, Plasmodium falciparum
TNEGNI

SEQ ID NO: 3250712 - protein, 16 aa, Plasmodium falciparum
TNEGNYQNRATSHSRY

SEQ ID NO: 3250713 - protein, 4 aa, Plasmodium falciparum
TNEH

SEQ ID NO: 3250714 - protein, 4 aa, Plasmodium falciparum
TNEK

SEQ ID NO: 3250715 - protein, 9 aa, Plasmodium falciparum
TNEKCNEEK

SEQ ID NO: 3250716 - protein, 13 aa, Plasmodium falciparum
TNEKEKKKNTHVD

SEQ ID NO: 3250717 - protein, 41 aa, Plasmodium falciparum
TNEKINTNEKINTNEKINTNEKINTNEKINTNEKINTNEKI

SEQ ID NO: 3250718 - protein, 7 aa, Plasmodium falciparum
TNEKNMG

SEQ ID NO: 3250719 - protein, 6 aa, Plasmodium falciparum
TNEKTQ

SEQ ID NO: 3250720 - protein, 5 aa, Plasmodium falciparum
TNELD

SEQ ID NO: 3250721 - protein, 22 aa, Plasmodium falciparum
TNELKKKNIGKENLTNDENKTK

SEQ ID NO: 3250722 - protein, 4 aa, Plasmodium falciparum
TNEN

SEQ ID NO: 3250723 - protein, 11 aa, Plasmodium falciparum
TNENDDDNNDP

SEQ ID NO: 3250724 - protein, 19 aa, Plasmodium falciparum
TNENNIKSGNNKNTGEDNK

SEQ ID NO: 3250725 - protein, 7 aa, Plasmodium falciparum
TNENNVP

SEQ ID NO: 3250726 - protein, 6 aa, Plasmodium falciparum
TNENRK

SEQ ID NO: 3250727 - protein, 5 aa, Plasmodium falciparum
TNENV

SEQ ID NO: 3250728 - protein, 8 aa, Plasmodium falciparum
TNEPHNVE

SEQ ID NO: 3250729 - protein, 7 aa, Plasmodium falciparum
TNEPNNY

SEQ ID NO: 3250730 - protein, 4 aa, Plasmodium falciparum
TNEQ

SEQ ID NO: 3250731 - protein, 6 aa, Plasmodium falciparum
TNEQEV

SEQ ID NO: 3250732 - protein, 24 aa, Plasmodium falciparum
TNEQNNVNNMNQNNNNNNNNNSDN

SEQ ID NO: 3250733 - protein, 5 aa, Plasmodium falciparum
TNEQY

SEQ ID NO: 3250734 - protein, 5 aa, Plasmodium falciparum
TNESL

SEQ ID NO: 3250735 - protein, 9 aa, Plasmodium falciparum
TNESTEKDK

SEQ ID NO: 3250736 - protein, 9 aa, Plasmodium falciparum
TNETNKSMN

SEQ ID NO: 3250737 - protein, 15 aa, Plasmodium falciparum
TNETYQEITTTKQLS

SEQ ID NO: 3250738 - protein, 8 aa, Plasmodium falciparum
TNEYTNDN

SEQ ID NO: 3250739 - protein, 10 aa, Plasmodium falciparum
TNEYYNKDET

SEQ ID NO: 3250740 - protein, 6 aa, Plasmodium falciparum
TNFDPK

SEQ ID NO: 3250741 - protein, 11 aa, Plasmodium falciparum
TNFNKNQKHNT

SEQ ID NO: 3250742 - protein, 4 aa, Plasmodium falciparum
TNFP

SEQ ID NO: 3250743 - protein, 4 aa, Plasmodium falciparum
TNGC

SEQ ID NO: 3250744 - protein, 13 aa, Plasmodium falciparum
TNGEENGKKQKTF

SEQ ID NO: 3250745 - protein, 125 aa, Plasmodium falciparum
TNGENNTTNNGKKNDDHRNKKKEYNSNENNNYCNNNSNRNNNNNNNNSHFGGNKNNRGDDNDEDDQEKNNKRNIYGKNGDDEEEDYDGEDDNNEENDHNNKKNIKRKNKKSNKAYNNNDDENKCI

SEQ ID NO: 3250746 - protein, 6 aa, Plasmodium falciparum
TNGFEP

SEQ ID NO: 3250747 - protein, 6 aa, Plasmodium falciparum
TNGHTS

SEQ ID NO: 3250748 - protein, 16 aa, Plasmodium falciparum
TNGKEKVNKQKTSHEM

SEQ ID NO: 3250749 - protein, 11 aa, Plasmodium falciparum
TNGKENVNKQK

SEQ ID NO: 3250750 - protein, 24 aa, Plasmodium falciparum
TNGKIYQKNKRPSQINRKNTNKQA

SEQ ID NO: 3250751 - protein, 5 aa, Plasmodium falciparum
TNGKR

SEQ ID NO: 3250752 - protein, 9 aa, Plasmodium falciparum
TNGKSSERK

SEQ ID NO: 3250753 - protein, 8 aa, Plasmodium falciparum
TNGNKQVN

SEQ ID NO: 3250754 - protein, 46 aa, Plasmodium falciparum
TNGNNNNDNKNDNNNDNNNDNNNDNNNDNNNDNNNDNNNDNSCDNS

SEQ ID NO: 3250755 - protein, 9 aa, Plasmodium falciparum
TNGNTTGKC

SEQ ID NO: 3250756 - protein, 15 aa, Plasmodium falciparum
TNGRNGVKDHYQDTT

SEQ ID NO: 3250757 - protein, 4 aa, Plasmodium falciparum
TNGS

SEQ ID NO: 3250758 - protein, 5 aa, Plasmodium falciparum
TNGSI

SEQ ID NO: 3250759 - protein, 11 aa, Plasmodium falciparum
TNGSYKKEQPF

SEQ ID NO: 3250760 - protein, 8 aa, Plasmodium falciparum
TNGTALAS

SEQ ID NO: 3250761 - protein, 8 aa, Plasmodium falciparum
TNGTKDVN

SEQ ID NO: 3250762 - protein, 17 aa, Plasmodium falciparum
TNHDTEQSVENKLDEDK

SEQ ID NO: 3250763 - protein, 5 aa, Plasmodium falciparum
TNHHN

SEQ ID NO: 3250764 - protein, 4 aa, Plasmodium falciparum
TNHK

SEQ ID NO: 3250765 - protein, 4 aa, Plasmodium falciparum
TNHN

SEQ ID NO: 3250766 - protein, 31 aa, Plasmodium falciparum
TNHNDRSDDSSTWGCTDRNNTKIATTKGRDK

SEQ ID NO: 3250767 - protein, 11 aa, Plasmodium falciparum
TNHTSEYKDED

SEQ ID NO: 3250768 - protein, 7 aa, Plasmodium falciparum
TNIDSND

SEQ ID NO: 3250769 - protein, 6 aa, Plasmodium falciparum
TNIETN

SEQ ID NO: 3250770 - protein, 4 aa, Plasmodium falciparum
TNIK

SEQ ID NO: 3250771 - protein, 10 aa, Plasmodium falciparum
TNIKDGDKHI

SEQ ID NO: 3250772 - protein, 12 aa, Plasmodium falciparum
TNIKKTKKRNQN

SEQ ID NO: 3250773 - protein, 5 aa, Plasmodium falciparum
TNIKN

SEQ ID NO: 3250774 - protein, 4 aa, Plasmodium falciparum
TNIN

SEQ ID NO: 3250775 - protein, 13 aa, Plasmodium falciparum
TNINDNENSNLAS

SEQ ID NO: 3250776 - protein, 9 aa, Plasmodium falciparum
TNINDPLSS

SEQ ID NO: 3250777 - protein, 78 aa, Plasmodium falciparum
TNINNDNNINNNNNINNDNNINNDNNINNDNNINNDNNINNDNNINNDNNINNDNNINNDNNINNDNINNNNNNNSLY

SEQ ID NO: 3250778 - protein, 19 aa, Plasmodium falciparum
TNINNNNNNNNNNKTDPCK

SEQ ID NO: 3250779 - protein, 17 aa, Plasmodium falciparum
TNINTNKNTNKKGDDYL

SEQ ID NO: 3250780 - protein, 7 aa, Plasmodium falciparum
TNIPEDL

SEQ ID NO: 3250781 - protein, 10 aa, Plasmodium falciparum
TNIQNGENNT

SEQ ID NO: 3250782 - protein, 8 aa, Plasmodium falciparum
TNIRSKTN

SEQ ID NO: 3250783 - protein, 11 aa, Plasmodium falciparum
TNISDDKNVSK

SEQ ID NO: 3250784 - protein, 10 aa, Plasmodium falciparum
TNISDNTPMD

SEQ ID NO: 3250785 - protein, 21 aa, Plasmodium falciparum
TNISKSSSRNISKSSSRSISD

SEQ ID NO: 3250786 - protein, 6 aa, Plasmodium falciparum
TNISPQ

SEQ ID NO: 3250787 - protein, 6 aa, Plasmodium falciparum
TNISSN

SEQ ID NO: 3250788 - protein, 26 aa, Plasmodium falciparum
TNISSSLSNSLDEKKKKKKIKKNNST

SEQ ID NO: 3250789 - protein, 25 aa, Plasmodium falciparum
TNITKKKRNYNVDPKKNKVIMDMDE

SEQ ID NO: 3250790 - protein, 17 aa, Plasmodium falciparum
TNITKQNSSSPERGYRR

SEQ ID NO: 3250791 - protein, 27 aa, Plasmodium falciparum
TNKCKNNKKPKIKNKQKQKKNNPKKKI

SEQ ID NO: 3250792 - protein, 6 aa, Plasmodium falciparum
TNKCNE

SEQ ID NO: 3250793 - protein, 12 aa, Plasmodium falciparum
TNKDDNNNVMGD

SEQ ID NO: 3250794 - protein, 9 aa, Plasmodium falciparum
TNKDQPCDI

SEQ ID NO: 3250795 - protein, 4 aa, Plasmodium falciparum
TNKE

SEQ ID NO: 3250796 - protein, 10 aa, Plasmodium falciparum
TNKEGTKQTG

SEQ ID NO: 3250797 - protein, 5 aa, Plasmodium falciparum
TNKEN

SEQ ID NO: 3250798 - protein, 9 aa, Plasmodium falciparum
TNKENEREN

SEQ ID NO: 3250799 - protein, 10 aa, Plasmodium falciparum
TNKENSKDEH

SEQ ID NO: 3250800 - protein, 10 aa, Plasmodium falciparum
TNKENVSQED

SEQ ID NO: 3250801 - protein, 8 aa, Plasmodium falciparum
TNKESAIK

SEQ ID NO: 3250802 - protein, 10 aa, Plasmodium falciparum
TNKESSGSNI

SEQ ID NO: 3250803 - protein, 11 aa, Plasmodium falciparum
TNKETNDITQD

SEQ ID NO: 3250804 - protein, 5 aa, Plasmodium falciparum
TNKFS

SEQ ID NO: 3250805 - protein, 7 aa, Plasmodium falciparum
TNKGNVK

SEQ ID NO: 3250806 - protein, 10 aa, Plasmodium falciparum
TNKHSNKNIH

SEQ ID NO: 3250807 - protein, 5 aa, Plasmodium falciparum
TNKIN

SEQ ID NO: 3250808 - protein, 14 aa, Plasmodium falciparum
TNKKDNKKNEKGTK

SEQ ID NO: 3250809 - protein, 9 aa, Plasmodium falciparum
TNKKEENSN

SEQ ID NO: 3250810 - protein, 10 aa, Plasmodium falciparum
TNKKEKHDVN

SEQ ID NO: 3250811 - protein, 7 aa, Plasmodium falciparum
TNKKEND

SEQ ID NO: 3250812 - protein, 15 aa, Plasmodium falciparum
TNKKHTKYSNENDKA

SEQ ID NO: 3250813 - protein, 9 aa, Plasmodium falciparum
TNKKKNAYI

SEQ ID NO: 3250814 - protein, 9 aa, Plasmodium falciparum
TNKKKNDEQ

SEQ ID NO: 3250815 - protein, 10 aa, Plasmodium falciparum
TNKKNVNHSM

SEQ ID NO: 3250816 - protein, 7 aa, Plasmodium falciparum
TNKKQIP

SEQ ID NO: 3250817 - protein, 48 aa, Plasmodium falciparum
TNKKTHNEQNKNSQGKGEETQNINQNENKNKIKNSTNKKKKKKNQTQK

SEQ ID NO: 3250818 - protein, 26 aa, Plasmodium falciparum
TNKLNDQKNNVSTKNIKPSGRDKNNT

SEQ ID NO: 3250819 - protein, 29 aa, Plasmodium falciparum
TNKMNNTNKMNNTNKMNNTNKMNNTNKMN

SEQ ID NO: 3250820 - protein, 10 aa, Plasmodium falciparum
TNKNETIDKN

SEQ ID NO: 3250821 - protein, 5 aa, Plasmodium falciparum
TNKNI

SEQ ID NO: 3250822 - protein, 10 aa, Plasmodium falciparum
TNKNISNDNI

SEQ ID NO: 3250823 - protein, 7 aa, Plasmodium falciparum
TNKNITK

SEQ ID NO: 3250824 - protein, 5 aa, Plasmodium falciparum
TNKNN

SEQ ID NO: 3250825 - protein, 17 aa, Plasmodium falciparum
TNKNNKKDEENKENNAT

SEQ ID NO: 3250826 - protein, 9 aa, Plasmodium falciparum
TNKNNNINN

SEQ ID NO: 3250827 - protein, 9 aa, Plasmodium falciparum
TNKNSNNKL

SEQ ID NO: 3250828 - protein, 8 aa, Plasmodium falciparum
TNKNTPID

SEQ ID NO: 3250829 - protein, 8 aa, Plasmodium falciparum
TNKNYNNK

SEQ ID NO: 3250830 - protein, 5 aa, Plasmodium falciparum
TNKPL

SEQ ID NO: 3250831 - protein, 14 aa, Plasmodium falciparum
TNKQCEKKSLTNEQ

SEQ ID NO: 3250832 - protein, 8 aa, Plasmodium falciparum
TNKQKKNV

SEQ ID NO: 3250833 - protein, 17 aa, Plasmodium falciparum
TNKRNYSLQGQRNKEDI

SEQ ID NO: 3250834 - protein, 6 aa, Plasmodium falciparum
TNKSSK

SEQ ID NO: 3250835 - protein, 7 aa, Plasmodium falciparum
TNKTEQD

SEQ ID NO: 3250836 - protein, 18 aa, Plasmodium falciparum
TNKYIKDENKKLNKTHVD

SEQ ID NO: 3250837 - protein, 9 aa, Plasmodium falciparum
TNKYKNSNK

SEQ ID NO: 3250838 - protein, 12 aa, Plasmodium falciparum
TNLDINEKKKND

SEQ ID NO: 3250839 - protein, 14 aa, Plasmodium falciparum
TNLDTNQNDSNSQI

SEQ ID NO: 3250840 - protein, 5 aa, Plasmodium falciparum
TNLHP

SEQ ID NO: 3250841 - protein, 8 aa, Plasmodium falciparum
TNLKKEEY

SEQ ID NO: 3250842 - protein, 5 aa, Plasmodium falciparum
TNLKS

SEQ ID NO: 3250843 - protein, 11 aa, Plasmodium falciparum
TNLQNSRTNQY

SEQ ID NO: 3250844 - protein, 10 aa, Plasmodium falciparum
TNLSHDKNGD

SEQ ID NO: 3250845 - protein, 6 aa, Plasmodium falciparum
TNLSTL

SEQ ID NO: 3250846 - protein, 4 aa, Plasmodium falciparum
TNLT

SEQ ID NO: 3250847 - protein, 70 aa, Plasmodium falciparum
TNMNENNNNSNKNNNSNKNNNSNKNNNSNKNNNSNKNNNSNKNNNSNKNNNSNNGNSNEGNGKGGDPKNM

SEQ ID NO: 3250848 - protein, 7 aa, Plasmodium falciparum
TNMNNSN

SEQ ID NO: 3250849 - protein, 28 aa, Plasmodium falciparum
TNMSSSPSLSLNNTTNTIGGNINSSGQN

SEQ ID NO: 3250850 - protein, 10 aa, Plasmodium falciparum
TNNAIDTNNP

SEQ ID NO: 3250851 - protein, 91 aa, Plasmodium falciparum
TNNASNSEEKKNKKKKNKKKKKIKKNKDNDKDDNKDDNKDDDKDDDKDDAKDDAKDDTKDDDNNNNYNNNIKNSSNVTPYDSQKKKKQKFK

SEQ ID NO: 3250852 - protein, 4 aa, Plasmodium falciparum
TNNC

SEQ ID NO: 3250853 - protein, 6 aa, Plasmodium falciparum
TNNDDK

SEQ ID NO: 3250854 - protein, 13 aa, Plasmodium falciparum
TNNDDKYEEKKKK

SEQ ID NO: 3250855 - protein, 7 aa, Plasmodium falciparum
TNNDIQK

SEQ ID NO: 3250856 - protein, 15 aa, Plasmodium falciparum
TNNDNNKEKDNTKDI

SEQ ID NO: 3250857 - protein, 23 aa, Plasmodium falciparum
TNNDQNSSSNSSIFTGTNNHSTI

SEQ ID NO: 3250858 - protein, 9 aa, Plasmodium falciparum
TNNDYKSKT

SEQ ID NO: 3250859 - protein, 8 aa, Plasmodium falciparum
TNNEGENH

SEQ ID NO: 3250860 - protein, 20 aa, Plasmodium falciparum
TNNEKSDSLQKDDGKGNVKY

SEQ ID NO: 3250861 - protein, 93 aa, Plasmodium falciparum
TNNEYNDNNNNNDNNNDNNNNNNDNNNDNNNNNDNNNDNNNDNNNNNYNNNNNNNNNNNNNNNNYNNNNNGGGDRNDENNDKDKKEDNDNDNI

SEQ ID NO: 3250862 - protein, 5 aa, Plasmodium falciparum
TNNFT

SEQ ID NO: 3250863 - protein, 4 aa, Plasmodium falciparum
TNNG

SEQ ID NO: 3250864 - protein, 9 aa, Plasmodium falciparum
TNNGLNEEE

SEQ ID NO: 3250865 - protein, 6 aa, Plasmodium falciparum
TNNGNT

SEQ ID NO: 3250866 - protein, 7 aa, Plasmodium falciparum
TNNGQLH

SEQ ID NO: 3250867 - protein, 9 aa, Plasmodium falciparum
TNNKCNKSP

SEQ ID NO: 3250868 - protein, 9 aa, Plasmodium falciparum
TNNKDSSSL

SEQ ID NO: 3250869 - protein, 9 aa, Plasmodium falciparum
TNNKKKNKK

SEQ ID NO: 3250870 - protein, 10 aa, Plasmodium falciparum
TNNKMKTDSY

SEQ ID NO: 3250871 - protein, 15 aa, Plasmodium falciparum
TNNKNNDSKIKRTLQ

SEQ ID NO: 3250872 - protein, 29 aa, Plasmodium falciparum
TNNKNNTTTSNNNITTTTTNSSNIHNNSS

SEQ ID NO: 3250873 - protein, 8 aa, Plasmodium falciparum
TNNKPSYY

SEQ ID NO: 3250874 - protein, 6 aa, Plasmodium falciparum
TNNKSK

SEQ ID NO: 3250875 - protein, 18 aa, Plasmodium falciparum
TNNKSSQEFSSSNTSNID

SEQ ID NO: 3250876 - protein, 17 aa, Plasmodium falciparum
TNNKTTELDKAKEREQR

SEQ ID NO: 3250877 - protein, 16 aa, Plasmodium falciparum
TNNKYDNNNNKNNLVN

SEQ ID NO: 3250878 - protein, 12 aa, Plasmodium falciparum
TNNKYYKKQTQP

SEQ ID NO: 3250879 - protein, 27 aa, Plasmodium falciparum
TNNLSNESYPINEKKKKNEDNGCKSNS

SEQ ID NO: 3250880 - protein, 8 aa, Plasmodium falciparum
TNNMEDNK

SEQ ID NO: 3250881 - protein, 5 aa, Plasmodium falciparum
TNNMN

SEQ ID NO: 3250882 - protein, 9 aa, Plasmodium falciparum
TNNMNNHDN

SEQ ID NO: 3250883 - protein, 5 aa, Plasmodium falciparum
TNNNC

SEQ ID NO: 3250884 - protein, 75 aa, Plasmodium falciparum
TNNNDIRKSADDVNKNGDDMNKNSDDMNKNSDDLNKNGDDMNKNSDGINNNGDDLNKNGDGINNNGDDMNKNSDG

SEQ ID NO: 3250885 - protein, 15 aa, Plasmodium falciparum
TNNNDKEELKNKKKE

SEQ ID NO: 3250886 - protein, 24 aa, Plasmodium falciparum
TNNNEHSQTLDNNNNNDNNNNNNI

SEQ ID NO: 3250887 - protein, 9 aa, Plasmodium falciparum
TNNNEQSPC

SEQ ID NO: 3250888 - protein, 16 aa, Plasmodium falciparum
TNNNGEEKRKKRKYYE

SEQ ID NO: 3250889 - protein, 5 aa, Plasmodium falciparum
TNNNI

SEQ ID NO: 3250890 - protein, 27 aa, Plasmodium falciparum
TNNNIKKKRKKKKKKKKKKEKKNVHED

SEQ ID NO: 3250891 - protein, 16 aa, Plasmodium falciparum
TNNNKDSCVEEGKNKF

SEQ ID NO: 3250892 - protein, 7 aa, Plasmodium falciparum
TNNNKEK

SEQ ID NO: 3250893 - protein, 8 aa, Plasmodium falciparum
TNNNNNIE

SEQ ID NO: 3250894 - protein, 11 aa, Plasmodium falciparum
TNNNNNNNNED

SEQ ID NO: 3250895 - protein, 21 aa, Plasmodium falciparum
TNNNNNNNNNNDNNIGDNHNN

SEQ ID NO: 3250896 - protein, 45 aa, Plasmodium falciparum
TNNNNNNNNNNNDNNENNENNENNENNENNSYYNNEGEKNTYNQN

SEQ ID NO: 3250897 - protein, 17 aa, Plasmodium falciparum
TNNNNNNNNNNNNNNNN

SEQ ID NO: 3250898 - protein, 25 aa, Plasmodium falciparum
TNNNNNNNNNNNNNNNNNNSNNNNI

SEQ ID NO: 3250899 - protein, 9 aa, Plasmodium falciparum
TNNNTYSNR

SEQ ID NO: 3250900 - protein, 9 aa, Plasmodium falciparum
TNNNVNEKK

SEQ ID NO: 3250901 - protein, 6 aa, Plasmodium falciparum
TNNNYD

SEQ ID NO: 3250902 - protein, 5 aa, Plasmodium falciparum
TNNPI

SEQ ID NO: 3250903 - protein, 6 aa, Plasmodium falciparum
TNNPID

SEQ ID NO: 3250904 - protein, 5 aa, Plasmodium falciparum
TNNPN

SEQ ID NO: 3250905 - protein, 16 aa, Plasmodium falciparum
TNNPNYSFNNTKGSNV

SEQ ID NO: 3250906 - protein, 8 aa, Plasmodium falciparum
TNNPSVDE

SEQ ID NO: 3250907 - protein, 6 aa, Plasmodium falciparum
TNNPYM

SEQ ID NO: 3250908 - protein, 6 aa, Plasmodium falciparum
TNNQNK

SEQ ID NO: 3250909 - protein, 8 aa, Plasmodium falciparum
TNNQPSLN

SEQ ID NO: 3250910 - protein, 13 aa, Plasmodium falciparum
TNNSITRETSLNE

SEQ ID NO: 3250911 - protein, 7 aa, Plasmodium falciparum
TNNSKND

SEQ ID NO: 3250912 - protein, 8 aa, Plasmodium falciparum
TNNSNNPI

SEQ ID NO: 3250913 - protein, 12 aa, Plasmodium falciparum
TNNTQHNPKQKN

SEQ ID NO: 3250914 - protein, 12 aa, Plasmodium falciparum
TNNTSIRKNDEK

SEQ ID NO: 3250915 - protein, 9 aa, Plasmodium falciparum
TNNTSTNNI

SEQ ID NO: 3250916 - protein, 10 aa, Plasmodium falciparum
TNNVPNNTNN

SEQ ID NO: 3250917 - protein, 7 aa, Plasmodium falciparum
TNNVTNK

SEQ ID NO: 3250918 - protein, 4 aa, Plasmodium falciparum
TNNY

SEQ ID NO: 3250919 - protein, 10 aa, Plasmodium falciparum
TNNYDNDTDM

SEQ ID NO: 3250920 - protein, 12 aa, Plasmodium falciparum
TNNYNKKEDIGE

SEQ ID NO: 3250921 - protein, 13 aa, Plasmodium falciparum
TNPISKNKYETNF

SEQ ID NO: 3250922 - protein, 8 aa, Plasmodium falciparum
TNPKGQYK

SEQ ID NO: 3250923 - protein, 22 aa, Plasmodium falciparum
TNPKKGNYTKGNINNSNKSYKN

SEQ ID NO: 3250924 - protein, 12 aa, Plasmodium falciparum
TNPKNKKVNESS

SEQ ID NO: 3250925 - protein, 22 aa, Plasmodium falciparum
TNPLNASSTNNLNSNNNMNQAP

SEQ ID NO: 3250926 - protein, 4 aa, Plasmodium falciparum
TNPN

SEQ ID NO: 3250927 - protein, 14 aa, Plasmodium falciparum
TNPQNAQEEYQNYK

SEQ ID NO: 3250928 - protein, 25 aa, Plasmodium falciparum
TNPQNNKDKNDASNKNNNPNNSSTP

SEQ ID NO: 3250929 - protein, 6 aa, Plasmodium falciparum
TNPVDP

SEQ ID NO: 3250930 - protein, 5 aa, Plasmodium falciparum
TNPYY

SEQ ID NO: 3250931 - protein, 8 aa, Plasmodium falciparum
TNQARLPN

SEQ ID NO: 3250932 - protein, 10 aa, Plasmodium falciparum
TNQCTNKTYD

SEQ ID NO: 3250933 - protein, 7 aa, Plasmodium falciparum
TNQDEDI

SEQ ID NO: 3250934 - protein, 8 aa, Plasmodium falciparum
TNQDKRKD

SEQ ID NO: 3250935 - protein, 7 aa, Plasmodium falciparum
TNQDKTI

SEQ ID NO: 3250936 - protein, 6 aa, Plasmodium falciparum
TNQEER

SEQ ID NO: 3250937 - protein, 13 aa, Plasmodium falciparum
TNQENIKQKHRIQ

SEQ ID NO: 3250938 - protein, 5 aa, Plasmodium falciparum
TNQFN

SEQ ID NO: 3250939 - protein, 6 aa, Plasmodium falciparum
TNQKGD

SEQ ID NO: 3250940 - protein, 5 aa, Plasmodium falciparum
TNQKP

SEQ ID NO: 3250941 - protein, 9 aa, Plasmodium falciparum
TNQKQDTTY

SEQ ID NO: 3250942 - protein, 6 aa, Plasmodium falciparum
TNQKVA

SEQ ID NO: 3250943 - protein, 16 aa, Plasmodium falciparum
TNQNKKNNSQKDQHGN

SEQ ID NO: 3250944 - protein, 7 aa, Plasmodium falciparum
TNQNRKY

SEQ ID NO: 3250945 - protein, 11 aa, Plasmodium falciparum
TNQQKNQIKSN

SEQ ID NO: 3250946 - protein, 11 aa, Plasmodium falciparum
TNQQNDIKNDY

SEQ ID NO: 3250947 - protein, 11 aa, Plasmodium falciparum
TNQQNEQNNKD

SEQ ID NO: 3250948 - protein, 5 aa, Plasmodium falciparum
TNQVT

SEQ ID NO: 3250949 - protein, 17 aa, Plasmodium falciparum
TNQYNEIGKKENEVKQV

SEQ ID NO: 3250950 - protein, 10 aa, Plasmodium falciparum
TNQYPNNDFN

SEQ ID NO: 3250951 - protein, 15 aa, Plasmodium falciparum
TNRESITTNVEGRRD

SEQ ID NO: 3250952 - protein, 8 aa, Plasmodium falciparum
TNRKNKDF

SEQ ID NO: 3250953 - protein, 10 aa, Plasmodium falciparum
TNRKRTRTIT

SEQ ID NO: 3250954 - protein, 13 aa, Plasmodium falciparum
TNRNGSSNINNNK

SEQ ID NO: 3250955 - protein, 8 aa, Plasmodium falciparum
TNRNQTPD

SEQ ID NO: 3250956 - protein, 8 aa, Plasmodium falciparum
TNRPNSID

SEQ ID NO: 3250957 - protein, 6 aa, Plasmodium falciparum
TNRQTA

SEQ ID NO: 3250958 - protein, 4 aa, Plasmodium falciparum
TNRR

SEQ ID NO: 3250959 - protein, 12 aa, Plasmodium falciparum
TNRRDEQNDQTI

SEQ ID NO: 3250960 - protein, 5 aa, Plasmodium falciparum
TNRRG

SEQ ID NO: 3250961 - protein, 14 aa, Plasmodium falciparum
TNRRNKIKGNKNAS

SEQ ID NO: 3250962 - protein, 6 aa, Plasmodium falciparum
TNRTNN

SEQ ID NO: 3250963 - protein, 6 aa, Plasmodium falciparum
TNRVDN

SEQ ID NO: 3250964 - protein, 4 aa, Plasmodium falciparum
TNSA

SEQ ID NO: 3250965 - protein, 23 aa, Plasmodium falciparum
TNSDDNLSTSNKSNNKEQKQIKR

SEQ ID NO: 3250966 - protein, 13 aa, Plasmodium falciparum
TNSDGNDNDDIDN

SEQ ID NO: 3250967 - protein, 14 aa, Plasmodium falciparum
TNSEDETSNRKGNG

SEQ ID NO: 3250968 - protein, 7 aa, Plasmodium falciparum
TNSEDNL

SEQ ID NO: 3250969 - protein, 8 aa, Plasmodium falciparum
TNSENRRK

SEQ ID NO: 3250970 - protein, 6 aa, Plasmodium falciparum
TNSERC

SEQ ID NO: 3250971 - protein, 9 aa, Plasmodium falciparum
TNSETKSIS

SEQ ID NO: 3250972 - protein, 13 aa, Plasmodium falciparum
TNSHNDTSSLSIS

SEQ ID NO: 3250973 - protein, 5 aa, Plasmodium falciparum
TNSID

SEQ ID NO: 3250974 - protein, 6 aa, Plasmodium falciparum
TNSIPY

SEQ ID NO: 3250975 - protein, 4 aa, Plasmodium falciparum
TNSK

SEQ ID NO: 3250976 - protein, 16 aa, Plasmodium falciparum
TNSKKKIVTSDGNHNN

SEQ ID NO: 3250977 - protein, 20 aa, Plasmodium falciparum
TNSKNNKDRNVKKGNEDSNI

SEQ ID NO: 3250978 - protein, 8 aa, Plasmodium falciparum
TNSKQEKQ

SEQ ID NO: 3250979 - protein, 6 aa, Plasmodium falciparum
TNSLRK

SEQ ID NO: 3250980 - protein, 9 aa, Plasmodium falciparum
TNSMDDPTY

SEQ ID NO: 3250981 - protein, 9 aa, Plasmodium falciparum
TNSMDDTSY

SEQ ID NO: 3250982 - protein, 4 aa, Plasmodium falciparum
TNSN

SEQ ID NO: 3250983 - protein, 5 aa, Plasmodium falciparum
TNSNK

SEQ ID NO: 3250984 - protein, 11 aa, Plasmodium falciparum
TNSNSKEIYKG

SEQ ID NO: 3250985 - protein, 14 aa, Plasmodium falciparum
TNSPDTLNNDLNDE

SEQ ID NO: 3250986 - protein, 10 aa, Plasmodium falciparum
TNSPKEENGT

SEQ ID NO: 3250987 - protein, 9 aa, Plasmodium falciparum
TNSPNEGDN

SEQ ID NO: 3250988 - protein, 20 aa, Plasmodium falciparum
TNSQSKEGNNMENKKRDISI

SEQ ID NO: 3250989 - protein, 17 aa, Plasmodium falciparum
TNSSQANNQNNSSALSG

SEQ ID NO: 3250990 - protein, 5 aa, Plasmodium falciparum
TNSTM

SEQ ID NO: 3250991 - protein, 7 aa, Plasmodium falciparum
TNSYDYG

SEQ ID NO: 3250992 - protein, 17 aa, Plasmodium falciparum
TNTASGDKHTLKQNKSL

SEQ ID NO: 3250993 - protein, 15 aa, Plasmodium falciparum
TNTASGDKPTQNEKV

SEQ ID NO: 3250994 - protein, 15 aa, Plasmodium falciparum
TNTASGEKKIEKDDA

SEQ ID NO: 3250995 - protein, 14 aa, Plasmodium falciparum
TNTDDSKKGDYLNN

SEQ ID NO: 3250996 - protein, 5 aa, Plasmodium falciparum
TNTET

SEQ ID NO: 3250997 - protein, 23 aa, Plasmodium falciparum
TNTGNTIDGDQQLERNKEDQNDS

SEQ ID NO: 3250998 - protein, 11 aa, Plasmodium falciparum
TNTKRGHNINK

SEQ ID NO: 3250999 - protein, 5 aa, Plasmodium falciparum
TNTKS

SEQ ID NO: 3251000 - protein, 6 aa, Plasmodium falciparum
TNTLTP

SEQ ID NO: 3251001 - protein, 14 aa, Plasmodium falciparum
TNTNAVNATYASSQ

SEQ ID NO: 3251002 - protein, 14 aa, Plasmodium falciparum
TNTNDNIDYTNSNY

SEQ ID NO: 3251003 - protein, 11 aa, Plasmodium falciparum
TNTNEQNDDED

SEQ ID NO: 3251004 - protein, 6 aa, Plasmodium falciparum
TNTNKK

SEQ ID NO: 3251005 - protein, 12 aa, Plasmodium falciparum
TNTNNAMGNITN

SEQ ID NO: 3251006 - protein, 8 aa, Plasmodium falciparum
TNTNQNKN

SEQ ID NO: 3251007 - protein, 9 aa, Plasmodium falciparum
TNTNTHTHT

SEQ ID NO: 3251008 - protein, 22 aa, Plasmodium falciparum
TNTNTNTNTNNKNGNNKSSNKK

SEQ ID NO: 3251009 - protein, 5 aa, Plasmodium falciparum
TNTPM

SEQ ID NO: 3251010 - protein, 12 aa, Plasmodium falciparum
TNTQKKVNTYDK

SEQ ID NO: 3251011 - protein, 7 aa, Plasmodium falciparum
TNTREGQ

SEQ ID NO: 3251012 - protein, 14 aa, Plasmodium falciparum
TNTSLNRANQNHFD

SEQ ID NO: 3251013 - protein, 6 aa, Plasmodium falciparum
TNTSPT

SEQ ID NO: 3251014 - protein, 5 aa, Plasmodium falciparum
TNTTG

SEQ ID NO: 3251015 - protein, 5 aa, Plasmodium falciparum
TNTTN

SEQ ID NO: 3251016 - protein, 13 aa, Plasmodium falciparum
TNTVSTENRKCRK

SEQ ID NO: 3251017 - protein, 12 aa, Plasmodium falciparum
TNVDINKEQEDI

SEQ ID NO: 3251018 - protein, 4 aa, Plasmodium falciparum
TNVK

SEQ ID NO: 3251019 - protein, 6 aa, Plasmodium falciparum
TNVKED

SEQ ID NO: 3251020 - protein, 9 aa, Plasmodium falciparum
TNVNDTKKN

SEQ ID NO: 3251021 - protein, 10 aa, Plasmodium falciparum
TNVNNKKYES

SEQ ID NO: 3251022 - protein, 12 aa, Plasmodium falciparum
TNVQANGDFDDN

SEQ ID NO: 3251023 - protein, 4 aa, Plasmodium falciparum
TNVT

SEQ ID NO: 3251024 - protein, 15 aa, Plasmodium falciparum
TNVTDNNNNNNKRYE

SEQ ID NO: 3251025 - protein, 5 aa, Plasmodium falciparum
TNVTI

SEQ ID NO: 3251026 - protein, 6 aa, Plasmodium falciparum
TNYDNR

SEQ ID NO: 3251027 - protein, 9 aa, Plasmodium falciparum
TNYKDDGND

SEQ ID NO: 3251028 - protein, 6 aa, Plasmodium falciparum
TNYKEE

SEQ ID NO: 3251029 - protein, 14 aa, Plasmodium falciparum
TNYKSLKNEETNKK

SEQ ID NO: 3251030 - protein, 11 aa, Plasmodium falciparum
TNYNDKNFEQN

SEQ ID NO: 3251031 - protein, 7 aa, Plasmodium falciparum
TNYNNEY

SEQ ID NO: 3251032 - protein, 6 aa, Plasmodium falciparum
TNYNNT

SEQ ID NO: 3251033 - protein, 5 aa, Plasmodium falciparum
TNYPR

SEQ ID NO: 3251034 - protein, 11 aa, Plasmodium falciparum
TNYRDNNLSDQ

SEQ ID NO: 3251035 - protein, 13 aa, Plasmodium falciparum
TNYSNNDNNSIVG

SEQ ID NO: 3251036 - protein, 8 aa, Plasmodium falciparum
TNYTEKDT

SEQ ID NO: 3251037 - protein, 6 aa, Plasmodium falciparum
TNYYTK

SEQ ID NO: 3251038 - protein, 4 aa, Plasmodium falciparum
TPAA

SEQ ID NO: 3251039 - protein, 7 aa, Plasmodium falciparum
TPAEGYS

SEQ ID NO: 3251040 - protein, 29 aa, Plasmodium falciparum
TPARRRQSNASANGNNSKQRRNSNGNSNS

SEQ ID NO: 3251041 - protein, 12 aa, Plasmodium falciparum
TPDEDFDSEELE

SEQ ID NO: 3251042 - protein, 10 aa, Plasmodium falciparum
TPDNSSNNYY

SEQ ID NO: 3251043 - protein, 5 aa, Plasmodium falciparum
TPDPL

SEQ ID NO: 3251044 - protein, 9 aa, Plasmodium falciparum
TPDSITSRT

SEQ ID NO: 3251045 - protein, 9 aa, Plasmodium falciparum
TPDTTKSNI

SEQ ID NO: 3251046 - protein, 13 aa, Plasmodium falciparum
TPEDIQRAKEDDK

SEQ ID NO: 3251047 - protein, 6 aa, Plasmodium falciparum
TPEEDA

SEQ ID NO: 3251048 - protein, 10 aa, Plasmodium falciparum
TPEEENELKS

SEQ ID NO: 3251049 - protein, 8 aa, Plasmodium falciparum
TPEEGQSG

SEQ ID NO: 3251050 - protein, 8 aa, Plasmodium falciparum
TPEKNTTF

SEQ ID NO: 3251051 - protein, 6 aa, Plasmodium falciparum
TPEQIK

SEQ ID NO: 3251052 - protein, 7 aa, Plasmodium falciparum
TPESITQ

SEQ ID NO: 3251053 - protein, 4 aa, Plasmodium falciparum
TPFP

SEQ ID NO: 3251054 - protein, 6 aa, Plasmodium falciparum
TPGFSG

SEQ ID NO: 3251055 - protein, 7 aa, Plasmodium falciparum
TPGGVRS

SEQ ID NO: 3251056 - protein, 13 aa, Plasmodium falciparum
TPGYNRSSRSNKL

SEQ ID NO: 3251057 - protein, 15 aa, Plasmodium falciparum
TPHGGDNHVKTPPTI

SEQ ID NO: 3251058 - protein, 6 aa, Plasmodium falciparum
TPHHNK

SEQ ID NO: 3251059 - protein, 5 aa, Plasmodium falciparum
TPHHS

SEQ ID NO: 3251060 - protein, 14 aa, Plasmodium falciparum
TPISNSNSNTKKEY

SEQ ID NO: 3251061 - protein, 5 aa, Plasmodium falciparum
TPITS

SEQ ID NO: 3251062 - protein, 7 aa, Plasmodium falciparum
TPKATTR

SEQ ID NO: 3251063 - protein, 4 aa, Plasmodium falciparum
TPKE

SEQ ID NO: 3251064 - protein, 5 aa, Plasmodium falciparum
TPKKI

SEQ ID NO: 3251065 - protein, 5 aa, Plasmodium falciparum
TPKQK

SEQ ID NO: 3251066 - protein, 7 aa, Plasmodium falciparum
TPKRPTT

SEQ ID NO: 3251067 - protein, 8 aa, Plasmodium falciparum
TPKSQLNE

SEQ ID NO: 3251068 - protein, 11 aa, Plasmodium falciparum
TPKTKSTRTHR

SEQ ID NO: 3251069 - protein, 11 aa, Plasmodium falciparum
TPLEDDDEEPY

SEQ ID NO: 3251070 - protein, 6 aa, Plasmodium falciparum
TPLEDL

SEQ ID NO: 3251071 - protein, 5 aa, Plasmodium falciparum
TPLEE

SEQ ID NO: 3251072 - protein, 5 aa, Plasmodium falciparum
TPLNE

SEQ ID NO: 3251073 - protein, 22 aa, Plasmodium falciparum
TPLNKNKRKLSNVSEEGNKNIY

SEQ ID NO: 3251074 - protein, 4 aa, Plasmodium falciparum
TPLS

SEQ ID NO: 3251075 - protein, 10 aa, Plasmodium falciparum
TPLSNNNKTS

SEQ ID NO: 3251076 - protein, 34 aa, Plasmodium falciparum
TPLSTNKHEKNKIHKNGNHLNKKETSCNNNDTFP

SEQ ID NO: 3251077 - protein, 6 aa, Plasmodium falciparum
TPMNSY

SEQ ID NO: 3251078 - protein, 5 aa, Plasmodium falciparum
TPNFN

SEQ ID NO: 3251079 - protein, 8 aa, Plasmodium falciparum
TPNHNSNN

SEQ ID NO: 3251080 - protein, 5 aa, Plasmodium falciparum
TPNKI

SEQ ID NO: 3251081 - protein, 11 aa, Plasmodium falciparum
TPNKNNENLNA

SEQ ID NO: 3251082 - protein, 6 aa, Plasmodium falciparum
TPNNNV

SEQ ID NO: 3251083 - protein, 16 aa, Plasmodium falciparum
TPNTTNDYNKELQNEE

SEQ ID NO: 3251084 - protein, 14 aa, Plasmodium falciparum
TPNYSGSDNDNYRS

SEQ ID NO: 3251085 - protein, 4 aa, Plasmodium falciparum
TPPN

SEQ ID NO: 3251086 - protein, 5 aa, Plasmodium falciparum
TPPPF

SEQ ID NO: 3251087 - protein, 5 aa, Plasmodium falciparum
TPPPG

SEQ ID NO: 3251088 - protein, 5 aa, Plasmodium falciparum
TPPQT

SEQ ID NO: 3251089 - protein, 18 aa, Plasmodium falciparum
TPQEDPQNKLKSGTIPEE

SEQ ID NO: 3251090 - protein, 90 aa, Plasmodium falciparum
TPQEENNDADNKENESNAITNEQQDENNNEKEDKDNNDGKNPEHNDDNNKPNDNLTNDEPTYNNNDDKAINDGNDNDNNNNNNINNNNNN

SEQ ID NO: 3251091 - protein, 11 aa, Plasmodium falciparum
TPRGQTGNAKP

SEQ ID NO: 3251092 - protein, 4 aa, Plasmodium falciparum
TPRK

SEQ ID NO: 3251093 - protein, 4 aa, Plasmodium falciparum
TPRL

SEQ ID NO: 3251094 - protein, 5 aa, Plasmodium falciparum
TPRLK

SEQ ID NO: 3251095 - protein, 11 aa, Plasmodium falciparum
TPRNINGTQKK

SEQ ID NO: 3251096 - protein, 63 aa, Plasmodium falciparum
TPSGDKAATSSEGKGSSDGGAKDGVGVNGGALQRNKRDLATPSAKSGDTTGGKDGATGKSDGS

SEQ ID NO: 3251097 - protein, 11 aa, Plasmodium falciparum
TPSGEKSGDKG

SEQ ID NO: 3251098 - protein, 22 aa, Plasmodium falciparum
TPSGKPGEAPSGDSTATGSSGS

SEQ ID NO: 3251099 - protein, 20 aa, Plasmodium falciparum
TPSGNTSDTTVKSGDTTGGS

SEQ ID NO: 3251100 - protein, 5 aa, Plasmodium falciparum
TPSIN

SEQ ID NO: 3251101 - protein, 5 aa, Plasmodium falciparum
TPSNF

SEQ ID NO: 3251102 - protein, 11 aa, Plasmodium falciparum
TPSNYDDDQEM

SEQ ID NO: 3251103 - protein, 13 aa, Plasmodium falciparum
TPSQKEEKRENDT

SEQ ID NO: 3251104 - protein, 25 aa, Plasmodium falciparum
TPSTLSSASTLESSYGSHASSPLSS

SEQ ID NO: 3251105 - protein, 7 aa, Plasmodium falciparum
TPTATSR

SEQ ID NO: 3251106 - protein, 10 aa, Plasmodium falciparum
TPTCEEKKQR

SEQ ID NO: 3251107 - protein, 5 aa, Plasmodium falciparum
TPTIK

SEQ ID NO: 3251108 - protein, 5 aa, Plasmodium falciparum
TPTNN

SEQ ID NO: 3251109 - protein, 8 aa, Plasmodium falciparum
TPTNYTKS

SEQ ID NO: 3251110 - protein, 18 aa, Plasmodium falciparum
TPVDSKKNKLQNGNHNTK

SEQ ID NO: 3251111 - protein, 16 aa, Plasmodium falciparum
TPYESGKNKISDENDV

SEQ ID NO: 3251112 - protein, 7 aa, Plasmodium falciparum
TPYGPSG

SEQ ID NO: 3251113 - protein, 4 aa, Plasmodium falciparum
TPYQ

SEQ ID NO: 3251114 - protein, 10 aa, Plasmodium falciparum
TPYTPNTSSR

SEQ ID NO: 3251115 - protein, 7 aa, Plasmodium falciparum
TQANKNT

SEQ ID NO: 3251116 - protein, 7 aa, Plasmodium falciparum
TQCNNNN

SEQ ID NO: 3251117 - protein, 6 aa, Plasmodium falciparum
TQDFGS

SEQ ID NO: 3251118 - protein, 21 aa, Plasmodium falciparum
TQDGNTNTIKEDKTKQTKTNI

SEQ ID NO: 3251119 - protein, 8 aa, Plasmodium falciparum
TQDHQNNI

SEQ ID NO: 3251120 - protein, 6 aa, Plasmodium falciparum
TQDKPV

SEQ ID NO: 3251121 - protein, 30 aa, Plasmodium falciparum
TQDNSYINNNNNSESYEKKRQTTDYIPQDE

SEQ ID NO: 3251122 - protein, 7 aa, Plasmodium falciparum
TQDTNEL

SEQ ID NO: 3251123 - protein, 6 aa, Plasmodium falciparum
TQEEEL

SEQ ID NO: 3251124 - protein, 9 aa, Plasmodium falciparum
TQEKKDEIK

SEQ ID NO: 3251125 - protein, 10 aa, Plasmodium falciparum
TQEKNKENEN

SEQ ID NO: 3251126 - protein, 4 aa, Plasmodium falciparum
TQEL

SEQ ID NO: 3251127 - protein, 7 aa, Plasmodium falciparum
TQENKKD

SEQ ID NO: 3251128 - protein, 31 aa, Plasmodium falciparum
TQEQEHNIPNHDKKKRKRSSTKINNDIQNEE

SEQ ID NO: 3251129 - protein, 6 aa, Plasmodium falciparum
TQERND

SEQ ID NO: 3251130 - protein, 9 aa, Plasmodium falciparum
TQETQTNMN

SEQ ID NO: 3251131 - protein, 8 aa, Plasmodium falciparum
TQGDVDPA

SEQ ID NO: 3251132 - protein, 6 aa, Plasmodium falciparum
TQGGKI

SEQ ID NO: 3251133 - protein, 9 aa, Plasmodium falciparum
TQGGNDNIN

SEQ ID NO: 3251134 - protein, 9 aa, Plasmodium falciparum
TQGGPNSNK

SEQ ID NO: 3251135 - protein, 12 aa, Plasmodium falciparum
TQGKINNDQIED

SEQ ID NO: 3251136 - protein, 5 aa, Plasmodium falciparum
TQHEK

SEQ ID NO: 3251137 - protein, 35 aa, Plasmodium falciparum
TQHYPSGKPEEQCKEPPPEDDYEDENEKKVESPTI

SEQ ID NO: 3251138 - protein, 18 aa, Plasmodium falciparum
TQIKTKLENDKIGSNIKK

SEQ ID NO: 3251139 - protein, 7 aa, Plasmodium falciparum
TQIQNQG

SEQ ID NO: 3251140 - protein, 4 aa, Plasmodium falciparum
TQIS

SEQ ID NO: 3251141 - protein, 8 aa, Plasmodium falciparum
TQKDKKEY

SEQ ID NO: 3251142 - protein, 8 aa, Plasmodium falciparum
TQKDKTFI

SEQ ID NO: 3251143 - protein, 15 aa, Plasmodium falciparum
TQKEGKTCNENSKND

SEQ ID NO: 3251144 - protein, 12 aa, Plasmodium falciparum
TQKENYSNRNNV

SEQ ID NO: 3251145 - protein, 10 aa, Plasmodium falciparum
TQKGDGDHFD

SEQ ID NO: 3251146 - protein, 8 aa, Plasmodium falciparum
TQKGEEIG

SEQ ID NO: 3251147 - protein, 16 aa, Plasmodium falciparum
TQKGEKTCDDESKNDC

SEQ ID NO: 3251148 - protein, 16 aa, Plasmodium falciparum
TQKGFDKEDNSSPSGF

SEQ ID NO: 3251149 - protein, 6 aa, Plasmodium falciparum
TQKGNI

SEQ ID NO: 3251150 - protein, 7 aa, Plasmodium falciparum
TQKHNPH

SEQ ID NO: 3251151 - protein, 9 aa, Plasmodium falciparum
TQKIPTTRS

SEQ ID NO: 3251152 - protein, 11 aa, Plasmodium falciparum
TQKKKKKNADD

SEQ ID NO: 3251153 - protein, 15 aa, Plasmodium falciparum
TQKNKKNKKKKKKKN

SEQ ID NO: 3251154 - protein, 5 aa, Plasmodium falciparum
TQKNN

SEQ ID NO: 3251155 - protein, 9 aa, Plasmodium falciparum
TQKNSPEQA

SEQ ID NO: 3251156 - protein, 14 aa, Plasmodium falciparum
TQKPHLGNAGDSVT

SEQ ID NO: 3251157 - protein, 14 aa, Plasmodium falciparum
TQKRPLANNNPNMS

SEQ ID NO: 3251158 - protein, 8 aa, Plasmodium falciparum
TQKSGNIG

SEQ ID NO: 3251159 - protein, 7 aa, Plasmodium falciparum
TQKTCKD

SEQ ID NO: 3251160 - protein, 8 aa, Plasmodium falciparum
TQKYDDDI

SEQ ID NO: 3251161 - protein, 12 aa, Plasmodium falciparum
TQLTGPNSKYQY

SEQ ID NO: 3251162 - protein, 7 aa, Plasmodium falciparum
TQNCKQY

SEQ ID NO: 3251163 - protein, 8 aa, Plasmodium falciparum
TQNDTTYY

SEQ ID NO: 3251164 - protein, 11 aa, Plasmodium falciparum
TQNEDKNHDNK

SEQ ID NO: 3251165 - protein, 8 aa, Plasmodium falciparum
TQNGDNNN

SEQ ID NO: 3251166 - protein, 19 aa, Plasmodium falciparum
TQNGGGGSDDCGGNSDSSL

SEQ ID NO: 3251167 - protein, 6 aa, Plasmodium falciparum
TQNGGS

SEQ ID NO: 3251168 - protein, 23 aa, Plasmodium falciparum
TQNGIKRKRNQQGEYHNEDQHEY

SEQ ID NO: 3251169 - protein, 21 aa, Plasmodium falciparum
TQNGNSGKASSSGSGDCGTNI

SEQ ID NO: 3251170 - protein, 25 aa, Plasmodium falciparum
TQNGSDGGRGGSGGSGGKNSDSSLY

SEQ ID NO: 3251171 - protein, 18 aa, Plasmodium falciparum
TQNGSDGSGGGNSEKKEL

SEQ ID NO: 3251172 - protein, 14 aa, Plasmodium falciparum
TQNIQSTQLSSNIN

SEQ ID NO: 3251173 - protein, 13 aa, Plasmodium falciparum
TQNKGNKTYDTAE

SEQ ID NO: 3251174 - protein, 9 aa, Plasmodium falciparum
TQNKTNDKT

SEQ ID NO: 3251175 - protein, 10 aa, Plasmodium falciparum
TQNNKKNMEN

SEQ ID NO: 3251176 - protein, 7 aa, Plasmodium falciparum
TQNNTNI

SEQ ID NO: 3251177 - protein, 122 aa, Plasmodium falciparum
TQNRSDGSSSVHVGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGSKSDSQKL

SEQ ID NO: 3251178 - protein, 15 aa, Plasmodium falciparum
TQNTEYTNQISSQTC

SEQ ID NO: 3251179 - protein, 9 aa, Plasmodium falciparum
TQNTYTNDD

SEQ ID NO: 3251180 - protein, 19 aa, Plasmodium falciparum
TQPHKKTNKITQYFTLKKK

SEQ ID NO: 3251181 - protein, 12 aa, Plasmodium falciparum
TQPQYDASSPDE

SEQ ID NO: 3251182 - protein, 6 aa, Plasmodium falciparum
TQQEDT

SEQ ID NO: 3251183 - protein, 13 aa, Plasmodium falciparum
TQQHSKEFEETTN

SEQ ID NO: 3251184 - protein, 7 aa, Plasmodium falciparum
TQQKSFN

SEQ ID NO: 3251185 - protein, 9 aa, Plasmodium falciparum
TQQTSTKSR

SEQ ID NO: 3251186 - protein, 4 aa, Plasmodium falciparum
TQRD

SEQ ID NO: 3251187 - protein, 5 aa, Plasmodium falciparum
TQRNF

SEQ ID NO: 3251188 - protein, 18 aa, Plasmodium falciparum
TQRSPSIGENQNGNPQQK

SEQ ID NO: 3251189 - protein, 6 aa, Plasmodium falciparum
TQRTTI

SEQ ID NO: 3251190 - protein, 25 aa, Plasmodium falciparum
TQSDSDAKTNANEDEKKKKKKKKKK

SEQ ID NO: 3251191 - protein, 4 aa, Plasmodium falciparum
TQSE

SEQ ID NO: 3251192 - protein, 11 aa, Plasmodium falciparum
TQSEKIDDNTT

SEQ ID NO: 3251193 - protein, 7 aa, Plasmodium falciparum
TQSHENN

SEQ ID NO: 3251194 - protein, 16 aa, Plasmodium falciparum
TQSNYNEKYNSYKNLS

SEQ ID NO: 3251195 - protein, 9 aa, Plasmodium falciparum
TQSQKTYGE

SEQ ID NO: 3251196 - protein, 6 aa, Plasmodium falciparum
TQSREK

SEQ ID NO: 3251197 - protein, 63 aa, Plasmodium falciparum
TQSSNTNDVSEQNKNKNKNKNKNKKDNKGNNNNHDDDDDDDNDNNKVISKDTNNNDKNYIQSN

SEQ ID NO: 3251198 - protein, 13 aa, Plasmodium falciparum
TQSTNYNNDEDIK

SEQ ID NO: 3251199 - protein, 14 aa, Plasmodium falciparum
TQSTNYNNDEEIKS

SEQ ID NO: 3251200 - protein, 11 aa, Plasmodium falciparum
TQTARGKNKYK

SEQ ID NO: 3251201 - protein, 9 aa, Plasmodium falciparum
TQTASGEKK

SEQ ID NO: 3251202 - protein, 11 aa, Plasmodium falciparum
TQTGPPAKYAI

SEQ ID NO: 3251203 - protein, 5 aa, Plasmodium falciparum
TQTKS

SEQ ID NO: 3251204 - protein, 8 aa, Plasmodium falciparum
TQTNINNN

SEQ ID NO: 3251205 - protein, 5 aa, Plasmodium falciparum
TQTNN

SEQ ID NO: 3251206 - protein, 16 aa, Plasmodium falciparum
TQTNVATNTYEAQEKN

SEQ ID NO: 3251207 - protein, 6 aa, Plasmodium falciparum
TQTSQN

SEQ ID NO: 3251208 - protein, 11 aa, Plasmodium falciparum
TQTSSDDPITN

SEQ ID NO: 3251209 - protein, 7 aa, Plasmodium falciparum
TQVGKNQ

SEQ ID NO: 3251210 - protein, 6 aa, Plasmodium falciparum
TQYDPS

SEQ ID NO: 3251211 - protein, 5 aa, Plasmodium falciparum
TQYEP

SEQ ID NO: 3251212 - protein, 5 aa, Plasmodium falciparum
TQYNA

SEQ ID NO: 3251213 - protein, 4 aa, Plasmodium falciparum
TQYQ

SEQ ID NO: 3251214 - protein, 17 aa, Plasmodium falciparum
TRCRGEKDGEKYCSRNG

SEQ ID NO: 3251215 - protein, 4 aa, Plasmodium falciparum
TRDD

SEQ ID NO: 3251216 - protein, 6 aa, Plasmodium falciparum
TRDDPC

SEQ ID NO: 3251217 - protein, 6 aa, Plasmodium falciparum
TRDQAL

SEQ ID NO: 3251218 - protein, 11 aa, Plasmodium falciparum
TRDQQTDGRGR

SEQ ID NO: 3251219 - protein, 7 aa, Plasmodium falciparum
TREDKYE

SEQ ID NO: 3251220 - protein, 17 aa, Plasmodium falciparum
TREDNYYSTYDKSDEHH

SEQ ID NO: 3251221 - protein, 14 aa, Plasmodium falciparum
TREKKAKKKQKNEF

SEQ ID NO: 3251222 - protein, 13 aa, Plasmodium falciparum
TREQNAEKDIETL

SEQ ID NO: 3251223 - protein, 15 aa, Plasmodium falciparum
TRGDHNNNNQTNDNH

SEQ ID NO: 3251224 - protein, 15 aa, Plasmodium falciparum
TRGEEDDDNNNISGK

SEQ ID NO: 3251225 - protein, 19 aa, Plasmodium falciparum
TRGSRNKNIYENSNMDKEK

SEQ ID NO: 3251226 - protein, 17 aa, Plasmodium falciparum
TRHNSYNNIQSDDHYDN

SEQ ID NO: 3251227 - protein, 5 aa, Plasmodium falciparum
TRKES

SEQ ID NO: 3251228 - protein, 6 aa, Plasmodium falciparum
TRKEST

SEQ ID NO: 3251229 - protein, 4 aa, Plasmodium falciparum
TRKI

SEQ ID NO: 3251230 - protein, 8 aa, Plasmodium falciparum
TRKKEKKK

SEQ ID NO: 3251231 - protein, 5 aa, Plasmodium falciparum
TRKKI

SEQ ID NO: 3251232 - protein, 10 aa, Plasmodium falciparum
TRKKKKGITL

SEQ ID NO: 3251233 - protein, 10 aa, Plasmodium falciparum
TRKKKSSNNM

SEQ ID NO: 3251234 - protein, 6 aa, Plasmodium falciparum
TRKKNK

SEQ ID NO: 3251235 - protein, 22 aa, Plasmodium falciparum
TRKNEDEYEGTEKRHSSNIPTD

SEQ ID NO: 3251236 - protein, 10 aa, Plasmodium falciparum
TRKNKQEEEY

SEQ ID NO: 3251237 - protein, 15 aa, Plasmodium falciparum
TRKNNNYEKNNLKNN

SEQ ID NO: 3251238 - protein, 6 aa, Plasmodium falciparum
TRKPTG

SEQ ID NO: 3251239 - protein, 16 aa, Plasmodium falciparum
TRKQSKKYQKTHEPYE

SEQ ID NO: 3251240 - protein, 14 aa, Plasmodium falciparum
TRLKTKKQRISEER

SEQ ID NO: 3251241 - protein, 6 aa, Plasmodium falciparum
TRLPTA

SEQ ID NO: 3251242 - protein, 11 aa, Plasmodium falciparum
TRNDKSQLDNI

SEQ ID NO: 3251243 - protein, 8 aa, Plasmodium falciparum
TRNETQEK

SEQ ID NO: 3251244 - protein, 5 aa, Plasmodium falciparum
TRNGK

SEQ ID NO: 3251245 - protein, 11 aa, Plasmodium falciparum
TRNNDNVKNNL

SEQ ID NO: 3251246 - protein, 5 aa, Plasmodium falciparum
TRNNK

SEQ ID NO: 3251247 - protein, 9 aa, Plasmodium falciparum
TRNSNVNKK

SEQ ID NO: 3251248 - protein, 7 aa, Plasmodium falciparum
TRNSSDT

SEQ ID NO: 3251249 - protein, 6 aa, Plasmodium falciparum
TRNSSQ

SEQ ID NO: 3251250 - protein, 8 aa, Plasmodium falciparum
TRPDQINK

SEQ ID NO: 3251251 - protein, 4 aa, Plasmodium falciparum
TRPG

SEQ ID NO: 3251252 - protein, 5 aa, Plasmodium falciparum
TRPGR

SEQ ID NO: 3251253 - protein, 16 aa, Plasmodium falciparum
TRQKTKVRKKKKKVDA

SEQ ID NO: 3251254 - protein, 6 aa, Plasmodium falciparum
TRQKVK

SEQ ID NO: 3251255 - protein, 4 aa, Plasmodium falciparum
TRRE

SEQ ID NO: 3251256 - protein, 18 aa, Plasmodium falciparum
TRREENEDHTNKNDDIQE

SEQ ID NO: 3251257 - protein, 7 aa, Plasmodium falciparum
TRSGPVA

SEQ ID NO: 3251258 - protein, 4 aa, Plasmodium falciparum
TRSI

SEQ ID NO: 3251259 - protein, 8 aa, Plasmodium falciparum
TRSKEADE

SEQ ID NO: 3251260 - protein, 15 aa, Plasmodium falciparum
TRSNNDNNETSEYKN

SEQ ID NO: 3251261 - protein, 4 aa, Plasmodium falciparum
TRSS

SEQ ID NO: 3251262 - protein, 9 aa, Plasmodium falciparum
TRSSGSTFS

SEQ ID NO: 3251263 - protein, 11 aa, Plasmodium falciparum
TRTGNNNASNT

SEQ ID NO: 3251264 - protein, 6 aa, Plasmodium falciparum
TRTHTD

SEQ ID NO: 3251265 - protein, 10 aa, Plasmodium falciparum
TRTLPRNKRP

SEQ ID NO: 3251266 - protein, 8 aa, Plasmodium falciparum
TRTSSPDN

SEQ ID NO: 3251267 - protein, 7 aa, Plasmodium falciparum
TRVDEET

SEQ ID NO: 3251268 - protein, 5 aa, Plasmodium falciparum
TSAHS

SEQ ID NO: 3251269 - protein, 8 aa, Plasmodium falciparum
TSALPNNG

SEQ ID NO: 3251270 - protein, 16 aa, Plasmodium falciparum
TSANDCTTTPTAFEED

SEQ ID NO: 3251271 - protein, 13 aa, Plasmodium falciparum
TSANGGESDENVQ

SEQ ID NO: 3251272 - protein, 6 aa, Plasmodium falciparum
TSANYE

SEQ ID NO: 3251273 - protein, 9 aa, Plasmodium falciparum
TSAQTNREY

SEQ ID NO: 3251274 - protein, 12 aa, Plasmodium falciparum
TSAVSTPKKGIS

SEQ ID NO: 3251275 - protein, 5 aa, Plasmodium falciparum
TSAYS

SEQ ID NO: 3251276 - protein, 8 aa, Plasmodium falciparum
TSCDTTTV

SEQ ID NO: 3251277 - protein, 11 aa, Plasmodium falciparum
TSDAPAYSDGH

SEQ ID NO: 3251278 - protein, 7 aa, Plasmodium falciparum
TSDEHTY

SEQ ID NO: 3251279 - protein, 11 aa, Plasmodium falciparum
TSDEQNNPCES

SEQ ID NO: 3251280 - protein, 7 aa, Plasmodium falciparum
TSDIIND

SEQ ID NO: 3251281 - protein, 10 aa, Plasmodium falciparum
TSDINSDVNN

SEQ ID NO: 3251282 - protein, 13 aa, Plasmodium falciparum
TSDKDKDESKTKV

SEQ ID NO: 3251283 - protein, 18 aa, Plasmodium falciparum
TSDLSKGNNNNNNNNMKE

SEQ ID NO: 3251284 - protein, 4 aa, Plasmodium falciparum
TSDN

SEQ ID NO: 3251285 - protein, 11 aa, Plasmodium falciparum
TSDNISESEIS

SEQ ID NO: 3251286 - protein, 18 aa, Plasmodium falciparum
TSDNNKKKDITNKINEPN

SEQ ID NO: 3251287 - protein, 5 aa, Plasmodium falciparum
TSDNQ

SEQ ID NO: 3251288 - protein, 10 aa, Plasmodium falciparum
TSDQKKNNLN

SEQ ID NO: 3251289 - protein, 6 aa, Plasmodium falciparum
TSDSLE

SEQ ID NO: 3251290 - protein, 66 aa, Plasmodium falciparum
TSEATYNNDNNNNNDNNNDNYCKDNHSDHNNNNNDNYCKDNHSDHNNNNNDNYCKDNGRDSHNDQV

SEQ ID NO: 3251291 - protein, 19 aa, Plasmodium falciparum
TSEDMSNTKNSRDNNFNDK

SEQ ID NO: 3251292 - protein, 4 aa, Plasmodium falciparum
TSEE

SEQ ID NO: 3251293 - protein, 8 aa, Plasmodium falciparum
TSEEEFEE

SEQ ID NO: 3251294 - protein, 8 aa, Plasmodium falciparum
TSEEKKYK

SEQ ID NO: 3251295 - protein, 5 aa, Plasmodium falciparum
TSEES

SEQ ID NO: 3251296 - protein, 6 aa, Plasmodium falciparum
TSEHVS

SEQ ID NO: 3251297 - protein, 30 aa, Plasmodium falciparum
TSEKENEKENHDVEDNSKLNTFNKGNNKYS

SEQ ID NO: 3251298 - protein, 5 aa, Plasmodium falciparum
TSEKL

SEQ ID NO: 3251299 - protein, 8 aa, Plasmodium falciparum
TSEKNRKS

SEQ ID NO: 3251300 - protein, 5 aa, Plasmodium falciparum
TSEKS

SEQ ID NO: 3251301 - protein, 25 aa, Plasmodium falciparum
TSEKSNNMDNNNMHNNNDDKRKGDL

SEQ ID NO: 3251302 - protein, 4 aa, Plasmodium falciparum
TSEL

SEQ ID NO: 3251303 - protein, 12 aa, Plasmodium falciparum
TSEMENEEKGYE

SEQ ID NO: 3251304 - protein, 4 aa, Plasmodium falciparum
TSEN

SEQ ID NO: 3251305 - protein, 7 aa, Plasmodium falciparum
TSENEKL

SEQ ID NO: 3251306 - protein, 6 aa, Plasmodium falciparum
TSEPKE

SEQ ID NO: 3251307 - protein, 5 aa, Plasmodium falciparum
TSERF

SEQ ID NO: 3251308 - protein, 5 aa, Plasmodium falciparum
TSERG

SEQ ID NO: 3251309 - protein, 7 aa, Plasmodium falciparum
TSERVKE

SEQ ID NO: 3251310 - protein, 28 aa, Plasmodium falciparum
TSESCESKNHYDSSKSKTYEKDDTPVKL

SEQ ID NO: 3251311 - protein, 6 aa, Plasmodium falciparum
TSESIQ

SEQ ID NO: 3251312 - protein, 12 aa, Plasmodium falciparum
TSFNSESNYDDN

SEQ ID NO: 3251313 - protein, 9 aa, Plasmodium falciparum
TSFNSVPKD

SEQ ID NO: 3251314 - protein, 13 aa, Plasmodium falciparum
TSFPSSSKNNITH

SEQ ID NO: 3251315 - protein, 35 aa, Plasmodium falciparum
TSGAGAPKTPLTQQPVASSDDPQSKLQKSGDIPPP

SEQ ID NO: 3251316 - protein, 4 aa, Plasmodium falciparum
TSGD

SEQ ID NO: 3251317 - protein, 53 aa, Plasmodium falciparum
TSGDNNNIYNDDNNNNIYNDDNNNNIYNDDNNNNIYNDDNNNNIYNDDNNNNI

SEQ ID NO: 3251318 - protein, 11 aa, Plasmodium falciparum
TSGGGGGKNYG

SEQ ID NO: 3251319 - protein, 7 aa, Plasmodium falciparum
TSGGKGV

SEQ ID NO: 3251320 - protein, 8 aa, Plasmodium falciparum
TSGKTKIN

SEQ ID NO: 3251321 - protein, 12 aa, Plasmodium falciparum
TSGLSTTTDTAS

SEQ ID NO: 3251322 - protein, 9 aa, Plasmodium falciparum
TSGNGARGP

SEQ ID NO: 3251323 - protein, 9 aa, Plasmodium falciparum
TSGRAGRRG

SEQ ID NO: 3251324 - protein, 9 aa, Plasmodium falciparum
TSGSGGNGH

SEQ ID NO: 3251325 - protein, 9 aa, Plasmodium falciparum
TSGSIPGAS

SEQ ID NO: 3251326 - protein, 5 aa, Plasmodium falciparum
TSGSL

SEQ ID NO: 3251327 - protein, 12 aa, Plasmodium falciparum
TSGTSDKFDNVG

SEQ ID NO: 3251328 - protein, 11 aa, Plasmodium falciparum
TSGTTAPSSSM

SEQ ID NO: 3251329 - protein, 6 aa, Plasmodium falciparum
TSGVRV

SEQ ID NO: 3251330 - protein, 8 aa, Plasmodium falciparum
TSHGDRSS

SEQ ID NO: 3251331 - protein, 9 aa, Plasmodium falciparum
TSHGENNYK

SEQ ID NO: 3251332 - protein, 7 aa, Plasmodium falciparum
TSHHNNN

SEQ ID NO: 3251333 - protein, 4 aa, Plasmodium falciparum
TSHN

SEQ ID NO: 3251334 - protein, 7 aa, Plasmodium falciparum
TSHNNNN

SEQ ID NO: 3251335 - protein, 13 aa, Plasmodium falciparum
TSHQTNKNSSGKS

SEQ ID NO: 3251336 - protein, 4 aa, Plasmodium falciparum
TSHY

SEQ ID NO: 3251337 - protein, 12 aa, Plasmodium falciparum
TSIENIKENETN

SEQ ID NO: 3251338 - protein, 17 aa, Plasmodium falciparum
TSIKKKKKKKKKDQTYN

SEQ ID NO: 3251339 - protein, 27 aa, Plasmodium falciparum
TSIKSKSNGSKNNQSDVQNDKELSEGT

SEQ ID NO: 3251340 - protein, 19 aa, Plasmodium falciparum
TSINNNNYNNINNNNNNNI

SEQ ID NO: 3251341 - protein, 9 aa, Plasmodium falciparum
TSINNVEGN

SEQ ID NO: 3251342 - protein, 8 aa, Plasmodium falciparum
TSINTKMK

SEQ ID NO: 3251343 - protein, 6 aa, Plasmodium falciparum
TSIQPQ

SEQ ID NO: 3251344 - protein, 24 aa, Plasmodium falciparum
TSISPTTTTTTTNIAGGAPIGSPN

SEQ ID NO: 3251345 - protein, 6 aa, Plasmodium falciparum
TSISSK

SEQ ID NO: 3251346 - protein, 5 aa, Plasmodium falciparum
TSITE

SEQ ID NO: 3251347 - protein, 14 aa, Plasmodium falciparum
TSITSSPEKNDHPG

SEQ ID NO: 3251348 - protein, 14 aa, Plasmodium falciparum
TSIVNNKNQVNNKT

SEQ ID NO: 3251349 - protein, 13 aa, Plasmodium falciparum
TSIYDNTDDGINN

SEQ ID NO: 3251350 - protein, 8 aa, Plasmodium falciparum
TSKAGTIS

SEQ ID NO: 3251351 - protein, 8 aa, Plasmodium falciparum
TSKANTFP

SEQ ID NO: 3251352 - protein, 4 aa, Plasmodium falciparum
TSKD

SEQ ID NO: 3251353 - protein, 12 aa, Plasmodium falciparum
TSKEKEESLNNT

SEQ ID NO: 3251354 - protein, 7 aa, Plasmodium falciparum
TSKENEN

SEQ ID NO: 3251355 - protein, 11 aa, Plasmodium falciparum
TSKENKSKDSI

SEQ ID NO: 3251356 - protein, 10 aa, Plasmodium falciparum
TSKENTNTFN

SEQ ID NO: 3251357 - protein, 6 aa, Plasmodium falciparum
TSKIRK

SEQ ID NO: 3251358 - protein, 4 aa, Plasmodium falciparum
TSKK

SEQ ID NO: 3251359 - protein, 22 aa, Plasmodium falciparum
TSKKDKRRTYSNEREYGSKTYE

SEQ ID NO: 3251360 - protein, 29 aa, Plasmodium falciparum
TSKKKKKRAHKEDRQSSNSSVSFKSTPSL

SEQ ID NO: 3251361 - protein, 6 aa, Plasmodium falciparum
TSKKLT

SEQ ID NO: 3251362 - protein, 11 aa, Plasmodium falciparum
TSKKNNDNYQN

SEQ ID NO: 3251363 - protein, 8 aa, Plasmodium falciparum
TSKKREKR

SEQ ID NO: 3251364 - protein, 8 aa, Plasmodium falciparum
TSKKTHDK

SEQ ID NO: 3251365 - protein, 11 aa, Plasmodium falciparum
TSKKTNENNKA

SEQ ID NO: 3251366 - protein, 9 aa, Plasmodium falciparum
TSKKYISSN

SEQ ID NO: 3251367 - protein, 5 aa, Plasmodium falciparum
TSKLK

SEQ ID NO: 3251368 - protein, 18 aa, Plasmodium falciparum
TSKNESNNNNSENTNNYN

SEQ ID NO: 3251369 - protein, 6 aa, Plasmodium falciparum
TSKNKN

SEQ ID NO: 3251370 - protein, 11 aa, Plasmodium falciparum
TSKNKNNTDIN

SEQ ID NO: 3251371 - protein, 14 aa, Plasmodium falciparum
TSKNNEKKKESNIE

SEQ ID NO: 3251372 - protein, 7 aa, Plasmodium falciparum
TSKNYRK

SEQ ID NO: 3251373 - protein, 4 aa, Plasmodium falciparum
TSKP

SEQ ID NO: 3251374 - protein, 14 aa, Plasmodium falciparum
TSKQNSKNNSNIQN

SEQ ID NO: 3251375 - protein, 7 aa, Plasmodium falciparum
TSKQSVR

SEQ ID NO: 3251376 - protein, 10 aa, Plasmodium falciparum
TSKRNTLDNS

SEQ ID NO: 3251377 - protein, 22 aa, Plasmodium falciparum
TSKSANILEKDSNKYEEGNQKY

SEQ ID NO: 3251378 - protein, 20 aa, Plasmodium falciparum
TSKSDPNPNNELTSNMNPKH

SEQ ID NO: 3251379 - protein, 5 aa, Plasmodium falciparum
TSKTK

SEQ ID NO: 3251380 - protein, 18 aa, Plasmodium falciparum
TSKTNLTLPKETDTSDIT

SEQ ID NO: 3251381 - protein, 8 aa, Plasmodium falciparum
TSKTQPWC

SEQ ID NO: 3251382 - protein, 6 aa, Plasmodium falciparum
TSKTTK

SEQ ID NO: 3251383 - protein, 17 aa, Plasmodium falciparum
TSKVYKKKKKLNSTRNN

SEQ ID NO: 3251384 - protein, 4 aa, Plasmodium falciparum
TSLD

SEQ ID NO: 3251385 - protein, 4 aa, Plasmodium falciparum
TSLH

SEQ ID NO: 3251386 - protein, 13 aa, Plasmodium falciparum
TSLNSKESTYVSS

SEQ ID NO: 3251387 - protein, 4 aa, Plasmodium falciparum
TSLP

SEQ ID NO: 3251388 - protein, 13 aa, Plasmodium falciparum
TSLQAGGATCATG

SEQ ID NO: 3251389 - protein, 8 aa, Plasmodium falciparum
TSLTTSLK

SEQ ID NO: 3251390 - protein, 11 aa, Plasmodium falciparum
TSMNPNETNKL

SEQ ID NO: 3251391 - protein, 7 aa, Plasmodium falciparum
TSMPSRK

SEQ ID NO: 3251392 - protein, 14 aa, Plasmodium falciparum
TSNCSNVKKKKDGV

SEQ ID NO: 3251393 - protein, 9 aa, Plasmodium falciparum
TSNDGIGYR

SEQ ID NO: 3251394 - protein, 7 aa, Plasmodium falciparum
TSNDIKN

SEQ ID NO: 3251395 - protein, 12 aa, Plasmodium falciparum
TSNEESNEDDKN

SEQ ID NO: 3251396 - protein, 10 aa, Plasmodium falciparum
TSNEETTSLN

SEQ ID NO: 3251397 - protein, 13 aa, Plasmodium falciparum
TSNGTCSKSPNCN

SEQ ID NO: 3251398 - protein, 10 aa, Plasmodium falciparum
TSNHSSYETE

SEQ ID NO: 3251399 - protein, 4 aa, Plasmodium falciparum
TSNI

SEQ ID NO: 3251400 - protein, 4 aa, Plasmodium falciparum
TSNK

SEQ ID NO: 3251401 - protein, 9 aa, Plasmodium falciparum
TSNKKTKYA

SEQ ID NO: 3251402 - protein, 9 aa, Plasmodium falciparum
TSNKNMSDT

SEQ ID NO: 3251403 - protein, 14 aa, Plasmodium falciparum
TSNKTFDYKGQQKF

SEQ ID NO: 3251404 - protein, 46 aa, Plasmodium falciparum
TSNLKNNSITNETHNNNDNMKTNHNNNNNNNNNNNNNNNNNTSGYP

SEQ ID NO: 3251405 - protein, 49 aa, Plasmodium falciparum
TSNNEEEQEDEDEDENEDEDENEDEDENEDEDEEDVENEQNKKYNDLKK

SEQ ID NO: 3251406 - protein, 5 aa, Plasmodium falciparum
TSNNK

SEQ ID NO: 3251407 - protein, 10 aa, Plasmodium falciparum
TSNNKKNDYS

SEQ ID NO: 3251408 - protein, 12 aa, Plasmodium falciparum
TSNNNNNNNNDN

SEQ ID NO: 3251409 - protein, 17 aa, Plasmodium falciparum
TSNNNNNNSNSNNHFSS

SEQ ID NO: 3251410 - protein, 7 aa, Plasmodium falciparum
TSNNQNF

SEQ ID NO: 3251411 - protein, 18 aa, Plasmodium falciparum
TSNNQPNTINKQNNLPSH

SEQ ID NO: 3251412 - protein, 10 aa, Plasmodium falciparum
TSNNRRNSAI

SEQ ID NO: 3251413 - protein, 8 aa, Plasmodium falciparum
TSNNSSLK

SEQ ID NO: 3251414 - protein, 6 aa, Plasmodium falciparum
TSNPLL

SEQ ID NO: 3251415 - protein, 6 aa, Plasmodium falciparum
TSNPSN

SEQ ID NO: 3251416 - protein, 9 aa, Plasmodium falciparum
TSNQNYQSN

SEQ ID NO: 3251417 - protein, 7 aa, Plasmodium falciparum
TSNRDNK

SEQ ID NO: 3251418 - protein, 12 aa, Plasmodium falciparum
TSNSDSSPDSIN

SEQ ID NO: 3251419 - protein, 14 aa, Plasmodium falciparum
TSNSSSDDDYSENN

SEQ ID NO: 3251420 - protein, 10 aa, Plasmodium falciparum
TSNTKSIKPH

SEQ ID NO: 3251421 - protein, 5 aa, Plasmodium falciparum
TSNTS

SEQ ID NO: 3251422 - protein, 6 aa, Plasmodium falciparum
TSNYDN

SEQ ID NO: 3251423 - protein, 12 aa, Plasmodium falciparum
TSNYDNDPDMKS

SEQ ID NO: 3251424 - protein, 5 aa, Plasmodium falciparum
TSNYN

SEQ ID NO: 3251425 - protein, 7 aa, Plasmodium falciparum
TSPFEEG

SEQ ID NO: 3251426 - protein, 12 aa, Plasmodium falciparum
TSPGKDSHNNNI

SEQ ID NO: 3251427 - protein, 13 aa, Plasmodium falciparum
TSPIMNPNNGYND

SEQ ID NO: 3251428 - protein, 5 aa, Plasmodium falciparum
TSPKK

SEQ ID NO: 3251429 - protein, 5 aa, Plasmodium falciparum
TSPLK

SEQ ID NO: 3251430 - protein, 5 aa, Plasmodium falciparum
TSPNI

SEQ ID NO: 3251431 - protein, 8 aa, Plasmodium falciparum
TSPNKKEL

SEQ ID NO: 3251432 - protein, 8 aa, Plasmodium falciparum
TSPPVSIP

SEQ ID NO: 3251433 - protein, 4 aa, Plasmodium falciparum
TSPS

SEQ ID NO: 3251434 - protein, 22 aa, Plasmodium falciparum
TSPTKGNNNNNNDNNNNNSNIY

SEQ ID NO: 3251435 - protein, 5 aa, Plasmodium falciparum
TSPVI

SEQ ID NO: 3251436 - protein, 4 aa, Plasmodium falciparum
TSQA

SEQ ID NO: 3251437 - protein, 6 aa, Plasmodium falciparum
TSQEKK

SEQ ID NO: 3251438 - protein, 11 aa, Plasmodium falciparum
TSQKGTLEATK

SEQ ID NO: 3251439 - protein, 9 aa, Plasmodium falciparum
TSQKQQNVI

SEQ ID NO: 3251440 - protein, 8 aa, Plasmodium falciparum
TSQKSITY

SEQ ID NO: 3251441 - protein, 8 aa, Plasmodium falciparum
TSQLNSNN

SEQ ID NO: 3251442 - protein, 10 aa, Plasmodium falciparum
TSQNKTKVPY

SEQ ID NO: 3251443 - protein, 8 aa, Plasmodium falciparum
TSQPLSSD

SEQ ID NO: 3251444 - protein, 14 aa, Plasmodium falciparum
TSQQNDGKYLEQNK

SEQ ID NO: 3251445 - protein, 10 aa, Plasmodium falciparum
TSRDKGGSPI

SEQ ID NO: 3251446 - protein, 4 aa, Plasmodium falciparum
TSRE

SEQ ID NO: 3251447 - protein, 5 aa, Plasmodium falciparum
TSRKE

SEQ ID NO: 3251448 - protein, 8 aa, Plasmodium falciparum
TSRNPSIK

SEQ ID NO: 3251449 - protein, 9 aa, Plasmodium falciparum
TSRSNRKDK

SEQ ID NO: 3251450 - protein, 15 aa, Plasmodium falciparum
TSRTTESVKKKANNV

SEQ ID NO: 3251451 - protein, 21 aa, Plasmodium falciparum
TSRVKENTNEKKSSKGSNTKR

SEQ ID NO: 3251452 - protein, 6 aa, Plasmodium falciparum
TSSDPI

SEQ ID NO: 3251453 - protein, 10 aa, Plasmodium falciparum
TSSEPSKEEL

SEQ ID NO: 3251454 - protein, 4 aa, Plasmodium falciparum
TSSF

SEQ ID NO: 3251455 - protein, 12 aa, Plasmodium falciparum
TSSFEDEESKKE

SEQ ID NO: 3251456 - protein, 6 aa, Plasmodium falciparum
TSSIRN

SEQ ID NO: 3251457 - protein, 6 aa, Plasmodium falciparum
TSSKGW

SEQ ID NO: 3251458 - protein, 27 aa, Plasmodium falciparum
TSSKRDDFSSGRSIQTSESKESFSDNK

SEQ ID NO: 3251459 - protein, 4 aa, Plasmodium falciparum
TSSL

SEQ ID NO: 3251460 - protein, 9 aa, Plasmodium falciparum
TSSLDNKSE

SEQ ID NO: 3251461 - protein, 10 aa, Plasmodium falciparum
TSSLDSNSEK

SEQ ID NO: 3251462 - protein, 8 aa, Plasmodium falciparum
TSSLDSRT

SEQ ID NO: 3251463 - protein, 12 aa, Plasmodium falciparum
TSSLESDEVEEH

SEQ ID NO: 3251464 - protein, 16 aa, Plasmodium falciparum
TSSLNKETDENTQNVD

SEQ ID NO: 3251465 - protein, 11 aa, Plasmodium falciparum
TSSNNADDKNI

SEQ ID NO: 3251466 - protein, 10 aa, Plasmodium falciparum
TSSNPLPPDI

SEQ ID NO: 3251467 - protein, 7 aa, Plasmodium falciparum
TSSNQHT

SEQ ID NO: 3251468 - protein, 6 aa, Plasmodium falciparum
TSSNRE

SEQ ID NO: 3251469 - protein, 8 aa, Plasmodium falciparum
TSSNSMDK

SEQ ID NO: 3251470 - protein, 10 aa, Plasmodium falciparum
TSSNSRNRGM

SEQ ID NO: 3251471 - protein, 6 aa, Plasmodium falciparum
TSSNSS

SEQ ID NO: 3251472 - protein, 7 aa, Plasmodium falciparum
TSSPSTK

SEQ ID NO: 3251473 - protein, 4 aa, Plasmodium falciparum
TSSS

SEQ ID NO: 3251474 - protein, 14 aa, Plasmodium falciparum
TSSSEEDNNNMNNM

SEQ ID NO: 3251475 - protein, 8 aa, Plasmodium falciparum
TSSSGFSD

SEQ ID NO: 3251476 - protein, 9 aa, Plasmodium falciparum
TSSSNINNN

SEQ ID NO: 3251477 - protein, 22 aa, Plasmodium falciparum
TSSSNQKDIKSEQNINAEKKES

SEQ ID NO: 3251478 - protein, 10 aa, Plasmodium falciparum
TSSSSEKSNL

SEQ ID NO: 3251479 - protein, 27 aa, Plasmodium falciparum
TSSSSLGSSSGRDVSSSPVGVGDEHEA

SEQ ID NO: 3251480 - protein, 5 aa, Plasmodium falciparum
TSSST

SEQ ID NO: 3251481 - protein, 6 aa, Plasmodium falciparum
TSSTPN

SEQ ID NO: 3251482 - protein, 7 aa, Plasmodium falciparum
TSSTYNN

SEQ ID NO: 3251483 - protein, 4 aa, Plasmodium falciparum
TSSY

SEQ ID NO: 3251484 - protein, 13 aa, Plasmodium falciparum
TSSYNTINNNDKN

SEQ ID NO: 3251485 - protein, 6 aa, Plasmodium falciparum
TSSYTK

SEQ ID NO: 3251486 - protein, 10 aa, Plasmodium falciparum
TSSYTTSSSS

SEQ ID NO: 3251487 - protein, 6 aa, Plasmodium falciparum
TSSYYK

SEQ ID NO: 3251488 - protein, 9 aa, Plasmodium falciparum
TSTATIEST

SEQ ID NO: 3251489 - protein, 63 aa, Plasmodium falciparum
TSTCTKNDDIKNDDTKNDDIKNDDTKNDDIKNDDTKNDDIKNDDTKNDDIKNDDTKNDDIKND

SEQ ID NO: 3251490 - protein, 9 aa, Plasmodium falciparum
TSTENDDKN

SEQ ID NO: 3251491 - protein, 10 aa, Plasmodium falciparum
TSTEQQKKKN

SEQ ID NO: 3251492 - protein, 4 aa, Plasmodium falciparum
TSTK

SEQ ID NO: 3251493 - protein, 17 aa, Plasmodium falciparum
TSTKNKTKNKLKNKDGY

SEQ ID NO: 3251494 - protein, 17 aa, Plasmodium falciparum
TSTKQTYGSVVRGTKNG

SEQ ID NO: 3251495 - protein, 6 aa, Plasmodium falciparum
TSTKRN

SEQ ID NO: 3251496 - protein, 8 aa, Plasmodium falciparum
TSTLGKEL

SEQ ID NO: 3251497 - protein, 29 aa, Plasmodium falciparum
TSTLPQTNKHTHKQNIENRETHKKNNYTK

SEQ ID NO: 3251498 - protein, 5 aa, Plasmodium falciparum
TSTLS

SEQ ID NO: 3251499 - protein, 7 aa, Plasmodium falciparum
TSTNKTK

SEQ ID NO: 3251500 - protein, 12 aa, Plasmodium falciparum
TSTNNFNTSNNN

SEQ ID NO: 3251501 - protein, 21 aa, Plasmodium falciparum
TSTNTDISDHGDFKKSNKNNF

SEQ ID NO: 3251502 - protein, 14 aa, Plasmodium falciparum
TSTNTSQQQTTSQK

SEQ ID NO: 3251503 - protein, 7 aa, Plasmodium falciparum
TSTSGND

SEQ ID NO: 3251504 - protein, 9 aa, Plasmodium falciparum
TSTSKTKTN

SEQ ID NO: 3251505 - protein, 6 aa, Plasmodium falciparum
TSTWGR

SEQ ID NO: 3251506 - protein, 8 aa, Plasmodium falciparum
TSVNDSDG

SEQ ID NO: 3251507 - protein, 5 aa, Plasmodium falciparum
TSYDI

SEQ ID NO: 3251508 - protein, 7 aa, Plasmodium falciparum
TSYEERN

SEQ ID NO: 3251509 - protein, 5 aa, Plasmodium falciparum
TSYEK

SEQ ID NO: 3251510 - protein, 23 aa, Plasmodium falciparum
TSYKSDMSSPTNEYNNMGNGSTI

SEQ ID NO: 3251511 - protein, 7 aa, Plasmodium falciparum
TSYNDKK

SEQ ID NO: 3251512 - protein, 6 aa, Plasmodium falciparum
TSYSDV

SEQ ID NO: 3251513 - protein, 24 aa, Plasmodium falciparum
TSYSNDSRNGNNGGPCTGKNDKRF

SEQ ID NO: 3251514 - protein, 6 aa, Plasmodium falciparum
TSYSRK

SEQ ID NO: 3251515 - protein, 10 aa, Plasmodium falciparum
TSYYGEGPKK

SEQ ID NO: 3251516 - protein, 12 aa, Plasmodium falciparum
TTAAKTAKEAVG

SEQ ID NO: 3251517 - protein, 8 aa, Plasmodium falciparum
TTAKRKTL

SEQ ID NO: 3251518 - protein, 4 aa, Plasmodium falciparum
TTAL

SEQ ID NO: 3251519 - protein, 22 aa, Plasmodium falciparum
TTANNNNNNNNNSNNNNKPFNK

SEQ ID NO: 3251520 - protein, 6 aa, Plasmodium falciparum
TTAPNN

SEQ ID NO: 3251521 - protein, 4 aa, Plasmodium falciparum
TTAR

SEQ ID NO: 3251522 - protein, 16 aa, Plasmodium falciparum
TTARNAGDTAFDNPND

SEQ ID NO: 3251523 - protein, 20 aa, Plasmodium falciparum
TTAVSSEATPAPSQSESDKL

SEQ ID NO: 3251524 - protein, 4 aa, Plasmodium falciparum
TTCG

SEQ ID NO: 3251525 - protein, 5 aa, Plasmodium falciparum
TTDAY

SEQ ID NO: 3251526 - protein, 5 aa, Plasmodium falciparum
TTDEE

SEQ ID NO: 3251527 - protein, 21 aa, Plasmodium falciparum
TTDGQEDDDDEDYDKDVRTGG

SEQ ID NO: 3251528 - protein, 5 aa, Plasmodium falciparum
TTDLN

SEQ ID NO: 3251529 - protein, 14 aa, Plasmodium falciparum
TTDLNSDKTTNFNT

SEQ ID NO: 3251530 - protein, 18 aa, Plasmodium falciparum
TTEDKNNKNLTNSEGSNF

SEQ ID NO: 3251531 - protein, 6 aa, Plasmodium falciparum
TTEEEI

SEQ ID NO: 3251532 - protein, 6 aa, Plasmodium falciparum
TTEEEL

SEQ ID NO: 3251533 - protein, 13 aa, Plasmodium falciparum
TTEEGKKKKKKNI

SEQ ID NO: 3251534 - protein, 6 aa, Plasmodium falciparum
TTEEIE

SEQ ID NO: 3251535 - protein, 39 aa, Plasmodium falciparum
TTEESCDDMNENEKDIKKKKKHTKGHTSKKEGKFGKMDE

SEQ ID NO: 3251536 - protein, 4 aa, Plasmodium falciparum
TTEI

SEQ ID NO: 3251537 - protein, 11 aa, Plasmodium falciparum
TTEKKNKERND

SEQ ID NO: 3251538 - protein, 5 aa, Plasmodium falciparum
TTENN

SEQ ID NO: 3251539 - protein, 11 aa, Plasmodium falciparum
TTENSETKIRS

SEQ ID NO: 3251540 - protein, 5 aa, Plasmodium falciparum
TTENV

SEQ ID NO: 3251541 - protein, 10 aa, Plasmodium falciparum
TTESSSSSSG

SEQ ID NO: 3251542 - protein, 6 aa, Plasmodium falciparum
TTETPP

SEQ ID NO: 3251543 - protein, 21 aa, Plasmodium falciparum
TTGDKNTNETTEIKKQTSTYI

SEQ ID NO: 3251544 - protein, 21 aa, Plasmodium falciparum
TTGDKNTNKTTEIKKQTSTYI

SEQ ID NO: 3251545 - protein, 12 aa, Plasmodium falciparum
TTGETKENKTSN

SEQ ID NO: 3251546 - protein, 5 aa, Plasmodium falciparum
TTGIK

SEQ ID NO: 3251547 - protein, 4 aa, Plasmodium falciparum
TTGN

SEQ ID NO: 3251548 - protein, 6 aa, Plasmodium falciparum
TTGNIK

SEQ ID NO: 3251549 - protein, 11 aa, Plasmodium falciparum
TTGSTNNPNTL

SEQ ID NO: 3251550 - protein, 5 aa, Plasmodium falciparum
TTHKI

SEQ ID NO: 3251551 - protein, 25 aa, Plasmodium falciparum
TTHSNDSRGSKGEPCKGKDGSGERM

SEQ ID NO: 3251552 - protein, 4 aa, Plasmodium falciparum
TTIE

SEQ ID NO: 3251553 - protein, 6 aa, Plasmodium falciparum
TTIGDE

SEQ ID NO: 3251554 - protein, 6 aa, Plasmodium falciparum
TTIKGK

SEQ ID NO: 3251555 - protein, 15 aa, Plasmodium falciparum
TTIKNDKRKQSSNTS

SEQ ID NO: 3251556 - protein, 9 aa, Plasmodium falciparum
TTINDDDQI

SEQ ID NO: 3251557 - protein, 11 aa, Plasmodium falciparum
TTINNHSTNNV

SEQ ID NO: 3251558 - protein, 18 aa, Plasmodium falciparum
TTINNNSNNYNNNNNKVN

SEQ ID NO: 3251559 - protein, 4 aa, Plasmodium falciparum
TTIT

SEQ ID NO: 3251560 - protein, 16 aa, Plasmodium falciparum
TTITNNDHNHDHNGNN

SEQ ID NO: 3251561 - protein, 8 aa, Plasmodium falciparum
TTITPYST

SEQ ID NO: 3251562 - protein, 4 aa, Plasmodium falciparum
TTKD

SEQ ID NO: 3251563 - protein, 4 aa, Plasmodium falciparum
TTKK

SEQ ID NO: 3251564 - protein, 9 aa, Plasmodium falciparum
TTKKEDKGC

SEQ ID NO: 3251565 - protein, 8 aa, Plasmodium falciparum
TTKKEDKH

SEQ ID NO: 3251566 - protein, 10 aa, Plasmodium falciparum
TTKKKKEKKN

SEQ ID NO: 3251567 - protein, 7 aa, Plasmodium falciparum
TTKKKKK

SEQ ID NO: 3251568 - protein, 14 aa, Plasmodium falciparum
TTKMNDDKNVNSKN

SEQ ID NO: 3251569 - protein, 5 aa, Plasmodium falciparum
TTKMR

SEQ ID NO: 3251570 - protein, 9 aa, Plasmodium falciparum
TTKNEDNNK

SEQ ID NO: 3251571 - protein, 8 aa, Plasmodium falciparum
TTKNGSYK

SEQ ID NO: 3251572 - protein, 14 aa, Plasmodium falciparum
TTKNGTKERYNDTD

SEQ ID NO: 3251573 - protein, 12 aa, Plasmodium falciparum
TTKNKPKNRQYE

SEQ ID NO: 3251574 - protein, 5 aa, Plasmodium falciparum
TTKNT

SEQ ID NO: 3251575 - protein, 4 aa, Plasmodium falciparum
TTKT

SEQ ID NO: 3251576 - protein, 33 aa, Plasmodium falciparum
TTLDQAKKESIKTVSKNERKNNMNKHSHDNKVS

SEQ ID NO: 3251577 - protein, 5 aa, Plasmodium falciparum
TTLNQ

SEQ ID NO: 3251578 - protein, 4 aa, Plasmodium falciparum
TTNA

SEQ ID NO: 3251579 - protein, 21 aa, Plasmodium falciparum
TTNAASGGAGGSGSKSDSKEL

SEQ ID NO: 3251580 - protein, 5 aa, Plasmodium falciparum
TTNAQ

SEQ ID NO: 3251581 - protein, 6 aa, Plasmodium falciparum
TTNDAT

SEQ ID NO: 3251582 - protein, 15 aa, Plasmodium falciparum
TTNDNNVSEEKKNYY

SEQ ID NO: 3251583 - protein, 10 aa, Plasmodium falciparum
TTNEKKSGYV

SEQ ID NO: 3251584 - protein, 5 aa, Plasmodium falciparum
TTNIP

SEQ ID NO: 3251585 - protein, 10 aa, Plasmodium falciparum
TTNKNEDSTF

SEQ ID NO: 3251586 - protein, 21 aa, Plasmodium falciparum
TTNNNDYSHDNSNDNHKIHEE

SEQ ID NO: 3251587 - protein, 8 aa, Plasmodium falciparum
TTNNNQRK

SEQ ID NO: 3251588 - protein, 8 aa, Plasmodium falciparum
TTNNNTVD

SEQ ID NO: 3251589 - protein, 11 aa, Plasmodium falciparum
TTNNSYEYNNT

SEQ ID NO: 3251590 - protein, 7 aa, Plasmodium falciparum
TTNNTED

SEQ ID NO: 3251591 - protein, 6 aa, Plasmodium falciparum
TTNPTC

SEQ ID NO: 3251592 - protein, 35 aa, Plasmodium falciparum
TTNQKDNNNNNNNNNNYNNNNNNNNNNNNNNYNNN

SEQ ID NO: 3251593 - protein, 5 aa, Plasmodium falciparum
TTNRL

SEQ ID NO: 3251594 - protein, 11 aa, Plasmodium falciparum
TTNSKKKNSND

SEQ ID NO: 3251595 - protein, 16 aa, Plasmodium falciparum
TTNTNEINNNQNYNNQ

SEQ ID NO: 3251596 - protein, 14 aa, Plasmodium falciparum
TTNVENKLKSNNQQ

SEQ ID NO: 3251597 - protein, 16 aa, Plasmodium falciparum
TTPGTTSGKYKEKYEY

SEQ ID NO: 3251598 - protein, 6 aa, Plasmodium falciparum
TTPIPT

SEQ ID NO: 3251599 - protein, 21 aa, Plasmodium falciparum
TTPKDEGELRTSDNNGGEENS

SEQ ID NO: 3251600 - protein, 5 aa, Plasmodium falciparum
TTPLE

SEQ ID NO: 3251601 - protein, 16 aa, Plasmodium falciparum
TTPNKNDQYNNPTDNL

SEQ ID NO: 3251602 - protein, 8 aa, Plasmodium falciparum
TTPQHVPQ

SEQ ID NO: 3251603 - protein, 4 aa, Plasmodium falciparum
TTPS

SEQ ID NO: 3251604 - protein, 5 aa, Plasmodium falciparum
TTPSS

SEQ ID NO: 3251605 - protein, 100 aa, Plasmodium falciparum
TTPTSDSTTTSSSSSVPLTKQSPHSSVPALSSTQSTTYNTTDSATPPFAKPHPPSLSEKENKRENEKRNSDKEFSQSYEEKAKNKSKDELKSPTPNEEKK

SEQ ID NO: 3251606 - protein, 4 aa, Plasmodium falciparum
TTPY

SEQ ID NO: 3251607 - protein, 7 aa, Plasmodium falciparum
TTPYKES

SEQ ID NO: 3251608 - protein, 6 aa, Plasmodium falciparum
TTQGLS

SEQ ID NO: 3251609 - protein, 6 aa, Plasmodium falciparum
TTQNEV

SEQ ID NO: 3251610 - protein, 9 aa, Plasmodium falciparum
TTQNKKEKE

SEQ ID NO: 3251611 - protein, 7 aa, Plasmodium falciparum
TTQNNNM

SEQ ID NO: 3251612 - protein, 8 aa, Plasmodium falciparum
TTQPEFSN

SEQ ID NO: 3251613 - protein, 6 aa, Plasmodium falciparum
TTQPYE

SEQ ID NO: 3251614 - protein, 5 aa, Plasmodium falciparum
TTQYA

SEQ ID NO: 3251615 - protein, 4 aa, Plasmodium falciparum
TTRC

SEQ ID NO: 3251616 - protein, 4 aa, Plasmodium falciparum
TTRG

SEQ ID NO: 3251617 - protein, 14 aa, Plasmodium falciparum
TTRGSGEPTGSSGS

SEQ ID NO: 3251618 - protein, 10 aa, Plasmodium falciparum
TTRNVEEDTR

SEQ ID NO: 3251619 - protein, 6 aa, Plasmodium falciparum
TTSELN

SEQ ID NO: 3251620 - protein, 6 aa, Plasmodium falciparum
TTSGEN

SEQ ID NO: 3251621 - protein, 5 aa, Plasmodium falciparum
TTSGK

SEQ ID NO: 3251622 - protein, 4 aa, Plasmodium falciparum
TTSK

SEQ ID NO: 3251623 - protein, 13 aa, Plasmodium falciparum
TTSKDMPEEPSAK

SEQ ID NO: 3251624 - protein, 4 aa, Plasmodium falciparum
TTSS

SEQ ID NO: 3251625 - protein, 10 aa, Plasmodium falciparum
TTSSNQKNEI

SEQ ID NO: 3251626 - protein, 4 aa, Plasmodium falciparum
TTST

SEQ ID NO: 3251627 - protein, 8 aa, Plasmodium falciparum
TTSTSALN

SEQ ID NO: 3251628 - protein, 7 aa, Plasmodium falciparum
TTSTTAG

SEQ ID NO: 3251629 - protein, 8 aa, Plasmodium falciparum
TTSYEGSS

SEQ ID NO: 3251630 - protein, 13 aa, Plasmodium falciparum
TTTDESLAHQSST

SEQ ID NO: 3251631 - protein, 16 aa, Plasmodium falciparum
TTTDMNNNNNINSSNV

SEQ ID NO: 3251632 - protein, 6 aa, Plasmodium falciparum
TTTEGN

SEQ ID NO: 3251633 - protein, 6 aa, Plasmodium falciparum
TTTEKI

SEQ ID NO: 3251634 - protein, 11 aa, Plasmodium falciparum
TTTKITNHTTY

SEQ ID NO: 3251635 - protein, 9 aa, Plasmodium falciparum
TTTKNGNNE

SEQ ID NO: 3251636 - protein, 5 aa, Plasmodium falciparum
TTTKS

SEQ ID NO: 3251637 - protein, 5 aa, Plasmodium falciparum
TTTME

SEQ ID NO: 3251638 - protein, 33 aa, Plasmodium falciparum
TTTNDNNNDDNNNDNNNNNNNNNNNNDHNNNGT

SEQ ID NO: 3251639 - protein, 6 aa, Plasmodium falciparum
TTTNIK

SEQ ID NO: 3251640 - protein, 33 aa, Plasmodium falciparum
TTTNSNSNSNSNNNNNNNNNNNNNSGDSTCNNY

SEQ ID NO: 3251641 - protein, 5 aa, Plasmodium falciparum
TTTNT

SEQ ID NO: 3251642 - protein, 5 aa, Plasmodium falciparum
TTTQI

SEQ ID NO: 3251643 - protein, 7 aa, Plasmodium falciparum
TTTRTNT

SEQ ID NO: 3251644 - protein, 4 aa, Plasmodium falciparum
TTTS

SEQ ID NO: 3251645 - protein, 7 aa, Plasmodium falciparum
TTTSSSY

SEQ ID NO: 3251646 - protein, 5 aa, Plasmodium falciparum
TTTST

SEQ ID NO: 3251647 - protein, 4 aa, Plasmodium falciparum
TTTT

SEQ ID NO: 3251648 - protein, 25 aa, Plasmodium falciparum
TTTTIGENGGTSDTSGTNNENEGTF

SEQ ID NO: 3251649 - protein, 21 aa, Plasmodium falciparum
TTTTTINNKKKKHQNKNNKNN

SEQ ID NO: 3251650 - protein, 38 aa, Plasmodium falciparum
TTTTTKNNNNNNNNNNNNSGSSNNNNNSGSSNNNNNNN

SEQ ID NO: 3251651 - protein, 16 aa, Plasmodium falciparum
TTTTTTTNNNNINNNN

SEQ ID NO: 3251652 - protein, 6 aa, Plasmodium falciparum
TTVRGK

SEQ ID NO: 3251653 - protein, 7 aa, Plasmodium falciparum
TTYDNNN

SEQ ID NO: 3251654 - protein, 24 aa, Plasmodium falciparum
TTYDQGNKEKETDVNGNKNNINIT

SEQ ID NO: 3251655 - protein, 4 aa, Plasmodium falciparum
TTYN

SEQ ID NO: 3251656 - protein, 4 aa, Plasmodium falciparum
TTYS

SEQ ID NO: 3251657 - protein, 4 aa, Plasmodium falciparum
TTYT

SEQ ID NO: 3251658 - protein, 23 aa, Plasmodium falciparum
TVAAAAAKKATEEAIKASTEAVE

SEQ ID NO: 3251659 - protein, 10 aa, Plasmodium falciparum
TVDKYQGKQN

SEQ ID NO: 3251660 - protein, 8 aa, Plasmodium falciparum
TVEEGDEY

SEQ ID NO: 3251661 - protein, 14 aa, Plasmodium falciparum
TVEEGNKDLNNSGN

SEQ ID NO: 3251662 - protein, 5 aa, Plasmodium falciparum
TVENE

SEQ ID NO: 3251663 - protein, 13 aa, Plasmodium falciparum
TVGDPCKDTAGPS

SEQ ID NO: 3251664 - protein, 14 aa, Plasmodium falciparum
TVGDPLKDTSGPSL

SEQ ID NO: 3251665 - protein, 9 aa, Plasmodium falciparum
TVGSNTPVK

SEQ ID NO: 3251666 - protein, 20 aa, Plasmodium falciparum
TVHSRQNKIENSGDNTQGKE

SEQ ID NO: 3251667 - protein, 5 aa, Plasmodium falciparum
TVKDE

SEQ ID NO: 3251668 - protein, 15 aa, Plasmodium falciparum
TVNGTNEDKYDEEVY

SEQ ID NO: 3251669 - protein, 4 aa, Plasmodium falciparum
TVNN

SEQ ID NO: 3251670 - protein, 7 aa, Plasmodium falciparum
TVNNNNT

SEQ ID NO: 3251671 - protein, 6 aa, Plasmodium falciparum
TVNTSY

SEQ ID NO: 3251672 - protein, 11 aa, Plasmodium falciparum
TVPYKKKEKMD

SEQ ID NO: 3251673 - protein, 4 aa, Plasmodium falciparum
TVRA

SEQ ID NO: 3251674 - protein, 7 aa, Plasmodium falciparum
TVRAKGK

SEQ ID NO: 3251675 - protein, 5 aa, Plasmodium falciparum
TVRNA

SEQ ID NO: 3251676 - protein, 5 aa, Plasmodium falciparum
TVRRS

SEQ ID NO: 3251677 - protein, 18 aa, Plasmodium falciparum
TVRSNGSTTSSSNDSDDT

SEQ ID NO: 3251678 - protein, 6 aa, Plasmodium falciparum
TVSDGD

SEQ ID NO: 3251679 - protein, 9 aa, Plasmodium falciparum
TVSEEKCKR

SEQ ID NO: 3251680 - protein, 31 aa, Plasmodium falciparum
TVSNCKKENSQGDEEKENENNIPNKRQTRNI

SEQ ID NO: 3251681 - protein, 15 aa, Plasmodium falciparum
TVSPSLDNTRTNYES

SEQ ID NO: 3251682 - protein, 12 aa, Plasmodium falciparum
TVTCSRDKNNNF

SEQ ID NO: 3251683 - protein, 16 aa, Plasmodium falciparum
TVTSGYDKENPCKDRP

SEQ ID NO: 3251684 - protein, 19 aa, Plasmodium falciparum
TVTSNIGSTITPTPSSSTL

SEQ ID NO: 3251685 - protein, 10 aa, Plasmodium falciparum
TVYSSSSDIR

SEQ ID NO: 3251686 - protein, 5 aa, Plasmodium falciparum
TWNPE

SEQ ID NO: 3251687 - protein, 5 aa, Plasmodium falciparum
TWTTA

SEQ ID NO: 3251688 - protein, 5 aa, Plasmodium falciparum
TYDDY

SEQ ID NO: 3251689 - protein, 6 aa, Plasmodium falciparum
TYDENL

SEQ ID NO: 3251690 - protein, 8 aa, Plasmodium falciparum
TYDESDNK

SEQ ID NO: 3251691 - protein, 5 aa, Plasmodium falciparum
TYDGD

SEQ ID NO: 3251692 - protein, 8 aa, Plasmodium falciparum
TYDGNEEE

SEQ ID NO: 3251693 - protein, 33 aa, Plasmodium falciparum
TYDKKDPTIQKTKSKTKTNTNTNTKTNTKTNTK

SEQ ID NO: 3251694 - protein, 8 aa, Plasmodium falciparum
TYDNDPEM

SEQ ID NO: 3251695 - protein, 21 aa, Plasmodium falciparum
TYDNNNNNDNNNNKNDNSNGI

SEQ ID NO: 3251696 - protein, 37 aa, Plasmodium falciparum
TYDNNNNSNNNNNNNSNNNNNNNNNNNNNNGRNSSYN

SEQ ID NO: 3251697 - protein, 5 aa, Plasmodium falciparum
TYDPE

SEQ ID NO: 3251698 - protein, 40 aa, Plasmodium falciparum
TYDSDTNNKCNNNINNNNIKNSNINNNNNNNSDDDDDDIQ

SEQ ID NO: 3251699 - protein, 5 aa, Plasmodium falciparum
TYDTY

SEQ ID NO: 3251700 - protein, 27 aa, Plasmodium falciparum
TYEEKGLQSSSAAMRGGGAGEENHHEE

SEQ ID NO: 3251701 - protein, 8 aa, Plasmodium falciparum
TYEEKKKS

SEQ ID NO: 3251702 - protein, 6 aa, Plasmodium falciparum
TYEKGN

SEQ ID NO: 3251703 - protein, 12 aa, Plasmodium falciparum
TYEKKDEHNKYN

SEQ ID NO: 3251704 - protein, 10 aa, Plasmodium falciparum
TYEKSTEGTY

SEQ ID NO: 3251705 - protein, 4 aa, Plasmodium falciparum
TYEN

SEQ ID NO: 3251706 - protein, 6 aa, Plasmodium falciparum
TYENRT

SEQ ID NO: 3251707 - protein, 18 aa, Plasmodium falciparum
TYESDQNDEENNEESMNE

SEQ ID NO: 3251708 - protein, 6 aa, Plasmodium falciparum
TYESNP

SEQ ID NO: 3251709 - protein, 5 aa, Plasmodium falciparum
TYEYD

SEQ ID NO: 3251710 - protein, 5 aa, Plasmodium falciparum
TYGDT

SEQ ID NO: 3251711 - protein, 42 aa, Plasmodium falciparum
TYGNNNDDNNDDDNNNDDDNNDDNNNDDNNNDDNNDDNNNNN

SEQ ID NO: 3251712 - protein, 6 aa, Plasmodium falciparum
TYGSSP

SEQ ID NO: 3251713 - protein, 12 aa, Plasmodium falciparum
TYHNKSTNSFSR

SEQ ID NO: 3251714 - protein, 7 aa, Plasmodium falciparum
TYHQGTS

SEQ ID NO: 3251715 - protein, 5 aa, Plasmodium falciparum
TYIGS

SEQ ID NO: 3251716 - protein, 6 aa, Plasmodium falciparum
TYINNK

SEQ ID NO: 3251717 - protein, 15 aa, Plasmodium falciparum
TYISSNEDIKKKKKK

SEQ ID NO: 3251718 - protein, 6 aa, Plasmodium falciparum
TYKDEP

SEQ ID NO: 3251719 - protein, 5 aa, Plasmodium falciparum
TYKDT

SEQ ID NO: 3251720 - protein, 9 aa, Plasmodium falciparum
TYKEDDERN

SEQ ID NO: 3251721 - protein, 11 aa, Plasmodium falciparum
TYKEKESQNYT

SEQ ID NO: 3251722 - protein, 8 aa, Plasmodium falciparum
TYKESNKK

SEQ ID NO: 3251723 - protein, 8 aa, Plasmodium falciparum
TYKHGENN

SEQ ID NO: 3251724 - protein, 11 aa, Plasmodium falciparum
TYKSNDKNINK

SEQ ID NO: 3251725 - protein, 10 aa, Plasmodium falciparum
TYKSNSENPF

SEQ ID NO: 3251726 - protein, 12 aa, Plasmodium falciparum
TYKSYKSKTNEF

SEQ ID NO: 3251727 - protein, 12 aa, Plasmodium falciparum
TYNDDRQENHPN

SEQ ID NO: 3251728 - protein, 5 aa, Plasmodium falciparum
TYNEK

SEQ ID NO: 3251729 - protein, 7 aa, Plasmodium falciparum
TYNENNK

SEQ ID NO: 3251730 - protein, 10 aa, Plasmodium falciparum
TYNENNNEQI

SEQ ID NO: 3251731 - protein, 5 aa, Plasmodium falciparum
TYNEQ

SEQ ID NO: 3251732 - protein, 4 aa, Plasmodium falciparum
TYNG

SEQ ID NO: 3251733 - protein, 11 aa, Plasmodium falciparum
TYNGIDNGRQV

SEQ ID NO: 3251734 - protein, 5 aa, Plasmodium falciparum
TYNIE

SEQ ID NO: 3251735 - protein, 8 aa, Plasmodium falciparum
TYNKKQIG

SEQ ID NO: 3251736 - protein, 24 aa, Plasmodium falciparum
TYNKNNKRTKVEDDDEDEKKEGNI

SEQ ID NO: 3251737 - protein, 4 aa, Plasmodium falciparum
TYNN

SEQ ID NO: 3251738 - protein, 5 aa, Plasmodium falciparum
TYNNK

SEQ ID NO: 3251739 - protein, 12 aa, Plasmodium falciparum
TYNNNDGSHNNN

SEQ ID NO: 3251740 - protein, 11 aa, Plasmodium falciparum
TYNNNKTEINM

SEQ ID NO: 3251741 - protein, 12 aa, Plasmodium falciparum
TYNNNLSKNKNN

SEQ ID NO: 3251742 - protein, 16 aa, Plasmodium falciparum
TYNNNNNNNNSNSNTC

SEQ ID NO: 3251743 - protein, 18 aa, Plasmodium falciparum
TYNNSLGDNGTRTTTYPN

SEQ ID NO: 3251744 - protein, 6 aa, Plasmodium falciparum
TYNNTD

SEQ ID NO: 3251745 - protein, 6 aa, Plasmodium falciparum
TYNQGD

SEQ ID NO: 3251746 - protein, 9 aa, Plasmodium falciparum
TYNRKGEDS

SEQ ID NO: 3251747 - protein, 6 aa, Plasmodium falciparum
TYNSDK

SEQ ID NO: 3251748 - protein, 6 aa, Plasmodium falciparum
TYNSNH

SEQ ID NO: 3251749 - protein, 8 aa, Plasmodium falciparum
TYNTTNGE

SEQ ID NO: 3251750 - protein, 4 aa, Plasmodium falciparum
TYNY

SEQ ID NO: 3251751 - protein, 8 aa, Plasmodium falciparum
TYPDKSTM

SEQ ID NO: 3251752 - protein, 10 aa, Plasmodium falciparum
TYPEETKTTC

SEQ ID NO: 3251753 - protein, 5 aa, Plasmodium falciparum
TYPEG

SEQ ID NO: 3251754 - protein, 7 aa, Plasmodium falciparum
TYPENST

SEQ ID NO: 3251755 - protein, 5 aa, Plasmodium falciparum
TYPEY

SEQ ID NO: 3251756 - protein, 7 aa, Plasmodium falciparum
TYPKNNS

SEQ ID NO: 3251757 - protein, 13 aa, Plasmodium falciparum
TYPKNRKIIFPYI

SEQ ID NO: 3251758 - protein, 19 aa, Plasmodium falciparum
TYPKNRKRKKRKRKSSNLS

SEQ ID NO: 3251759 - protein, 6 aa, Plasmodium falciparum
TYPNAS

SEQ ID NO: 3251760 - protein, 8 aa, Plasmodium falciparum
TYPNDDKP

SEQ ID NO: 3251761 - protein, 7 aa, Plasmodium falciparum
TYPNGED

SEQ ID NO: 3251762 - protein, 25 aa, Plasmodium falciparum
TYPNKNLQTNNTSDHNKQTYKNQTH

SEQ ID NO: 3251763 - protein, 8 aa, Plasmodium falciparum
TYPNNSSM

SEQ ID NO: 3251764 - protein, 5 aa, Plasmodium falciparum
TYPNT

SEQ ID NO: 3251765 - protein, 6 aa, Plasmodium falciparum
TYPSKK

SEQ ID NO: 3251766 - protein, 12 aa, Plasmodium falciparum
TYPSQLSPNMEN

SEQ ID NO: 3251767 - protein, 8 aa, Plasmodium falciparum
TYPSSNEY

SEQ ID NO: 3251768 - protein, 4 aa, Plasmodium falciparum
TYQN

SEQ ID NO: 3251769 - protein, 17 aa, Plasmodium falciparum
TYQNDQTDMEKKKYSDE

SEQ ID NO: 3251770 - protein, 12 aa, Plasmodium falciparum
TYQNNNNNNNDS

SEQ ID NO: 3251771 - protein, 9 aa, Plasmodium falciparum
TYQNNNSYE

SEQ ID NO: 3251772 - protein, 14 aa, Plasmodium falciparum
TYQQEDSGEDENTL

SEQ ID NO: 3251773 - protein, 6 aa, Plasmodium falciparum
TYREQS

SEQ ID NO: 3251774 - protein, 6 aa, Plasmodium falciparum
TYRKST

SEQ ID NO: 3251775 - protein, 4 aa, Plasmodium falciparum
TYRN

SEQ ID NO: 3251776 - protein, 20 aa, Plasmodium falciparum
TYRNNKNNDENDEYGEYDNY

SEQ ID NO: 3251777 - protein, 5 aa, Plasmodium falciparum
TYRSK

SEQ ID NO: 3251778 - protein, 4 aa, Plasmodium falciparum
TYSE

SEQ ID NO: 3251779 - protein, 13 aa, Plasmodium falciparum
TYSEEASDNYDEI

SEQ ID NO: 3251780 - protein, 6 aa, Plasmodium falciparum
TYSGKS

SEQ ID NO: 3251781 - protein, 41 aa, Plasmodium falciparum
TYSNNDNRDNYDDDNCDNYDNYDNDNENDNCDNSKNDRGVK

SEQ ID NO: 3251782 - protein, 8 aa, Plasmodium falciparum
TYSSDQER

SEQ ID NO: 3251783 - protein, 15 aa, Plasmodium falciparum
TYSSDSNNNTSSSNL

SEQ ID NO: 3251784 - protein, 9 aa, Plasmodium falciparum
TYSSSTHAD

SEQ ID NO: 3251785 - protein, 9 aa, Plasmodium falciparum
TYTDSPSQL

SEQ ID NO: 3251786 - protein, 13 aa, Plasmodium falciparum
TYTDTQRKDHENV

SEQ ID NO: 3251787 - protein, 4 aa, Plasmodium falciparum
TYTE

SEQ ID NO: 3251788 - protein, 11 aa, Plasmodium falciparum
TYTKSTHNNKT

SEQ ID NO: 3251789 - protein, 24 aa, Plasmodium falciparum
TYTNSSSSLYNKNNNNKNNNNNYY

SEQ ID NO: 3251790 - protein, 7 aa, Plasmodium falciparum
TYTPMSE

SEQ ID NO: 3251791 - protein, 7 aa, Plasmodium falciparum
TYTQEKK

SEQ ID NO: 3251792 - protein, 22 aa, Plasmodium falciparum
TYTQPNNNVNSGNNNVEDDTYN

SEQ ID NO: 3251793 - protein, 7 aa, Plasmodium falciparum
TYTQQHE

SEQ ID NO: 3251794 - protein, 5 aa, Plasmodium falciparum
TYTTA

SEQ ID NO: 3251795 - protein, 9 aa, Plasmodium falciparum
TYVSPKSDG

SEQ ID NO: 3251796 - protein, 5 aa, Plasmodium falciparum
TYYSN

SEQ ID NO: 3251797 - protein, 20 aa, Plasmodium falciparum
TYYSPSGEEPREKRSTNYYN

SEQ ID NO: 3251798 - protein, 6 aa, Plasmodium falciparum
TYYTKK

SEQ ID NO: 3251799 - protein, 9 aa, Plasmodium falciparum
VADGGDGSY

SEQ ID NO: 3251800 - protein, 6 aa, Plasmodium falciparum
VADPDH

SEQ ID NO: 3251801 - protein, 11 aa, Plasmodium falciparum
VAENVEESVAE

SEQ ID NO: 3251802 - protein, 68 aa, Plasmodium falciparum
VAGDNIPKKEDSDEEEEEEEEGTEGTGEVEENVEEDNTENKDQEDVSGEGSKEAEKEPTAKKDEAEKV

SEQ ID NO: 3251803 - protein, 7 aa, Plasmodium falciparum
VAKNTKK

SEQ ID NO: 3251804 - protein, 10 aa, Plasmodium falciparum
VAKNTNSDPI

SEQ ID NO: 3251805 - protein, 32 aa, Plasmodium falciparum
VAPQVGGGNTKAGESSQSSSGSETPSQPDPKV

SEQ ID NO: 3251806 - protein, 4 aa, Plasmodium falciparum
VAPS

SEQ ID NO: 3251807 - protein, 9 aa, Plasmodium falciparum
VAQPNGSYT

SEQ ID NO: 3251808 - protein, 12 aa, Plasmodium falciparum
VARRATYNSTTL

SEQ ID NO: 3251809 - protein, 8 aa, Plasmodium falciparum
VASPDPAT

SEQ ID NO: 3251810 - protein, 17 aa, Plasmodium falciparum
VASPKGEDEKKSQPQHP

SEQ ID NO: 3251811 - protein, 5 aa, Plasmodium falciparum
VASRN

SEQ ID NO: 3251812 - protein, 10 aa, Plasmodium falciparum
VASSSSTYKD

SEQ ID NO: 3251813 - protein, 4 aa, Plasmodium falciparum
VATN

SEQ ID NO: 3251814 - protein, 10 aa, Plasmodium falciparum
VATPPGVQVP

SEQ ID NO: 3251815 - protein, 9 aa, Plasmodium falciparum
VCEEKDDGY

SEQ ID NO: 3251816 - protein, 4 aa, Plasmodium falciparum
VCEG

SEQ ID NO: 3251817 - protein, 20 aa, Plasmodium falciparum
VCGGNTKRKCDGKTDISAED

SEQ ID NO: 3251818 - protein, 6 aa, Plasmodium falciparum
VCKNNN

SEQ ID NO: 3251819 - protein, 20 aa, Plasmodium falciparum
VCNGDPTKGECNGETVTAEE

SEQ ID NO: 3251820 - protein, 12 aa, Plasmodium falciparum
VCNNNNNNYDPS

SEQ ID NO: 3251821 - protein, 18 aa, Plasmodium falciparum
VCSGDTKVECNGKTPIAA

SEQ ID NO: 3251822 - protein, 7 aa, Plasmodium falciparum
VCSNKEE

SEQ ID NO: 3251823 - protein, 11 aa, Plasmodium falciparum
VCTSSTDDSTC

SEQ ID NO: 3251824 - protein, 9 aa, Plasmodium falciparum
VDAAEAAES

SEQ ID NO: 3251825 - protein, 7 aa, Plasmodium falciparum
VDANKKK

SEQ ID NO: 3251826 - protein, 9 aa, Plasmodium falciparum
VDDDDDDDV

SEQ ID NO: 3251827 - protein, 19 aa, Plasmodium falciparum
VDDDEEDRKDKHGNSSKKK

SEQ ID NO: 3251828 - protein, 8 aa, Plasmodium falciparum
VDDEGGKI

SEQ ID NO: 3251829 - protein, 5 aa, Plasmodium falciparum
VDDKD

SEQ ID NO: 3251830 - protein, 28 aa, Plasmodium falciparum
VDDKRRKLNNSKIKKEELNEEEKKKKEE

SEQ ID NO: 3251831 - protein, 19 aa, Plasmodium falciparum
VDDNEQINKIETKKEQHLN

SEQ ID NO: 3251832 - protein, 7 aa, Plasmodium falciparum
VDDNTNK

SEQ ID NO: 3251833 - protein, 5 aa, Plasmodium falciparum
VDDNY

SEQ ID NO: 3251834 - protein, 7 aa, Plasmodium falciparum
VDDSEIS

SEQ ID NO: 3251835 - protein, 8 aa, Plasmodium falciparum
VDDSSLTN

SEQ ID NO: 3251836 - protein, 10 aa, Plasmodium falciparum
VDEAQSSKSL

SEQ ID NO: 3251837 - protein, 42 aa, Plasmodium falciparum
VDEEEPEDNPVEGSSEEEKQEVVKDTEAAVPKQDTQPKEEVN

SEQ ID NO: 3251838 - protein, 6 aa, Plasmodium falciparum
VDEEHN

SEQ ID NO: 3251839 - protein, 7 aa, Plasmodium falciparum
VDEENKN

SEQ ID NO: 3251840 - protein, 10 aa, Plasmodium falciparum
VDEKKEHCQE

SEQ ID NO: 3251841 - protein, 30 aa, Plasmodium falciparum
VDEKKESYDNDVSSSKSMSEGTKKKTTKQQ

SEQ ID NO: 3251842 - protein, 14 aa, Plasmodium falciparum
VDENNDNNNNNSSQ

SEQ ID NO: 3251843 - protein, 5 aa, Plasmodium falciparum
VDEQE

SEQ ID NO: 3251844 - protein, 10 aa, Plasmodium falciparum
VDEYNENKNY

SEQ ID NO: 3251845 - protein, 34 aa, Plasmodium falciparum
VDGEESTTDDPGERIQEKRRTKKKKKKKKEIKGK

SEQ ID NO: 3251846 - protein, 8 aa, Plasmodium falciparum
VDGSYNEK

SEQ ID NO: 3251847 - protein, 20 aa, Plasmodium falciparum
VDGTIQRTSSYNKHNINNPE

SEQ ID NO: 3251848 - protein, 14 aa, Plasmodium falciparum
VDINKNNGDINKNN

SEQ ID NO: 3251849 - protein, 46 aa, Plasmodium falciparum
VDINKNNGDINKNNGDINKNNGDINKNNGDINKNNGDINKNNGDIN

SEQ ID NO: 3251850 - protein, 4 aa, Plasmodium falciparum
VDIQ

SEQ ID NO: 3251851 - protein, 22 aa, Plasmodium falciparum
VDKATRSAKAAAEAKSTTVTAE

SEQ ID NO: 3251852 - protein, 10 aa, Plasmodium falciparum
VDKDGIDHQS

SEQ ID NO: 3251853 - protein, 8 aa, Plasmodium falciparum
VDKENYDD

SEQ ID NO: 3251854 - protein, 10 aa, Plasmodium falciparum
VDKGQKGLGG

SEQ ID NO: 3251855 - protein, 111 aa, Plasmodium falciparum
VDKGYRNNKHGNVVSSEDNNDDDDGDDGDDGDGDDGDGDGDDGDGDDGDGDDGDGDDGDGDDGDGDDGDGDDGDGDDGDGDDGDGDDGDGDDDNAYNDDDDHNDDDNHSDH

SEQ ID NO: 3251856 - protein, 18 aa, Plasmodium falciparum
VDKKKKKKYNKNKGHLDS

SEQ ID NO: 3251857 - protein, 22 aa, Plasmodium falciparum
VDKKKRKKKKEKEKEKKKKKNM

SEQ ID NO: 3251858 - protein, 8 aa, Plasmodium falciparum
VDKNGDVD

SEQ ID NO: 3251859 - protein, 11 aa, Plasmodium falciparum
VDKNKNEDHTN

SEQ ID NO: 3251860 - protein, 10 aa, Plasmodium falciparum
VDKNNKGDHI

SEQ ID NO: 3251861 - protein, 127 aa, Plasmodium falciparum
VDKNTEGDKDGDEDKGGGESEGGDGHGSAGDSAGGDRGGDENKDKDNEENKDKKGNKDDDDEEEEEEEEDDEEKEEKDEKDEKDEKDEKDEKDEKDEKDEKDEKDEKDEKDEKDEKGEKDESKGEEK

SEQ ID NO: 3251862 - protein, 5 aa, Plasmodium falciparum
VDKNY

SEQ ID NO: 3251863 - protein, 41 aa, Plasmodium falciparum
VDKQKNVDTPKNVDTPKNVDTPKNVDTPKNVDTPKNVDTKK

SEQ ID NO: 3251864 - protein, 8 aa, Plasmodium falciparum
VDKQMSDT

SEQ ID NO: 3251865 - protein, 9 aa, Plasmodium falciparum
VDKQNSKNN

SEQ ID NO: 3251866 - protein, 11 aa, Plasmodium falciparum
VDKSKKDKEHI

SEQ ID NO: 3251867 - protein, 7 aa, Plasmodium falciparum
VDKTDRT

SEQ ID NO: 3251868 - protein, 6 aa, Plasmodium falciparum
VDKTNE

SEQ ID NO: 3251869 - protein, 4 aa, Plasmodium falciparum
VDKY

SEQ ID NO: 3251870 - protein, 18 aa, Plasmodium falciparum
VDMNNNNNNNNKNNNISK

SEQ ID NO: 3251871 - protein, 11 aa, Plasmodium falciparum
VDNDDDNNNNI

SEQ ID NO: 3251872 - protein, 7 aa, Plasmodium falciparum
VDNEENN

SEQ ID NO: 3251873 - protein, 14 aa, Plasmodium falciparum
VDNEQDKKQAPLNK

SEQ ID NO: 3251874 - protein, 10 aa, Plasmodium falciparum
VDNHSSNNQY

SEQ ID NO: 3251875 - protein, 16 aa, Plasmodium falciparum
VDNKDKNGINNNTSNC

SEQ ID NO: 3251876 - protein, 18 aa, Plasmodium falciparum
VDNKRTHDDTIDEKYKNN

SEQ ID NO: 3251877 - protein, 4 aa, Plasmodium falciparum
VDNN

SEQ ID NO: 3251878 - protein, 22 aa, Plasmodium falciparum
VDNNGDNNDDDYDDDNNNNSTY

SEQ ID NO: 3251879 - protein, 15 aa, Plasmodium falciparum
VDNNKYNHNKKHPDV

SEQ ID NO: 3251880 - protein, 16 aa, Plasmodium falciparum
VDNNNKRNDHNKNNEL

SEQ ID NO: 3251881 - protein, 10 aa, Plasmodium falciparum
VDNNNNKNHY

SEQ ID NO: 3251882 - protein, 12 aa, Plasmodium falciparum
VDNNNNKNKNNY

SEQ ID NO: 3251883 - protein, 10 aa, Plasmodium falciparum
VDNNNNNNNH

SEQ ID NO: 3251884 - protein, 29 aa, Plasmodium falciparum
VDNNNNNNNNNNNNNNNNNNNNRSNNNSF

SEQ ID NO: 3251885 - protein, 28 aa, Plasmodium falciparum
VDNNQANKNNDYSTNYEEHNTNDSIEDM

SEQ ID NO: 3251886 - protein, 9 aa, Plasmodium falciparum
VDNNTNPKT

SEQ ID NO: 3251887 - protein, 7 aa, Plasmodium falciparum
VDNRKDG

SEQ ID NO: 3251888 - protein, 8 aa, Plasmodium falciparum
VDNSNNQI

SEQ ID NO: 3251889 - protein, 4 aa, Plasmodium falciparum
VDNT

SEQ ID NO: 3251890 - protein, 12 aa, Plasmodium falciparum
VDPLQSKEDLRQ

SEQ ID NO: 3251891 - protein, 12 aa, Plasmodium falciparum
VDPNNPNKGEIG

SEQ ID NO: 3251892 - protein, 18 aa, Plasmodium falciparum
VDQDNDKNGKKCSGYGED

SEQ ID NO: 3251893 - protein, 15 aa, Plasmodium falciparum
VDQDNNNNKFDNDTK

SEQ ID NO: 3251894 - protein, 7 aa, Plasmodium falciparum
VDQKEDD

SEQ ID NO: 3251895 - protein, 20 aa, Plasmodium falciparum
VDQNKEPKNNQKENNNYHND

SEQ ID NO: 3251896 - protein, 9 aa, Plasmodium falciparum
VDQNPEDAQ

SEQ ID NO: 3251897 - protein, 9 aa, Plasmodium falciparum
VDRDKGNSR

SEQ ID NO: 3251898 - protein, 4 aa, Plasmodium falciparum
VDRN

SEQ ID NO: 3251899 - protein, 13 aa, Plasmodium falciparum
VDSCTKGTPDCEQ

SEQ ID NO: 3251900 - protein, 5 aa, Plasmodium falciparum
VDSDI

SEQ ID NO: 3251901 - protein, 4 aa, Plasmodium falciparum
VDSE

SEQ ID NO: 3251902 - protein, 41 aa, Plasmodium falciparum
VDSEYKECKENYKNKESPNSSNNTTTTNNNNNNNNNNNNNV

SEQ ID NO: 3251903 - protein, 12 aa, Plasmodium falciparum
VDSGTSSITAPT

SEQ ID NO: 3251904 - protein, 12 aa, Plasmodium falciparum
VDSGTSTITAPT

SEQ ID NO: 3251905 - protein, 17 aa, Plasmodium falciparum
VDSNDATNKQPNNKNDI

SEQ ID NO: 3251906 - protein, 7 aa, Plasmodium falciparum
VDSNPKS

SEQ ID NO: 3251907 - protein, 18 aa, Plasmodium falciparum
VDSTTNRNDSYHANSSKY

SEQ ID NO: 3251908 - protein, 6 aa, Plasmodium falciparum
VDTDKL

SEQ ID NO: 3251909 - protein, 11 aa, Plasmodium falciparum
VDTENKKAHLN

SEQ ID NO: 3251910 - protein, 10 aa, Plasmodium falciparum
VDTGKGDYED

SEQ ID NO: 3251911 - protein, 8 aa, Plasmodium falciparum
VDTHTNPN

SEQ ID NO: 3251912 - protein, 6 aa, Plasmodium falciparum
VDTKDE

SEQ ID NO: 3251913 - protein, 18 aa, Plasmodium falciparum
VDTNSEDTEDFSINIKLE

SEQ ID NO: 3251914 - protein, 12 aa, Plasmodium falciparum
VDTQETKQYSNY

SEQ ID NO: 3251915 - protein, 7 aa, Plasmodium falciparum
VDTQGCP

SEQ ID NO: 3251916 - protein, 8 aa, Plasmodium falciparum
VDTRTEDY

SEQ ID NO: 3251917 - protein, 8 aa, Plasmodium falciparum
VDTTDDKS

SEQ ID NO: 3251918 - protein, 35 aa, Plasmodium falciparum
VDVNENKIKNGNKNKIKNDHNNNNNNKNNNNNLNG

SEQ ID NO: 3251919 - protein, 13 aa, Plasmodium falciparum
VDVNRKKEVGVKK

SEQ ID NO: 3251920 - protein, 4 aa, Plasmodium falciparum
VDVP

SEQ ID NO: 3251921 - protein, 15 aa, Plasmodium falciparum
VEANGRDGKKNPKCS

SEQ ID NO: 3251922 - protein, 21 aa, Plasmodium falciparum
VEDDDDEEPLEETEENTVEQP

SEQ ID NO: 3251923 - protein, 20 aa, Plasmodium falciparum
VEDDDDPLEEVDQNPEEAKK

SEQ ID NO: 3251924 - protein, 10 aa, Plasmodium falciparum
VEDDKAKINE

SEQ ID NO: 3251925 - protein, 10 aa, Plasmodium falciparum
VEDEASVTEE

SEQ ID NO: 3251926 - protein, 25 aa, Plasmodium falciparum
VEDENKKSLTEKEQNNYVPNENNDA

SEQ ID NO: 3251927 - protein, 7 aa, Plasmodium falciparum
VEDEQRK

SEQ ID NO: 3251928 - protein, 4 aa, Plasmodium falciparum
VEDN

SEQ ID NO: 3251929 - protein, 23 aa, Plasmodium falciparum
VEDNQETSIDRNPQYGADSHTQR

SEQ ID NO: 3251930 - protein, 7 aa, Plasmodium falciparum
VEDNTRH

SEQ ID NO: 3251931 - protein, 4 aa, Plasmodium falciparum
VEDT

SEQ ID NO: 3251932 - protein, 11 aa, Plasmodium falciparum
VEDTKRKGENQ

SEQ ID NO: 3251933 - protein, 5 aa, Plasmodium falciparum
VEDYE

SEQ ID NO: 3251934 - protein, 4 aa, Plasmodium falciparum
VEED

SEQ ID NO: 3251935 - protein, 7 aa, Plasmodium falciparum
VEEDPNE

SEQ ID NO: 3251936 - protein, 10 aa, Plasmodium falciparum
VEEDPSEKKC

SEQ ID NO: 3251937 - protein, 4 aa, Plasmodium falciparum
VEEE

SEQ ID NO: 3251938 - protein, 25 aa, Plasmodium falciparum
VEEEEKRKKMKSIEEEKEKEKLERQ

SEQ ID NO: 3251939 - protein, 13 aa, Plasmodium falciparum
VEEEELKEKENKN

SEQ ID NO: 3251940 - protein, 55 aa, Plasmodium falciparum
VEEEESSSEEIVEEEESSSEEIVEEEESSSEEIVEEEESSSEEIVEEEESSSEEI

SEQ ID NO: 3251941 - protein, 20 aa, Plasmodium falciparum
VEEEGSVTEEIKEQEESVNE

SEQ ID NO: 3251942 - protein, 5 aa, Plasmodium falciparum
VEEEK

SEQ ID NO: 3251943 - protein, 11 aa, Plasmodium falciparum
VEEGEDDEVYE

SEQ ID NO: 3251944 - protein, 30 aa, Plasmodium falciparum
VEEGSADESYNSSNDKSSEDYDDRGNDKNQ

SEQ ID NO: 3251945 - protein, 10 aa, Plasmodium falciparum
VEEGSTTEEV

SEQ ID NO: 3251946 - protein, 4 aa, Plasmodium falciparum
VEEK

SEQ ID NO: 3251947 - protein, 9 aa, Plasmodium falciparum
VEEKKEKSA

SEQ ID NO: 3251948 - protein, 9 aa, Plasmodium falciparum
VEEKNSVTS

SEQ ID NO: 3251949 - protein, 5 aa, Plasmodium falciparum
VEEMK

SEQ ID NO: 3251950 - protein, 4 aa, Plasmodium falciparum
VEEN

SEQ ID NO: 3251951 - protein, 26 aa, Plasmodium falciparum
VEENGDRRRGGITRQYSGDGESCETI

SEQ ID NO: 3251952 - protein, 11 aa, Plasmodium falciparum
VEENGNKYKSK

SEQ ID NO: 3251953 - protein, 23 aa, Plasmodium falciparum
VEENTGARGGTTKQKYSGDGEEC

SEQ ID NO: 3251954 - protein, 7 aa, Plasmodium falciparum
VEEPSQE

SEQ ID NO: 3251955 - protein, 5 aa, Plasmodium falciparum
VEEQI

SEQ ID NO: 3251956 - protein, 9 aa, Plasmodium falciparum
VEESEEINE

SEQ ID NO: 3251957 - protein, 7 aa, Plasmodium falciparum
VEESKKI

SEQ ID NO: 3251958 - protein, 7 aa, Plasmodium falciparum
VEETEDK

SEQ ID NO: 3251959 - protein, 9 aa, Plasmodium falciparum
VEETTQEGA

SEQ ID NO: 3251960 - protein, 5 aa, Plasmodium falciparum
VEGDP

SEQ ID NO: 3251961 - protein, 17 aa, Plasmodium falciparum
VEGGWKDKNKDCAKKKE

SEQ ID NO: 3251962 - protein, 9 aa, Plasmodium falciparum
VEGKKSVDM

SEQ ID NO: 3251963 - protein, 68 aa, Plasmodium falciparum
VEGKNKVKHKDKVKNKGEDKVKNKGEDNIKNKGEDNVKYKGEDNVKNKGEDNVKNKCEDNVKNKCEDN

SEQ ID NO: 3251964 - protein, 75 aa, Plasmodium falciparum
VEGTPTPTSINNNNNDNINNNDNINNNDNINNNDNNNNNDNINNNNNINNNNNNNRGNVKKEGNNNRYNPKNDDI

SEQ ID NO: 3251965 - protein, 6 aa, Plasmodium falciparum
VEHGTN

SEQ ID NO: 3251966 - protein, 36 aa, Plasmodium falciparum
VEHSDEHSDEHSVEHSDEHSNEHSDEHSDEHSDEQL

SEQ ID NO: 3251967 - protein, 6 aa, Plasmodium falciparum
VEHTDR

SEQ ID NO: 3251968 - protein, 12 aa, Plasmodium falciparum
VEISEKDKHPEN

SEQ ID NO: 3251969 - protein, 5 aa, Plasmodium falciparum
VEKDE

SEQ ID NO: 3251970 - protein, 16 aa, Plasmodium falciparum
VEKDGQDGVDDDDDLE

SEQ ID NO: 3251971 - protein, 23 aa, Plasmodium falciparum
VEKDGQDGVDDDDEEDVQKVKNA

SEQ ID NO: 3251972 - protein, 15 aa, Plasmodium falciparum
VEKEAKERSNGDLKG

SEQ ID NO: 3251973 - protein, 12 aa, Plasmodium falciparum
VEKELNKKSTAE

SEQ ID NO: 3251974 - protein, 9 aa, Plasmodium falciparum
VEKETKNIT

SEQ ID NO: 3251975 - protein, 16 aa, Plasmodium falciparum
VEKGIKENHTESKDKV

SEQ ID NO: 3251976 - protein, 5 aa, Plasmodium falciparum
VEKGK

SEQ ID NO: 3251977 - protein, 29 aa, Plasmodium falciparum
VEKHENNRLKKDKIGKEDDINEEKNIKSN

SEQ ID NO: 3251978 - protein, 4 aa, Plasmodium falciparum
VEKI

SEQ ID NO: 3251979 - protein, 38 aa, Plasmodium falciparum
VEKKDKKKKTQQENCDNKYGNKYNKCDKDKDKDNYNNK

SEQ ID NO: 3251980 - protein, 21 aa, Plasmodium falciparum
VEKKDNGEFQKKEKNNGECDG

SEQ ID NO: 3251981 - protein, 27 aa, Plasmodium falciparum
VEKKDNGEFQKKEKNNGECKGGKRYEI

SEQ ID NO: 3251982 - protein, 23 aa, Plasmodium falciparum
VEKKKKNKDNNKQKGKAKSSVGQ

SEQ ID NO: 3251983 - protein, 11 aa, Plasmodium falciparum
VEKKNKNKFDD

SEQ ID NO: 3251984 - protein, 4 aa, Plasmodium falciparum
VEKL

SEQ ID NO: 3251985 - protein, 11 aa, Plasmodium falciparum
VEKNEENKKDE

SEQ ID NO: 3251986 - protein, 19 aa, Plasmodium falciparum
VEKNGKKYTSGNDTEPMST

SEQ ID NO: 3251987 - protein, 24 aa, Plasmodium falciparum
VEKNNLNNKTYNNMNESPNNMNQS

SEQ ID NO: 3251988 - protein, 10 aa, Plasmodium falciparum
VEKNNSYESK

SEQ ID NO: 3251989 - protein, 29 aa, Plasmodium falciparum
VEKNPDNECPKQKAPGDGAAPSDPPREDI

SEQ ID NO: 3251990 - protein, 11 aa, Plasmodium falciparum
VEKQQDDDIDI

SEQ ID NO: 3251991 - protein, 7 aa, Plasmodium falciparum
VEKRDPL

SEQ ID NO: 3251992 - protein, 7 aa, Plasmodium falciparum
VEKRKSV

SEQ ID NO: 3251993 - protein, 15 aa, Plasmodium falciparum
VEKRNTRTYGPPNQK

SEQ ID NO: 3251994 - protein, 10 aa, Plasmodium falciparum
VEKTNQTNQT

SEQ ID NO: 3251995 - protein, 6 aa, Plasmodium falciparum
VEKYNE

SEQ ID NO: 3251996 - protein, 21 aa, Plasmodium falciparum
VEMNTNENVNNKTESKKMKKK

SEQ ID NO: 3251997 - protein, 9 aa, Plasmodium falciparum
VEMSKESYV

SEQ ID NO: 3251998 - protein, 13 aa, Plasmodium falciparum
VENAPNIKDQKRD

SEQ ID NO: 3251999 - protein, 7 aa, Plasmodium falciparum
VENATEE

SEQ ID NO: 3252000 - protein, 7 aa, Plasmodium falciparum
VENDENK

SEQ ID NO: 3252001 - protein, 7 aa, Plasmodium falciparum
VENDSED

SEQ ID NO: 3252002 - protein, 13 aa, Plasmodium falciparum
VENDYKDDVNGSG

SEQ ID NO: 3252003 - protein, 37 aa, Plasmodium falciparum
VENEEKDDVSNSLGNDNEMKSYDKYKGEDKNYNDEQT

SEQ ID NO: 3252004 - protein, 5 aa, Plasmodium falciparum
VENEI

SEQ ID NO: 3252005 - protein, 7 aa, Plasmodium falciparum
VENKEDE

SEQ ID NO: 3252006 - protein, 7 aa, Plasmodium falciparum
VENKNNN

SEQ ID NO: 3252007 - protein, 11 aa, Plasmodium falciparum
VENNDDGETLP

SEQ ID NO: 3252008 - protein, 72 aa, Plasmodium falciparum
VENNDVKDDEKGDNNNVKDDKKGDNNNVKDDKKGDNNNVKDDEKGDNNNDVKDEEKRDNNNNVKDDENDNMD

SEQ ID NO: 3252009 - protein, 7 aa, Plasmodium falciparum
VENNKTE

SEQ ID NO: 3252010 - protein, 10 aa, Plasmodium falciparum
VENNNGEKEK

SEQ ID NO: 3252011 - protein, 11 aa, Plasmodium falciparum
VENSESKSIHR

SEQ ID NO: 3252012 - protein, 8 aa, Plasmodium falciparum
VENTDEDY

SEQ ID NO: 3252013 - protein, 19 aa, Plasmodium falciparum
VENTPSSDVATAVSNSSSI

SEQ ID NO: 3252014 - protein, 21 aa, Plasmodium falciparum
VENTQNVESTQNVENTQNVEN

SEQ ID NO: 3252015 - protein, 5 aa, Plasmodium falciparum
VENYD

SEQ ID NO: 3252016 - protein, 38 aa, Plasmodium falciparum
VEPDDDDDYDNNNDNNNNDNNNNNNMNSYEERQNTPIN

SEQ ID NO: 3252017 - protein, 6 aa, Plasmodium falciparum
VEPQGK

SEQ ID NO: 3252018 - protein, 5 aa, Plasmodium falciparum
VEPRF

SEQ ID NO: 3252019 - protein, 14 aa, Plasmodium falciparum
VEPTKGKEKSNENY

SEQ ID NO: 3252020 - protein, 11 aa, Plasmodium falciparum
VEQENNNDNCN

SEQ ID NO: 3252021 - protein, 8 aa, Plasmodium falciparum
VEQETSVE

SEQ ID NO: 3252022 - protein, 5 aa, Plasmodium falciparum
VEQKT

SEQ ID NO: 3252023 - protein, 12 aa, Plasmodium falciparum
VEQNESAKKNSL

SEQ ID NO: 3252024 - protein, 8 aa, Plasmodium falciparum
VEQQKKQT

SEQ ID NO: 3252025 - protein, 18 aa, Plasmodium falciparum
VEQTSISNDITSHQQNNI

SEQ ID NO: 3252026 - protein, 12 aa, Plasmodium falciparum
VEREVEKRSEKL

SEQ ID NO: 3252027 - protein, 16 aa, Plasmodium falciparum
VERKKKEWKENEKKDI

SEQ ID NO: 3252028 - protein, 9 aa, Plasmodium falciparum
VERRGKYKG

SEQ ID NO: 3252029 - protein, 37 aa, Plasmodium falciparum
VESDNNNTHQNNPDGYEGNDSSSMCSDNNKKSKQKKM

SEQ ID NO: 3252030 - protein, 7 aa, Plasmodium falciparum
VESDSPV

SEQ ID NO: 3252031 - protein, 5 aa, Plasmodium falciparum
VESEG

SEQ ID NO: 3252032 - protein, 11 aa, Plasmodium falciparum
VESEPNNSYTN

SEQ ID NO: 3252033 - protein, 27 aa, Plasmodium falciparum
VESETIKKKTEHHENVNEDNVEKPKLQ

SEQ ID NO: 3252034 - protein, 39 aa, Plasmodium falciparum
VESHNNNNNNNNNNKNNNKNKNNDRNNNNRKKKDIQKSK

SEQ ID NO: 3252035 - protein, 4 aa, Plasmodium falciparum
VESK

SEQ ID NO: 3252036 - protein, 23 aa, Plasmodium falciparum
VESNDVKKGPLNNDNIKNKESNV

SEQ ID NO: 3252037 - protein, 5 aa, Plasmodium falciparum
VESNE

SEQ ID NO: 3252038 - protein, 8 aa, Plasmodium falciparum
VESPAESM

SEQ ID NO: 3252039 - protein, 9 aa, Plasmodium falciparum
VESQSRDET

SEQ ID NO: 3252040 - protein, 7 aa, Plasmodium falciparum
VESSEKK

SEQ ID NO: 3252041 - protein, 9 aa, Plasmodium falciparum
VESSGTSIP

SEQ ID NO: 3252042 - protein, 44 aa, Plasmodium falciparum
VESSNSEDSNKSDDDDEEYINEESSRNNKKKKLKQTYSSSTFKN

SEQ ID NO: 3252043 - protein, 8 aa, Plasmodium falciparum
VESTNKNV

SEQ ID NO: 3252044 - protein, 8 aa, Plasmodium falciparum
VESTTSLE

SEQ ID NO: 3252045 - protein, 4 aa, Plasmodium falciparum
VETD

SEQ ID NO: 3252046 - protein, 14 aa, Plasmodium falciparum
VETKKKKKINKSEE

SEQ ID NO: 3252047 - protein, 4 aa, Plasmodium falciparum
VETN

SEQ ID NO: 3252048 - protein, 20 aa, Plasmodium falciparum
VETNNNNNNNNNNNSNSNDA

SEQ ID NO: 3252049 - protein, 4 aa, Plasmodium falciparum
VETQ

SEQ ID NO: 3252050 - protein, 8 aa, Plasmodium falciparum
VEYETTNS

SEQ ID NO: 3252051 - protein, 14 aa, Plasmodium falciparum
VEYGPPPASAIPDT

SEQ ID NO: 3252052 - protein, 11 aa, Plasmodium falciparum
VFESEEKNNNL

SEQ ID NO: 3252053 - protein, 6 aa, Plasmodium falciparum
VFNTNE

SEQ ID NO: 3252054 - protein, 7 aa, Plasmodium falciparum
VGAEAYK

SEQ ID NO: 3252055 - protein, 4 aa, Plasmodium falciparum
VGCN

SEQ ID NO: 3252056 - protein, 5 aa, Plasmodium falciparum
VGCNT

SEQ ID NO: 3252057 - protein, 19 aa, Plasmodium falciparum
VGDTATQPQVDTPSQSDKL

SEQ ID NO: 3252058 - protein, 11 aa, Plasmodium falciparum
VGEDEKKGKGE

SEQ ID NO: 3252059 - protein, 10 aa, Plasmodium falciparum
VGEDGATHQG

SEQ ID NO: 3252060 - protein, 8 aa, Plasmodium falciparum
VGEGEGGV

SEQ ID NO: 3252061 - protein, 18 aa, Plasmodium falciparum
VGENGDRRRDGKKNPKCS

SEQ ID NO: 3252062 - protein, 9 aa, Plasmodium falciparum
VGENKNNEI

SEQ ID NO: 3252063 - protein, 5 aa, Plasmodium falciparum
VGESS

SEQ ID NO: 3252064 - protein, 4 aa, Plasmodium falciparum
VGET

SEQ ID NO: 3252065 - protein, 8 aa, Plasmodium falciparum
VGETESVT

SEQ ID NO: 3252066 - protein, 23 aa, Plasmodium falciparum
VGETPQVSTPALTSPPPSDPRAD

SEQ ID NO: 3252067 - protein, 18 aa, Plasmodium falciparum
VGGGEVYKKKKGNSFRNN

SEQ ID NO: 3252068 - protein, 12 aa, Plasmodium falciparum
VGHPGKTNSYLS

SEQ ID NO: 3252069 - protein, 9 aa, Plasmodium falciparum
VGISNSEPF

SEQ ID NO: 3252070 - protein, 16 aa, Plasmodium falciparum
VGKDNTPIQHKKENQV

SEQ ID NO: 3252071 - protein, 9 aa, Plasmodium falciparum
VGKGEQNEN

SEQ ID NO: 3252072 - protein, 12 aa, Plasmodium falciparum
VGKKDEDKNIPK

SEQ ID NO: 3252073 - protein, 14 aa, Plasmodium falciparum
VGKKISKSDENSTY

SEQ ID NO: 3252074 - protein, 6 aa, Plasmodium falciparum
VGKKNK

SEQ ID NO: 3252075 - protein, 7 aa, Plasmodium falciparum
VGKNRNR

SEQ ID NO: 3252076 - protein, 20 aa, Plasmodium falciparum
VGKNTNNINNTESNEKNSTN

SEQ ID NO: 3252077 - protein, 8 aa, Plasmodium falciparum
VGKSASDL

SEQ ID NO: 3252078 - protein, 10 aa, Plasmodium falciparum
VGKTNPSDSF

SEQ ID NO: 3252079 - protein, 4 aa, Plasmodium falciparum
VGND

SEQ ID NO: 3252080 - protein, 10 aa, Plasmodium falciparum
VGNDNQENNN

SEQ ID NO: 3252081 - protein, 31 aa, Plasmodium falciparum
VGNDNRENVVSTAGKRLNRGKPNKDGVPHTS

SEQ ID NO: 3252082 - protein, 7 aa, Plasmodium falciparum
VGNGVSP

SEQ ID NO: 3252083 - protein, 4 aa, Plasmodium falciparum
VGNN

SEQ ID NO: 3252084 - protein, 17 aa, Plasmodium falciparum
VGNNNDDDNNNNNGHIQ

SEQ ID NO: 3252085 - protein, 50 aa, Plasmodium falciparum
VGNNNTTDTNTSDNNTNDNNISDSNTSENKTNDVNVSSNNISDIKKGKEY

SEQ ID NO: 3252086 - protein, 22 aa, Plasmodium falciparum
VGPNQGGLSQGLSGKDSADKMP

SEQ ID NO: 3252087 - protein, 9 aa, Plasmodium falciparum
VGPQSPPLN

SEQ ID NO: 3252088 - protein, 6 aa, Plasmodium falciparum
VGQGAY

SEQ ID NO: 3252089 - protein, 8 aa, Plasmodium falciparum
VGQKTTAK

SEQ ID NO: 3252090 - protein, 4 aa, Plasmodium falciparum
VGRI

SEQ ID NO: 3252091 - protein, 49 aa, Plasmodium falciparum
VGRKKEYNKRINEGLEKREGHKSTYEKENEVKQNNVTQNGDKKLQNNVQ

SEQ ID NO: 3252092 - protein, 21 aa, Plasmodium falciparum
VGRKRSKGGFSGGGNDERENT

SEQ ID NO: 3252093 - protein, 38 aa, Plasmodium falciparum
VGRSGDEKSKNRTKEHFNNNKKKKNNVNNNNVGGSKNF

SEQ ID NO: 3252094 - protein, 8 aa, Plasmodium falciparum
VGSDSEEI

SEQ ID NO: 3252095 - protein, 17 aa, Plasmodium falciparum
VGSGENKVSEGNSNDNI

SEQ ID NO: 3252096 - protein, 12 aa, Plasmodium falciparum
VGSKRSSRDNSA

SEQ ID NO: 3252097 - protein, 10 aa, Plasmodium falciparum
VGSNKKIKRE

SEQ ID NO: 3252098 - protein, 4 aa, Plasmodium falciparum
VGSY

SEQ ID NO: 3252099 - protein, 22 aa, Plasmodium falciparum
VGTDINSSSESGNTNSNNENSL

SEQ ID NO: 3252100 - protein, 15 aa, Plasmodium falciparum
VGTPPTDDEEDPPEK

SEQ ID NO: 3252101 - protein, 5 aa, Plasmodium falciparum
VGTSC

SEQ ID NO: 3252102 - protein, 4 aa, Plasmodium falciparum
VGYD

SEQ ID NO: 3252103 - protein, 6 aa, Plasmodium falciparum
VGYENG

SEQ ID NO: 3252104 - protein, 6 aa, Plasmodium falciparum
VGYKED

SEQ ID NO: 3252105 - protein, 5 aa, Plasmodium falciparum
VGYQE

SEQ ID NO: 3252106 - protein, 5 aa, Plasmodium falciparum
VHDKN

SEQ ID NO: 3252107 - protein, 7 aa, Plasmodium falciparum
VHGDTED

SEQ ID NO: 3252108 - protein, 65 aa, Plasmodium falciparum
VHGKDEQTGDINTNHQKYNTKNINNNHNNNNNNNNNNNHNNNNHNNNNHNNNNHNNNNHNNNNHN

SEQ ID NO: 3252109 - protein, 10 aa, Plasmodium falciparum
VHGKQPNYND

SEQ ID NO: 3252110 - protein, 107 aa, Plasmodium falciparum
VHHTNDDKVNHTNDDKVNHTNDDKVNHTNDDKVNHTNDDKVNHTNDDNVNHTNDDKVNHTNDDKVNHTNDDKVNHTNDDKVNHTNNYYNDKKNNAGDIKTNNSIREE

SEQ ID NO: 3252111 - protein, 16 aa, Plasmodium falciparum
VHKDNNNQKGHKYDEK

SEQ ID NO: 3252112 - protein, 7 aa, Plasmodium falciparum
VHKPEEV

SEQ ID NO: 3252113 - protein, 5 aa, Plasmodium falciparum
VHNDP

SEQ ID NO: 3252114 - protein, 7 aa, Plasmodium falciparum
VHNKPVD

SEQ ID NO: 3252115 - protein, 5 aa, Plasmodium falciparum
VHNNN

SEQ ID NO: 3252116 - protein, 20 aa, Plasmodium falciparum
VHNNNNDNIKYDGAHNNNHD

SEQ ID NO: 3252117 - protein, 21 aa, Plasmodium falciparum
VHNNNTNTVNKKNKHKSSRFK

SEQ ID NO: 3252118 - protein, 6 aa, Plasmodium falciparum
VHNNST

SEQ ID NO: 3252119 - protein, 5 aa, Plasmodium falciparum
VHNPN

SEQ ID NO: 3252120 - protein, 4 aa, Plasmodium falciparum
VHQG

SEQ ID NO: 3252121 - protein, 16 aa, Plasmodium falciparum
VHQKSSSVSKKLTNPN

SEQ ID NO: 3252122 - protein, 14 aa, Plasmodium falciparum
VHQNRNEDDIDGSI

SEQ ID NO: 3252123 - protein, 11 aa, Plasmodium falciparum
VHSKNKPYITS

SEQ ID NO: 3252124 - protein, 13 aa, Plasmodium falciparum
VHSQGGNNSNRDV

SEQ ID NO: 3252125 - protein, 10 aa, Plasmodium falciparum
VHTDSTNITY

SEQ ID NO: 3252126 - protein, 5 aa, Plasmodium falciparum
VHTES

SEQ ID NO: 3252127 - protein, 14 aa, Plasmodium falciparum
VHTNDKNECASEVS

SEQ ID NO: 3252128 - protein, 5 aa, Plasmodium falciparum
VHVSE

SEQ ID NO: 3252129 - protein, 9 aa, Plasmodium falciparum
VIKSPRKVA

SEQ ID NO: 3252130 - protein, 14 aa, Plasmodium falciparum
VIQDNTKCKEYKNS

SEQ ID NO: 3252131 - protein, 9 aa, Plasmodium falciparum
VISESTTKY

SEQ ID NO: 3252132 - protein, 8 aa, Plasmodium falciparum
VISGKEGN

SEQ ID NO: 3252133 - protein, 17 aa, Plasmodium falciparum
VISSGNKTCNDKEKCDA

SEQ ID NO: 3252134 - protein, 4 aa, Plasmodium falciparum
VITK

SEQ ID NO: 3252135 - protein, 11 aa, Plasmodium falciparum
VITPDNETSNE

SEQ ID NO: 3252136 - protein, 7 aa, Plasmodium falciparum
VKAGEVT

SEQ ID NO: 3252137 - protein, 7 aa, Plasmodium falciparum
VKAQSTK

SEQ ID NO: 3252138 - protein, 6 aa, Plasmodium falciparum
VKDDEL

SEQ ID NO: 3252139 - protein, 25 aa, Plasmodium falciparum
VKDDELSDNESSDNEKSKKNLRGKK

SEQ ID NO: 3252140 - protein, 23 aa, Plasmodium falciparum
VKDDKNGEEEDEDEEDVDKVKKA

SEQ ID NO: 3252141 - protein, 9 aa, Plasmodium falciparum
VKDEKTTDI

SEQ ID NO: 3252142 - protein, 11 aa, Plasmodium falciparum
VKDENGKMGSQ

SEQ ID NO: 3252143 - protein, 17 aa, Plasmodium falciparum
VKDGENENDSYDETEED

SEQ ID NO: 3252144 - protein, 26 aa, Plasmodium falciparum
VKDGNDSSSEELDNTNVPTSKPKKKL

SEQ ID NO: 3252145 - protein, 9 aa, Plasmodium falciparum
VKDKNDNDK

SEQ ID NO: 3252146 - protein, 12 aa, Plasmodium falciparum
VKDNDKEDGTKC

SEQ ID NO: 3252147 - protein, 39 aa, Plasmodium falciparum
VKDNKGEEDNIDVEDNKGEEDNIDVEENKNVEDNKDEEV

SEQ ID NO: 3252148 - protein, 8 aa, Plasmodium falciparum
VKDNNTSF

SEQ ID NO: 3252149 - protein, 9 aa, Plasmodium falciparum
VKDPTNAKI

SEQ ID NO: 3252150 - protein, 8 aa, Plasmodium falciparum
VKDQKNGI

SEQ ID NO: 3252151 - protein, 12 aa, Plasmodium falciparum
VKDSNNENNTFS

SEQ ID NO: 3252152 - protein, 10 aa, Plasmodium falciparum
VKDTNKNAKL

SEQ ID NO: 3252153 - protein, 7 aa, Plasmodium falciparum
VKDTSDK

SEQ ID NO: 3252154 - protein, 14 aa, Plasmodium falciparum
VKECSEKEDCKMNN

SEQ ID NO: 3252155 - protein, 6 aa, Plasmodium falciparum
VKEDYT

SEQ ID NO: 3252156 - protein, 10 aa, Plasmodium falciparum
VKEEDYDNTN

SEQ ID NO: 3252157 - protein, 21 aa, Plasmodium falciparum
VKEEEEEEDEEEDQGTKNRED

SEQ ID NO: 3252158 - protein, 18 aa, Plasmodium falciparum
VKEEEIHESSSNEQSDSY

SEQ ID NO: 3252159 - protein, 8 aa, Plasmodium falciparum
VKEEESIS

SEQ ID NO: 3252160 - protein, 12 aa, Plasmodium falciparum
VKEEPKKKITKK

SEQ ID NO: 3252161 - protein, 8 aa, Plasmodium falciparum
VKEGKDQK

SEQ ID NO: 3252162 - protein, 5 aa, Plasmodium falciparum
VKEGY

SEQ ID NO: 3252163 - protein, 5 aa, Plasmodium falciparum
VKEKE

SEQ ID NO: 3252164 - protein, 10 aa, Plasmodium falciparum
VKEKENKKHS

SEQ ID NO: 3252165 - protein, 9 aa, Plasmodium falciparum
VKEKKKKKT

SEQ ID NO: 3252166 - protein, 8 aa, Plasmodium falciparum
VKEKLEEE

SEQ ID NO: 3252167 - protein, 22 aa, Plasmodium falciparum
VKEKNSKSKNEEDKTDESYNET

SEQ ID NO: 3252168 - protein, 23 aa, Plasmodium falciparum
VKENEYKKKNKVDSTHTTEQPTA

SEQ ID NO: 3252169 - protein, 19 aa, Plasmodium falciparum
VKENKSDSNDIENGNKIER

SEQ ID NO: 3252170 - protein, 22 aa, Plasmodium falciparum
VKEQKEKTGVERSNEGVEEDDC

SEQ ID NO: 3252171 - protein, 13 aa, Plasmodium falciparum
VKERKKKYKKGYI

SEQ ID NO: 3252172 - protein, 9 aa, Plasmodium falciparum
VKESDEQYE

SEQ ID NO: 3252173 - protein, 14 aa, Plasmodium falciparum
VKESNKKLQEAAGK

SEQ ID NO: 3252174 - protein, 8 aa, Plasmodium falciparum
VKETEDNA

SEQ ID NO: 3252175 - protein, 8 aa, Plasmodium falciparum
VKETNHNK

SEQ ID NO: 3252176 - protein, 8 aa, Plasmodium falciparum
VKETNSDD

SEQ ID NO: 3252177 - protein, 20 aa, Plasmodium falciparum
VKGDVKDDVKDDVKDDVKGD

SEQ ID NO: 3252178 - protein, 7 aa, Plasmodium falciparum
VKGDVND

SEQ ID NO: 3252179 - protein, 33 aa, Plasmodium falciparum
VKGEDVKGEDVKGEDVKGEDVKGDDVKGGDINR

SEQ ID NO: 3252180 - protein, 24 aa, Plasmodium falciparum
VKGKGKKLKNKGMERNKTKYKNVN

SEQ ID NO: 3252181 - protein, 27 aa, Plasmodium falciparum
VKGNEKNVEISESNNNINNKIDSEYTK

SEQ ID NO: 3252182 - protein, 8 aa, Plasmodium falciparum
VKGNEQDL

SEQ ID NO: 3252183 - protein, 6 aa, Plasmodium falciparum
VKGNQN

SEQ ID NO: 3252184 - protein, 6 aa, Plasmodium falciparum
VKGTTL

SEQ ID NO: 3252185 - protein, 16 aa, Plasmodium falciparum
VKHGDNNDNVYNNNNY

SEQ ID NO: 3252186 - protein, 17 aa, Plasmodium falciparum
VKHKSKNKNEVYTEIPF

SEQ ID NO: 3252187 - protein, 11 aa, Plasmodium falciparum
VKINEEKETKN

SEQ ID NO: 3252188 - protein, 34 aa, Plasmodium falciparum
VKKAKEVDDQNNSTGTKQIKDKEIQEDNNRKNDE

SEQ ID NO: 3252189 - protein, 7 aa, Plasmodium falciparum
VKKESNQ

SEQ ID NO: 3252190 - protein, 8 aa, Plasmodium falciparum
VKKEYNEA

SEQ ID NO: 3252191 - protein, 5 aa, Plasmodium falciparum
VKKKD

SEQ ID NO: 3252192 - protein, 8 aa, Plasmodium falciparum
VKKKERKE

SEQ ID NO: 3252193 - protein, 9 aa, Plasmodium falciparum
VKKKGHKKY

SEQ ID NO: 3252194 - protein, 14 aa, Plasmodium falciparum
VKKKKKEKDEKKKN

SEQ ID NO: 3252195 - protein, 34 aa, Plasmodium falciparum
VKKKNDKKDDAAHNVANTNEDNNNNNNNNNNNIN

SEQ ID NO: 3252196 - protein, 9 aa, Plasmodium falciparum
VKKKNEAYK

SEQ ID NO: 3252197 - protein, 48 aa, Plasmodium falciparum
VKKKNNPTTTNNNNNNNDDDKKNVEEKNKCTENYPDTNINNKDLKNDN

SEQ ID NO: 3252198 - protein, 9 aa, Plasmodium falciparum
VKKKSDNIR

SEQ ID NO: 3252199 - protein, 9 aa, Plasmodium falciparum
VKKNKDDII

SEQ ID NO: 3252200 - protein, 15 aa, Plasmodium falciparum
VKKNNRKDIKNYNEN

SEQ ID NO: 3252201 - protein, 25 aa, Plasmodium falciparum
VKKNVNKKVKKNVKKKDKNNIENEL

SEQ ID NO: 3252202 - protein, 17 aa, Plasmodium falciparum
VKKRVKKRNNKNENKDN

SEQ ID NO: 3252203 - protein, 20 aa, Plasmodium falciparum
VKKSKKSKKERKSKKWNSKI

SEQ ID NO: 3252204 - protein, 7 aa, Plasmodium falciparum
VKKSTHA

SEQ ID NO: 3252205 - protein, 9 aa, Plasmodium falciparum
VKKYKNNGT

SEQ ID NO: 3252206 - protein, 10 aa, Plasmodium falciparum
VKKYNDQNYV

SEQ ID NO: 3252207 - protein, 10 aa, Plasmodium falciparum
VKLSGGERQR

SEQ ID NO: 3252208 - protein, 4 aa, Plasmodium falciparum
VKNA

SEQ ID NO: 3252209 - protein, 9 aa, Plasmodium falciparum
VKNDDNQNL

SEQ ID NO: 3252210 - protein, 9 aa, Plasmodium falciparum
VKNDEDEYL

SEQ ID NO: 3252211 - protein, 10 aa, Plasmodium falciparum
VKNDNDLTTC

SEQ ID NO: 3252212 - protein, 4 aa, Plasmodium falciparum
VKNE

SEQ ID NO: 3252213 - protein, 26 aa, Plasmodium falciparum
VKNEKEGEKDYMDNEQKDERKRYKRK

SEQ ID NO: 3252214 - protein, 9 aa, Plasmodium falciparum
VKNENKNKD

SEQ ID NO: 3252215 - protein, 33 aa, Plasmodium falciparum
VKNENNDGSYINSNGSYINNPENSNSNNNDDTN

SEQ ID NO: 3252216 - protein, 12 aa, Plasmodium falciparum
VKNGDAETYKGA

SEQ ID NO: 3252217 - protein, 8 aa, Plasmodium falciparum
VKNGEAKT

SEQ ID NO: 3252218 - protein, 21 aa, Plasmodium falciparum
VKNGEDDDDDDDVDGNYVKNG

SEQ ID NO: 3252219 - protein, 5 aa, Plasmodium falciparum
VKNGG

SEQ ID NO: 3252220 - protein, 11 aa, Plasmodium falciparum
VKNGGADAKKY

SEQ ID NO: 3252221 - protein, 7 aa, Plasmodium falciparum
VKNGGAE

SEQ ID NO: 3252222 - protein, 6 aa, Plasmodium falciparum
VKNGKD

SEQ ID NO: 3252223 - protein, 6 aa, Plasmodium falciparum
VKNKEA

SEQ ID NO: 3252224 - protein, 12 aa, Plasmodium falciparum
VKNKKGKRKKMK

SEQ ID NO: 3252225 - protein, 12 aa, Plasmodium falciparum
VKNKKGKSKDLS

SEQ ID NO: 3252226 - protein, 9 aa, Plasmodium falciparum
VKNKKNNNE

SEQ ID NO: 3252227 - protein, 9 aa, Plasmodium falciparum
VKNNHKENT

SEQ ID NO: 3252228 - protein, 7 aa, Plasmodium falciparum
VKNNKNS

SEQ ID NO: 3252229 - protein, 5 aa, Plasmodium falciparum
VKNNN

SEQ ID NO: 3252230 - protein, 10 aa, Plasmodium falciparum
VKNNNNNNRW

SEQ ID NO: 3252231 - protein, 5 aa, Plasmodium falciparum
VKNNY

SEQ ID NO: 3252232 - protein, 10 aa, Plasmodium falciparum
VKNPDGKNTY

SEQ ID NO: 3252233 - protein, 16 aa, Plasmodium falciparum
VKNPEIDTKTARQQYK

SEQ ID NO: 3252234 - protein, 9 aa, Plasmodium falciparum
VKNPSEESM

SEQ ID NO: 3252235 - protein, 4 aa, Plasmodium falciparum
VKNQ

SEQ ID NO: 3252236 - protein, 4 aa, Plasmodium falciparum
VKNR

SEQ ID NO: 3252237 - protein, 10 aa, Plasmodium falciparum
VKNSSNKEDM

SEQ ID NO: 3252238 - protein, 4 aa, Plasmodium falciparum
VKNT

SEQ ID NO: 3252239 - protein, 45 aa, Plasmodium falciparum
VKNTTNSKRKKYNSNNTMPTKKYNNTHQDNNITENREKENTSSIY

SEQ ID NO: 3252240 - protein, 4 aa, Plasmodium falciparum
VKPC

SEQ ID NO: 3252241 - protein, 10 aa, Plasmodium falciparum
VKPEDIKKDE

SEQ ID NO: 3252242 - protein, 5 aa, Plasmodium falciparum
VKPFQ

SEQ ID NO: 3252243 - protein, 16 aa, Plasmodium falciparum
VKPTTVRSNSSKLDDK

SEQ ID NO: 3252244 - protein, 18 aa, Plasmodium falciparum
VKPYDPEDIKDEEFNEPS

SEQ ID NO: 3252245 - protein, 16 aa, Plasmodium falciparum
VKQKELDEKKKQQQEN

SEQ ID NO: 3252246 - protein, 5 aa, Plasmodium falciparum
VKQKY

SEQ ID NO: 3252247 - protein, 10 aa, Plasmodium falciparum
VKQNTEKENH

SEQ ID NO: 3252248 - protein, 11 aa, Plasmodium falciparum
VKQQAKDDTLL

SEQ ID NO: 3252249 - protein, 5 aa, Plasmodium falciparum
VKQVS

SEQ ID NO: 3252250 - protein, 20 aa, Plasmodium falciparum
VKREGEEEDDDEEDYKNVKA

SEQ ID NO: 3252251 - protein, 15 aa, Plasmodium falciparum
VKRENQNKTKKNNDL

SEQ ID NO: 3252252 - protein, 22 aa, Plasmodium falciparum
VKRKKNIKNEENHEKKKKEVNM

SEQ ID NO: 3252253 - protein, 12 aa, Plasmodium falciparum
VKRKRKLKNIYE

SEQ ID NO: 3252254 - protein, 14 aa, Plasmodium falciparum
VKRREEKKKSKLGN

SEQ ID NO: 3252255 - protein, 9 aa, Plasmodium falciparum
VKRSNNNNE

SEQ ID NO: 3252256 - protein, 5 aa, Plasmodium falciparum
VKRSV

SEQ ID NO: 3252257 - protein, 10 aa, Plasmodium falciparum
VKSENGLNKP

SEQ ID NO: 3252258 - protein, 15 aa, Plasmodium falciparum
VKSESNGFKDELEGS

SEQ ID NO: 3252259 - protein, 8 aa, Plasmodium falciparum
VKSHKARK

SEQ ID NO: 3252260 - protein, 10 aa, Plasmodium falciparum
VKSKDENTES

SEQ ID NO: 3252261 - protein, 7 aa, Plasmodium falciparum
VKSKKKK

SEQ ID NO: 3252262 - protein, 7 aa, Plasmodium falciparum
VKSNISD

SEQ ID NO: 3252263 - protein, 9 aa, Plasmodium falciparum
VKSNKNIDS

SEQ ID NO: 3252264 - protein, 13 aa, Plasmodium falciparum
VKSPKPSENPSDV

SEQ ID NO: 3252265 - protein, 9 aa, Plasmodium falciparum
VKSSNDDNI

SEQ ID NO: 3252266 - protein, 14 aa, Plasmodium falciparum
VKSSSASVPGGGND

SEQ ID NO: 3252267 - protein, 9 aa, Plasmodium falciparum
VKTAVDTTK

SEQ ID NO: 3252268 - protein, 5 aa, Plasmodium falciparum
VKTDD

SEQ ID NO: 3252269 - protein, 27 aa, Plasmodium falciparum
VKTENKLNDSNNKNDNNNYNNSNQNIN

SEQ ID NO: 3252270 - protein, 4 aa, Plasmodium falciparum
VKTK

SEQ ID NO: 3252271 - protein, 12 aa, Plasmodium falciparum
VKTKDKPKNIEE

SEQ ID NO: 3252272 - protein, 5 aa, Plasmodium falciparum
VKTNR

SEQ ID NO: 3252273 - protein, 7 aa, Plasmodium falciparum
VKTNSTI

SEQ ID NO: 3252274 - protein, 5 aa, Plasmodium falciparum
VKTNY

SEQ ID NO: 3252275 - protein, 48 aa, Plasmodium falciparum
VKTQENVNKNENNEKEQKFDTTETTNVHQNETNKNKSNKKNNRKKNKK

SEQ ID NO: 3252276 - protein, 5 aa, Plasmodium falciparum
VKTQN

SEQ ID NO: 3252277 - protein, 4 aa, Plasmodium falciparum
VKVN

SEQ ID NO: 3252278 - protein, 18 aa, Plasmodium falciparum
VLDQTTNKGDNINDGNKI

SEQ ID NO: 3252279 - protein, 6 aa, Plasmodium falciparum
VLKGDD

SEQ ID NO: 3252280 - protein, 4 aa, Plasmodium falciparum
VLNN

SEQ ID NO: 3252281 - protein, 10 aa, Plasmodium falciparum
VLNNKSDHND

SEQ ID NO: 3252282 - protein, 18 aa, Plasmodium falciparum
VLNNSNNVEDGDNENSKF

SEQ ID NO: 3252283 - protein, 4 aa, Plasmodium falciparum
VLPK

SEQ ID NO: 3252284 - protein, 11 aa, Plasmodium falciparum
VLQKGDDNDME

SEQ ID NO: 3252285 - protein, 11 aa, Plasmodium falciparum
VLQPEQEESVS

SEQ ID NO: 3252286 - protein, 6 aa, Plasmodium falciparum
VLSPTN

SEQ ID NO: 3252287 - protein, 10 aa, Plasmodium falciparum
VMKEKSDDTY

SEQ ID NO: 3252288 - protein, 5 aa, Plasmodium falciparum
VMSDR

SEQ ID NO: 3252289 - protein, 4 aa, Plasmodium falciparum
VNAE

SEQ ID NO: 3252290 - protein, 5 aa, Plasmodium falciparum
VNCEH

SEQ ID NO: 3252291 - protein, 11 aa, Plasmodium falciparum
VNDADDTNDID

SEQ ID NO: 3252292 - protein, 56 aa, Plasmodium falciparum
VNDDDSSVGNKRKYNKENENNKNNNNNNNNRHNRRNKNKHNNNNNNNSSGDNSNAI

SEQ ID NO: 3252293 - protein, 9 aa, Plasmodium falciparum
VNDESINTA

SEQ ID NO: 3252294 - protein, 25 aa, Plasmodium falciparum
VNDESNNKRDNYDTLNKDSSCNRNE

SEQ ID NO: 3252295 - protein, 73 aa, Plasmodium falciparum
VNDGDKNSNFNNNNNNNINGDSNNNNINGDSNNNNINGDSNNNNINGDSNNNNINGDSNNNNINGDSNNNNYH

SEQ ID NO: 3252296 - protein, 17 aa, Plasmodium falciparum
VNDNDNSSCGSNSKDSL

SEQ ID NO: 3252297 - protein, 5 aa, Plasmodium falciparum
VNDNN

SEQ ID NO: 3252298 - protein, 5 aa, Plasmodium falciparum
VNDNP

SEQ ID NO: 3252299 - protein, 14 aa, Plasmodium falciparum
VNDNVNNKEEKKME

SEQ ID NO: 3252300 - protein, 24 aa, Plasmodium falciparum
VNDPDSYKTSYERKEKDSTFDEEE

SEQ ID NO: 3252301 - protein, 5 aa, Plasmodium falciparum
VNDRE

SEQ ID NO: 3252302 - protein, 9 aa, Plasmodium falciparum
VNDYSESSN

SEQ ID NO: 3252303 - protein, 9 aa, Plasmodium falciparum
VNEADGTNM

SEQ ID NO: 3252304 - protein, 6 aa, Plasmodium falciparum
VNEDTL

SEQ ID NO: 3252305 - protein, 8 aa, Plasmodium falciparum
VNEEDQEG

SEQ ID NO: 3252306 - protein, 7 aa, Plasmodium falciparum
VNEESPC

SEQ ID NO: 3252307 - protein, 18 aa, Plasmodium falciparum
VNEETQSVAENNEEDKEL

SEQ ID NO: 3252308 - protein, 4 aa, Plasmodium falciparum
VNEG

SEQ ID NO: 3252309 - protein, 7 aa, Plasmodium falciparum
VNEHTTS

SEQ ID NO: 3252310 - protein, 4 aa, Plasmodium falciparum
VNEK

SEQ ID NO: 3252311 - protein, 62 aa, Plasmodium falciparum
VNEKDTANKDKVIEQEKEKEEVKEKEEVKEKEEVKEKEEVKEKEEVKEKEEVKEKDTESKDN

SEQ ID NO: 3252312 - protein, 12 aa, Plasmodium falciparum
VNEKDTESKDKM

SEQ ID NO: 3252313 - protein, 10 aa, Plasmodium falciparum
VNEKKKKKYM

SEQ ID NO: 3252314 - protein, 10 aa, Plasmodium falciparum
VNEKKSPICK

SEQ ID NO: 3252315 - protein, 20 aa, Plasmodium falciparum
VNEKRNDKNVDNKNKDKEEC

SEQ ID NO: 3252316 - protein, 11 aa, Plasmodium falciparum
VNEKSNSKNMK

SEQ ID NO: 3252317 - protein, 10 aa, Plasmodium falciparum
VNEKTQENNY

SEQ ID NO: 3252318 - protein, 6 aa, Plasmodium falciparum
VNENDP

SEQ ID NO: 3252319 - protein, 8 aa, Plasmodium falciparum
VNENITEG

SEQ ID NO: 3252320 - protein, 5 aa, Plasmodium falciparum
VNENL

SEQ ID NO: 3252321 - protein, 27 aa, Plasmodium falciparum
VNENLKNDTLKENEQKYDKLKTNGKRK

SEQ ID NO: 3252322 - protein, 16 aa, Plasmodium falciparum
VNENNSSSIKNKVNQN

SEQ ID NO: 3252323 - protein, 15 aa, Plasmodium falciparum
VNETDNKSEDYNDDS

SEQ ID NO: 3252324 - protein, 5 aa, Plasmodium falciparum
VNEYT

SEQ ID NO: 3252325 - protein, 11 aa, Plasmodium falciparum
VNGDGKGERYP

SEQ ID NO: 3252326 - protein, 9 aa, Plasmodium falciparum
VNGEKDNGK

SEQ ID NO: 3252327 - protein, 5 aa, Plasmodium falciparum
VNGEV

SEQ ID NO: 3252328 - protein, 5 aa, Plasmodium falciparum
VNGKD

SEQ ID NO: 3252329 - protein, 9 aa, Plasmodium falciparum
VNGKPNGEN

SEQ ID NO: 3252330 - protein, 10 aa, Plasmodium falciparum
VNGKSNRYPC

SEQ ID NO: 3252331 - protein, 6 aa, Plasmodium falciparum
VNGLTT

SEQ ID NO: 3252332 - protein, 4 aa, Plasmodium falciparum
VNGN

SEQ ID NO: 3252333 - protein, 48 aa, Plasmodium falciparum
VNGNEGDHINGNEGDHINGNEGDHINGNEGDHINGNEDDHINGNEDDH

SEQ ID NO: 3252334 - protein, 10 aa, Plasmodium falciparum
VNGNNHNDYK

SEQ ID NO: 3252335 - protein, 49 aa, Plasmodium falciparum
VNGSKDEYSPETESANSKIKPTYEENDEDKSKISIETSEIDRDKEPFRI

SEQ ID NO: 3252336 - protein, 17 aa, Plasmodium falciparum
VNGSKDNTKNSNNGRDR

SEQ ID NO: 3252337 - protein, 15 aa, Plasmodium falciparum
VNGSSAKGKDGTQKD

SEQ ID NO: 3252338 - protein, 8 aa, Plasmodium falciparum
VNGTQNQN

SEQ ID NO: 3252339 - protein, 11 aa, Plasmodium falciparum
VNHDTKNKYPL

SEQ ID NO: 3252340 - protein, 24 aa, Plasmodium falciparum
VNHNNSNNNNNNNNNNVDIKKPKQ

SEQ ID NO: 3252341 - protein, 17 aa, Plasmodium falciparum
VNIDKDDDGDDDNDNDD

SEQ ID NO: 3252342 - protein, 30 aa, Plasmodium falciparum
VNIQNGQSVNIQNDQDINDQNNKDINVQND

SEQ ID NO: 3252343 - protein, 15 aa, Plasmodium falciparum
VNKDEYNKREISKHE

SEQ ID NO: 3252344 - protein, 7 aa, Plasmodium falciparum
VNKDNDK

SEQ ID NO: 3252345 - protein, 12 aa, Plasmodium falciparum
VNKDNKSEKCKK

SEQ ID NO: 3252346 - protein, 14 aa, Plasmodium falciparum
VNKDNNNNNNTEQI

SEQ ID NO: 3252347 - protein, 12 aa, Plasmodium falciparum
VNKEENTNLYDG

SEQ ID NO: 3252348 - protein, 7 aa, Plasmodium falciparum
VNKEKTK

SEQ ID NO: 3252349 - protein, 8 aa, Plasmodium falciparum
VNKENNMN

SEQ ID NO: 3252350 - protein, 10 aa, Plasmodium falciparum
VNKESSIQNE

SEQ ID NO: 3252351 - protein, 12 aa, Plasmodium falciparum
VNKGEPKNDDKK

SEQ ID NO: 3252352 - protein, 10 aa, Plasmodium falciparum
VNKKENEEKI

SEQ ID NO: 3252353 - protein, 7 aa, Plasmodium falciparum
VNKKNRS

SEQ ID NO: 3252354 - protein, 5 aa, Plasmodium falciparum
VNKKS

SEQ ID NO: 3252355 - protein, 11 aa, Plasmodium falciparum
VNKKTQKMTKN

SEQ ID NO: 3252356 - protein, 13 aa, Plasmodium falciparum
VNKNDEDLNNNSK

SEQ ID NO: 3252357 - protein, 8 aa, Plasmodium falciparum
VNKNDRNM

SEQ ID NO: 3252358 - protein, 16 aa, Plasmodium falciparum
VNKNHQDNSQKTQSIN

SEQ ID NO: 3252359 - protein, 8 aa, Plasmodium falciparum
VNKNKSDM

SEQ ID NO: 3252360 - protein, 19 aa, Plasmodium falciparum
VNKNNKNKKSKKNKKNDSC

SEQ ID NO: 3252361 - protein, 9 aa, Plasmodium falciparum
VNKNNNNNL

SEQ ID NO: 3252362 - protein, 25 aa, Plasmodium falciparum
VNKNNNNNNNNKNKNTQKNQNQNKI

SEQ ID NO: 3252363 - protein, 30 aa, Plasmodium falciparum
VNKRNSRDSKLSEALSEDKKGSNASNKSSI

SEQ ID NO: 3252364 - protein, 9 aa, Plasmodium falciparum
VNKSESMED

SEQ ID NO: 3252365 - protein, 10 aa, Plasmodium falciparum
VNKSKDSIEK

SEQ ID NO: 3252366 - protein, 8 aa, Plasmodium falciparum
VNKSNTDK

SEQ ID NO: 3252367 - protein, 9 aa, Plasmodium falciparum
VNKTGDEHM

SEQ ID NO: 3252368 - protein, 8 aa, Plasmodium falciparum
VNKYAEQN

SEQ ID NO: 3252369 - protein, 10 aa, Plasmodium falciparum
VNNANTGVNS

SEQ ID NO: 3252370 - protein, 4 aa, Plasmodium falciparum
VNND

SEQ ID NO: 3252371 - protein, 16 aa, Plasmodium falciparum
VNNDDKYNDKSNDKDI

SEQ ID NO: 3252372 - protein, 101 aa, Plasmodium falciparum
VNNDDTTKNQQQNVNNNEKLNNNNNNNNNQQVNNNNNNNNQQVNNNNNNNNNQVNNNNNNNNNQVNNNNYNNNNQVNNNNNNNQQVNNNNNYNNQLNNNNF

SEQ ID NO: 3252373 - protein, 32 aa, Plasmodium falciparum
VNNDNNDNNENDDNNENNENDDNNENNENNDN

SEQ ID NO: 3252374 - protein, 12 aa, Plasmodium falciparum
VNNDNQLNKQNN

SEQ ID NO: 3252375 - protein, 16 aa, Plasmodium falciparum
VNNDSSDISEKVKTKK

SEQ ID NO: 3252376 - protein, 15 aa, Plasmodium falciparum
VNNEATNKQTNKINK

SEQ ID NO: 3252377 - protein, 8 aa, Plasmodium falciparum
VNNEEDKK

SEQ ID NO: 3252378 - protein, 10 aa, Plasmodium falciparum
VNNEGDNNIS

SEQ ID NO: 3252379 - protein, 11 aa, Plasmodium falciparum
VNNEPYSNNYK

SEQ ID NO: 3252380 - protein, 8 aa, Plasmodium falciparum
VNNGSNRS

SEQ ID NO: 3252381 - protein, 7 aa, Plasmodium falciparum
VNNHNNM

SEQ ID NO: 3252382 - protein, 20 aa, Plasmodium falciparum
VNNIKENKHEKNYKNDEVKN

SEQ ID NO: 3252383 - protein, 7 aa, Plasmodium falciparum
VNNKENK

SEQ ID NO: 3252384 - protein, 7 aa, Plasmodium falciparum
VNNKKEK

SEQ ID NO: 3252385 - protein, 11 aa, Plasmodium falciparum
VNNKNDTTNDY

SEQ ID NO: 3252386 - protein, 9 aa, Plasmodium falciparum
VNNKNEEDY

SEQ ID NO: 3252387 - protein, 15 aa, Plasmodium falciparum
VNNKYTKRQKKEEMK

SEQ ID NO: 3252388 - protein, 4 aa, Plasmodium falciparum
VNNN

SEQ ID NO: 3252389 - protein, 35 aa, Plasmodium falciparum
VNNNHNKNNRTSSIKTNSSNKTQSTKNTKTNINSY

SEQ ID NO: 3252390 - protein, 14 aa, Plasmodium falciparum
VNNNINDCEDNNID

SEQ ID NO: 3252391 - protein, 5 aa, Plasmodium falciparum
VNNNN

SEQ ID NO: 3252392 - protein, 8 aa, Plasmodium falciparum
VNNNNNLN

SEQ ID NO: 3252393 - protein, 34 aa, Plasmodium falciparum
VNNNNNNNNNNNNNNNNNSNNNKILDPSTNSLQQ

SEQ ID NO: 3252394 - protein, 10 aa, Plasmodium falciparum
VNNNNNNPSV

SEQ ID NO: 3252395 - protein, 6 aa, Plasmodium falciparum
VNNNRN

SEQ ID NO: 3252396 - protein, 6 aa, Plasmodium falciparum
VNNNTH

SEQ ID NO: 3252397 - protein, 9 aa, Plasmodium falciparum
VNNNTNDDS

SEQ ID NO: 3252398 - protein, 11 aa, Plasmodium falciparum
VNNNTNNGTIQ

SEQ ID NO: 3252399 - protein, 38 aa, Plasmodium falciparum
VNNNTNNNNDEKNNKKHSNDKKSKEDNDDMGYHTGDEN

SEQ ID NO: 3252400 - protein, 8 aa, Plasmodium falciparum
VNNQNKKY

SEQ ID NO: 3252401 - protein, 4 aa, Plasmodium falciparum
VNNR

SEQ ID NO: 3252402 - protein, 8 aa, Plasmodium falciparum
VNNSDCNS

SEQ ID NO: 3252403 - protein, 12 aa, Plasmodium falciparum
VNNSDKEINNNE

SEQ ID NO: 3252404 - protein, 34 aa, Plasmodium falciparum
VNNTDNNNDNNKDNNNDNNNDNNDDNNDDDNNDN

SEQ ID NO: 3252405 - protein, 10 aa, Plasmodium falciparum
VNNTENDESA

SEQ ID NO: 3252406 - protein, 11 aa, Plasmodium falciparum
VNNTKEKLTDQ

SEQ ID NO: 3252407 - protein, 11 aa, Plasmodium falciparum
VNNTNEVNNTN

SEQ ID NO: 3252408 - protein, 6 aa, Plasmodium falciparum
VNNTPN

SEQ ID NO: 3252409 - protein, 11 aa, Plasmodium falciparum
VNNTSSKNSIS

SEQ ID NO: 3252410 - protein, 4 aa, Plasmodium falciparum
VNNV

SEQ ID NO: 3252411 - protein, 6 aa, Plasmodium falciparum
VNNVQS

SEQ ID NO: 3252412 - protein, 12 aa, Plasmodium falciparum
VNNYDNDNSSNI

SEQ ID NO: 3252413 - protein, 20 aa, Plasmodium falciparum
VNNYNNTDGYNNNIDGYNNN

SEQ ID NO: 3252414 - protein, 5 aa, Plasmodium falciparum
VNPDD

SEQ ID NO: 3252415 - protein, 5 aa, Plasmodium falciparum
VNPDL

SEQ ID NO: 3252416 - protein, 9 aa, Plasmodium falciparum
VNPDNVEYG

SEQ ID NO: 3252417 - protein, 9 aa, Plasmodium falciparum
VNPGNIPDN

SEQ ID NO: 3252418 - protein, 12 aa, Plasmodium falciparum
VNPYKKKETQLS

SEQ ID NO: 3252419 - protein, 13 aa, Plasmodium falciparum
VNQINDDDKNYYK

SEQ ID NO: 3252420 - protein, 5 aa, Plasmodium falciparum
VNQND

SEQ ID NO: 3252421 - protein, 19 aa, Plasmodium falciparum
VNQNEYSNKYKKKDDGQKK

SEQ ID NO: 3252422 - protein, 12 aa, Plasmodium falciparum
VNRKKSDCSTGC

SEQ ID NO: 3252423 - protein, 18 aa, Plasmodium falciparum
VNSDKNSYDDDSNKTFSH

SEQ ID NO: 3252424 - protein, 20 aa, Plasmodium falciparum
VNSENNKKMDIPKNDEQIGK

SEQ ID NO: 3252425 - protein, 6 aa, Plasmodium falciparum
VNSETY

SEQ ID NO: 3252426 - protein, 4 aa, Plasmodium falciparum
VNSF

SEQ ID NO: 3252427 - protein, 10 aa, Plasmodium falciparum
VNSGKNKKGI

SEQ ID NO: 3252428 - protein, 36 aa, Plasmodium falciparum
VNSGKNSGGGESGDRGKGASSTSDTSGTNDETKGTF

SEQ ID NO: 3252429 - protein, 4 aa, Plasmodium falciparum
VNSH

SEQ ID NO: 3252430 - protein, 7 aa, Plasmodium falciparum
VNSKNGE

SEQ ID NO: 3252431 - protein, 10 aa, Plasmodium falciparum
VNSKNNRTKN

SEQ ID NO: 3252432 - protein, 19 aa, Plasmodium falciparum
VNSNKLSNKNLNNNKYEDN

SEQ ID NO: 3252433 - protein, 12 aa, Plasmodium falciparum
VNSNRSKNGKHS

SEQ ID NO: 3252434 - protein, 7 aa, Plasmodium falciparum
VNSPSQQ

SEQ ID NO: 3252435 - protein, 4 aa, Plasmodium falciparum
VNSS

SEQ ID NO: 3252436 - protein, 18 aa, Plasmodium falciparum
VNSSSGSGGGEGSNKTFS

SEQ ID NO: 3252437 - protein, 10 aa, Plasmodium falciparum
VNSSSNNREM

SEQ ID NO: 3252438 - protein, 23 aa, Plasmodium falciparum
VNSSSSTTSRVHKQNKKDNKYDD

SEQ ID NO: 3252439 - protein, 5 aa, Plasmodium falciparum
VNSYP

SEQ ID NO: 3252440 - protein, 5 aa, Plasmodium falciparum
VNTDE

SEQ ID NO: 3252441 - protein, 15 aa, Plasmodium falciparum
VNTDNKENNVNINQE

SEQ ID NO: 3252442 - protein, 14 aa, Plasmodium falciparum
VNTEEINRTEKSVN

SEQ ID NO: 3252443 - protein, 12 aa, Plasmodium falciparum
VNTEEYKNVDSQ

SEQ ID NO: 3252444 - protein, 13 aa, Plasmodium falciparum
VNTENTTAESEYT

SEQ ID NO: 3252445 - protein, 22 aa, Plasmodium falciparum
VNTGGAASGGTSGTNVESQGTF

SEQ ID NO: 3252446 - protein, 5 aa, Plasmodium falciparum
VNTGN

SEQ ID NO: 3252447 - protein, 14 aa, Plasmodium falciparum
VNTKEDSHNNYQQN

SEQ ID NO: 3252448 - protein, 5 aa, Plasmodium falciparum
VNTLN

SEQ ID NO: 3252449 - protein, 4 aa, Plasmodium falciparum
VNTN

SEQ ID NO: 3252450 - protein, 12 aa, Plasmodium falciparum
VNTNEWANPTGL

SEQ ID NO: 3252451 - protein, 20 aa, Plasmodium falciparum
VNTNNHKNNNMNPSISNNDN

SEQ ID NO: 3252452 - protein, 10 aa, Plasmodium falciparum
VNTNNKRNPM

SEQ ID NO: 3252453 - protein, 7 aa, Plasmodium falciparum
VNTNNNI

SEQ ID NO: 3252454 - protein, 14 aa, Plasmodium falciparum
VNTNTNMKNNNQGN

SEQ ID NO: 3252455 - protein, 9 aa, Plasmodium falciparum
VNTPVQEND

SEQ ID NO: 3252456 - protein, 39 aa, Plasmodium falciparum
VNTTKKIDESDIEPVGEEKEKEKNETDKIKQNNNNNNNN

SEQ ID NO: 3252457 - protein, 7 aa, Plasmodium falciparum
VNTTRDD

SEQ ID NO: 3252458 - protein, 11 aa, Plasmodium falciparum
VNTYSYDKGEH

SEQ ID NO: 3252459 - protein, 9 aa, Plasmodium falciparum
VNYEEKNNH

SEQ ID NO: 3252460 - protein, 4 aa, Plasmodium falciparum
VNYS

SEQ ID NO: 3252461 - protein, 7 aa, Plasmodium falciparum
VPAATSA

SEQ ID NO: 3252462 - protein, 13 aa, Plasmodium falciparum
VPDKKYKTYRHSS

SEQ ID NO: 3252463 - protein, 28 aa, Plasmodium falciparum
VPEKSKVPESEDDSTKTSESTKKGESSI

SEQ ID NO: 3252464 - protein, 4 aa, Plasmodium falciparum
VPEY

SEQ ID NO: 3252465 - protein, 11 aa, Plasmodium falciparum
VPFEKNKEKKY

SEQ ID NO: 3252466 - protein, 7 aa, Plasmodium falciparum
VPGRNST

SEQ ID NO: 3252467 - protein, 8 aa, Plasmodium falciparum
VPGSGKTS

SEQ ID NO: 3252468 - protein, 7 aa, Plasmodium falciparum
VPIKQDG

SEQ ID NO: 3252469 - protein, 5 aa, Plasmodium falciparum
VPKDK

SEQ ID NO: 3252470 - protein, 8 aa, Plasmodium falciparum
VPKEENDM

SEQ ID NO: 3252471 - protein, 12 aa, Plasmodium falciparum
VPKEESENSNND

SEQ ID NO: 3252472 - protein, 15 aa, Plasmodium falciparum
VPKERNNINNDENKI

SEQ ID NO: 3252473 - protein, 5 aa, Plasmodium falciparum
VPKGD

SEQ ID NO: 3252474 - protein, 9 aa, Plasmodium falciparum
VPKKKGNGH

SEQ ID NO: 3252475 - protein, 7 aa, Plasmodium falciparum
VPKKKRN

SEQ ID NO: 3252476 - protein, 19 aa, Plasmodium falciparum
VPKSGKKKRRLKKSKKITK

SEQ ID NO: 3252477 - protein, 5 aa, Plasmodium falciparum
VPKTS

SEQ ID NO: 3252478 - protein, 11 aa, Plasmodium falciparum
VPLPESASEAK

SEQ ID NO: 3252479 - protein, 4 aa, Plasmodium falciparum
VPLS

SEQ ID NO: 3252480 - protein, 11 aa, Plasmodium falciparum
VPNDIRSQGIE

SEQ ID NO: 3252481 - protein, 5 aa, Plasmodium falciparum
VPNIP

SEQ ID NO: 3252482 - protein, 9 aa, Plasmodium falciparum
VPNKEKGKC

SEQ ID NO: 3252483 - protein, 7 aa, Plasmodium falciparum
VPNQKEI

SEQ ID NO: 3252484 - protein, 8 aa, Plasmodium falciparum
VPNSKEVQ

SEQ ID NO: 3252485 - protein, 6 aa, Plasmodium falciparum
VPPAET

SEQ ID NO: 3252486 - protein, 9 aa, Plasmodium falciparum
VPPEGVDPT

SEQ ID NO: 3252487 - protein, 6 aa, Plasmodium falciparum
VPPPQQ

SEQ ID NO: 3252488 - protein, 6 aa, Plasmodium falciparum
VPPPRG

SEQ ID NO: 3252489 - protein, 5 aa, Plasmodium falciparum
VPPQR

SEQ ID NO: 3252490 - protein, 5 aa, Plasmodium falciparum
VPPRR

SEQ ID NO: 3252491 - protein, 7 aa, Plasmodium falciparum
VPPTDEY

SEQ ID NO: 3252492 - protein, 79 aa, Plasmodium falciparum
VPQEPKAEDESGCKTDAPQPDVKEEEEEKEEEKDKGDEEQSGAPSSPSPSEGTEEPPPAPEAPPSTPRPQPLPSDNTSD

SEQ ID NO: 3252493 - protein, 14 aa, Plasmodium falciparum
VPQPEEPQEPVPTD

SEQ ID NO: 3252494 - protein, 5 aa, Plasmodium falciparum
VPRQI

SEQ ID NO: 3252495 - protein, 9 aa, Plasmodium falciparum
VPRSTRAQK

SEQ ID NO: 3252496 - protein, 7 aa, Plasmodium falciparum
VPSFGEQ

SEQ ID NO: 3252497 - protein, 10 aa, Plasmodium falciparum
VPSKSNKSTN

SEQ ID NO: 3252498 - protein, 81 aa, Plasmodium falciparum
VPSNNKKKKNNNNNNNKTTITTTTTTTITNNNDNNNDNNNDNNNDNNNDNNNDNNHNDNHNNNHNNNHNNNNNTNSSHNNS

SEQ ID NO: 3252499 - protein, 16 aa, Plasmodium falciparum
VPSSSEKADKSFCSEK

SEQ ID NO: 3252500 - protein, 4 aa, Plasmodium falciparum
VPST

SEQ ID NO: 3252501 - protein, 25 aa, Plasmodium falciparum
VPSTTVKPPDEKRSEEVGEKEAKEI

SEQ ID NO: 3252502 - protein, 5 aa, Plasmodium falciparum
VPTQH

SEQ ID NO: 3252503 - protein, 21 aa, Plasmodium falciparum
VPTSNTYNITKRKKKSTENMT

SEQ ID NO: 3252504 - protein, 16 aa, Plasmodium falciparum
VPTVGTVPQADVPTEG

SEQ ID NO: 3252505 - protein, 5 aa, Plasmodium falciparum
VPYEK

SEQ ID NO: 3252506 - protein, 5 aa, Plasmodium falciparum
VPYKP

SEQ ID NO: 3252507 - protein, 13 aa, Plasmodium falciparum
VQAQKKKIQNCSN

SEQ ID NO: 3252508 - protein, 9 aa, Plasmodium falciparum
VQDDKGGRI

SEQ ID NO: 3252509 - protein, 6 aa, Plasmodium falciparum
VQDDQK

SEQ ID NO: 3252510 - protein, 8 aa, Plasmodium falciparum
VQDTQGGK

SEQ ID NO: 3252511 - protein, 19 aa, Plasmodium falciparum
VQEDETPEKEKDENSSMRD

SEQ ID NO: 3252512 - protein, 14 aa, Plasmodium falciparum
VQEEDESVTEELPE

SEQ ID NO: 3252513 - protein, 9 aa, Plasmodium falciparum
VQEEEESAY

SEQ ID NO: 3252514 - protein, 118 aa, Plasmodium falciparum
VQEEEGEKEESEDKGDAEELGKGEVSEDKEDKEKEGKKEESEDKEDTEEVKEEEASEDKENAEEVGKEEASEDKEDAEELGKGEVSEDKEDADEVEKEETSEDVRDNEEVGEGEVSED

SEQ ID NO: 3252515 - protein, 174 aa, Plasmodium falciparum
VQEEEGEKEESEDKGDAEELGKGEVSEDKGDAEELGKEETSEVKGDAEELGKEETSEDKEYTEEVGKEEASEDKEDTEEVKEEEVSEDKGDIEEVEKEETSEDKGDTEEVREDEVSEDIEDSDEVGEGEVSEDIEDSEEVGKEEEPYEKGDYEEVGKEEASYDKGDADEVSEDI

SEQ ID NO: 3252516 - protein, 43 aa, Plasmodium falciparum
VQEENKKDTIIKDPKKNNENNKNSNSSCCGSSSSDDHGNHNKN

SEQ ID NO: 3252517 - protein, 6 aa, Plasmodium falciparum
VQEGQC

SEQ ID NO: 3252518 - protein, 5 aa, Plasmodium falciparum
VQEND

SEQ ID NO: 3252519 - protein, 6 aa, Plasmodium falciparum
VQENGS

SEQ ID NO: 3252520 - protein, 5 aa, Plasmodium falciparum
VQEPD

SEQ ID NO: 3252521 - protein, 7 aa, Plasmodium falciparum
VQGENNI

SEQ ID NO: 3252522 - protein, 25 aa, Plasmodium falciparum
VQKDQNAQEDDDDGEYDKDYTNIEN

SEQ ID NO: 3252523 - protein, 25 aa, Plasmodium falciparum
VQKDYKKNNKKNDKNNVNKNNTYNN

SEQ ID NO: 3252524 - protein, 13 aa, Plasmodium falciparum
VQKKAKEKADVAS

SEQ ID NO: 3252525 - protein, 8 aa, Plasmodium falciparum
VQKKQKKI

SEQ ID NO: 3252526 - protein, 17 aa, Plasmodium falciparum
VQKNDEENVENKQETYK

SEQ ID NO: 3252527 - protein, 15 aa, Plasmodium falciparum
VQKNEDMSNIQPNGI

SEQ ID NO: 3252528 - protein, 6 aa, Plasmodium falciparum
VQMENS

SEQ ID NO: 3252529 - protein, 6 aa, Plasmodium falciparum
VQNAQN

SEQ ID NO: 3252530 - protein, 22 aa, Plasmodium falciparum
VQNAQNNIDSFNSSEKHDEDIE

SEQ ID NO: 3252531 - protein, 6 aa, Plasmodium falciparum
VQNDGT

SEQ ID NO: 3252532 - protein, 11 aa, Plasmodium falciparum
VQNEEETNFKE

SEQ ID NO: 3252533 - protein, 5 aa, Plasmodium falciparum
VQNEL

SEQ ID NO: 3252534 - protein, 5 aa, Plasmodium falciparum
VQNEN

SEQ ID NO: 3252535 - protein, 10 aa, Plasmodium falciparum
VQNKNKDNQL

SEQ ID NO: 3252536 - protein, 10 aa, Plasmodium falciparum
VQNKSKKENK

SEQ ID NO: 3252537 - protein, 12 aa, Plasmodium falciparum
VQNKSKKKYTIN

SEQ ID NO: 3252538 - protein, 4 aa, Plasmodium falciparum
VQNN

SEQ ID NO: 3252539 - protein, 8 aa, Plasmodium falciparum
VQNSENNE

SEQ ID NO: 3252540 - protein, 22 aa, Plasmodium falciparum
VQNSSDNNLSSSQDQQQCANEN

SEQ ID NO: 3252541 - protein, 14 aa, Plasmodium falciparum
VQNTRQKCKEQCDK

SEQ ID NO: 3252542 - protein, 14 aa, Plasmodium falciparum
VQNYKNEKNTNMEH

SEQ ID NO: 3252543 - protein, 51 aa, Plasmodium falciparum
VQPSSSNSGGHVGEEEDHNEGEGEHEEEEEHEEDDDDEDDDTYNKDDLEDE

SEQ ID NO: 3252544 - protein, 8 aa, Plasmodium falciparum
VQQDSEVD

SEQ ID NO: 3252545 - protein, 67 aa, Plasmodium falciparum
VQQEQQHNVEEKVEESVEENDEESVEENVEENVEENDDESVASSVEESIASSVDESIDSSIEENVAP

SEQ ID NO: 3252546 - protein, 8 aa, Plasmodium falciparum
VQRDAKKY

SEQ ID NO: 3252547 - protein, 5 aa, Plasmodium falciparum
VQRNN

SEQ ID NO: 3252548 - protein, 9 aa, Plasmodium falciparum
VQSAKEQTL

SEQ ID NO: 3252549 - protein, 11 aa, Plasmodium falciparum
VQSENEDNNSS

SEQ ID NO: 3252550 - protein, 24 aa, Plasmodium falciparum
VQSHKKDDKKCYSKNDVKSDIRDN

SEQ ID NO: 3252551 - protein, 15 aa, Plasmodium falciparum
VQSKDQDIKNQKNNT

SEQ ID NO: 3252552 - protein, 8 aa, Plasmodium falciparum
VQTDPSDV

SEQ ID NO: 3252553 - protein, 6 aa, Plasmodium falciparum
VRARGK

SEQ ID NO: 3252554 - protein, 6 aa, Plasmodium falciparum
VRDEKD

SEQ ID NO: 3252555 - protein, 7 aa, Plasmodium falciparum
VRDRRER

SEQ ID NO: 3252556 - protein, 17 aa, Plasmodium falciparum
VRDTTNDDVKDMNGRDK

SEQ ID NO: 3252557 - protein, 7 aa, Plasmodium falciparum
VREEKGQ

SEQ ID NO: 3252558 - protein, 10 aa, Plasmodium falciparum
VREETDAECQ

SEQ ID NO: 3252559 - protein, 5 aa, Plasmodium falciparum
VREGN

SEQ ID NO: 3252560 - protein, 27 aa, Plasmodium falciparum
VRFSDTKGAECDNRKIRDSEKKSNYGA

SEQ ID NO: 3252561 - protein, 21 aa, Plasmodium falciparum
VRGSKNKCAINSEERRGNNCE

SEQ ID NO: 3252562 - protein, 20 aa, Plasmodium falciparum
VRKENNSSTHNEHEENVQNT

SEQ ID NO: 3252563 - protein, 8 aa, Plasmodium falciparum
VRKGSTSN

SEQ ID NO: 3252564 - protein, 7 aa, Plasmodium falciparum
VRKKEEI

SEQ ID NO: 3252565 - protein, 23 aa, Plasmodium falciparum
VRKSDEDIKDTTVDSMNNKNNKN

SEQ ID NO: 3252566 - protein, 7 aa, Plasmodium falciparum
VRKSESD

SEQ ID NO: 3252567 - protein, 10 aa, Plasmodium falciparum
VRLNEENKNM

SEQ ID NO: 3252568 - protein, 15 aa, Plasmodium falciparum
VRNDNNNNNNNNNIK

SEQ ID NO: 3252569 - protein, 7 aa, Plasmodium falciparum
VRNKPND

SEQ ID NO: 3252570 - protein, 9 aa, Plasmodium falciparum
VRNNTESNI

SEQ ID NO: 3252571 - protein, 6 aa, Plasmodium falciparum
VRPNPT

SEQ ID NO: 3252572 - protein, 6 aa, Plasmodium falciparum
VRRNKT

SEQ ID NO: 3252573 - protein, 66 aa, Plasmodium falciparum
VRRNTSDSLSKSKEDIEDNTKKVVPGNGRRRRRKKSTVDNMENNVNDSNLNESNTNENIGNKDNHE

SEQ ID NO: 3252574 - protein, 8 aa, Plasmodium falciparum
VRSEPNLR

SEQ ID NO: 3252575 - protein, 12 aa, Plasmodium falciparum
VRSKNSNDTIKE

SEQ ID NO: 3252576 - protein, 17 aa, Plasmodium falciparum
VRSNNISHKEDDCGASE

SEQ ID NO: 3252577 - protein, 16 aa, Plasmodium falciparum
VRSPSKDVNVETPTTF

SEQ ID NO: 3252578 - protein, 6 aa, Plasmodium falciparum
VRSPSQ

SEQ ID NO: 3252579 - protein, 26 aa, Plasmodium falciparum
VRTDKDSDRNKGKDTATDTKNSPENL

SEQ ID NO: 3252580 - protein, 15 aa, Plasmodium falciparum
VRTEDKNTNGQDKQD

SEQ ID NO: 3252581 - protein, 8 aa, Plasmodium falciparum
VRTRKPTG

SEQ ID NO: 3252582 - protein, 8 aa, Plasmodium falciparum
VSAAEATS

SEQ ID NO: 3252583 - protein, 13 aa, Plasmodium falciparum
VSASDKDSMQKNL

SEQ ID NO: 3252584 - protein, 15 aa, Plasmodium falciparum
VSASEEYVDDKSVTD

SEQ ID NO: 3252585 - protein, 5 aa, Plasmodium falciparum
VSASH

SEQ ID NO: 3252586 - protein, 7 aa, Plasmodium falciparum
VSASKEI

SEQ ID NO: 3252587 - protein, 22 aa, Plasmodium falciparum
VSDANSTSTADSNFDDYGKKHT

SEQ ID NO: 3252588 - protein, 41 aa, Plasmodium falciparum
VSDNNVKKDSSKYELNEENKDNIKNEGDEKGGKNKSNETYI

SEQ ID NO: 3252589 - protein, 7 aa, Plasmodium falciparum
VSDPTRK

SEQ ID NO: 3252590 - protein, 10 aa, Plasmodium falciparum
VSDQKAKINE

SEQ ID NO: 3252591 - protein, 6 aa, Plasmodium falciparum
VSDSKS

SEQ ID NO: 3252592 - protein, 11 aa, Plasmodium falciparum
VSEDDKKKITT

SEQ ID NO: 3252593 - protein, 22 aa, Plasmodium falciparum
VSEDESENNSENPHEDAQETKR

SEQ ID NO: 3252594 - protein, 25 aa, Plasmodium falciparum
VSEDSSNNKYKQNDYLQKSQEQNEI

SEQ ID NO: 3252595 - protein, 20 aa, Plasmodium falciparum
VSEKNENINSNYNSTNNKGD

SEQ ID NO: 3252596 - protein, 6 aa, Plasmodium falciparum
VSEKVE

SEQ ID NO: 3252597 - protein, 10 aa, Plasmodium falciparum
VSEMDSTNYT

SEQ ID NO: 3252598 - protein, 10 aa, Plasmodium falciparum
VSENEDKISM

SEQ ID NO: 3252599 - protein, 6 aa, Plasmodium falciparum
VSENNG

SEQ ID NO: 3252600 - protein, 6 aa, Plasmodium falciparum
VSENNL

SEQ ID NO: 3252601 - protein, 5 aa, Plasmodium falciparum
VSENS

SEQ ID NO: 3252602 - protein, 10 aa, Plasmodium falciparum
VSEREEFKQD

SEQ ID NO: 3252603 - protein, 54 aa, Plasmodium falciparum
VSEREEIKQDDDYISEREEIKQDDDYVNEREEIKQDDDYVSEREEIKQDESFVG

SEQ ID NO: 3252604 - protein, 15 aa, Plasmodium falciparum
VSEREESKQDESFVG

SEQ ID NO: 3252605 - protein, 16 aa, Plasmodium falciparum
VSETNNNNSNINSINN

SEQ ID NO: 3252606 - protein, 4 aa, Plasmodium falciparum
VSFS

SEQ ID NO: 3252607 - protein, 9 aa, Plasmodium falciparum
VSFSSEEEH

SEQ ID NO: 3252608 - protein, 4 aa, Plasmodium falciparum
VSGD

SEQ ID NO: 3252609 - protein, 12 aa, Plasmodium falciparum
VSGETGATDKPC

SEQ ID NO: 3252610 - protein, 4 aa, Plasmodium falciparum
VSGG

SEQ ID NO: 3252611 - protein, 8 aa, Plasmodium falciparum
VSGGKRRA

SEQ ID NO: 3252612 - protein, 12 aa, Plasmodium falciparum
VSGGNKKKTKNK

SEQ ID NO: 3252613 - protein, 7 aa, Plasmodium falciparum
VSGHPNH

SEQ ID NO: 3252614 - protein, 8 aa, Plasmodium falciparum
VSGPLSQT

SEQ ID NO: 3252615 - protein, 4 aa, Plasmodium falciparum
VSGR

SEQ ID NO: 3252616 - protein, 25 aa, Plasmodium falciparum
VSHDERDYNKVDKETNKKKKNIKNI

SEQ ID NO: 3252617 - protein, 11 aa, Plasmodium falciparum
VSIKKNKSNEE

SEQ ID NO: 3252618 - protein, 14 aa, Plasmodium falciparum
VSKEDKSSKHEDNP

SEQ ID NO: 3252619 - protein, 6 aa, Plasmodium falciparum
VSKEMG

SEQ ID NO: 3252620 - protein, 9 aa, Plasmodium falciparum
VSKENEGKH

SEQ ID NO: 3252621 - protein, 167 aa, Plasmodium falciparum
VSKEQDGKDSQDVKGGKHGQDVKDDKDEQDVKGGKHGQDVKDDKDEQDVKDGKHGQDVKGGKHGQDVKDDKDEQDVKDGKHGQDVKDDNDEQDVKDDKDEQDVKDDKDEQDVKDDNDEQDVKDDKDEQDVKDDKDEQNVKDDKEDKDIKGGKHGQDVKNDKHGQDVK

SEQ ID NO: 3252622 - protein, 9 aa, Plasmodium falciparum
VSKEQSSFT

SEQ ID NO: 3252623 - protein, 18 aa, Plasmodium falciparum
VSKKDASDTEENKDQNLD

SEQ ID NO: 3252624 - protein, 12 aa, Plasmodium falciparum
VSKKKDKKKVSL

SEQ ID NO: 3252625 - protein, 8 aa, Plasmodium falciparum
VSKKKKKV

SEQ ID NO: 3252626 - protein, 11 aa, Plasmodium falciparum
VSKKKKKYKMN

SEQ ID NO: 3252627 - protein, 9 aa, Plasmodium falciparum
VSKNDSNYG

SEQ ID NO: 3252628 - protein, 30 aa, Plasmodium falciparum
VSKNNKNKKKKNSQRDYSLNKSTKEKGVKK

SEQ ID NO: 3252629 - protein, 10 aa, Plasmodium falciparum
VSKPIGGHKY

SEQ ID NO: 3252630 - protein, 34 aa, Plasmodium falciparum
VSKRNSSYNKKERDSKKDRDSVYDENRRKSSAYQ

SEQ ID NO: 3252631 - protein, 19 aa, Plasmodium falciparum
VSKSREKYYAKKKKEDKNK

SEQ ID NO: 3252632 - protein, 19 aa, Plasmodium falciparum
VSKSSNAAAQATKDITEQV

SEQ ID NO: 3252633 - protein, 8 aa, Plasmodium falciparum
VSKSSNNS

SEQ ID NO: 3252634 - protein, 7 aa, Plasmodium falciparum
VSKTSHT

SEQ ID NO: 3252635 - protein, 11 aa, Plasmodium falciparum
VSLNNNNNNYV

SEQ ID NO: 3252636 - protein, 17 aa, Plasmodium falciparum
VSMGPERKSLRQSDHQR

SEQ ID NO: 3252637 - protein, 8 aa, Plasmodium falciparum
VSNDDTIN

SEQ ID NO: 3252638 - protein, 17 aa, Plasmodium falciparum
VSNDKKKKKKKKKKKNH

SEQ ID NO: 3252639 - protein, 5 aa, Plasmodium falciparum
VSNDN

SEQ ID NO: 3252640 - protein, 8 aa, Plasmodium falciparum
VSNDNTPY

SEQ ID NO: 3252641 - protein, 4 aa, Plasmodium falciparum
VSNE

SEQ ID NO: 3252642 - protein, 44 aa, Plasmodium falciparum
VSNEGNPLEGGEEKNNVKISEQNGRNLESSVGTDKGSDKNEEEV

SEQ ID NO: 3252643 - protein, 9 aa, Plasmodium falciparum
VSNESRRRY

SEQ ID NO: 3252644 - protein, 23 aa, Plasmodium falciparum
VSNGLRKNAKKEIDHYNDKDNKY

SEQ ID NO: 3252645 - protein, 10 aa, Plasmodium falciparum
VSNGNEHTNF

SEQ ID NO: 3252646 - protein, 9 aa, Plasmodium falciparum
VSNIPTQDI

SEQ ID NO: 3252647 - protein, 9 aa, Plasmodium falciparum
VSNKKSINN

SEQ ID NO: 3252648 - protein, 10 aa, Plasmodium falciparum
VSNKNLNNDD

SEQ ID NO: 3252649 - protein, 12 aa, Plasmodium falciparum
VSNNDKATVQKT

SEQ ID NO: 3252650 - protein, 9 aa, Plasmodium falciparum
VSNNEKSYC

SEQ ID NO: 3252651 - protein, 38 aa, Plasmodium falciparum
VSNNHDNNNNNDNNDNNNDNNDNNNDNDNDNNNNNNNY

SEQ ID NO: 3252652 - protein, 23 aa, Plasmodium falciparum
VSNNKKKKKEEQDRDKKKEENLE

SEQ ID NO: 3252653 - protein, 14 aa, Plasmodium falciparum
VSNNNRKKKSETMI

SEQ ID NO: 3252654 - protein, 16 aa, Plasmodium falciparum
VSNNSSLGNKYNSDED

SEQ ID NO: 3252655 - protein, 6 aa, Plasmodium falciparum
VSNNYS

SEQ ID NO: 3252656 - protein, 22 aa, Plasmodium falciparum
VSNQTNYQNNYYPNNSQPVNVT

SEQ ID NO: 3252657 - protein, 11 aa, Plasmodium falciparum
VSNSTTAESGS

SEQ ID NO: 3252658 - protein, 7 aa, Plasmodium falciparum
VSNTNPY

SEQ ID NO: 3252659 - protein, 15 aa, Plasmodium falciparum
VSNVEQNLQKDTKKY

SEQ ID NO: 3252660 - protein, 16 aa, Plasmodium falciparum
VSPEPLSANTTKNNNT

SEQ ID NO: 3252661 - protein, 6 aa, Plasmodium falciparum
VSPFEE

SEQ ID NO: 3252662 - protein, 5 aa, Plasmodium falciparum
VSPKV

SEQ ID NO: 3252663 - protein, 4 aa, Plasmodium falciparum
VSPN

SEQ ID NO: 3252664 - protein, 10 aa, Plasmodium falciparum
VSPNNKTEED

SEQ ID NO: 3252665 - protein, 6 aa, Plasmodium falciparum
VSPNRI

SEQ ID NO: 3252666 - protein, 55 aa, Plasmodium falciparum
VSPQASGDKATQAAEPQASDKAAQVTEASASSSSSESNSVQTTPASTSSPSNSRD

SEQ ID NO: 3252667 - protein, 6 aa, Plasmodium falciparum
VSPYTP

SEQ ID NO: 3252668 - protein, 13 aa, Plasmodium falciparum
VSQHEKKEENQIE

SEQ ID NO: 3252669 - protein, 5 aa, Plasmodium falciparum
VSQNN

SEQ ID NO: 3252670 - protein, 6 aa, Plasmodium falciparum
VSRNKE

SEQ ID NO: 3252671 - protein, 8 aa, Plasmodium falciparum
VSRSDRKD

SEQ ID NO: 3252672 - protein, 7 aa, Plasmodium falciparum
VSSCSDK

SEQ ID NO: 3252673 - protein, 5 aa, Plasmodium falciparum
VSSED

SEQ ID NO: 3252674 - protein, 8 aa, Plasmodium falciparum
VSSEEEYC

SEQ ID NO: 3252675 - protein, 35 aa, Plasmodium falciparum
VSSEELKNEKSTRTYNSSLQEGSDYDEEEDEEYDV

SEQ ID NO: 3252676 - protein, 16 aa, Plasmodium falciparum
VSSETIRTHRNKENMT

SEQ ID NO: 3252677 - protein, 11 aa, Plasmodium falciparum
VSSGFGSRSKE

SEQ ID NO: 3252678 - protein, 13 aa, Plasmodium falciparum
VSSGMSSDTYDDI

SEQ ID NO: 3252679 - protein, 18 aa, Plasmodium falciparum
VSSKDDKDIEKSSHQYSI

SEQ ID NO: 3252680 - protein, 17 aa, Plasmodium falciparum
VSSKENKQKNEKKNDDI

SEQ ID NO: 3252681 - protein, 10 aa, Plasmodium falciparum
VSSNDESIGS

SEQ ID NO: 3252682 - protein, 5 aa, Plasmodium falciparum
VSSNY

SEQ ID NO: 3252683 - protein, 48 aa, Plasmodium falciparum
VSSSEEISDEKKVKKKKTNKKDNNINNINNNNNNNNNNNNNISNGYDK

SEQ ID NO: 3252684 - protein, 7 aa, Plasmodium falciparum
VSSSERC

SEQ ID NO: 3252685 - protein, 26 aa, Plasmodium falciparum
VSSSESAKKGNEKNTATCKKRKTSCS

SEQ ID NO: 3252686 - protein, 21 aa, Plasmodium falciparum
VSSSSKPIINAGNGTGEHPTQ

SEQ ID NO: 3252687 - protein, 9 aa, Plasmodium falciparum
VSSSSSSSY

SEQ ID NO: 3252688 - protein, 7 aa, Plasmodium falciparum
VSSTGDY

SEQ ID NO: 3252689 - protein, 7 aa, Plasmodium falciparum
VSSTITK

SEQ ID NO: 3252690 - protein, 8 aa, Plasmodium falciparum
VSSTKDSN

SEQ ID NO: 3252691 - protein, 22 aa, Plasmodium falciparum
VSSTNNNITNEDAQSKKPELDS

SEQ ID NO: 3252692 - protein, 24 aa, Plasmodium falciparum
VSSTNRNIDDEERKEKKKKEDISK

SEQ ID NO: 3252693 - protein, 12 aa, Plasmodium falciparum
VSSTSDITEEAT

SEQ ID NO: 3252694 - protein, 12 aa, Plasmodium falciparum
VSSYTSSSSFNS

SEQ ID NO: 3252695 - protein, 16 aa, Plasmodium falciparum
VSTDEIKTNDEKKNYE

SEQ ID NO: 3252696 - protein, 9 aa, Plasmodium falciparum
VSTDTSTQA

SEQ ID NO: 3252697 - protein, 12 aa, Plasmodium falciparum
VSTEEITNAENE

SEQ ID NO: 3252698 - protein, 14 aa, Plasmodium falciparum
VSTERTSELSSNTM

SEQ ID NO: 3252699 - protein, 23 aa, Plasmodium falciparum
VSTNTKQVTKENKENKENKDVQN

SEQ ID NO: 3252700 - protein, 8 aa, Plasmodium falciparum
VSTPSSFP

SEQ ID NO: 3252701 - protein, 14 aa, Plasmodium falciparum
VSTQDNDSDQSNFS

SEQ ID NO: 3252702 - protein, 11 aa, Plasmodium falciparum
VSTSHTNKENT

SEQ ID NO: 3252703 - protein, 17 aa, Plasmodium falciparum
VSTTEKHDEVDRSTTEE

SEQ ID NO: 3252704 - protein, 10 aa, Plasmodium falciparum
VSTTKKGISF

SEQ ID NO: 3252705 - protein, 6 aa, Plasmodium falciparum
VSWGKR

SEQ ID NO: 3252706 - protein, 14 aa, Plasmodium falciparum
VSYDNTKESEYVDN

SEQ ID NO: 3252707 - protein, 6 aa, Plasmodium falciparum
VSYNNK

SEQ ID NO: 3252708 - protein, 5 aa, Plasmodium falciparum
VTAGT

SEQ ID NO: 3252709 - protein, 4 aa, Plasmodium falciparum
VTCG

SEQ ID NO: 3252710 - protein, 6 aa, Plasmodium falciparum
VTDDYR

SEQ ID NO: 3252711 - protein, 10 aa, Plasmodium falciparum
VTDEAEGRKN

SEQ ID NO: 3252712 - protein, 20 aa, Plasmodium falciparum
VTDNNIRNKSYDEKRKKKNY

SEQ ID NO: 3252713 - protein, 10 aa, Plasmodium falciparum
VTDNNSTRDI

SEQ ID NO: 3252714 - protein, 7 aa, Plasmodium falciparum
VTDPKLE

SEQ ID NO: 3252715 - protein, 5 aa, Plasmodium falciparum
VTDPN

SEQ ID NO: 3252716 - protein, 4 aa, Plasmodium falciparum
VTDS

SEQ ID NO: 3252717 - protein, 7 aa, Plasmodium falciparum
VTDSNDY

SEQ ID NO: 3252718 - protein, 6 aa, Plasmodium falciparum
VTEKDM

SEQ ID NO: 3252719 - protein, 7 aa, Plasmodium falciparum
VTENEKD

SEQ ID NO: 3252720 - protein, 7 aa, Plasmodium falciparum
VTEQSLP

SEQ ID NO: 3252721 - protein, 4 aa, Plasmodium falciparum
VTES

SEQ ID NO: 3252722 - protein, 7 aa, Plasmodium falciparum
VTGDKTP

SEQ ID NO: 3252723 - protein, 7 aa, Plasmodium falciparum
VTGNEKY

SEQ ID NO: 3252724 - protein, 21 aa, Plasmodium falciparum
VTGPQEVNNNAMSSDKNPLSH

SEQ ID NO: 3252725 - protein, 14 aa, Plasmodium falciparum
VTIGGGREYPCKDR

SEQ ID NO: 3252726 - protein, 6 aa, Plasmodium falciparum
VTIKSN

SEQ ID NO: 3252727 - protein, 17 aa, Plasmodium falciparum
VTITNEKNSIQKDNGNI

SEQ ID NO: 3252728 - protein, 12 aa, Plasmodium falciparum
VTKAQDNLKSEE

SEQ ID NO: 3252729 - protein, 12 aa, Plasmodium falciparum
VTKENKKKKRKK

SEQ ID NO: 3252730 - protein, 10 aa, Plasmodium falciparum
VTKGEDKEYP

SEQ ID NO: 3252731 - protein, 40 aa, Plasmodium falciparum
VTKGGNKEYPCRNGTEKRFSEVSGGECDDSKIKGSNGGAC

SEQ ID NO: 3252732 - protein, 14 aa, Plasmodium falciparum
VTKGHGKEYPCEDR

SEQ ID NO: 3252733 - protein, 9 aa, Plasmodium falciparum
VTKGSNTKI

SEQ ID NO: 3252734 - protein, 11 aa, Plasmodium falciparum
VTKKPYTQNGT

SEQ ID NO: 3252735 - protein, 10 aa, Plasmodium falciparum
VTKNKDSYHT

SEQ ID NO: 3252736 - protein, 25 aa, Plasmodium falciparum
VTKNNEKINNSYHNNNNSKDARNEY

SEQ ID NO: 3252737 - protein, 34 aa, Plasmodium falciparum
VTLSRDGKNDIEEEEEEDEEDEKNINNSQDTTLS

SEQ ID NO: 3252738 - protein, 5 aa, Plasmodium falciparum
VTNAS

SEQ ID NO: 3252739 - protein, 10 aa, Plasmodium falciparum
VTNDDEMNNH

SEQ ID NO: 3252740 - protein, 4 aa, Plasmodium falciparum
VTNE

SEQ ID NO: 3252741 - protein, 8 aa, Plasmodium falciparum
VTNEDETI

SEQ ID NO: 3252742 - protein, 19 aa, Plasmodium falciparum
VTNESRKTYNDNNLNSSSR

SEQ ID NO: 3252743 - protein, 9 aa, Plasmodium falciparum
VTNNTYDDK

SEQ ID NO: 3252744 - protein, 5 aa, Plasmodium falciparum
VTNSG

SEQ ID NO: 3252745 - protein, 4 aa, Plasmodium falciparum
VTNT

SEQ ID NO: 3252746 - protein, 16 aa, Plasmodium falciparum
VTNTEKKTKIKNDYSY

SEQ ID NO: 3252747 - protein, 6 aa, Plasmodium falciparum
VTNTSN

SEQ ID NO: 3252748 - protein, 4 aa, Plasmodium falciparum
VTPK

SEQ ID NO: 3252749 - protein, 5 aa, Plasmodium falciparum
VTPNN

SEQ ID NO: 3252750 - protein, 13 aa, Plasmodium falciparum
VTPPQPDVTPSPL

SEQ ID NO: 3252751 - protein, 4 aa, Plasmodium falciparum
VTPT

SEQ ID NO: 3252752 - protein, 5 aa, Plasmodium falciparum
VTPVK

SEQ ID NO: 3252753 - protein, 4 aa, Plasmodium falciparum
VTQD

SEQ ID NO: 3252754 - protein, 16 aa, Plasmodium falciparum
VTQDPKEGGGKKNYDR

SEQ ID NO: 3252755 - protein, 39 aa, Plasmodium falciparum
VTQSDESTLSQHGKESSQEQHNLDGSSLSRHSNQDEERS

SEQ ID NO: 3252756 - protein, 11 aa, Plasmodium falciparum
VTQSNNKHKSM

SEQ ID NO: 3252757 - protein, 9 aa, Plasmodium falciparum
VTRKSNRDL

SEQ ID NO: 3252758 - protein, 13 aa, Plasmodium falciparum
VTSGGGKENPCYG

SEQ ID NO: 3252759 - protein, 4 aa, Plasmodium falciparum
VTSN

SEQ ID NO: 3252760 - protein, 11 aa, Plasmodium falciparum
VTSNDDDRNKL

SEQ ID NO: 3252761 - protein, 9 aa, Plasmodium falciparum
VTSNTKNET

SEQ ID NO: 3252762 - protein, 10 aa, Plasmodium falciparum
VTSQEKEDKI

SEQ ID NO: 3252763 - protein, 10 aa, Plasmodium falciparum
VTSQQNDDQF

SEQ ID NO: 3252764 - protein, 9 aa, Plasmodium falciparum
VTSQSNDDN

SEQ ID NO: 3252765 - protein, 11 aa, Plasmodium falciparum
VTSTPTTDPIE

SEQ ID NO: 3252766 - protein, 13 aa, Plasmodium falciparum
VTSTSGKNRKALR

SEQ ID NO: 3252767 - protein, 16 aa, Plasmodium falciparum
VTTAPSSAKSGDTTGS

SEQ ID NO: 3252768 - protein, 7 aa, Plasmodium falciparum
VTTEETK

SEQ ID NO: 3252769 - protein, 12 aa, Plasmodium falciparum
VTTETSKKTEHG

SEQ ID NO: 3252770 - protein, 9 aa, Plasmodium falciparum
VTTGCSSDL

SEQ ID NO: 3252771 - protein, 15 aa, Plasmodium falciparum
VTTGQDSAFEDYDEN

SEQ ID NO: 3252772 - protein, 22 aa, Plasmodium falciparum
VTTNGKNKDALKTRYNDDAKGG

SEQ ID NO: 3252773 - protein, 18 aa, Plasmodium falciparum
VTTTNGEAAEARYNDTKN

SEQ ID NO: 3252774 - protein, 10 aa, Plasmodium falciparum
VTYNTDDLNN

SEQ ID NO: 3252775 - protein, 10 aa, Plasmodium falciparum
VVDDDNKLEG

SEQ ID NO: 3252776 - protein, 26 aa, Plasmodium falciparum
VVDDKEKDELISDDNNKDIHYTQKSQ

SEQ ID NO: 3252777 - protein, 13 aa, Plasmodium falciparum
VVDGKKDCDEKYE

SEQ ID NO: 3252778 - protein, 4 aa, Plasmodium falciparum
VVDT

SEQ ID NO: 3252779 - protein, 6 aa, Plasmodium falciparum
VVENDK

SEQ ID NO: 3252780 - protein, 17 aa, Plasmodium falciparum
VVNQSGVANQSGVANQS

SEQ ID NO: 3252781 - protein, 16 aa, Plasmodium falciparum
VVPEASSQKNDKDITD

SEQ ID NO: 3252782 - protein, 10 aa, Plasmodium falciparum
VVSEPEDSSR

SEQ ID NO: 3252783 - protein, 15 aa, Plasmodium falciparum
VVTTPRQEQEQEHNE

SEQ ID NO: 3252784 - protein, 4 aa, Plasmodium falciparum
VWNT

SEQ ID NO: 3252785 - protein, 11 aa, Plasmodium falciparum
VYDERERYSNA

SEQ ID NO: 3252786 - protein, 42 aa, Plasmodium falciparum
VYNDDNNYNDGNIYNNNNDYAYNNKSNEGSTYPLNEEETNVN

SEQ ID NO: 3252787 - protein, 11 aa, Plasmodium falciparum
VYNDEDSDGSF

SEQ ID NO: 3252788 - protein, 16 aa, Plasmodium falciparum
VYNNGDYKNNLNKDDH

SEQ ID NO: 3252789 - protein, 20 aa, Plasmodium falciparum
VYNQKNPYLTPHKTNPKSVK

SEQ ID NO: 3252790 - protein, 12 aa, Plasmodium falciparum
VYTSNKHNKKKT

SEQ ID NO: 3252791 - protein, 39 aa, Plasmodium falciparum
WANSGNTQAAEPQEDGKAQTPQGQTPSQSGKESSQSQKL

SEQ ID NO: 3252792 - protein, 40 aa, Plasmodium falciparum
WASGGNTQGGGGNTQVTPQAGGSEAQTQPQGKDAASTSPQ

SEQ ID NO: 3252793 - protein, 9 aa, Plasmodium falciparum
WDGEEKKNT

SEQ ID NO: 3252794 - protein, 6 aa, Plasmodium falciparum
WDINED

SEQ ID NO: 3252795 - protein, 12 aa, Plasmodium falciparum
WDKKDEPEHYLE

SEQ ID NO: 3252796 - protein, 17 aa, Plasmodium falciparum
WDKKKKKKLKSAEKEEY

SEQ ID NO: 3252797 - protein, 7 aa, Plasmodium falciparum
WDPTGSH

SEQ ID NO: 3252798 - protein, 21 aa, Plasmodium falciparum
WDRTNDRENIDNHGNHTDGNT

SEQ ID NO: 3252799 - protein, 11 aa, Plasmodium falciparum
WEHRNKKPQDG

SEQ ID NO: 3252800 - protein, 15 aa, Plasmodium falciparum
WEKEKKKKNKKENVY

SEQ ID NO: 3252801 - protein, 9 aa, Plasmodium falciparum
WEKQSGKYD

SEQ ID NO: 3252802 - protein, 10 aa, Plasmodium falciparum
WENGSKIGTE

SEQ ID NO: 3252803 - protein, 5 aa, Plasmodium falciparum
WEYAT

SEQ ID NO: 3252804 - protein, 6 aa, Plasmodium falciparum
WGKGKD

SEQ ID NO: 3252805 - protein, 4 aa, Plasmodium falciparum
WGTG

SEQ ID NO: 3252806 - protein, 4 aa, Plasmodium falciparum
WKDE

SEQ ID NO: 3252807 - protein, 13 aa, Plasmodium falciparum
WKDEDEKNDCRNE

SEQ ID NO: 3252808 - protein, 8 aa, Plasmodium falciparum
WKDEEEEY

SEQ ID NO: 3252809 - protein, 8 aa, Plasmodium falciparum
WKDNNDKK

SEQ ID NO: 3252810 - protein, 10 aa, Plasmodium falciparum
WKDTGKSGKH

SEQ ID NO: 3252811 - protein, 7 aa, Plasmodium falciparum
WKEEDEK

SEQ ID NO: 3252812 - protein, 8 aa, Plasmodium falciparum
WKKENKKK

SEQ ID NO: 3252813 - protein, 8 aa, Plasmodium falciparum
WKKEQNEY

SEQ ID NO: 3252814 - protein, 7 aa, Plasmodium falciparum
WKNNKTS

SEQ ID NO: 3252815 - protein, 12 aa, Plasmodium falciparum
WKSGADVSKEHA

SEQ ID NO: 3252816 - protein, 11 aa, Plasmodium falciparum
WKSGTDINKKH

SEQ ID NO: 3252817 - protein, 4 aa, Plasmodium falciparum
WNEE

SEQ ID NO: 3252818 - protein, 6 aa, Plasmodium falciparum
WNESNK

SEQ ID NO: 3252819 - protein, 12 aa, Plasmodium falciparum
WNKDNDGGNVPI

SEQ ID NO: 3252820 - protein, 9 aa, Plasmodium falciparum
WNKRTEENI

SEQ ID NO: 3252821 - protein, 20 aa, Plasmodium falciparum
WNNKNSKIELSKKRDSSNKY

SEQ ID NO: 3252822 - protein, 11 aa, Plasmodium falciparum
WNNNSSSNYHH

SEQ ID NO: 3252823 - protein, 11 aa, Plasmodium falciparum
WNNQQSNHFSN

SEQ ID NO: 3252824 - protein, 9 aa, Plasmodium falciparum
WNSNKSERC

SEQ ID NO: 3252825 - protein, 13 aa, Plasmodium falciparum
WNTKKKKQINDKN

SEQ ID NO: 3252826 - protein, 9 aa, Plasmodium falciparum
WPNKTPERY

SEQ ID NO: 3252827 - protein, 8 aa, Plasmodium falciparum
WRDEEDEY

SEQ ID NO: 3252828 - protein, 8 aa, Plasmodium falciparum
WRDEEEEY

SEQ ID NO: 3252829 - protein, 4 aa, Plasmodium falciparum
WSAP

SEQ ID NO: 3252830 - protein, 4 aa, Plasmodium falciparum
WSDE

SEQ ID NO: 3252831 - protein, 5 aa, Plasmodium falciparum
WSEID

SEQ ID NO: 3252832 - protein, 8 aa, Plasmodium falciparum
WSEPPLRN

SEQ ID NO: 3252833 - protein, 5 aa, Plasmodium falciparum
WSSDT

SEQ ID NO: 3252834 - protein, 8 aa, Plasmodium falciparum
WSSKERRN

SEQ ID NO: 3252835 - protein, 6 aa, Plasmodium falciparum
WSSNEA

SEQ ID NO: 3252836 - protein, 12 aa, Plasmodium falciparum
WTKHKKNKKKIN

SEQ ID NO: 3252837 - protein, 24 aa, Plasmodium falciparum
YAAPYDNQYQQDDDTPSPRGENHT

SEQ ID NO: 3252838 - protein, 7 aa, Plasmodium falciparum
YAEEKAL

SEQ ID NO: 3252839 - protein, 5 aa, Plasmodium falciparum
YAEET

SEQ ID NO: 3252840 - protein, 4 aa, Plasmodium falciparum
YAHN

SEQ ID NO: 3252841 - protein, 13 aa, Plasmodium falciparum
YAHNKNKPSITPH

SEQ ID NO: 3252842 - protein, 10 aa, Plasmodium falciparum
YAHNKNKQYI

SEQ ID NO: 3252843 - protein, 8 aa, Plasmodium falciparum
YAHNKNKS

SEQ ID NO: 3252844 - protein, 6 aa, Plasmodium falciparum
YAHPNN

SEQ ID NO: 3252845 - protein, 7 aa, Plasmodium falciparum
YAHSENK

SEQ ID NO: 3252846 - protein, 13 aa, Plasmodium falciparum
YAIKDSSNNYDEQ

SEQ ID NO: 3252847 - protein, 4 aa, Plasmodium falciparum
YAIN

SEQ ID NO: 3252848 - protein, 6 aa, Plasmodium falciparum
YAIPKE

SEQ ID NO: 3252849 - protein, 5 aa, Plasmodium falciparum
YAKGD

SEQ ID NO: 3252850 - protein, 4 aa, Plasmodium falciparum
YAMN

SEQ ID NO: 3252851 - protein, 9 aa, Plasmodium falciparum
YANDNKSKH

SEQ ID NO: 3252852 - protein, 21 aa, Plasmodium falciparum
YANGNNNNNNNNNNNNSNNYC

SEQ ID NO: 3252853 - protein, 16 aa, Plasmodium falciparum
YANGTTTKETSNGPIN

SEQ ID NO: 3252854 - protein, 5 aa, Plasmodium falciparum
YANNK

SEQ ID NO: 3252855 - protein, 7 aa, Plasmodium falciparum
YANNNST

SEQ ID NO: 3252856 - protein, 8 aa, Plasmodium falciparum
YANNQNPK

SEQ ID NO: 3252857 - protein, 7 aa, Plasmodium falciparum
YANTSAA

SEQ ID NO: 3252858 - protein, 12 aa, Plasmodium falciparum
YAQENNSRGECE

SEQ ID NO: 3252859 - protein, 15 aa, Plasmodium falciparum
YAQKGYLGSENDSIE

SEQ ID NO: 3252860 - protein, 12 aa, Plasmodium falciparum
YASDLSSKYAGS

SEQ ID NO: 3252861 - protein, 9 aa, Plasmodium falciparum
YASGATSAS

SEQ ID NO: 3252862 - protein, 12 aa, Plasmodium falciparum
YASPTYDPKKGT

SEQ ID NO: 3252863 - protein, 4 aa, Plasmodium falciparum
YASQ

SEQ ID NO: 3252864 - protein, 5 aa, Plasmodium falciparum
YAYED

SEQ ID NO: 3252865 - protein, 6 aa, Plasmodium falciparum
YCKSNE

SEQ ID NO: 3252866 - protein, 9 aa, Plasmodium falciparum
YCQKTNDIT

SEQ ID NO: 3252867 - protein, 11 aa, Plasmodium falciparum
YDASNLEEHAK

SEQ ID NO: 3252868 - protein, 10 aa, Plasmodium falciparum
YDCEKTKPAI

SEQ ID NO: 3252869 - protein, 5 aa, Plasmodium falciparum
YDDDD

SEQ ID NO: 3252870 - protein, 14 aa, Plasmodium falciparum
YDDDDNNIYDNNHN

SEQ ID NO: 3252871 - protein, 12 aa, Plasmodium falciparum
YDDDNDDDDDNI

SEQ ID NO: 3252872 - protein, 21 aa, Plasmodium falciparum
YDDDNNSDSIYSNEYNESSDF

SEQ ID NO: 3252873 - protein, 29 aa, Plasmodium falciparum
YDDDNVDDDNVDDDNVDDDNVDDDNVNAD

SEQ ID NO: 3252874 - protein, 20 aa, Plasmodium falciparum
YDDEDDNYNDENNDNYNDNY

SEQ ID NO: 3252875 - protein, 20 aa, Plasmodium falciparum
YDDEEEEEDDIKENANDGIN

SEQ ID NO: 3252876 - protein, 13 aa, Plasmodium falciparum
YDDEEKNRRKKLE

SEQ ID NO: 3252877 - protein, 5 aa, Plasmodium falciparum
YDDEK

SEQ ID NO: 3252878 - protein, 13 aa, Plasmodium falciparum
YDDEYYDDEYYDD

SEQ ID NO: 3252879 - protein, 25 aa, Plasmodium falciparum
YDDGNNNNNNNDSMNNHKDDMNNYN

SEQ ID NO: 3252880 - protein, 6 aa, Plasmodium falciparum
YDDKDK

SEQ ID NO: 3252881 - protein, 11 aa, Plasmodium falciparum
YDDKNPPRVPE

SEQ ID NO: 3252882 - protein, 4 aa, Plasmodium falciparum
YDDL

SEQ ID NO: 3252883 - protein, 8 aa, Plasmodium falciparum
YDDNDEDI

SEQ ID NO: 3252884 - protein, 10 aa, Plasmodium falciparum
YDDNDKKDII

SEQ ID NO: 3252885 - protein, 16 aa, Plasmodium falciparum
YDDNEKNNENKRKSGI

SEQ ID NO: 3252886 - protein, 5 aa, Plasmodium falciparum
YDDNK

SEQ ID NO: 3252887 - protein, 48 aa, Plasmodium falciparum
YDDNKDDEEDVEKDDGVNNNDEEKNGKDKKKKNKEKKNNEKDGMDNDI

SEQ ID NO: 3252888 - protein, 8 aa, Plasmodium falciparum
YDDNNNNN

SEQ ID NO: 3252889 - protein, 50 aa, Plasmodium falciparum
YDDNSYNDNSYDDNSYDDNSYDDEKKMNKKSLPYNKTQKRYQRKDKNNKL

SEQ ID NO: 3252890 - protein, 83 aa, Plasmodium falciparum
YDDNVSKYDDNGSKYENNGSKYDDNGSKYENNGSKYENNGSKYENNGSKYENNGSKYENNGSKYENNGSKYEDNGSKYNKSFD

SEQ ID NO: 3252891 - protein, 83 aa, Plasmodium falciparum
YDDSDEDDEYEDGHGEYKERHGEYKERHGEYKERHGEYKERHGEYKESHGEYKERHGEYKERHGEYKDRHGEYKDDKTQNCTS

SEQ ID NO: 3252892 - protein, 9 aa, Plasmodium falciparum
YDDSNTTTI

SEQ ID NO: 3252893 - protein, 9 aa, Plasmodium falciparum
YDDSSNSCF

SEQ ID NO: 3252894 - protein, 4 aa, Plasmodium falciparum
YDDT

SEQ ID NO: 3252895 - protein, 7 aa, Plasmodium falciparum
YDDTENS

SEQ ID NO: 3252896 - protein, 4 aa, Plasmodium falciparum
YDED

SEQ ID NO: 3252897 - protein, 7 aa, Plasmodium falciparum
YDEDDSK

SEQ ID NO: 3252898 - protein, 15 aa, Plasmodium falciparum
YDEDEENNDDISDDI

SEQ ID NO: 3252899 - protein, 11 aa, Plasmodium falciparum
YDEDQNKPIGH

SEQ ID NO: 3252900 - protein, 15 aa, Plasmodium falciparum
YDEDTNKYIDTSPNF

SEQ ID NO: 3252901 - protein, 19 aa, Plasmodium falciparum
YDEDYDEEYNYEDKNSDYE

SEQ ID NO: 3252902 - protein, 4 aa, Plasmodium falciparum
YDEE

SEQ ID NO: 3252903 - protein, 6 aa, Plasmodium falciparum
YDEEDD

SEQ ID NO: 3252904 - protein, 9 aa, Plasmodium falciparum
YDEEENDKI

SEQ ID NO: 3252905 - protein, 9 aa, Plasmodium falciparum
YDEEENNLS

SEQ ID NO: 3252906 - protein, 8 aa, Plasmodium falciparum
YDEEKGEM

SEQ ID NO: 3252907 - protein, 15 aa, Plasmodium falciparum
YDEESTCENKNPCGD

SEQ ID NO: 3252908 - protein, 5 aa, Plasmodium falciparum
YDEIN

SEQ ID NO: 3252909 - protein, 4 aa, Plasmodium falciparum
YDEK

SEQ ID NO: 3252910 - protein, 6 aa, Plasmodium falciparum
YDEKGA

SEQ ID NO: 3252911 - protein, 15 aa, Plasmodium falciparum
YDEKKTKDIEESNYE

SEQ ID NO: 3252912 - protein, 16 aa, Plasmodium falciparum
YDELNNAKKGDSSLEE

SEQ ID NO: 3252913 - protein, 7 aa, Plasmodium falciparum
YDENHDK

SEQ ID NO: 3252914 - protein, 5 aa, Plasmodium falciparum
YDENK

SEQ ID NO: 3252915 - protein, 29 aa, Plasmodium falciparum
YDENNDENDVYNDDYNDEYNYDDNNDDYH

SEQ ID NO: 3252916 - protein, 7 aa, Plasmodium falciparum
YDENNEE

SEQ ID NO: 3252917 - protein, 10 aa, Plasmodium falciparum
YDENNERKYC

SEQ ID NO: 3252918 - protein, 31 aa, Plasmodium falciparum
YDENNSSIHDDNSKKEKFSDNEKYHERAEEE

SEQ ID NO: 3252919 - protein, 5 aa, Plasmodium falciparum
YDEPV

SEQ ID NO: 3252920 - protein, 22 aa, Plasmodium falciparum
YDEQGEKDVEDEDVQDKEDIGK

SEQ ID NO: 3252921 - protein, 21 aa, Plasmodium falciparum
YDEQGNYKTVPRKEKTKQNIQ

SEQ ID NO: 3252922 - protein, 7 aa, Plasmodium falciparum
YDEQPKI

SEQ ID NO: 3252923 - protein, 13 aa, Plasmodium falciparum
YDERTKQYKQNKK

SEQ ID NO: 3252924 - protein, 8 aa, Plasmodium falciparum
YDESRELK

SEQ ID NO: 3252925 - protein, 8 aa, Plasmodium falciparum
YDESSKNK

SEQ ID NO: 3252926 - protein, 9 aa, Plasmodium falciparum
YDESSTTNL

SEQ ID NO: 3252927 - protein, 21 aa, Plasmodium falciparum
YDGENAKKHDFTNESISNSRK

SEQ ID NO: 3252928 - protein, 11 aa, Plasmodium falciparum
YDGKGENGKNI

SEQ ID NO: 3252929 - protein, 14 aa, Plasmodium falciparum
YDGNDDDDNNNHDE

SEQ ID NO: 3252930 - protein, 8 aa, Plasmodium falciparum
YDGQTEHG

SEQ ID NO: 3252931 - protein, 17 aa, Plasmodium falciparum
YDHEKNSKNSYKTNTNI

SEQ ID NO: 3252932 - protein, 14 aa, Plasmodium falciparum
YDHSSYDDSSCGDN

SEQ ID NO: 3252933 - protein, 9 aa, Plasmodium falciparum
YDIKSSINK

SEQ ID NO: 3252934 - protein, 17 aa, Plasmodium falciparum
YDIPKKTYDNISTSCEP

SEQ ID NO: 3252935 - protein, 11 aa, Plasmodium falciparum
YDIRKDAEKNI

SEQ ID NO: 3252936 - protein, 4 aa, Plasmodium falciparum
YDKD

SEQ ID NO: 3252937 - protein, 9 aa, Plasmodium falciparum
YDKDTSSIH

SEQ ID NO: 3252938 - protein, 4 aa, Plasmodium falciparum
YDKE

SEQ ID NO: 3252939 - protein, 17 aa, Plasmodium falciparum
YDKEKKMRTTGAEENNM

SEQ ID NO: 3252940 - protein, 9 aa, Plasmodium falciparum
YDKENDNNH

SEQ ID NO: 3252941 - protein, 14 aa, Plasmodium falciparum
YDKGNLTENNEVTP

SEQ ID NO: 3252942 - protein, 8 aa, Plasmodium falciparum
YDKHNQSF

SEQ ID NO: 3252943 - protein, 4 aa, Plasmodium falciparum
YDKK

SEQ ID NO: 3252944 - protein, 19 aa, Plasmodium falciparum
YDKNDEDLLNSTSSGMSSY

SEQ ID NO: 3252945 - protein, 20 aa, Plasmodium falciparum
YDKNDYGSYPSYNKYSNDYK

SEQ ID NO: 3252946 - protein, 11 aa, Plasmodium falciparum
YDKNEETNNGL

SEQ ID NO: 3252947 - protein, 11 aa, Plasmodium falciparum
YDKNKKSIKQG

SEQ ID NO: 3252948 - protein, 67 aa, Plasmodium falciparum
YDKNNTNDNNIYDKNNTNDNNIYDKNNTNDNNIYDKNNTNDNNIYDKNNTNDNNIYDKNNTNDNNIY

SEQ ID NO: 3252949 - protein, 9 aa, Plasmodium falciparum
YDKNSIKKK

SEQ ID NO: 3252950 - protein, 16 aa, Plasmodium falciparum
YDKNYKRDKTGGREAH

SEQ ID NO: 3252951 - protein, 11 aa, Plasmodium falciparum
YDKRHGENETP

SEQ ID NO: 3252952 - protein, 7 aa, Plasmodium falciparum
YDKRSDN

SEQ ID NO: 3252953 - protein, 8 aa, Plasmodium falciparum
YDKSGNGI

SEQ ID NO: 3252954 - protein, 23 aa, Plasmodium falciparum
YDKTNDNNIDTYTKRKEKKKCLN

SEQ ID NO: 3252955 - protein, 13 aa, Plasmodium falciparum
YDMSTTKSSNRYV

SEQ ID NO: 3252956 - protein, 10 aa, Plasmodium falciparum
YDNDNKNSNL

SEQ ID NO: 3252957 - protein, 7 aa, Plasmodium falciparum
YDNDNMK

SEQ ID NO: 3252958 - protein, 10 aa, Plasmodium falciparum
YDNDPDLESV

SEQ ID NO: 3252959 - protein, 11 aa, Plasmodium falciparum
YDNDTCNNYRN

SEQ ID NO: 3252960 - protein, 11 aa, Plasmodium falciparum
YDNEKVKKSSV

SEQ ID NO: 3252961 - protein, 12 aa, Plasmodium falciparum
YDNHKNDDNHMN

SEQ ID NO: 3252962 - protein, 4 aa, Plasmodium falciparum
YDNK

SEQ ID NO: 3252963 - protein, 7 aa, Plasmodium falciparum
YDNKDKE

SEQ ID NO: 3252964 - protein, 11 aa, Plasmodium falciparum
YDNKKEQNINQ

SEQ ID NO: 3252965 - protein, 5 aa, Plasmodium falciparum
YDNKN

SEQ ID NO: 3252966 - protein, 19 aa, Plasmodium falciparum
YDNKRTSSHYTDHNKSSKL

SEQ ID NO: 3252967 - protein, 6 aa, Plasmodium falciparum
YDNKTK

SEQ ID NO: 3252968 - protein, 15 aa, Plasmodium falciparum
YDNMRSSDKKYGDKN

SEQ ID NO: 3252969 - protein, 10 aa, Plasmodium falciparum
YDNNEEKKKK

SEQ ID NO: 3252970 - protein, 8 aa, Plasmodium falciparum
YDNNEESY

SEQ ID NO: 3252971 - protein, 5 aa, Plasmodium falciparum
YDNNI

SEQ ID NO: 3252972 - protein, 10 aa, Plasmodium falciparum
YDNNKNKNNM

SEQ ID NO: 3252973 - protein, 21 aa, Plasmodium falciparum
YDNNKTYSSSCYNNTKQKEPE

SEQ ID NO: 3252974 - protein, 9 aa, Plasmodium falciparum
YDNNNNNNI

SEQ ID NO: 3252975 - protein, 14 aa, Plasmodium falciparum
YDNNNNNNNNNNIY

SEQ ID NO: 3252976 - protein, 8 aa, Plasmodium falciparum
YDNNNVDE

SEQ ID NO: 3252977 - protein, 6 aa, Plasmodium falciparum
YDNNPD

SEQ ID NO: 3252978 - protein, 6 aa, Plasmodium falciparum
YDNNYD

SEQ ID NO: 3252979 - protein, 5 aa, Plasmodium falciparum
YDNPE

SEQ ID NO: 3252980 - protein, 9 aa, Plasmodium falciparum
YDNPNNENK

SEQ ID NO: 3252981 - protein, 8 aa, Plasmodium falciparum
YDNQNNYN

SEQ ID NO: 3252982 - protein, 5 aa, Plasmodium falciparum
YDNRR

SEQ ID NO: 3252983 - protein, 6 aa, Plasmodium falciparum
YDNRTN

SEQ ID NO: 3252984 - protein, 9 aa, Plasmodium falciparum
YDNSYGNNN

SEQ ID NO: 3252985 - protein, 10 aa, Plasmodium falciparum
YDNTKDNINA

SEQ ID NO: 3252986 - protein, 11 aa, Plasmodium falciparum
YDNTNQDQNNG

SEQ ID NO: 3252987 - protein, 8 aa, Plasmodium falciparum
YDNTPTKQ

SEQ ID NO: 3252988 - protein, 25 aa, Plasmodium falciparum
YDNTSDAKSISTSTSVLSSESSNEL

SEQ ID NO: 3252989 - protein, 5 aa, Plasmodium falciparum
YDNYE

SEQ ID NO: 3252990 - protein, 14 aa, Plasmodium falciparum
YDNYTNCKNENNIK

SEQ ID NO: 3252991 - protein, 4 aa, Plasmodium falciparum
YDPD

SEQ ID NO: 3252992 - protein, 9 aa, Plasmodium falciparum
YDPENIKNK

SEQ ID NO: 3252993 - protein, 4 aa, Plasmodium falciparum
YDPK

SEQ ID NO: 3252994 - protein, 5 aa, Plasmodium falciparum
YDPME

SEQ ID NO: 3252995 - protein, 6 aa, Plasmodium falciparum
YDPNSS

SEQ ID NO: 3252996 - protein, 13 aa, Plasmodium falciparum
YDPPKRKGRNFNE

SEQ ID NO: 3252997 - protein, 16 aa, Plasmodium falciparum
YDQENDNKNNDHHEDS

SEQ ID NO: 3252998 - protein, 26 aa, Plasmodium falciparum
YDQENEKDNEYENEKSYKKSTRPYYE

SEQ ID NO: 3252999 - protein, 7 aa, Plasmodium falciparum
YDQEYKN

SEQ ID NO: 3253000 - protein, 12 aa, Plasmodium falciparum
YDQGHNEKNEKR

SEQ ID NO: 3253001 - protein, 7 aa, Plasmodium falciparum
YDQKDEK

SEQ ID NO: 3253002 - protein, 16 aa, Plasmodium falciparum
YDQKQNKKNQTSKDNC

SEQ ID NO: 3253003 - protein, 4 aa, Plasmodium falciparum
YDQS

SEQ ID NO: 3253004 - protein, 5 aa, Plasmodium falciparum
YDQSD

SEQ ID NO: 3253005 - protein, 22 aa, Plasmodium falciparum
YDRANNKINSNNKINSNKNNNY

SEQ ID NO: 3253006 - protein, 6 aa, Plasmodium falciparum
YDRKEK

SEQ ID NO: 3253007 - protein, 5 aa, Plasmodium falciparum
YDRNN

SEQ ID NO: 3253008 - protein, 19 aa, Plasmodium falciparum
YDSDDDSNISNSKNTSENF

SEQ ID NO: 3253009 - protein, 14 aa, Plasmodium falciparum
YDSDESLDDYEKRN

SEQ ID NO: 3253010 - protein, 8 aa, Plasmodium falciparum
YDSDSDDQ

SEQ ID NO: 3253011 - protein, 7 aa, Plasmodium falciparum
YDSEESE

SEQ ID NO: 3253012 - protein, 9 aa, Plasmodium falciparum
YDSKVKETL

SEQ ID NO: 3253013 - protein, 9 aa, Plasmodium falciparum
YDSNDSNFN

SEQ ID NO: 3253014 - protein, 5 aa, Plasmodium falciparum
YDSNN

SEQ ID NO: 3253015 - protein, 17 aa, Plasmodium falciparum
YDSNNSAKYNDNEKNYI

SEQ ID NO: 3253016 - protein, 7 aa, Plasmodium falciparum
YDSNSEW

SEQ ID NO: 3253017 - protein, 6 aa, Plasmodium falciparum
YDSNVR

SEQ ID NO: 3253018 - protein, 8 aa, Plasmodium falciparum
YDSPEISN

SEQ ID NO: 3253019 - protein, 8 aa, Plasmodium falciparum
YDSRNEEK

SEQ ID NO: 3253020 - protein, 10 aa, Plasmodium falciparum
YDSRNEKDAC

SEQ ID NO: 3253021 - protein, 9 aa, Plasmodium falciparum
YDSSSGYDS

SEQ ID NO: 3253022 - protein, 10 aa, Plasmodium falciparum
YDSSTEEECD

SEQ ID NO: 3253023 - protein, 4 aa, Plasmodium falciparum
YDSV

SEQ ID NO: 3253024 - protein, 101 aa, Plasmodium falciparum
YDTDENSNISSSKENDISDEYSSYNNDSLYNSDNSEVEKMSSSMDEDELDEYDDDDDGEDEEEEEEEENSDEDKYNDTYYNNDNNNNNSDKFVEGDNQKHI

SEQ ID NO: 3253025 - protein, 13 aa, Plasmodium falciparum
YDTDENVTEKKPK

SEQ ID NO: 3253026 - protein, 34 aa, Plasmodium falciparum
YDTENDTTNNQDNNNNNNGNNNSNNNNNNNSYNY

SEQ ID NO: 3253027 - protein, 16 aa, Plasmodium falciparum
YDTESSIYDSDDEIDS

SEQ ID NO: 3253028 - protein, 15 aa, Plasmodium falciparum
YDTESSIYDSDEDIN

SEQ ID NO: 3253029 - protein, 5 aa, Plasmodium falciparum
YDTGI

SEQ ID NO: 3253030 - protein, 20 aa, Plasmodium falciparum
YDTKDEGTKDENLTDQDKTS

SEQ ID NO: 3253031 - protein, 6 aa, Plasmodium falciparum
YDTKLE

SEQ ID NO: 3253032 - protein, 8 aa, Plasmodium falciparum
YDTNEKKI

SEQ ID NO: 3253033 - protein, 16 aa, Plasmodium falciparum
YDTRNKQLQKKSFDSN

SEQ ID NO: 3253034 - protein, 10 aa, Plasmodium falciparum
YDTSSNEYNN

SEQ ID NO: 3253035 - protein, 13 aa, Plasmodium falciparum
YDTTEKNSINTSF

SEQ ID NO: 3253036 - protein, 50 aa, Plasmodium falciparum
YDTTRKNEESTNDTTTNDTSSNMETKNEPAMKNPNVTNDMTKPKTDTTQQ

SEQ ID NO: 3253037 - protein, 11 aa, Plasmodium falciparum
YDTTVDPTGPI

SEQ ID NO: 3253038 - protein, 5 aa, Plasmodium falciparum
YDVQE

SEQ ID NO: 3253039 - protein, 4 aa, Plasmodium falciparum
YEAE

SEQ ID NO: 3253040 - protein, 10 aa, Plasmodium falciparum
YEAERTKNHY

SEQ ID NO: 3253041 - protein, 136 aa, Plasmodium falciparum
YEASHKDEASHKDEASHKDEVSHKYEASHKDEASRNDSPNDSRDSHNRNNDNNDNNNNNNKNNNNNNNNNNNNNNNNNNNNNKNNSNTGGGGNNNNNNNNNNNNNNNNNNNNNNNNNNNNNNNNDDDKKKKKKNAI

SEQ ID NO: 3253042 - protein, 10 aa, Plasmodium falciparum
YEDADEDLTK

SEQ ID NO: 3253043 - protein, 10 aa, Plasmodium falciparum
YEDDDERESH

SEQ ID NO: 3253044 - protein, 18 aa, Plasmodium falciparum
YEDDERKVQATNILTIKR

SEQ ID NO: 3253045 - protein, 6 aa, Plasmodium falciparum
YEDDTS

SEQ ID NO: 3253046 - protein, 8 aa, Plasmodium falciparum
YEDEKNPF

SEQ ID NO: 3253047 - protein, 18 aa, Plasmodium falciparum
YEDEKSRRELEESQPQKC

SEQ ID NO: 3253048 - protein, 12 aa, Plasmodium falciparum
YEDEQKNGITHT

SEQ ID NO: 3253049 - protein, 7 aa, Plasmodium falciparum
YEDESYN

SEQ ID NO: 3253050 - protein, 17 aa, Plasmodium falciparum
YEDGGTGEKQYSGYGEA

SEQ ID NO: 3253051 - protein, 26 aa, Plasmodium falciparum
YEDGRRNDSDGSYNNNNLNSNEKNDT

SEQ ID NO: 3253052 - protein, 4 aa, Plasmodium falciparum
YEDK

SEQ ID NO: 3253053 - protein, 9 aa, Plasmodium falciparum
YEDKKNKRK

SEQ ID NO: 3253054 - protein, 12 aa, Plasmodium falciparum
YEDRKKDVSNKY

SEQ ID NO: 3253055 - protein, 7 aa, Plasmodium falciparum
YEDSNLR

SEQ ID NO: 3253056 - protein, 4 aa, Plasmodium falciparum
YEDV

SEQ ID NO: 3253057 - protein, 13 aa, Plasmodium falciparum
YEDVNNKTNYNKP

SEQ ID NO: 3253058 - protein, 12 aa, Plasmodium falciparum
YEEAKDESKEYC

SEQ ID NO: 3253059 - protein, 26 aa, Plasmodium falciparum
YEEDDEKYYPKDYHDEKNDVRYNNNN

SEQ ID NO: 3253060 - protein, 8 aa, Plasmodium falciparum
YEEDQYRR

SEQ ID NO: 3253061 - protein, 15 aa, Plasmodium falciparum
YEEDSINENKKSVEN

SEQ ID NO: 3253062 - protein, 11 aa, Plasmodium falciparum
YEEEGDDGSGV

SEQ ID NO: 3253063 - protein, 15 aa, Plasmodium falciparum
YEEEKEERYSSDGKD

SEQ ID NO: 3253064 - protein, 10 aa, Plasmodium falciparum
YEEEKQYSEP

SEQ ID NO: 3253065 - protein, 12 aa, Plasmodium falciparum
YEEEQNGVHTNN

SEQ ID NO: 3253066 - protein, 6 aa, Plasmodium falciparum
YEEETT

SEQ ID NO: 3253067 - protein, 6 aa, Plasmodium falciparum
YEEEYN

SEQ ID NO: 3253068 - protein, 95 aa, Plasmodium falciparum
YEEGDGKYDNNDNNDDNDNDNNYDNNNYDNNNNYDNNNNYDNNNNYDNNNNYDNNNNYDNNNNYDNNNNYDNYNNYDNNNNYDNYNNYDNYNNYD

SEQ ID NO: 3253069 - protein, 6 aa, Plasmodium falciparum
YEEGQN

SEQ ID NO: 3253070 - protein, 5 aa, Plasmodium falciparum
YEEKE

SEQ ID NO: 3253071 - protein, 9 aa, Plasmodium falciparum
YEEKEKKKI

SEQ ID NO: 3253072 - protein, 8 aa, Plasmodium falciparum
YEEKKKNN

SEQ ID NO: 3253073 - protein, 9 aa, Plasmodium falciparum
YEEKYEKGK

SEQ ID NO: 3253074 - protein, 5 aa, Plasmodium falciparum
YEELP

SEQ ID NO: 3253075 - protein, 10 aa, Plasmodium falciparum
YEENDDHHNN

SEQ ID NO: 3253076 - protein, 7 aa, Plasmodium falciparum
YEENETS

SEQ ID NO: 3253077 - protein, 5 aa, Plasmodium falciparum
YEENN

SEQ ID NO: 3253078 - protein, 5 aa, Plasmodium falciparum
YEENQ

SEQ ID NO: 3253079 - protein, 4 aa, Plasmodium falciparum
YEER

SEQ ID NO: 3253080 - protein, 7 aa, Plasmodium falciparum
YEERENE

SEQ ID NO: 3253081 - protein, 6 aa, Plasmodium falciparum
YEERYE

SEQ ID NO: 3253082 - protein, 11 aa, Plasmodium falciparum
YEESEENNEYF

SEQ ID NO: 3253083 - protein, 8 aa, Plasmodium falciparum
YEESPDKH

SEQ ID NO: 3253084 - protein, 5 aa, Plasmodium falciparum
YEEYD

SEQ ID NO: 3253085 - protein, 4 aa, Plasmodium falciparum
YEGA

SEQ ID NO: 3253086 - protein, 10 aa, Plasmodium falciparum
YEGDSISGRY

SEQ ID NO: 3253087 - protein, 6 aa, Plasmodium falciparum
YEGEDG

SEQ ID NO: 3253088 - protein, 13 aa, Plasmodium falciparum
YEGEEKEKRKNNN

SEQ ID NO: 3253089 - protein, 6 aa, Plasmodium falciparum
YEGESI

SEQ ID NO: 3253090 - protein, 23 aa, Plasmodium falciparum
YEGESITGRYPQHQETNPDTKSQ

SEQ ID NO: 3253091 - protein, 10 aa, Plasmodium falciparum
YEGESLKGYH

SEQ ID NO: 3253092 - protein, 6 aa, Plasmodium falciparum
YEGNSI

SEQ ID NO: 3253093 - protein, 5 aa, Plasmodium falciparum
YEGQS

SEQ ID NO: 3253094 - protein, 7 aa, Plasmodium falciparum
YEGQSIN

SEQ ID NO: 3253095 - protein, 23 aa, Plasmodium falciparum
YEGQSITQDYPKYQATYDDSPSK

SEQ ID NO: 3253096 - protein, 4 aa, Plasmodium falciparum
YEGW

SEQ ID NO: 3253097 - protein, 4 aa, Plasmodium falciparum
YEGY

SEQ ID NO: 3253098 - protein, 11 aa, Plasmodium falciparum
YEGYAASGIQN

SEQ ID NO: 3253099 - protein, 14 aa, Plasmodium falciparum
YEGYDQKDKEQKVK

SEQ ID NO: 3253100 - protein, 9 aa, Plasmodium falciparum
YEHENDETK

SEQ ID NO: 3253101 - protein, 51 aa, Plasmodium falciparum
YEHHDKEEDINANENNNCEQNANVKDNNNNNNNNNNVNKPNTATENESRNT

SEQ ID NO: 3253102 - protein, 48 aa, Plasmodium falciparum
YEHKDKDEHKDKDEHKDKDEHKDKDEHKDKDEHKDKDEHKDKEGEREL

SEQ ID NO: 3253103 - protein, 12 aa, Plasmodium falciparum
YEHKDKDEHKYE

SEQ ID NO: 3253104 - protein, 4 aa, Plasmodium falciparum
YEHN

SEQ ID NO: 3253105 - protein, 11 aa, Plasmodium falciparum
YEHPKGVESAE

SEQ ID NO: 3253106 - protein, 52 aa, Plasmodium falciparum
YEHTSDKKNDTNKNRDGANNSNNNNNKDVSNNKNKNNNNYNYNSNNDYIKQN

SEQ ID NO: 3253107 - protein, 4 aa, Plasmodium falciparum
YEIA

SEQ ID NO: 3253108 - protein, 4 aa, Plasmodium falciparum
YEIN

SEQ ID NO: 3253109 - protein, 4 aa, Plasmodium falciparum
YEIR

SEQ ID NO: 3253110 - protein, 34 aa, Plasmodium falciparum
YEISNKNNNNNNNNNNNNNNNNNYSNNNYSNNNF

SEQ ID NO: 3253111 - protein, 5 aa, Plasmodium falciparum
YEKAV

SEQ ID NO: 3253112 - protein, 8 aa, Plasmodium falciparum
YEKDEYNE

SEQ ID NO: 3253113 - protein, 25 aa, Plasmodium falciparum
YEKDNKKDETKNKYHNNNYNNNKKI

SEQ ID NO: 3253114 - protein, 8 aa, Plasmodium falciparum
YEKDPDVQ

SEQ ID NO: 3253115 - protein, 15 aa, Plasmodium falciparum
YEKEKEKEKEKEKKK

SEQ ID NO: 3253116 - protein, 7 aa, Plasmodium falciparum
YEKENKL

SEQ ID NO: 3253117 - protein, 9 aa, Plasmodium falciparum
YEKENKTLK

SEQ ID NO: 3253118 - protein, 11 aa, Plasmodium falciparum
YEKESSDNNTE

SEQ ID NO: 3253119 - protein, 9 aa, Plasmodium falciparum
YEKGEDKKI

SEQ ID NO: 3253120 - protein, 7 aa, Plasmodium falciparum
YEKGKRK

SEQ ID NO: 3253121 - protein, 13 aa, Plasmodium falciparum
YEKHSKDHNEGIP

SEQ ID NO: 3253122 - protein, 7 aa, Plasmodium falciparum
YEKKDNR

SEQ ID NO: 3253123 - protein, 7 aa, Plasmodium falciparum
YEKKESD

SEQ ID NO: 3253124 - protein, 9 aa, Plasmodium falciparum
YEKKKKLEK

SEQ ID NO: 3253125 - protein, 9 aa, Plasmodium falciparum
YEKKSVTKE

SEQ ID NO: 3253126 - protein, 13 aa, Plasmodium falciparum
YEKMSKSKGNTIN

SEQ ID NO: 3253127 - protein, 4 aa, Plasmodium falciparum
YEKN

SEQ ID NO: 3253128 - protein, 9 aa, Plasmodium falciparum
YEKNGNGDI

SEQ ID NO: 3253129 - protein, 14 aa, Plasmodium falciparum
YEKNKNSQENTDDN

SEQ ID NO: 3253130 - protein, 15 aa, Plasmodium falciparum
YEKNKNSQENTDDNI

SEQ ID NO: 3253131 - protein, 17 aa, Plasmodium falciparum
YEKNNEKLNKNKINEYS

SEQ ID NO: 3253132 - protein, 6 aa, Plasmodium falciparum
YEKNNY

SEQ ID NO: 3253133 - protein, 12 aa, Plasmodium falciparum
YEKQKDKYQGEL

SEQ ID NO: 3253134 - protein, 9 aa, Plasmodium falciparum
YEKQKKKEK

SEQ ID NO: 3253135 - protein, 10 aa, Plasmodium falciparum
YEKQQEQVEK

SEQ ID NO: 3253136 - protein, 7 aa, Plasmodium falciparum
YEKRAYT

SEQ ID NO: 3253137 - protein, 4 aa, Plasmodium falciparum
YEKS

SEQ ID NO: 3253138 - protein, 9 aa, Plasmodium falciparum
YEKSEECEI

SEQ ID NO: 3253139 - protein, 10 aa, Plasmodium falciparum
YEKSNINNNE

SEQ ID NO: 3253140 - protein, 9 aa, Plasmodium falciparum
YEKSNISSS

SEQ ID NO: 3253141 - protein, 22 aa, Plasmodium falciparum
YEKSTDSKINVEDKDNNIDDKN

SEQ ID NO: 3253142 - protein, 6 aa, Plasmodium falciparum
YEKTEK

SEQ ID NO: 3253143 - protein, 6 aa, Plasmodium falciparum
YEKTKN

SEQ ID NO: 3253144 - protein, 22 aa, Plasmodium falciparum
YEKTKNPDLDEQTKDIKTHSDS

SEQ ID NO: 3253145 - protein, 4 aa, Plasmodium falciparum
YEKV

SEQ ID NO: 3253146 - protein, 36 aa, Plasmodium falciparum
YEKYGNNEKCEKNEKYEKNEKYGKNEKIYQNQPDFQ

SEQ ID NO: 3253147 - protein, 6 aa, Plasmodium falciparum
YENDSD

SEQ ID NO: 3253148 - protein, 4 aa, Plasmodium falciparum
YENE

SEQ ID NO: 3253149 - protein, 7 aa, Plasmodium falciparum
YENEENV

SEQ ID NO: 3253150 - protein, 10 aa, Plasmodium falciparum
YENEKDINNC

SEQ ID NO: 3253151 - protein, 6 aa, Plasmodium falciparum
YENENN

SEQ ID NO: 3253152 - protein, 20 aa, Plasmodium falciparum
YENENNKHSGLNTPKNIPVN

SEQ ID NO: 3253153 - protein, 15 aa, Plasmodium falciparum
YENESEDDGEEEDHQ

SEQ ID NO: 3253154 - protein, 7 aa, Plasmodium falciparum
YENGNLS

SEQ ID NO: 3253155 - protein, 7 aa, Plasmodium falciparum
YENKNEK

SEQ ID NO: 3253156 - protein, 12 aa, Plasmodium falciparum
YENKNSDTNSNI

SEQ ID NO: 3253157 - protein, 13 aa, Plasmodium falciparum
YENKRNVTSPTNI

SEQ ID NO: 3253158 - protein, 6 aa, Plasmodium falciparum
YENKST

SEQ ID NO: 3253159 - protein, 15 aa, Plasmodium falciparum
YENKTKDQNKDEMKN

SEQ ID NO: 3253160 - protein, 21 aa, Plasmodium falciparum
YENNDDKNEEEEEYNDQDNDY

SEQ ID NO: 3253161 - protein, 9 aa, Plasmodium falciparum
YENNKNVDN

SEQ ID NO: 3253162 - protein, 14 aa, Plasmodium falciparum
YENQKSNNSITQIN

SEQ ID NO: 3253163 - protein, 10 aa, Plasmodium falciparum
YENRNTQNKY

SEQ ID NO: 3253164 - protein, 11 aa, Plasmodium falciparum
YENSAENISSS

SEQ ID NO: 3253165 - protein, 16 aa, Plasmodium falciparum
YENTNKNDKNKHTDES

SEQ ID NO: 3253166 - protein, 5 aa, Plasmodium falciparum
YENVD

SEQ ID NO: 3253167 - protein, 11 aa, Plasmodium falciparum
YEPASGAQGTP

SEQ ID NO: 3253168 - protein, 4 aa, Plasmodium falciparum
YEPK

SEQ ID NO: 3253169 - protein, 11 aa, Plasmodium falciparum
YEPKPNKEGTT

SEQ ID NO: 3253170 - protein, 6 aa, Plasmodium falciparum
YEPNNY

SEQ ID NO: 3253171 - protein, 10 aa, Plasmodium falciparum
YEPSSDTFDE

SEQ ID NO: 3253172 - protein, 6 aa, Plasmodium falciparum
YEPTKE

SEQ ID NO: 3253173 - protein, 4 aa, Plasmodium falciparum
YEQE

SEQ ID NO: 3253174 - protein, 12 aa, Plasmodium falciparum
YEQEENNEEEHD

SEQ ID NO: 3253175 - protein, 6 aa, Plasmodium falciparum
YEQEKL

SEQ ID NO: 3253176 - protein, 13 aa, Plasmodium falciparum
YEQINQGNNTDKY

SEQ ID NO: 3253177 - protein, 7 aa, Plasmodium falciparum
YEQKDEG

SEQ ID NO: 3253178 - protein, 13 aa, Plasmodium falciparum
YEQKEKQNENKNK

SEQ ID NO: 3253179 - protein, 10 aa, Plasmodium falciparum
YEQKKNNFKE

SEQ ID NO: 3253180 - protein, 4 aa, Plasmodium falciparum
YEQN

SEQ ID NO: 3253181 - protein, 6 aa, Plasmodium falciparum
YEQNDA

SEQ ID NO: 3253182 - protein, 7 aa, Plasmodium falciparum
YEQNNDY

SEQ ID NO: 3253183 - protein, 10 aa, Plasmodium falciparum
YEQNNTNDKF

SEQ ID NO: 3253184 - protein, 5 aa, Plasmodium falciparum
YEQPR

SEQ ID NO: 3253185 - protein, 12 aa, Plasmodium falciparum
YEQPYPLHKSLE

SEQ ID NO: 3253186 - protein, 9 aa, Plasmodium falciparum
YEQSTSSMY

SEQ ID NO: 3253187 - protein, 4 aa, Plasmodium falciparum
YERD

SEQ ID NO: 3253188 - protein, 4 aa, Plasmodium falciparum
YERN

SEQ ID NO: 3253189 - protein, 19 aa, Plasmodium falciparum
YERNDEGKKIDKKDNTENN

SEQ ID NO: 3253190 - protein, 13 aa, Plasmodium falciparum
YERNGRNKNQEVK

SEQ ID NO: 3253191 - protein, 27 aa, Plasmodium falciparum
YERRYKDDENSKRLTKEGCKQADITGK

SEQ ID NO: 3253192 - protein, 9 aa, Plasmodium falciparum
YERSKDVTP

SEQ ID NO: 3253193 - protein, 6 aa, Plasmodium falciparum
YERTNS

SEQ ID NO: 3253194 - protein, 6 aa, Plasmodium falciparum
YESAKK

SEQ ID NO: 3253195 - protein, 10 aa, Plasmodium falciparum
YESARREKLE

SEQ ID NO: 3253196 - protein, 52 aa, Plasmodium falciparum
YESDEEEENDKNDKNDDDQYDNTYQSDEDRKKSNNKKKEQSKKIKGDNESYN

SEQ ID NO: 3253197 - protein, 5 aa, Plasmodium falciparum
YESDY

SEQ ID NO: 3253198 - protein, 7 aa, Plasmodium falciparum
YESEKKH

SEQ ID NO: 3253199 - protein, 10 aa, Plasmodium falciparum
YESKDNIAES

SEQ ID NO: 3253200 - protein, 4 aa, Plasmodium falciparum
YESN

SEQ ID NO: 3253201 - protein, 4 aa, Plasmodium falciparum
YESR

SEQ ID NO: 3253202 - protein, 4 aa, Plasmodium falciparum
YESS

SEQ ID NO: 3253203 - protein, 6 aa, Plasmodium falciparum
YESSSD

SEQ ID NO: 3253204 - protein, 11 aa, Plasmodium falciparum
YESTKNKNDVI

SEQ ID NO: 3253205 - protein, 6 aa, Plasmodium falciparum
YESTQR

SEQ ID NO: 3253206 - protein, 4 aa, Plasmodium falciparum
YETA

SEQ ID NO: 3253207 - protein, 27 aa, Plasmodium falciparum
YETEGETKGSLYSDNYNKKKKTDSMNK

SEQ ID NO: 3253208 - protein, 5 aa, Plasmodium falciparum
YETEL

SEQ ID NO: 3253209 - protein, 12 aa, Plasmodium falciparum
YETKHQKIKITA

SEQ ID NO: 3253210 - protein, 8 aa, Plasmodium falciparum
YETNNNHL

SEQ ID NO: 3253211 - protein, 14 aa, Plasmodium falciparum
YETNNNKKKDTNEK

SEQ ID NO: 3253212 - protein, 5 aa, Plasmodium falciparum
YETPT

SEQ ID NO: 3253213 - protein, 12 aa, Plasmodium falciparum
YETRGNNNKRNI

SEQ ID NO: 3253214 - protein, 18 aa, Plasmodium falciparum
YETSDDLEYETENKTDIH

SEQ ID NO: 3253215 - protein, 11 aa, Plasmodium falciparum
YETSEPSTIDD

SEQ ID NO: 3253216 - protein, 11 aa, Plasmodium falciparum
YETSGNEKLGD

SEQ ID NO: 3253217 - protein, 15 aa, Plasmodium falciparum
YETSYSKYNNSTEFQ

SEQ ID NO: 3253218 - protein, 4 aa, Plasmodium falciparum
YETT

SEQ ID NO: 3253219 - protein, 6 aa, Plasmodium falciparum
YETTQA

SEQ ID NO: 3253220 - protein, 4 aa, Plasmodium falciparum
YEYE

SEQ ID NO: 3253221 - protein, 4 aa, Plasmodium falciparum
YEYG

SEQ ID NO: 3253222 - protein, 4 aa, Plasmodium falciparum
YEYL

SEQ ID NO: 3253223 - protein, 4 aa, Plasmodium falciparum
YEYN

SEQ ID NO: 3253224 - protein, 7 aa, Plasmodium falciparum
YEYNENG

SEQ ID NO: 3253225 - protein, 19 aa, Plasmodium falciparum
YEYSDKSSKCEKCKPGYYK

SEQ ID NO: 3253226 - protein, 12 aa, Plasmodium falciparum
YEYSKDEEKKNI

SEQ ID NO: 3253227 - protein, 26 aa, Plasmodium falciparum
YFKSPKKKTSCSENNDDDEIEEYEKE

SEQ ID NO: 3253228 - protein, 12 aa, Plasmodium falciparum
YFSGENKNMGDI

SEQ ID NO: 3253229 - protein, 4 aa, Plasmodium falciparum
YFSK

SEQ ID NO: 3253230 - protein, 11 aa, Plasmodium falciparum
YGCSKKKNKNI

SEQ ID NO: 3253231 - protein, 7 aa, Plasmodium falciparum
YGDAQAI

SEQ ID NO: 3253232 - protein, 5 aa, Plasmodium falciparum
YGDDK

SEQ ID NO: 3253233 - protein, 10 aa, Plasmodium falciparum
YGDDNKEDDY

SEQ ID NO: 3253234 - protein, 6 aa, Plasmodium falciparum
YGDEQK

SEQ ID NO: 3253235 - protein, 4 aa, Plasmodium falciparum
YGDK

SEQ ID NO: 3253236 - protein, 30 aa, Plasmodium falciparum
YGDKYGDKYDDKYDDKYDEKYDDKYGDRKL

SEQ ID NO: 3253237 - protein, 4 aa, Plasmodium falciparum
YGDN

SEQ ID NO: 3253238 - protein, 10 aa, Plasmodium falciparum
YGDNADEDVD

SEQ ID NO: 3253239 - protein, 13 aa, Plasmodium falciparum
YGDNINNGDNINY

SEQ ID NO: 3253240 - protein, 7 aa, Plasmodium falciparum
YGDSPSQ

SEQ ID NO: 3253241 - protein, 8 aa, Plasmodium falciparum
YGDSTAIQ

SEQ ID NO: 3253242 - protein, 5 aa, Plasmodium falciparum
YGDYN

SEQ ID NO: 3253243 - protein, 11 aa, Plasmodium falciparum
YGDYNKRKKRN

SEQ ID NO: 3253244 - protein, 5 aa, Plasmodium falciparum
YGEAK

SEQ ID NO: 3253245 - protein, 4 aa, Plasmodium falciparum
YGED

SEQ ID NO: 3253246 - protein, 10 aa, Plasmodium falciparum
YGEDGQYNND

SEQ ID NO: 3253247 - protein, 26 aa, Plasmodium falciparum
YGEEGLDKYGSNNGHSKGFKRTDPND

SEQ ID NO: 3253248 - protein, 5 aa, Plasmodium falciparum
YGEEQ

SEQ ID NO: 3253249 - protein, 8 aa, Plasmodium falciparum
YGEERKKE

SEQ ID NO: 3253250 - protein, 16 aa, Plasmodium falciparum
YGEERNNTKQDKSDNN

SEQ ID NO: 3253251 - protein, 5 aa, Plasmodium falciparum
YGEET

SEQ ID NO: 3253252 - protein, 12 aa, Plasmodium falciparum
YGEKKKNKIKYG

SEQ ID NO: 3253253 - protein, 7 aa, Plasmodium falciparum
YGEPTTD

SEQ ID NO: 3253254 - protein, 11 aa, Plasmodium falciparum
YGEQGQKKKQA

SEQ ID NO: 3253255 - protein, 4 aa, Plasmodium falciparum
YGER

SEQ ID NO: 3253256 - protein, 6 aa, Plasmodium falciparum
YGGDTH

SEQ ID NO: 3253257 - protein, 6 aa, Plasmodium falciparum
YGGECA

SEQ ID NO: 3253258 - protein, 7 aa, Plasmodium falciparum
YGGESNI

SEQ ID NO: 3253259 - protein, 30 aa, Plasmodium falciparum
YGGISSNDGEDGNIKQSDNEIKDSEPSSEN

SEQ ID NO: 3253260 - protein, 19 aa, Plasmodium falciparum
YGGMNDDNSSNNNNNNNNM

SEQ ID NO: 3253261 - protein, 7 aa, Plasmodium falciparum
YGGNNSR

SEQ ID NO: 3253262 - protein, 21 aa, Plasmodium falciparum
YGGQCTDSKIKGNEDNKGGAC

SEQ ID NO: 3253263 - protein, 7 aa, Plasmodium falciparum
YGGREKK

SEQ ID NO: 3253264 - protein, 16 aa, Plasmodium falciparum
YGGTHQNSQSLSSMRT

SEQ ID NO: 3253265 - protein, 5 aa, Plasmodium falciparum
YGGYP

SEQ ID NO: 3253266 - protein, 10 aa, Plasmodium falciparum
YGHSIEESKN

SEQ ID NO: 3253267 - protein, 20 aa, Plasmodium falciparum
YGIEKSKELKEKLKSNKGHG

SEQ ID NO: 3253268 - protein, 11 aa, Plasmodium falciparum
YGKARKDPSNN

SEQ ID NO: 3253269 - protein, 4 aa, Plasmodium falciparum
YGKD

SEQ ID NO: 3253270 - protein, 11 aa, Plasmodium falciparum
YGKEKKNNKYY

SEQ ID NO: 3253271 - protein, 8 aa, Plasmodium falciparum
YGKEKSQN

SEQ ID NO: 3253272 - protein, 9 aa, Plasmodium falciparum
YGKESGEYK

SEQ ID NO: 3253273 - protein, 10 aa, Plasmodium falciparum
YGKGNTFSSI

SEQ ID NO: 3253274 - protein, 12 aa, Plasmodium falciparum
YGKKKKNKKKRK

SEQ ID NO: 3253275 - protein, 7 aa, Plasmodium falciparum
YGKNDDA

SEQ ID NO: 3253276 - protein, 11 aa, Plasmodium falciparum
YGKNKSPQENI

SEQ ID NO: 3253277 - protein, 6 aa, Plasmodium falciparum
YGKNND

SEQ ID NO: 3253278 - protein, 4 aa, Plasmodium falciparum
YGKS

SEQ ID NO: 3253279 - protein, 12 aa, Plasmodium falciparum
YGKSSNIQVATS

SEQ ID NO: 3253280 - protein, 8 aa, Plasmodium falciparum
YGKTSTCS

SEQ ID NO: 3253281 - protein, 4 aa, Plasmodium falciparum
YGLG

SEQ ID NO: 3253282 - protein, 13 aa, Plasmodium falciparum
YGLSNKDPSEKNC

SEQ ID NO: 3253283 - protein, 8 aa, Plasmodium falciparum
YGMPSSHS

SEQ ID NO: 3253284 - protein, 5 aa, Plasmodium falciparum
YGMPT

SEQ ID NO: 3253285 - protein, 5 aa, Plasmodium falciparum
YGNDN

SEQ ID NO: 3253286 - protein, 18 aa, Plasmodium falciparum
YGNFNTPTISPTNIKRNK

SEQ ID NO: 3253287 - protein, 12 aa, Plasmodium falciparum
YGNLKKGAQNVK

SEQ ID NO: 3253288 - protein, 4 aa, Plasmodium falciparum
YGNN

SEQ ID NO: 3253289 - protein, 5 aa, Plasmodium falciparum
YGNNI

SEQ ID NO: 3253290 - protein, 8 aa, Plasmodium falciparum
YGNNKGKH

SEQ ID NO: 3253291 - protein, 7 aa, Plasmodium falciparum
YGNNTKN

SEQ ID NO: 3253292 - protein, 6 aa, Plasmodium falciparum
YGNNVR

SEQ ID NO: 3253293 - protein, 8 aa, Plasmodium falciparum
YGNPSNKS

SEQ ID NO: 3253294 - protein, 5 aa, Plasmodium falciparum
YGNPT

SEQ ID NO: 3253295 - protein, 6 aa, Plasmodium falciparum
YGNQNI

SEQ ID NO: 3253296 - protein, 16 aa, Plasmodium falciparum
YGNRDIPREQNETNTC

SEQ ID NO: 3253297 - protein, 5 aa, Plasmodium falciparum
YGNYK

SEQ ID NO: 3253298 - protein, 6 aa, Plasmodium falciparum
YGPGDS

SEQ ID NO: 3253299 - protein, 8 aa, Plasmodium falciparum
YGPKAPTS

SEQ ID NO: 3253300 - protein, 9 aa, Plasmodium falciparum
YGPKNGRCN

SEQ ID NO: 3253301 - protein, 7 aa, Plasmodium falciparum
YGQCGQK

SEQ ID NO: 3253302 - protein, 6 aa, Plasmodium falciparum
YGQKEK

SEQ ID NO: 3253303 - protein, 7 aa, Plasmodium falciparum
YGQNHSS

SEQ ID NO: 3253304 - protein, 7 aa, Plasmodium falciparum
YGQSKNC

SEQ ID NO: 3253305 - protein, 9 aa, Plasmodium falciparum
YGQSTNPQV

SEQ ID NO: 3253306 - protein, 5 aa, Plasmodium falciparum
YGQTN

SEQ ID NO: 3253307 - protein, 7 aa, Plasmodium falciparum
YGRKGEY

SEQ ID NO: 3253308 - protein, 34 aa, Plasmodium falciparum
YGRNENNNNNNNNNKKKNVKNSTNDKKGNSSERI

SEQ ID NO: 3253309 - protein, 5 aa, Plasmodium falciparum
YGRNN

SEQ ID NO: 3253310 - protein, 10 aa, Plasmodium falciparum
YGRQAKNNYN

SEQ ID NO: 3253311 - protein, 7 aa, Plasmodium falciparum
YGRTESK

SEQ ID NO: 3253312 - protein, 9 aa, Plasmodium falciparum
YGSDLSEDN

SEQ ID NO: 3253313 - protein, 10 aa, Plasmodium falciparum
YGSEPQTKVY

SEQ ID NO: 3253314 - protein, 6 aa, Plasmodium falciparum
YGSGTV

SEQ ID NO: 3253315 - protein, 23 aa, Plasmodium falciparum
YGSNKRSSKIYDNNNNNNNNNIN

SEQ ID NO: 3253316 - protein, 9 aa, Plasmodium falciparum
YGSNRKLNN

SEQ ID NO: 3253317 - protein, 9 aa, Plasmodium falciparum
YGSPNSISP

SEQ ID NO: 3253318 - protein, 6 aa, Plasmodium falciparum
YGSSDA

SEQ ID NO: 3253319 - protein, 9 aa, Plasmodium falciparum
YGSSKTKIF

SEQ ID NO: 3253320 - protein, 11 aa, Plasmodium falciparum
YGSYKKEDNNH

SEQ ID NO: 3253321 - protein, 11 aa, Plasmodium falciparum
YGYNNSGESYP

SEQ ID NO: 3253322 - protein, 9 aa, Plasmodium falciparum
YHAGSPINK

SEQ ID NO: 3253323 - protein, 19 aa, Plasmodium falciparum
YHDDDLDDDDIQNKDNNNY

SEQ ID NO: 3253324 - protein, 16 aa, Plasmodium falciparum
YHDKGESDKQVPSSVG

SEQ ID NO: 3253325 - protein, 10 aa, Plasmodium falciparum
YHDPKKKTSQ

SEQ ID NO: 3253326 - protein, 11 aa, Plasmodium falciparum
YHEEKKQETKV

SEQ ID NO: 3253327 - protein, 5 aa, Plasmodium falciparum
YHEGK

SEQ ID NO: 3253328 - protein, 15 aa, Plasmodium falciparum
YHEKPSREKHNSSSE

SEQ ID NO: 3253329 - protein, 28 aa, Plasmodium falciparum
YHEPNNNNNNNNNKYNYYGSNNNNHDNV

SEQ ID NO: 3253330 - protein, 8 aa, Plasmodium falciparum
YHHQNNNY

SEQ ID NO: 3253331 - protein, 8 aa, Plasmodium falciparum
YHKDGPDY

SEQ ID NO: 3253332 - protein, 13 aa, Plasmodium falciparum
YHKNNEKKIKNQS

SEQ ID NO: 3253333 - protein, 8 aa, Plasmodium falciparum
YHKQPNGN

SEQ ID NO: 3253334 - protein, 18 aa, Plasmodium falciparum
YHNDEEKYHNDKNKYIND

SEQ ID NO: 3253335 - protein, 11 aa, Plasmodium falciparum
YHNDKNDHNNY

SEQ ID NO: 3253336 - protein, 7 aa, Plasmodium falciparum
YHNDNDN

SEQ ID NO: 3253337 - protein, 5 aa, Plasmodium falciparum
YHNKY

SEQ ID NO: 3253338 - protein, 20 aa, Plasmodium falciparum
YHNNDRNNDFHNNDRNNDYH

SEQ ID NO: 3253339 - protein, 10 aa, Plasmodium falciparum
YHNNNDKGAN

SEQ ID NO: 3253340 - protein, 11 aa, Plasmodium falciparum
YHNNNNNNNNH

SEQ ID NO: 3253341 - protein, 10 aa, Plasmodium falciparum
YHNNNNNNNV

SEQ ID NO: 3253342 - protein, 19 aa, Plasmodium falciparum
YHNNNTNINNSNNNNNNNM

SEQ ID NO: 3253343 - protein, 10 aa, Plasmodium falciparum
YHNNRNNEQH

SEQ ID NO: 3253344 - protein, 13 aa, Plasmodium falciparum
YHNQQNDKNEQNI

SEQ ID NO: 3253345 - protein, 37 aa, Plasmodium falciparum
YHNSDDNNNDNSDDNNNDNSDDNNDGSNHNKNKIKNK

SEQ ID NO: 3253346 - protein, 14 aa, Plasmodium falciparum
YHNSTKEKKNDING

SEQ ID NO: 3253347 - protein, 8 aa, Plasmodium falciparum
YHNSTSNM

SEQ ID NO: 3253348 - protein, 78 aa, Plasmodium falciparum
YHPDKDEQNVEDESDSDNNNDEYQTDSNDNNNDNNSDDNNDNNSDDNNNNNDEDETHSDNNTDNAPLNDHNNSNTSDV

SEQ ID NO: 3253349 - protein, 13 aa, Plasmodium falciparum
YHPDKNPNDTSAA

SEQ ID NO: 3253350 - protein, 11 aa, Plasmodium falciparum
YHPEKNIGNDK

SEQ ID NO: 3253351 - protein, 5 aa, Plasmodium falciparum
YHPKT

SEQ ID NO: 3253352 - protein, 5 aa, Plasmodium falciparum
YHPNE

SEQ ID NO: 3253353 - protein, 5 aa, Plasmodium falciparum
YHPSA

SEQ ID NO: 3253354 - protein, 4 aa, Plasmodium falciparum
YHRS

SEQ ID NO: 3253355 - protein, 8 aa, Plasmodium falciparum
YHSDDKSD

SEQ ID NO: 3253356 - protein, 11 aa, Plasmodium falciparum
YHTDNSDNEEI

SEQ ID NO: 3253357 - protein, 48 aa, Plasmodium falciparum
YHTKKHKNKYTTHKNKINKHSKKNKKEHIKKDTEVDQINNKESDITNH

SEQ ID NO: 3253358 - protein, 16 aa, Plasmodium falciparum
YIDDTNKYKEHDEYNN

SEQ ID NO: 3253359 - protein, 9 aa, Plasmodium falciparum
YIGPKRQNK

SEQ ID NO: 3253360 - protein, 4 aa, Plasmodium falciparum
YIHS

SEQ ID NO: 3253361 - protein, 10 aa, Plasmodium falciparum
YIHSDDNNHV

SEQ ID NO: 3253362 - protein, 6 aa, Plasmodium falciparum
YIKPKD

SEQ ID NO: 3253363 - protein, 10 aa, Plasmodium falciparum
YIKTDASNNI

SEQ ID NO: 3253364 - protein, 11 aa, Plasmodium falciparum
YIKTQRNLSTR

SEQ ID NO: 3253365 - protein, 11 aa, Plasmodium falciparum
YINEDGTCGQY

SEQ ID NO: 3253366 - protein, 8 aa, Plasmodium falciparum
YINEEEKK

SEQ ID NO: 3253367 - protein, 14 aa, Plasmodium falciparum
YIPENDGNNDKDKN

SEQ ID NO: 3253368 - protein, 10 aa, Plasmodium falciparum
YIQTSKNNQQ

SEQ ID NO: 3253369 - protein, 13 aa, Plasmodium falciparum
YIRNPNNSNYPDR

SEQ ID NO: 3253370 - protein, 9 aa, Plasmodium falciparum
YISEDSGET

SEQ ID NO: 3253371 - protein, 5 aa, Plasmodium falciparum
YISNR

SEQ ID NO: 3253372 - protein, 16 aa, Plasmodium falciparum
YISTPNKNNNKNNTMN

SEQ ID NO: 3253373 - protein, 5 aa, Plasmodium falciparum
YITNN

SEQ ID NO: 3253374 - protein, 4 aa, Plasmodium falciparum
YKAK

SEQ ID NO: 3253375 - protein, 8 aa, Plasmodium falciparum
YKDDNSKL

SEQ ID NO: 3253376 - protein, 7 aa, Plasmodium falciparum
YKDEKNE

SEQ ID NO: 3253377 - protein, 5 aa, Plasmodium falciparum
YKDEY

SEQ ID NO: 3253378 - protein, 8 aa, Plasmodium falciparum
YKDGSSKR

SEQ ID NO: 3253379 - protein, 12 aa, Plasmodium falciparum
YKDIPKENIERE

SEQ ID NO: 3253380 - protein, 6 aa, Plasmodium falciparum
YKDKEN

SEQ ID NO: 3253381 - protein, 9 aa, Plasmodium falciparum
YKDKKNTNN

SEQ ID NO: 3253382 - protein, 6 aa, Plasmodium falciparum
YKDLDK

SEQ ID NO: 3253383 - protein, 9 aa, Plasmodium falciparum
YKDNNGITI

SEQ ID NO: 3253384 - protein, 12 aa, Plasmodium falciparum
YKDNNKNSSRVK

SEQ ID NO: 3253385 - protein, 10 aa, Plasmodium falciparum
YKDNRKRKHD

SEQ ID NO: 3253386 - protein, 8 aa, Plasmodium falciparum
YKDNRNNK

SEQ ID NO: 3253387 - protein, 13 aa, Plasmodium falciparum
YKDNSSAKDDVTV

SEQ ID NO: 3253388 - protein, 13 aa, Plasmodium falciparum
YKDNTEKKNEKEH

SEQ ID NO: 3253389 - protein, 5 aa, Plasmodium falciparum
YKDPK

SEQ ID NO: 3253390 - protein, 12 aa, Plasmodium falciparum
YKDQNGDEEDTL

SEQ ID NO: 3253391 - protein, 10 aa, Plasmodium falciparum
YKDRENLKNE

SEQ ID NO: 3253392 - protein, 4 aa, Plasmodium falciparum
YKDS

SEQ ID NO: 3253393 - protein, 4 aa, Plasmodium falciparum
YKDT

SEQ ID NO: 3253394 - protein, 7 aa, Plasmodium falciparum
YKDTNNL

SEQ ID NO: 3253395 - protein, 14 aa, Plasmodium falciparum
YKDTPIPDKTLSEA

SEQ ID NO: 3253396 - protein, 9 aa, Plasmodium falciparum
YKDTQRRKN

SEQ ID NO: 3253397 - protein, 11 aa, Plasmodium falciparum
YKDYNESEDPS

SEQ ID NO: 3253398 - protein, 4 aa, Plasmodium falciparum
YKEA

SEQ ID NO: 3253399 - protein, 13 aa, Plasmodium falciparum
YKEDDDKKNNIKK

SEQ ID NO: 3253400 - protein, 7 aa, Plasmodium falciparum
YKEDSQG

SEQ ID NO: 3253401 - protein, 6 aa, Plasmodium falciparum
YKEEMA

SEQ ID NO: 3253402 - protein, 4 aa, Plasmodium falciparum
YKEG

SEQ ID NO: 3253403 - protein, 11 aa, Plasmodium falciparum
YKEGGGRKGLP

SEQ ID NO: 3253404 - protein, 9 aa, Plasmodium falciparum
YKEKDSSLH

SEQ ID NO: 3253405 - protein, 15 aa, Plasmodium falciparum
YKEKERNNEKKKSFQ

SEQ ID NO: 3253406 - protein, 31 aa, Plasmodium falciparum
YKEKETIAQNVQQNNDIKEEQRKEDINNSCN

SEQ ID NO: 3253407 - protein, 6 aa, Plasmodium falciparum
YKEKKR

SEQ ID NO: 3253408 - protein, 6 aa, Plasmodium falciparum
YKEKNN

SEQ ID NO: 3253409 - protein, 11 aa, Plasmodium falciparum
YKEKNYNTKKN

SEQ ID NO: 3253410 - protein, 7 aa, Plasmodium falciparum
YKEKQIH

SEQ ID NO: 3253411 - protein, 4 aa, Plasmodium falciparum
YKEL

SEQ ID NO: 3253412 - protein, 6 aa, Plasmodium falciparum
YKENDK

SEQ ID NO: 3253413 - protein, 8 aa, Plasmodium falciparum
YKENDKQD

SEQ ID NO: 3253414 - protein, 13 aa, Plasmodium falciparum
YKENEKETNGYVQ

SEQ ID NO: 3253415 - protein, 5 aa, Plasmodium falciparum
YKENK

SEQ ID NO: 3253416 - protein, 14 aa, Plasmodium falciparum
YKENNNEPVILSGE

SEQ ID NO: 3253417 - protein, 9 aa, Plasmodium falciparum
YKENNNKIN

SEQ ID NO: 3253418 - protein, 14 aa, Plasmodium falciparum
YKENNSIQKKDSFN

SEQ ID NO: 3253419 - protein, 12 aa, Plasmodium falciparum
YKEPNNEFPKNN

SEQ ID NO: 3253420 - protein, 5 aa, Plasmodium falciparum
YKEPY

SEQ ID NO: 3253421 - protein, 4 aa, Plasmodium falciparum
YKES

SEQ ID NO: 3253422 - protein, 10 aa, Plasmodium falciparum
YKESKIKPTN

SEQ ID NO: 3253423 - protein, 32 aa, Plasmodium falciparum
YKESYESDLNNELEEKENKMKNRKRRNASSSF

SEQ ID NO: 3253424 - protein, 6 aa, Plasmodium falciparum
YKGDEI

SEQ ID NO: 3253425 - protein, 19 aa, Plasmodium falciparum
YKGDGSSSYENSITEAPYI

SEQ ID NO: 3253426 - protein, 16 aa, Plasmodium falciparum
YKGEDDSIKNNKSNYN

SEQ ID NO: 3253427 - protein, 5 aa, Plasmodium falciparum
YKGEF

SEQ ID NO: 3253428 - protein, 15 aa, Plasmodium falciparum
YKGEGDQTSPMSNPG

SEQ ID NO: 3253429 - protein, 4 aa, Plasmodium falciparum
YKGG

SEQ ID NO: 3253430 - protein, 17 aa, Plasmodium falciparum
YKGKDNALVSNTKTHQG

SEQ ID NO: 3253431 - protein, 11 aa, Plasmodium falciparum
YKGKNKKRQLK

SEQ ID NO: 3253432 - protein, 6 aa, Plasmodium falciparum
YKGQNK

SEQ ID NO: 3253433 - protein, 16 aa, Plasmodium falciparum
YKGQSDDDNDEEKNFN

SEQ ID NO: 3253434 - protein, 7 aa, Plasmodium falciparum
YKGRSDW

SEQ ID NO: 3253435 - protein, 11 aa, Plasmodium falciparum
YKGSNKNYKYE

SEQ ID NO: 3253436 - protein, 11 aa, Plasmodium falciparum
YKGSSPQPLNS

SEQ ID NO: 3253437 - protein, 29 aa, Plasmodium falciparum
YKGTCENDSSSETEEKSNTNKANIETSAD

SEQ ID NO: 3253438 - protein, 5 aa, Plasmodium falciparum
YKGTF

SEQ ID NO: 3253439 - protein, 22 aa, Plasmodium falciparum
YKHADKTKCRKHTYDESYKGQY

SEQ ID NO: 3253440 - protein, 8 aa, Plasmodium falciparum
YKHDNTSS

SEQ ID NO: 3253441 - protein, 5 aa, Plasmodium falciparum
YKHDR

SEQ ID NO: 3253442 - protein, 7 aa, Plasmodium falciparum
YKIDTKS

SEQ ID NO: 3253443 - protein, 13 aa, Plasmodium falciparum
YKKADDKWKKTKE

SEQ ID NO: 3253444 - protein, 10 aa, Plasmodium falciparum
YKKDKQKRNV

SEQ ID NO: 3253445 - protein, 20 aa, Plasmodium falciparum
YKKDRKEDIYKNDDNYSDNN

SEQ ID NO: 3253446 - protein, 43 aa, Plasmodium falciparum
YKKEKNKDEKNKIKKNKSYKNKTHKNKKQKNKSSNADKMNKNS

SEQ ID NO: 3253447 - protein, 22 aa, Plasmodium falciparum
YKKEQEKNIKKKKKKDENDDEI

SEQ ID NO: 3253448 - protein, 8 aa, Plasmodium falciparum
YKKEQKNK

SEQ ID NO: 3253449 - protein, 10 aa, Plasmodium falciparum
YKKGDEEKVN

SEQ ID NO: 3253450 - protein, 18 aa, Plasmodium falciparum
YKKGNHNPSNKNENDPQE

SEQ ID NO: 3253451 - protein, 8 aa, Plasmodium falciparum
YKKGSTDQ

SEQ ID NO: 3253452 - protein, 20 aa, Plasmodium falciparum
YKKGTYDKEKEEKSNRSPHS

SEQ ID NO: 3253453 - protein, 4 aa, Plasmodium falciparum
YKKK

SEQ ID NO: 3253454 - protein, 68 aa, Plasmodium falciparum
YKKKDKSSEHTNSENRFSDSSKNYSSLSSSLSSSLSSSLSSSLSSSLSSSLSSSLSSSLSSSLSSSNS

SEQ ID NO: 3253455 - protein, 7 aa, Plasmodium falciparum
YKKKEEM

SEQ ID NO: 3253456 - protein, 9 aa, Plasmodium falciparum
YKKKENYNI

SEQ ID NO: 3253457 - protein, 10 aa, Plasmodium falciparum
YKKKEQKYTL

SEQ ID NO: 3253458 - protein, 8 aa, Plasmodium falciparum
YKKKGNIE

SEQ ID NO: 3253459 - protein, 49 aa, Plasmodium falciparum
YKKKKIKKKEKEKKEKEKEKEKEKDKYKDQQKKDKQNLAQVTKDRKRGL

SEQ ID NO: 3253460 - protein, 7 aa, Plasmodium falciparum
YKKKKRK

SEQ ID NO: 3253461 - protein, 8 aa, Plasmodium falciparum
YKKKKRKN

SEQ ID NO: 3253462 - protein, 6 aa, Plasmodium falciparum
YKKKLE

SEQ ID NO: 3253463 - protein, 8 aa, Plasmodium falciparum
YKKKRRLQ

SEQ ID NO: 3253464 - protein, 9 aa, Plasmodium falciparum
YKKKRSNIK

SEQ ID NO: 3253465 - protein, 5 aa, Plasmodium falciparum
YKKKS

SEQ ID NO: 3253466 - protein, 10 aa, Plasmodium falciparum
YKKKTGEDVI

SEQ ID NO: 3253467 - protein, 8 aa, Plasmodium falciparum
YKKNDKKS

SEQ ID NO: 3253468 - protein, 12 aa, Plasmodium falciparum
YKKNEVQNDPKL

SEQ ID NO: 3253469 - protein, 8 aa, Plasmodium falciparum
YKKNKKYT

SEQ ID NO: 3253470 - protein, 6 aa, Plasmodium falciparum
YKKNKY

SEQ ID NO: 3253471 - protein, 8 aa, Plasmodium falciparum
YKKNNSLS

SEQ ID NO: 3253472 - protein, 7 aa, Plasmodium falciparum
YKKNNYH

SEQ ID NO: 3253473 - protein, 7 aa, Plasmodium falciparum
YKKNPKF

SEQ ID NO: 3253474 - protein, 15 aa, Plasmodium falciparum
YKKNTLNSDNNIRNN

SEQ ID NO: 3253475 - protein, 19 aa, Plasmodium falciparum
YKKNTSNNSVAKLTNSDPI

SEQ ID NO: 3253476 - protein, 21 aa, Plasmodium falciparum
YKKNTSNNSVTKNINSDPIDN

SEQ ID NO: 3253477 - protein, 11 aa, Plasmodium falciparum
YKKQKEKLNKK

SEQ ID NO: 3253478 - protein, 5 aa, Plasmodium falciparum
YKKRA

SEQ ID NO: 3253479 - protein, 5 aa, Plasmodium falciparum
YKKSN

SEQ ID NO: 3253480 - protein, 17 aa, Plasmodium falciparum
YKKSQENNASNENNTND

SEQ ID NO: 3253481 - protein, 10 aa, Plasmodium falciparum
YKKSSSTYNI

SEQ ID NO: 3253482 - protein, 7 aa, Plasmodium falciparum
YKKYKKY

SEQ ID NO: 3253483 - protein, 10 aa, Plasmodium falciparum
YKLNNNNNNN

SEQ ID NO: 3253484 - protein, 4 aa, Plasmodium falciparum
YKLS

SEQ ID NO: 3253485 - protein, 8 aa, Plasmodium falciparum
YKNAKDAK

SEQ ID NO: 3253486 - protein, 7 aa, Plasmodium falciparum
YKNAQDA

SEQ ID NO: 3253487 - protein, 5 aa, Plasmodium falciparum
YKNCS

SEQ ID NO: 3253488 - protein, 4 aa, Plasmodium falciparum
YKND

SEQ ID NO: 3253489 - protein, 16 aa, Plasmodium falciparum
YKNDDDKSDDSSSCGC

SEQ ID NO: 3253490 - protein, 13 aa, Plasmodium falciparum
YKNDKQVNKEKEK

SEQ ID NO: 3253491 - protein, 9 aa, Plasmodium falciparum
YKNDKRKED

SEQ ID NO: 3253492 - protein, 8 aa, Plasmodium falciparum
YKNDSSAY

SEQ ID NO: 3253493 - protein, 7 aa, Plasmodium falciparum
YKNDTDQ

SEQ ID NO: 3253494 - protein, 7 aa, Plasmodium falciparum
YKNDYND

SEQ ID NO: 3253495 - protein, 4 aa, Plasmodium falciparum
YKNE

SEQ ID NO: 3253496 - protein, 11 aa, Plasmodium falciparum
YKNEDSKREGL

SEQ ID NO: 3253497 - protein, 8 aa, Plasmodium falciparum
YKNEDYEK

SEQ ID NO: 3253498 - protein, 7 aa, Plasmodium falciparum
YKNEHNN

SEQ ID NO: 3253499 - protein, 13 aa, Plasmodium falciparum
YKNENKEKQNFKE

SEQ ID NO: 3253500 - protein, 128 aa, Plasmodium falciparum
YKNGDTYKYKNGDTNKYKNGDTNKYKNGDTYKYKNGDTNKYKNGDTNKYKNGDTNKYKNGDTYKYKNGDTNKYKNGDTYKYKNGDTYKYKNGDTNKYKNGDTYKYKNGDTNKYKNGDTYKYKNGDTNI

SEQ ID NO: 3253501 - protein, 8 aa, Plasmodium falciparum
YKNGINDK

SEQ ID NO: 3253502 - protein, 16 aa, Plasmodium falciparum
YKNGNYNSQHDNNDKN

SEQ ID NO: 3253503 - protein, 10 aa, Plasmodium falciparum
YKNISKKKKN

SEQ ID NO: 3253504 - protein, 8 aa, Plasmodium falciparum
YKNKDDKE

SEQ ID NO: 3253505 - protein, 6 aa, Plasmodium falciparum
YKNKDN

SEQ ID NO: 3253506 - protein, 6 aa, Plasmodium falciparum
YKNKEV

SEQ ID NO: 3253507 - protein, 8 aa, Plasmodium falciparum
YKNKGQKR

SEQ ID NO: 3253508 - protein, 13 aa, Plasmodium falciparum
YKNKTDDKNDNTF

SEQ ID NO: 3253509 - protein, 7 aa, Plasmodium falciparum
YKNKTKK

SEQ ID NO: 3253510 - protein, 4 aa, Plasmodium falciparum
YKNN

SEQ ID NO: 3253511 - protein, 14 aa, Plasmodium falciparum
YKNNEIKKCTNDSE

SEQ ID NO: 3253512 - protein, 6 aa, Plasmodium falciparum
YKNNIT

SEQ ID NO: 3253513 - protein, 8 aa, Plasmodium falciparum
YKNNKNEI

SEQ ID NO: 3253514 - protein, 7 aa, Plasmodium falciparum
YKNNKRN

SEQ ID NO: 3253515 - protein, 10 aa, Plasmodium falciparum
YKNNNHEDNN

SEQ ID NO: 3253516 - protein, 7 aa, Plasmodium falciparum
YKNNNIS

SEQ ID NO: 3253517 - protein, 6 aa, Plasmodium falciparum
YKNNQE

SEQ ID NO: 3253518 - protein, 21 aa, Plasmodium falciparum
YKNNQKNNLESQITSDEENDA

SEQ ID NO: 3253519 - protein, 10 aa, Plasmodium falciparum
YKNNTQEKNT

SEQ ID NO: 3253520 - protein, 4 aa, Plasmodium falciparum
YKNQ

SEQ ID NO: 3253521 - protein, 9 aa, Plasmodium falciparum
YKNQPTLGG

SEQ ID NO: 3253522 - protein, 39 aa, Plasmodium falciparum
YKNQVTQKDDTHNTDKNNKHNNKDASHFENNNSTSQKKK

SEQ ID NO: 3253523 - protein, 12 aa, Plasmodium falciparum
YKNRKGKETKKI

SEQ ID NO: 3253524 - protein, 20 aa, Plasmodium falciparum
YKNRKKSPAYNTNDDNKNEV

SEQ ID NO: 3253525 - protein, 7 aa, Plasmodium falciparum
YKNSISE

SEQ ID NO: 3253526 - protein, 20 aa, Plasmodium falciparum
YKNSKDPKKRITFMNYEGPL

SEQ ID NO: 3253527 - protein, 4 aa, Plasmodium falciparum
YKNT

SEQ ID NO: 3253528 - protein, 8 aa, Plasmodium falciparum
YKNTPEYK

SEQ ID NO: 3253529 - protein, 26 aa, Plasmodium falciparum
YKNVQNDNNDDDYKKNNEHMNNQSDG

SEQ ID NO: 3253530 - protein, 7 aa, Plasmodium falciparum
YKPADAK

SEQ ID NO: 3253531 - protein, 8 aa, Plasmodium falciparum
YKPKDDNV

SEQ ID NO: 3253532 - protein, 11 aa, Plasmodium falciparum
YKPKGDAEATP

SEQ ID NO: 3253533 - protein, 10 aa, Plasmodium falciparum
YKPKNVKQEE

SEQ ID NO: 3253534 - protein, 26 aa, Plasmodium falciparum
YKPKRKPSEINSDIAERKEEREADNA

SEQ ID NO: 3253535 - protein, 4 aa, Plasmodium falciparum
YKPN

SEQ ID NO: 3253536 - protein, 6 aa, Plasmodium falciparum
YKPNKK

SEQ ID NO: 3253537 - protein, 15 aa, Plasmodium falciparum
YKPNNSYNTHGKDTK

SEQ ID NO: 3253538 - protein, 5 aa, Plasmodium falciparum
YKPTE

SEQ ID NO: 3253539 - protein, 7 aa, Plasmodium falciparum
YKPYSSH

SEQ ID NO: 3253540 - protein, 4 aa, Plasmodium falciparum
YKQA

SEQ ID NO: 3253541 - protein, 13 aa, Plasmodium falciparum
YKQDRKNNKYTTV

SEQ ID NO: 3253542 - protein, 9 aa, Plasmodium falciparum
YKQETNLSP

SEQ ID NO: 3253543 - protein, 13 aa, Plasmodium falciparum
YKQNNTKKESVRN

SEQ ID NO: 3253544 - protein, 36 aa, Plasmodium falciparum
YKQRSKKKHINKVDNSNVNNNNISEYKKKKDCSKRN

SEQ ID NO: 3253545 - protein, 14 aa, Plasmodium falciparum
YKQTDDEDKTPQEL

SEQ ID NO: 3253546 - protein, 15 aa, Plasmodium falciparum
YKQYEEDNTNEHNSK

SEQ ID NO: 3253547 - protein, 5 aa, Plasmodium falciparum
YKRAQ

SEQ ID NO: 3253548 - protein, 7 aa, Plasmodium falciparum
YKRDKGI

SEQ ID NO: 3253549 - protein, 11 aa, Plasmodium falciparum
YKRQNEKGDTE

SEQ ID NO: 3253550 - protein, 10 aa, Plasmodium falciparum
YKRSKKEKKY

SEQ ID NO: 3253551 - protein, 12 aa, Plasmodium falciparum
YKSCRKSKKKKI

SEQ ID NO: 3253552 - protein, 6 aa, Plasmodium falciparum
YKSEDT

SEQ ID NO: 3253553 - protein, 4 aa, Plasmodium falciparum
YKSG

SEQ ID NO: 3253554 - protein, 6 aa, Plasmodium falciparum
YKSKED

SEQ ID NO: 3253555 - protein, 10 aa, Plasmodium falciparum
YKSKEEEGYN

SEQ ID NO: 3253556 - protein, 8 aa, Plasmodium falciparum
YKSKEKKM

SEQ ID NO: 3253557 - protein, 10 aa, Plasmodium falciparum
YKSKKGKGDI

SEQ ID NO: 3253558 - protein, 9 aa, Plasmodium falciparum
YKSKKGNEF

SEQ ID NO: 3253559 - protein, 6 aa, Plasmodium falciparum
YKSKSM

SEQ ID NO: 3253560 - protein, 8 aa, Plasmodium falciparum
YKSMSDEC

SEQ ID NO: 3253561 - protein, 26 aa, Plasmodium falciparum
YKSNDKNNKSCECANNKKSSNKLSLS

SEQ ID NO: 3253562 - protein, 9 aa, Plasmodium falciparum
YKSNTQPLS

SEQ ID NO: 3253563 - protein, 6 aa, Plasmodium falciparum
YKSPKY

SEQ ID NO: 3253564 - protein, 5 aa, Plasmodium falciparum
YKSSE

SEQ ID NO: 3253565 - protein, 6 aa, Plasmodium falciparum
YKSTDK

SEQ ID NO: 3253566 - protein, 20 aa, Plasmodium falciparum
YKSTKKKKFINEEKRKRKVK

SEQ ID NO: 3253567 - protein, 5 aa, Plasmodium falciparum
YKSTY

SEQ ID NO: 3253568 - protein, 8 aa, Plasmodium falciparum
YKSYSSYT

SEQ ID NO: 3253569 - protein, 4 aa, Plasmodium falciparum
YKTE

SEQ ID NO: 3253570 - protein, 9 aa, Plasmodium falciparum
YKTGDEPLK

SEQ ID NO: 3253571 - protein, 16 aa, Plasmodium falciparum
YKTHDNINSKSRNISE

SEQ ID NO: 3253572 - protein, 33 aa, Plasmodium falciparum
YKTKEEEHIQRGDHNNNNNYNNSYDNNNYSDDI

SEQ ID NO: 3253573 - protein, 9 aa, Plasmodium falciparum
YKTKEEIEK

SEQ ID NO: 3253574 - protein, 4 aa, Plasmodium falciparum
YKTN

SEQ ID NO: 3253575 - protein, 97 aa, Plasmodium falciparum
YKTNKNGSIIQESDNDNYNTTRNEEIHEDEDEEDDDEKEDVEKEDVEKEDVEKEDVEKEDVEKEDVEKEDVEKEDVEKEDVEKEDVEKEDNEEQKEH

SEQ ID NO: 3253576 - protein, 13 aa, Plasmodium falciparum
YKTQKTSEGFKDE

SEQ ID NO: 3253577 - protein, 23 aa, Plasmodium falciparum
YKTRNEYDKTNNESYKNQNFNDS

SEQ ID NO: 3253578 - protein, 5 aa, Plasmodium falciparum
YKTSE

SEQ ID NO: 3253579 - protein, 8 aa, Plasmodium falciparum
YKTSNTSN

SEQ ID NO: 3253580 - protein, 9 aa, Plasmodium falciparum
YKTSVSSSI

SEQ ID NO: 3253581 - protein, 14 aa, Plasmodium falciparum
YKTTDTDKKNNQLK

SEQ ID NO: 3253582 - protein, 6 aa, Plasmodium falciparum
YKTTNN

SEQ ID NO: 3253583 - protein, 5 aa, Plasmodium falciparum
YKVTD

SEQ ID NO: 3253584 - protein, 18 aa, Plasmodium falciparum
YKYDEEDIDTEKASPLNP

SEQ ID NO: 3253585 - protein, 12 aa, Plasmodium falciparum
YKYEKGYTSKNT

SEQ ID NO: 3253586 - protein, 12 aa, Plasmodium falciparum
YKYKERENVDGT

SEQ ID NO: 3253587 - protein, 13 aa, Plasmodium falciparum
YKYKKGKYKTYDY

SEQ ID NO: 3253588 - protein, 7 aa, Plasmodium falciparum
YKYTPSH

SEQ ID NO: 3253589 - protein, 6 aa, Plasmodium falciparum
YLEETQ

SEQ ID NO: 3253590 - protein, 5 aa, Plasmodium falciparum
YLEKE

SEQ ID NO: 3253591 - protein, 9 aa, Plasmodium falciparum
YLENEKRTL

SEQ ID NO: 3253592 - protein, 17 aa, Plasmodium falciparum
YLNDEKNTNNLAKESNE

SEQ ID NO: 3253593 - protein, 20 aa, Plasmodium falciparum
YLNNSKGMSYKREEEKVPSN

SEQ ID NO: 3253594 - protein, 8 aa, Plasmodium falciparum
YLTSSNEL

SEQ ID NO: 3253595 - protein, 5 aa, Plasmodium falciparum
YMGEK

SEQ ID NO: 3253596 - protein, 5 aa, Plasmodium falciparum
YMNER

SEQ ID NO: 3253597 - protein, 9 aa, Plasmodium falciparum
YMNKKKKYK

SEQ ID NO: 3253598 - protein, 25 aa, Plasmodium falciparum
YMNKSKKECREKNDYYEGDNIKSNK

SEQ ID NO: 3253599 - protein, 5 aa, Plasmodium falciparum
YMPNN

SEQ ID NO: 3253600 - protein, 4 aa, Plasmodium falciparum
YMPP

SEQ ID NO: 3253601 - protein, 4 aa, Plasmodium falciparum
YNAN

SEQ ID NO: 3253602 - protein, 8 aa, Plasmodium falciparum
YNASTSPV

SEQ ID NO: 3253603 - protein, 8 aa, Plasmodium falciparum
YNDASNDL

SEQ ID NO: 3253604 - protein, 4 aa, Plasmodium falciparum
YNDD

SEQ ID NO: 3253605 - protein, 78 aa, Plasmodium falciparum
YNDDDKKKKISGSNNDNNDNNNDDKNNKNDDDNHNDNHKNDDDNHNDNHNNDDDNNNDNHNDDDNNSSHYNKEKEANF

SEQ ID NO: 3253606 - protein, 8 aa, Plasmodium falciparum
YNDDGDED

SEQ ID NO: 3253607 - protein, 20 aa, Plasmodium falciparum
YNDDKNGNEYNISQRKKNES

SEQ ID NO: 3253608 - protein, 5 aa, Plasmodium falciparum
YNDDN

SEQ ID NO: 3253609 - protein, 10 aa, Plasmodium falciparum
YNDDNKNDLH

SEQ ID NO: 3253610 - protein, 8 aa, Plasmodium falciparum
YNDDNNND

SEQ ID NO: 3253611 - protein, 17 aa, Plasmodium falciparum
YNDDNNNDNNDNNDYDD

SEQ ID NO: 3253612 - protein, 7 aa, Plasmodium falciparum
YNDDSTS

SEQ ID NO: 3253613 - protein, 4 aa, Plasmodium falciparum
YNDE

SEQ ID NO: 3253614 - protein, 10 aa, Plasmodium falciparum
YNDEDSQDTY

SEQ ID NO: 3253615 - protein, 9 aa, Plasmodium falciparum
YNDENTNGH

SEQ ID NO: 3253616 - protein, 12 aa, Plasmodium falciparum
YNDEYNDDYYDA

SEQ ID NO: 3253617 - protein, 19 aa, Plasmodium falciparum
YNDGNKSCSCSTKNHTNKF

SEQ ID NO: 3253618 - protein, 8 aa, Plasmodium falciparum
YNDKKNNY

SEQ ID NO: 3253619 - protein, 5 aa, Plasmodium falciparum
YNDKN

SEQ ID NO: 3253620 - protein, 10 aa, Plasmodium falciparum
YNDKYNDKCN

SEQ ID NO: 3253621 - protein, 5 aa, Plasmodium falciparum
YNDND

SEQ ID NO: 3253622 - protein, 8 aa, Plasmodium falciparum
YNDNKIDD

SEQ ID NO: 3253623 - protein, 5 aa, Plasmodium falciparum
YNDPD

SEQ ID NO: 3253624 - protein, 5 aa, Plasmodium falciparum
YNDSF

SEQ ID NO: 3253625 - protein, 7 aa, Plasmodium falciparum
YNDSPSQ

SEQ ID NO: 3253626 - protein, 11 aa, Plasmodium falciparum
YNDSYDPPEDS

SEQ ID NO: 3253627 - protein, 8 aa, Plasmodium falciparum
YNDTYTTS

SEQ ID NO: 3253628 - protein, 9 aa, Plasmodium falciparum
YNDYENEND

SEQ ID NO: 3253629 - protein, 5 aa, Plasmodium falciparum
YNEDE

SEQ ID NO: 3253630 - protein, 10 aa, Plasmodium falciparum
YNEDNNSTLN

SEQ ID NO: 3253631 - protein, 4 aa, Plasmodium falciparum
YNEE

SEQ ID NO: 3253632 - protein, 9 aa, Plasmodium falciparum
YNEEHPNMS

SEQ ID NO: 3253633 - protein, 9 aa, Plasmodium falciparum
YNEENSKRM

SEQ ID NO: 3253634 - protein, 7 aa, Plasmodium falciparum
YNEERKN

SEQ ID NO: 3253635 - protein, 17 aa, Plasmodium falciparum
YNEGKNNINENTNENVN

SEQ ID NO: 3253636 - protein, 5 aa, Plasmodium falciparum
YNEKE

SEQ ID NO: 3253637 - protein, 10 aa, Plasmodium falciparum
YNEKEKKRQK

SEQ ID NO: 3253638 - protein, 8 aa, Plasmodium falciparum
YNEKENDE

SEQ ID NO: 3253639 - protein, 7 aa, Plasmodium falciparum
YNEKKKK

SEQ ID NO: 3253640 - protein, 12 aa, Plasmodium falciparum
YNEKKSSVIQNK

SEQ ID NO: 3253641 - protein, 20 aa, Plasmodium falciparum
YNEKQNDGKNGLRKDQATTC

SEQ ID NO: 3253642 - protein, 18 aa, Plasmodium falciparum
YNEKSGLGRNKNTTNNSC

SEQ ID NO: 3253643 - protein, 12 aa, Plasmodium falciparum
YNEKSSINSNSN

SEQ ID NO: 3253644 - protein, 4 aa, Plasmodium falciparum
YNEN

SEQ ID NO: 3253645 - protein, 14 aa, Plasmodium falciparum
YNENDNNKYNDGNT

SEQ ID NO: 3253646 - protein, 14 aa, Plasmodium falciparum
YNENHKDSDEQKVG

SEQ ID NO: 3253647 - protein, 8 aa, Plasmodium falciparum
YNENKIDN

SEQ ID NO: 3253648 - protein, 9 aa, Plasmodium falciparum
YNEQERKKE

SEQ ID NO: 3253649 - protein, 5 aa, Plasmodium falciparum
YNEQF

SEQ ID NO: 3253650 - protein, 23 aa, Plasmodium falciparum
YNEQKEKAKNNKDPESKSGNISD

SEQ ID NO: 3253651 - protein, 15 aa, Plasmodium falciparum
YNEQKENINVDTSTQ

SEQ ID NO: 3253652 - protein, 5 aa, Plasmodium falciparum
YNEQN

SEQ ID NO: 3253653 - protein, 9 aa, Plasmodium falciparum
YNEQSNEYH

SEQ ID NO: 3253654 - protein, 25 aa, Plasmodium falciparum
YNERENTQEDSSYKNYNYERDKNND

SEQ ID NO: 3253655 - protein, 12 aa, Plasmodium falciparum
YNERHSGNNSYI

SEQ ID NO: 3253656 - protein, 6 aa, Plasmodium falciparum
YNERTT

SEQ ID NO: 3253657 - protein, 4 aa, Plasmodium falciparum
YNES

SEQ ID NO: 3253658 - protein, 14 aa, Plasmodium falciparum
YNESAKLDNSYNMP

SEQ ID NO: 3253659 - protein, 6 aa, Plasmodium falciparum
YNESND

SEQ ID NO: 3253660 - protein, 22 aa, Plasmodium falciparum
YNESNKSIKSNKRNKSNKCKEM

SEQ ID NO: 3253661 - protein, 5 aa, Plasmodium falciparum
YNESQ

SEQ ID NO: 3253662 - protein, 24 aa, Plasmodium falciparum
YNETTSDDELNKDSCDYSEEKENI

SEQ ID NO: 3253663 - protein, 13 aa, Plasmodium falciparum
YNEYGGDKNLNGK

SEQ ID NO: 3253664 - protein, 7 aa, Plasmodium falciparum
YNEYKKD

SEQ ID NO: 3253665 - protein, 20 aa, Plasmodium falciparum
YNFSGSKITEENNRYTSGSF

SEQ ID NO: 3253666 - protein, 11 aa, Plasmodium falciparum
YNGEKYERDKN

SEQ ID NO: 3253667 - protein, 6 aa, Plasmodium falciparum
YNGFTE

SEQ ID NO: 3253668 - protein, 15 aa, Plasmodium falciparum
YNGGNDNSGNYNNEK

SEQ ID NO: 3253669 - protein, 11 aa, Plasmodium falciparum
YNGKNGKNIYN

SEQ ID NO: 3253670 - protein, 20 aa, Plasmodium falciparum
YNGKNNNKNNINQYENENDN

SEQ ID NO: 3253671 - protein, 21 aa, Plasmodium falciparum
YNGNSNYQTSYKKEENPQMPK

SEQ ID NO: 3253672 - protein, 12 aa, Plasmodium falciparum
YNGNYSKIENDQ

SEQ ID NO: 3253673 - protein, 13 aa, Plasmodium falciparum
YNGPDNKITKSRR

SEQ ID NO: 3253674 - protein, 6 aa, Plasmodium falciparum
YNGRDI

SEQ ID NO: 3253675 - protein, 9 aa, Plasmodium falciparum
YNGSSDNIY

SEQ ID NO: 3253676 - protein, 6 aa, Plasmodium falciparum
YNGTNK

SEQ ID NO: 3253677 - protein, 5 aa, Plasmodium falciparum
YNGTY

SEQ ID NO: 3253678 - protein, 24 aa, Plasmodium falciparum
YNHEENDGSHKEENKKYSNENENV

SEQ ID NO: 3253679 - protein, 9 aa, Plasmodium falciparum
YNHENNNNQ

SEQ ID NO: 3253680 - protein, 6 aa, Plasmodium falciparum
YNHKET

SEQ ID NO: 3253681 - protein, 6 aa, Plasmodium falciparum
YNHNEP

SEQ ID NO: 3253682 - protein, 16 aa, Plasmodium falciparum
YNHNSTNNGNSDKAED

SEQ ID NO: 3253683 - protein, 20 aa, Plasmodium falciparum
YNHPTDAKSSNMDKKKNNMD

SEQ ID NO: 3253684 - protein, 13 aa, Plasmodium falciparum
YNHSDQSKKNGHQ

SEQ ID NO: 3253685 - protein, 5 aa, Plasmodium falciparum
YNHST

SEQ ID NO: 3253686 - protein, 10 aa, Plasmodium falciparum
YNIKEKRRGE

SEQ ID NO: 3253687 - protein, 12 aa, Plasmodium falciparum
YNINNKKKNSKH

SEQ ID NO: 3253688 - protein, 5 aa, Plasmodium falciparum
YNIPD

SEQ ID NO: 3253689 - protein, 5 aa, Plasmodium falciparum
YNISE

SEQ ID NO: 3253690 - protein, 7 aa, Plasmodium falciparum
YNKADES

SEQ ID NO: 3253691 - protein, 11 aa, Plasmodium falciparum
YNKDDNNISYN

SEQ ID NO: 3253692 - protein, 6 aa, Plasmodium falciparum
YNKDDY

SEQ ID NO: 3253693 - protein, 10 aa, Plasmodium falciparum
YNKDHKDMDK

SEQ ID NO: 3253694 - protein, 22 aa, Plasmodium falciparum
YNKDNRNDNIYKSKTKNIKTEY

SEQ ID NO: 3253695 - protein, 10 aa, Plasmodium falciparum
YNKDTEETSN

SEQ ID NO: 3253696 - protein, 18 aa, Plasmodium falciparum
YNKEHPKKISNGGNNKKY

SEQ ID NO: 3253697 - protein, 12 aa, Plasmodium falciparum
YNKEKKNENSLR

SEQ ID NO: 3253698 - protein, 13 aa, Plasmodium falciparum
YNKENEITKNDTK

SEQ ID NO: 3253699 - protein, 8 aa, Plasmodium falciparum
YNKENKTT

SEQ ID NO: 3253700 - protein, 10 aa, Plasmodium falciparum
YNKENNKDMY

SEQ ID NO: 3253701 - protein, 5 aa, Plasmodium falciparum
YNKES

SEQ ID NO: 3253702 - protein, 6 aa, Plasmodium falciparum
YNKKGE

SEQ ID NO: 3253703 - protein, 5 aa, Plasmodium falciparum
YNKKK

SEQ ID NO: 3253704 - protein, 10 aa, Plasmodium falciparum
YNKKNNKQKF

SEQ ID NO: 3253705 - protein, 7 aa, Plasmodium falciparum
YNKKNVN

SEQ ID NO: 3253706 - protein, 13 aa, Plasmodium falciparum
YNKKRSKKEIENK

SEQ ID NO: 3253707 - protein, 10 aa, Plasmodium falciparum
YNKNKKPNDN

SEQ ID NO: 3253708 - protein, 8 aa, Plasmodium falciparum
YNKNNEDI

SEQ ID NO: 3253709 - protein, 10 aa, Plasmodium falciparum
YNKNNTSGNV

SEQ ID NO: 3253710 - protein, 14 aa, Plasmodium falciparum
YNKNNVDSKTDDKK

SEQ ID NO: 3253711 - protein, 7 aa, Plasmodium falciparum
YNKNQAQ

SEQ ID NO: 3253712 - protein, 9 aa, Plasmodium falciparum
YNKPNKKYK

SEQ ID NO: 3253713 - protein, 11 aa, Plasmodium falciparum
YNKQKERYAKV

SEQ ID NO: 3253714 - protein, 6 aa, Plasmodium falciparum
YNKREY

SEQ ID NO: 3253715 - protein, 11 aa, Plasmodium falciparum
YNKRGNEKTFY

SEQ ID NO: 3253716 - protein, 7 aa, Plasmodium falciparum
YNKRSKV

SEQ ID NO: 3253717 - protein, 8 aa, Plasmodium falciparum
YNKRTKYK

SEQ ID NO: 3253718 - protein, 10 aa, Plasmodium falciparum
YNKSEESSIC

SEQ ID NO: 3253719 - protein, 7 aa, Plasmodium falciparum
YNKSGGN

SEQ ID NO: 3253720 - protein, 17 aa, Plasmodium falciparum
YNKSNKNLNNTLNQNKG

SEQ ID NO: 3253721 - protein, 27 aa, Plasmodium falciparum
YNKSSNEHMEKKGNVSRQKSLKNTNHE

SEQ ID NO: 3253722 - protein, 11 aa, Plasmodium falciparum
YNKSSQNNNNI

SEQ ID NO: 3253723 - protein, 16 aa, Plasmodium falciparum
YNKTKKKKKKKNDTID

SEQ ID NO: 3253724 - protein, 5 aa, Plasmodium falciparum
YNKTN

SEQ ID NO: 3253725 - protein, 26 aa, Plasmodium falciparum
YNKYEDDDIYEDDDKYEDDDKYKDYD

SEQ ID NO: 3253726 - protein, 7 aa, Plasmodium falciparum
YNKYTEK

SEQ ID NO: 3253727 - protein, 4 aa, Plasmodium falciparum
YNLE

SEQ ID NO: 3253728 - protein, 11 aa, Plasmodium falciparum
YNLPTDERDDT

SEQ ID NO: 3253729 - protein, 9 aa, Plasmodium falciparum
YNLSNNNIN

SEQ ID NO: 3253730 - protein, 10 aa, Plasmodium falciparum
YNNAKYNKNR

SEQ ID NO: 3253731 - protein, 13 aa, Plasmodium falciparum
YNNDDDDDNNSNI

SEQ ID NO: 3253732 - protein, 15 aa, Plasmodium falciparum
YNNDDYDDDKEKTIY

SEQ ID NO: 3253733 - protein, 14 aa, Plasmodium falciparum
YNNDEPSDHYNKEE

SEQ ID NO: 3253734 - protein, 8 aa, Plasmodium falciparum
YNNDKNRD

SEQ ID NO: 3253735 - protein, 7 aa, Plasmodium falciparum
YNNDPEL

SEQ ID NO: 3253736 - protein, 8 aa, Plasmodium falciparum
YNNEKKNI

SEQ ID NO: 3253737 - protein, 7 aa, Plasmodium falciparum
YNNEKRK

SEQ ID NO: 3253738 - protein, 16 aa, Plasmodium falciparum
YNNENVGDTNNLEEEI

SEQ ID NO: 3253739 - protein, 14 aa, Plasmodium falciparum
YNNETSLKSPNGFQ

SEQ ID NO: 3253740 - protein, 4 aa, Plasmodium falciparum
YNNG

SEQ ID NO: 3253741 - protein, 7 aa, Plasmodium falciparum
YNNGKEQ

SEQ ID NO: 3253742 - protein, 7 aa, Plasmodium falciparum
YNNHSVD

SEQ ID NO: 3253743 - protein, 4 aa, Plasmodium falciparum
YNNI

SEQ ID NO: 3253744 - protein, 4 aa, Plasmodium falciparum
YNNK

SEQ ID NO: 3253745 - protein, 9 aa, Plasmodium falciparum
YNNKDNVVK

SEQ ID NO: 3253746 - protein, 11 aa, Plasmodium falciparum
YNNKDTPNYHT

SEQ ID NO: 3253747 - protein, 7 aa, Plasmodium falciparum
YNNKEEN

SEQ ID NO: 3253748 - protein, 8 aa, Plasmodium falciparum
YNNKENEY

SEQ ID NO: 3253749 - protein, 6 aa, Plasmodium falciparum
YNNKGV

SEQ ID NO: 3253750 - protein, 15 aa, Plasmodium falciparum
YNNKHNDKNINTRSS

SEQ ID NO: 3253751 - protein, 25 aa, Plasmodium falciparum
YNNKIKKKKKNHHHNDNNNNNNNNN

SEQ ID NO: 3253752 - protein, 11 aa, Plasmodium falciparum
YNNKKEDNVNS

SEQ ID NO: 3253753 - protein, 12 aa, Plasmodium falciparum
YNNKKKNNNVNG

SEQ ID NO: 3253754 - protein, 6 aa, Plasmodium falciparum
YNNKNS

SEQ ID NO: 3253755 - protein, 16 aa, Plasmodium falciparum
YNNKSGNVLSQSSSYD

SEQ ID NO: 3253756 - protein, 12 aa, Plasmodium falciparum
YNNKTKDNNCNK

SEQ ID NO: 3253757 - protein, 22 aa, Plasmodium falciparum
YNNKTKNNKNNKFEQQNYDESY

SEQ ID NO: 3253758 - protein, 10 aa, Plasmodium falciparum
YNNKTYDEQY

SEQ ID NO: 3253759 - protein, 14 aa, Plasmodium falciparum
YNNNDNNSSNTCRR

SEQ ID NO: 3253760 - protein, 9 aa, Plasmodium falciparum
YNNNEKKKK

SEQ ID NO: 3253761 - protein, 20 aa, Plasmodium falciparum
YNNNKDMNSINDNNNKDMNN

SEQ ID NO: 3253762 - protein, 10 aa, Plasmodium falciparum
YNNNKERNPK

SEQ ID NO: 3253763 - protein, 56 aa, Plasmodium falciparum
YNNNKESQNFSDEKENNHSEENNHCDENNHCDENNHCDENNHCDKNNNCEENNHCD

SEQ ID NO: 3253764 - protein, 10 aa, Plasmodium falciparum
YNNNKKNEEN

SEQ ID NO: 3253765 - protein, 8 aa, Plasmodium falciparum
YNNNKSIE

SEQ ID NO: 3253766 - protein, 11 aa, Plasmodium falciparum
YNNNKSKTDNN

SEQ ID NO: 3253767 - protein, 5 aa, Plasmodium falciparum
YNNNN

SEQ ID NO: 3253768 - protein, 8 aa, Plasmodium falciparum
YNNNNAPV

SEQ ID NO: 3253769 - protein, 6 aa, Plasmodium falciparum
YNNNND

SEQ ID NO: 3253770 - protein, 7 aa, Plasmodium falciparum
YNNNNKL

SEQ ID NO: 3253771 - protein, 10 aa, Plasmodium falciparum
YNNNNNDKNN

SEQ ID NO: 3253772 - protein, 13 aa, Plasmodium falciparum
YNNNNNKWDNINS

SEQ ID NO: 3253773 - protein, 8 aa, Plasmodium falciparum
YNNNNNMN

SEQ ID NO: 3253774 - protein, 7 aa, Plasmodium falciparum
YNNNNNN

SEQ ID NO: 3253775 - protein, 13 aa, Plasmodium falciparum
YNNNNNNDGVTNH

SEQ ID NO: 3253776 - protein, 19 aa, Plasmodium falciparum
YNNNNNNKIKKKKKKTYKG

SEQ ID NO: 3253777 - protein, 8 aa, Plasmodium falciparum
YNNNNNNN

SEQ ID NO: 3253778 - protein, 11 aa, Plasmodium falciparum
YNNNNNNNIPI

SEQ ID NO: 3253779 - protein, 12 aa, Plasmodium falciparum
YNNNNNNNLSSY

SEQ ID NO: 3253780 - protein, 13 aa, Plasmodium falciparum
YNNNNNNNNEHYK

SEQ ID NO: 3253781 - protein, 20 aa, Plasmodium falciparum
YNNNNNNNNIMSDEEDEDNI

SEQ ID NO: 3253782 - protein, 10 aa, Plasmodium falciparum
YNNNNNNNNN

SEQ ID NO: 3253783 - protein, 14 aa, Plasmodium falciparum
YNNNNNNNNNIDND

SEQ ID NO: 3253784 - protein, 15 aa, Plasmodium falciparum
YNNNNNNNNNKRNDY

SEQ ID NO: 3253785 - protein, 29 aa, Plasmodium falciparum
YNNNNNNNNNNNAHNNNAHNNNNAHNNNI

SEQ ID NO: 3253786 - protein, 13 aa, Plasmodium falciparum
YNNNNNNNNNNNI

SEQ ID NO: 3253787 - protein, 24 aa, Plasmodium falciparum
YNNNNNNNNNNNNNFNNKSDVKKK

SEQ ID NO: 3253788 - protein, 11 aa, Plasmodium falciparum
YNNNNNNNNNY

SEQ ID NO: 3253789 - protein, 26 aa, Plasmodium falciparum
YNNNNNNNQVQPNKYNHANQTTTKEQ

SEQ ID NO: 3253790 - protein, 11 aa, Plasmodium falciparum
YNNNNNTSSSF

SEQ ID NO: 3253791 - protein, 16 aa, Plasmodium falciparum
YNNNNQKIKDSNNNMN

SEQ ID NO: 3253792 - protein, 14 aa, Plasmodium falciparum
YNNNQNNKNENIND

SEQ ID NO: 3253793 - protein, 7 aa, Plasmodium falciparum
YNNNSIN

SEQ ID NO: 3253794 - protein, 9 aa, Plasmodium falciparum
YNNNSNDLN

SEQ ID NO: 3253795 - protein, 25 aa, Plasmodium falciparum
YNNNSSNKVSMDEEKRKNLDNNTYP

SEQ ID NO: 3253796 - protein, 5 aa, Plasmodium falciparum
YNNNT

SEQ ID NO: 3253797 - protein, 10 aa, Plasmodium falciparum
YNNPNLNNQN

SEQ ID NO: 3253798 - protein, 5 aa, Plasmodium falciparum
YNNQI

SEQ ID NO: 3253799 - protein, 28 aa, Plasmodium falciparum
YNNQNNNKNKNKNKNKNKNKNKKNIYND

SEQ ID NO: 3253800 - protein, 10 aa, Plasmodium falciparum
YNNQPTNTNT

SEQ ID NO: 3253801 - protein, 11 aa, Plasmodium falciparum
YNNRKQRNEEN

SEQ ID NO: 3253802 - protein, 4 aa, Plasmodium falciparum
YNNS

SEQ ID NO: 3253803 - protein, 11 aa, Plasmodium falciparum
YNNSDDAYNNT

SEQ ID NO: 3253804 - protein, 20 aa, Plasmodium falciparum
YNNSDQEDDIRTNHKSNNNS

SEQ ID NO: 3253805 - protein, 5 aa, Plasmodium falciparum
YNNSE

SEQ ID NO: 3253806 - protein, 8 aa, Plasmodium falciparum
YNNSGEGG

SEQ ID NO: 3253807 - protein, 9 aa, Plasmodium falciparum
YNNSGGANR

SEQ ID NO: 3253808 - protein, 9 aa, Plasmodium falciparum
YNNSGNPNM

SEQ ID NO: 3253809 - protein, 13 aa, Plasmodium falciparum
YNNSINDNSLRHN

SEQ ID NO: 3253810 - protein, 5 aa, Plasmodium falciparum
YNNSS

SEQ ID NO: 3253811 - protein, 7 aa, Plasmodium falciparum
YNNTDRY

SEQ ID NO: 3253812 - protein, 5 aa, Plasmodium falciparum
YNNTN

SEQ ID NO: 3253813 - protein, 15 aa, Plasmodium falciparum
YNNTNNNNNNNNNNN

SEQ ID NO: 3253814 - protein, 33 aa, Plasmodium falciparum
YNNTNYNNTNYNNTNYNNNNYNKIKDSNNNSNN

SEQ ID NO: 3253815 - protein, 4 aa, Plasmodium falciparum
YNNV

SEQ ID NO: 3253816 - protein, 24 aa, Plasmodium falciparum
YNNVDGNNEFNSYEEKDDDENSTY

SEQ ID NO: 3253817 - protein, 4 aa, Plasmodium falciparum
YNPN

SEQ ID NO: 3253818 - protein, 9 aa, Plasmodium falciparum
YNPQNKNNL

SEQ ID NO: 3253819 - protein, 16 aa, Plasmodium falciparum
YNPRAPKDVDDYNDWP

SEQ ID NO: 3253820 - protein, 11 aa, Plasmodium falciparum
YNPTEQSSTCE

SEQ ID NO: 3253821 - protein, 5 aa, Plasmodium falciparum
YNPYS

SEQ ID NO: 3253822 - protein, 9 aa, Plasmodium falciparum
YNQAGKAIE

SEQ ID NO: 3253823 - protein, 12 aa, Plasmodium falciparum
YNQEKQTKKNIT

SEQ ID NO: 3253824 - protein, 8 aa, Plasmodium falciparum
YNQGKELN

SEQ ID NO: 3253825 - protein, 5 aa, Plasmodium falciparum
YNQGN

SEQ ID NO: 3253826 - protein, 10 aa, Plasmodium falciparum
YNQKEDKTKE

SEQ ID NO: 3253827 - protein, 11 aa, Plasmodium falciparum
YNQKEKDEEQQ

SEQ ID NO: 3253828 - protein, 4 aa, Plasmodium falciparum
YNQN

SEQ ID NO: 3253829 - protein, 4 aa, Plasmodium falciparum
YNQQ

SEQ ID NO: 3253830 - protein, 9 aa, Plasmodium falciparum
YNQQEKEID

SEQ ID NO: 3253831 - protein, 9 aa, Plasmodium falciparum
YNQQTSQRF

SEQ ID NO: 3253832 - protein, 8 aa, Plasmodium falciparum
YNQRENID

SEQ ID NO: 3253833 - protein, 20 aa, Plasmodium falciparum
YNQSENDKKFTEPNNKSNNI

SEQ ID NO: 3253834 - protein, 26 aa, Plasmodium falciparum
YNQTDNNNDNDNDNNNDNNNDNNNNL

SEQ ID NO: 3253835 - protein, 12 aa, Plasmodium falciparum
YNRDEGDHNKDD

SEQ ID NO: 3253836 - protein, 11 aa, Plasmodium falciparum
YNRDTTSIQGG

SEQ ID NO: 3253837 - protein, 94 aa, Plasmodium falciparum
YNRNGDEYDGDEYDGDEYDGDECDGDEYDGDEYDGDEYDGDEYDGDEHNGDEYNGDEYNGDEYNGDEYNGDEYNGDEYNGDEYNGDEYNGDEES

SEQ ID NO: 3253838 - protein, 5 aa, Plasmodium falciparum
YNRNK

SEQ ID NO: 3253839 - protein, 6 aa, Plasmodium falciparum
YNRNKN

SEQ ID NO: 3253840 - protein, 9 aa, Plasmodium falciparum
YNRQTSQRF

SEQ ID NO: 3253841 - protein, 5 aa, Plasmodium falciparum
YNRSS

SEQ ID NO: 3253842 - protein, 7 aa, Plasmodium falciparum
YNRYPGS

SEQ ID NO: 3253843 - protein, 21 aa, Plasmodium falciparum
YNSASEKRRSRYNNNYDASGE

SEQ ID NO: 3253844 - protein, 14 aa, Plasmodium falciparum
YNSDDESSSSHTSL

SEQ ID NO: 3253845 - protein, 9 aa, Plasmodium falciparum
YNSDEYSDD

SEQ ID NO: 3253846 - protein, 7 aa, Plasmodium falciparum
YNSDKDA

SEQ ID NO: 3253847 - protein, 9 aa, Plasmodium falciparum
YNSDSSDVS

SEQ ID NO: 3253848 - protein, 20 aa, Plasmodium falciparum
YNSETNIPCSSKSNKSTNKK

SEQ ID NO: 3253849 - protein, 5 aa, Plasmodium falciparum
YNSFS

SEQ ID NO: 3253850 - protein, 17 aa, Plasmodium falciparum
YNSGEKKEKEKNVQAAS

SEQ ID NO: 3253851 - protein, 4 aa, Plasmodium falciparum
YNSH

SEQ ID NO: 3253852 - protein, 17 aa, Plasmodium falciparum
YNSKEIEKNDGGSVDYN

SEQ ID NO: 3253853 - protein, 5 aa, Plasmodium falciparum
YNSKK

SEQ ID NO: 3253854 - protein, 4 aa, Plasmodium falciparum
YNSN

SEQ ID NO: 3253855 - protein, 11 aa, Plasmodium falciparum
YNSNEKNVHQN

SEQ ID NO: 3253856 - protein, 11 aa, Plasmodium falciparum
YNSNKEKKKNM

SEQ ID NO: 3253857 - protein, 9 aa, Plasmodium falciparum
YNSNKNTTH

SEQ ID NO: 3253858 - protein, 8 aa, Plasmodium falciparum
YNSNNGNI

SEQ ID NO: 3253859 - protein, 15 aa, Plasmodium falciparum
YNSNSNKSEYSHNKS

SEQ ID NO: 3253860 - protein, 16 aa, Plasmodium falciparum
YNSQNESYADSPSCSQ

SEQ ID NO: 3253861 - protein, 21 aa, Plasmodium falciparum
YNSRQNKKDEHNSCSEENVSD

SEQ ID NO: 3253862 - protein, 11 aa, Plasmodium falciparum
YNSSEDYKKDI

SEQ ID NO: 3253863 - protein, 12 aa, Plasmodium falciparum
YNSSLKNNSISP

SEQ ID NO: 3253864 - protein, 11 aa, Plasmodium falciparum
YNSSNVPNESV

SEQ ID NO: 3253865 - protein, 10 aa, Plasmodium falciparum
YNSSSGDSDN

SEQ ID NO: 3253866 - protein, 23 aa, Plasmodium falciparum
YNSSSSSIESISSNKKNSKYNYN

SEQ ID NO: 3253867 - protein, 18 aa, Plasmodium falciparum
YNSTKSSRGENNDDKTPS

SEQ ID NO: 3253868 - protein, 34 aa, Plasmodium falciparum
YNSTNKNSNNSSSKGKASNIQQNNLNNNNNINNN

SEQ ID NO: 3253869 - protein, 21 aa, Plasmodium falciparum
YNSTYDTSGISPTKNEHNSYN

SEQ ID NO: 3253870 - protein, 4 aa, Plasmodium falciparum
YNSY

SEQ ID NO: 3253871 - protein, 5 aa, Plasmodium falciparum
YNTEL

SEQ ID NO: 3253872 - protein, 6 aa, Plasmodium falciparum
YNTETQ

SEQ ID NO: 3253873 - protein, 12 aa, Plasmodium falciparum
YNTHNDQDTYNT

SEQ ID NO: 3253874 - protein, 5 aa, Plasmodium falciparum
YNTKD

SEQ ID NO: 3253875 - protein, 9 aa, Plasmodium falciparum
YNTKSNKMN

SEQ ID NO: 3253876 - protein, 12 aa, Plasmodium falciparum
YNTNDEPNTEEK

SEQ ID NO: 3253877 - protein, 8 aa, Plasmodium falciparum
YNTNDKKV

SEQ ID NO: 3253878 - protein, 14 aa, Plasmodium falciparum
YNTNEKDKEKINHN

SEQ ID NO: 3253879 - protein, 47 aa, Plasmodium falciparum
YNTNEQNNLSDMTKNDPKEYDYNPQNEINNNNNNNNCDNNNNNCNNN

SEQ ID NO: 3253880 - protein, 6 aa, Plasmodium falciparum
YNTNHT

SEQ ID NO: 3253881 - protein, 14 aa, Plasmodium falciparum
YNTNNPCNNTNDHS

SEQ ID NO: 3253882 - protein, 8 aa, Plasmodium falciparum
YNTNNYNV

SEQ ID NO: 3253883 - protein, 5 aa, Plasmodium falciparum
YNTNT

SEQ ID NO: 3253884 - protein, 5 aa, Plasmodium falciparum
YNTPG

SEQ ID NO: 3253885 - protein, 5 aa, Plasmodium falciparum
YNTQR

SEQ ID NO: 3253886 - protein, 9 aa, Plasmodium falciparum
YNTRNEDNE

SEQ ID NO: 3253887 - protein, 5 aa, Plasmodium falciparum
YNTRS

SEQ ID NO: 3253888 - protein, 6 aa, Plasmodium falciparum
YNTSDH

SEQ ID NO: 3253889 - protein, 13 aa, Plasmodium falciparum
YNTSTTNKRTNNN

SEQ ID NO: 3253890 - protein, 7 aa, Plasmodium falciparum
YNTTNNM

SEQ ID NO: 3253891 - protein, 6 aa, Plasmodium falciparum
YNTTTT

SEQ ID NO: 3253892 - protein, 16 aa, Plasmodium falciparum
YNTYANNDFNKNEQSF

SEQ ID NO: 3253893 - protein, 7 aa, Plasmodium falciparum
YNTYKNS

SEQ ID NO: 3253894 - protein, 8 aa, Plasmodium falciparum
YNVDNSFS

SEQ ID NO: 3253895 - protein, 11 aa, Plasmodium falciparum
YNVKEKKDGFY

SEQ ID NO: 3253896 - protein, 4 aa, Plasmodium falciparum
YNVN

SEQ ID NO: 3253897 - protein, 11 aa, Plasmodium falciparum
YNYKRKNSRKK

SEQ ID NO: 3253898 - protein, 6 aa, Plasmodium falciparum
YNYNNY

SEQ ID NO: 3253899 - protein, 11 aa, Plasmodium falciparum
YNYTKNKNYDN

SEQ ID NO: 3253900 - protein, 4 aa, Plasmodium falciparum
YPAT

SEQ ID NO: 3253901 - protein, 63 aa, Plasmodium falciparum
YPDGSMAAEGSYTSYDSINPEESVTPEGNNSTSETIKEEDNMTSQNNYSSNGSYNSEEDKDNM

SEQ ID NO: 3253902 - protein, 6 aa, Plasmodium falciparum
YPDLQE

SEQ ID NO: 3253903 - protein, 7 aa, Plasmodium falciparum
YPEDAEC

SEQ ID NO: 3253904 - protein, 15 aa, Plasmodium falciparum
YPEGSMDTEGSYSSY

SEQ ID NO: 3253905 - protein, 17 aa, Plasmodium falciparum
YPENNKEEKNSKKKNFK

SEQ ID NO: 3253906 - protein, 16 aa, Plasmodium falciparum
YPEQNHNTNRQHENDL

SEQ ID NO: 3253907 - protein, 8 aa, Plasmodium falciparum
YPGPSNIK

SEQ ID NO: 3253908 - protein, 18 aa, Plasmodium falciparum
YPGRKKKKKKKVKLNEKK

SEQ ID NO: 3253909 - protein, 5 aa, Plasmodium falciparum
YPGSK

SEQ ID NO: 3253910 - protein, 11 aa, Plasmodium falciparum
YPIENNNNNNI

SEQ ID NO: 3253911 - protein, 5 aa, Plasmodium falciparum
YPIES

SEQ ID NO: 3253912 - protein, 4 aa, Plasmodium falciparum
YPIK

SEQ ID NO: 3253913 - protein, 8 aa, Plasmodium falciparum
YPINGSTI

SEQ ID NO: 3253914 - protein, 17 aa, Plasmodium falciparum
YPINSTQDYNTNYDKNG

SEQ ID NO: 3253915 - protein, 5 aa, Plasmodium falciparum
YPISD

SEQ ID NO: 3253916 - protein, 4 aa, Plasmodium falciparum
YPKD

SEQ ID NO: 3253917 - protein, 9 aa, Plasmodium falciparum
YPKDHSTTF

SEQ ID NO: 3253918 - protein, 5 aa, Plasmodium falciparum
YPKTK

SEQ ID NO: 3253919 - protein, 17 aa, Plasmodium falciparum
YPMNKSDHEKKNNNTCG

SEQ ID NO: 3253920 - protein, 15 aa, Plasmodium falciparum
YPNDDEKSDKSSTCE

SEQ ID NO: 3253921 - protein, 33 aa, Plasmodium falciparum
YPNDDNGSDKSSTCEYTDTNNTKLEKTKGKDKY

SEQ ID NO: 3253922 - protein, 5 aa, Plasmodium falciparum
YPNEE

SEQ ID NO: 3253923 - protein, 11 aa, Plasmodium falciparum
YPNEEVKEEDR

SEQ ID NO: 3253924 - protein, 13 aa, Plasmodium falciparum
YPNENNKNNINNK

SEQ ID NO: 3253925 - protein, 7 aa, Plasmodium falciparum
YPNINSR

SEQ ID NO: 3253926 - protein, 4 aa, Plasmodium falciparum
YPNN

SEQ ID NO: 3253927 - protein, 9 aa, Plasmodium falciparum
YPNNENNSY

SEQ ID NO: 3253928 - protein, 10 aa, Plasmodium falciparum
YPNNSSQKYS

SEQ ID NO: 3253929 - protein, 10 aa, Plasmodium falciparum
YPNSSGGGCP

SEQ ID NO: 3253930 - protein, 11 aa, Plasmodium falciparum
YPNSSSNNHKK

SEQ ID NO: 3253931 - protein, 14 aa, Plasmodium falciparum
YPPDKAQYPDLTDE

SEQ ID NO: 3253932 - protein, 6 aa, Plasmodium falciparum
YPPEEL

SEQ ID NO: 3253933 - protein, 6 aa, Plasmodium falciparum
YPPKEI

SEQ ID NO: 3253934 - protein, 22 aa, Plasmodium falciparum
YPPKKEAHSKLNNNNNNNNNNN

SEQ ID NO: 3253935 - protein, 4 aa, Plasmodium falciparum
YPQD

SEQ ID NO: 3253936 - protein, 8 aa, Plasmodium falciparum
YPQDRNNN

SEQ ID NO: 3253937 - protein, 26 aa, Plasmodium falciparum
YPQGNSMNEYTNEKKKKKKKKGENVM

SEQ ID NO: 3253938 - protein, 5 aa, Plasmodium falciparum
YPRNE

SEQ ID NO: 3253939 - protein, 7 aa, Plasmodium falciparum
YPRTNKE

SEQ ID NO: 3253940 - protein, 6 aa, Plasmodium falciparum
YPSDEY

SEQ ID NO: 3253941 - protein, 11 aa, Plasmodium falciparum
YPSEEDIKRSN

SEQ ID NO: 3253942 - protein, 6 aa, Plasmodium falciparum
YPSKNF

SEQ ID NO: 3253943 - protein, 12 aa, Plasmodium falciparum
YPSNAIQENSTI

SEQ ID NO: 3253944 - protein, 20 aa, Plasmodium falciparum
YPSNINSSNSNTKEKKENIN

SEQ ID NO: 3253945 - protein, 19 aa, Plasmodium falciparum
YPSNKSNHLSNEKSNFSSY

SEQ ID NO: 3253946 - protein, 44 aa, Plasmodium falciparum
YPSNLSGAGDNINVNNNDDKNDSNKNINSNNNSNSNNNSNSNCS

SEQ ID NO: 3253947 - protein, 6 aa, Plasmodium falciparum
YPSSNY

SEQ ID NO: 3253948 - protein, 24 aa, Plasmodium falciparum
YPSSQNNNNMPASLDDTPSDYKDT

SEQ ID NO: 3253949 - protein, 6 aa, Plasmodium falciparum
YPTDNK

SEQ ID NO: 3253950 - protein, 5 aa, Plasmodium falciparum
YPTPN

SEQ ID NO: 3253951 - protein, 6 aa, Plasmodium falciparum
YPTPPR

SEQ ID NO: 3253952 - protein, 8 aa, Plasmodium falciparum
YPTTEEKY

SEQ ID NO: 3253953 - protein, 11 aa, Plasmodium falciparum
YPYDNNTYDNH

SEQ ID NO: 3253954 - protein, 14 aa, Plasmodium falciparum
YPYDSGEKINNTYY

SEQ ID NO: 3253955 - protein, 5 aa, Plasmodium falciparum
YPYGP

SEQ ID NO: 3253956 - protein, 13 aa, Plasmodium falciparum
YQATSSGKEQENK

SEQ ID NO: 3253957 - protein, 13 aa, Plasmodium falciparum
YQAYKKENQNGGE

SEQ ID NO: 3253958 - protein, 9 aa, Plasmodium falciparum
YQDDAQSKY

SEQ ID NO: 3253959 - protein, 5 aa, Plasmodium falciparum
YQDDK

SEQ ID NO: 3253960 - protein, 11 aa, Plasmodium falciparum
YQDNKKSKNKN

SEQ ID NO: 3253961 - protein, 13 aa, Plasmodium falciparum
YQEDDNSDHSNKK

SEQ ID NO: 3253962 - protein, 9 aa, Plasmodium falciparum
YQEDKTNKE

SEQ ID NO: 3253963 - protein, 13 aa, Plasmodium falciparum
YQEKENEKKYVSQ

SEQ ID NO: 3253964 - protein, 25 aa, Plasmodium falciparum
YQEKKNKKEKEKKKERKKNSSNDLN

SEQ ID NO: 3253965 - protein, 8 aa, Plasmodium falciparum
YQENRNSV

SEQ ID NO: 3253966 - protein, 5 aa, Plasmodium falciparum
YQENS

SEQ ID NO: 3253967 - protein, 7 aa, Plasmodium falciparum
YQGPEEL

SEQ ID NO: 3253968 - protein, 21 aa, Plasmodium falciparum
YQGQGEVQNQRNSNKGTSSNI

SEQ ID NO: 3253969 - protein, 12 aa, Plasmodium falciparum
YQITQKDNPIGY

SEQ ID NO: 3253970 - protein, 15 aa, Plasmodium falciparum
YQKEEQEKKKRNEKI

SEQ ID NO: 3253971 - protein, 6 aa, Plasmodium falciparum
YQKIKD

SEQ ID NO: 3253972 - protein, 5 aa, Plasmodium falciparum
YQKKK

SEQ ID NO: 3253973 - protein, 6 aa, Plasmodium falciparum
YQKNDV

SEQ ID NO: 3253974 - protein, 9 aa, Plasmodium falciparum
YQKNHDPYE

SEQ ID NO: 3253975 - protein, 9 aa, Plasmodium falciparum
YQKNSSKQK

SEQ ID NO: 3253976 - protein, 10 aa, Plasmodium falciparum
YQKNVDEEEL

SEQ ID NO: 3253977 - protein, 18 aa, Plasmodium falciparum
YQKSDKSNYALKQKKEGT

SEQ ID NO: 3253978 - protein, 9 aa, Plasmodium falciparum
YQKTHDPYE

SEQ ID NO: 3253979 - protein, 14 aa, Plasmodium falciparum
YQKYQKKKEEIDQY

SEQ ID NO: 3253980 - protein, 19 aa, Plasmodium falciparum
YQNANSKDNKKSSVEVKLI

SEQ ID NO: 3253981 - protein, 33 aa, Plasmodium falciparum
YQNDDDGSDDSSTCECTDTNNSELAKTKGKDKY

SEQ ID NO: 3253982 - protein, 6 aa, Plasmodium falciparum
YQNDPE

SEQ ID NO: 3253983 - protein, 67 aa, Plasmodium falciparum
YQNGDDNIKGGDNIKGGDNIKGDDNINGDDNIKGGDNIKGDDNIKRDDNFQRDDNFQRDDNFQRGDN

SEQ ID NO: 3253984 - protein, 22 aa, Plasmodium falciparum
YQNGNNNEENLNQEDDIKNELE

SEQ ID NO: 3253985 - protein, 15 aa, Plasmodium falciparum
YQNGTNPVTNFLERH

SEQ ID NO: 3253986 - protein, 9 aa, Plasmodium falciparum
YQNKGEEKI

SEQ ID NO: 3253987 - protein, 4 aa, Plasmodium falciparum
YQNN

SEQ ID NO: 3253988 - protein, 8 aa, Plasmodium falciparum
YQNNNNNS

SEQ ID NO: 3253989 - protein, 13 aa, Plasmodium falciparum
YQNQKHKYQGEYD

SEQ ID NO: 3253990 - protein, 14 aa, Plasmodium falciparum
YQPTKGLKEYEESH

SEQ ID NO: 3253991 - protein, 10 aa, Plasmodium falciparum
YQQDADYSFT

SEQ ID NO: 3253992 - protein, 6 aa, Plasmodium falciparum
YQQEKH

SEQ ID NO: 3253993 - protein, 8 aa, Plasmodium falciparum
YQQTHDPY

SEQ ID NO: 3253994 - protein, 4 aa, Plasmodium falciparum
YQQY

SEQ ID NO: 3253995 - protein, 6 aa, Plasmodium falciparum
YQSPKY

SEQ ID NO: 3253996 - protein, 10 aa, Plasmodium falciparum
YQSSDNLDYN

SEQ ID NO: 3253997 - protein, 11 aa, Plasmodium falciparum
YQTDKKKKIDK

SEQ ID NO: 3253998 - protein, 5 aa, Plasmodium falciparum
YQTIK

SEQ ID NO: 3253999 - protein, 9 aa, Plasmodium falciparum
YQTKNQAVT

SEQ ID NO: 3254000 - protein, 7 aa, Plasmodium falciparum
YQTNDSF

SEQ ID NO: 3254001 - protein, 6 aa, Plasmodium falciparum
YQTQSN

SEQ ID NO: 3254002 - protein, 21 aa, Plasmodium falciparum
YQTYYNENSKSTQLKRSAQEY

SEQ ID NO: 3254003 - protein, 8 aa, Plasmodium falciparum
YRAPSGSL

SEQ ID NO: 3254004 - protein, 31 aa, Plasmodium falciparum
YRDDEENSKSQKKVKGEKNENIKKETLKEKR

SEQ ID NO: 3254005 - protein, 7 aa, Plasmodium falciparum
YRDKESS

SEQ ID NO: 3254006 - protein, 4 aa, Plasmodium falciparum
YRDN

SEQ ID NO: 3254007 - protein, 64 aa, Plasmodium falciparum
YRDNKYRDNKYRDNKHKDNKHDSNKYDSNPPSSQALSTDPPSSNPPGSNAYSIDPQNNNPYSNN

SEQ ID NO: 3254008 - protein, 7 aa, Plasmodium falciparum
YRDNSYA

SEQ ID NO: 3254009 - protein, 29 aa, Plasmodium falciparum
YREKRKKKKKKNDKEKDKDQNNNYNDPGD

SEQ ID NO: 3254010 - protein, 8 aa, Plasmodium falciparum
YRENPAKA

SEQ ID NO: 3254011 - protein, 14 aa, Plasmodium falciparum
YRGDKGEKKKLEEN

SEQ ID NO: 3254012 - protein, 8 aa, Plasmodium falciparum
YRGEEKDT

SEQ ID NO: 3254013 - protein, 6 aa, Plasmodium falciparum
YRGEKE

SEQ ID NO: 3254014 - protein, 13 aa, Plasmodium falciparum
YRGGGRGRKQLEE

SEQ ID NO: 3254015 - protein, 17 aa, Plasmodium falciparum
YRGGNTKEKKKRKKLEE

SEQ ID NO: 3254016 - protein, 22 aa, Plasmodium falciparum
YRGKKKKKQNGKETETERDQLE

SEQ ID NO: 3254017 - protein, 22 aa, Plasmodium falciparum
YRGKSKSITNDKRKKSQQKTYE

SEQ ID NO: 3254018 - protein, 18 aa, Plasmodium falciparum
YRGNKKKIKTETERDKLE

SEQ ID NO: 3254019 - protein, 12 aa, Plasmodium falciparum
YRGNNGKDKLEE

SEQ ID NO: 3254020 - protein, 13 aa, Plasmodium falciparum
YRGNNKEKDRLED

SEQ ID NO: 3254021 - protein, 18 aa, Plasmodium falciparum
YRGNRKKNETKTEREKLD

SEQ ID NO: 3254022 - protein, 7 aa, Plasmodium falciparum
YRGRTTK

SEQ ID NO: 3254023 - protein, 12 aa, Plasmodium falciparum
YRINSKKKNSWD

SEQ ID NO: 3254024 - protein, 40 aa, Plasmodium falciparum
YRKEKKKKKKYNTNFDKDESEAYDDDEDNNNNNSDESYHH

SEQ ID NO: 3254025 - protein, 11 aa, Plasmodium falciparum
YRKEQKGKNDY

SEQ ID NO: 3254026 - protein, 7 aa, Plasmodium falciparum
YRKGDIS

SEQ ID NO: 3254027 - protein, 14 aa, Plasmodium falciparum
YRKKKKKKNKKDFE

SEQ ID NO: 3254028 - protein, 8 aa, Plasmodium falciparum
YRKNEQTL

SEQ ID NO: 3254029 - protein, 12 aa, Plasmodium falciparum
YRKNLDDEKGFY

SEQ ID NO: 3254030 - protein, 8 aa, Plasmodium falciparum
YRKNNNNV

SEQ ID NO: 3254031 - protein, 14 aa, Plasmodium falciparum
YRKRKKSSGTYKGS

SEQ ID NO: 3254032 - protein, 15 aa, Plasmodium falciparum
YRKSSTSHRYKYDLK

SEQ ID NO: 3254033 - protein, 6 aa, Plasmodium falciparum
YRNDSY

SEQ ID NO: 3254034 - protein, 10 aa, Plasmodium falciparum
YRNGGREGPI

SEQ ID NO: 3254035 - protein, 27 aa, Plasmodium falciparum
YRNGGRGDKQYSGDGEACDRTDTSNKG

SEQ ID NO: 3254036 - protein, 4 aa, Plasmodium falciparum
YRNK

SEQ ID NO: 3254037 - protein, 15 aa, Plasmodium falciparum
YRNNNNNNNNNGHIN

SEQ ID NO: 3254038 - protein, 6 aa, Plasmodium falciparum
YRNPES

SEQ ID NO: 3254039 - protein, 13 aa, Plasmodium falciparum
YRPNENAQTSSQI

SEQ ID NO: 3254040 - protein, 39 aa, Plasmodium falciparum
YRQEEKERGQHYKGRKDDQETYEEEYDEESEQDDYYDDD

SEQ ID NO: 3254041 - protein, 17 aa, Plasmodium falciparum
YRQKQNEQVTQKKSQGI

SEQ ID NO: 3254042 - protein, 7 aa, Plasmodium falciparum
YRQTKDK

SEQ ID NO: 3254043 - protein, 6 aa, Plasmodium falciparum
YRRNDA

SEQ ID NO: 3254044 - protein, 14 aa, Plasmodium falciparum
YRSNNDYNSTYPNL

SEQ ID NO: 3254045 - protein, 4 aa, Plasmodium falciparum
YRSP

SEQ ID NO: 3254046 - protein, 8 aa, Plasmodium falciparum
YRSSDGGK

SEQ ID NO: 3254047 - protein, 11 aa, Plasmodium falciparum
YRTNTNGYRKD

SEQ ID NO: 3254048 - protein, 11 aa, Plasmodium falciparum
YRTQDEDPHNI

SEQ ID NO: 3254049 - protein, 12 aa, Plasmodium falciparum
YRTTNKNNKMIF

SEQ ID NO: 3254050 - protein, 4 aa, Plasmodium falciparum
YRYE

SEQ ID NO: 3254051 - protein, 6 aa, Plasmodium falciparum
YRYENN

SEQ ID NO: 3254052 - protein, 9 aa, Plasmodium falciparum
YSCDEQDKA

SEQ ID NO: 3254053 - protein, 11 aa, Plasmodium falciparum
YSCEDKTVKKY

SEQ ID NO: 3254054 - protein, 10 aa, Plasmodium falciparum
YSDDEKKKKY

SEQ ID NO: 3254055 - protein, 9 aa, Plasmodium falciparum
YSDDERNNI

SEQ ID NO: 3254056 - protein, 11 aa, Plasmodium falciparum
YSDDKKNRDLY

SEQ ID NO: 3254057 - protein, 21 aa, Plasmodium falciparum
YSDDNNHNNNNNNNYNDNDCS

SEQ ID NO: 3254058 - protein, 11 aa, Plasmodium falciparum
YSDDSTDDNTA

SEQ ID NO: 3254059 - protein, 8 aa, Plasmodium falciparum
YSDDYSDD

SEQ ID NO: 3254060 - protein, 6 aa, Plasmodium falciparum
YSDEKK

SEQ ID NO: 3254061 - protein, 10 aa, Plasmodium falciparum
YSDEKKNEDM

SEQ ID NO: 3254062 - protein, 9 aa, Plasmodium falciparum
YSDHGDNYS

SEQ ID NO: 3254063 - protein, 6 aa, Plasmodium falciparum
YSDINN

SEQ ID NO: 3254064 - protein, 5 aa, Plasmodium falciparum
YSDMN

SEQ ID NO: 3254065 - protein, 4 aa, Plasmodium falciparum
YSDN

SEQ ID NO: 3254066 - protein, 18 aa, Plasmodium falciparum
YSDNKNKDNDDEKKDLQG

SEQ ID NO: 3254067 - protein, 4 aa, Plasmodium falciparum
YSDS

SEQ ID NO: 3254068 - protein, 17 aa, Plasmodium falciparum
YSDSDYDDHTPGNKKKV

SEQ ID NO: 3254069 - protein, 5 aa, Plasmodium falciparum
YSDSE

SEQ ID NO: 3254070 - protein, 8 aa, Plasmodium falciparum
YSDSQSKD

SEQ ID NO: 3254071 - protein, 4 aa, Plasmodium falciparum
YSEA

SEQ ID NO: 3254072 - protein, 8 aa, Plasmodium falciparum
YSECDDSE

SEQ ID NO: 3254073 - protein, 21 aa, Plasmodium falciparum
YSEDEEEELEKYNKDDEKRDI

SEQ ID NO: 3254074 - protein, 5 aa, Plasmodium falciparum
YSEEK

SEQ ID NO: 3254075 - protein, 6 aa, Plasmodium falciparum
YSEEKG

SEQ ID NO: 3254076 - protein, 8 aa, Plasmodium falciparum
YSEERNYG

SEQ ID NO: 3254077 - protein, 5 aa, Plasmodium falciparum
YSEGD

SEQ ID NO: 3254078 - protein, 7 aa, Plasmodium falciparum
YSEGRDM

SEQ ID NO: 3254079 - protein, 4 aa, Plasmodium falciparum
YSEI

SEQ ID NO: 3254080 - protein, 17 aa, Plasmodium falciparum
YSEISDTNKGNKKLKKK

SEQ ID NO: 3254081 - protein, 36 aa, Plasmodium falciparum
YSEKKKNEHSNNSNNNNNMNNNNNSNSNSDQNDIQN

SEQ ID NO: 3254082 - protein, 15 aa, Plasmodium falciparum
YSEKSVEEIIPIKTN

SEQ ID NO: 3254083 - protein, 10 aa, Plasmodium falciparum
YSEKTGRHAL

SEQ ID NO: 3254084 - protein, 6 aa, Plasmodium falciparum
YSEYNH

SEQ ID NO: 3254085 - protein, 4 aa, Plasmodium falciparum
YSFD

SEQ ID NO: 3254086 - protein, 5 aa, Plasmodium falciparum
YSFPN

SEQ ID NO: 3254087 - protein, 5 aa, Plasmodium falciparum
YSGAS

SEQ ID NO: 3254088 - protein, 7 aa, Plasmodium falciparum
YSGDKDD

SEQ ID NO: 3254089 - protein, 6 aa, Plasmodium falciparum
YSGEEK

SEQ ID NO: 3254090 - protein, 4 aa, Plasmodium falciparum
YSGH

SEQ ID NO: 3254091 - protein, 18 aa, Plasmodium falciparum
YSGKDKKAQDESNTSDKY

SEQ ID NO: 3254092 - protein, 6 aa, Plasmodium falciparum
YSGNET

SEQ ID NO: 3254093 - protein, 14 aa, Plasmodium falciparum
YSGNKVKKKKLDDS

SEQ ID NO: 3254094 - protein, 13 aa, Plasmodium falciparum
YSGSESEEKTPQQ

SEQ ID NO: 3254095 - protein, 5 aa, Plasmodium falciparum
YSHDN

SEQ ID NO: 3254096 - protein, 6 aa, Plasmodium falciparum
YSHNKR

SEQ ID NO: 3254097 - protein, 7 aa, Plasmodium falciparum
YSHSSDD

SEQ ID NO: 3254098 - protein, 8 aa, Plasmodium falciparum
YSINEKKR

SEQ ID NO: 3254099 - protein, 7 aa, Plasmodium falciparum
YSIQENT

SEQ ID NO: 3254100 - protein, 7 aa, Plasmodium falciparum
YSKDEKR

SEQ ID NO: 3254101 - protein, 11 aa, Plasmodium falciparum
YSKDKNSCEDE

SEQ ID NO: 3254102 - protein, 9 aa, Plasmodium falciparum
YSKDKTKNW

SEQ ID NO: 3254103 - protein, 5 aa, Plasmodium falciparum
YSKDN

SEQ ID NO: 3254104 - protein, 10 aa, Plasmodium falciparum
YSKDSPNNNL

SEQ ID NO: 3254105 - protein, 10 aa, Plasmodium falciparum
YSKEAKNPYE

SEQ ID NO: 3254106 - protein, 8 aa, Plasmodium falciparum
YSKEDFSN

SEQ ID NO: 3254107 - protein, 7 aa, Plasmodium falciparum
YSKEDTG

SEQ ID NO: 3254108 - protein, 5 aa, Plasmodium falciparum
YSKEH

SEQ ID NO: 3254109 - protein, 11 aa, Plasmodium falciparum
YSKEKIKEAEK

SEQ ID NO: 3254110 - protein, 10 aa, Plasmodium falciparum
YSKESNKEID

SEQ ID NO: 3254111 - protein, 6 aa, Plasmodium falciparum
YSKGNL

SEQ ID NO: 3254112 - protein, 14 aa, Plasmodium falciparum
YSKHPTKESYSDEN

SEQ ID NO: 3254113 - protein, 4 aa, Plasmodium falciparum
YSKK

SEQ ID NO: 3254114 - protein, 10 aa, Plasmodium falciparum
YSKKDSMSNE

SEQ ID NO: 3254115 - protein, 5 aa, Plasmodium falciparum
YSKKE

SEQ ID NO: 3254116 - protein, 17 aa, Plasmodium falciparum
YSKKSLKKKAFIQKFYK

SEQ ID NO: 3254117 - protein, 7 aa, Plasmodium falciparum
YSKKYDT

SEQ ID NO: 3254118 - protein, 10 aa, Plasmodium falciparum
YSKLNNEERE

SEQ ID NO: 3254119 - protein, 4 aa, Plasmodium falciparum
YSKN

SEQ ID NO: 3254120 - protein, 7 aa, Plasmodium falciparum
YSKNAQK

SEQ ID NO: 3254121 - protein, 7 aa, Plasmodium falciparum
YSKNKEK

SEQ ID NO: 3254122 - protein, 11 aa, Plasmodium falciparum
YSKNSTPNYNL

SEQ ID NO: 3254123 - protein, 8 aa, Plasmodium falciparum
YSKQGKKS

SEQ ID NO: 3254124 - protein, 14 aa, Plasmodium falciparum
YSKRDMNKNNKSKM

SEQ ID NO: 3254125 - protein, 5 aa, Plasmodium falciparum
YSKRG

SEQ ID NO: 3254126 - protein, 10 aa, Plasmodium falciparum
YSKSEEENNT

SEQ ID NO: 3254127 - protein, 10 aa, Plasmodium falciparum
YSKSLSNSIS

SEQ ID NO: 3254128 - protein, 7 aa, Plasmodium falciparum
YSKSSKR

SEQ ID NO: 3254129 - protein, 14 aa, Plasmodium falciparum
YSKSYTSTKSVEEN

SEQ ID NO: 3254130 - protein, 6 aa, Plasmodium falciparum
YSKTSR

SEQ ID NO: 3254131 - protein, 12 aa, Plasmodium falciparum
YSKYTHKGYPKQ

SEQ ID NO: 3254132 - protein, 15 aa, Plasmodium falciparum
YSLTSKNNNNEDEHM

SEQ ID NO: 3254133 - protein, 9 aa, Plasmodium falciparum
YSMPNEKDI

SEQ ID NO: 3254134 - protein, 4 aa, Plasmodium falciparum
YSNA

SEQ ID NO: 3254135 - protein, 40 aa, Plasmodium falciparum
YSNAEKKIKEEKFQGHKNVSKGTHSSYDELSKTKKINKIE

SEQ ID NO: 3254136 - protein, 48 aa, Plasmodium falciparum
YSNAESNVQSDVDKGTSTKNEKKEEKNKKKITTTTTKKKNNNDDNSDM

SEQ ID NO: 3254137 - protein, 7 aa, Plasmodium falciparum
YSNDEEK

SEQ ID NO: 3254138 - protein, 30 aa, Plasmodium falciparum
YSNDGNINYPSNRNKKKNNNKNKKNKIKNK

SEQ ID NO: 3254139 - protein, 15 aa, Plasmodium falciparum
YSNDKDEDEISSSDV

SEQ ID NO: 3254140 - protein, 12 aa, Plasmodium falciparum
YSNDKDKKGNLH

SEQ ID NO: 3254141 - protein, 16 aa, Plasmodium falciparum
YSNEFESNNFNSPHYD

SEQ ID NO: 3254142 - protein, 5 aa, Plasmodium falciparum
YSNGN

SEQ ID NO: 3254143 - protein, 20 aa, Plasmodium falciparum
YSNGNNNNNKKIIPSNTSDL

SEQ ID NO: 3254144 - protein, 7 aa, Plasmodium falciparum
YSNGNNY

SEQ ID NO: 3254145 - protein, 17 aa, Plasmodium falciparum
YSNHNNNNHNNNHNNNN

SEQ ID NO: 3254146 - protein, 9 aa, Plasmodium falciparum
YSNKEKTKN

SEQ ID NO: 3254147 - protein, 9 aa, Plasmodium falciparum
YSNKGNRNY

SEQ ID NO: 3254148 - protein, 11 aa, Plasmodium falciparum
YSNKIKRKNKI

SEQ ID NO: 3254149 - protein, 5 aa, Plasmodium falciparum
YSNNE

SEQ ID NO: 3254150 - protein, 21 aa, Plasmodium falciparum
YSNNNNSELHKSENKNDPNRI

SEQ ID NO: 3254151 - protein, 18 aa, Plasmodium falciparum
YSNNNRYSNNNSCSNNNC

SEQ ID NO: 3254152 - protein, 10 aa, Plasmodium falciparum
YSNNTEKKEY

SEQ ID NO: 3254153 - protein, 9 aa, Plasmodium falciparum
YSNNYQKNL

SEQ ID NO: 3254154 - protein, 84 aa, Plasmodium falciparum
YSNNYTKNNDIDDTSQNNDIDKTSQNNDIDDTSQNNDIDDTSQNNDIDDTSQNNDIDDTSKNNDIDDTSQDNDKTVSPKNNINN

SEQ ID NO: 3254155 - protein, 11 aa, Plasmodium falciparum
YSNNYTNEKNN

SEQ ID NO: 3254156 - protein, 5 aa, Plasmodium falciparum
YSNPN

SEQ ID NO: 3254157 - protein, 4 aa, Plasmodium falciparum
YSNQ

SEQ ID NO: 3254158 - protein, 22 aa, Plasmodium falciparum
YSNRIPRKSEGPCYGKNPQRFY

SEQ ID NO: 3254159 - protein, 16 aa, Plasmodium falciparum
YSNSNDDADKSSNPLN

SEQ ID NO: 3254160 - protein, 11 aa, Plasmodium falciparum
YSNSPSSPNGN

SEQ ID NO: 3254161 - protein, 6 aa, Plasmodium falciparum
YSNSSH

SEQ ID NO: 3254162 - protein, 32 aa, Plasmodium falciparum
YSPGKDKYENKNVNHQNNDNNNNNNNDNNSSS

SEQ ID NO: 3254163 - protein, 9 aa, Plasmodium falciparum
YSPIPYPEQ

SEQ ID NO: 3254164 - protein, 11 aa, Plasmodium falciparum
YSPKKDNSEYY

SEQ ID NO: 3254165 - protein, 16 aa, Plasmodium falciparum
YSPPSYKRNNYSYKDK

SEQ ID NO: 3254166 - protein, 12 aa, Plasmodium falciparum
YSPRDSSNDEEN

SEQ ID NO: 3254167 - protein, 8 aa, Plasmodium falciparum
YSPTNTNI

SEQ ID NO: 3254168 - protein, 8 aa, Plasmodium falciparum
YSQEDEQE

SEQ ID NO: 3254169 - protein, 8 aa, Plasmodium falciparum
YSQENGPN

SEQ ID NO: 3254170 - protein, 17 aa, Plasmodium falciparum
YSQGTNATINNTNTGGN

SEQ ID NO: 3254171 - protein, 8 aa, Plasmodium falciparum
YSQNNKKE

SEQ ID NO: 3254172 - protein, 10 aa, Plasmodium falciparum
YSQNNRRSQE

SEQ ID NO: 3254173 - protein, 12 aa, Plasmodium falciparum
YSQSLSNTSYSN

SEQ ID NO: 3254174 - protein, 4 aa, Plasmodium falciparum
YSRD

SEQ ID NO: 3254175 - protein, 16 aa, Plasmodium falciparum
YSRESSLKNANKKCAP

SEQ ID NO: 3254176 - protein, 18 aa, Plasmodium falciparum
YSRIPRYDTSNLKGYNKN

SEQ ID NO: 3254177 - protein, 23 aa, Plasmodium falciparum
YSRKRRNKNIQKYKQKREEYNEL

SEQ ID NO: 3254178 - protein, 13 aa, Plasmodium falciparum
YSRTYSSDDRKIT

SEQ ID NO: 3254179 - protein, 4 aa, Plasmodium falciparum
YSSA

SEQ ID NO: 3254180 - protein, 4 aa, Plasmodium falciparum
YSSD

SEQ ID NO: 3254181 - protein, 12 aa, Plasmodium falciparum
YSSDSNSNCSSH

SEQ ID NO: 3254182 - protein, 7 aa, Plasmodium falciparum
YSSDTDD

SEQ ID NO: 3254183 - protein, 17 aa, Plasmodium falciparum
YSSEENDSLPNGGTEDF

SEQ ID NO: 3254184 - protein, 31 aa, Plasmodium falciparum
YSSEKYSSEKYSSEKYSSEKYSSSNRNQSTN

SEQ ID NO: 3254185 - protein, 14 aa, Plasmodium falciparum
YSSHNSSDNEDNNN

SEQ ID NO: 3254186 - protein, 13 aa, Plasmodium falciparum
YSSHTNKNNNPDI

SEQ ID NO: 3254187 - protein, 12 aa, Plasmodium falciparum
YSSKKKKDKKYV

SEQ ID NO: 3254188 - protein, 7 aa, Plasmodium falciparum
YSSKNRY

SEQ ID NO: 3254189 - protein, 5 aa, Plasmodium falciparum
YSSKS

SEQ ID NO: 3254190 - protein, 15 aa, Plasmodium falciparum
YSSKYKKKRKNEMKK

SEQ ID NO: 3254191 - protein, 21 aa, Plasmodium falciparum
YSSMSKKVEDENDNKKKSKKK

SEQ ID NO: 3254192 - protein, 9 aa, Plasmodium falciparum
YSSNDEKER

SEQ ID NO: 3254193 - protein, 7 aa, Plasmodium falciparum
YSSNKRV

SEQ ID NO: 3254194 - protein, 10 aa, Plasmodium falciparum
YSSNNNGDNI

SEQ ID NO: 3254195 - protein, 11 aa, Plasmodium falciparum
YSSRSSNKTEN

SEQ ID NO: 3254196 - protein, 18 aa, Plasmodium falciparum
YSSSDNNKYNDHNEYNTY

SEQ ID NO: 3254197 - protein, 5 aa, Plasmodium falciparum
YSSSE

SEQ ID NO: 3254198 - protein, 9 aa, Plasmodium falciparum
YSSSISNAN

SEQ ID NO: 3254199 - protein, 7 aa, Plasmodium falciparum
YSSSNEY

SEQ ID NO: 3254200 - protein, 7 aa, Plasmodium falciparum
YSSSNYS

SEQ ID NO: 3254201 - protein, 15 aa, Plasmodium falciparum
YSSSPSSSLKTDKCN

SEQ ID NO: 3254202 - protein, 10 aa, Plasmodium falciparum
YSSTDSYERD

SEQ ID NO: 3254203 - protein, 4 aa, Plasmodium falciparum
YSSY

SEQ ID NO: 3254204 - protein, 9 aa, Plasmodium falciparum
YSSYGKKKN

SEQ ID NO: 3254205 - protein, 14 aa, Plasmodium falciparum
YSSYSSPKYGDNEN

SEQ ID NO: 3254206 - protein, 5 aa, Plasmodium falciparum
YSTDD

SEQ ID NO: 3254207 - protein, 6 aa, Plasmodium falciparum
YSTNDQ

SEQ ID NO: 3254208 - protein, 6 aa, Plasmodium falciparum
YSTNDT

SEQ ID NO: 3254209 - protein, 11 aa, Plasmodium falciparum
YSTNPRNNNIT

SEQ ID NO: 3254210 - protein, 5 aa, Plasmodium falciparum
YSTQN

SEQ ID NO: 3254211 - protein, 11 aa, Plasmodium falciparum
YSTSKSKENGN

SEQ ID NO: 3254212 - protein, 5 aa, Plasmodium falciparum
YSYDD

SEQ ID NO: 3254213 - protein, 14 aa, Plasmodium falciparum
YSYDKNAKEYKAQN

SEQ ID NO: 3254214 - protein, 15 aa, Plasmodium falciparum
YSYEKEINDNDSDDD

SEQ ID NO: 3254215 - protein, 13 aa, Plasmodium falciparum
YSYETNKPYDTDT

SEQ ID NO: 3254216 - protein, 14 aa, Plasmodium falciparum
YSYGQTGIDGCNKK

SEQ ID NO: 3254217 - protein, 11 aa, Plasmodium falciparum
YSYKRDKNKIN

SEQ ID NO: 3254218 - protein, 12 aa, Plasmodium falciparum
YSYKRKGISPIK

SEQ ID NO: 3254219 - protein, 5 aa, Plasmodium falciparum
YSYNN

SEQ ID NO: 3254220 - protein, 5 aa, Plasmodium falciparum
YSYPK

SEQ ID NO: 3254221 - protein, 5 aa, Plasmodium falciparum
YSYPS

SEQ ID NO: 3254222 - protein, 4 aa, Plasmodium falciparum
YSYR

SEQ ID NO: 3254223 - protein, 7 aa, Plasmodium falciparum
YSYTDKN

SEQ ID NO: 3254224 - protein, 15 aa, Plasmodium falciparum
YTAGYNKNGELGNGE

SEQ ID NO: 3254225 - protein, 35 aa, Plasmodium falciparum
YTDDNMKENNLEDSNNDDSSALNYTDDENVDPENN

SEQ ID NO: 3254226 - protein, 9 aa, Plasmodium falciparum
YTDEDTIDS

SEQ ID NO: 3254227 - protein, 6 aa, Plasmodium falciparum
YTDKDT

SEQ ID NO: 3254228 - protein, 10 aa, Plasmodium falciparum
YTDKDYNSEH

SEQ ID NO: 3254229 - protein, 14 aa, Plasmodium falciparum
YTDLNEKKKEEYKK

SEQ ID NO: 3254230 - protein, 4 aa, Plasmodium falciparum
YTDN

SEQ ID NO: 3254231 - protein, 6 aa, Plasmodium falciparum
YTDNDI

SEQ ID NO: 3254232 - protein, 15 aa, Plasmodium falciparum
YTDRANNDLGNNKDT

SEQ ID NO: 3254233 - protein, 8 aa, Plasmodium falciparum
YTDSPSQL

SEQ ID NO: 3254234 - protein, 5 aa, Plasmodium falciparum
YTDSS

SEQ ID NO: 3254235 - protein, 15 aa, Plasmodium falciparum
YTDYSNSKKRKGNHD

SEQ ID NO: 3254236 - protein, 9 aa, Plasmodium falciparum
YTEDKDDNY

SEQ ID NO: 3254237 - protein, 14 aa, Plasmodium falciparum
YTEESEKEGKKKNK

SEQ ID NO: 3254238 - protein, 5 aa, Plasmodium falciparum
YTEKG

SEQ ID NO: 3254239 - protein, 4 aa, Plasmodium falciparum
YTEN

SEQ ID NO: 3254240 - protein, 5 aa, Plasmodium falciparum
YTENP

SEQ ID NO: 3254241 - protein, 5 aa, Plasmodium falciparum
YTESN

SEQ ID NO: 3254242 - protein, 4 aa, Plasmodium falciparum
YTFT

SEQ ID NO: 3254243 - protein, 5 aa, Plasmodium falciparum
YTGNS

SEQ ID NO: 3254244 - protein, 5 aa, Plasmodium falciparum
YTGTP

SEQ ID NO: 3254245 - protein, 9 aa, Plasmodium falciparum
YTGVNNNNS

SEQ ID NO: 3254246 - protein, 10 aa, Plasmodium falciparum
YTHNDDNTLR

SEQ ID NO: 3254247 - protein, 13 aa, Plasmodium falciparum
YTINKNPGSEYNS

SEQ ID NO: 3254248 - protein, 5 aa, Plasmodium falciparum
YTISK

SEQ ID NO: 3254249 - protein, 8 aa, Plasmodium falciparum
YTKDNNYK

SEQ ID NO: 3254250 - protein, 6 aa, Plasmodium falciparum
YTKEET

SEQ ID NO: 3254251 - protein, 11 aa, Plasmodium falciparum
YTKENDGSNDL

SEQ ID NO: 3254252 - protein, 5 aa, Plasmodium falciparum
YTKKE

SEQ ID NO: 3254253 - protein, 10 aa, Plasmodium falciparum
YTKKRKTLQY

SEQ ID NO: 3254254 - protein, 12 aa, Plasmodium falciparum
YTKPDENQKEKK

SEQ ID NO: 3254255 - protein, 7 aa, Plasmodium falciparum
YTKPQNV

SEQ ID NO: 3254256 - protein, 8 aa, Plasmodium falciparum
YTKSPNNN

SEQ ID NO: 3254257 - protein, 6 aa, Plasmodium falciparum
YTKTGT

SEQ ID NO: 3254258 - protein, 23 aa, Plasmodium falciparum
YTKYTNNNHQNVTATNNDNNELT

SEQ ID NO: 3254259 - protein, 22 aa, Plasmodium falciparum
YTLSPQRADPFADKSPSPGERT

SEQ ID NO: 3254260 - protein, 4 aa, Plasmodium falciparum
YTNA

SEQ ID NO: 3254261 - protein, 4 aa, Plasmodium falciparum
YTND

SEQ ID NO: 3254262 - protein, 5 aa, Plasmodium falciparum
YTNDE

SEQ ID NO: 3254263 - protein, 6 aa, Plasmodium falciparum
YTNDEE

SEQ ID NO: 3254264 - protein, 8 aa, Plasmodium falciparum
YTNDKNER

SEQ ID NO: 3254265 - protein, 10 aa, Plasmodium falciparum
YTNDNNNNSI

SEQ ID NO: 3254266 - protein, 7 aa, Plasmodium falciparum
YTNDQNS

SEQ ID NO: 3254267 - protein, 12 aa, Plasmodium falciparum
YTNEGNKSCECS

SEQ ID NO: 3254268 - protein, 5 aa, Plasmodium falciparum
YTNEK

SEQ ID NO: 3254269 - protein, 16 aa, Plasmodium falciparum
YTNENHKSNDKNDKSC

SEQ ID NO: 3254270 - protein, 58 aa, Plasmodium falciparum
YTNGCTNDYTNGYNNEYTNGCTNDYTNDYTNGYNNEYTNDYTNDYNNDYTNDYKNHNT

SEQ ID NO: 3254271 - protein, 10 aa, Plasmodium falciparum
YTNGKHKGSI

SEQ ID NO: 3254272 - protein, 5 aa, Plasmodium falciparum
YTNIE

SEQ ID NO: 3254273 - protein, 5 aa, Plasmodium falciparum
YTNKL

SEQ ID NO: 3254274 - protein, 5 aa, Plasmodium falciparum
YTNKV

SEQ ID NO: 3254275 - protein, 16 aa, Plasmodium falciparum
YTNLEEKDKEKMKKNE

SEQ ID NO: 3254276 - protein, 24 aa, Plasmodium falciparum
YTNNDLKNNDIQNKDLSNKDMKNK

SEQ ID NO: 3254277 - protein, 27 aa, Plasmodium falciparum
YTNNQNMEHNENNETTNIKEEDLNRND

SEQ ID NO: 3254278 - protein, 5 aa, Plasmodium falciparum
YTNQN

SEQ ID NO: 3254279 - protein, 5 aa, Plasmodium falciparum
YTNSK

SEQ ID NO: 3254280 - protein, 7 aa, Plasmodium falciparum
YTNSKSI

SEQ ID NO: 3254281 - protein, 13 aa, Plasmodium falciparum
YTNSRSSKGISNN

SEQ ID NO: 3254282 - protein, 5 aa, Plasmodium falciparum
YTNST

SEQ ID NO: 3254283 - protein, 7 aa, Plasmodium falciparum
YTNTKEY

SEQ ID NO: 3254284 - protein, 11 aa, Plasmodium falciparum
YTNTPLNNSSL

SEQ ID NO: 3254285 - protein, 4 aa, Plasmodium falciparum
YTNV

SEQ ID NO: 3254286 - protein, 5 aa, Plasmodium falciparum
YTPNN

SEQ ID NO: 3254287 - protein, 6 aa, Plasmodium falciparum
YTPRGS

SEQ ID NO: 3254288 - protein, 5 aa, Plasmodium falciparum
YTPTH

SEQ ID NO: 3254289 - protein, 15 aa, Plasmodium falciparum
YTPYPQDTNQNAYYP

SEQ ID NO: 3254290 - protein, 6 aa, Plasmodium falciparum
YTQEQN

SEQ ID NO: 3254291 - protein, 4 aa, Plasmodium falciparum
YTQN

SEQ ID NO: 3254292 - protein, 6 aa, Plasmodium falciparum
YTQQNI

SEQ ID NO: 3254293 - protein, 5 aa, Plasmodium falciparum
YTQYY

SEQ ID NO: 3254294 - protein, 11 aa, Plasmodium falciparum
YTRNNKYRSDN

SEQ ID NO: 3254295 - protein, 6 aa, Plasmodium falciparum
YTRNST

SEQ ID NO: 3254296 - protein, 11 aa, Plasmodium falciparum
YTRRKQTSECF

SEQ ID NO: 3254297 - protein, 11 aa, Plasmodium falciparum
YTSATKNATNY

SEQ ID NO: 3254298 - protein, 6 aa, Plasmodium falciparum
YTSDGL

SEQ ID NO: 3254299 - protein, 5 aa, Plasmodium falciparum
YTSEK

SEQ ID NO: 3254300 - protein, 35 aa, Plasmodium falciparum
YTSENKNNNNNNNNDDVDGEDNNNYDDHNNNNNVD

SEQ ID NO: 3254301 - protein, 5 aa, Plasmodium falciparum
YTSKD

SEQ ID NO: 3254302 - protein, 10 aa, Plasmodium falciparum
YTSNEATFNN

SEQ ID NO: 3254303 - protein, 10 aa, Plasmodium falciparum
YTSNESYRRK

SEQ ID NO: 3254304 - protein, 33 aa, Plasmodium falciparum
YTSNNNNNNSNNNSNSNNSNSNSNSNSNNSTHN

SEQ ID NO: 3254305 - protein, 10 aa, Plasmodium falciparum
YTSNNSDKEE

SEQ ID NO: 3254306 - protein, 6 aa, Plasmodium falciparum
YTSPKY

SEQ ID NO: 3254307 - protein, 18 aa, Plasmodium falciparum
YTSPQRNRYSNKNLRNEE

SEQ ID NO: 3254308 - protein, 5 aa, Plasmodium falciparum
YTSPR

SEQ ID NO: 3254309 - protein, 4 aa, Plasmodium falciparum
YTSQ

SEQ ID NO: 3254310 - protein, 19 aa, Plasmodium falciparum
YTSRSNNPPRQDSQTSYYG

SEQ ID NO: 3254311 - protein, 28 aa, Plasmodium falciparum
YTSRTNNQHRSENENDDESDYDDDEELQ

SEQ ID NO: 3254312 - protein, 8 aa, Plasmodium falciparum
YTSSGSYE

SEQ ID NO: 3254313 - protein, 31 aa, Plasmodium falciparum
YTSSSVHNSTNNERKSDEDLDNIEGDNITKE

SEQ ID NO: 3254314 - protein, 7 aa, Plasmodium falciparum
YTSSTAQ

SEQ ID NO: 3254315 - protein, 6 aa, Plasmodium falciparum
YTSSYE

SEQ ID NO: 3254316 - protein, 4 aa, Plasmodium falciparum
YTST

SEQ ID NO: 3254317 - protein, 5 aa, Plasmodium falciparum
YTTDH

SEQ ID NO: 3254318 - protein, 19 aa, Plasmodium falciparum
YTTDNNNNNNNNNNMKDEK

SEQ ID NO: 3254319 - protein, 9 aa, Plasmodium falciparum
YTTEFETTT

SEQ ID NO: 3254320 - protein, 6 aa, Plasmodium falciparum
YTTGHS

SEQ ID NO: 3254321 - protein, 4 aa, Plasmodium falciparum
YTTH

SEQ ID NO: 3254322 - protein, 4 aa, Plasmodium falciparum
YTTI

SEQ ID NO: 3254323 - protein, 6 aa, Plasmodium falciparum
YTTNPI

SEQ ID NO: 3254324 - protein, 17 aa, Plasmodium falciparum
YTTTDNNNNNNNNYNYN

SEQ ID NO: 3254325 - protein, 19 aa, Plasmodium falciparum
YTTTEKCNKETDKSKLQQC

SEQ ID NO: 3254326 - protein, 10 aa, Plasmodium falciparum
YTTTTKKKKD

SEQ ID NO: 3254327 - protein, 28 aa, Plasmodium falciparum
YTYGDEDDMNNGYHNNNNNKLKEEDGCG

SEQ ID NO: 3254328 - protein, 5 aa, Plasmodium falciparum
YTYKE

SEQ ID NO: 3254329 - protein, 13 aa, Plasmodium falciparum
YTYNNNDKSLSEL

SEQ ID NO: 3254330 - protein, 14 aa, Plasmodium falciparum
YTYNNSSIRDNDNN

SEQ ID NO: 3254331 - protein, 44 aa, Plasmodium falciparum
YTYSKNKKKKEKLKKNKTNISLKDNSSAYIDNNNNNNNNNNNEI

SEQ ID NO: 3254332 - protein, 16 aa, Plasmodium falciparum
YTYSPKINDKEEQQPH

SEQ ID NO: 3254333 - protein, 9 aa, Plasmodium falciparum
YVDDEKMND

SEQ ID NO: 3254334 - protein, 5 aa, Plasmodium falciparum
YVDEG

SEQ ID NO: 3254335 - protein, 8 aa, Plasmodium falciparum
YVKEKEKE

SEQ ID NO: 3254336 - protein, 7 aa, Plasmodium falciparum
YVKRNGS

SEQ ID NO: 3254337 - protein, 4 aa, Plasmodium falciparum
YVKS

SEQ ID NO: 3254338 - protein, 4 aa, Plasmodium falciparum
YVNE

SEQ ID NO: 3254339 - protein, 21 aa, Plasmodium falciparum
YVPSGDDNNPQKKLEEGEIPE

SEQ ID NO: 3254340 - protein, 4 aa, Plasmodium falciparum
YVTR

SEQ ID NO: 3254341 - protein, 15 aa, Plasmodium falciparum
YYANQDNAKRKREKT

SEQ ID NO: 3254342 - protein, 12 aa, Plasmodium falciparum
YYDDDNNNNNNN

SEQ ID NO: 3254343 - protein, 28 aa, Plasmodium falciparum
YYDDGDDYEEDEDEDEEEDDHENNYNDD

SEQ ID NO: 3254344 - protein, 76 aa, Plasmodium falciparum
YYDGGDGDDNDDDNDDDNDDDDNDDDDDNDDNNDDDYNDQSDESEENYEMKDNNEKKYEQNDEKKTKKQKKEITNK

SEQ ID NO: 3254345 - protein, 4 aa, Plasmodium falciparum
YYDK

SEQ ID NO: 3254346 - protein, 18 aa, Plasmodium falciparum
YYDKENNDNIYDNEQKEN

SEQ ID NO: 3254347 - protein, 6 aa, Plasmodium falciparum
YYDKQS

SEQ ID NO: 3254348 - protein, 16 aa, Plasmodium falciparum
YYDSSDISDDETNDDG

SEQ ID NO: 3254349 - protein, 39 aa, Plasmodium falciparum
YYDSSNNSEQIQAKNKMEKNNKMYEASNPKMNNEKDKKN

SEQ ID NO: 3254350 - protein, 12 aa, Plasmodium falciparum
YYEEEGEKSKNV

SEQ ID NO: 3254351 - protein, 11 aa, Plasmodium falciparum
YYEENKKNDEY

SEQ ID NO: 3254352 - protein, 12 aa, Plasmodium falciparum
YYENKKDANFDK

SEQ ID NO: 3254353 - protein, 16 aa, Plasmodium falciparum
YYEQNGAESLKKKKKK

SEQ ID NO: 3254354 - protein, 4 aa, Plasmodium falciparum
YYET

SEQ ID NO: 3254355 - protein, 4 aa, Plasmodium falciparum
YYGD

SEQ ID NO: 3254356 - protein, 9 aa, Plasmodium falciparum
YYGEDKKKK

SEQ ID NO: 3254357 - protein, 6 aa, Plasmodium falciparum
YYGKRE

SEQ ID NO: 3254358 - protein, 6 aa, Plasmodium falciparum
YYGQEQ

SEQ ID NO: 3254359 - protein, 9 aa, Plasmodium falciparum
YYGSGGDGY

SEQ ID NO: 3254360 - protein, 15 aa, Plasmodium falciparum
YYKEGENYEHGQENS

SEQ ID NO: 3254361 - protein, 12 aa, Plasmodium falciparum
YYKNKTKCSIQD

SEQ ID NO: 3254362 - protein, 10 aa, Plasmodium falciparum
YYKNPKKAPH

SEQ ID NO: 3254363 - protein, 12 aa, Plasmodium falciparum
YYKSSTSTSSKA

SEQ ID NO: 3254364 - protein, 20 aa, Plasmodium falciparum
YYNEGKDDEEEDDDDDNDEY

SEQ ID NO: 3254365 - protein, 7 aa, Plasmodium falciparum
YYNEPNN

SEQ ID NO: 3254366 - protein, 7 aa, Plasmodium falciparum
YYNNKED

SEQ ID NO: 3254367 - protein, 5 aa, Plasmodium falciparum
YYNNY

SEQ ID NO: 3254368 - protein, 4 aa, Plasmodium falciparum
YYNS

SEQ ID NO: 3254369 - protein, 11 aa, Plasmodium falciparum
YYNSQEQRNHP

SEQ ID NO: 3254370 - protein, 13 aa, Plasmodium falciparum
YYNSSNKSKRRTN

SEQ ID NO: 3254371 - protein, 7 aa, Plasmodium falciparum
YYNTKRS

SEQ ID NO: 3254372 - protein, 14 aa, Plasmodium falciparum
YYNYNDKDKDMNNK

SEQ ID NO: 3254373 - protein, 6 aa, Plasmodium falciparum
YYPPKY

SEQ ID NO: 3254374 - protein, 5 aa, Plasmodium falciparum
YYQHP

SEQ ID NO: 3254375 - protein, 4 aa, Plasmodium falciparum
YYSS

SEQ ID NO: 3254376 - protein, 10 aa, Plasmodium falciparum
YYSSDVGSTQ

SEQ ID NO: 3254377 - protein, 4 aa, Plasmodium falciparum
YYTN

SEQ ID NO: 3254378 - protein, 4 aa, Plasmodium falciparum
YYTS

SEQ ID NO: 3254379 - protein, 16 aa, Plasmodium falciparum
YYTYNNNNNNNNNDKF

SEQ ID NO: 3254380 - protein, 18 aa, Plasmodium falciparum
PGSPKYKTLIEVVLEPSG

SEQ ID NO: 3254381 - protein, 19 aa, Plasmodium falciparum
YIWLYRRRKNSWKHECKKH

SEQ ID NO: 3254382 - protein, 18 aa, Plasmodium falciparum
PGSPKYKTLIEVVLEPSK

SEQ ID NO: 3254383 - protein, 17 aa, Plasmodium falciparum
PKYKTLIEVVLEPSGNN

SEQ ID NO: 3254384 - protein, 21 aa, Plasmodium falciparum
VPQYLRWFEEWAEDFCRKKKK

SEQ ID NO: 3254385 - protein, 25 aa, Plasmodium falciparum
IIVICLLVWLWPSRGKLMGKDKTEN

SEQ ID NO: 3254386 - protein, 20 aa, Plasmodium falciparum
PRAPKYKTLIEVVLEPSGNN

SEQ ID NO: 3254387 - protein, 17 aa, Plasmodium falciparum
IVICLYLIIYKNSDIKW

SEQ ID NO: 3254388 - protein, 22 aa, Plasmodium falciparum
DPEYRKHLEVFHKILTNTDPND

SEQ ID NO: 3254389 - protein, 25 aa, Plasmodium falciparum
TSTLAWSVGIGFAAFTYFYLKKKTK

SEQ ID NO: 3254390 - protein, 19 aa, Plasmodium falciparum
DAIPTCVCEKSVADKVEKT

SEQ ID NO: 3254391 - protein, 22 aa, Plasmodium falciparum
DDIPTCICEKSLADKVEKGCLR

SEQ ID NO: 3254392 - protein, 17 aa, Plasmodium falciparum
EDFCRKKKKYVDIVKTY

SEQ ID NO: 3254393 - protein, 19 aa, Plasmodium falciparum
FSAVPSFIAFSSFVGIILL

SEQ ID NO: 3254394 - protein, 21 aa, Plasmodium falciparum
IKWKKHINCCKYHFYFFSSKR

SEQ ID NO: 3254395 - protein, 21 aa, Plasmodium falciparum
PCYPEDKKLIIYYEVDNKVVE

SEQ ID NO: 3254396 - protein, 19 aa, Plasmodium falciparum
RCAQNLGGVAPGWGLLSGF

SEQ ID NO: 3254397 - protein, 22 aa, Plasmodium falciparum
VPQYLRWFEEWAEDFCRKKKIY

SEQ ID NO: 3254398 - protein, 17 aa, Plasmodium falciparum
YKTLIEVVLEPSGNNTT

SEQ ID NO: 3254399 - protein, 24 aa, Plasmodium falciparum
ADPEYRKHLEIFYKILTNTDPNDE

SEQ ID NO: 3254400 - protein, 18 aa, Plasmodium falciparum
AYEAMKFSYADYSDIVKG

SEQ ID NO: 3254401 - protein, 20 aa, Plasmodium falciparum
FSAVPSFIAFSSFVGIILLS

SEQ ID NO: 3254402 - protein, 29 aa, Plasmodium falciparum
LKEYRKKKLICIIWIKIYMMIIEEHKKEE

SEQ ID NO: 3254403 - protein, 22 aa, Plasmodium falciparum
LSSKRVLKWKTIIEIHLEVLHD

SEQ ID NO: 3254404 - protein, 19 aa, Plasmodium falciparum
MLPEELIEVVVPEELVEEV

SEQ ID NO: 3254405 - protein, 17 aa, Plasmodium falciparum
NLARIFIILFNIKNQIY

SEQ ID NO: 3254406 - protein, 18 aa, Plasmodium falciparum
PHAPKYKTLIEVVLEPSG

SEQ ID NO: 3254407 - protein, 23 aa, Plasmodium falciparum
SDAIPTCICEKSLADKVEKGCLR

SEQ ID NO: 3254408 - protein, 23 aa, Plasmodium falciparum
SDAIPTCVCEKSLADKVEKGCLR

SEQ ID NO: 3254409 - protein, 23 aa, Plasmodium falciparum
SDILKTTIPFGIALALTSIALLF

SEQ ID NO: 3254410 - protein, 18 aa, Plasmodium falciparum
SIYLSSKRVLKWKTIIEI

SEQ ID NO: 3254411 - protein, 18 aa, Plasmodium falciparum
SKNVRSFSSQGIRQDFPY

SEQ ID NO: 3254412 - protein, 25 aa, Plasmodium falciparum
TSTLAWSVGIGFAAFTYFFLKKKTK

SEQ ID NO: 3254413 - protein, 22 aa, Plasmodium falciparum
TTLKTAMGYITKFKDFIQNKSE

SEQ ID NO: 3254414 - protein, 24 aa, Plasmodium falciparum
VEKGCLRCGYGLGTVAPTVGLIGA

SEQ ID NO: 3254415 - protein, 21 aa, Plasmodium falciparum
VPQFLRWFEEWAEEFCRIKKI

SEQ ID NO: 3254416 - protein, 22 aa, Plasmodium falciparum
VPQYLRWFEEWAEDFCRKKKKK

SEQ ID NO: 3254417 - protein, 22 aa, Plasmodium falciparum
VPQYLRWFEEWAEDFCRKKNKK

SEQ ID NO: 3254418 - protein, 25 aa, Plasmodium falciparum
VPQYLRWFEEWAEDFCRLRKHKLKD

SEQ ID NO: 3254419 - protein, 17 aa, Plasmodium falciparum
YKTLIEVVLEPSKRDTQ

SEQ ID NO: 3254420 - protein, 24 aa, Plasmodium falciparum
YVTKHCNGCICNLRDMEDIHKNIN

SEQ ID NO: 3254421 - protein, 21 aa, Plasmodium falciparum
ACAPYRRRHICDYNLHHINEN

SEQ ID NO: 3254422 - protein, 23 aa, Plasmodium falciparum
ADPEYRKHLEIFHKILTNTDPND

SEQ ID NO: 3254423 - protein, 17 aa, Plasmodium falciparum
AEDCKPCSEFKVNCENG

SEQ ID NO: 3254424 - protein, 18 aa, Plasmodium falciparum
AIDVLINIIMRYVNKDNI

SEQ ID NO: 3254425 - protein, 17 aa, Plasmodium falciparum
AIPTCVCEKSVADKVEK

SEQ ID NO: 3254426 - protein, 19 aa, Plasmodium falciparum
ALGTYGWKIAATAMAYETA

SEQ ID NO: 3254427 - protein, 20 aa, Plasmodium falciparum
ALIKRYFMSLIFIMLSYIMI

SEQ ID NO: 3254428 - protein, 20 aa, Plasmodium falciparum
ALYALWEIFEHIVLPVVTSM

SEQ ID NO: 3254429 - protein, 21 aa, Plasmodium falciparum
CGACAPYRRLHLCDYNLEKMG

SEQ ID NO: 3254430 - protein, 27 aa, Plasmodium falciparum
CIRECKSKCDCFKKWVVQKEQEWKQLE

SEQ ID NO: 3254431 - protein, 25 aa, Plasmodium falciparum
CKNDCNTNCKCFENWAKTKENEWKK

SEQ ID NO: 3254432 - protein, 17 aa, Plasmodium falciparum
CSGDGLRCDEKVPDKKD

SEQ ID NO: 3254433 - protein, 19 aa, Plasmodium falciparum
CTMLARSFADIGDIVRGKD

SEQ ID NO: 3254434 - protein, 36 aa, Plasmodium falciparum
CTPGQFKSGHAGACMPPRRIKLCVINLQYLNEKKSP

SEQ ID NO: 3254435 - protein, 25 aa, Plasmodium falciparum
CVPPRRRRLYIKKIVDWAESQSKTV

SEQ ID NO: 3254436 - protein, 18 aa, Plasmodium falciparum
DACTLKYVTGKNYGWKCI

SEQ ID NO: 3254437 - protein, 17 aa, Plasmodium falciparum
DAFYRSDYCQICPECGV

SEQ ID NO: 3254438 - protein, 20 aa, Plasmodium falciparum
DAIPTCVCEKSLADKTEKFC

SEQ ID NO: 3254439 - protein, 20 aa, Plasmodium falciparum
DAIPTCVCEKSLADKVEKGC

SEQ ID NO: 3254440 - protein, 19 aa, Plasmodium falciparum
DCKELRELSTALYDLKIQI

SEQ ID NO: 3254441 - protein, 18 aa, Plasmodium falciparum
DGFDGMLTELSYYVEEYL

SEQ ID NO: 3254442 - protein, 22 aa, Plasmodium falciparum
DILKTTIPFGIALALTSIALLF

SEQ ID NO: 3254443 - protein, 27 aa, Plasmodium falciparum
DKKLEGYKCAENFLKELKHCKPSEDNN

SEQ ID NO: 3254444 - protein, 23 aa, Plasmodium falciparum
DKQFAFNLIVHYFIREKGKDTCE

SEQ ID NO: 3254445 - protein, 17 aa, Plasmodium falciparum
DLLAEVCMAAKYEGDSI

SEQ ID NO: 3254446 - protein, 20 aa, Plasmodium falciparum
DPYLKLRADWWEANRAKVWK

SEQ ID NO: 3254447 - protein, 17 aa, Plasmodium falciparum
DQEGICRAMKYSFADIG

SEQ ID NO: 3254448 - protein, 24 aa, Plasmodium falciparum
DQFLRWLTEWAQQYCKEKLIKAHI

SEQ ID NO: 3254449 - protein, 19 aa, Plasmodium falciparum
DQNRKSCAINNGGCSDDQI

SEQ ID NO: 3254450 - protein, 20 aa, Plasmodium falciparum
DRSVYDFLYELHLQNGGKKG

SEQ ID NO: 3254451 - protein, 17 aa, Plasmodium falciparum
DSIDWSKELKTCINNEK

SEQ ID NO: 3254452 - protein, 19 aa, Plasmodium falciparum
DSIHWKKKLEKCLKNGTKT

SEQ ID NO: 3254453 - protein, 19 aa, Plasmodium falciparum
DSIHWKKKLEKCLQNGTKT

SEQ ID NO: 3254454 - protein, 25 aa, Plasmodium falciparum
DVECKRLFIDYEEWFRYRYNQWKGL

SEQ ID NO: 3254455 - protein, 21 aa, Plasmodium falciparum
EANRAKVWKAMKCKTNGVDIT

SEQ ID NO: 3254456 - protein, 17 aa, Plasmodium falciparum
EDICATVAKALKGDKSL

SEQ ID NO: 3254457 - protein, 17 aa, Plasmodium falciparum
EENIFRFYRTVANEEVQ

SEQ ID NO: 3254458 - protein, 25 aa, Plasmodium falciparum
EFLYKCSKELCNIFKDAIYTCVLVR

SEQ ID NO: 3254459 - protein, 24 aa, Plasmodium falciparum
EGLTVCIICSVLLNCSFYCLYFRN

SEQ ID NO: 3254460 - protein, 23 aa, Plasmodium falciparum
EIKDIIKRYNFHLKHIEKGKEYI

SEQ ID NO: 3254461 - protein, 26 aa, Plasmodium falciparum
EIPTYFRWLHEWGSDFCGKRARMLKD

SEQ ID NO: 3254462 - protein, 18 aa, Plasmodium falciparum
EKCGMCTGKGQGDGKDCT

SEQ ID NO: 3254463 - protein, 17 aa, Plasmodium falciparum
EKGCLRCGCGLGGVAAS

SEQ ID NO: 3254464 - protein, 17 aa, Plasmodium falciparum
EKGCLRCGCGLGSVAGS

SEQ ID NO: 3254465 - protein, 17 aa, Plasmodium falciparum
EKLEEKCGMCTGKGQGD

SEQ ID NO: 3254466 - protein, 24 aa, Plasmodium falciparum
EKTCLKCGGILGGGLEPTVGLLVT

SEQ ID NO: 3254467 - protein, 20 aa, Plasmodium falciparum
EKYFHCIKTAKFIDDDSSDV

SEQ ID NO: 3254468 - protein, 24 aa, Plasmodium falciparum
ENNFFDIFISYVIKNLGTGDMTPE

SEQ ID NO: 3254469 - protein, 20 aa, Plasmodium falciparum
ERYHYFGGRKPVSMKNVRET

SEQ ID NO: 3254470 - protein, 20 aa, Plasmodium falciparum
EWNILPNIDMYEWIPFSSKE

SEQ ID NO: 3254471 - protein, 24 aa, Plasmodium falciparum
FEDKVKYLWLYIEDYLKKYEYQCY

SEQ ID NO: 3254472 - protein, 23 aa, Plasmodium falciparum
FKNEVDKAIKPCGNLTDFKKSKK

SEQ ID NO: 3254473 - protein, 20 aa, Plasmodium falciparum
FMDLECPRCADDCKSYETWV

SEQ ID NO: 3254474 - protein, 18 aa, Plasmodium falciparum
FNDIITRTYVKNIILNIL

SEQ ID NO: 3254475 - protein, 20 aa, Plasmodium falciparum
FRPFFLRCILHLNRKQEVII

SEQ ID NO: 3254476 - protein, 24 aa, Plasmodium falciparum
FYETEFLKALYFYSAIQKNKRDEE

SEQ ID NO: 3254477 - protein, 17 aa, Plasmodium falciparum
FYRSEYCQVCPDCGVKY

SEQ ID NO: 3254478 - protein, 26 aa, Plasmodium falciparum
GAICIPPRRRRLYIQKLQEWAKTVGN

SEQ ID NO: 3254479 - protein, 22 aa, Plasmodium falciparum
GAVPSRPSLQLLSGVGVPGEPG

SEQ ID NO: 3254480 - protein, 24 aa, Plasmodium falciparum
GCSVKCKVYELWLRNQRNEFEKQK

SEQ ID NO: 3254481 - protein, 19 aa, Plasmodium falciparum
GEKCKKCKEQCQIFKELVS

SEQ ID NO: 3254482 - protein, 19 aa, Plasmodium falciparum
GGVTPAWGLISGIVYTGWK

SEQ ID NO: 3254483 - protein, 17 aa, Plasmodium falciparum
GIFGALGTYGWKIAATA

SEQ ID NO: 3254484 - protein, 19 aa, Plasmodium falciparum
GILCMGILYLPNDRNNKVS

SEQ ID NO: 3254485 - protein, 27 aa, Plasmodium falciparum
GKCFIREYLCTEFLRRIKHCCHINYVK

SEQ ID NO: 3254486 - protein, 30 aa, Plasmodium falciparum
GKNKRKITSWKFCKSLILTTLGMLYIFLLK

SEQ ID NO: 3254487 - protein, 18 aa, Plasmodium falciparum
GKTPQEWWKENAKHIWHG

SEQ ID NO: 3254488 - protein, 27 aa, Plasmodium falciparum
GLCIPPRRRRLYVGGLSQWASQRTQGE

SEQ ID NO: 3254489 - protein, 17 aa, Plasmodium falciparum
GLLCGYGAYELVKVAIG

SEQ ID NO: 3254490 - protein, 17 aa, Plasmodium falciparum
GSAEDCKPCSEFKVNCE

SEQ ID NO: 3254491 - protein, 17 aa, Plasmodium falciparum
GSPKYKTLIEVVLEPSK

SEQ ID NO: 3254492 - protein, 30 aa, Plasmodium falciparum
HASIKISHIFKIINIFSCLIKSPSCAPTSI

SEQ ID NO: 3254493 - protein, 28 aa, Plasmodium falciparum
HFDCPSCARHCRSYRKWIERKKTEYEKQ

SEQ ID NO: 3254494 - protein, 23 aa, Plasmodium falciparum
HFLRYIICMLFFFLFAINLFHIS

SEQ ID NO: 3254495 - protein, 24 aa, Plasmodium falciparum
HHLKGDLAKAVFRHPFSAYRPNYG

SEQ ID NO: 3254496 - protein, 22 aa, Plasmodium falciparum
HIRNPNGLCLFESCIPTIGKIE

SEQ ID NO: 3254497 - protein, 25 aa, Plasmodium falciparum
HRNAEDRNPCLFSRAKRFSNEGEAE

SEQ ID NO: 3254498 - protein, 18 aa, Plasmodium falciparum
HVIIEIFGGKCFIREYLC

SEQ ID NO: 3254499 - protein, 38 aa, Plasmodium falciparum
IDDEGIENLILLRSSFFTILVCYLRNNLIKMNKIYTKT

SEQ ID NO: 3254500 - protein, 17 aa, Plasmodium falciparum
IDMYEWIPFSSKEAKVD

SEQ ID NO: 3254501 - protein, 18 aa, Plasmodium falciparum
IFEHIVLPVVTSMLLNGN

SEQ ID NO: 3254502 - protein, 24 aa, Plasmodium falciparum
IFKGSNFWKGLGIYLGTLSGAALG

SEQ ID NO: 3254503 - protein, 23 aa, Plasmodium falciparum
IFYLSLKYDKGFLEKKLNKSKKI

SEQ ID NO: 3254504 - protein, 40 aa, Plasmodium falciparum
IGSAVPLYMSYKLIICICIPKLIFYMLLWMKNLLLHQYKI

SEQ ID NO: 3254505 - protein, 26 aa, Plasmodium falciparum
IIFKGSNFWKGLGIYLGTLSGATLGQ

SEQ ID NO: 3254506 - protein, 26 aa, Plasmodium falciparum
IIFKGSNFWKGLGIYLGTLSGAVLGQ

SEQ ID NO: 3254507 - protein, 26 aa, Plasmodium falciparum
IIRALFKRWLEYFLEDYNKIRKKLKP

SEQ ID NO: 3254508 - protein, 20 aa, Plasmodium falciparum
IKDKSVCTEFVTPLLSLVEK

SEQ ID NO: 3254509 - protein, 25 aa, Plasmodium falciparum
IKECEEFRYHFSFYLLDHTLFLSET

SEQ ID NO: 3254510 - protein, 20 aa, Plasmodium falciparum
IKIKHIFKALSNITLSNFIN

SEQ ID NO: 3254511 - protein, 31 aa, Plasmodium falciparum
IKNIIMFFKRFKGYFKLCRKNMYELSPSLMI

SEQ ID NO: 3254512 - protein, 27 aa, Plasmodium falciparum
IKNKISDIYLLLSIQFIYNYLNTSDDD

SEQ ID NO: 3254513 - protein, 23 aa, Plasmodium falciparum
IKNKNTIKCFLKNNNKIFNCYYI

SEQ ID NO: 3254514 - protein, 24 aa, Plasmodium falciparum
IKYKKKVLVVILWIKIYMSMLEEY

SEQ ID NO: 3254515 - protein, 19 aa, Plasmodium falciparum
ILIWVYHFFWNKADASVDK

SEQ ID NO: 3254516 - protein, 28 aa, Plasmodium falciparum
ILKFFLFKCIFVVIIGILCMGILYLPND

SEQ ID NO: 3254517 - protein, 23 aa, Plasmodium falciparum
ILNIFCVILTFYSIFYTKTVFSK

SEQ ID NO: 3254518 - protein, 19 aa, Plasmodium falciparum
INNFIKVIQHLLFLEKQRD

SEQ ID NO: 3254519 - protein, 25 aa, Plasmodium falciparum
INNNLLKRFFIYLITKFKYTNKNTD

SEQ ID NO: 3254520 - protein, 17 aa, Plasmodium falciparum
INRCFQTNIYPEDIEDN

SEQ ID NO: 3254521 - protein, 24 aa, Plasmodium falciparum
IPDDFKRQMFYTFGDYRDLCLDTD

SEQ ID NO: 3254522 - protein, 17 aa, Plasmodium falciparum
IPFLRLVDNNFRNCKNY

SEQ ID NO: 3254523 - protein, 17 aa, Plasmodium falciparum
IPITRLLCECELYTPAN

SEQ ID NO: 3254524 - protein, 24 aa, Plasmodium falciparum
IPQRLRWMSEWSEYFCNVLNKEID

SEQ ID NO: 3254525 - protein, 26 aa, Plasmodium falciparum
IPQRLRWMTEWAEWYCKAQSQEYKKL

SEQ ID NO: 3254526 - protein, 26 aa, Plasmodium falciparum
IPQRLRWMTEWAEWYCKEQSRLYGEL

SEQ ID NO: 3254527 - protein, 25 aa, Plasmodium falciparum
IPQRLRWMTEWAEWYCKKQSQEYEK

SEQ ID NO: 3254528 - protein, 22 aa, Plasmodium falciparum
IPSCLTLSLLIFFKEHSLNNYK

SEQ ID NO: 3254529 - protein, 23 aa, Plasmodium falciparum
ISFCNIIFFFLELSHEHFVGQSS

SEQ ID NO: 3254530 - protein, 17 aa, Plasmodium falciparum
ITCHAGESDKYFRNTCN

SEQ ID NO: 3254531 - protein, 18 aa, Plasmodium falciparum
ITSDLLIKYEREAYLSMK

SEQ ID NO: 3254532 - protein, 17 aa, Plasmodium falciparum
IWLYRRRKNSWKHECKK

SEQ ID NO: 3254533 - protein, 18 aa, Plasmodium falciparum
IWLYRRRKNSWKHECKKH

SEQ ID NO: 3254534 - protein, 17 aa, Plasmodium falciparum
IWYRWVERHAHMLEKWK

SEQ ID NO: 3254535 - protein, 23 aa, Plasmodium falciparum
IYNISSFNKFKCENINYYVVLSV

SEQ ID NO: 3254536 - protein, 28 aa, Plasmodium falciparum
IYPIFRCIKGKFGYGSIWEENIFRFYRT

SEQ ID NO: 3254537 - protein, 23 aa, Plasmodium falciparum
IYRRNVHALFVLNGFSSQLQDII

SEQ ID NO: 3254538 - protein, 20 aa, Plasmodium falciparum
KCGDFCGIDICTLEKTNNGK

SEQ ID NO: 3254539 - protein, 23 aa, Plasmodium falciparum
KEEYLECKEIFLDTCVDELREQE

SEQ ID NO: 3254540 - protein, 23 aa, Plasmodium falciparum
KEFVKRWLEYFFEDYNRIQKKLK

SEQ ID NO: 3254541 - protein, 22 aa, Plasmodium falciparum
KEGEVLHELVVRLLNHYTSIIN

SEQ ID NO: 3254542 - protein, 23 aa, Plasmodium falciparum
KENYPGWNCTPGQFKSGHAGACM

SEQ ID NO: 3254543 - protein, 31 aa, Plasmodium falciparum
KESSRSISLYKWRSLIKINTEIDLKHGGEVS

SEQ ID NO: 3254544 - protein, 22 aa, Plasmodium falciparum
KEYLKEIIKIISAQDNSEHVKN

SEQ ID NO: 3254545 - protein, 18 aa, Plasmodium falciparum
KEYMDSYLMHLRMQNDIK

SEQ ID NO: 3254546 - protein, 18 aa, Plasmodium falciparum
KGECGACAPYRRRHICDY

SEQ ID NO: 3254547 - protein, 20 aa, Plasmodium falciparum
KHDLLLDVCMAANYEAQSLI

SEQ ID NO: 3254548 - protein, 18 aa, Plasmodium falciparum
KHRCIGGICSCSVGSFLL

SEQ ID NO: 3254549 - protein, 25 aa, Plasmodium falciparum
KIEKGCLMCGCGLGSVAGSVGLFGG

SEQ ID NO: 3254550 - protein, 26 aa, Plasmodium falciparum
KIEKGCLMCGCGLGSVAGSVGLFGGI

SEQ ID NO: 3254551 - protein, 35 aa, Plasmodium falciparum
KKKLANKIKSIICKMEYKVCQIFWEESKIYENCCQ

SEQ ID NO: 3254552 - protein, 20 aa, Plasmodium falciparum
KKKLEKCLQNGTKTRCRNNE

SEQ ID NO: 3254553 - protein, 19 aa, Plasmodium falciparum
KKPYMKRSLINLENDLFRL

SEQ ID NO: 3254554 - protein, 21 aa, Plasmodium falciparum
KKRNFFFLLDFLKSLIDNVEI

SEQ ID NO: 3254555 - protein, 18 aa, Plasmodium falciparum
KLCGNADCKCMDGESKET

SEQ ID NO: 3254556 - protein, 17 aa, Plasmodium falciparum
KNAMLSSTIMWSIGIGF

SEQ ID NO: 3254557 - protein, 24 aa, Plasmodium falciparum
KNIYLAFDCIFSLKVDNNNYNHFF

SEQ ID NO: 3254558 - protein, 18 aa, Plasmodium falciparum
KNNNKIFNCYYIEDKTNF

SEQ ID NO: 3254559 - protein, 18 aa, Plasmodium falciparum
KRFNVGTEWSFKDNHRKR

SEQ ID NO: 3254560 - protein, 26 aa, Plasmodium falciparum
KSENAYEFLYFKGRLNVRRQKDTDKN

SEQ ID NO: 3254561 - protein, 24 aa, Plasmodium falciparum
KTDEINNIFSFFFLFFENLEKYSE

SEQ ID NO: 3254562 - protein, 19 aa, Plasmodium falciparum
KTKHPVDLFSVINIPKSDY

SEQ ID NO: 3254563 - protein, 17 aa, Plasmodium falciparum
KVIKRFISRFIDERDNK

SEQ ID NO: 3254564 - protein, 29 aa, Plasmodium falciparum
KYKSFVFTSFVHRNHCYNLIMDMIYENNN

SEQ ID NO: 3254565 - protein, 21 aa, Plasmodium falciparum
LCLFESCIPTIGKIEYIPPEC

SEQ ID NO: 3254566 - protein, 20 aa, Plasmodium falciparum
LEKTIPFGVALALGSIAFLF

SEQ ID NO: 3254567 - protein, 23 aa, Plasmodium falciparum
LEKWKKEKWFIVLKENWKNEEHK

SEQ ID NO: 3254568 - protein, 25 aa, Plasmodium falciparum
LERQKYIWRKWIAKHLYHIDEWENE

SEQ ID NO: 3254569 - protein, 24 aa, Plasmodium falciparum
LGCYKQCRKYKKWIDIKFVEYHNQ

SEQ ID NO: 3254570 - protein, 18 aa, Plasmodium falciparum
LGLSAWKTTALKVAIEAA

SEQ ID NO: 3254571 - protein, 19 aa, Plasmodium falciparum
LHTTIPFGVALALGSIAFL

SEQ ID NO: 3254572 - protein, 24 aa, Plasmodium falciparum
LKDMYEFLETIDINKILKSIHNSM

SEQ ID NO: 3254573 - protein, 21 aa, Plasmodium falciparum
LKDPYFYAYFFDAHKKMNINK

SEQ ID NO: 3254574 - protein, 17 aa, Plasmodium falciparum
LKFIYSFLEHFKTLKKE

SEQ ID NO: 3254575 - protein, 17 aa, Plasmodium falciparum
LKIKYVDIVSVEKLTIL

SEQ ID NO: 3254576 - protein, 25 aa, Plasmodium falciparum
LKLLLFKKLILMNASLKYKDEINIL

SEQ ID NO: 3254577 - protein, 18 aa, Plasmodium falciparum
LKNAMLSSTIMWSIGIGF

SEQ ID NO: 3254578 - protein, 27 aa, Plasmodium falciparum
LKVKSFCFNYIYSFRPFFLRCILHLNR

SEQ ID NO: 3254579 - protein, 17 aa, Plasmodium falciparum
LLVNLTLLYVQKIKDKS

SEQ ID NO: 3254580 - protein, 34 aa, Plasmodium falciparum
LNCEKKRINDMLIVKLIIYFYFPIIGSFHNAIYF

SEQ ID NO: 3254581 - protein, 22 aa, Plasmodium falciparum
LREDWWALNRDQVWKALTCSDD

SEQ ID NO: 3254582 - protein, 27 aa, Plasmodium falciparum
LREDWWTANRATVWKAITCKADTGNAY

SEQ ID NO: 3254583 - protein, 36 aa, Plasmodium falciparum
LREFPSPELKNAMLFSTILWMVGIGFAAFTYFFLKK

SEQ ID NO: 3254584 - protein, 21 aa, Plasmodium falciparum
LSSTIMWSVGIGFAAFTYFFL

SEQ ID NO: 3254585 - protein, 23 aa, Plasmodium falciparum
LTCIYLKGVSLWSIAISIICKNV

SEQ ID NO: 3254586 - protein, 17 aa, Plasmodium falciparum
LYVKYSLEKFFSTQKIY

SEQ ID NO: 3254587 - protein, 22 aa, Plasmodium falciparum
MCVECLYKFLFKKYPLYKKYLL

SEQ ID NO: 3254588 - protein, 25 aa, Plasmodium falciparum
MEKECLKCAQNLGGIVAPSTGVLGE

SEQ ID NO: 3254589 - protein, 23 aa, Plasmodium falciparum
MLLRIIVYILEFIELMILVVTVI

SEQ ID NO: 3254590 - protein, 22 aa, Plasmodium falciparum
MLSSTIMWSIGIGFATFTYFYL

SEQ ID NO: 3254591 - protein, 24 aa, Plasmodium falciparum
MRICDFAKCTPRYTYNLRHIRNPN

SEQ ID NO: 3254592 - protein, 24 aa, Plasmodium falciparum
MTLSEHLLEYAMDVLKANPQKPID

SEQ ID NO: 3254593 - protein, 21 aa, Plasmodium falciparum
NARINLKIKFIVKSIVKVITK

SEQ ID NO: 3254594 - protein, 18 aa, Plasmodium falciparum
NEDLRKIWTNTLTVAKGG

SEQ ID NO: 3254595 - protein, 28 aa, Plasmodium falciparum
NFESIAFIKLMLSFFIELDIFMENIYLQ

SEQ ID NO: 3254596 - protein, 27 aa, Plasmodium falciparum
NFLRGLFCSFCIAVIFIISLILNIQNT

SEQ ID NO: 3254597 - protein, 22 aa, Plasmodium falciparum
NFSYCFSIFSAIWITAVLEYHF

SEQ ID NO: 3254598 - protein, 20 aa, Plasmodium falciparum
NIFFQLRMGFTLEKNYGIMK

SEQ ID NO: 3254599 - protein, 28 aa, Plasmodium falciparum
NILKTLKLRLEVFLNYIYNLCNNIYKKI

SEQ ID NO: 3254600 - protein, 20 aa, Plasmodium falciparum
NIQLKKIFIQNVIKEINKEY

SEQ ID NO: 3254601 - protein, 25 aa, Plasmodium falciparum
NITKCDLCKGAFLYANMKFDEVPSM

SEQ ID NO: 3254602 - protein, 25 aa, Plasmodium falciparum
NLLKTELSHLLSLKENIIKKLLNHI

SEQ ID NO: 3254603 - protein, 26 aa, Plasmodium falciparum
NNFRNCKNYDFCKSLSSSNESSMNSN

SEQ ID NO: 3254604 - protein, 18 aa, Plasmodium falciparum
NNNLYLLRVNEVKSTPID

SEQ ID NO: 3254605 - protein, 35 aa, Plasmodium falciparum
NNPKLSDFVLRPTYFRYLEEWGESFCGTRKRMLEQ

SEQ ID NO: 3254606 - protein, 19 aa, Plasmodium falciparum
NPLLQRQKIIWRKWIAKNL

SEQ ID NO: 3254607 - protein, 25 aa, Plasmodium falciparum
NPSKYCKACPVYGVKYIGGNYIPNE

SEQ ID NO: 3254608 - protein, 24 aa, Plasmodium falciparum
NRKQEVIIHRLFFLLMVVKIKPLW

SEQ ID NO: 3254609 - protein, 24 aa, Plasmodium falciparum
NSLFKDSYLFKSVRDQNWECKFEN

SEQ ID NO: 3254610 - protein, 18 aa, Plasmodium falciparum
NSLKKFFIYLSFFTFGNN

SEQ ID NO: 3254611 - protein, 22 aa, Plasmodium falciparum
NSRLGWKCIPTSGGEKATGGSG

SEQ ID NO: 3254612 - protein, 23 aa, Plasmodium falciparum
NTSPLLIKLCTSFDKNMEEILSL

SEQ ID NO: 3254613 - protein, 23 aa, Plasmodium falciparum
NVKKEWCVKELNFMKNILKLNFY

SEQ ID NO: 3254614 - protein, 20 aa, Plasmodium falciparum
NWINEMLKDSIDWSKELKTC

SEQ ID NO: 3254615 - protein, 18 aa, Plasmodium falciparum
NYGCNGGLINNAFEDMIE

SEQ ID NO: 3254616 - protein, 27 aa, Plasmodium falciparum
NYYKLREAWWALNRKDVWKALTCSAPR

SEQ ID NO: 3254617 - protein, 19 aa, Plasmodium falciparum
PDLPPALKNAMLSSTIMWS

SEQ ID NO: 3254618 - protein, 23 aa, Plasmodium falciparum
PEDFKRQMFYTLGDYRDILVGDK

SEQ ID NO: 3254619 - protein, 23 aa, Plasmodium falciparum
PEEFKRQMFYTLGDYKDIFEGKS

SEQ ID NO: 3254620 - protein, 22 aa, Plasmodium falciparum
PGSPKYKTLIEVVLEPSGNNTT

SEQ ID NO: 3254621 - protein, 22 aa, Plasmodium falciparum
PGSPKYKTLIEVVLEPSKRDTQ

SEQ ID NO: 3254622 - protein, 17 aa, Plasmodium falciparum
PKYKMFIEVVLEPLNRD

SEQ ID NO: 3254623 - protein, 23 aa, Plasmodium falciparum
PLITRLYLILSFALMVLCSLDII

SEQ ID NO: 3254624 - protein, 17 aa, Plasmodium falciparum
PMVISFIVVVIIVIILL

SEQ ID NO: 3254625 - protein, 19 aa, Plasmodium falciparum
PPLGLPRSYPLSLVLEHKF

SEQ ID NO: 3254626 - protein, 17 aa, Plasmodium falciparum
QFLRWFTEWSDEFCTER

SEQ ID NO: 3254627 - protein, 25 aa, Plasmodium falciparum
QGHIPPDFLRLMFYTLADYRDICIG

SEQ ID NO: 3254628 - protein, 25 aa, Plasmodium falciparum
QKYGPKAPTSWKCVPTTGDKDGATG

SEQ ID NO: 3254629 - protein, 24 aa, Plasmodium falciparum
QMKCLDIFYTFCSFDDNIVNIILT

SEQ ID NO: 3254630 - protein, 19 aa, Plasmodium falciparum
QPLTLLRPGVLGNGLQSPQ

SEQ ID NO: 3254631 - protein, 17 aa, Plasmodium falciparum
QPNSGKTPQEWWKENAK

SEQ ID NO: 3254632 - protein, 22 aa, Plasmodium falciparum
QRKPWWGKNAEAIWDGMLCALS

SEQ ID NO: 3254633 - protein, 18 aa, Plasmodium falciparum
QRQKIIWRKWIAKNLYHI

SEQ ID NO: 3254634 - protein, 19 aa, Plasmodium falciparum
QYSYLEMIRKYYAQEKPVQ

SEQ ID NO: 3254635 - protein, 19 aa, Plasmodium falciparum
RACTTYKTWLKNWKTQYKT

SEQ ID NO: 3254636 - protein, 25 aa, Plasmodium falciparum
RAPFSCFYLFYLMISRRLPKIKRIN

SEQ ID NO: 3254637 - protein, 24 aa, Plasmodium falciparum
REKALKLLVTFFFNNTLFSNTHTH

SEQ ID NO: 3254638 - protein, 20 aa, Plasmodium falciparum
RHVKNLYKYHNIYNINNKLM

SEQ ID NO: 3254639 - protein, 20 aa, Plasmodium falciparum
RIIKIYRFVINFIKKHTKEK

SEQ ID NO: 3254640 - protein, 27 aa, Plasmodium falciparum
RKEEWKCRNECGLDVCGLKKGDNNGKL

SEQ ID NO: 3254641 - protein, 18 aa, Plasmodium falciparum
RKENELFGTNHVKQTSIH

SEQ ID NO: 3254642 - protein, 21 aa, Plasmodium falciparum
RKKWLWKTIIEIHMLILEEQR

SEQ ID NO: 3254643 - protein, 17 aa, Plasmodium falciparum
RLGWKCIPTSGDKTDTS

SEQ ID NO: 3254644 - protein, 27 aa, Plasmodium falciparum
RLIRRKFLNLLSITGILLVVVLNNIII

SEQ ID NO: 3254645 - protein, 18 aa, Plasmodium falciparum
RLNEIFMDLECPRCADDC

SEQ ID NO: 3254646 - protein, 22 aa, Plasmodium falciparum
RLSKLLINFRFFEFFLILFYGS

SEQ ID NO: 3254647 - protein, 24 aa, Plasmodium falciparum
RPFEFCALECIFSSALEHLNAEMK

SEQ ID NO: 3254648 - protein, 25 aa, Plasmodium falciparum
RPPYFRYLEEWGQNFCKKRTEMLGK

SEQ ID NO: 3254649 - protein, 25 aa, Plasmodium falciparum
RSNVKEIFMFFFFKNNIIIQKIITL

SEQ ID NO: 3254650 - protein, 23 aa, Plasmodium falciparum
SDAIPTCVCEKSIADKMEKECLR

SEQ ID NO: 3254651 - protein, 22 aa, Plasmodium falciparum
SDAIPTCVCEKSLADKVEKGCL

SEQ ID NO: 3254652 - protein, 23 aa, Plasmodium falciparum
SDFSMCTMLARSFADIGDIIRGK

SEQ ID NO: 3254653 - protein, 24 aa, Plasmodium falciparum
SDPEYRKHLEIFYKILTNTDPNDD

SEQ ID NO: 3254654 - protein, 21 aa, Plasmodium falciparum
SEYHPGISPHFYTLLYEPLDY

SEQ ID NO: 3254655 - protein, 19 aa, Plasmodium falciparum
SIGLFGAVAINIWKPAALD

SEQ ID NO: 3254656 - protein, 24 aa, Plasmodium falciparum
SLIFGEQINECFLHKILSNELKDP

SEQ ID NO: 3254657 - protein, 24 aa, Plasmodium falciparum
SPEELRKAFIQCAAIETYWLWQKY

SEQ ID NO: 3254658 - protein, 17 aa, Plasmodium falciparum
SPNEMKERFQVFLQNAH

SEQ ID NO: 3254659 - protein, 20 aa, Plasmodium falciparum
SRLGWKCVTPSGDQKATSEG

SEQ ID NO: 3254660 - protein, 25 aa, Plasmodium falciparum
SVNFYKYGIIYGFKVNKEILKEVVD

SEQ ID NO: 3254661 - protein, 21 aa, Plasmodium falciparum
TCLKCGGVLGGAVPELGLLCG

SEQ ID NO: 3254662 - protein, 22 aa, Plasmodium falciparum
TCLKCGGVLGGAVPELGLLCGY

SEQ ID NO: 3254663 - protein, 25 aa, Plasmodium falciparum
TCLKCGGVLGGGVTPAWGLISGIVY

SEQ ID NO: 3254664 - protein, 29 aa, Plasmodium falciparum
TCLKCGGVLGGGVTPAWGLLSGIVYTGWK

SEQ ID NO: 3254665 - protein, 20 aa, Plasmodium falciparum
TCLNCGGILGTVVPGWGILG

SEQ ID NO: 3254666 - protein, 19 aa, Plasmodium falciparum
TDFLRQMFYTLGDYRDILF

SEQ ID NO: 3254667 - protein, 24 aa, Plasmodium falciparum
TEKFCLNCGVQLGGGVLQASGLLG

SEQ ID NO: 3254668 - protein, 19 aa, Plasmodium falciparum
TELARSFADIGDIVRGRDL

SEQ ID NO: 3254669 - protein, 19 aa, Plasmodium falciparum
THRTLCECELYAPSNYEND

SEQ ID NO: 3254670 - protein, 24 aa, Plasmodium falciparum
TISIMKLLFCLVYILNRNEEFFID

SEQ ID NO: 3254671 - protein, 26 aa, Plasmodium falciparum
TKYGPKAPTSWKCIPSGDKAATSGEG

SEQ ID NO: 3254672 - protein, 24 aa, Plasmodium falciparum
TNRKEVKECVGVHLNRTCLYQENN

SEQ ID NO: 3254673 - protein, 20 aa, Plasmodium falciparum
TNTSLVEWVFDYISNTKYEN

SEQ ID NO: 3254674 - protein, 25 aa, Plasmodium falciparum
TPEKFKKACKCKIPNPLEKCPNEEN

SEQ ID NO: 3254675 - protein, 17 aa, Plasmodium falciparum
TTIPFGIALALGSIAFL

SEQ ID NO: 3254676 - protein, 23 aa, Plasmodium falciparum
TTQTCLWTYLAILNVYDQKYIFS

SEQ ID NO: 3254677 - protein, 25 aa, Plasmodium falciparum
VEKCCLICGCGLGGGVAPFVGLFGG

SEQ ID NO: 3254678 - protein, 25 aa, Plasmodium falciparum
VEKGCLRCGCGLGGVAAGVGIFGAL

SEQ ID NO: 3254679 - protein, 24 aa, Plasmodium falciparum
VEKGCLRCGYGLGTVAPTVGLIGS

SEQ ID NO: 3254680 - protein, 25 aa, Plasmodium falciparum
VFNEFFQRWLRYFVQDYNKLKDKIN

SEQ ID NO: 3254681 - protein, 17 aa, Plasmodium falciparum
VGGLSQWASQRTQGETS

SEQ ID NO: 3254682 - protein, 18 aa, Plasmodium falciparum
VGLFGGIAINIWKNVALD

SEQ ID NO: 3254683 - protein, 17 aa, Plasmodium falciparum
VGTEWSFKDNHRKRTHP

SEQ ID NO: 3254684 - protein, 25 aa, Plasmodium falciparum
VKNGFRLKIGTPWTNIVQKKKKKSY

SEQ ID NO: 3254685 - protein, 18 aa, Plasmodium falciparum
VLCSLDIISPLSLYLNWN

SEQ ID NO: 3254686 - protein, 20 aa, Plasmodium falciparum
VPFDFSYKDATALIDIKNKN

SEQ ID NO: 3254687 - protein, 23 aa, Plasmodium falciparum
VPGSPKYKTLIEVVLEPSKSNGN

SEQ ID NO: 3254688 - protein, 25 aa, Plasmodium falciparum
VPQYLRWFEEWAEDFCRIRKHKLKN

SEQ ID NO: 3254689 - protein, 22 aa, Plasmodium falciparum
VPQYLRWFEEWAEDFCRKKKKY

SEQ ID NO: 3254690 - protein, 22 aa, Plasmodium falciparum
VPQYLRWFEEWAEDFCRKRKHK

SEQ ID NO: 3254691 - protein, 21 aa, Plasmodium falciparum
VPRAPKYKTLIEVVLEPSGNN

SEQ ID NO: 3254692 - protein, 24 aa, Plasmodium falciparum
VQILKVCFYISFILFTLYVLPKKL

SEQ ID NO: 3254693 - protein, 25 aa, Plasmodium falciparum
VRPTYFRWLEEWGEEFCRKQKHKLY

SEQ ID NO: 3254694 - protein, 17 aa, Plasmodium falciparum
VSVPRLSVSEFENNDDV

SEQ ID NO: 3254695 - protein, 26 aa, Plasmodium falciparum
VVEKPCDKEKLWGCTGDNLKEGEDPG

SEQ ID NO: 3254696 - protein, 17 aa, Plasmodium falciparum
VWKAMKCKTNGVDITCD

SEQ ID NO: 3254697 - protein, 17 aa, Plasmodium falciparum
WEIFEHIVLPVVTSMLL

SEQ ID NO: 3254698 - protein, 20 aa, Plasmodium falciparum
WLEDFIEGYYILKKRKVFEQ

SEQ ID NO: 3254699 - protein, 18 aa, Plasmodium falciparum
WLLCKYICVNIIVIILII

SEQ ID NO: 3254700 - protein, 18 aa, Plasmodium falciparum
WNDFKIECVKKIACEDSV

SEQ ID NO: 3254701 - protein, 26 aa, Plasmodium falciparum
YASRSIYVIDLFIKHEIINPSDGKNF

SEQ ID NO: 3254702 - protein, 17 aa, Plasmodium falciparum
YDGVICLLDNLKNIIKT

SEQ ID NO: 3254703 - protein, 25 aa, Plasmodium falciparum
YDTTRSLIVYKEIKSGIQSVNDKYK

SEQ ID NO: 3254704 - protein, 30 aa, Plasmodium falciparum
YEEWFRYRYNQWKGLSEKYIKIKKSKNSGV

SEQ ID NO: 3254705 - protein, 18 aa, Plasmodium falciparum
YEYERYHYFGGRKPVSMK

SEQ ID NO: 3254706 - protein, 17 aa, Plasmodium falciparum
YFMSLIFIMLSYIMIEI

SEQ ID NO: 3254707 - protein, 17 aa, Plasmodium falciparum
YGKTFVFSNYFMLASKM

SEQ ID NO: 3254708 - protein, 20 aa, Plasmodium falciparum
YGVFNKYFINYAIIKLKEIT

SEQ ID NO: 3254709 - protein, 18 aa, Plasmodium falciparum
YIFFILFHTFILSNTNIP

SEQ ID NO: 3254710 - protein, 24 aa, Plasmodium falciparum
YLDIYTCKEAILFTTSFYKDLDKS

SEQ ID NO: 3254711 - protein, 20 aa, Plasmodium falciparum
YLRIITLKLLVNLTLLYVQK

SEQ ID NO: 3254712 - protein, 25 aa, Plasmodium falciparum
YNDFFYYWVAHMLKDSIHWKKKLEK

SEQ ID NO: 3254713 - protein, 24 aa, Plasmodium falciparum
YNELSNPILLNFMLLTNIQKEKNI

SEQ ID NO: 3254714 - protein, 30 aa, Plasmodium falciparum
YNIFKVGLCLHPLCYVNSFKNFSLLYNYLI

SEQ ID NO: 3254715 - protein, 20 aa, Plasmodium falciparum
YPCANRSPVRFSDESRSQCT

SEQ ID NO: 3254716 - protein, 29 aa, Plasmodium falciparum
YPLYKKYLLFKSINNLFCIKECEEFRYHF

SEQ ID NO: 3254717 - protein, 25 aa, Plasmodium falciparum
YTILSRLSNHFSFTKNSVLKEKDNF

SEQ ID NO: 3254718 - protein, 18 aa, Plasmodium falciparum
YTLFPNWINEMLKDSIDW

SEQ ID NO: 3254719 - protein, 25 aa, Plasmodium falciparum
YTTFKVLLIYWLEDFIEGYYILKKR

SEQ ID NO: 3254720 - protein, 22 aa, Plasmodium falciparum
YVPQFLRWFEEWAEDFCRKKKK

SEQ ID NO: 3254721 - protein, 16 aa, Plasmodium falciparum
DILHKLNEEWTIEHNE

SEQ ID NO: 3254722 - protein, 17 aa, Plasmodium falciparum
AAAETFVLWQNYNSKND

SEQ ID NO: 3254723 - protein, 19 aa, Plasmodium falciparum
AACPLIGTVTLPYIARTIN

SEQ ID NO: 3254724 - protein, 23 aa, Plasmodium falciparum
AACVFSIAYLWAISETDQTTSYT

SEQ ID NO: 3254725 - protein, 19 aa, Plasmodium falciparum
AADPEYRKHINVLYQILTH

SEQ ID NO: 3254726 - protein, 23 aa, Plasmodium falciparum
AADPEYRKHLNVLYQILNNTDPN

SEQ ID NO: 3254727 - protein, 18 aa, Plasmodium falciparum
AADYSFRESRVLAEGKST

SEQ ID NO: 3254728 - protein, 21 aa, Plasmodium falciparum
AAHGYAGIFFVLFTLIQFFKN

SEQ ID NO: 3254729 - protein, 27 aa, Plasmodium falciparum
AAIAPWWGLVCGSGYAGWLHSAMAAAI

SEQ ID NO: 3254730 - protein, 19 aa, Plasmodium falciparum
AAICPHAGYDYALETNSHV

SEQ ID NO: 3254731 - protein, 37 aa, Plasmodium falciparum
AAIISLILFCCSVFSAGGAFVGLGYVLLGWYILSCLK

SEQ ID NO: 3254732 - protein, 18 aa, Plasmodium falciparum
AAILDDWASLLKSVDQPE

SEQ ID NO: 3254733 - protein, 27 aa, Plasmodium falciparum
AAINALSFLLMCFYHTVNYNGTNKSYI

SEQ ID NO: 3254734 - protein, 33 aa, Plasmodium falciparum
AALGKGTCFPFSFKGRFAHILYIFMTFTYIHYK

SEQ ID NO: 3254735 - protein, 21 aa, Plasmodium falciparum
AARIYRYIVILLIHNLKNTNL

SEQ ID NO: 3254736 - protein, 18 aa, Plasmodium falciparum
AAVETFFLWDRYKKEKEK

SEQ ID NO: 3254737 - protein, 18 aa, Plasmodium falciparum
AAYELSHNPRYVCDKGNY

SEQ ID NO: 3254738 - protein, 25 aa, Plasmodium falciparum
ACADKFMLGVLFIWIWTSGNLWVCS

SEQ ID NO: 3254739 - protein, 17 aa, Plasmodium falciparum
ACAPYRRLHLCNKNFPN

SEQ ID NO: 3254740 - protein, 22 aa, Plasmodium falciparum
ACAPYRRLHVCDQNLEQIRPEQ

SEQ ID NO: 3254741 - protein, 20 aa, Plasmodium falciparum
ACAPYRRLSLCNKNMEKMGR

SEQ ID NO: 3254742 - protein, 24 aa, Plasmodium falciparum
ACEYIYKIYLIYKTMMNVKKSFSY

SEQ ID NO: 3254743 - protein, 25 aa, Plasmodium falciparum
ACIHANVIIHLCLYIIKAKVNSIYY

SEQ ID NO: 3254744 - protein, 20 aa, Plasmodium falciparum
ACKCKDRQPELVTEKKKDDE

SEQ ID NO: 3254745 - protein, 25 aa, Plasmodium falciparum
ACKTFEYKFGIFIEGSRKPGPPAYN

SEQ ID NO: 3254746 - protein, 17 aa, Plasmodium falciparum
ACLQLKSTILGKYHYLL

SEQ ID NO: 3254747 - protein, 24 aa, Plasmodium falciparum
ACMPPRRQKLCVINLQYFKGKTTV

SEQ ID NO: 3254748 - protein, 18 aa, Plasmodium falciparum
ACTLNECEKVLIITKDGN

SEQ ID NO: 3254749 - protein, 20 aa, Plasmodium falciparum
ACYLLNYFLKYYDNNKNEFF

SEQ ID NO: 3254750 - protein, 17 aa, Plasmodium falciparum
ACYTCQHYSRAYLHHLY

SEQ ID NO: 3254751 - protein, 18 aa, Plasmodium falciparum
ADCLLNICRIIVLKSNEE

SEQ ID NO: 3254752 - protein, 18 aa, Plasmodium falciparum
ADEKTKCEILEKNNKSFF

SEQ ID NO: 3254753 - protein, 18 aa, Plasmodium falciparum
ADELFVMDSINNCNNMNV

SEQ ID NO: 3254754 - protein, 17 aa, Plasmodium falciparum
ADGYKLYMTCPHVKFLN

SEQ ID NO: 3254755 - protein, 19 aa, Plasmodium falciparum
ADIPLNFLSRSKHFDSLSV

SEQ ID NO: 3254756 - protein, 22 aa, Plasmodium falciparum
ADIYMLGILFIWISSNRYLWGN

SEQ ID NO: 3254757 - protein, 33 aa, Plasmodium falciparum
ADIYSAALILLELLCPRFTTIMERYKRLNDFRN

SEQ ID NO: 3254758 - protein, 22 aa, Plasmodium falciparum
ADKFMLGIFFIWVWNNNYIWEK

SEQ ID NO: 3254759 - protein, 31 aa, Plasmodium falciparum
ADKIASIFIPFILILCIVVFFIWFILTFFDI

SEQ ID NO: 3254760 - protein, 18 aa, Plasmodium falciparum
ADKYMLGIFFIFLWNDGY

SEQ ID NO: 3254761 - protein, 26 aa, Plasmodium falciparum
ADKYMLGILYIWIWNNNYIWKRADPS

SEQ ID NO: 3254762 - protein, 19 aa, Plasmodium falciparum
ADLAQLCFEAAIQCIKEHI

SEQ ID NO: 3254763 - protein, 26 aa, Plasmodium falciparum
ADLKCPGCGRECRKYKKWIERKKIEF

SEQ ID NO: 3254764 - protein, 66 aa, Plasmodium falciparum
ADLTYNEIFFLIFIYFIKIICMFGKYVIQVILFISFFIYIYFKKKPYKTICTTVLVSFPVLLFCLS

SEQ ID NO: 3254765 - protein, 17 aa, Plasmodium falciparum
ADNKNIWEKINLNKNQN

SEQ ID NO: 3254766 - protein, 29 aa, Plasmodium falciparum
ADNLLKLFIPRFISVVSYSFEQKFISNIN

SEQ ID NO: 3254767 - protein, 19 aa, Plasmodium falciparum
ADQNLRVCEKYCLYHNFIL

SEQ ID NO: 3254768 - protein, 24 aa, Plasmodium falciparum
ADSKVRYYVCESLYNLCKVSRKYI

SEQ ID NO: 3254769 - protein, 19 aa, Plasmodium falciparum
ADTQLGYFFYINDEKLYPS

SEQ ID NO: 3254770 - protein, 19 aa, Plasmodium falciparum
ADVAWSFALYLESVCVLPQ

SEQ ID NO: 3254771 - protein, 20 aa, Plasmodium falciparum
ADVAWSFALYLESVCVLPQL

SEQ ID NO: 3254772 - protein, 27 aa, Plasmodium falciparum
ADVSRRRIDFYFPFFFENTTNVCLYVN

SEQ ID NO: 3254773 - protein, 24 aa, Plasmodium falciparum
ADYKEDIINFFIYLIHLLYEKKKN

SEQ ID NO: 3254774 - protein, 22 aa, Plasmodium falciparum
AEANLHILEFFSILKNKDKIKD

SEQ ID NO: 3254775 - protein, 17 aa, Plasmodium falciparum
AEAQFLLLLISNNPFVF

SEQ ID NO: 3254776 - protein, 21 aa, Plasmodium falciparum
AECLQYLLFYIIENNYMYNNR

SEQ ID NO: 3254777 - protein, 18 aa, Plasmodium falciparum
AEDIIKEIMDIYSNKNND

SEQ ID NO: 3254778 - protein, 24 aa, Plasmodium falciparum
AEEGEYPLSMFLHDLIEIDMESNF

SEQ ID NO: 3254779 - protein, 26 aa, Plasmodium falciparum
AEEIYLFEWYCLGINYNLIENNNQYK

SEQ ID NO: 3254780 - protein, 24 aa, Plasmodium falciparum
AEEVPSHIMFKENVTEEVPKEVKY

SEQ ID NO: 3254781 - protein, 20 aa, Plasmodium falciparum
AEGALYVWRDAEIVAAIAAA

SEQ ID NO: 3254782 - protein, 19 aa, Plasmodium falciparum
AEGCKWKYGKMSQGGTEWD

SEQ ID NO: 3254783 - protein, 17 aa, Plasmodium falciparum
AEILCIYSSNAFEKIRK

SEQ ID NO: 3254784 - protein, 22 aa, Plasmodium falciparum
AEIYILNYFYFYIISLIYNKDI

SEQ ID NO: 3254785 - protein, 22 aa, Plasmodium falciparum
AEKERLCESVIWEMLQSYYKKA

SEQ ID NO: 3254786 - protein, 25 aa, Plasmodium falciparum
AEKGCLRCGYGLGSVAPMIGLTGSV

SEQ ID NO: 3254787 - protein, 18 aa, Plasmodium falciparum
AEKSKFKRYFSNSEESIK

SEQ ID NO: 3254788 - protein, 17 aa, Plasmodium falciparum
AELEMLIWNNIYNLLLI

SEQ ID NO: 3254789 - protein, 19 aa, Plasmodium falciparum
AENYHFSTYMGFDRRSFLP

SEQ ID NO: 3254790 - protein, 19 aa, Plasmodium falciparum
AEPIFDCILFTLIFFIIYV

SEQ ID NO: 3254791 - protein, 25 aa, Plasmodium falciparum
AERHPFFRWFIEWTDEFCQEQKKEY

SEQ ID NO: 3254792 - protein, 23 aa, Plasmodium falciparum
AERIVKSVFRFNIRKKRKLYQND

SEQ ID NO: 3254793 - protein, 18 aa, Plasmodium falciparum
AETFLKYFTSGYLLNEII

SEQ ID NO: 3254794 - protein, 17 aa, Plasmodium falciparum
AEVKRIVYQDENVLENN

SEQ ID NO: 3254795 - protein, 19 aa, Plasmodium falciparum
AFAKKAAVASLVYYGEAFQ

SEQ ID NO: 3254796 - protein, 18 aa, Plasmodium falciparum
AFATSRISLLKIIYERSC

SEQ ID NO: 3254797 - protein, 23 aa, Plasmodium falciparum
AFFICKFLFFYYIYKKPILPFDS

SEQ ID NO: 3254798 - protein, 19 aa, Plasmodium falciparum
AFFILPRFSKSSITAAGKI

SEQ ID NO: 3254799 - protein, 19 aa, Plasmodium falciparum
AFFSYGISALFLILISVIF

SEQ ID NO: 3254800 - protein, 22 aa, Plasmodium falciparum
AFFSYGISAVFLILISVIFVLL

SEQ ID NO: 3254801 - protein, 17 aa, Plasmodium falciparum
AFGPYGIAIYVIIAIIV

SEQ ID NO: 3254802 - protein, 20 aa, Plasmodium falciparum
AFIDMTLYVMRTWGIHIKVN

SEQ ID NO: 3254803 - protein, 23 aa, Plasmodium falciparum
AFIKCAGAEIFLLWQKYKTDNNS

SEQ ID NO: 3254804 - protein, 27 aa, Plasmodium falciparum
AFINFLRYVCLMVYVIGFLNVFLDNSY

SEQ ID NO: 3254805 - protein, 20 aa, Plasmodium falciparum
AFIRRYYKSRLLSDVSYKNN

SEQ ID NO: 3254806 - protein, 17 aa, Plasmodium falciparum
AFIYLLWRKIRPSKKKT

SEQ ID NO: 3254807 - protein, 20 aa, Plasmodium falciparum
AFLLLPIFLIMIFIPSDKIN

SEQ ID NO: 3254808 - protein, 27 aa, Plasmodium falciparum
AFLSLLLCSSLFILIAISGSIYCYKFN

SEQ ID NO: 3254809 - protein, 19 aa, Plasmodium falciparum
AFLTWEIVLLIVHILIYLV

SEQ ID NO: 3254810 - protein, 17 aa, Plasmodium falciparum
AFMKKSLIIYSKMFSNT

SEQ ID NO: 3254811 - protein, 30 aa, Plasmodium falciparum
AFREDVWTCGKVCGYNVCKPVKVNGETFDA

SEQ ID NO: 3254812 - protein, 21 aa, Plasmodium falciparum
AFRELQFIKLRDRTRPRKHVN

SEQ ID NO: 3254813 - protein, 17 aa, Plasmodium falciparum
AFRVKSYFVDQGLFDND

SEQ ID NO: 3254814 - protein, 27 aa, Plasmodium falciparum
AFSSFLKCYYKCFLILNLKLYENNMFK

SEQ ID NO: 3254815 - protein, 17 aa, Plasmodium falciparum
AFTDMFGILLATAACCF

SEQ ID NO: 3254816 - protein, 19 aa, Plasmodium falciparum
AFTPATNCKPCPEFKINCK

SEQ ID NO: 3254817 - protein, 22 aa, Plasmodium falciparum
AFVKLWVEYFFEDYKKIKHKIS

SEQ ID NO: 3254818 - protein, 29 aa, Plasmodium falciparum
AFYEKNYKLACVYFRKGLIQLDYSFPDTN

SEQ ID NO: 3254819 - protein, 18 aa, Plasmodium falciparum
AFYILNWIYRYFFDDKPY

SEQ ID NO: 3254820 - protein, 22 aa, Plasmodium falciparum
AFYNLLCFRITYKNNSVLSEES

SEQ ID NO: 3254821 - protein, 29 aa, Plasmodium falciparum
AFYPVPKVQAAVMKIIFKNHESYYKHINC

SEQ ID NO: 3254822 - protein, 22 aa, Plasmodium falciparum
AFYTLIFHNFIFQYKENEIQFA

SEQ ID NO: 3254823 - protein, 23 aa, Plasmodium falciparum
AGETRMKFSYGKQHRKQKKKKKN

SEQ ID NO: 3254824 - protein, 17 aa, Plasmodium falciparum
AGGACAPFRRQNMCDKN

SEQ ID NO: 3254825 - protein, 19 aa, Plasmodium falciparum
AGGIPRSIYTINLGFNKCP

SEQ ID NO: 3254826 - protein, 18 aa, Plasmodium falciparum
AGGVECFSDLAGTISSAA

SEQ ID NO: 3254827 - protein, 23 aa, Plasmodium falciparum
AGHGKFTYLILRALSKYKKYFKS

SEQ ID NO: 3254828 - protein, 18 aa, Plasmodium falciparum
AGHIPIMIMSNLCNLSNL

SEQ ID NO: 3254829 - protein, 24 aa, Plasmodium falciparum
AGKPEYIVNFFFMLAEEVREYLAS

SEQ ID NO: 3254830 - protein, 29 aa, Plasmodium falciparum
AGLHNLCPRRILSILLFFYEQNIESEKQL

SEQ ID NO: 3254831 - protein, 17 aa, Plasmodium falciparum
AGRRGCFNLNDFIYNKE

SEQ ID NO: 3254832 - protein, 26 aa, Plasmodium falciparum
AGSICACCLSVGLSVNKCYFLIENII

SEQ ID NO: 3254833 - protein, 19 aa, Plasmodium falciparum
AGSLSLWTSVCPEACRDAI

SEQ ID NO: 3254834 - protein, 21 aa, Plasmodium falciparum
AGSPRLSWVLGEFLPIQHSIF

SEQ ID NO: 3254835 - protein, 19 aa, Plasmodium falciparum
AGTTFCAIHSLKLLKNEKG

SEQ ID NO: 3254836 - protein, 22 aa, Plasmodium falciparum
AHADMIQCYLVYGAPILYALNI

SEQ ID NO: 3254837 - protein, 23 aa, Plasmodium falciparum
AHGSCPNYGKAIIVQNLLGEEYD

SEQ ID NO: 3254838 - protein, 26 aa, Plasmodium falciparum
AHIGEFIGCLIFKFYKYKDTNNENNA

SEQ ID NO: 3254839 - protein, 22 aa, Plasmodium falciparum
AHIKNKLLLNAIRKYKKHNNHK

SEQ ID NO: 3254840 - protein, 17 aa, Plasmodium falciparum
AHKLKLRKMIKNYDKLK

SEQ ID NO: 3254841 - protein, 24 aa, Plasmodium falciparum
AHLHEISDILALYIMTPICSLCIL

SEQ ID NO: 3254842 - protein, 21 aa, Plasmodium falciparum
AHLSFYFSLKQFILFFYTFNG

SEQ ID NO: 3254843 - protein, 19 aa, Plasmodium falciparum
AHNNIKYDIKEGGSDNIYT

SEQ ID NO: 3254844 - protein, 24 aa, Plasmodium falciparum
AHPACNDFQLGLGIHLPNGSTLGI

SEQ ID NO: 3254845 - protein, 23 aa, Plasmodium falciparum
AHRHIPFYFTITLSTKRKRKKKR

SEQ ID NO: 3254846 - protein, 26 aa, Plasmodium falciparum
AHVTFSMAISYVFHYVHLLFVVIFLV

SEQ ID NO: 3254847 - protein, 19 aa, Plasmodium falciparum
AIAALFIYPLEIVKTRLIV

SEQ ID NO: 3254848 - protein, 17 aa, Plasmodium falciparum
AIAKPVTKNSFLKAYID

SEQ ID NO: 3254849 - protein, 26 aa, Plasmodium falciparum
AICIPPRRRKLYIGKIKEWANSGNTQ

SEQ ID NO: 3254850 - protein, 31 aa, Plasmodium falciparum
AICVPPRRRKLYLGGFKRLTDGTAVSSEATQ

SEQ ID NO: 3254851 - protein, 25 aa, Plasmodium falciparum
AIDGICPFSKLKLQIKRRAKSKLKN

SEQ ID NO: 3254852 - protein, 17 aa, Plasmodium falciparum
AIEAFRYARIFNQQDSF

SEQ ID NO: 3254853 - protein, 26 aa, Plasmodium falciparum
AIEELKFSNIFKHVWEGTYTNIVFLE

SEQ ID NO: 3254854 - protein, 17 aa, Plasmodium falciparum
AIEPCKGLENFEKSCGL

SEQ ID NO: 3254855 - protein, 25 aa, Plasmodium falciparum
AIFKCPSCAISCRSYKTWINTKKDE

SEQ ID NO: 3254856 - protein, 19 aa, Plasmodium falciparum
AIGYVCFPSLVKYNYLKDI

SEQ ID NO: 3254857 - protein, 20 aa, Plasmodium falciparum
AIHCSYLFFLLSNILYFIHL

SEQ ID NO: 3254858 - protein, 19 aa, Plasmodium falciparum
AIIAVKLVYPGYVAAGSNN

SEQ ID NO: 3254859 - protein, 24 aa, Plasmodium falciparum
AIIGVTSFGSWFFKNSLYNVEAGK

SEQ ID NO: 3254860 - protein, 19 aa, Plasmodium falciparum
AIIILCWKIQIIALNYLTP

SEQ ID NO: 3254861 - protein, 25 aa, Plasmodium falciparum
AIIYACIHGTLSLLTLFQFNSSTIY

SEQ ID NO: 3254862 - protein, 25 aa, Plasmodium falciparum
AIKPCKGLTKFESFCGLNRTESSKI

SEQ ID NO: 3254863 - protein, 25 aa, Plasmodium falciparum
AIKPCKGLTQFESFCGLNGDKPSQN

SEQ ID NO: 3254864 - protein, 17 aa, Plasmodium falciparum
AILFTFSGIMYILEAPD

SEQ ID NO: 3254865 - protein, 18 aa, Plasmodium falciparum
AILLTIGIIIFAKFQTRL

SEQ ID NO: 3254866 - protein, 22 aa, Plasmodium falciparum
AIMEFHRYKDLLKLRKNNMQKE

SEQ ID NO: 3254867 - protein, 18 aa, Plasmodium falciparum
AIMSAWKVAALKAATEYA

SEQ ID NO: 3254868 - protein, 24 aa, Plasmodium falciparum
AINFLFLYIINFCLLHYLKECNTS

SEQ ID NO: 3254869 - protein, 17 aa, Plasmodium falciparum
AINFSWTIVDYIIDRSN

SEQ ID NO: 3254870 - protein, 34 aa, Plasmodium falciparum
AINKNVWIFKIFKFFYYRSFMCFYKNKSQEEHLY

SEQ ID NO: 3254871 - protein, 22 aa, Plasmodium falciparum
AIPEIRYLTARSIGNISQFLDM

SEQ ID NO: 3254872 - protein, 17 aa, Plasmodium falciparum
AIPTCVCEKSLADKVEK

SEQ ID NO: 3254873 - protein, 20 aa, Plasmodium falciparum
AIPTCVCEKSLEDKMEKGCL

SEQ ID NO: 3254874 - protein, 24 aa, Plasmodium falciparum
AIQECIKEGIQVVIERIKLFDFIS

SEQ ID NO: 3254875 - protein, 31 aa, Plasmodium falciparum
AIQVYPSLDCLKCILSPSIFKKLKGTYKKSR

SEQ ID NO: 3254876 - protein, 20 aa, Plasmodium falciparum
AIRLHFIICVDFLIENMNII

SEQ ID NO: 3254877 - protein, 18 aa, Plasmodium falciparum
AISALYIANCSKRKHKNR

SEQ ID NO: 3254878 - protein, 25 aa, Plasmodium falciparum
AISPFYSICAFSLFTASSLFFGYLM

SEQ ID NO: 3254879 - protein, 24 aa, Plasmodium falciparum
AISTCVIMLFFGFIFKLTAKEQTR

SEQ ID NO: 3254880 - protein, 22 aa, Plasmodium falciparum
AISTYICSSIGIIIKNINIFEI

SEQ ID NO: 3254881 - protein, 19 aa, Plasmodium falciparum
AISVLKPLAIEAAKKAAVT

SEQ ID NO: 3254882 - protein, 18 aa, Plasmodium falciparum
AITCKADTGNAYFRPTCS

SEQ ID NO: 3254883 - protein, 25 aa, Plasmodium falciparum
AITSSTYCAIPFALMAGILFFQVYR

SEQ ID NO: 3254884 - protein, 27 aa, Plasmodium falciparum
AIVCSAEGGVIWQMILSLINNINITIK

SEQ ID NO: 3254885 - protein, 18 aa, Plasmodium falciparum
AKAYKLLMYAFSLYNSLI

SEQ ID NO: 3254886 - protein, 17 aa, Plasmodium falciparum
AKCCSSDVGKGQCECEE

SEQ ID NO: 3254887 - protein, 19 aa, Plasmodium falciparum
AKDSLGKGFLRFADGNRDI

SEQ ID NO: 3254888 - protein, 19 aa, Plasmodium falciparum
AKEEIMEFVDFLKNPTKYE

SEQ ID NO: 3254889 - protein, 24 aa, Plasmodium falciparum
AKEIPPGVIVGLFSIFYVALGENR

SEQ ID NO: 3254890 - protein, 19 aa, Plasmodium falciparum
AKELLEFTSNVINDMDKRI

SEQ ID NO: 3254891 - protein, 21 aa, Plasmodium falciparum
AKEMYCQPFHVILYKKLRQNI

SEQ ID NO: 3254892 - protein, 21 aa, Plasmodium falciparum
AKFLVIEGRNRIGGRAFSTIL

SEQ ID NO: 3254893 - protein, 24 aa, Plasmodium falciparum
AKFNDIFDFLINWASKKSSSQKEF

SEQ ID NO: 3254894 - protein, 27 aa, Plasmodium falciparum
AKFQTRLSLHWPIYASYIFIICAVILL

SEQ ID NO: 3254895 - protein, 24 aa, Plasmodium falciparum
AKFSSYLWWWIWPFAITNLILYKM

SEQ ID NO: 3254896 - protein, 17 aa, Plasmodium falciparum
AKGSLFIKKCYYTNNSK

SEQ ID NO: 3254897 - protein, 21 aa, Plasmodium falciparum
AKHDLLLDVCLAAKYEGESLK

SEQ ID NO: 3254898 - protein, 21 aa, Plasmodium falciparum
AKHDLLLDVCMAANYEAQSLI

SEQ ID NO: 3254899 - protein, 25 aa, Plasmodium falciparum
AKHIWKGMVCALTYKDNTNGGPPTQ

SEQ ID NO: 3254900 - protein, 19 aa, Plasmodium falciparum
AKHNLLLDVCLAANHEGQS

SEQ ID NO: 3254901 - protein, 24 aa, Plasmodium falciparum
AKHNLLLDVCMAAKYEGYSINTHY

SEQ ID NO: 3254902 - protein, 20 aa, Plasmodium falciparum
AKIDPKCQYIWNAKKMFFFI

SEQ ID NO: 3254903 - protein, 28 aa, Plasmodium falciparum
AKIKAFLYKKSFIFLFCSFYNIFLKILL

SEQ ID NO: 3254904 - protein, 19 aa, Plasmodium falciparum
AKIKFSLSNNTAYLKVKQK

SEQ ID NO: 3254905 - protein, 25 aa, Plasmodium falciparum
AKINKCFPLIRYIIRENEYVHDNFI

SEQ ID NO: 3254906 - protein, 29 aa, Plasmodium falciparum
AKISFSTLFCSICAVITSLFGMNLKNFIE

SEQ ID NO: 3254907 - protein, 19 aa, Plasmodium falciparum
AKKDSCSDLQYDKKKEENK

SEQ ID NO: 3254908 - protein, 17 aa, Plasmodium falciparum
AKKELLETLQIVAEREA

SEQ ID NO: 3254909 - protein, 17 aa, Plasmodium falciparum
AKKGMLMINIKRKHEYD

SEQ ID NO: 3254910 - protein, 32 aa, Plasmodium falciparum
AKKIKTFNSEPYWKRLEKKDIEEFKHSVNKSY

SEQ ID NO: 3254911 - protein, 17 aa, Plasmodium falciparum
AKKLIGDLSSNGRGGYT

SEQ ID NO: 3254912 - protein, 26 aa, Plasmodium falciparum
AKKPYIVGIISFFSWVVITGNFVPIS

SEQ ID NO: 3254913 - protein, 19 aa, Plasmodium falciparum
AKKRKGSVSLILNPKKSLK

SEQ ID NO: 3254914 - protein, 24 aa, Plasmodium falciparum
AKKSCSNYEWKSLIKEGSGKCTGS

SEQ ID NO: 3254915 - protein, 19 aa, Plasmodium falciparum
AKKTKGFLILQLFLYGYLN

SEQ ID NO: 3254916 - protein, 21 aa, Plasmodium falciparum
AKLILKEQFLIPDFREKQLEC

SEQ ID NO: 3254917 - protein, 26 aa, Plasmodium falciparum
AKLLGYICIHIHININFGFSIPFIFK

SEQ ID NO: 3254918 - protein, 17 aa, Plasmodium falciparum
AKLLIKKSESIILSNEL

SEQ ID NO: 3254919 - protein, 18 aa, Plasmodium falciparum
AKLNFWYYKSISINDQDI

SEQ ID NO: 3254920 - protein, 18 aa, Plasmodium falciparum
AKLVLEAFDNIFIDKLID

SEQ ID NO: 3254921 - protein, 21 aa, Plasmodium falciparum
AKMFFSIVLCEPVDEDKAEEK

SEQ ID NO: 3254922 - protein, 22 aa, Plasmodium falciparum
AKNHIKNAFGDMNNRKTMLNEI

SEQ ID NO: 3254923 - protein, 36 aa, Plasmodium falciparum
AKNIPLWIYKFFYIFHYKRLEMISLNCYDYICILIF

SEQ ID NO: 3254924 - protein, 56 aa, Plasmodium falciparum
AKNKLKGKVCYYTNKSFLFLVRNIYRIRKMWIREKMKKRNEKLLFYKKKTNKCKNN

SEQ ID NO: 3254925 - protein, 19 aa, Plasmodium falciparum
AKNMFLRFLCLLFLSITIS

SEQ ID NO: 3254926 - protein, 20 aa, Plasmodium falciparum
AKNRAILRGKITEFNQSVKF

SEQ ID NO: 3254927 - protein, 24 aa, Plasmodium falciparum
AKPCRNLYFYKCINNYSHITSFFY

SEQ ID NO: 3254928 - protein, 18 aa, Plasmodium falciparum
AKPFIFNCTVNFKEEENY

SEQ ID NO: 3254929 - protein, 20 aa, Plasmodium falciparum
AKPQFIRWLEEWTNEFCEKY

SEQ ID NO: 3254930 - protein, 22 aa, Plasmodium falciparum
AKRKYLEYINFFFRNPHIKSNM

SEQ ID NO: 3254931 - protein, 19 aa, Plasmodium falciparum
AKRTKAFIEKYFKIKGIEY

SEQ ID NO: 3254932 - protein, 17 aa, Plasmodium falciparum
AKSFFFFISTDKKKKKN

SEQ ID NO: 3254933 - protein, 28 aa, Plasmodium falciparum
AKSKTECLCKPGYFLKDKRCVKCVAGFY

SEQ ID NO: 3254934 - protein, 20 aa, Plasmodium falciparum
AKSLLKYKGLLHMPFEKGPL

SEQ ID NO: 3254935 - protein, 20 aa, Plasmodium falciparum
AKSVIFECYDFILFNYKKNY

SEQ ID NO: 3254936 - protein, 24 aa, Plasmodium falciparum
AKSVNCKGLFFLIINFFYKPKAVK

SEQ ID NO: 3254937 - protein, 22 aa, Plasmodium falciparum
AKTDLSYDMKEYFIFEKNENFY

SEQ ID NO: 3254938 - protein, 17 aa, Plasmodium falciparum
AKTELKGKMKNKENNNK

SEQ ID NO: 3254939 - protein, 19 aa, Plasmodium falciparum
AKTFIKFNKNILITLSVKE

SEQ ID NO: 3254940 - protein, 20 aa, Plasmodium falciparum
AKTHIKSFMSKHMILNNFLE

SEQ ID NO: 3254941 - protein, 23 aa, Plasmodium falciparum
AKTKCLFVKSIRSFPDENSGCIL

SEQ ID NO: 3254942 - protein, 20 aa, Plasmodium falciparum
AKTPECFKSVSIKDLRPINE

SEQ ID NO: 3254943 - protein, 19 aa, Plasmodium falciparum
AKTWWKENAPHIWEGMICA

SEQ ID NO: 3254944 - protein, 24 aa, Plasmodium falciparum
AKVLLEDIFNFWLENEHLDKNEFI

SEQ ID NO: 3254945 - protein, 18 aa, Plasmodium falciparum
AKWVCGSVNFTGFDNKNM

SEQ ID NO: 3254946 - protein, 21 aa, Plasmodium falciparum
AKYLFRKRPRYINTNHNQSNA

SEQ ID NO: 3254947 - protein, 23 aa, Plasmodium falciparum
AKYMFRSFLSIIHLYKEYCRKVW

SEQ ID NO: 3254948 - protein, 17 aa, Plasmodium falciparum
AKYVICQNAIIASVVAL

SEQ ID NO: 3254949 - protein, 18 aa, Plasmodium falciparum
AKYVICQNAIIASVVALL

SEQ ID NO: 3254950 - protein, 18 aa, Plasmodium falciparum
ALARSFADIGDIIRGKDL

SEQ ID NO: 3254951 - protein, 17 aa, Plasmodium falciparum
ALARSFADIGDILRGKD

SEQ ID NO: 3254952 - protein, 17 aa, Plasmodium falciparum
ALCGIIFFHEKRKLLWF

SEQ ID NO: 3254953 - protein, 22 aa, Plasmodium falciparum
ALCKGSLLIMEFYNIRYIFNKQ

SEQ ID NO: 3254954 - protein, 17 aa, Plasmodium falciparum
ALCSSIAGYNGIYVAVR

SEQ ID NO: 3254955 - protein, 25 aa, Plasmodium falciparum
ALEELRSEMILDFNKRKHLTNNTDD

SEQ ID NO: 3254956 - protein, 18 aa, Plasmodium falciparum
ALFALGHFSFQLIISNVT

SEQ ID NO: 3254957 - protein, 17 aa, Plasmodium falciparum
ALFNFGFERKYCSSDFN

SEQ ID NO: 3254958 - protein, 22 aa, Plasmodium falciparum
ALGHFMILKLALKYYDIYFELK

SEQ ID NO: 3254959 - protein, 28 aa, Plasmodium falciparum
ALGLIAKLKLILFFSTYVNSRNETNNSK

SEQ ID NO: 3254960 - protein, 18 aa, Plasmodium falciparum
ALGPHKLKTIPLLPNEVG

SEQ ID NO: 3254961 - protein, 17 aa, Plasmodium falciparum
ALHKYLLSKNLRTKCSL

SEQ ID NO: 3254962 - protein, 17 aa, Plasmodium falciparum
ALIILYIWLYKRRKNSW

SEQ ID NO: 3254963 - protein, 18 aa, Plasmodium falciparum
ALIKGFQKYVLFLKKYSS

SEQ ID NO: 3254964 - protein, 18 aa, Plasmodium falciparum
ALIPVCFSNMTREIVFKK

SEQ ID NO: 3254965 - protein, 21 aa, Plasmodium falciparum
ALISCVSMIIGFIRKSSEHTY

SEQ ID NO: 3254966 - protein, 26 aa, Plasmodium falciparum
ALISFNHFRWPLLVDIQNIGLQWLKK

SEQ ID NO: 3254967 - protein, 25 aa, Plasmodium falciparum
ALIYMVHISCCFLTNEEWKYFFESP

SEQ ID NO: 3254968 - protein, 23 aa, Plasmodium falciparum
ALKELRKSLQCLVDSRPSDFCKT

SEQ ID NO: 3254969 - protein, 25 aa, Plasmodium falciparum
ALKILCLGYYALLFLDKNEDYKNIT

SEQ ID NO: 3254970 - protein, 23 aa, Plasmodium falciparum
ALKNKRIRILKNILNKKEHANPY

SEQ ID NO: 3254971 - protein, 18 aa, Plasmodium falciparum
ALKVKDLITEGGPQLLDL

SEQ ID NO: 3254972 - protein, 18 aa, Plasmodium falciparum
ALLFFYILLIKGYYGRTE

SEQ ID NO: 3254973 - protein, 18 aa, Plasmodium falciparum
ALLFPKKMYSDVQINNII

SEQ ID NO: 3254974 - protein, 19 aa, Plasmodium falciparum
ALMVGFPIIRNYRAFREQF

SEQ ID NO: 3254975 - protein, 24 aa, Plasmodium falciparum
ALNGICIPCPLGSYNNINEYIKNN

SEQ ID NO: 3254976 - protein, 26 aa, Plasmodium falciparum
ALNIIKRNPMVYLWIKSSNPFKKKRF

SEQ ID NO: 3254977 - protein, 29 aa, Plasmodium falciparum
ALNKYKIILTHLFFYFFHLYMKNYNEEYI

SEQ ID NO: 3254978 - protein, 19 aa, Plasmodium falciparum
ALSAWKVTKAVHVSFSKKY

SEQ ID NO: 3254979 - protein, 19 aa, Plasmodium falciparum
ALSLRKVIYVDIVNDKISY

SEQ ID NO: 3254980 - protein, 28 aa, Plasmodium falciparum
ALSNHLKYTLKMTIIYDIEKMKHIREAD

SEQ ID NO: 3254981 - protein, 20 aa, Plasmodium falciparum
ALVYSVCYNQGFIPQAEEVL

SEQ ID NO: 3254982 - protein, 19 aa, Plasmodium falciparum
ALYESGALTFLISSLYESK

SEQ ID NO: 3254983 - protein, 19 aa, Plasmodium falciparum
ALYIWKVCADYGSSDAQFY

SEQ ID NO: 3254984 - protein, 27 aa, Plasmodium falciparum
ALYKSKSWFKGILFPILHRECTKKQMI

SEQ ID NO: 3254985 - protein, 18 aa, Plasmodium falciparum
ALYPAFILLIFIIYIYAR

SEQ ID NO: 3254986 - protein, 26 aa, Plasmodium falciparum
ALYRRHVNEDIPLLLPQPLNIENTHE

SEQ ID NO: 3254987 - protein, 30 aa, Plasmodium falciparum
ALYVMVGVCAFLSLSFPGLLFSRAKRTKAF

SEQ ID NO: 3254988 - protein, 34 aa, Plasmodium falciparum
AMAYLGMYCASLFPICWLPIGLKVAETMPICFPQ

SEQ ID NO: 3254989 - protein, 28 aa, Plasmodium falciparum
AMCTRFPEIYIHYSFSSFFMNIEKYTDE

SEQ ID NO: 3254990 - protein, 18 aa, Plasmodium falciparum
AMIWSFRTVSSIGYILSG

SEQ ID NO: 3254991 - protein, 23 aa, Plasmodium falciparum
AMKYKSSCLLYKKNFNFKLFSYL

SEQ ID NO: 3254992 - protein, 23 aa, Plasmodium falciparum
AMLSSTIMWSIGIGFATFTYFFL

SEQ ID NO: 3254993 - protein, 23 aa, Plasmodium falciparum
AMLSSTIMWSIGIGFATFTYFYL

SEQ ID NO: 3254994 - protein, 17 aa, Plasmodium falciparum
AMPLTIEEYKVCQLYFV

SEQ ID NO: 3254995 - protein, 21 aa, Plasmodium falciparum
AMYKKKCIDIAKYNMILLNEQ

SEQ ID NO: 3254996 - protein, 24 aa, Plasmodium falciparum
ANASYKLLNYEGFSRSIDYDDDNV

SEQ ID NO: 3254997 - protein, 24 aa, Plasmodium falciparum
ANCKKISTYILYLLIKNYKIEYEY

SEQ ID NO: 3254998 - protein, 21 aa, Plasmodium falciparum
ANDIFPFSYLILVNTLLFQLA

SEQ ID NO: 3254999 - protein, 19 aa, Plasmodium falciparum
ANDLIGFKCPSNYSVEPHD

SEQ ID NO: 3255000 - protein, 21 aa, Plasmodium falciparum
ANDYCQIPFNLKIRANELDVL

SEQ ID NO: 3255001 - protein, 18 aa, Plasmodium falciparum
ANEIANIFCAWIEIELLE

SEQ ID NO: 3255002 - protein, 20 aa, Plasmodium falciparum
ANEIYFYRYDINKLLIRNNF

SEQ ID NO: 3255003 - protein, 24 aa, Plasmodium falciparum
ANEKIKEVFHLGGEKRGDGMTRKR

SEQ ID NO: 3255004 - protein, 21 aa, Plasmodium falciparum
ANEVYKIKIIFPDNYPLKPPI

SEQ ID NO: 3255005 - protein, 22 aa, Plasmodium falciparum
ANFFCIFISYLLLTHIENKQLK

SEQ ID NO: 3255006 - protein, 23 aa, Plasmodium falciparum
ANFISCINYYLKINKYNNVQHNW

SEQ ID NO: 3255007 - protein, 25 aa, Plasmodium falciparum
ANFKQYCLYLYVVDHVSKIYSKHIK

SEQ ID NO: 3255008 - protein, 24 aa, Plasmodium falciparum
ANFTRWVYEENLEEIISMENENNE

SEQ ID NO: 3255009 - protein, 18 aa, Plasmodium falciparum
ANHFKFNIIEINGSDDRN

SEQ ID NO: 3255010 - protein, 20 aa, Plasmodium falciparum
ANIFCAWIEIELLERNYKEA

SEQ ID NO: 3255011 - protein, 19 aa, Plasmodium falciparum
ANIFKSIRKDVWKCVNICG

SEQ ID NO: 3255012 - protein, 18 aa, Plasmodium falciparum
ANILNFIKHIKFINIQMF

SEQ ID NO: 3255013 - protein, 25 aa, Plasmodium falciparum
ANIMFACIFLLLNLSKVPVITIIVT

SEQ ID NO: 3255014 - protein, 18 aa, Plasmodium falciparum
ANIPKCIILLHISNNHDD

SEQ ID NO: 3255015 - protein, 19 aa, Plasmodium falciparum
ANIVHPFLFNLNDYKDHKK

SEQ ID NO: 3255016 - protein, 26 aa, Plasmodium falciparum
ANIYKYIYFFIVHFIHKFDIYNLCQA

SEQ ID NO: 3255017 - protein, 22 aa, Plasmodium falciparum
ANKKKLLCGGIERSFEQNLPAR

SEQ ID NO: 3255018 - protein, 17 aa, Plasmodium falciparum
ANKLFLKHIHKYDNEYL

SEQ ID NO: 3255019 - protein, 18 aa, Plasmodium falciparum
ANKLKCYNYDLLHIEKKW

SEQ ID NO: 3255020 - protein, 25 aa, Plasmodium falciparum
ANKNYAFYFIIKFLINKKITSNCTA

SEQ ID NO: 3255021 - protein, 21 aa, Plasmodium falciparum
ANKRWKLRNQRIYKKEQNDER

SEQ ID NO: 3255022 - protein, 18 aa, Plasmodium falciparum
ANLEGIKAGIPVVIGKIK

SEQ ID NO: 3255023 - protein, 18 aa, Plasmodium falciparum
ANMDLLLYLILTYYKFPF

SEQ ID NO: 3255024 - protein, 18 aa, Plasmodium falciparum
ANNLYILKKIYFADMYQI

SEQ ID NO: 3255025 - protein, 18 aa, Plasmodium falciparum
ANPNLIYDPNYETIYSKW

SEQ ID NO: 3255026 - protein, 22 aa, Plasmodium falciparum
ANPSEFLSFYRKKIRQRDIYNN

SEQ ID NO: 3255027 - protein, 17 aa, Plasmodium falciparum
ANPYLIFSLGEKTSNLR

SEQ ID NO: 3255028 - protein, 18 aa, Plasmodium falciparum
ANRAKVWEAMQCPTIPPV

SEQ ID NO: 3255029 - protein, 19 aa, Plasmodium falciparum
ANRDQVWKAITCEAPENAY

SEQ ID NO: 3255030 - protein, 19 aa, Plasmodium falciparum
ANRDQVWKAITCRAPNGAN

SEQ ID NO: 3255031 - protein, 19 aa, Plasmodium falciparum
ANRDQVWKAMTCVAPENAY

SEQ ID NO: 3255032 - protein, 20 aa, Plasmodium falciparum
ANRDQVWRAITCYIPYYVNY

SEQ ID NO: 3255033 - protein, 18 aa, Plasmodium falciparum
ANRETVWKAIRCSAPRDA

SEQ ID NO: 3255034 - protein, 20 aa, Plasmodium falciparum
ANRNDIWKALTCHAPPDAQY

SEQ ID NO: 3255035 - protein, 18 aa, Plasmodium falciparum
ANRNDVWKAITCSADKGN

SEQ ID NO: 3255036 - protein, 19 aa, Plasmodium falciparum
ANRRQVWKAITCDAKAFNY

SEQ ID NO: 3255037 - protein, 18 aa, Plasmodium falciparum
ANSLEVNKAFIIIHSYSQ

SEQ ID NO: 3255038 - protein, 23 aa, Plasmodium falciparum
ANSSAPKSSWWLMSDNYESFLAC

SEQ ID NO: 3255039 - protein, 19 aa, Plasmodium falciparum
ANVQYELGDLLSVKFNVED

SEQ ID NO: 3255040 - protein, 31 aa, Plasmodium falciparum
ANYYKLREAWWALNRQDVWKALTCDAHGTYF

SEQ ID NO: 3255041 - protein, 20 aa, Plasmodium falciparum
APANMKSTMHKVGVKKQKLK

SEQ ID NO: 3255042 - protein, 24 aa, Plasmodium falciparum
APAWDLFSGLGYDAWTNYAATTLV

SEQ ID NO: 3255043 - protein, 20 aa, Plasmodium falciparum
APEVKPACEIVKELFNDTNK

SEQ ID NO: 3255044 - protein, 23 aa, Plasmodium falciparum
APFKNLICNGLVLASDGKKMSKR

SEQ ID NO: 3255045 - protein, 26 aa, Plasmodium falciparum
APGHSLKIKVCYNVVSLNYQEDHIRL

SEQ ID NO: 3255046 - protein, 21 aa, Plasmodium falciparum
APHFLKGELIFNENKKEKLKI

SEQ ID NO: 3255047 - protein, 25 aa, Plasmodium falciparum
APINDCRLKRSFSDVRNVIEDDIIK

SEQ ID NO: 3255048 - protein, 26 aa, Plasmodium falciparum
APINKGAKHKLCFDEYDKEIMLPYKT

SEQ ID NO: 3255049 - protein, 30 aa, Plasmodium falciparum
APKISASCPGELVILFGFALMKGIGSSSAN

SEQ ID NO: 3255050 - protein, 17 aa, Plasmodium falciparum
APLLSGIIMDIMHKYTN

SEQ ID NO: 3255051 - protein, 17 aa, Plasmodium falciparum
APLVVTGIWHMLKSIIP

SEQ ID NO: 3255052 - protein, 17 aa, Plasmodium falciparum
APMAGLAVWNILKSEFK

SEQ ID NO: 3255053 - protein, 31 aa, Plasmodium falciparum
APNDKLIMILNCCRIVTSVLYAAKRNLKRKK

SEQ ID NO: 3255054 - protein, 23 aa, Plasmodium falciparum
APRAPKYKTLIEVVLEPSGKNTT

SEQ ID NO: 3255055 - protein, 25 aa, Plasmodium falciparum
APSIKKEVCHHLCFRCNSISEDYFL

SEQ ID NO: 3255056 - protein, 25 aa, Plasmodium falciparum
APSIWKGMICALTYKEDGEKSTDDK

SEQ ID NO: 3255057 - protein, 21 aa, Plasmodium falciparum
APYLRQIHFLFTPIYISIFNK

SEQ ID NO: 3255058 - protein, 17 aa, Plasmodium falciparum
APYRRLFLCNKNMEKMG

SEQ ID NO: 3255059 - protein, 19 aa, Plasmodium falciparum
APYRRLHVCDKNMEKIPTS

SEQ ID NO: 3255060 - protein, 20 aa, Plasmodium falciparum
APYRRLSLCNKNFPNMNSKD

SEQ ID NO: 3255061 - protein, 19 aa, Plasmodium falciparum
APYRRLSLCNKNFQKINNY

SEQ ID NO: 3255062 - protein, 26 aa, Plasmodium falciparum
AQANCKCQSIGLWRDIPEKDMSEYRY

SEQ ID NO: 3255063 - protein, 30 aa, Plasmodium falciparum
AQDLRNLAKCLPRVSGVWYDLHKNSWEARW

SEQ ID NO: 3255064 - protein, 20 aa, Plasmodium falciparum
AQEISIIIWSFGSIKNELIE

SEQ ID NO: 3255065 - protein, 18 aa, Plasmodium falciparum
AQEVISKWGIPAIGCLHR

SEQ ID NO: 3255066 - protein, 22 aa, Plasmodium falciparum
AQFFVVFPIYYFLTLHRLKNVW

SEQ ID NO: 3255067 - protein, 23 aa, Plasmodium falciparum
AQFLKRLKNGPCKNNDNGEGKIE

SEQ ID NO: 3255068 - protein, 18 aa, Plasmodium falciparum
AQFLLLLISNNPFVFSFS

SEQ ID NO: 3255069 - protein, 17 aa, Plasmodium falciparum
AQFSKYVIIQEYTKYTS

SEQ ID NO: 3255070 - protein, 20 aa, Plasmodium falciparum
AQFVQLFLERNIAPENIVSF

SEQ ID NO: 3255071 - protein, 17 aa, Plasmodium falciparum
AQFYLGVMYSNYFSLPN

SEQ ID NO: 3255072 - protein, 23 aa, Plasmodium falciparum
AQKKWTRKRYKATILEKRVKTNN

SEQ ID NO: 3255073 - protein, 21 aa, Plasmodium falciparum
AQKMIPKICGDVIPKEEAKEE

SEQ ID NO: 3255074 - protein, 30 aa, Plasmodium falciparum
AQLNLSCDFNLYLRICKVVLNDEKHIHTSN

SEQ ID NO: 3255075 - protein, 21 aa, Plasmodium falciparum
AQLSIFLIRLINISYNVSTHE

SEQ ID NO: 3255076 - protein, 17 aa, Plasmodium falciparum
AQPFMKLYVVLNMLEIL

SEQ ID NO: 3255077 - protein, 23 aa, Plasmodium falciparum
AQQFSEKLLRKWGIGNSPCHDGI

SEQ ID NO: 3255078 - protein, 21 aa, Plasmodium falciparum
AQSYLKRLCIIKWRNITREFF

SEQ ID NO: 3255079 - protein, 26 aa, Plasmodium falciparum
AQTRKSVLFCIRELFINNVLHVDIFK

SEQ ID NO: 3255080 - protein, 19 aa, Plasmodium falciparum
ARAVVCCRCSPIEKKEIAI

SEQ ID NO: 3255081 - protein, 18 aa, Plasmodium falciparum
ARGKYRMGNQCTKCLFAC

SEQ ID NO: 3255082 - protein, 21 aa, Plasmodium falciparum
ARKNVFKYLLRNERLLFKRRR

SEQ ID NO: 3255083 - protein, 18 aa, Plasmodium falciparum
ARKRNGIVQSMYQRLTIK

SEQ ID NO: 3255084 - protein, 18 aa, Plasmodium falciparum
ARLKWDTQYDTYYSNDDI

SEQ ID NO: 3255085 - protein, 20 aa, Plasmodium falciparum
ARNALKEKKLKEQKKNDAQK

SEQ ID NO: 3255086 - protein, 24 aa, Plasmodium falciparum
ARNTDYPWACSCDTLQLEEYKEKK

SEQ ID NO: 3255087 - protein, 19 aa, Plasmodium falciparum
ARQAFSINLYYEALNHYIC

SEQ ID NO: 3255088 - protein, 18 aa, Plasmodium falciparum
ARRRRRIGNNGPPSAEEL

SEQ ID NO: 3255089 - protein, 20 aa, Plasmodium falciparum
ARVERRGKYKGMNGININND

SEQ ID NO: 3255090 - protein, 23 aa, Plasmodium falciparum
ARVIFYCLKYLYSKKLYNIVSNA

SEQ ID NO: 3255091 - protein, 18 aa, Plasmodium falciparum
ASAIKFANLEGIKAGIPV

SEQ ID NO: 3255092 - protein, 17 aa, Plasmodium falciparum
ASASGLAFIVSLFGAGG

SEQ ID NO: 3255093 - protein, 24 aa, Plasmodium falciparum
ASCDSGGTLVCYELDLNKKKIMDE

SEQ ID NO: 3255094 - protein, 17 aa, Plasmodium falciparum
ASCKKKGKEKCTQGDND

SEQ ID NO: 3255095 - protein, 21 aa, Plasmodium falciparum
ASDFRKSFFGTFDKLKTIKRY

SEQ ID NO: 3255096 - protein, 27 aa, Plasmodium falciparum
ASEIVDACGNIKGGALKVKDLITEGGP

SEQ ID NO: 3255097 - protein, 19 aa, Plasmodium falciparum
ASFPIFKTTAIYILNEFTQ

SEQ ID NO: 3255098 - protein, 25 aa, Plasmodium falciparum
ASFYCTCFFCNGKCNFLMCEEDNRY

SEQ ID NO: 3255099 - protein, 24 aa, Plasmodium falciparum
ASHLFCDLLSFALNLFSIYVSSFQ

SEQ ID NO: 3255100 - protein, 20 aa, Plasmodium falciparum
ASIIKYIKCLGNIKKVNNDI

SEQ ID NO: 3255101 - protein, 26 aa, Plasmodium falciparum
ASILFELLSAKLLVTISIILLSISLY

SEQ ID NO: 3255102 - protein, 23 aa, Plasmodium falciparum
ASILKKNFLLYSLDFYTLKYFSR

SEQ ID NO: 3255103 - protein, 38 aa, Plasmodium falciparum
ASISDLIWRNEVIPFSLEIIKRINISYKNVHMGVLLFS

SEQ ID NO: 3255104 - protein, 26 aa, Plasmodium falciparum
ASKACETMCQWILAIYHYFIINKELE

SEQ ID NO: 3255105 - protein, 18 aa, Plasmodium falciparum
ASKEFGFYDIKMVEGGEK

SEQ ID NO: 3255106 - protein, 21 aa, Plasmodium falciparum
ASKLRSLVISIWSNIPSSKPK

SEQ ID NO: 3255107 - protein, 17 aa, Plasmodium falciparum
ASKNLKGTILTNNDDKL

SEQ ID NO: 3255108 - protein, 20 aa, Plasmodium falciparum
ASLASSLALATCKEPLRISL

SEQ ID NO: 3255109 - protein, 17 aa, Plasmodium falciparum
ASLEKFAFYTGSPQIVT

SEQ ID NO: 3255110 - protein, 19 aa, Plasmodium falciparum
ASLKINWFSEIEKYLPAFD

SEQ ID NO: 3255111 - protein, 21 aa, Plasmodium falciparum
ASLSILLGLCKKIRYINNHER

SEQ ID NO: 3255112 - protein, 28 aa, Plasmodium falciparum
ASLVNSFQLFKFISLYSIMQCSQVLILY

SEQ ID NO: 3255113 - protein, 23 aa, Plasmodium falciparum
ASMIKSAFLPTGAFKADRYKSHG

SEQ ID NO: 3255114 - protein, 21 aa, Plasmodium falciparum
ASNILSCNYNKGAFPNKFEKN

SEQ ID NO: 3255115 - protein, 19 aa, Plasmodium falciparum
ASNSFKIYSIFISFLSITK

SEQ ID NO: 3255116 - protein, 27 aa, Plasmodium falciparum
ASRFFFLIKNFEQFLSFRSVDEEKFLN

SEQ ID NO: 3255117 - protein, 20 aa, Plasmodium falciparum
ASRLRLFFFGIFVCIHITSY

SEQ ID NO: 3255118 - protein, 17 aa, Plasmodium falciparum
ASSYLIGVVKNIRKIQS

SEQ ID NO: 3255119 - protein, 18 aa, Plasmodium falciparum
ASTLIACRVTPKQKSLLV

SEQ ID NO: 3255120 - protein, 22 aa, Plasmodium falciparum
ASTSDVCFDIHYTARKCNELLI

SEQ ID NO: 3255121 - protein, 17 aa, Plasmodium falciparum
ASTYFINCHLIIFKNAS

SEQ ID NO: 3255122 - protein, 20 aa, Plasmodium falciparum
ASTYSRYKRALLLKTTNKLP

SEQ ID NO: 3255123 - protein, 18 aa, Plasmodium falciparum
ASVFSLSVLEHVLSFYYN

SEQ ID NO: 3255124 - protein, 18 aa, Plasmodium falciparum
ASVWKINNLMVVKKKKKK

SEQ ID NO: 3255125 - protein, 36 aa, Plasmodium falciparum
ASYNIPAFYLNYIIINCYTLLFGIILYFFKNNIKRI

SEQ ID NO: 3255126 - protein, 21 aa, Plasmodium falciparum
ATCTPMLYIINNFFLIILNHI

SEQ ID NO: 3255127 - protein, 25 aa, Plasmodium falciparum
ATDPLGETSVLCFYKTIGEPNATAA

SEQ ID NO: 3255128 - protein, 19 aa, Plasmodium falciparum
ATILFFLDILHDIMSLIIF

SEQ ID NO: 3255129 - protein, 25 aa, Plasmodium falciparum
ATKGCLKSVLFILLYNRQEINNEVD

SEQ ID NO: 3255130 - protein, 23 aa, Plasmodium falciparum
ATKTRIGTNLAFDGYAITTWNSI

SEQ ID NO: 3255131 - protein, 17 aa, Plasmodium falciparum
ATLPPIGSYTETNVICK

SEQ ID NO: 3255132 - protein, 23 aa, Plasmodium falciparum
ATLPSSYSKLNFEEMQVIRYASM

SEQ ID NO: 3255133 - protein, 25 aa, Plasmodium falciparum
ATPFIFISFCSLFRNSSRTFMNKII

SEQ ID NO: 3255134 - protein, 19 aa, Plasmodium falciparum
ATQLCEPFKLWNKLDTKRQ

SEQ ID NO: 3255135 - protein, 24 aa, Plasmodium falciparum
ATSFLLKKILYIWLEKSDEMKNII

SEQ ID NO: 3255136 - protein, 18 aa, Plasmodium falciparum
ATSGLRTLVLGYKYLTEN

SEQ ID NO: 3255137 - protein, 21 aa, Plasmodium falciparum
ATSIIRCLSVLTSAPVMGYPI

SEQ ID NO: 3255138 - protein, 18 aa, Plasmodium falciparum
ATSKCLDVQMGISPILSG

SEQ ID NO: 3255139 - protein, 23 aa, Plasmodium falciparum
ATVHEPRNLITLIKNKDIDDHNV

SEQ ID NO: 3255140 - protein, 18 aa, Plasmodium falciparum
AVACAYLSEHYPGLTPKL

SEQ ID NO: 3255141 - protein, 20 aa, Plasmodium falciparum
AVALAILGIVFIIYIIVRII

SEQ ID NO: 3255142 - protein, 18 aa, Plasmodium falciparum
AVATRAGLPVSTTHSIIG

SEQ ID NO: 3255143 - protein, 21 aa, Plasmodium falciparum
AVAVHVWKPMALEAAIEAAIA

SEQ ID NO: 3255144 - protein, 26 aa, Plasmodium falciparum
AVCIPPRRRRLYVGKLEQWASGGNTQ

SEQ ID NO: 3255145 - protein, 19 aa, Plasmodium falciparum
AVCNYYNYDMLILLYNYAL

SEQ ID NO: 3255146 - protein, 17 aa, Plasmodium falciparum
AVDVLLKHEEEIAENCI

SEQ ID NO: 3255147 - protein, 23 aa, Plasmodium falciparum
AVEAKEAFWGLVQKAIYKIKMPL

SEQ ID NO: 3255148 - protein, 24 aa, Plasmodium falciparum
AVEVLKYKLIYGRPNKVASIIKDL

SEQ ID NO: 3255149 - protein, 22 aa, Plasmodium falciparum
AVGGEIGLTWGYNSLDDPDFQV

SEQ ID NO: 3255150 - protein, 22 aa, Plasmodium falciparum
AVGLLLKIAFFYLFNFGNNEFY

SEQ ID NO: 3255151 - protein, 19 aa, Plasmodium falciparum
AVGTCLRNAPSLKPACDAI

SEQ ID NO: 3255152 - protein, 39 aa, Plasmodium falciparum
AVILFLIFVCISLRPFYNIRLKAEVIFLNVLSLICIIGL

SEQ ID NO: 3255153 - protein, 19 aa, Plasmodium falciparum
AVIPCAIIFTCFCFFLFTI

SEQ ID NO: 3255154 - protein, 17 aa, Plasmodium falciparum
AVIPKHVANIAWASSVL

SEQ ID NO: 3255155 - protein, 26 aa, Plasmodium falciparum
AVIPPEFPITLSLAVTISIVYLYNMK

SEQ ID NO: 3255156 - protein, 24 aa, Plasmodium falciparum
AVKELKLNNFLSIHNLLQLLNNYE

SEQ ID NO: 3255157 - protein, 17 aa, Plasmodium falciparum
AVKGGKCWVLYVYSISI

SEQ ID NO: 3255158 - protein, 22 aa, Plasmodium falciparum
AVLCIFFNFFASFLLHNFEWKP

SEQ ID NO: 3255159 - protein, 18 aa, Plasmodium falciparum
AVLFKYFGNILLKKNTRL

SEQ ID NO: 3255160 - protein, 19 aa, Plasmodium falciparum
AVLFVKLLFLSPVFGIGMA

SEQ ID NO: 3255161 - protein, 17 aa, Plasmodium falciparum
AVLPFKPIFPFTLLTRT

SEQ ID NO: 3255162 - protein, 24 aa, Plasmodium falciparum
AVLPHLKDLVQIIAHGLHDEQQKV

SEQ ID NO: 3255163 - protein, 34 aa, Plasmodium falciparum
AVMGIFCGFLGFLSGSGFLYFLGVKSVPPAETVP

SEQ ID NO: 3255164 - protein, 23 aa, Plasmodium falciparum
AVNSVWRPLPWDIKECEKINKQQ

SEQ ID NO: 3255165 - protein, 26 aa, Plasmodium falciparum
AVPGWSIICSIGFYAFLNTNAMEAVV

SEQ ID NO: 3255166 - protein, 17 aa, Plasmodium falciparum
AVQCLLKNLGNEAKKCE

SEQ ID NO: 3255167 - protein, 19 aa, Plasmodium falciparum
AVTLLRCFLFGQDNPTYRF

SEQ ID NO: 3255168 - protein, 25 aa, Plasmodium falciparum
AWAADPVYRKHVNVLYQILTHTDPN

SEQ ID NO: 3255169 - protein, 18 aa, Plasmodium falciparum
AWLSNPFAIIKGFIKGLC

SEQ ID NO: 3255170 - protein, 24 aa, Plasmodium falciparum
AWMEKRMNFSFTNEGWNYDGQTEH

SEQ ID NO: 3255171 - protein, 19 aa, Plasmodium falciparum
AYCGLSNCNKHIIKKLLHF

SEQ ID NO: 3255172 - protein, 33 aa, Plasmodium falciparum
AYDIENLIFLGICIKIVICRISNLLNAKSCLQQ

SEQ ID NO: 3255173 - protein, 25 aa, Plasmodium falciparum
AYDSTRRLLDMDLLGEISRVTQTIH

SEQ ID NO: 3255174 - protein, 20 aa, Plasmodium falciparum
AYDTGIRAAEDIAHIGLHLK

SEQ ID NO: 3255175 - protein, 24 aa, Plasmodium falciparum
AYEKAPYFYPWSLKYPENYLSTHK

SEQ ID NO: 3255176 - protein, 18 aa, Plasmodium falciparum
AYFAFSFFNGLIVDYLGS

SEQ ID NO: 3255177 - protein, 21 aa, Plasmodium falciparum
AYFFISTEVIKIFRLLLYCNI

SEQ ID NO: 3255178 - protein, 17 aa, Plasmodium falciparum
AYFNYKDVYTFLMNYKQ

SEQ ID NO: 3255179 - protein, 24 aa, Plasmodium falciparum
AYIKLPENTLIFVITANKFFFQDL

SEQ ID NO: 3255180 - protein, 22 aa, Plasmodium falciparum
AYINLIYCFNIYNTLFYWLHIY

SEQ ID NO: 3255181 - protein, 21 aa, Plasmodium falciparum
AYKDALIFYGLTYGLQLFGQE

SEQ ID NO: 3255182 - protein, 18 aa, Plasmodium falciparum
AYKIKGNVFNISYEPYNI

SEQ ID NO: 3255183 - protein, 20 aa, Plasmodium falciparum
AYKKKNCTFQNYSLKRKSNR

SEQ ID NO: 3255184 - protein, 18 aa, Plasmodium falciparum
AYKKLAMKWHPDKHLNAA

SEQ ID NO: 3255185 - protein, 25 aa, Plasmodium falciparum
AYKLLKNYFYLVSYMMTLPFIKWNI

SEQ ID NO: 3255186 - protein, 18 aa, Plasmodium falciparum
AYLHIIKDIYFHNYKNEY

SEQ ID NO: 3255187 - protein, 17 aa, Plasmodium falciparum
AYMKFLEYIYFKRKLKK

SEQ ID NO: 3255188 - protein, 23 aa, Plasmodium falciparum
AYNRCSFNFVIEYINIRFNTTNI

SEQ ID NO: 3255189 - protein, 17 aa, Plasmodium falciparum
AYRAYPILKELKQKDYF

SEQ ID NO: 3255190 - protein, 28 aa, Plasmodium falciparum
AYRFKLKSKEKHLKFSTKCPSPYLMNVK

SEQ ID NO: 3255191 - protein, 21 aa, Plasmodium falciparum
AYSIFKITDIFLFQNSLALLL

SEQ ID NO: 3255192 - protein, 19 aa, Plasmodium falciparum
AYTPIDIIKYFLINKNYVL

SEQ ID NO: 3255193 - protein, 24 aa, Plasmodium falciparum
AYTPPECWEIYWRYYELKIKEPLE

SEQ ID NO: 3255194 - protein, 25 aa, Plasmodium falciparum
AYTPRGSSYLIIWKVYYNDKKEQFT

SEQ ID NO: 3255195 - protein, 18 aa, Plasmodium falciparum
AYVGTHVVEFLKKVEKNK

SEQ ID NO: 3255196 - protein, 26 aa, Plasmodium falciparum
AYYFFYKLYFLLFVFFFLFKWLTFKI

SEQ ID NO: 3255197 - protein, 23 aa, Plasmodium falciparum
AYYLYKLYYNMFVWDNKNHFDGL

SEQ ID NO: 3255198 - protein, 17 aa, Plasmodium falciparum
AYYNFLVPLYILLCRKE

SEQ ID NO: 3255199 - protein, 20 aa, Plasmodium falciparum
AYYWILEYIVKKGVISRHLS

SEQ ID NO: 3255200 - protein, 19 aa, Plasmodium falciparum
CAAFAAGIVEGFLCSSEFQ

SEQ ID NO: 3255201 - protein, 23 aa, Plasmodium falciparum
CADKYMLGILFIWIWNDGHIWHC

SEQ ID NO: 3255202 - protein, 19 aa, Plasmodium falciparum
CADLFESICAEIIASMILG

SEQ ID NO: 3255203 - protein, 19 aa, Plasmodium falciparum
CADNKIKAYSWMNSLSEAS

SEQ ID NO: 3255204 - protein, 26 aa, Plasmodium falciparum
CAESMNAIFHYVRCIPFIHKKENIIF

SEQ ID NO: 3255205 - protein, 21 aa, Plasmodium falciparum
CAIIFTCFCFFLFTIIYSYVQ

SEQ ID NO: 3255206 - protein, 17 aa, Plasmodium falciparum
CAIILSKVSEKPENVFV

SEQ ID NO: 3255207 - protein, 25 aa, Plasmodium falciparum
CAIQYGSFFFHFHVNGLTFIQWVFC

SEQ ID NO: 3255208 - protein, 23 aa, Plasmodium falciparum
CAKIIKNKIEIFKKNQELSFKKI

SEQ ID NO: 3255209 - protein, 21 aa, Plasmodium falciparum
CALCSLYFKKWAIWKNIPIHC

SEQ ID NO: 3255210 - protein, 23 aa, Plasmodium falciparum
CALIACKVKKLSNVIGIGGGITS

SEQ ID NO: 3255211 - protein, 24 aa, Plasmodium falciparum
CALQVLNWEIPYGIVKKNDNCISK

SEQ ID NO: 3255212 - protein, 18 aa, Plasmodium falciparum
CALYITFFSKVICLSEGY

SEQ ID NO: 3255213 - protein, 20 aa, Plasmodium falciparum
CANIAYKTCTHCMTITGNTV

SEQ ID NO: 3255214 - protein, 19 aa, Plasmodium falciparum
CAPYRRLFLCNKNMEKMGR

SEQ ID NO: 3255215 - protein, 21 aa, Plasmodium falciparum
CAPYRRLSLCNKNFPNMNSKD

SEQ ID NO: 3255216 - protein, 19 aa, Plasmodium falciparum
CAPYRRLSLCNKNMEKKGT

SEQ ID NO: 3255217 - protein, 17 aa, Plasmodium falciparum
CAPYRRLYMCDRNLEHI

SEQ ID NO: 3255218 - protein, 21 aa, Plasmodium falciparum
CAPYRRRNICDYNLEHLNERN

SEQ ID NO: 3255219 - protein, 20 aa, Plasmodium falciparum
CAQISIKSCEYLQKKKRPSD

SEQ ID NO: 3255220 - protein, 17 aa, Plasmodium falciparum
CASFRRLNLCKKNMEKI

SEQ ID NO: 3255221 - protein, 23 aa, Plasmodium falciparum
CAVKEHSFCFSTYISNENALSKR

SEQ ID NO: 3255222 - protein, 24 aa, Plasmodium falciparum
CAVLSGGTLPFFISVFGVILKNMN

SEQ ID NO: 3255223 - protein, 24 aa, Plasmodium falciparum
CCGKYCLRSLILLGSLRKTFFTNE

SEQ ID NO: 3255224 - protein, 17 aa, Plasmodium falciparum
CCLIKYKAHYEFDDNRK

SEQ ID NO: 3255225 - protein, 27 aa, Plasmodium falciparum
CCLKINKYYYYYSWLLFYFIILFFYNI

SEQ ID NO: 3255226 - protein, 22 aa, Plasmodium falciparum
CCLSITLLKFIEWEQYNYDCVV

SEQ ID NO: 3255227 - protein, 33 aa, Plasmodium falciparum
CCNNALRSICIINKFVICVSFGNIIKIINVRNI

SEQ ID NO: 3255228 - protein, 23 aa, Plasmodium falciparum
CCPHNMSQFWLALHNNNLIFYDN

SEQ ID NO: 3255229 - protein, 30 aa, Plasmodium falciparum
CCSNISYFCIFLKFFQIYQVIMFKKDASTD

SEQ ID NO: 3255230 - protein, 22 aa, Plasmodium falciparum
CCYNTFNIFCKKIILFKENNHY

SEQ ID NO: 3255231 - protein, 21 aa, Plasmodium falciparum
CDALHKFDIPIELPKQRLKYI

SEQ ID NO: 3255232 - protein, 17 aa, Plasmodium falciparum
CDCILCKKKHNVCYCNM

SEQ ID NO: 3255233 - protein, 18 aa, Plasmodium falciparum
CDCLKIKDIHNIYMNNKE

SEQ ID NO: 3255234 - protein, 21 aa, Plasmodium falciparum
CDDFLKISFLYPNTINYFASL

SEQ ID NO: 3255235 - protein, 20 aa, Plasmodium falciparum
CDDISLDIFLYCHNFNENYI

SEQ ID NO: 3255236 - protein, 20 aa, Plasmodium falciparum
CDEKSRYSINECINTLTDAI

SEQ ID NO: 3255237 - protein, 20 aa, Plasmodium falciparum
CDFLKMKVDDTIFDNKDFLL

SEQ ID NO: 3255238 - protein, 19 aa, Plasmodium falciparum
CDHYLKFDVDNCRMIINKL

SEQ ID NO: 3255239 - protein, 17 aa, Plasmodium falciparum
CDIIIRFEIIKIQIRSF

SEQ ID NO: 3255240 - protein, 23 aa, Plasmodium falciparum
CDIKCSNFKDWLETKKDEYDIQS

SEQ ID NO: 3255241 - protein, 18 aa, Plasmodium falciparum
CDISNNIFMWLTYINSTS

SEQ ID NO: 3255242 - protein, 19 aa, Plasmodium falciparum
CDKKLIALTKIFGNVMDDS

SEQ ID NO: 3255243 - protein, 19 aa, Plasmodium falciparum
CDKNCLKCKASYHSHCLHK

SEQ ID NO: 3255244 - protein, 17 aa, Plasmodium falciparum
CDLEHRFYTNINNGYLP

SEQ ID NO: 3255245 - protein, 18 aa, Plasmodium falciparum
CDLFLKYKFDPSLKNNNN

SEQ ID NO: 3255246 - protein, 19 aa, Plasmodium falciparum
CDMFNMISNYYFKKFYFNK

SEQ ID NO: 3255247 - protein, 23 aa, Plasmodium falciparum
CDMPLDYFESIIYFFIKKIEDWH

SEQ ID NO: 3255248 - protein, 21 aa, Plasmodium falciparum
CDNIHKCIYYEEKLYREKKEI

SEQ ID NO: 3255249 - protein, 22 aa, Plasmodium falciparum
CDNINFLFSLTVSYFNYSSCFR

SEQ ID NO: 3255250 - protein, 19 aa, Plasmodium falciparum
CDNISRFIEYFKEYEINET

SEQ ID NO: 3255251 - protein, 26 aa, Plasmodium falciparum
CDNIYKKILFCLNIYKKIKKPILIFK

SEQ ID NO: 3255252 - protein, 24 aa, Plasmodium falciparum
CDNLKFEKYIICFEKHPIFRNYLL

SEQ ID NO: 3255253 - protein, 18 aa, Plasmodium falciparum
CDPLDLLFNIQNNIPAMY

SEQ ID NO: 3255254 - protein, 19 aa, Plasmodium falciparum
CDRTCNVGVRIRHFISHMF

SEQ ID NO: 3255255 - protein, 25 aa, Plasmodium falciparum
CDSSFNRKNIKGHTFDSSSEYIHIL

SEQ ID NO: 3255256 - protein, 19 aa, Plasmodium falciparum
CDVFLRSNIEWLSKAINWE

SEQ ID NO: 3255257 - protein, 18 aa, Plasmodium falciparum
CDVIHKLCSFYNDEIKSE

SEQ ID NO: 3255258 - protein, 22 aa, Plasmodium falciparum
CDVSCKIIFIPYVIRYLLNELI

SEQ ID NO: 3255259 - protein, 20 aa, Plasmodium falciparum
CDYSYLYICMCDIGNISFPY

SEQ ID NO: 3255260 - protein, 17 aa, Plasmodium falciparum
CDYYKYNFEYINIKKVL

SEQ ID NO: 3255261 - protein, 18 aa, Plasmodium falciparum
CDYYVCINNIYIYNKHNL

SEQ ID NO: 3255262 - protein, 27 aa, Plasmodium falciparum
CEEECKKECECFQKWIGKKKEEWDKIK

SEQ ID NO: 3255263 - protein, 26 aa, Plasmodium falciparum
CEEKAEIIKGLIIYDYINDYSCYIKY

SEQ ID NO: 3255264 - protein, 17 aa, Plasmodium falciparum
CEEKCKCVSKWIDQKSK

SEQ ID NO: 3255265 - protein, 23 aa, Plasmodium falciparum
CEEKEILLYKILKKLNILNLIYF

SEQ ID NO: 3255266 - protein, 19 aa, Plasmodium falciparum
CEFISTFLITLLLLSLYNY

SEQ ID NO: 3255267 - protein, 17 aa, Plasmodium falciparum
CEFNELKCFNVKRRKKS

SEQ ID NO: 3255268 - protein, 20 aa, Plasmodium falciparum
CEHKSLYYLIQFLKEHVPWG

SEQ ID NO: 3255269 - protein, 19 aa, Plasmodium falciparum
CEIQLKKNILFSSTAIVCG

SEQ ID NO: 3255270 - protein, 36 aa, Plasmodium falciparum
CEKLKKIPMENLKVVLPILCKIVKNILINPNILNTR

SEQ ID NO: 3255271 - protein, 17 aa, Plasmodium falciparum
CEKPCDCFQRWVQQKET

SEQ ID NO: 3255272 - protein, 24 aa, Plasmodium falciparum
CEKSIKIKYLFKIYLGVTTPLEIV

SEQ ID NO: 3255273 - protein, 17 aa, Plasmodium falciparum
CELKKKPSKYELDYSKF

SEQ ID NO: 3255274 - protein, 18 aa, Plasmodium falciparum
CELLDIYRKPSIKDILSH

SEQ ID NO: 3255275 - protein, 25 aa, Plasmodium falciparum
CEMIKDIRRIWIRNLYRDDRVITFS

SEQ ID NO: 3255276 - protein, 23 aa, Plasmodium falciparum
CEMKKEKKLFVILQIPHNINSSS

SEQ ID NO: 3255277 - protein, 24 aa, Plasmodium falciparum
CEMLRAYTVRSWEPFYKVFNRNMW

SEQ ID NO: 3255278 - protein, 19 aa, Plasmodium falciparum
CENFLTFSIYLIIYYEQNE

SEQ ID NO: 3255279 - protein, 17 aa, Plasmodium falciparum
CENISAIFITLGLKEIH

SEQ ID NO: 3255280 - protein, 32 aa, Plasmodium falciparum
CENKNKFYFWCFLFLHIIRINFNKSLLKNYKI

SEQ ID NO: 3255281 - protein, 27 aa, Plasmodium falciparum
CENMIKPKCLTLLQACTFIISGIIPCL

SEQ ID NO: 3255282 - protein, 23 aa, Plasmodium falciparum
CEPNCFCKIVSCDQNLKHIVIFA

SEQ ID NO: 3255283 - protein, 17 aa, Plasmodium falciparum
CEQWKTKEDMLYKSNEV

SEQ ID NO: 3255284 - protein, 18 aa, Plasmodium falciparum
CEYINRIILYKSKENNVV

SEQ ID NO: 3255285 - protein, 17 aa, Plasmodium falciparum
CEYKCMKYPSSQNNNNM

SEQ ID NO: 3255286 - protein, 24 aa, Plasmodium falciparum
CEYKRCKNYILGCEYYDKKSKIKS

SEQ ID NO: 3255287 - protein, 20 aa, Plasmodium falciparum
CEYKVKLKKFKDEILENDKR

SEQ ID NO: 3255288 - protein, 20 aa, Plasmodium falciparum
CEYNTLCLHNSSNINSYSVY

SEQ ID NO: 3255289 - protein, 21 aa, Plasmodium falciparum
CEYSKCGPNSRCYIVEKDKEQ

SEQ ID NO: 3255290 - protein, 18 aa, Plasmodium falciparum
CFDEYLKNDICIENIPII

SEQ ID NO: 3255291 - protein, 20 aa, Plasmodium falciparum
CFDNKLEYEEFLKLQLLHIN

SEQ ID NO: 3255292 - protein, 20 aa, Plasmodium falciparum
CFDSFSLLYCMYKNIIQNIL

SEQ ID NO: 3255293 - protein, 19 aa, Plasmodium falciparum
CFEHLFKKKKFFELWNSFN

SEQ ID NO: 3255294 - protein, 22 aa, Plasmodium falciparum
CFEKHPIFRNYLLSCYDDSSCK

SEQ ID NO: 3255295 - protein, 19 aa, Plasmodium falciparum
CFEQFPFVEIIGGQIKCFT

SEQ ID NO: 3255296 - protein, 19 aa, Plasmodium falciparum
CFFFCLHLALLKIAEVFSE

SEQ ID NO: 3255297 - protein, 18 aa, Plasmodium falciparum
CFFLKRKIWELLHDQTNL

SEQ ID NO: 3255298 - protein, 18 aa, Plasmodium falciparum
CFGLKPWFFLCSDKNGEA

SEQ ID NO: 3255299 - protein, 18 aa, Plasmodium falciparum
CFHDVYFGADLILNSKNV

SEQ ID NO: 3255300 - protein, 20 aa, Plasmodium falciparum
CFIHSCSYAYIEPIIPTIIS

SEQ ID NO: 3255301 - protein, 26 aa, Plasmodium falciparum
CFIKLYKYKLCFLINNTVVQLNNFVR

SEQ ID NO: 3255302 - protein, 26 aa, Plasmodium falciparum
CFILLKRIRYIFLFSIISIILFEIAI

SEQ ID NO: 3255303 - protein, 22 aa, Plasmodium falciparum
CFKNCQCFEKWINKKQDEWNKI

SEQ ID NO: 3255304 - protein, 24 aa, Plasmodium falciparum
CFKSEGQSSIPYFAAGGILVVIVL

SEQ ID NO: 3255305 - protein, 33 aa, Plasmodium falciparum
CFLDNFEFFKLLKFEVIYIILISLKYDLDIDVF

SEQ ID NO: 3255306 - protein, 29 aa, Plasmodium falciparum
CFLDPIKIHPFILICLDKVIGTHQLKIHE

SEQ ID NO: 3255307 - protein, 26 aa, Plasmodium falciparum
CFLIILSCWIFLLRVDNITWFQLYSY

SEQ ID NO: 3255308 - protein, 18 aa, Plasmodium falciparum
CFLLHIRDHIKISIHLKR

SEQ ID NO: 3255309 - protein, 24 aa, Plasmodium falciparum
CFLYNLKNNSCFVFYESIIILLKI

SEQ ID NO: 3255310 - protein, 24 aa, Plasmodium falciparum
CFMNKENYFAIYFYNLANLIKFLF

SEQ ID NO: 3255311 - protein, 25 aa, Plasmodium falciparum
CFNNIKIVILLLEINRCIRHNKGER

SEQ ID NO: 3255312 - protein, 21 aa, Plasmodium falciparum
CFNTKYIYCDKKLYVSKNILP

SEQ ID NO: 3255313 - protein, 20 aa, Plasmodium falciparum
CFRCGGLLGGGIAPGWGLVS

SEQ ID NO: 3255314 - protein, 19 aa, Plasmodium falciparum
CFTIPLSCAYKHFKNNRGF

SEQ ID NO: 3255315 - protein, 22 aa, Plasmodium falciparum
CFYEWLLFIIITNFMLLSCAGE

SEQ ID NO: 3255316 - protein, 18 aa, Plasmodium falciparum
CFYIFKKYIKFMYLIFNK

SEQ ID NO: 3255317 - protein, 20 aa, Plasmodium falciparum
CGACAPYRRLHLCSHNLESI

SEQ ID NO: 3255318 - protein, 18 aa, Plasmodium falciparum
CGCKEYDLFLKNKGKACC

SEQ ID NO: 3255319 - protein, 17 aa, Plasmodium falciparum
CGDSIKANTSKMCHNCI

SEQ ID NO: 3255320 - protein, 24 aa, Plasmodium falciparum
CGEANTVITCFKKSIYDKYYKYII

SEQ ID NO: 3255321 - protein, 18 aa, Plasmodium falciparum
CGEYCGVDICEPNTFDGK

SEQ ID NO: 3255322 - protein, 26 aa, Plasmodium falciparum
CGHRGIIFKVKFFKSTKYICSVSDDR

SEQ ID NO: 3255323 - protein, 19 aa, Plasmodium falciparum
CGIKLVWMKLFSSLEISCK

SEQ ID NO: 3255324 - protein, 27 aa, Plasmodium falciparum
CGILGISEYIYFFFFILFFKSNYDKTN

SEQ ID NO: 3255325 - protein, 17 aa, Plasmodium falciparum
CGKEIFNKYIILQNCSS

SEQ ID NO: 3255326 - protein, 19 aa, Plasmodium falciparum
CGKGYRLLNGNNHMYDEQM

SEQ ID NO: 3255327 - protein, 24 aa, Plasmodium falciparum
CGKSLKHLAGLILDKSDKEAKLII

SEQ ID NO: 3255328 - protein, 22 aa, Plasmodium falciparum
CGKSVTAWMYFFKNFGTHVSTL

SEQ ID NO: 3255329 - protein, 18 aa, Plasmodium falciparum
CGKTMGGVAPGWGLVSGL

SEQ ID NO: 3255330 - protein, 17 aa, Plasmodium falciparum
CGLAKFDNYSCPYFYPN

SEQ ID NO: 3255331 - protein, 19 aa, Plasmodium falciparum
CGLMTFNLDMYDYEDIIKK

SEQ ID NO: 3255332 - protein, 18 aa, Plasmodium falciparum
CGMKKTKNGNGWEEKDTN

SEQ ID NO: 3255333 - protein, 35 aa, Plasmodium falciparum
CGMNIPFYLFCELYKLPLPMLNNFFSFNKKMWNPC

SEQ ID NO: 3255334 - protein, 17 aa, Plasmodium falciparum
CGNHIKDSISIYMKKAC

SEQ ID NO: 3255335 - protein, 33 aa, Plasmodium falciparum
CGNLDFLEIFLMTIKPYRIILTTLDLNIFRNVE

SEQ ID NO: 3255336 - protein, 24 aa, Plasmodium falciparum
CGQYTYKRINLINKLPKWLLNFID

SEQ ID NO: 3255337 - protein, 19 aa, Plasmodium falciparum
CGTLQQFESFCGLNGDESS

SEQ ID NO: 3255338 - protein, 17 aa, Plasmodium falciparum
CGVPLVEIVVEKAYMNS

SEQ ID NO: 3255339 - protein, 21 aa, Plasmodium falciparum
CGYDAKIIFHNSLRKNIQLMF

SEQ ID NO: 3255340 - protein, 17 aa, Plasmodium falciparum
CGYNKSGGNLLIKDLDN

SEQ ID NO: 3255341 - protein, 18 aa, Plasmodium falciparum
CGYQIRFEKSYFLKHSKI

SEQ ID NO: 3255342 - protein, 20 aa, Plasmodium falciparum
CGYYKDMLAKIVRFQASLQN

SEQ ID NO: 3255343 - protein, 17 aa, Plasmodium falciparum
CHCNFPQGKGIGLFNIN

SEQ ID NO: 3255344 - protein, 20 aa, Plasmodium falciparum
CHFDRMKGLLLLLNSSEVTN

SEQ ID NO: 3255345 - protein, 19 aa, Plasmodium falciparum
CHFILNIFELYTLSLNNIS

SEQ ID NO: 3255346 - protein, 17 aa, Plasmodium falciparum
CHFNKIIYYHISYCKSL

SEQ ID NO: 3255347 - protein, 17 aa, Plasmodium falciparum
CHGGVWDELVTLYDPIY

SEQ ID NO: 3255348 - protein, 18 aa, Plasmodium falciparum
CHIKRNPPIYKPHYNQLN

SEQ ID NO: 3255349 - protein, 26 aa, Plasmodium falciparum
CHIMNKCYLYHRWINFLMKKYNKIII

SEQ ID NO: 3255350 - protein, 18 aa, Plasmodium falciparum
CHIQCRKYRKWIEKKFEE

SEQ ID NO: 3255351 - protein, 17 aa, Plasmodium falciparum
CHLQRELTSDLNVLNNL

SEQ ID NO: 3255352 - protein, 17 aa, Plasmodium falciparum
CHNCCDGMSNKASSIEW

SEQ ID NO: 3255353 - protein, 17 aa, Plasmodium falciparum
CHPYCILNEKMKCINYV

SEQ ID NO: 3255354 - protein, 17 aa, Plasmodium falciparum
CHTCKPIWKILFPSKNI

SEQ ID NO: 3255355 - protein, 42 aa, Plasmodium falciparum
CHTKRHLLVYFLKYYIIDKQVCKFLKKIYFIILKYVIYMQNI

SEQ ID NO: 3255356 - protein, 20 aa, Plasmodium falciparum
CIALARSFADIGDIVRGKDM

SEQ ID NO: 3255357 - protein, 17 aa, Plasmodium falciparum
CIASTGVEEKNHLIETN

SEQ ID NO: 3255358 - protein, 17 aa, Plasmodium falciparum
CIAYVKMIYIIIVCIAR

SEQ ID NO: 3255359 - protein, 17 aa, Plasmodium falciparum
CICEKSLADKTEKFCLN

SEQ ID NO: 3255360 - protein, 19 aa, Plasmodium falciparum
CICKDGYLLGTKCIILNSY

SEQ ID NO: 3255361 - protein, 26 aa, Plasmodium falciparum
CIDISVLECFSNFFLIINPKLNIIRS

SEQ ID NO: 3255362 - protein, 31 aa, Plasmodium falciparum
CIDPCMKYRDWIIRSKFEWHTLSKEYETQKV

SEQ ID NO: 3255363 - protein, 25 aa, Plasmodium falciparum
CIDSRCLSEGYLNLYSPLCSNNPYF

SEQ ID NO: 3255364 - protein, 17 aa, Plasmodium falciparum
CIEGCKKKCECVEKWLD

SEQ ID NO: 3255365 - protein, 24 aa, Plasmodium falciparum
CIEIDMSIHAFICPKSFDKTNVKC

SEQ ID NO: 3255366 - protein, 20 aa, Plasmodium falciparum
CIENLCEFYETFVDTQDDLI

SEQ ID NO: 3255367 - protein, 25 aa, Plasmodium falciparum
CIEQLKTYFIHSSYLYKELVNIKSY

SEQ ID NO: 3255368 - protein, 20 aa, Plasmodium falciparum
CIFELIKFFIELIKRPLIYS

SEQ ID NO: 3255369 - protein, 52 aa, Plasmodium falciparum
CIFIIPSLPFCTYFFIKLKWFHKLKTIRLLILWKVQDTFTFFKKIPRKVWRF

SEQ ID NO: 3255370 - protein, 18 aa, Plasmodium falciparum
CIFLSLVSFLLQCKNTLA

SEQ ID NO: 3255371 - protein, 20 aa, Plasmodium falciparum
CIFNYMYYHVILKKSKDING

SEQ ID NO: 3255372 - protein, 20 aa, Plasmodium falciparum
CIFYMPVKIGIYATILGIIT

SEQ ID NO: 3255373 - protein, 24 aa, Plasmodium falciparum
CIGTATYPLICFTLFPIVFYIVFL

SEQ ID NO: 3255374 - protein, 18 aa, Plasmodium falciparum
CIHALNAPGRKNIKTKDA

SEQ ID NO: 3255375 - protein, 19 aa, Plasmodium falciparum
CIIEQKMGYLNINSLKNGI

SEQ ID NO: 3255376 - protein, 19 aa, Plasmodium falciparum
CIIFCCFILPIISHVYIYY

SEQ ID NO: 3255377 - protein, 19 aa, Plasmodium falciparum
CIIFYVYLYIFLSIPIFIF

SEQ ID NO: 3255378 - protein, 26 aa, Plasmodium falciparum
CIIIDRRVDMITPFCTPFTYEGLIDH

SEQ ID NO: 3255379 - protein, 19 aa, Plasmodium falciparum
CIIYLISSILMYAQQNVKN

SEQ ID NO: 3255380 - protein, 21 aa, Plasmodium falciparum
CIKFMLYFLWLLYLLFLNIEF

SEQ ID NO: 3255381 - protein, 24 aa, Plasmodium falciparum
CIKGCKGKCECVKEWLNKKSTEWK

SEQ ID NO: 3255382 - protein, 23 aa, Plasmodium falciparum
CIKHLPYVIIGIMNFFKLYKKFK

SEQ ID NO: 3255383 - protein, 22 aa, Plasmodium falciparum
CIKTKKIVRCFNPFVRTKTIKK

SEQ ID NO: 3255384 - protein, 21 aa, Plasmodium falciparum
CIKTTLKKWFCRYCSENINEN

SEQ ID NO: 3255385 - protein, 18 aa, Plasmodium falciparum
CILDIYYKYMINMYNTDI

SEQ ID NO: 3255386 - protein, 17 aa, Plasmodium falciparum
CILGRKITYTRRKQTSE

SEQ ID NO: 3255387 - protein, 17 aa, Plasmodium falciparum
CILKKNILYSVVAKGDG

SEQ ID NO: 3255388 - protein, 17 aa, Plasmodium falciparum
CILLFRYDILLYIYNIH

SEQ ID NO: 3255389 - protein, 22 aa, Plasmodium falciparum
CILNKCTYSRRWNLNDFLYNYI

SEQ ID NO: 3255390 - protein, 33 aa, Plasmodium falciparum
CILTECVFSFLILFPIRSFRLVGGSLIFIYCIL

SEQ ID NO: 3255391 - protein, 17 aa, Plasmodium falciparum
CILYCFVCECYKNQMID

SEQ ID NO: 3255392 - protein, 23 aa, Plasmodium falciparum
CIMCTSKFFCLYIFNEKHVYKEE

SEQ ID NO: 3255393 - protein, 18 aa, Plasmodium falciparum
CINFYIIFLYILKKNINE

SEQ ID NO: 3255394 - protein, 21 aa, Plasmodium falciparum
CINHLKLNGSLSYNYIFYYLS

SEQ ID NO: 3255395 - protein, 23 aa, Plasmodium falciparum
CIPPRRKRLYVKDLETFSDHTTV

SEQ ID NO: 3255396 - protein, 29 aa, Plasmodium falciparum
CIQECNHTYCFLCFYRLLYMEKKENDNLN

SEQ ID NO: 3255397 - protein, 20 aa, Plasmodium falciparum
CIQKAKWIIENNYRVSNKKS

SEQ ID NO: 3255398 - protein, 17 aa, Plasmodium falciparum
CIQNRIISIKKYCSYSE

SEQ ID NO: 3255399 - protein, 23 aa, Plasmodium falciparum
CIRGCKKPCECFERWVEQKEEEW

SEQ ID NO: 3255400 - protein, 18 aa, Plasmodium falciparum
CISESFYNPPFMINDNDV

SEQ ID NO: 3255401 - protein, 27 aa, Plasmodium falciparum
CISFSARLGVIIKFLLCDYTHIEKEMC

SEQ ID NO: 3255402 - protein, 27 aa, Plasmodium falciparum
CISNIKIPWKLLSHFKNDNTFFIVVYW

SEQ ID NO: 3255403 - protein, 24 aa, Plasmodium falciparum
CITHILCSQLMYLDMNSFNQAIQD

SEQ ID NO: 3255404 - protein, 17 aa, Plasmodium falciparum
CITWDDKTFYPFVKHNS

SEQ ID NO: 3255405 - protein, 26 aa, Plasmodium falciparum
CIVVCGILSSLFSGLSLGIMMLDTLQ

SEQ ID NO: 3255406 - protein, 19 aa, Plasmodium falciparum
CIYIKELAEEYGIGLIKIK

SEQ ID NO: 3255407 - protein, 19 aa, Plasmodium falciparum
CIYYFLKHFYHSLLTIKEE

SEQ ID NO: 3255408 - protein, 27 aa, Plasmodium falciparum
CIYYKNIFLVFISFIKKIFIYFLQLNI

SEQ ID NO: 3255409 - protein, 18 aa, Plasmodium falciparum
CKAMKYSFADLGDIIRGR

SEQ ID NO: 3255410 - protein, 18 aa, Plasmodium falciparum
CKAYKEWLQTWKEHYEKQ

SEQ ID NO: 3255411 - protein, 21 aa, Plasmodium falciparum
CKCKYEKRTIGSILNIINDTN

SEQ ID NO: 3255412 - protein, 17 aa, Plasmodium falciparum
CKCYESWVQQKKTEWNA

SEQ ID NO: 3255413 - protein, 19 aa, Plasmodium falciparum
CKDNLKIIFYDQNNMNNIY

SEQ ID NO: 3255414 - protein, 17 aa, Plasmodium falciparum
CKDRPEVRFSYTEGAEC

SEQ ID NO: 3255415 - protein, 17 aa, Plasmodium falciparum
CKDTIRAQEKLVKGYDC

SEQ ID NO: 3255416 - protein, 21 aa, Plasmodium falciparum
CKEFIRIVKRHTIECMFEELF

SEQ ID NO: 3255417 - protein, 19 aa, Plasmodium falciparum
CKEIKKHTSASEFLKELKH

SEQ ID NO: 3255418 - protein, 25 aa, Plasmodium falciparum
CKEKEIRHQLSFVYNIIKLYILKNK

SEQ ID NO: 3255419 - protein, 20 aa, Plasmodium falciparum
CKESLFKDTINYFFKQVLPK

SEQ ID NO: 3255420 - protein, 20 aa, Plasmodium falciparum
CKFEQPFLYYYFFIETCVNS

SEQ ID NO: 3255421 - protein, 25 aa, Plasmodium falciparum
CKFFKVYSIWNWKYPVLLQNIKKYN

SEQ ID NO: 3255422 - protein, 17 aa, Plasmodium falciparum
CKFVRFQDIDVVPYYLI

SEQ ID NO: 3255423 - protein, 18 aa, Plasmodium falciparum
CKGKRSTHTWICENKGNN

SEQ ID NO: 3255424 - protein, 18 aa, Plasmodium falciparum
CKGLSGIIVERFSDTLGG

SEQ ID NO: 3255425 - protein, 20 aa, Plasmodium falciparum
CKGTEAWGKQSCEFPIKTIT

SEQ ID NO: 3255426 - protein, 17 aa, Plasmodium falciparum
CKHKCECVEKWIKIKEA

SEQ ID NO: 3255427 - protein, 17 aa, Plasmodium falciparum
CKHSYRRLMKRIKKEKD

SEQ ID NO: 3255428 - protein, 20 aa, Plasmodium falciparum
CKIKTSFFKMERIISTDEPS

SEQ ID NO: 3255429 - protein, 17 aa, Plasmodium falciparum
CKILLTSLLNYIRPFIK

SEQ ID NO: 3255430 - protein, 18 aa, Plasmodium falciparum
CKKACRKYKKWIEKKLEE

SEQ ID NO: 3255431 - protein, 19 aa, Plasmodium falciparum
CKKACRKYKKWIEKKLEEF

SEQ ID NO: 3255432 - protein, 46 aa, Plasmodium falciparum
CKKCVKCMKCKKCLKCMKCVKCKKCLKCKKCLKCTKYAKYKKNISL

SEQ ID NO: 3255433 - protein, 20 aa, Plasmodium falciparum
CKKKKKLLFFEGKYININEE

SEQ ID NO: 3255434 - protein, 19 aa, Plasmodium falciparum
CKKKKKLNYIVGIENTCDD

SEQ ID NO: 3255435 - protein, 21 aa, Plasmodium falciparum
CKKKLWRDFLTNESFNKQLSN

SEQ ID NO: 3255436 - protein, 19 aa, Plasmodium falciparum
CKKSFKLLQKKSLKINLYP

SEQ ID NO: 3255437 - protein, 25 aa, Plasmodium falciparum
CKKVKRLWNTDIFKTNKKRNIKYAS

SEQ ID NO: 3255438 - protein, 17 aa, Plasmodium falciparum
CKLIKKDDKNRFYKNIK

SEQ ID NO: 3255439 - protein, 21 aa, Plasmodium falciparum
CKLKEYYILENKKLEISLNII

SEQ ID NO: 3255440 - protein, 21 aa, Plasmodium falciparum
CKLMIYDHFLILYGTPYVCNV

SEQ ID NO: 3255441 - protein, 19 aa, Plasmodium falciparum
CKLNLKKTVKLLLIINIKE

SEQ ID NO: 3255442 - protein, 18 aa, Plasmodium falciparum
CKLPYFKKLLKYIKYMEE

SEQ ID NO: 3255443 - protein, 19 aa, Plasmodium falciparum
CKLYLYLYSYFYYEFYIYS

SEQ ID NO: 3255444 - protein, 17 aa, Plasmodium falciparum
CKLYSVYGYISRNRALN

SEQ ID NO: 3255445 - protein, 19 aa, Plasmodium falciparum
CKMIILDLYGNNIFVDTER

SEQ ID NO: 3255446 - protein, 17 aa, Plasmodium falciparum
CKNCPKPKAQQEGPGGA

SEQ ID NO: 3255447 - protein, 25 aa, Plasmodium falciparum
CKNDCNTNCKCFENWAKTKEKEWEN

SEQ ID NO: 3255448 - protein, 28 aa, Plasmodium falciparum
CKNECNTNCDCFKKWIGKKKEEWDKIKK

SEQ ID NO: 3255449 - protein, 29 aa, Plasmodium falciparum
CKNECNTNCKCFLKWIGKKKTEWGKIVEH

SEQ ID NO: 3255450 - protein, 21 aa, Plasmodium falciparum
CKNFNSKNCSKYSLMEVQNKN

SEQ ID NO: 3255451 - protein, 26 aa, Plasmodium falciparum
CKNGCKTPCKCFEKWIEQKKKEEWTK

SEQ ID NO: 3255452 - protein, 29 aa, Plasmodium falciparum
CKNGTEIRGQLRLKVMVCDENDYISNNNI

SEQ ID NO: 3255453 - protein, 20 aa, Plasmodium falciparum
CKNIQKPLCDTFNKIIYNWI

SEQ ID NO: 3255454 - protein, 18 aa, Plasmodium falciparum
CKNIYLINDKKYYKYINK

SEQ ID NO: 3255455 - protein, 21 aa, Plasmodium falciparum
CKNKCNDKCNCASKWIDEKRT

SEQ ID NO: 3255456 - protein, 19 aa, Plasmodium falciparum
CKNNGFFPGEIIVQKRFAT

SEQ ID NO: 3255457 - protein, 19 aa, Plasmodium falciparum
CKNQIIFLGPNNKFEFYDK

SEQ ID NO: 3255458 - protein, 20 aa, Plasmodium falciparum
CKNRIYIFFMKKIFGKKDNY

SEQ ID NO: 3255459 - protein, 19 aa, Plasmodium falciparum
CKNRSGVRFWCRGSNENGD

SEQ ID NO: 3255460 - protein, 19 aa, Plasmodium falciparum
CKNYILEIFNIYNYDDVDY

SEQ ID NO: 3255461 - protein, 24 aa, Plasmodium falciparum
CKPCSEFKVKCDYDNCTGANANTC

SEQ ID NO: 3255462 - protein, 21 aa, Plasmodium falciparum
CKQYKACDIVKEKLKYSYGQT

SEQ ID NO: 3255463 - protein, 22 aa, Plasmodium falciparum
CKRIVKVEPFFIHKNVRRYVYR

SEQ ID NO: 3255464 - protein, 19 aa, Plasmodium falciparum
CKRKRKFINYNNIQSSYNN

SEQ ID NO: 3255465 - protein, 21 aa, Plasmodium falciparum
CKRSYPFYPRIQRYRRKLLAD

SEQ ID NO: 3255466 - protein, 24 aa, Plasmodium falciparum
CKSEFLNRFNEFFGNKKFRSNNFL

SEQ ID NO: 3255467 - protein, 20 aa, Plasmodium falciparum
CKSITHLGSIYNIKIDSLEK

SEQ ID NO: 3255468 - protein, 19 aa, Plasmodium falciparum
CKSPEEIAIKILKSQNWEN

SEQ ID NO: 3255469 - protein, 17 aa, Plasmodium falciparum
CKSQCGQYEKFITQWKS

SEQ ID NO: 3255470 - protein, 21 aa, Plasmodium falciparum
CKTECKNKCEVYKKFIEDCKG

SEQ ID NO: 3255471 - protein, 26 aa, Plasmodium falciparum
CKTKKLKRRPTCIVDKENNCSKWLLW

SEQ ID NO: 3255472 - protein, 18 aa, Plasmodium falciparum
CKTNKKFNKIACLTNKKF

SEQ ID NO: 3255473 - protein, 18 aa, Plasmodium falciparum
CKTYEDFYIYLNTYYEEY

SEQ ID NO: 3255474 - protein, 21 aa, Plasmodium falciparum
CKYIDEFCMFMLAKYVQNNIQ

SEQ ID NO: 3255475 - protein, 42 aa, Plasmodium falciparum
CKYIRKFNWNDSFFLYILKKYIFKYLMYMSIYQINNLASLLY

SEQ ID NO: 3255476 - protein, 25 aa, Plasmodium falciparum
CKYKIYKYKICKRKKKYTNTHKFYY

SEQ ID NO: 3255477 - protein, 17 aa, Plasmodium falciparum
CKYKIYTEYELKNNIYL

SEQ ID NO: 3255478 - protein, 23 aa, Plasmodium falciparum
CKYKTNCYNVMAALHTKNNRYIH

SEQ ID NO: 3255479 - protein, 20 aa, Plasmodium falciparum
CKYYIFRINLLLNKLYISAG

SEQ ID NO: 3255480 - protein, 24 aa, Plasmodium falciparum
CLALSCADIGISLCNNNESSICSS

SEQ ID NO: 3255481 - protein, 22 aa, Plasmodium falciparum
CLALWLLFLLDVRKCEKLISKL

SEQ ID NO: 3255482 - protein, 20 aa, Plasmodium falciparum
CLAPLTFPALHVGPNEVNDI

SEQ ID NO: 3255483 - protein, 27 aa, Plasmodium falciparum
CLENSFGNKCFRNLPAYYNHLTNECVI

SEQ ID NO: 3255484 - protein, 18 aa, Plasmodium falciparum
CLFMLHGELLFFCKKHEN

SEQ ID NO: 3255485 - protein, 18 aa, Plasmodium falciparum
CLGILYFPSLIEYDEEIK

SEQ ID NO: 3255486 - protein, 19 aa, Plasmodium falciparum
CLGISFVLYILLSVCEGHK

SEQ ID NO: 3255487 - protein, 24 aa, Plasmodium falciparum
CLGTDFRFSALIKDFKTHNVNSDL

SEQ ID NO: 3255488 - protein, 25 aa, Plasmodium falciparum
CLGYSNGYCCFVILKEEYDNYTNCK

SEQ ID NO: 3255489 - protein, 29 aa, Plasmodium falciparum
CLHLYIKFKKEIYTNLLINKNEMNKYMNI

SEQ ID NO: 3255490 - protein, 17 aa, Plasmodium falciparum
CLHPLKGIKIGLYIFNN

SEQ ID NO: 3255491 - protein, 18 aa, Plasmodium falciparum
CLICMTSYKDTLLMPCRH

SEQ ID NO: 3255492 - protein, 18 aa, Plasmodium falciparum
CLIGSGGDSSHDLIKQFL

SEQ ID NO: 3255493 - protein, 20 aa, Plasmodium falciparum
CLIKDIKLNHVFNKDIINIF

SEQ ID NO: 3255494 - protein, 21 aa, Plasmodium falciparum
CLIYSSSFLGYRLVLRNKNTM

SEQ ID NO: 3255495 - protein, 20 aa, Plasmodium falciparum
CLKCGGILGTTIPKLALLGG

SEQ ID NO: 3255496 - protein, 18 aa, Plasmodium falciparum
CLKCGGVLGSGIAPSVGL

SEQ ID NO: 3255497 - protein, 18 aa, Plasmodium falciparum
CLKGCDYKNLKSIALTFF

SEQ ID NO: 3255498 - protein, 20 aa, Plasmodium falciparum
CLKNGKAIKCTDKCKGDCKC

SEQ ID NO: 3255499 - protein, 21 aa, Plasmodium falciparum
CLKRKNLWNNIGINSITLSLI

SEQ ID NO: 3255500 - protein, 17 aa, Plasmodium falciparum
CLLDCIIIPIVMFTLSV

SEQ ID NO: 3255501 - protein, 32 aa, Plasmodium falciparum
CLLFYKNGTYQFGFKFDTFYNYRNLKNTFLSE

SEQ ID NO: 3255502 - protein, 20 aa, Plasmodium falciparum
CLLKKGRKNEYLNFYCDGMG

SEQ ID NO: 3255503 - protein, 19 aa, Plasmodium falciparum
CLLLIIPTFERIFLNYKIK

SEQ ID NO: 3255504 - protein, 19 aa, Plasmodium falciparum
CLLLLSGIQIYFICPSKKK

SEQ ID NO: 3255505 - protein, 23 aa, Plasmodium falciparum
CLNAIKPIFTFYFLRNVKVSKCL

SEQ ID NO: 3255506 - protein, 29 aa, Plasmodium falciparum
CLNIKKKLFLDFYIDIFLFNHFIYSNKCS

SEQ ID NO: 3255507 - protein, 20 aa, Plasmodium falciparum
CLNIPSRICMSLPMLKDEIY

SEQ ID NO: 3255508 - protein, 24 aa, Plasmodium falciparum
CLNKFVNILEGFIFEGIQKDDIKK

SEQ ID NO: 3255509 - protein, 24 aa, Plasmodium falciparum
CLNKRSKCFQNWILNRDITSGQYN

SEQ ID NO: 3255510 - protein, 20 aa, Plasmodium falciparum
CLNPTWLNLYGFHKKEFDLE

SEQ ID NO: 3255511 - protein, 22 aa, Plasmodium falciparum
CLNVKRKIWVMWAQKFYEEIEQ

SEQ ID NO: 3255512 - protein, 17 aa, Plasmodium falciparum
CLNYKFPSFKPERLHIV

SEQ ID NO: 3255513 - protein, 25 aa, Plasmodium falciparum
CLNYPSLRSPYSLNTFKKKYPNMEK

SEQ ID NO: 3255514 - protein, 21 aa, Plasmodium falciparum
CLQILKMLIHVIIYEHELRLK

SEQ ID NO: 3255515 - protein, 20 aa, Plasmodium falciparum
CLRCGCGLGGVAASVGIIGP

SEQ ID NO: 3255516 - protein, 20 aa, Plasmodium falciparum
CLRCGCGLGGVAASVGVLGT

SEQ ID NO: 3255517 - protein, 21 aa, Plasmodium falciparum
CLRCGCGLGSVAGSIGLFGAV

SEQ ID NO: 3255518 - protein, 20 aa, Plasmodium falciparum
CLRCGSVFGGGIAPSVGLLG

SEQ ID NO: 3255519 - protein, 20 aa, Plasmodium falciparum
CLRNAPYIDDPLWGSVVTDK

SEQ ID NO: 3255520 - protein, 20 aa, Plasmodium falciparum
CLSILYDHWSPVLSVNSICL

SEQ ID NO: 3255521 - protein, 23 aa, Plasmodium falciparum
CLSSQEIINFFALPKDLLIRCNF

SEQ ID NO: 3255522 - protein, 24 aa, Plasmodium falciparum
CLTICVIGMLCIKLRDKYEGYAAS

SEQ ID NO: 3255523 - protein, 27 aa, Plasmodium falciparum
CLTLSGLFYYLGLKPVNRNVCNALYIW

SEQ ID NO: 3255524 - protein, 17 aa, Plasmodium falciparum
CLVQCAYPFKKYFPQYE

SEQ ID NO: 3255525 - protein, 21 aa, Plasmodium falciparum
CLYIRIPKPDKILFNNHILDF

SEQ ID NO: 3255526 - protein, 27 aa, Plasmodium falciparum
CLYNINDLFALFIFYVHIKRFYFDFFF

SEQ ID NO: 3255527 - protein, 27 aa, Plasmodium falciparum
CLYSLPGNFISCYIYIITCVKITQREL

SEQ ID NO: 3255528 - protein, 20 aa, Plasmodium falciparum
CLYYEKYKWYDIKNVINIKC

SEQ ID NO: 3255529 - protein, 19 aa, Plasmodium falciparum
CLYYFKISVALAVAAIPEG

SEQ ID NO: 3255530 - protein, 18 aa, Plasmodium falciparum
CMCINKYIYICNLIYNCL

SEQ ID NO: 3255531 - protein, 19 aa, Plasmodium falciparum
CMDVFLGSILNFVTHNINE

SEQ ID NO: 3255532 - protein, 17 aa, Plasmodium falciparum
CMDYCCMNNVCMHNNCM

SEQ ID NO: 3255533 - protein, 27 aa, Plasmodium falciparum
CMFPVWPLRLKLALWHISVAFLTLISI

SEQ ID NO: 3255534 - protein, 23 aa, Plasmodium falciparum
CMKTKIFVIRKVCNFKNRPFSSN

SEQ ID NO: 3255535 - protein, 20 aa, Plasmodium falciparum
CMLQELLPLLPLENLIVRVQ

SEQ ID NO: 3255536 - protein, 22 aa, Plasmodium falciparum
CMPKECWDIVKEYMRLKIKNPL

SEQ ID NO: 3255537 - protein, 23 aa, Plasmodium falciparum
CMPPRRIKLCIYYLENHTQKGNI

SEQ ID NO: 3255538 - protein, 22 aa, Plasmodium falciparum
CMPPRRQKLCVYFFANPSQIGS

SEQ ID NO: 3255539 - protein, 21 aa, Plasmodium falciparum
CMSYEPSIRLTFKHTFQNLNI

SEQ ID NO: 3255540 - protein, 17 aa, Plasmodium falciparum
CMWMKSTYSNYVDTNKE

SEQ ID NO: 3255541 - protein, 18 aa, Plasmodium falciparum
CNEHFYLIIIKYIKYLFV

SEQ ID NO: 3255542 - protein, 25 aa, Plasmodium falciparum
CNETCTTCGPAAIDYVPADAPNGYA

SEQ ID NO: 3255543 - protein, 22 aa, Plasmodium falciparum
CNEYNFDVPFHLRNSSNKYIYT

SEQ ID NO: 3255544 - protein, 17 aa, Plasmodium falciparum
CNFDFRFDTNAPDKGSY

SEQ ID NO: 3255545 - protein, 17 aa, Plasmodium falciparum
CNFKELINITKYIYHFQ

SEQ ID NO: 3255546 - protein, 17 aa, Plasmodium falciparum
CNFKKEDIFNYIIETSI

SEQ ID NO: 3255547 - protein, 19 aa, Plasmodium falciparum
CNFKLYKKKFLNKFNSENI

SEQ ID NO: 3255548 - protein, 17 aa, Plasmodium falciparum
CNGHVIINYNFVRTVPI

SEQ ID NO: 3255549 - protein, 24 aa, Plasmodium falciparum
CNHFKKKYIALKIIRKIIKKYKNN

SEQ ID NO: 3255550 - protein, 24 aa, Plasmodium falciparum
CNHICCYKCMYYSLLHKRNCPICK

SEQ ID NO: 3255551 - protein, 21 aa, Plasmodium falciparum
CNHPIHSVWKDTTRGHCSWRC

SEQ ID NO: 3255552 - protein, 28 aa, Plasmodium falciparum
CNIETSIWIELCLFLSKNFNIYGSKFID

SEQ ID NO: 3255553 - protein, 17 aa, Plasmodium falciparum
CNIFRNTFNISKCDIIN

SEQ ID NO: 3255554 - protein, 19 aa, Plasmodium falciparum
CNIIHPCLVKAMMLPKYLF

SEQ ID NO: 3255555 - protein, 18 aa, Plasmodium falciparum
CNIIKPPRVHHCAECFHC

SEQ ID NO: 3255556 - protein, 17 aa, Plasmodium falciparum
CNIKISYKILKDYMLNG

SEQ ID NO: 3255557 - protein, 18 aa, Plasmodium falciparum
CNILCVLLKESSYHNINH

SEQ ID NO: 3255558 - protein, 19 aa, Plasmodium falciparum
CNILYSFSRCQLAIKSNHT

SEQ ID NO: 3255559 - protein, 26 aa, Plasmodium falciparum
CNIMKTCLLQFLSIFYEELSKVNIFK

SEQ ID NO: 3255560 - protein, 17 aa, Plasmodium falciparum
CNINIEIYFCMICWNNI

SEQ ID NO: 3255561 - protein, 22 aa, Plasmodium falciparum
CNIYLKSLSNIHIFTNYNLLIN

SEQ ID NO: 3255562 - protein, 26 aa, Plasmodium falciparum
CNIYPILKRTFESFVSYLSNLLEHKD

SEQ ID NO: 3255563 - protein, 17 aa, Plasmodium falciparum
CNKECGCFQKWVEQKKK

SEQ ID NO: 3255564 - protein, 20 aa, Plasmodium falciparum
CNKKGPFVWNCDNTIDSSYN

SEQ ID NO: 3255565 - protein, 23 aa, Plasmodium falciparum
CNKKINFSWKYLKKININVYNSV

SEQ ID NO: 3255566 - protein, 21 aa, Plasmodium falciparum
CNKNYSLVYLFIGILIEYISF

SEQ ID NO: 3255567 - protein, 19 aa, Plasmodium falciparum
CNKYISYRIFFLFEFYFNI

SEQ ID NO: 3255568 - protein, 21 aa, Plasmodium falciparum
CNLCLMSWISTRQCWYDCDEL

SEQ ID NO: 3255569 - protein, 19 aa, Plasmodium falciparum
CNLLLKMNWMISAVVYPAC

SEQ ID NO: 3255570 - protein, 18 aa, Plasmodium falciparum
CNLSEYIQNFLKSINEKD

SEQ ID NO: 3255571 - protein, 19 aa, Plasmodium falciparum
CNLYFKSKIFYLNKKIKKM

SEQ ID NO: 3255572 - protein, 19 aa, Plasmodium falciparum
CNNFFKNSLNNILNYKKGS

SEQ ID NO: 3255573 - protein, 19 aa, Plasmodium falciparum
CNNGHLFENIILFIYKEYE

SEQ ID NO: 3255574 - protein, 22 aa, Plasmodium falciparum
CNNIYKKVFFNFKRKKSDNKEK

SEQ ID NO: 3255575 - protein, 30 aa, Plasmodium falciparum
CNNMIIQLIKLWFKLYVTYMNILKELFKYS

SEQ ID NO: 3255576 - protein, 21 aa, Plasmodium falciparum
CNRLFTLNYKKLYPLNNYIEG

SEQ ID NO: 3255577 - protein, 28 aa, Plasmodium falciparum
CNSHNKFVEYFFYFAIKKPNDYLKKKQC

SEQ ID NO: 3255578 - protein, 23 aa, Plasmodium falciparum
CNSTFIRIRYQRILIQTEELSPT

SEQ ID NO: 3255579 - protein, 26 aa, Plasmodium falciparum
CNTFSRDTFPYSFRYSNNFSKSSTLN

SEQ ID NO: 3255580 - protein, 18 aa, Plasmodium falciparum
CNVECGMESNVYSNAESV

SEQ ID NO: 3255581 - protein, 21 aa, Plasmodium falciparum
CNWLNKPRKYEWFEWNMVVKK

SEQ ID NO: 3255582 - protein, 17 aa, Plasmodium falciparum
CNYELTQYIGWNTMVKQ

SEQ ID NO: 3255583 - protein, 17 aa, Plasmodium falciparum
CNYFVNFVKRKKRKKGS

SEQ ID NO: 3255584 - protein, 23 aa, Plasmodium falciparum
CNYIFCDYLKYHIKRKKKKSYIH

SEQ ID NO: 3255585 - protein, 19 aa, Plasmodium falciparum
CNYKTCVVLDLGYINCRIL

SEQ ID NO: 3255586 - protein, 28 aa, Plasmodium falciparum
CNYLKRKKRTFPFFDIFNKAISYILCNY

SEQ ID NO: 3255587 - protein, 17 aa, Plasmodium falciparum
CNYRMKKIWNINHIENK

SEQ ID NO: 3255588 - protein, 24 aa, Plasmodium falciparum
CNYSVHCKIFFKRINLQENILKNK

SEQ ID NO: 3255589 - protein, 18 aa, Plasmodium falciparum
CPDDKMYNKECDKEVRNY

SEQ ID NO: 3255590 - protein, 18 aa, Plasmodium falciparum
CPFYNIFEILNFEKFFNS

SEQ ID NO: 3255591 - protein, 18 aa, Plasmodium falciparum
CPGCGVERNGSGWEEKSG

SEQ ID NO: 3255592 - protein, 22 aa, Plasmodium falciparum
CPGDIIPDCFFQVYQPESEELE

SEQ ID NO: 3255593 - protein, 22 aa, Plasmodium falciparum
CPKCGKHCSSYRKWINTKKTQY

SEQ ID NO: 3255594 - protein, 18 aa, Plasmodium falciparum
CPKFKVDCKNGKCDNDKG

SEQ ID NO: 3255595 - protein, 19 aa, Plasmodium falciparum
CPLSYLQLRLWRNKNCYEQ

SEQ ID NO: 3255596 - protein, 18 aa, Plasmodium falciparum
CPNKIDGNISINCIHENF

SEQ ID NO: 3255597 - protein, 26 aa, Plasmodium falciparum
CPSNIPQPRNHLFIYFRTSSRISHEE

SEQ ID NO: 3255598 - protein, 19 aa, Plasmodium falciparum
CPWCGAQKVEGGWKDKNKD

SEQ ID NO: 3255599 - protein, 20 aa, Plasmodium falciparum
CPYCGMKKKVPGKEWEKKND

SEQ ID NO: 3255600 - protein, 18 aa, Plasmodium falciparum
CPYFKVLTNKDCENDICV

SEQ ID NO: 3255601 - protein, 19 aa, Plasmodium falciparum
CPYTHIETINKYNEEIKKK

SEQ ID NO: 3255602 - protein, 25 aa, Plasmodium falciparum
CQAVHLCIIKKIYIKPLYQNFLKYL

SEQ ID NO: 3255603 - protein, 21 aa, Plasmodium falciparum
CQDKFIKFTLMYVSKNSQMYK

SEQ ID NO: 3255604 - protein, 24 aa, Plasmodium falciparum
CQHEKDSWTFLKYMSPNKIDKALC

SEQ ID NO: 3255605 - protein, 18 aa, Plasmodium falciparum
CQIHQYFFKHTFPKKNLN

SEQ ID NO: 3255606 - protein, 18 aa, Plasmodium falciparum
CQKECIKYKKWIVNKRNE

SEQ ID NO: 3255607 - protein, 24 aa, Plasmodium falciparum
CQLESCEKCVLLANRGISSSNNNN

SEQ ID NO: 3255608 - protein, 17 aa, Plasmodium falciparum
CQLYSCLVFNGMKSAVQ

SEQ ID NO: 3255609 - protein, 17 aa, Plasmodium falciparum
CQMCKRCVRTFDHHCPW

SEQ ID NO: 3255610 - protein, 26 aa, Plasmodium falciparum
CQNKCQNKCKCVGEWIKLKQQEWEEI

SEQ ID NO: 3255611 - protein, 25 aa, Plasmodium falciparum
CQNKCQNKCKCVGEWIPKKREEWEK

SEQ ID NO: 3255612 - protein, 24 aa, Plasmodium falciparum
CQNKCQNKCKCVGEWIPKKREEWQ

SEQ ID NO: 3255613 - protein, 33 aa, Plasmodium falciparum
CQNLFYEILHFILLKLLYYIIVIFICSLNGNIL

SEQ ID NO: 3255614 - protein, 26 aa, Plasmodium falciparum
CQRYVHICYYLFIYCTYKYHCELCDA

SEQ ID NO: 3255615 - protein, 17 aa, Plasmodium falciparum
CQSLLPVSYASHQMYSF

SEQ ID NO: 3255616 - protein, 21 aa, Plasmodium falciparum
CQSLLYLFFHFIKKCYNSFRN

SEQ ID NO: 3255617 - protein, 18 aa, Plasmodium falciparum
CQYSCAPFVDWIDNQKLE

SEQ ID NO: 3255618 - protein, 25 aa, Plasmodium falciparum
CRDCGKYCTFYKRWINGKKTEYDEQ

SEQ ID NO: 3255619 - protein, 31 aa, Plasmodium falciparum
CRDCHKQCRKYRKWIDIKFEEFQNQKSIYQA

SEQ ID NO: 3255620 - protein, 28 aa, Plasmodium falciparum
CRDCYKQCRKYRKWIEKKVEEFHKQEKK

SEQ ID NO: 3255621 - protein, 20 aa, Plasmodium falciparum
CRDKEYKEKCYIKYETPKFL

SEQ ID NO: 3255622 - protein, 19 aa, Plasmodium falciparum
CREACKSYKEWTDKKFKEY

SEQ ID NO: 3255623 - protein, 20 aa, Plasmodium falciparum
CRKAEETLNNIIHVHEKDKD

SEQ ID NO: 3255624 - protein, 22 aa, Plasmodium falciparum
CRKILFLKDIMKLLNHINYENF

SEQ ID NO: 3255625 - protein, 18 aa, Plasmodium falciparum
CRKKIISSIIFDMICPYL

SEQ ID NO: 3255626 - protein, 17 aa, Plasmodium falciparum
CRKNVHERNNWLGSSVK

SEQ ID NO: 3255627 - protein, 27 aa, Plasmodium falciparum
CRLEMKLSNNPYLCFECFINEMNAHTG

SEQ ID NO: 3255628 - protein, 17 aa, Plasmodium falciparum
CRLRGKCFLENFYEYIV

SEQ ID NO: 3255629 - protein, 21 aa, Plasmodium falciparum
CRLRKRYETLISHKTELLTSS

SEQ ID NO: 3255630 - protein, 19 aa, Plasmodium falciparum
CRLYIRYTRSFFKYFETKY

SEQ ID NO: 3255631 - protein, 23 aa, Plasmodium falciparum
CRMKLREWIVRITAASTLIIMWI

SEQ ID NO: 3255632 - protein, 29 aa, Plasmodium falciparum
CRNGCHGKCDCFKRWIDKKEKDEWDKIKE

SEQ ID NO: 3255633 - protein, 18 aa, Plasmodium falciparum
CRNGDSCEFCHHIDHSNL

SEQ ID NO: 3255634 - protein, 25 aa, Plasmodium falciparum
CRNIYYELYTSFDIDFFSLNEINII

SEQ ID NO: 3255635 - protein, 26 aa, Plasmodium falciparum
CRNKCKKKCDCVGKWVEEKKNEWEKI

SEQ ID NO: 3255636 - protein, 19 aa, Plasmodium falciparum
CRNKNELNIHSEKQCIDIS

SEQ ID NO: 3255637 - protein, 17 aa, Plasmodium falciparum
CRNLKYHYIILLITAIV

SEQ ID NO: 3255638 - protein, 19 aa, Plasmodium falciparum
CRNLNILHCNTNNIIINRN

SEQ ID NO: 3255639 - protein, 20 aa, Plasmodium falciparum
CRNNYICICEKIEREQLRKK

SEQ ID NO: 3255640 - protein, 17 aa, Plasmodium falciparum
CRRKSFNGLENMGNYKY

SEQ ID NO: 3255641 - protein, 17 aa, Plasmodium falciparum
CRSIIFAGHTIELNSLM

SEQ ID NO: 3255642 - protein, 25 aa, Plasmodium falciparum
CRTFCVDRAISILIFLRKKFVVDVL

SEQ ID NO: 3255643 - protein, 19 aa, Plasmodium falciparum
CSAFLYMCVTSVYTSQIYC

SEQ ID NO: 3255644 - protein, 20 aa, Plasmodium falciparum
CSCYHEIYDQFYLLQSLFKN

SEQ ID NO: 3255645 - protein, 21 aa, Plasmodium falciparum
CSDIFLSSVIHSYASVNYKDK

SEQ ID NO: 3255646 - protein, 28 aa, Plasmodium falciparum
CSDKELKYSVSVYILFLVCKYCYAPINL

SEQ ID NO: 3255647 - protein, 20 aa, Plasmodium falciparum
CSDNAFLRASQMNTLVNKNN

SEQ ID NO: 3255648 - protein, 33 aa, Plasmodium falciparum
CSDNLAFFFGCVAPFLFAWIFSNGLIFSDTFNY

SEQ ID NO: 3255649 - protein, 22 aa, Plasmodium falciparum
CSDTFGIFFGYVLNYLLQTYKI

SEQ ID NO: 3255650 - protein, 18 aa, Plasmodium falciparum
CSECEYNTLCLHNSSNIN

SEQ ID NO: 3255651 - protein, 17 aa, Plasmodium falciparum
CSEHVGKDIGLEVHNYI

SEQ ID NO: 3255652 - protein, 24 aa, Plasmodium falciparum
CSEIRICVKEYLLLHGVYNKNKEK

SEQ ID NO: 3255653 - protein, 20 aa, Plasmodium falciparum
CSEYQFYANKNCVITQNKNN

SEQ ID NO: 3255654 - protein, 18 aa, Plasmodium falciparum
CSFLLYILVLYYEILIFL

SEQ ID NO: 3255655 - protein, 17 aa, Plasmodium falciparum
CSFVLFFHKLSICEKLD

SEQ ID NO: 3255656 - protein, 20 aa, Plasmodium falciparum
CSFYLHKPVYIFDEEKDKEE

SEQ ID NO: 3255657 - protein, 17 aa, Plasmodium falciparum
CSGGKTPTQGKCRCIDF

SEQ ID NO: 3255658 - protein, 20 aa, Plasmodium falciparum
CSHFQFKYKQGLNEVLALFF

SEQ ID NO: 3255659 - protein, 17 aa, Plasmodium falciparum
CSICLNDFQIDECVRTL

SEQ ID NO: 3255660 - protein, 18 aa, Plasmodium falciparum
CSIFSDCIYNIFNSDTYN

SEQ ID NO: 3255661 - protein, 19 aa, Plasmodium falciparum
CSILLIVVFIYLCIVSMYR

SEQ ID NO: 3255662 - protein, 18 aa, Plasmodium falciparum
CSIQCALIGFIILLIIAI

SEQ ID NO: 3255663 - protein, 19 aa, Plasmodium falciparum
CSIQLYKKGGISIFYSSYA

SEQ ID NO: 3255664 - protein, 21 aa, Plasmodium falciparum
CSIYIMITISWFFNQINIGMY

SEQ ID NO: 3255665 - protein, 19 aa, Plasmodium falciparum
CSIYIYLNNCCKKKNMQKQ

SEQ ID NO: 3255666 - protein, 26 aa, Plasmodium falciparum
CSKHFGMYEICRYILQAYLYNNLKKE

SEQ ID NO: 3255667 - protein, 21 aa, Plasmodium falciparum
CSKQLIWKEGPLYTGDIINSI

SEQ ID NO: 3255668 - protein, 24 aa, Plasmodium falciparum
CSLDPVNNRLCLSIFFYMDSSGKI

SEQ ID NO: 3255669 - protein, 19 aa, Plasmodium falciparum
CSLESALMYNKLKNIMINE

SEQ ID NO: 3255670 - protein, 19 aa, Plasmodium falciparum
CSLLLNFLILLLYTFFNSF

SEQ ID NO: 3255671 - protein, 27 aa, Plasmodium falciparum
CSLNIIYKYIRIWLLRLKLQDVDVFFC

SEQ ID NO: 3255672 - protein, 18 aa, Plasmodium falciparum
CSLPRLNYLSNISLFSFA

SEQ ID NO: 3255673 - protein, 19 aa, Plasmodium falciparum
CSLSRPFNIQSFVSVLIFS

SEQ ID NO: 3255674 - protein, 32 aa, Plasmodium falciparum
CSLYFERIGYCQGMNYIAGILLLVFRKNIDTI

SEQ ID NO: 3255675 - protein, 20 aa, Plasmodium falciparum
CSMALCKTGKCVPTNDKPYY

SEQ ID NO: 3255676 - protein, 20 aa, Plasmodium falciparum
CSMILHSIGYYKFYMKKIKG

SEQ ID NO: 3255677 - protein, 26 aa, Plasmodium falciparum
CSNFWYSKDEIYTWNVLTGKEKNRRN

SEQ ID NO: 3255678 - protein, 24 aa, Plasmodium falciparum
CSNLCIYYFDLLHRYNIKKNNFIK

SEQ ID NO: 3255679 - protein, 20 aa, Plasmodium falciparum
CSNLHDWKLFCGLPTIRFRK

SEQ ID NO: 3255680 - protein, 20 aa, Plasmodium falciparum
CSNNIFFSFFQKIQMNKYEL

SEQ ID NO: 3255681 - protein, 17 aa, Plasmodium falciparum
CSPKEYFTNITKEYTLY

SEQ ID NO: 3255682 - protein, 20 aa, Plasmodium falciparum
CSPPYKSDYFRYIQKKKIQN

SEQ ID NO: 3255683 - protein, 26 aa, Plasmodium falciparum
CSSFKIDCKKAKCSNRDDTNVGFNCK

SEQ ID NO: 3255684 - protein, 20 aa, Plasmodium falciparum
CSSHGRVFFKTTYVKHKNYR

SEQ ID NO: 3255685 - protein, 22 aa, Plasmodium falciparum
CSSLCKENYFPPILNLNKAYRN

SEQ ID NO: 3255686 - protein, 24 aa, Plasmodium falciparum
CSSSDWRFKLITSRIQNKINTFLN

SEQ ID NO: 3255687 - protein, 19 aa, Plasmodium falciparum
CSSSFTISLILVDNNADNM

SEQ ID NO: 3255688 - protein, 17 aa, Plasmodium falciparum
CSSSNSIYCNKNEYTSD

SEQ ID NO: 3255689 - protein, 18 aa, Plasmodium falciparum
CSSYRKWIKGKKTQYEKQ

SEQ ID NO: 3255690 - protein, 17 aa, Plasmodium falciparum
CSSYRKWINTKKTQYEK

SEQ ID NO: 3255691 - protein, 25 aa, Plasmodium falciparum
CSVAVFCSLMILRAMTMIPKNKNFE

SEQ ID NO: 3255692 - protein, 18 aa, Plasmodium falciparum
CSVGSALLTMFGLAVAKK

SEQ ID NO: 3255693 - protein, 24 aa, Plasmodium falciparum
CSVIKSRILIILFYLCNRDYSREK

SEQ ID NO: 3255694 - protein, 18 aa, Plasmodium falciparum
CSVLCFLDNSGILVNTNH

SEQ ID NO: 3255695 - protein, 22 aa, Plasmodium falciparum
CSVSSNVSLFFYKVDKYKPHIL

SEQ ID NO: 3255696 - protein, 20 aa, Plasmodium falciparum
CSVVQISIVTNEDFLKKVRE

SEQ ID NO: 3255697 - protein, 17 aa, Plasmodium falciparum
CSVWCRLYEKWIDNQKK

SEQ ID NO: 3255698 - protein, 17 aa, Plasmodium falciparum
CSVWCRLYEKWIDNQKL

SEQ ID NO: 3255699 - protein, 18 aa, Plasmodium falciparum
CSYSCSPFVKWIDNQKLE

SEQ ID NO: 3255700 - protein, 20 aa, Plasmodium falciparum
CTALARSFADIGDIIRGKDL

SEQ ID NO: 3255701 - protein, 20 aa, Plasmodium falciparum
CTALARSFADIGDIVRGKDL

SEQ ID NO: 3255702 - protein, 20 aa, Plasmodium falciparum
CTALARSFADIGDIVRGKDM

SEQ ID NO: 3255703 - protein, 22 aa, Plasmodium falciparum
CTALKRKDRVRCERKIKLKEKF

SEQ ID NO: 3255704 - protein, 25 aa, Plasmodium falciparum
CTDGNKENCGAATSLLNNSSNIASI

SEQ ID NO: 3255705 - protein, 19 aa, Plasmodium falciparum
CTDIYDFIGSYFPIKEKNK

SEQ ID NO: 3255706 - protein, 20 aa, Plasmodium falciparum
CTDVCRKNCECIDKWIEMKM

SEQ ID NO: 3255707 - protein, 18 aa, Plasmodium falciparum
CTDYDKWIINKRKEYKMQ

SEQ ID NO: 3255708 - protein, 18 aa, Plasmodium falciparum
CTEEIRVAQRRQMILKKK

SEQ ID NO: 3255709 - protein, 21 aa, Plasmodium falciparum
CTFMFKMVINNLAYYHDLGNI

SEQ ID NO: 3255710 - protein, 21 aa, Plasmodium falciparum
CTGLISILICYIIKNNLFYYF

SEQ ID NO: 3255711 - protein, 21 aa, Plasmodium falciparum
CTHCDKYLFQCKEVKKDKSIF

SEQ ID NO: 3255712 - protein, 18 aa, Plasmodium falciparum
CTIFSIKTDDKFVNVQHK

SEQ ID NO: 3255713 - protein, 25 aa, Plasmodium falciparum
CTIICNKLKIYLYHILCKTGDGEKK

SEQ ID NO: 3255714 - protein, 24 aa, Plasmodium falciparum
CTKCPRKMFCPGYWLENYENEIHH

SEQ ID NO: 3255715 - protein, 28 aa, Plasmodium falciparum
CTKCSFWCGFYKKWLENQKQEFLKQKKK

SEQ ID NO: 3255716 - protein, 25 aa, Plasmodium falciparum
CTKCSFWCRMYETWIDNQKKEFLKQ

SEQ ID NO: 3255717 - protein, 33 aa, Plasmodium falciparum
CTKIKNMILLFIMKRFVCIDIKNINIIFEDNII

SEQ ID NO: 3255718 - protein, 19 aa, Plasmodium falciparum
CTKTIRAKYIYAIGSECTK

SEQ ID NO: 3255719 - protein, 24 aa, Plasmodium falciparum
CTKTIYKKGRIVVGYECTSCSVWC

SEQ ID NO: 3255720 - protein, 18 aa, Plasmodium falciparum
CTLEESLKHKDVVYTTNN

SEQ ID NO: 3255721 - protein, 25 aa, Plasmodium falciparum
CTLKDCIRAIYLLKENGFKVDIHLM

SEQ ID NO: 3255722 - protein, 25 aa, Plasmodium falciparum
CTLKHFPYDIVHTIEYARDIFQGLF

SEQ ID NO: 3255723 - protein, 17 aa, Plasmodium falciparum
CTLKRIYFYTLYIWLIF

SEQ ID NO: 3255724 - protein, 28 aa, Plasmodium falciparum
CTLTKRIINHFIDFIFSFIKKITQTSQN

SEQ ID NO: 3255725 - protein, 24 aa, Plasmodium falciparum
CTLTQIFPDIFFETMKKYTEHNDI

SEQ ID NO: 3255726 - protein, 19 aa, Plasmodium falciparum
CTMLARSFADIGDIIRGKD

SEQ ID NO: 3255727 - protein, 17 aa, Plasmodium falciparum
CTNDCPNKCKCVRKWIE

SEQ ID NO: 3255728 - protein, 23 aa, Plasmodium falciparum
CTNFIKLGESFISEFNAENTVYG

SEQ ID NO: 3255729 - protein, 17 aa, Plasmodium falciparum
CTNIFKRNVNIINTFEN

SEQ ID NO: 3255730 - protein, 37 aa, Plasmodium falciparum
CTNLFCDEIYWFICFFGDYIIKYNIIRCYGEIYRNKK

SEQ ID NO: 3255731 - protein, 19 aa, Plasmodium falciparum
CTNNLKKKCTLIYNYVMNV

SEQ ID NO: 3255732 - protein, 17 aa, Plasmodium falciparum
CTQNLGGIVAPSSGVLA

SEQ ID NO: 3255733 - protein, 19 aa, Plasmodium falciparum
CTRIKLYKPRSGQGGTPIK

SEQ ID NO: 3255734 - protein, 18 aa, Plasmodium falciparum
CTRYFKEIDFSKNNDLKK

SEQ ID NO: 3255735 - protein, 26 aa, Plasmodium falciparum
CTSDCGKKCNCVKDWITKKKDEWKNI

SEQ ID NO: 3255736 - protein, 18 aa, Plasmodium falciparum
CTSGFFSFIFNKIKYYCK

SEQ ID NO: 3255737 - protein, 17 aa, Plasmodium falciparum
CTSNICGDDNTIRCQEK

SEQ ID NO: 3255738 - protein, 17 aa, Plasmodium falciparum
CTTFHIYHDEEKKKNYE

SEQ ID NO: 3255739 - protein, 20 aa, Plasmodium falciparum
CTVLARSFADIGDIIRGKDL

SEQ ID NO: 3255740 - protein, 18 aa, Plasmodium falciparum
CTVLARSFADIGDIVRGK

SEQ ID NO: 3255741 - protein, 19 aa, Plasmodium falciparum
CTVYIGSIFLRNNLNREEY

SEQ ID NO: 3255742 - protein, 29 aa, Plasmodium falciparum
CTWNICKRRISFFGVLPFELEKKGNIRKI

SEQ ID NO: 3255743 - protein, 31 aa, Plasmodium falciparum
CTYDNCRVLLPALFPFWKIIQNFYMAYFDLF

SEQ ID NO: 3255744 - protein, 21 aa, Plasmodium falciparum
CTYDPTLACIVPLDSIYLRSL

SEQ ID NO: 3255745 - protein, 17 aa, Plasmodium falciparum
CTYLKPKFPNIFDNKKN

SEQ ID NO: 3255746 - protein, 19 aa, Plasmodium falciparum
CVCCYNGPTFNRYFSRAAE

SEQ ID NO: 3255747 - protein, 17 aa, Plasmodium falciparum
CVCEKSLADKMEKTCLK

SEQ ID NO: 3255748 - protein, 17 aa, Plasmodium falciparum
CVCEKSLADKTEKFCLN

SEQ ID NO: 3255749 - protein, 26 aa, Plasmodium falciparum
CVCIKFKTKCCSFKINKLEKKKKESY

SEQ ID NO: 3255750 - protein, 19 aa, Plasmodium falciparum
CVCNKGFKLSSYLNGGNKC

SEQ ID NO: 3255751 - protein, 31 aa, Plasmodium falciparum
CVEEPVPFQALIDICRLLFLKKEINKKIMFT

SEQ ID NO: 3255752 - protein, 23 aa, Plasmodium falciparum
CVFICFCSSILIASFYFIGKKFS

SEQ ID NO: 3255753 - protein, 19 aa, Plasmodium falciparum
CVGYFKINLPLLYFMKNPI

SEQ ID NO: 3255754 - protein, 19 aa, Plasmodium falciparum
CVIDAPWTIKSDIVEMVLN

SEQ ID NO: 3255755 - protein, 21 aa, Plasmodium falciparum
CVIIFCSYIFIGLPLLQIELS

SEQ ID NO: 3255756 - protein, 32 aa, Plasmodium falciparum
CVIKKKHCRKWCRNFYFKSCSLVYKNELENLI

SEQ ID NO: 3255757 - protein, 23 aa, Plasmodium falciparum
CVIPSRLARHGYFLSKIKTIETI

SEQ ID NO: 3255758 - protein, 27 aa, Plasmodium falciparum
CVITSVICPTCPVSVICALALSTYLSF

SEQ ID NO: 3255759 - protein, 19 aa, Plasmodium falciparum
CVKCGRILGTAVPELSLIG

SEQ ID NO: 3255760 - protein, 24 aa, Plasmodium falciparum
CVKEKTEICIIKIKNYNSILEYNG

SEQ ID NO: 3255761 - protein, 24 aa, Plasmodium falciparum
CVKKCSDLWLNVMKNERGKFNHII

SEQ ID NO: 3255762 - protein, 20 aa, Plasmodium falciparum
CVKMGIQICGAKAYSFKHND

SEQ ID NO: 3255763 - protein, 19 aa, Plasmodium falciparum
CVKNCSKQLIWKEGPLYTG

SEQ ID NO: 3255764 - protein, 23 aa, Plasmodium falciparum
CVLFYFFCTHLFFLHVITKHNLK

SEQ ID NO: 3255765 - protein, 19 aa, Plasmodium falciparum
CVLVSKLFFVFILMSEKIR

SEQ ID NO: 3255766 - protein, 22 aa, Plasmodium falciparum
CVNFKCFKKIFNKKIYKKNKNI

SEQ ID NO: 3255767 - protein, 19 aa, Plasmodium falciparum
CVNHFPLKPLINIYNIQGD

SEQ ID NO: 3255768 - protein, 23 aa, Plasmodium falciparum
CVNNLCCKFICTIRKYVKYFLYL

SEQ ID NO: 3255769 - protein, 43 aa, Plasmodium falciparum
CVPDRKIQLCIANFLNSRLETMEKFKEIFLISVNTEAKLLYNK

SEQ ID NO: 3255770 - protein, 19 aa, Plasmodium falciparum
CVPLVYSLIFRKYIFLKNI

SEQ ID NO: 3255771 - protein, 18 aa, Plasmodium falciparum
CVPPRRQELCLGNIDRIY

SEQ ID NO: 3255772 - protein, 27 aa, Plasmodium falciparum
CVPPRRRKLYIKKIVDWAESQSKTLTS

SEQ ID NO: 3255773 - protein, 21 aa, Plasmodium falciparum
CVPPRRRKLYLHKVDDGEFDD

SEQ ID NO: 3255774 - protein, 23 aa, Plasmodium falciparum
CVPPRRRKLYVTPLTKWAEETTK

SEQ ID NO: 3255775 - protein, 20 aa, Plasmodium falciparum
CVPPRRRRLYIHKVDDNVKD

SEQ ID NO: 3255776 - protein, 23 aa, Plasmodium falciparum
CVPPRRRRLYIQKLHDWAEKVGD

SEQ ID NO: 3255777 - protein, 23 aa, Plasmodium falciparum
CVPPRRRRLYIQKLHDWATAVSP

SEQ ID NO: 3255778 - protein, 29 aa, Plasmodium falciparum
CVPPRRRRLYVGGLTKWASGNTVVSGQAQ

SEQ ID NO: 3255779 - protein, 24 aa, Plasmodium falciparum
CVPPRRRRLYVGKLHDWASGNTQE

SEQ ID NO: 3255780 - protein, 24 aa, Plasmodium falciparum
CVPPRRRRLYVGKLTQWASQRTQG

SEQ ID NO: 3255781 - protein, 22 aa, Plasmodium falciparum
CVPPRRRRLYVKDLEKIGDGEV

SEQ ID NO: 3255782 - protein, 22 aa, Plasmodium falciparum
CVPPRRRRLYVKDLETLGDSEV

SEQ ID NO: 3255783 - protein, 23 aa, Plasmodium falciparum
CVPPRRRRLYVTPLTKWATNMEA

SEQ ID NO: 3255784 - protein, 22 aa, Plasmodium falciparum
CVPPRRRRLYVTPLTRLAGDNT

SEQ ID NO: 3255785 - protein, 22 aa, Plasmodium falciparum
CVPPRRRRLYVTPLTRLAGGDG

SEQ ID NO: 3255786 - protein, 22 aa, Plasmodium falciparum
CVPPRRRRLYVTPLTRLAGGDK

SEQ ID NO: 3255787 - protein, 23 aa, Plasmodium falciparum
CVPPRRRRLYVTPLTRLAGGGNT

SEQ ID NO: 3255788 - protein, 22 aa, Plasmodium falciparum
CVPPRRRRLYVTPLTRLTGGDS

SEQ ID NO: 3255789 - protein, 18 aa, Plasmodium falciparum
CVSFEIKLIDSFSFYNKK

SEQ ID NO: 3255790 - protein, 26 aa, Plasmodium falciparum
CVSGAFYRTFPRVIFYNLNLTNNTSK

SEQ ID NO: 3255791 - protein, 24 aa, Plasmodium falciparum
CVSILLNIFNQFVLFIGCHMPAKD

SEQ ID NO: 3255792 - protein, 24 aa, Plasmodium falciparum
CVSIRMIYIYLYFKDIKKSIHHIY

SEQ ID NO: 3255793 - protein, 19 aa, Plasmodium falciparum
CVYSYIVFIFISIEKYIKC

SEQ ID NO: 3255794 - protein, 18 aa, Plasmodium falciparum
CYAQHCEVFAWTTTPWTL

SEQ ID NO: 3255795 - protein, 17 aa, Plasmodium falciparum
CYCNYDIYLKQSGNKYN

SEQ ID NO: 3255796 - protein, 28 aa, Plasmodium falciparum
CYDIKKYRCSLLKFPSYVDYIMFIAIFI

SEQ ID NO: 3255797 - protein, 18 aa, Plasmodium falciparum
CYDLCFYEKEIVFYQKKL

SEQ ID NO: 3255798 - protein, 25 aa, Plasmodium falciparum
CYDPKRLMYHFPFFDEKKNKNKKKK

SEQ ID NO: 3255799 - protein, 17 aa, Plasmodium falciparum
CYFILRFIQKNPVLCAE

SEQ ID NO: 3255800 - protein, 18 aa, Plasmodium falciparum
CYFLKKKPTCVLKKENHF

SEQ ID NO: 3255801 - protein, 18 aa, Plasmodium falciparum
CYGLHNIDIILFYNENSK

SEQ ID NO: 3255802 - protein, 24 aa, Plasmodium falciparum
CYIAIRLVFSFFKKVINLIFTIIF

SEQ ID NO: 3255803 - protein, 18 aa, Plasmodium falciparum
CYIIYMIEIHYKFISTYS

SEQ ID NO: 3255804 - protein, 17 aa, Plasmodium falciparum
CYINFVIMYWKIIGINY

SEQ ID NO: 3255805 - protein, 19 aa, Plasmodium falciparum
CYIYVCIYLLYLNMLYIYI

SEQ ID NO: 3255806 - protein, 19 aa, Plasmodium falciparum
CYKSIKMSYDYLTKDLNIK

SEQ ID NO: 3255807 - protein, 28 aa, Plasmodium falciparum
CYMNIYKYICSFLLFLISYIERKPIEYL

SEQ ID NO: 3255808 - protein, 17 aa, Plasmodium falciparum
CYNHFLKNNWFDNECIN

SEQ ID NO: 3255809 - protein, 27 aa, Plasmodium falciparum
CYNLIYIPSLLWIYKILNYKNNCTYNI

SEQ ID NO: 3255810 - protein, 18 aa, Plasmodium falciparum
CYNNKYNSVCKIKTENSL

SEQ ID NO: 3255811 - protein, 20 aa, Plasmodium falciparum
CYPDDKKLIIYYEVDNNVVV

SEQ ID NO: 3255812 - protein, 17 aa, Plasmodium falciparum
CYQKINGKPFRKKKKLF

SEQ ID NO: 3255813 - protein, 18 aa, Plasmodium falciparum
CYRILKSLEINNKINEEE

SEQ ID NO: 3255814 - protein, 23 aa, Plasmodium falciparum
CYRSLRGSLHMEYIFKDSYELLD

SEQ ID NO: 3255815 - protein, 27 aa, Plasmodium falciparum
CYSLEKIIPFSFCSDFLFIFLLSLSCT

SEQ ID NO: 3255816 - protein, 23 aa, Plasmodium falciparum
CYTFNILCDLELLHQCYTYIYSI

SEQ ID NO: 3255817 - protein, 29 aa, Plasmodium falciparum
CYYHYKYIIKCFHFKYLYELIKSKIMIYN

SEQ ID NO: 3255818 - protein, 18 aa, Plasmodium falciparum
CYYNNELLECFLKNHLNY

SEQ ID NO: 3255819 - protein, 33 aa, Plasmodium falciparum
CYYSLPTPIKYMWPSPFFYIYLFYHYCIYVIYH

SEQ ID NO: 3255820 - protein, 25 aa, Plasmodium falciparum
DACGLKYGKNYGWKCVPTTSDKGSE

SEQ ID NO: 3255821 - protein, 18 aa, Plasmodium falciparum
DACSLTYKFHTNITTDGG

SEQ ID NO: 3255822 - protein, 19 aa, Plasmodium falciparum
DACTLKYVTGKNYGWKCVS

SEQ ID NO: 3255823 - protein, 26 aa, Plasmodium falciparum
DADIMLRMTVSWDWESVNIDEEINKE

SEQ ID NO: 3255824 - protein, 27 aa, Plasmodium falciparum
DADLKCPGCGRECRKYKKWIEKKKEEF

SEQ ID NO: 3255825 - protein, 34 aa, Plasmodium falciparum
DAEFKIPKRVKIILNIKAGMVFGAAIISLILFCC

SEQ ID NO: 3255826 - protein, 17 aa, Plasmodium falciparum
DAELLLADMEFKESDLP

SEQ ID NO: 3255827 - protein, 20 aa, Plasmodium falciparum
DAEYPKYYNLILNILNKNTL

SEQ ID NO: 3255828 - protein, 26 aa, Plasmodium falciparum
DAFFPKKYFLKMNVSQVILDLFNKLK

SEQ ID NO: 3255829 - protein, 24 aa, Plasmodium falciparum
DAFIKKLNTLLGLDEAEEIILNDK

SEQ ID NO: 3255830 - protein, 17 aa, Plasmodium falciparum
DAFLLVWKYQKKEYSNK

SEQ ID NO: 3255831 - protein, 18 aa, Plasmodium falciparum
DAFVYTSCYNLVYHECSK

SEQ ID NO: 3255832 - protein, 19 aa, Plasmodium falciparum
DAGIFKSIRKDVWKCGNVC

SEQ ID NO: 3255833 - protein, 24 aa, Plasmodium falciparum
DAIIPHWVHDIFLGYCDNSIKYYD

SEQ ID NO: 3255834 - protein, 24 aa, Plasmodium falciparum
DAIIRYGGMFAIAMAYCGLSNCNK

SEQ ID NO: 3255835 - protein, 24 aa, Plasmodium falciparum
DAIKINFLFFKSLIIYNVPLKNIE

SEQ ID NO: 3255836 - protein, 18 aa, Plasmodium falciparum
DAILNIFPGGSMTGSPKY

SEQ ID NO: 3255837 - protein, 22 aa, Plasmodium falciparum
DAIPTCICEKSLADKVEKGCLK

SEQ ID NO: 3255838 - protein, 18 aa, Plasmodium falciparum
DAIPTCICEKSVSEKVEK

SEQ ID NO: 3255839 - protein, 20 aa, Plasmodium falciparum
DAIPTCICEKSVTDKFEKTC

SEQ ID NO: 3255840 - protein, 20 aa, Plasmodium falciparum
DAIPTCVCEKSIADKVEKGC

SEQ ID NO: 3255841 - protein, 22 aa, Plasmodium falciparum
DAIPTCVCEKSIADKVEKNCLA

SEQ ID NO: 3255842 - protein, 19 aa, Plasmodium falciparum
DAIPTCVCEKSLADKTEKF

SEQ ID NO: 3255843 - protein, 21 aa, Plasmodium falciparum
DAIPTCVCEKSLADKTEKFCL

SEQ ID NO: 3255844 - protein, 18 aa, Plasmodium falciparum
DAIPTCVCEKSLADKVEK

SEQ ID NO: 3255845 - protein, 20 aa, Plasmodium falciparum
DAIPTCVCEKSLADKVEKTC

SEQ ID NO: 3255846 - protein, 22 aa, Plasmodium falciparum
DAIPTCVCEKSLADKVEKTCLK

SEQ ID NO: 3255847 - protein, 19 aa, Plasmodium falciparum
DAIPTCVCEKSVADKMEKG

SEQ ID NO: 3255848 - protein, 18 aa, Plasmodium falciparum
DAIPTCVCEKSVADKTEK

SEQ ID NO: 3255849 - protein, 19 aa, Plasmodium falciparum
DAIPTCVCEKSVADKTEKV

SEQ ID NO: 3255850 - protein, 20 aa, Plasmodium falciparum
DAIRSIILIYRLTNDIFNKF

SEQ ID NO: 3255851 - protein, 19 aa, Plasmodium falciparum
DAKKKEWTNIGSFILNSIK

SEQ ID NO: 3255852 - protein, 25 aa, Plasmodium falciparum
DAKKWWTENRHHVWEAMMCGYQSAQ

SEQ ID NO: 3255853 - protein, 25 aa, Plasmodium falciparum
DAKVLYNWKLGKSILGKMINSTEDF

SEQ ID NO: 3255854 - protein, 34 aa, Plasmodium falciparum
DALYNLSYYSYFSIHICIIIKNILVKHIHDMKVS

SEQ ID NO: 3255855 - protein, 25 aa, Plasmodium falciparum
DAQCVKEGYSSLFMYLKEYTNIIFK

SEQ ID NO: 3255856 - protein, 24 aa, Plasmodium falciparum
DASELIICIQLIFIKNMLFKHKFF

SEQ ID NO: 3255857 - protein, 20 aa, Plasmodium falciparum
DASFIFKHNYYDIGPSDIIN

SEQ ID NO: 3255858 - protein, 17 aa, Plasmodium falciparum
DASSAYFHATCSDSHRS

SEQ ID NO: 3255859 - protein, 24 aa, Plasmodium falciparum
DASTLKILLCTDNHLGYKENNSIQ

SEQ ID NO: 3255860 - protein, 24 aa, Plasmodium falciparum
DAYLINEILLLFLLFSENSTEIKN

SEQ ID NO: 3255861 - protein, 25 aa, Plasmodium falciparum
DAYLKKYPLYFSMMLMLSHFYAYKL

SEQ ID NO: 3255862 - protein, 30 aa, Plasmodium falciparum
DCAEISKKFPRIVGVHYDSYATAWVVNCSF

SEQ ID NO: 3255863 - protein, 24 aa, Plasmodium falciparum
DCCSNIFFLLYVRLLYNLKIPKDI

SEQ ID NO: 3255864 - protein, 17 aa, Plasmodium falciparum
DCDYHLFNTSDKEVSEK

SEQ ID NO: 3255865 - protein, 20 aa, Plasmodium falciparum
DCFSLCYSSVSSSYEYDDIN

SEQ ID NO: 3255866 - protein, 17 aa, Plasmodium falciparum
DCGVKPLGGGKFQDKET

SEQ ID NO: 3255867 - protein, 17 aa, Plasmodium falciparum
DCGVKRKDNQWKDKYDG

SEQ ID NO: 3255868 - protein, 25 aa, Plasmodium falciparum
DCHKQCRKYRKWIDIKFEEYEKQKD

SEQ ID NO: 3255869 - protein, 20 aa, Plasmodium falciparum
DCIFVIILTCRSFYAYSYDK

SEQ ID NO: 3255870 - protein, 25 aa, Plasmodium falciparum
DCIHKENFSILNFDYSLFVEISDTQ

SEQ ID NO: 3255871 - protein, 24 aa, Plasmodium falciparum
DCIKNVSVFLGVLIFEVITTVYSL

SEQ ID NO: 3255872 - protein, 23 aa, Plasmodium falciparum
DCKMKRGSFLFKYPQIKKCLPPY

SEQ ID NO: 3255873 - protein, 18 aa, Plasmodium falciparum
DCKNKIKKMFLKEKKKYI

SEQ ID NO: 3255874 - protein, 19 aa, Plasmodium falciparum
DCKRRKGLYNLNNKNSNCS

SEQ ID NO: 3255875 - protein, 20 aa, Plasmodium falciparum
DCLDNLISFIFTKLYNYLSL

SEQ ID NO: 3255876 - protein, 21 aa, Plasmodium falciparum
DCMKECRNYKTWIVKKKNEYD

SEQ ID NO: 3255877 - protein, 21 aa, Plasmodium falciparum
DCNNFNWLIQLKYFYYNKNLY

SEQ ID NO: 3255878 - protein, 22 aa, Plasmodium falciparum
DCNNLANIACHFFLKKLNKEKN

SEQ ID NO: 3255879 - protein, 20 aa, Plasmodium falciparum
DCNYSSGGIYHIPCNQGVCY

SEQ ID NO: 3255880 - protein, 21 aa, Plasmodium falciparum
DCPLHFERIGSIYKYIFPIIN

SEQ ID NO: 3255881 - protein, 19 aa, Plasmodium falciparum
DCPNKCKCVEKWVEKKREE

SEQ ID NO: 3255882 - protein, 24 aa, Plasmodium falciparum
DCQHAGIFKGIRKDVWTCGNVCGY

SEQ ID NO: 3255883 - protein, 26 aa, Plasmodium falciparum
DCSSLICAVCLWGILDDIFLIISNNS

SEQ ID NO: 3255884 - protein, 23 aa, Plasmodium falciparum
DCVSFKMFLDELVHIKKNYFICK

SEQ ID NO: 3255885 - protein, 18 aa, Plasmodium falciparum
DCVTTFFKQYIITYERKS

SEQ ID NO: 3255886 - protein, 17 aa, Plasmodium falciparum
DCYNISQILLKYIYNTY

SEQ ID NO: 3255887 - protein, 20 aa, Plasmodium falciparum
DCYNNYLCLLKEKDDDDEYV

SEQ ID NO: 3255888 - protein, 22 aa, Plasmodium falciparum
DDACILKNLFNSFTTERRIKNK

SEQ ID NO: 3255889 - protein, 20 aa, Plasmodium falciparum
DDCHGMFLLILLFFMNTPQK

SEQ ID NO: 3255890 - protein, 20 aa, Plasmodium falciparum
DDCIKWKNTLIQKLQIISER

SEQ ID NO: 3255891 - protein, 20 aa, Plasmodium falciparum
DDCIYIWKRLQENNNTDENT

SEQ ID NO: 3255892 - protein, 22 aa, Plasmodium falciparum
DDCKNAHIFKAFREDVWTCGKV

SEQ ID NO: 3255893 - protein, 23 aa, Plasmodium falciparum
DDCNHIHSLIKIEIQYFYDNNKC

SEQ ID NO: 3255894 - protein, 19 aa, Plasmodium falciparum
DDDDKLGGYSYFRATCGSG

SEQ ID NO: 3255895 - protein, 27 aa, Plasmodium falciparum
DDDIFLILKRVCSFLFYCVKNNKFDCL

SEQ ID NO: 3255896 - protein, 25 aa, Plasmodium falciparum
DDDQHVCHLKRRIKNKHKWFCKKKN

SEQ ID NO: 3255897 - protein, 18 aa, Plasmodium falciparum
DDFFGSGLRCERTYNNHN

SEQ ID NO: 3255898 - protein, 19 aa, Plasmodium falciparum
DDFLRQMFYTLADYKDILF

SEQ ID NO: 3255899 - protein, 19 aa, Plasmodium falciparum
DDFLRQMFYTLGDYRDICI

SEQ ID NO: 3255900 - protein, 24 aa, Plasmodium falciparum
DDGVESFNSFLLEEDINLSRRAYR

SEQ ID NO: 3255901 - protein, 18 aa, Plasmodium falciparum
DDHHIFKKIIQIVSLENI

SEQ ID NO: 3255902 - protein, 23 aa, Plasmodium falciparum
DDHIPEYNFKLPYRTIDKSRTLK

SEQ ID NO: 3255903 - protein, 18 aa, Plasmodium falciparum
DDIALIIIILSYTINLYN

SEQ ID NO: 3255904 - protein, 18 aa, Plasmodium falciparum
DDIFFVFLDMSVRKLCVL

SEQ ID NO: 3255905 - protein, 17 aa, Plasmodium falciparum
DDIGIHCMNYFIEKKKQ

SEQ ID NO: 3255906 - protein, 24 aa, Plasmodium falciparum
DDIKKCYEYMKGIFESDEFVEYVK

SEQ ID NO: 3255907 - protein, 25 aa, Plasmodium falciparum
DDIKRKILCYCASKNKSLHRTPEES

SEQ ID NO: 3255908 - protein, 27 aa, Plasmodium falciparum
DDIWKQIKKITCLTSLAIYSYIKEKIK

SEQ ID NO: 3255909 - protein, 26 aa, Plasmodium falciparum
DDIYEVYRLLCLFSILTNGINQNYIN

SEQ ID NO: 3255910 - protein, 21 aa, Plasmodium falciparum
DDKHFPFTQGLFFSNNETLIE

SEQ ID NO: 3255911 - protein, 20 aa, Plasmodium falciparum
DDKKRKLGVHIDKRNNNNII

SEQ ID NO: 3255912 - protein, 18 aa, Plasmodium falciparum
DDKYEFFNDTNILEKKNI

SEQ ID NO: 3255913 - protein, 31 aa, Plasmodium falciparum
DDLDCRPCYEQCRKYRKWIDIKFVEYQNQKN

SEQ ID NO: 3255914 - protein, 28 aa, Plasmodium falciparum
DDLDYEIIYRILLIFKNLTRYKSFYHVI

SEQ ID NO: 3255915 - protein, 19 aa, Plasmodium falciparum
DDLFYKYQEDIYILNEKLN

SEQ ID NO: 3255916 - protein, 20 aa, Plasmodium falciparum
DDLIKCNFMDNKLREINLKK

SEQ ID NO: 3255917 - protein, 26 aa, Plasmodium falciparum
DDLKKLFILMFIRFIKIPMYDHNMDT

SEQ ID NO: 3255918 - protein, 17 aa, Plasmodium falciparum
DDLRNIWNHSLAVAKEG

SEQ ID NO: 3255919 - protein, 24 aa, Plasmodium falciparum
DDLWKTVLNPFDFFHLNNDVNVFF

SEQ ID NO: 3255920 - protein, 21 aa, Plasmodium falciparum
DDLYLKKSVEEFIPGFLSNIN

SEQ ID NO: 3255921 - protein, 18 aa, Plasmodium falciparum
DDMFSSWDKIPILKKNSS

SEQ ID NO: 3255922 - protein, 18 aa, Plasmodium falciparum
DDMKKCNVHDHFKDLENE

SEQ ID NO: 3255923 - protein, 18 aa, Plasmodium falciparum
DDMLKRKIIIETKNIYNF

SEQ ID NO: 3255924 - protein, 28 aa, Plasmodium falciparum
DDNAKYIWKGMICALTYDTDSGAIGQPP

SEQ ID NO: 3255925 - protein, 18 aa, Plasmodium falciparum
DDNILKMQILKGLNQTHY

SEQ ID NO: 3255926 - protein, 24 aa, Plasmodium falciparum
DDPMKLSIPFFYLVSQNYFTLYTH

SEQ ID NO: 3255927 - protein, 28 aa, Plasmodium falciparum
DDRILFKVLFERWLKYFIQDFNNVKDKI

SEQ ID NO: 3255928 - protein, 18 aa, Plasmodium falciparum
DDRIPFKHHNMNNVSMKN

SEQ ID NO: 3255929 - protein, 17 aa, Plasmodium falciparum
DDSEDFIAFKYFFNNII

SEQ ID NO: 3255930 - protein, 18 aa, Plasmodium falciparum
DDSLIIEVLLKYKNSIED

SEQ ID NO: 3255931 - protein, 25 aa, Plasmodium falciparum
DDTKRNFNFFYAFVSSNFFYNVKLT

SEQ ID NO: 3255932 - protein, 17 aa, Plasmodium falciparum
DDVCPLLLSESSIIEGS

SEQ ID NO: 3255933 - protein, 21 aa, Plasmodium falciparum
DDVIFEWIIYLIISLITSYNK

SEQ ID NO: 3255934 - protein, 27 aa, Plasmodium falciparum
DDVIIKFLLYMFYEKFINKFNKYINIH

SEQ ID NO: 3255935 - protein, 22 aa, Plasmodium falciparum
DDVLCSVSFLKSYFSSIPHFID

SEQ ID NO: 3255936 - protein, 24 aa, Plasmodium falciparum
DDVRRAAVIALGFVLCNSPNQVPK

SEQ ID NO: 3255937 - protein, 39 aa, Plasmodium falciparum
DDYIDMYVFCFQEVVELTGFRILMNMKDKFKEKKIEQMI

SEQ ID NO: 3255938 - protein, 22 aa, Plasmodium falciparum
DDYRVCCKYGIIDPESNILIDP

SEQ ID NO: 3255939 - protein, 20 aa, Plasmodium falciparum
DEAWKEIPLFNLDQENQKED

SEQ ID NO: 3255940 - protein, 22 aa, Plasmodium falciparum
DECKEADIFKGIRKEEWECDKL

SEQ ID NO: 3255941 - protein, 23 aa, Plasmodium falciparum
DECRIFVLKIYFLIEKNLNNLLL

SEQ ID NO: 3255942 - protein, 25 aa, Plasmodium falciparum
DECVSIFLNTFIKPAFSSSLLNINE

SEQ ID NO: 3255943 - protein, 19 aa, Plasmodium falciparum
DEDKVCKMNEDFKEKHKIM

SEQ ID NO: 3255944 - protein, 30 aa, Plasmodium falciparum
DEEKGFKYIGYRVSFELKKDNKKKAQVKVG

SEQ ID NO: 3255945 - protein, 26 aa, Plasmodium falciparum
DEFCDAWNRSLADYKDIFQGKDMWND

SEQ ID NO: 3255946 - protein, 27 aa, Plasmodium falciparum
DEFDVCKILKVHFLKNNRRGGGNHIMC

SEQ ID NO: 3255947 - protein, 17 aa, Plasmodium falciparum
DEFKPIVQYDNFQDEEN

SEQ ID NO: 3255948 - protein, 23 aa, Plasmodium falciparum
DEHIKYTSCYVTFDKDIIYLNYK

SEQ ID NO: 3255949 - protein, 25 aa, Plasmodium falciparum
DEHLSIGNITKWSIPVKENIYMDTN

SEQ ID NO: 3255950 - protein, 25 aa, Plasmodium falciparum
DEICKYIKFPLNFNKIINHKRDGFY

SEQ ID NO: 3255951 - protein, 21 aa, Plasmodium falciparum
DEIFYRTKRKFNWNKAKLEMF

SEQ ID NO: 3255952 - protein, 28 aa, Plasmodium falciparum
DEIIILTSLPIKFYWNVIRLLNKKNMCQ

SEQ ID NO: 3255953 - protein, 31 aa, Plasmodium falciparum
DEIIYMRFIHKIKIKNMFALINNIRKNIYIN

SEQ ID NO: 3255954 - protein, 17 aa, Plasmodium falciparum
DEIKFSYFRLLKKVEKN

SEQ ID NO: 3255955 - protein, 22 aa, Plasmodium falciparum
DEIKTRLCDVMKIRQNNYIDIR

SEQ ID NO: 3255956 - protein, 18 aa, Plasmodium falciparum
DEILRKESKMGIQNNTID

SEQ ID NO: 3255957 - protein, 17 aa, Plasmodium falciparum
DEINILIKHIINKKPEI

SEQ ID NO: 3255958 - protein, 25 aa, Plasmodium falciparum
DEIRKNYCSYAYFNITYTNQTEEET

SEQ ID NO: 3255959 - protein, 23 aa, Plasmodium falciparum
DEITKLIFCSHVYDLEKEDYNNP

SEQ ID NO: 3255960 - protein, 20 aa, Plasmodium falciparum
DEITNKWGIGLSFVNIKLAY

SEQ ID NO: 3255961 - protein, 34 aa, Plasmodium falciparum
DEIYKQLICYRDIIFFILFNFDQFLLLIKDEEQN

SEQ ID NO: 3255962 - protein, 23 aa, Plasmodium falciparum
DEKHKLVIELLKIIVTKKKIEHI

SEQ ID NO: 3255963 - protein, 23 aa, Plasmodium falciparum
DEKIHRRNHKWYDEKNEKREETR

SEQ ID NO: 3255964 - protein, 22 aa, Plasmodium falciparum
DEKQMLGHLSLYLYEYLGEEYP

SEQ ID NO: 3255965 - protein, 17 aa, Plasmodium falciparum
DEKRKKKNYNFISQTSY

SEQ ID NO: 3255966 - protein, 21 aa, Plasmodium falciparum
DEKYLSVVLVPIHFYKKRNYP

SEQ ID NO: 3255967 - protein, 23 aa, Plasmodium falciparum
DELKVCKGAGIFEGIRKDVWKCG

SEQ ID NO: 3255968 - protein, 21 aa, Plasmodium falciparum
DELLLPIKIQYFKNRKIFMNA

SEQ ID NO: 3255969 - protein, 20 aa, Plasmodium falciparum
DELMEILTLKQCKKFKRNVP

SEQ ID NO: 3255970 - protein, 23 aa, Plasmodium falciparum
DELNELLRIISINQHDKIDTFKY

SEQ ID NO: 3255971 - protein, 26 aa, Plasmodium falciparum
DELPEIKIPPVILNNFTFILIDYNIK

SEQ ID NO: 3255972 - protein, 22 aa, Plasmodium falciparum
DELRGKLSLAPIWNESAGTDDP

SEQ ID NO: 3255973 - protein, 18 aa, Plasmodium falciparum
DELVKLKKDMEIFNFEVT

SEQ ID NO: 3255974 - protein, 23 aa, Plasmodium falciparum
DELYFDFFMSVLINFVNNKNNFD

SEQ ID NO: 3255975 - protein, 26 aa, Plasmodium falciparum
DENCPKTKINPCIKRTRIPTRGASNN

SEQ ID NO: 3255976 - protein, 29 aa, Plasmodium falciparum
DENFYSFSFSYIFLNVCKKCTSVNICDCI

SEQ ID NO: 3255977 - protein, 18 aa, Plasmodium falciparum
DENISFIYVHDIYNYELK

SEQ ID NO: 3255978 - protein, 19 aa, Plasmodium falciparum
DENITRYGSGYGEDCKNNL

SEQ ID NO: 3255979 - protein, 17 aa, Plasmodium falciparum
DENLNLFMHTYKNIYVL

SEQ ID NO: 3255980 - protein, 36 aa, Plasmodium falciparum
DENVKVPALFIYRKNGKCLEKRILKEKIRKKSKKYG

SEQ ID NO: 3255981 - protein, 27 aa, Plasmodium falciparum
DENYKIFNYFVLRWILIFFKNKNQFFL

SEQ ID NO: 3255982 - protein, 26 aa, Plasmodium falciparum
DEPQINRWLMEWAYDTDYNKNLWYNK

SEQ ID NO: 3255983 - protein, 22 aa, Plasmodium falciparum
DEQKKLFFFNYVNYINTLYYCN

SEQ ID NO: 3255984 - protein, 18 aa, Plasmodium falciparum
DEQLKIIYNYIVNPKIQI

SEQ ID NO: 3255985 - protein, 24 aa, Plasmodium falciparum
DEQMKYYISFFLNPFLYNKRNYIY

SEQ ID NO: 3255986 - protein, 26 aa, Plasmodium falciparum
DEQRKTWWGDFAQYIWNGMICALTYT

SEQ ID NO: 3255987 - protein, 30 aa, Plasmodium falciparum
DERGRYRLLSCSVPKIINCKKNENMNFTSE

SEQ ID NO: 3255988 - protein, 25 aa, Plasmodium falciparum
DESFRLYIQKCIFNIIDYKYLFNLL

SEQ ID NO: 3255989 - protein, 19 aa, Plasmodium falciparum
DESKNDCACVKKWVEKKTT

SEQ ID NO: 3255990 - protein, 17 aa, Plasmodium falciparum
DESRSQCTYNRIKDNET

SEQ ID NO: 3255991 - protein, 19 aa, Plasmodium falciparum
DESRSQCTYNRIKDNETDD

SEQ ID NO: 3255992 - protein, 26 aa, Plasmodium falciparum
DESYKYKFLLNRSIKEYINLIKVHTK

SEQ ID NO: 3255993 - protein, 23 aa, Plasmodium falciparum
DETLKCVLFKYINYSNILLLKYK

SEQ ID NO: 3255994 - protein, 45 aa, Plasmodium falciparum
DETLVCTKCDKWGEWSECKDGRMHRKVLNCPFIKEEQECDVNNEM

SEQ ID NO: 3255995 - protein, 24 aa, Plasmodium falciparum
DEVNVSKAIWFSSIFTSIFYFIFG

SEQ ID NO: 3255996 - protein, 22 aa, Plasmodium falciparum
DEVPHYSALRYNKVEKNVTDEM

SEQ ID NO: 3255997 - protein, 17 aa, Plasmodium falciparum
DEVVGVLMFLNKLRSHG

SEQ ID NO: 3255998 - protein, 20 aa, Plasmodium falciparum
DEVVPVWLIFLSQYCSPVVL

SEQ ID NO: 3255999 - protein, 17 aa, Plasmodium falciparum
DEWEEIKKPYLEQYKNG

SEQ ID NO: 3256000 - protein, 25 aa, Plasmodium falciparum
DEYFQSVEIAHFWAYGYGHMSWEWE

SEQ ID NO: 3256001 - protein, 19 aa, Plasmodium falciparum
DEYKDIFQINNFSKNTDHN

SEQ ID NO: 3256002 - protein, 24 aa, Plasmodium falciparum
DEYKQKICKQIKCSTKKNDISHII

SEQ ID NO: 3256003 - protein, 19 aa, Plasmodium falciparum
DEYLISIINYVSFDLNVFV

SEQ ID NO: 3256004 - protein, 24 aa, Plasmodium falciparum
DEYMYKKFCNFISQAREIKKQREK

SEQ ID NO: 3256005 - protein, 18 aa, Plasmodium falciparum
DEYSRWSDEIAIINSNKK

SEQ ID NO: 3256006 - protein, 22 aa, Plasmodium falciparum
DEYTWNWKILDTFKNVDAYGFV

SEQ ID NO: 3256007 - protein, 18 aa, Plasmodium falciparum
DFCRKKKKKLPNVKTNCR

SEQ ID NO: 3256008 - protein, 19 aa, Plasmodium falciparum
DFDCKDCQYSCAPFVDWID

SEQ ID NO: 3256009 - protein, 24 aa, Plasmodium falciparum
DFDLIKILFFFQVPHLFIMYVYII

SEQ ID NO: 3256010 - protein, 29 aa, Plasmodium falciparum
DFDLILKFVVELFIIFRIMYKKKKLINKL

SEQ ID NO: 3256011 - protein, 23 aa, Plasmodium falciparum
DFDYFCIVEKLYGDIISIDIIKK

SEQ ID NO: 3256012 - protein, 25 aa, Plasmodium falciparum
DFESLKKMLQRIFSCDMDTSHNNNN

SEQ ID NO: 3256013 - protein, 18 aa, Plasmodium falciparum
DFFFSILSAILLLGNIQM

SEQ ID NO: 3256014 - protein, 25 aa, Plasmodium falciparum
DFFKCKKYLPCLLLSCLSFTNTMIL

SEQ ID NO: 3256015 - protein, 19 aa, Plasmodium falciparum
DFFKEKKYQSHLFNNNNEE

SEQ ID NO: 3256016 - protein, 18 aa, Plasmodium falciparum
DFFLYFFFLLIPFLLISF

SEQ ID NO: 3256017 - protein, 25 aa, Plasmodium falciparum
DFFMNHFQNTFGFAFAFNIYSNKNT

SEQ ID NO: 3256018 - protein, 22 aa, Plasmodium falciparum
DFGYILNIYPGISINFELAPFK

SEQ ID NO: 3256019 - protein, 20 aa, Plasmodium falciparum
DFHCPGCAKECMKYKTWIGK

SEQ ID NO: 3256020 - protein, 25 aa, Plasmodium falciparum
DFHNLKLLFFFISKFEKFDSSLLEN

SEQ ID NO: 3256021 - protein, 24 aa, Plasmodium falciparum
DFHYFPYNLCVPINNKINTTQLNL

SEQ ID NO: 3256022 - protein, 17 aa, Plasmodium falciparum
DFIESIDFRRFFSNLFF

SEQ ID NO: 3256023 - protein, 20 aa, Plasmodium falciparum
DFIGNPLIIYKHWKKGYETF

SEQ ID NO: 3256024 - protein, 26 aa, Plasmodium falciparum
DFIHIVEPLLVYCFCYGKEEVFILAS

SEQ ID NO: 3256025 - protein, 19 aa, Plasmodium falciparum
DFIKQFYINRNHFIQYVNK

SEQ ID NO: 3256026 - protein, 21 aa, Plasmodium falciparum
DFIKRFPLSINTMISKHMDYI

SEQ ID NO: 3256027 - protein, 20 aa, Plasmodium falciparum
DFILFLFIIQYCIYKKENKI

SEQ ID NO: 3256028 - protein, 18 aa, Plasmodium falciparum
DFKKYSINIYFLVYDNIL

SEQ ID NO: 3256029 - protein, 25 aa, Plasmodium falciparum
DFKQEIYNSMKLIFQFIKQNFYYLC

SEQ ID NO: 3256030 - protein, 22 aa, Plasmodium falciparum
DFLEYYLKLQFFEEVSEEKSQT

SEQ ID NO: 3256031 - protein, 24 aa, Plasmodium falciparum
DFLFKEYKRAYAYIDEKARNINNI

SEQ ID NO: 3256032 - protein, 25 aa, Plasmodium falciparum
DFLSFKGANCSLLINNRKEDEGKEN

SEQ ID NO: 3256033 - protein, 20 aa, Plasmodium falciparum
DFLYPCSILLIVVFIYLCIV

SEQ ID NO: 3256034 - protein, 19 aa, Plasmodium falciparum
DFNHLILFLYSYVKLNGYI

SEQ ID NO: 3256035 - protein, 23 aa, Plasmodium falciparum
DFNIKNKKEFILFENKINMLHIT

SEQ ID NO: 3256036 - protein, 23 aa, Plasmodium falciparum
DFNKDIRKGITFYSASDSLNSDI

SEQ ID NO: 3256037 - protein, 28 aa, Plasmodium falciparum
DFNMEYRLLNILLFDSFYTGMNNVKSIV

SEQ ID NO: 3256038 - protein, 27 aa, Plasmodium falciparum
DFNNIPSLVCSFKLFLNTQKHGLLGKD

SEQ ID NO: 3256039 - protein, 21 aa, Plasmodium falciparum
DFRKVCLHMRNGLKNNRFFDN

SEQ ID NO: 3256040 - protein, 23 aa, Plasmodium falciparum
DFSSKRNMCYYVLGSEAVRCVYN

SEQ ID NO: 3256041 - protein, 25 aa, Plasmodium falciparum
DFSTLKVFLVCNVDINCLNNTIVTN

SEQ ID NO: 3256042 - protein, 24 aa, Plasmodium falciparum
DFTKFELNEIFSLTEYCKPCPYCG

SEQ ID NO: 3256043 - protein, 20 aa, Plasmodium falciparum
DFVKICNKVISLSVNDKDME

SEQ ID NO: 3256044 - protein, 20 aa, Plasmodium falciparum
DFYFLRKLKYSLEHSDNIER

SEQ ID NO: 3256045 - protein, 25 aa, Plasmodium falciparum
DFYKYTLWYEPRELIYGDIRGMQMK

SEQ ID NO: 3256046 - protein, 19 aa, Plasmodium falciparum
DFYPTKGFEPCGGLFDSNE

SEQ ID NO: 3256047 - protein, 33 aa, Plasmodium falciparum
DGDKFFQLREDWWTANRHTVWKALTCKAEGAYF

SEQ ID NO: 3256048 - protein, 25 aa, Plasmodium falciparum
DGDYSVKMIYPYSSIYYTLRHNNEI

SEQ ID NO: 3256049 - protein, 23 aa, Plasmodium falciparum
DGEELFFKAALMLAQSAYQDSLQ

SEQ ID NO: 3256050 - protein, 25 aa, Plasmodium falciparum
DGFSRLNFFYPLPILVNQILKMKDK

SEQ ID NO: 3256051 - protein, 28 aa, Plasmodium falciparum
DGGDFFQLREDWWTANRETVWKAMTCSE

SEQ ID NO: 3256052 - protein, 25 aa, Plasmodium falciparum
DGHGSCIRLAKIGQKVFIDVQKKKL

SEQ ID NO: 3256053 - protein, 23 aa, Plasmodium falciparum
DGHPLEHIMNLFGQGHNNGDAKG

SEQ ID NO: 3256054 - protein, 20 aa, Plasmodium falciparum
DGIICNEMCDIYCDKDRILL

SEQ ID NO: 3256055 - protein, 17 aa, Plasmodium falciparum
DGIIDWYTFVYNLKEEP

SEQ ID NO: 3256056 - protein, 19 aa, Plasmodium falciparum
DGKDNVCCVIFGGNKKDKK

SEQ ID NO: 3256057 - protein, 17 aa, Plasmodium falciparum
DGKELIENIYLSKNHIL

SEQ ID NO: 3256058 - protein, 23 aa, Plasmodium falciparum
DGKSIFHSFSINKIFGEKKKDDP

SEQ ID NO: 3256059 - protein, 23 aa, Plasmodium falciparum
DGKYYIEMAHLFSSIMSSCNALF

SEQ ID NO: 3256060 - protein, 25 aa, Plasmodium falciparum
DGLGECKEAHIFKGIRKDVWTCEKV

SEQ ID NO: 3256061 - protein, 21 aa, Plasmodium falciparum
DGLHVTFIISFVLGNFASFYF

SEQ ID NO: 3256062 - protein, 22 aa, Plasmodium falciparum
DGMIDCIKDIYNICNKYDIYDK

SEQ ID NO: 3256063 - protein, 32 aa, Plasmodium falciparum
DGNFFQLREDWWYANRATIWEALTCNAQGNTY

SEQ ID NO: 3256064 - protein, 35 aa, Plasmodium falciparum
DGNHCKSIHIIKKKIKICKDIYILYLYKIGLLLNI

SEQ ID NO: 3256065 - protein, 17 aa, Plasmodium falciparum
DGNIFDGNFFDDHNTLP

SEQ ID NO: 3256066 - protein, 17 aa, Plasmodium falciparum
DGSELAGGIPRSIYTIN

SEQ ID NO: 3256067 - protein, 24 aa, Plasmodium falciparum
DGSSKRIITKWKNTFTITLEKFVF

SEQ ID NO: 3256068 - protein, 18 aa, Plasmodium falciparum
DGSYNFIGNFQWHRLMRE

SEQ ID NO: 3256069 - protein, 34 aa, Plasmodium falciparum
DGVLFKELYDNILIKILFFYIFFYFGDHYFCIIL

SEQ ID NO: 3256070 - protein, 25 aa, Plasmodium falciparum
DGYFKHIIGPLFLKLCLGTNFCPIS

SEQ ID NO: 3256071 - protein, 22 aa, Plasmodium falciparum
DGYRRRSLSLTYGRNHHSKNKH

SEQ ID NO: 3256072 - protein, 21 aa, Plasmodium falciparum
DHAILSKRCLNHILKNYYNIL

SEQ ID NO: 3256073 - protein, 26 aa, Plasmodium falciparum
DHCSSVWKVISSFALHHLKNPDSLHT

SEQ ID NO: 3256074 - protein, 20 aa, Plasmodium falciparum
DHHCPWIGTCVGEKNLKFFF

SEQ ID NO: 3256075 - protein, 20 aa, Plasmodium falciparum
DHHCPWIYNCVGYNNHKYFM

SEQ ID NO: 3256076 - protein, 19 aa, Plasmodium falciparum
DHIKCSFVNKIINRLIDLL

SEQ ID NO: 3256077 - protein, 24 aa, Plasmodium falciparum
DHIYKILLKEGINYIENENNEIIK

SEQ ID NO: 3256078 - protein, 33 aa, Plasmodium falciparum
DHKNKCVIKHSYKIFLNKREDVILKVLSLNNMF

SEQ ID NO: 3256079 - protein, 26 aa, Plasmodium falciparum
DHLHFFKFVGKFIAKAIYDGQVIDAY

SEQ ID NO: 3256080 - protein, 23 aa, Plasmodium falciparum
DHLKAQYAPLIPIFSKNYDKIYT

SEQ ID NO: 3256081 - protein, 18 aa, Plasmodium falciparum
DHLLFLSFCYMNKLIEKY

SEQ ID NO: 3256082 - protein, 27 aa, Plasmodium falciparum
DHLNLFYKNICLCIPCKTSEQINVQNV

SEQ ID NO: 3256083 - protein, 27 aa, Plasmodium falciparum
DHLYNFFIRKLHYEDIQHIFYFLQYVL

SEQ ID NO: 3256084 - protein, 19 aa, Plasmodium falciparum
DHMKEGVFLDGEKKTSHRK

SEQ ID NO: 3256085 - protein, 24 aa, Plasmodium falciparum
DHPVCVLYIPKLCHGICAALCDLG

SEQ ID NO: 3256086 - protein, 26 aa, Plasmodium falciparum
DHRISEILNRCILRLNEFDLIHLSSL

SEQ ID NO: 3256087 - protein, 18 aa, Plasmodium falciparum
DHRKEIFIPEKNEVVKCH

SEQ ID NO: 3256088 - protein, 25 aa, Plasmodium falciparum
DHSFFAFLLRMCFMSLNKINNNFFL

SEQ ID NO: 3256089 - protein, 21 aa, Plasmodium falciparum
DHYMSVMSFIDKWNKNNIEYN

SEQ ID NO: 3256090 - protein, 17 aa, Plasmodium falciparum
DIAKRSSKEYILSNEKK

SEQ ID NO: 3256091 - protein, 26 aa, Plasmodium falciparum
DICIPFLKFMCEFVYNKSQRITFPKS

SEQ ID NO: 3256092 - protein, 19 aa, Plasmodium falciparum
DICKYRKIPKILLQTNNCK

SEQ ID NO: 3256093 - protein, 26 aa, Plasmodium falciparum
DICLSHLLCALTFLEAYLKQNLFNFQ

SEQ ID NO: 3256094 - protein, 18 aa, Plasmodium falciparum
DIDICIQIPILLNRKDQI

SEQ ID NO: 3256095 - protein, 21 aa, Plasmodium falciparum
DIDPALCMLYILPVDIDDNTF

SEQ ID NO: 3256096 - protein, 24 aa, Plasmodium falciparum
DIDPTVFKEYFLKVNQCDGDYLPL

SEQ ID NO: 3256097 - protein, 19 aa, Plasmodium falciparum
DIDRRMAVYNALYEKAQSY

SEQ ID NO: 3256098 - protein, 18 aa, Plasmodium falciparum
DIDYIFNLFLKLGSILLL

SEQ ID NO: 3256099 - protein, 22 aa, Plasmodium falciparum
DIEIIKIKYCYIKKDSENIPCN

SEQ ID NO: 3256100 - protein, 23 aa, Plasmodium falciparum
DIEIKRKIMLMMKAILKKKNICD

SEQ ID NO: 3256101 - protein, 26 aa, Plasmodium falciparum
DIEISSKFLIHLSFGIRNFISALIGG

SEQ ID NO: 3256102 - protein, 25 aa, Plasmodium falciparum
DIEKRHVQEFISFFSNILKSKKINH

SEQ ID NO: 3256103 - protein, 19 aa, Plasmodium falciparum
DIEMIPIDIVGNIRLYKLF

SEQ ID NO: 3256104 - protein, 31 aa, Plasmodium falciparum
DIESYKYIIKFSIELLYIIVKKIKYVHHTNT

SEQ ID NO: 3256105 - protein, 25 aa, Plasmodium falciparum
DIEYKLLQSYSMKTVDEYGYLGKGS

SEQ ID NO: 3256106 - protein, 18 aa, Plasmodium falciparum
DIFCKIQIINPVEKENVS

SEQ ID NO: 3256107 - protein, 30 aa, Plasmodium falciparum
DIFFKINKFILLRKSRMIYLRQLKKRVYSY

SEQ ID NO: 3256108 - protein, 17 aa, Plasmodium falciparum
DIFFKYNPSENIMDHQE

SEQ ID NO: 3256109 - protein, 32 aa, Plasmodium falciparum
DIFIMRIISCDFRNYFFLIFCNYRKFIDMYSL

SEQ ID NO: 3256110 - protein, 23 aa, Plasmodium falciparum
DIFLNKIYISICTHDIKEKKNLN

SEQ ID NO: 3256111 - protein, 19 aa, Plasmodium falciparum
DIFNYKYVFPFFFNSTNKI

SEQ ID NO: 3256112 - protein, 26 aa, Plasmodium falciparum
DIFSLTCKILFFEVYSVSNLKTLYKY

SEQ ID NO: 3256113 - protein, 18 aa, Plasmodium falciparum
DIFTIVLCDIELTVRYAA

SEQ ID NO: 3256114 - protein, 25 aa, Plasmodium falciparum
DIFVEGECKRHCIKVKYEKKFKKKE

SEQ ID NO: 3256115 - protein, 19 aa, Plasmodium falciparum
DIFVKTSIVSRELKKNIEE

SEQ ID NO: 3256116 - protein, 17 aa, Plasmodium falciparum
DIGDALPGKAFYFPTNP

SEQ ID NO: 3256117 - protein, 26 aa, Plasmodium falciparum
DIGKYVLEILFFISIIVTCTLSLIID

SEQ ID NO: 3256118 - protein, 22 aa, Plasmodium falciparum
DIGLEVHNYIGLGIKDNKLTIL

SEQ ID NO: 3256119 - protein, 23 aa, Plasmodium falciparum
DIHAKCSFINKQIVCECKDKFEG

SEQ ID NO: 3256120 - protein, 21 aa, Plasmodium falciparum
DIHATCFIHRDLKPENIFVDP

SEQ ID NO: 3256121 - protein, 17 aa, Plasmodium falciparum
DIHDNFLLNFDIINSFK

SEQ ID NO: 3256122 - protein, 18 aa, Plasmodium falciparum
DIHECYKNYYSLKNDEDI

SEQ ID NO: 3256123 - protein, 18 aa, Plasmodium falciparum
DIHEIFLRYRGCTMDGNT

SEQ ID NO: 3256124 - protein, 22 aa, Plasmodium falciparum
DIHITKMKFNFVQKNKKINKNI

SEQ ID NO: 3256125 - protein, 19 aa, Plasmodium falciparum
DIHKCICRKGYSINLSIKP

SEQ ID NO: 3256126 - protein, 28 aa, Plasmodium falciparum
DIHKKVVLEIIHLLKIHSNFQKKKDNVN

SEQ ID NO: 3256127 - protein, 23 aa, Plasmodium falciparum
DIHPLCYKMILYFQKNTSFLIKK

SEQ ID NO: 3256128 - protein, 20 aa, Plasmodium falciparum
DIHRGFRILCILISTHVEAY

SEQ ID NO: 3256129 - protein, 17 aa, Plasmodium falciparum
DIICINSELAIWLKKKN

SEQ ID NO: 3256130 - protein, 17 aa, Plasmodium falciparum
DIIDKFCYILRHKDNTI

SEQ ID NO: 3256131 - protein, 18 aa, Plasmodium falciparum
DIIELRITQIIEEANKFY

SEQ ID NO: 3256132 - protein, 25 aa, Plasmodium falciparum
DIIFFKGNIIELYGLKAYKYLMKND

SEQ ID NO: 3256133 - protein, 22 aa, Plasmodium falciparum
DIIFKRKVIKFIKLIYDNKYHL

SEQ ID NO: 3256134 - protein, 18 aa, Plasmodium falciparum
DIIHRRTILYDKLSNAFH

SEQ ID NO: 3256135 - protein, 18 aa, Plasmodium falciparum
DIIHVIYSFYLFQNYHFF

SEQ ID NO: 3256136 - protein, 20 aa, Plasmodium falciparum
DIIKCFSNTYIGDFNLNGKK

SEQ ID NO: 3256137 - protein, 19 aa, Plasmodium falciparum
DIIKIHPFMNAKRIRNVVL

SEQ ID NO: 3256138 - protein, 25 aa, Plasmodium falciparum
DIIKIKVVHSLSVFILKTNVAVFIT

SEQ ID NO: 3256139 - protein, 20 aa, Plasmodium falciparum
DIIKLVGISIFDCIHKSYEP

SEQ ID NO: 3256140 - protein, 19 aa, Plasmodium falciparum
DIIKLYFAFFNRFLYYLLH

SEQ ID NO: 3256141 - protein, 20 aa, Plasmodium falciparum
DIIKRLLKIDTIPIYLNDEM

SEQ ID NO: 3256142 - protein, 25 aa, Plasmodium falciparum
DIIKRTMDSYNIYNLSKCKIDEDNI

SEQ ID NO: 3256143 - protein, 25 aa, Plasmodium falciparum
DIIKSCINVNMSIHIRIIKDDTQTN

SEQ ID NO: 3256144 - protein, 17 aa, Plasmodium falciparum
DIIKSCYYNESELIRKN

SEQ ID NO: 3256145 - protein, 25 aa, Plasmodium falciparum
DIILGRAIIPLFLILNTYKWKIKKI

SEQ ID NO: 3256146 - protein, 20 aa, Plasmodium falciparum
DIIMKSSLYKKVMDIDIKEK

SEQ ID NO: 3256147 - protein, 25 aa, Plasmodium falciparum
DIIRIFKKNVHMFNEMYTCNLSLFC

SEQ ID NO: 3256148 - protein, 27 aa, Plasmodium falciparum
DIIRVWKFKNKSFKFLILHNTYTKQLY

SEQ ID NO: 3256149 - protein, 25 aa, Plasmodium falciparum
DIIRYNNDYFWKWIRVLNYEIKNEL

SEQ ID NO: 3256150 - protein, 19 aa, Plasmodium falciparum
DIKECIIHLLDITKAQKEM

SEQ ID NO: 3256151 - protein, 17 aa, Plasmodium falciparum
DIKELIFSFPTNEAQKY

SEQ ID NO: 3256152 - protein, 23 aa, Plasmodium falciparum
DIKKFYRCIVKYINKKKEHIKIY

SEQ ID NO: 3256153 - protein, 24 aa, Plasmodium falciparum
DIKKVKSFFFFLNLYEKKKTMEIL

SEQ ID NO: 3256154 - protein, 22 aa, Plasmodium falciparum
DIKMWKRWNNLYTFTYNNDIVM

SEQ ID NO: 3256155 - protein, 25 aa, Plasmodium falciparum
DIKNIIWTDKWRYLISGDYKDNYIL

SEQ ID NO: 3256156 - protein, 20 aa, Plasmodium falciparum
DIKRLIMLIQCFNKKRIISR

SEQ ID NO: 3256157 - protein, 24 aa, Plasmodium falciparum
DIKYEEVDVMKSCKHVSMMDSEDT

SEQ ID NO: 3256158 - protein, 25 aa, Plasmodium falciparum
DIKYPTVFGNYNFKQLISSYISSYS

SEQ ID NO: 3256159 - protein, 20 aa, Plasmodium falciparum
DIKYYFPNHFHHIAYASSPF

SEQ ID NO: 3256160 - protein, 21 aa, Plasmodium falciparum
DILCFLDLYLHINISQEFITF

SEQ ID NO: 3256161 - protein, 25 aa, Plasmodium falciparum
DILDLKWRYKVILPFFASLPLLLSY

SEQ ID NO: 3256162 - protein, 17 aa, Plasmodium falciparum
DILELLHKIFLNYIRKE

SEQ ID NO: 3256163 - protein, 17 aa, Plasmodium falciparum
DILHDIMSLIIFLVFIL

SEQ ID NO: 3256164 - protein, 25 aa, Plasmodium falciparum
DILIKEIIKRLIFFKNMNINSFCIS

SEQ ID NO: 3256165 - protein, 18 aa, Plasmodium falciparum
DILIKIIKILSVAMGSAH

SEQ ID NO: 3256166 - protein, 26 aa, Plasmodium falciparum
DILKNILLPLCTWKTGLSEAQTRKSV

SEQ ID NO: 3256167 - protein, 18 aa, Plasmodium falciparum
DILKNMFDSEFLKIDMGK

SEQ ID NO: 3256168 - protein, 17 aa, Plasmodium falciparum
DILKYVFYKSNNMSDDT

SEQ ID NO: 3256169 - protein, 20 aa, Plasmodium falciparum
DILLCFKFMNFYSSNENLDN

SEQ ID NO: 3256170 - protein, 17 aa, Plasmodium falciparum
DILNHRWIRGTLTSCEF

SEQ ID NO: 3256171 - protein, 26 aa, Plasmodium falciparum
DILNKLNALYKMNAVYKMNALNKVSA

SEQ ID NO: 3256172 - protein, 23 aa, Plasmodium falciparum
DILSKRFYYYYIYNDTFKELKND

SEQ ID NO: 3256173 - protein, 18 aa, Plasmodium falciparum
DILWMRFFSLIKEHNNEI

SEQ ID NO: 3256174 - protein, 29 aa, Plasmodium falciparum
DILYREGKHVFKVTCNYNYIEIDNPKREC

SEQ ID NO: 3256175 - protein, 18 aa, Plasmodium falciparum
DIMKLLFPIVEKFIKNNE

SEQ ID NO: 3256176 - protein, 17 aa, Plasmodium falciparum
DINCSFEPIVLNVDSNT

SEQ ID NO: 3256177 - protein, 26 aa, Plasmodium falciparum
DINDEWKEIYYYSVMIYMKVLKNEDI

SEQ ID NO: 3256178 - protein, 21 aa, Plasmodium falciparum
DINIEIGLCVHRIIYCLLYIF

SEQ ID NO: 3256179 - protein, 19 aa, Plasmodium falciparum
DINIFMSIMYYFLNYETFQ

SEQ ID NO: 3256180 - protein, 28 aa, Plasmodium falciparum
DINLSRRAYRNFHICSIFIHLSLLLMVI

SEQ ID NO: 3256181 - protein, 20 aa, Plasmodium falciparum
DINNYFLKRNIIYLQKIHKK

SEQ ID NO: 3256182 - protein, 18 aa, Plasmodium falciparum
DINTFKKTYLTNIMKLQI

SEQ ID NO: 3256183 - protein, 26 aa, Plasmodium falciparum
DIPCEFKIYSDLFILFGEKKKIEMMP

SEQ ID NO: 3256184 - protein, 18 aa, Plasmodium falciparum
DIPFQKFFNEYKIKNEKI

SEQ ID NO: 3256185 - protein, 26 aa, Plasmodium falciparum
DIPQFLRWFREWGTYVCEESEKNMNT

SEQ ID NO: 3256186 - protein, 17 aa, Plasmodium falciparum
DIPTCICDKSLSDKVEK

SEQ ID NO: 3256187 - protein, 17 aa, Plasmodium falciparum
DIPTCVCEKSIADKTEK

SEQ ID NO: 3256188 - protein, 18 aa, Plasmodium falciparum
DIPVFWPLLLFYFICLFF

SEQ ID NO: 3256189 - protein, 28 aa, Plasmodium falciparum
DIPYIYFCILFAFGFIVQHGFGLLEKKE

SEQ ID NO: 3256190 - protein, 25 aa, Plasmodium falciparum
DIQKNCLYNFLLNILKKPYLTNFNL

SEQ ID NO: 3256191 - protein, 18 aa, Plasmodium falciparum
DIQTISFGLVASMASVIL

SEQ ID NO: 3256192 - protein, 21 aa, Plasmodium falciparum
DIRKALGNIIVHFDVNNENVK

SEQ ID NO: 3256193 - protein, 27 aa, Plasmodium falciparum
DIRKISIPLSHSFLFYNNITNLQIARP

SEQ ID NO: 3256194 - protein, 25 aa, Plasmodium falciparum
DIRKYYCIYFLYLSLKYNIMSSQGL

SEQ ID NO: 3256195 - protein, 23 aa, Plasmodium falciparum
DIRSCFNALDLLSRIPNVSQMNI

SEQ ID NO: 3256196 - protein, 21 aa, Plasmodium falciparum
DISFFLSRLLLFFMLQTVSCS

SEQ ID NO: 3256197 - protein, 20 aa, Plasmodium falciparum
DISGYIINILHYIPLSEFIT

SEQ ID NO: 3256198 - protein, 19 aa, Plasmodium falciparum
DISKNCFLNNYFNSLEGDG

SEQ ID NO: 3256199 - protein, 25 aa, Plasmodium falciparum
DISLSLLCIHRLVITAAMISVKFFD

SEQ ID NO: 3256200 - protein, 28 aa, Plasmodium falciparum
DISMCIRIFQSFSKFDIIKNINMFLYYY

SEQ ID NO: 3256201 - protein, 23 aa, Plasmodium falciparum
DISRIHQTFLYFIHTTLNHCQKY

SEQ ID NO: 3256202 - protein, 21 aa, Plasmodium falciparum
DISSKLFNSDFCDILKTKNLN

SEQ ID NO: 3256203 - protein, 18 aa, Plasmodium falciparum
DISTIFFYIHFKINVPKL

SEQ ID NO: 3256204 - protein, 23 aa, Plasmodium falciparum
DISYKYGSITSMTWNDSGNLLMV

SEQ ID NO: 3256205 - protein, 24 aa, Plasmodium falciparum
DITHPVSCFPIFKKGNIEKENKSF

SEQ ID NO: 3256206 - protein, 23 aa, Plasmodium falciparum
DITKRYEICASFYEDDKYFYNIG

SEQ ID NO: 3256207 - protein, 35 aa, Plasmodium falciparum
DITQPRIHTILSFFFPFIGCLSYLINLKYPEPSLR

SEQ ID NO: 3256208 - protein, 34 aa, Plasmodium falciparum
DITYKKFICKDCYRCIYCCESIYDYKQTPNVANY

SEQ ID NO: 3256209 - protein, 24 aa, Plasmodium falciparum
DIVCYSIKIVGIFFETFLHKVDLL

SEQ ID NO: 3256210 - protein, 19 aa, Plasmodium falciparum
DIVKHILLKYIKSLDRLSK

SEQ ID NO: 3256211 - protein, 24 aa, Plasmodium falciparum
DIVKKRFLLFKKKKTEKVNESELD

SEQ ID NO: 3256212 - protein, 25 aa, Plasmodium falciparum
DIVKSICNYIDYFLYKYEKYINEVI

SEQ ID NO: 3256213 - protein, 30 aa, Plasmodium falciparum
DIVLYGIYCCFFIYNKIKAVKKKDNLIENF

SEQ ID NO: 3256214 - protein, 18 aa, Plasmodium falciparum
DIVYREWIYSISEIISRK

SEQ ID NO: 3256215 - protein, 18 aa, Plasmodium falciparum
DIWLRLENFFQNENFNHF

SEQ ID NO: 3256216 - protein, 18 aa, Plasmodium falciparum
DIWNGMVCALTYKEDTSG

SEQ ID NO: 3256217 - protein, 32 aa, Plasmodium falciparum
DIWNILKLLPASDRYKLYFKFFDKLQKGRKDL

SEQ ID NO: 3256218 - protein, 18 aa, Plasmodium falciparum
DIWYRWVERHAHMLEKWK

SEQ ID NO: 3256219 - protein, 19 aa, Plasmodium falciparum
DIYEINERVISSSRKLNID

SEQ ID NO: 3256220 - protein, 24 aa, Plasmodium falciparum
DIYFYMKRFKSIMNIQHDEKKNMV

SEQ ID NO: 3256221 - protein, 19 aa, Plasmodium falciparum
DIYHIAPFLNIIRNNNIFY

SEQ ID NO: 3256222 - protein, 20 aa, Plasmodium falciparum
DIYICQSLFFYLDILQQGSI

SEQ ID NO: 3256223 - protein, 20 aa, Plasmodium falciparum
DIYIEFLYVLLINSQLFNRF

SEQ ID NO: 3256224 - protein, 23 aa, Plasmodium falciparum
DIYKLSNVLIKFLKDKKKKEEED

SEQ ID NO: 3256225 - protein, 21 aa, Plasmodium falciparum
DIYKYRCINNIQTLPEVYDDM

SEQ ID NO: 3256226 - protein, 19 aa, Plasmodium falciparum
DIYLFHSLCLLNYKEQKQI

SEQ ID NO: 3256227 - protein, 22 aa, Plasmodium falciparum
DIYMDKIICEGDVDNRKDGMMN

SEQ ID NO: 3256228 - protein, 24 aa, Plasmodium falciparum
DIYMNFYLCKKCYGLHNIDIILFY

SEQ ID NO: 3256229 - protein, 23 aa, Plasmodium falciparum
DIYNKSEESSICSNHNKNLDEKT

SEQ ID NO: 3256230 - protein, 19 aa, Plasmodium falciparum
DIYNLPGSFFLIGNSELYS

SEQ ID NO: 3256231 - protein, 20 aa, Plasmodium falciparum
DIYPLIFMSLVKLLNGTIKI

SEQ ID NO: 3256232 - protein, 27 aa, Plasmodium falciparum
DIYSDVYVWYFLKNVYKKMEICSFNKM

SEQ ID NO: 3256233 - protein, 18 aa, Plasmodium falciparum
DIYSLPFKIDKKNKNKNK

SEQ ID NO: 3256234 - protein, 30 aa, Plasmodium falciparum
DIYTYISCMYYKCLLAIIHMYLEILDNKDI

SEQ ID NO: 3256235 - protein, 26 aa, Plasmodium falciparum
DKALKECNEIICLSAHYLQRHLNNMF

SEQ ID NO: 3256236 - protein, 19 aa, Plasmodium falciparum
DKALTRPGRLDKLIYISLP

SEQ ID NO: 3256237 - protein, 21 aa, Plasmodium falciparum
DKAYENCFFENRWDDIVEEDD

SEQ ID NO: 3256238 - protein, 20 aa, Plasmodium falciparum
DKCHTRRNFGSCFNRKQYIK

SEQ ID NO: 3256239 - protein, 19 aa, Plasmodium falciparum
DKCKIRNSIINNIINLQLK

SEQ ID NO: 3256240 - protein, 19 aa, Plasmodium falciparum
DKCNGECSCLSEYFKDETR

SEQ ID NO: 3256241 - protein, 24 aa, Plasmodium falciparum
DKDEIKNAMKIYYDNIDMNALSNE

SEQ ID NO: 3256242 - protein, 26 aa, Plasmodium falciparum
DKDEILSIIIYLTIYLCCKLNIMKRI

SEQ ID NO: 3256243 - protein, 28 aa, Plasmodium falciparum
DKDILSFPIKRLLFAGEHTYHSDCNSLV

SEQ ID NO: 3256244 - protein, 21 aa, Plasmodium falciparum
DKDIWDFFSQIILRKREKKKK

SEQ ID NO: 3256245 - protein, 18 aa, Plasmodium falciparum
DKDKPLLLVCGWPDNIHM

SEQ ID NO: 3256246 - protein, 28 aa, Plasmodium falciparum
DKDLIFCVMYLFEYCNIIEIKECEINLN

SEQ ID NO: 3256247 - protein, 17 aa, Plasmodium falciparum
DKDRILLEYKYNYKKIN

SEQ ID NO: 3256248 - protein, 25 aa, Plasmodium falciparum
DKEDNITCLIRDMFVRKSEIYYFNY

SEQ ID NO: 3256249 - protein, 18 aa, Plasmodium falciparum
DKENISICLNHDTNNYNK

SEQ ID NO: 3256250 - protein, 37 aa, Plasmodium falciparum
DKEREFRSYIKYIYNIWFKWLKKRKGELTGEQKPWMT

SEQ ID NO: 3256251 - protein, 26 aa, Plasmodium falciparum
DKFEILKLLDSIGIYTSYDISLCILK

SEQ ID NO: 3256252 - protein, 24 aa, Plasmodium falciparum
DKFGGLALFSRFFFTMPINNINNY

SEQ ID NO: 3256253 - protein, 17 aa, Plasmodium falciparum
DKFHNIEEIILLFKNLY

SEQ ID NO: 3256254 - protein, 18 aa, Plasmodium falciparum
DKFIRPFLYYGFTPMIFG

SEQ ID NO: 3256255 - protein, 25 aa, Plasmodium falciparum
DKFKEALRYLGPISISIAASDDFAF

SEQ ID NO: 3256256 - protein, 18 aa, Plasmodium falciparum
DKFKELRKLLNKNENEAK

SEQ ID NO: 3256257 - protein, 21 aa, Plasmodium falciparum
DKFMLGVLFIWIWNNDYLWKS

SEQ ID NO: 3256258 - protein, 25 aa, Plasmodium falciparum
DKFNSLIYDGEWRNCEKNGKGKLLF

SEQ ID NO: 3256259 - protein, 17 aa, Plasmodium falciparum
DKFVPLFPLKDIFKNYV

SEQ ID NO: 3256260 - protein, 22 aa, Plasmodium falciparum
DKGCIHVNKLLKYCINDVDHSI

SEQ ID NO: 3256261 - protein, 23 aa, Plasmodium falciparum
DKHKNGLNKLAIIPFSKMSINNL

SEQ ID NO: 3256262 - protein, 23 aa, Plasmodium falciparum
DKHLPFNIPIFILNPIEKIDQYF

SEQ ID NO: 3256263 - protein, 24 aa, Plasmodium falciparum
DKIDMLDIMLIKFIRNNYLSENSV

SEQ ID NO: 3256264 - protein, 17 aa, Plasmodium falciparum
DKIERILYLLFLLDKYK

SEQ ID NO: 3256265 - protein, 17 aa, Plasmodium falciparum
DKIFYFVGNNIYRNKLK

SEQ ID NO: 3256266 - protein, 20 aa, Plasmodium falciparum
DKIIFFCGKNIYVGSHKNLM

SEQ ID NO: 3256267 - protein, 23 aa, Plasmodium falciparum
DKIIMSNIFMRINIETILNLLKF

SEQ ID NO: 3256268 - protein, 37 aa, Plasmodium falciparum
DKIIYPCGYLNMRIFYNLPSYYLFQIYKNANIDDINR

SEQ ID NO: 3256269 - protein, 28 aa, Plasmodium falciparum
DKIKCLRFLQIKEFFFLHNIDKNNTLFF

SEQ ID NO: 3256270 - protein, 29 aa, Plasmodium falciparum
DKIKHIYMKKFLFDKERLINRRSDENNFH

SEQ ID NO: 3256271 - protein, 20 aa, Plasmodium falciparum
DKIKKVKVIPGKWEGNGLLG

SEQ ID NO: 3256272 - protein, 23 aa, Plasmodium falciparum
DKIKSICCNMEYKKLSEDMEYCY

SEQ ID NO: 3256273 - protein, 19 aa, Plasmodium falciparum
DKILKIALLMDIFMAILDT

SEQ ID NO: 3256274 - protein, 18 aa, Plasmodium falciparum
DKIRYVFDYMHKKLNSDD

SEQ ID NO: 3256275 - protein, 25 aa, Plasmodium falciparum
DKITFLKCLKELFFVTHTNKENNQM

SEQ ID NO: 3256276 - protein, 18 aa, Plasmodium falciparum
DKITIKCIININLSNIRR

SEQ ID NO: 3256277 - protein, 24 aa, Plasmodium falciparum
DKKACYILKCMLYYNFDENYKGNS

SEQ ID NO: 3256278 - protein, 25 aa, Plasmodium falciparum
DKKDMINNFLITRKNNYYNINQLKI

SEQ ID NO: 3256279 - protein, 24 aa, Plasmodium falciparum
DKKEKLLCIPFIIRPRDLKNVRIN

SEQ ID NO: 3256280 - protein, 21 aa, Plasmodium falciparum
DKKELRYIWINIKSNEENKYF

SEQ ID NO: 3256281 - protein, 22 aa, Plasmodium falciparum
DKKGFWKFILGKKYKGEDDSIK

SEQ ID NO: 3256282 - protein, 33 aa, Plasmodium falciparum
DKKIIMFEFLKLLIKLHNAGLVHLDISPENILI

SEQ ID NO: 3256283 - protein, 29 aa, Plasmodium falciparum
DKKKELIHFSLFVSLIIKKGVEELKNMIY

SEQ ID NO: 3256284 - protein, 25 aa, Plasmodium falciparum
DKKKKSNFFVKIKNGTDLKDTKKDR

SEQ ID NO: 3256285 - protein, 24 aa, Plasmodium falciparum
DKKKRCLLDAVINFKNCKNGLEDI

SEQ ID NO: 3256286 - protein, 21 aa, Plasmodium falciparum
DKKLRLLNNYINMFDKNKNDK

SEQ ID NO: 3256287 - protein, 23 aa, Plasmodium falciparum
DKKNCSYQKNFVSVFYFTIYVNK

SEQ ID NO: 3256288 - protein, 32 aa, Plasmodium falciparum
DKKQYLELLLFWCKRDYKHFIDVVKKEWDKKD

SEQ ID NO: 3256289 - protein, 27 aa, Plasmodium falciparum
DKKTCIRKCNDNCKCYESWVQQKKTEW

SEQ ID NO: 3256290 - protein, 23 aa, Plasmodium falciparum
DKLDHYNFISGLHKSIRAGNVKA

SEQ ID NO: 3256291 - protein, 31 aa, Plasmodium falciparum
DKLESFKYLHFNFFYICSKLENKSISNINKY

SEQ ID NO: 3256292 - protein, 20 aa, Plasmodium falciparum
DKLFSIWINVRYNYVRKYVD

SEQ ID NO: 3256293 - protein, 21 aa, Plasmodium falciparum
DKLKEEYCHRSLFLKNNINNF

SEQ ID NO: 3256294 - protein, 17 aa, Plasmodium falciparum
DKLKGNHFLDDKLKGEN

SEQ ID NO: 3256295 - protein, 27 aa, Plasmodium falciparum
DKLKKDIVCINRCLYILYKMDSHSFNN

SEQ ID NO: 3256296 - protein, 31 aa, Plasmodium falciparum
DKLKKSELISILACICTNIVIEFLKLKEEKK

SEQ ID NO: 3256297 - protein, 25 aa, Plasmodium falciparum
DKLKPHVIVAYKFGCILATHLDGPK

SEQ ID NO: 3256298 - protein, 18 aa, Plasmodium falciparum
DKLKSLKFNNFVNSKIKN

SEQ ID NO: 3256299 - protein, 26 aa, Plasmodium falciparum
DKLLDLRIYDMLKYVYRNNIYRTSHE

SEQ ID NO: 3256300 - protein, 17 aa, Plasmodium falciparum
DKLLKSLFERYDVNVKV

SEQ ID NO: 3256301 - protein, 18 aa, Plasmodium falciparum
DKLPELWKNNSYSSNRNL

SEQ ID NO: 3256302 - protein, 21 aa, Plasmodium falciparum
DKLQLAFTYDLFETFDPQYLN

SEQ ID NO: 3256303 - protein, 17 aa, Plasmodium falciparum
DKLYFKLYEYISRIDKF

SEQ ID NO: 3256304 - protein, 17 aa, Plasmodium falciparum
DKMEVIFLLNKYFKKLN

SEQ ID NO: 3256305 - protein, 22 aa, Plasmodium falciparum
DKMLKITCHINLHLKKNPHFTI

SEQ ID NO: 3256306 - protein, 36 aa, Plasmodium falciparum
DKMVYTKIAMPWIIRDRYLLMDVWICEDFEYSRGIF

SEQ ID NO: 3256307 - protein, 19 aa, Plasmodium falciparum
DKNFFLEVIDIHINSWRNI

SEQ ID NO: 3256308 - protein, 17 aa, Plasmodium falciparum
DKNFFQRSYYLNVSYHF

SEQ ID NO: 3256309 - protein, 31 aa, Plasmodium falciparum
DKNFTIDFCFDICIINSTILLTIETFNKINT

SEQ ID NO: 3256310 - protein, 21 aa, Plasmodium falciparum
DKNFYRRRGSYEFTHTQNEIT

SEQ ID NO: 3256311 - protein, 26 aa, Plasmodium falciparum
DKNGLKKAVYIFLILILIFYDQWSFP

SEQ ID NO: 3256312 - protein, 18 aa, Plasmodium falciparum
DKNICQIHQYFFKHTFPK

SEQ ID NO: 3256313 - protein, 20 aa, Plasmodium falciparum
DKNKCSLLLCNNKSDEFDNN

SEQ ID NO: 3256314 - protein, 17 aa, Plasmodium falciparum
DKNSFFLSPSVVMEPQE

SEQ ID NO: 3256315 - protein, 21 aa, Plasmodium falciparum
DKNYFACFVQYNYLEKNKIKY

SEQ ID NO: 3256316 - protein, 21 aa, Plasmodium falciparum
DKNYIENICIIQADQENNKKV

SEQ ID NO: 3256317 - protein, 25 aa, Plasmodium falciparum
DKPHIINRSLSFFKDYISNSINQST

SEQ ID NO: 3256318 - protein, 22 aa, Plasmodium falciparum
DKQRFLINSSLFFSEFDSCVYF

SEQ ID NO: 3256319 - protein, 28 aa, Plasmodium falciparum
DKRAKIIYVLGLFLLPSLVSYIGSNYYI

SEQ ID NO: 3256320 - protein, 23 aa, Plasmodium falciparum
DKRNNCLQHIKLLEMQESERRKQ

SEQ ID NO: 3256321 - protein, 22 aa, Plasmodium falciparum
DKRSYFDIMFDFYNYINIDINF

SEQ ID NO: 3256322 - protein, 20 aa, Plasmodium falciparum
DKRVPNIYIFSVKDYKNELI

SEQ ID NO: 3256323 - protein, 20 aa, Plasmodium falciparum
DKSAVNFSVSFKKGSEYSKD

SEQ ID NO: 3256324 - protein, 31 aa, Plasmodium falciparum
DKSFFDLLCDIILKKYCTFHINNLCIALLCF

SEQ ID NO: 3256325 - protein, 19 aa, Plasmodium falciparum
DKSFYWFGHHHFNKKNNFQ

SEQ ID NO: 3256326 - protein, 23 aa, Plasmodium falciparum
DKSKENVSCGVIISEDELNKNMI

SEQ ID NO: 3256327 - protein, 19 aa, Plasmodium falciparum
DKSKIIALLALLYNENESN

SEQ ID NO: 3256328 - protein, 22 aa, Plasmodium falciparum
DKSKMIYLLFSYILNVENYLKS

SEQ ID NO: 3256329 - protein, 18 aa, Plasmodium falciparum
DKSKVGLRNVNCKNSAGK

SEQ ID NO: 3256330 - protein, 20 aa, Plasmodium falciparum
DKSLRKWFIESAAVETFFLW

SEQ ID NO: 3256331 - protein, 20 aa, Plasmodium falciparum
DKSLRKWFIETAAIETFFLW

SEQ ID NO: 3256332 - protein, 22 aa, Plasmodium falciparum
DKSSFFQVKWRNIALQISLNIL

SEQ ID NO: 3256333 - protein, 18 aa, Plasmodium falciparum
DKTAGFCRIELISERPND

SEQ ID NO: 3256334 - protein, 19 aa, Plasmodium falciparum
DKTKIAIISFNSCIYFYNC

SEQ ID NO: 3256335 - protein, 26 aa, Plasmodium falciparum
DKTKIFTRKKHHSIIIIVNKFKIKEH

SEQ ID NO: 3256336 - protein, 20 aa, Plasmodium falciparum
DKVFLFKVNYKYNIYDCNIL

SEQ ID NO: 3256337 - protein, 25 aa, Plasmodium falciparum
DKVSSCTSLFFKNDLIEWNNSGVKN

SEQ ID NO: 3256338 - protein, 29 aa, Plasmodium falciparum
DKVTTLRIYYFLILVTLEITYISMKNSNI

SEQ ID NO: 3256339 - protein, 25 aa, Plasmodium falciparum
DKWKCGTVCGVDICTLEKKDTNGQE

SEQ ID NO: 3256340 - protein, 23 aa, Plasmodium falciparum
DKWLKNKSTEWEIIKKYYKENFG

SEQ ID NO: 3256341 - protein, 20 aa, Plasmodium falciparum
DKYIFLFDIFIKKYLLNVFV

SEQ ID NO: 3256342 - protein, 24 aa, Plasmodium falciparum
DKYILEKFPFMFDLLKEAQKKSVH

SEQ ID NO: 3256343 - protein, 21 aa, Plasmodium falciparum
DKYINKSICLFLNNFQDSSIF

SEQ ID NO: 3256344 - protein, 31 aa, Plasmodium falciparum
DKYKRYIFLGIHSFLFAFELYFVKGKHQGKE

SEQ ID NO: 3256345 - protein, 20 aa, Plasmodium falciparum
DKYMLGIVFIWIWNYNFLWK

SEQ ID NO: 3256346 - protein, 26 aa, Plasmodium falciparum
DKYMLGVFFIWVWNNGYLWSRSDPEQ

SEQ ID NO: 3256347 - protein, 20 aa, Plasmodium falciparum
DKYMLLFIIYCLKYNIINIV

SEQ ID NO: 3256348 - protein, 18 aa, Plasmodium falciparum
DKYVECFMDINFISDTWE

SEQ ID NO: 3256349 - protein, 18 aa, Plasmodium falciparum
DLAAAFIFIDTWVLSSNF

SEQ ID NO: 3256350 - protein, 19 aa, Plasmodium falciparum
DLAVSLKYRLEGYVNGDDD

SEQ ID NO: 3256351 - protein, 21 aa, Plasmodium falciparum
DLDCKWLKPKHIKYPYEGYDI

SEQ ID NO: 3256352 - protein, 19 aa, Plasmodium falciparum
DLDDALSIEFIKDNKEQHE

SEQ ID NO: 3256353 - protein, 25 aa, Plasmodium falciparum
DLDEFYDYIIGRRNLINITYKNEYA

SEQ ID NO: 3256354 - protein, 26 aa, Plasmodium falciparum
DLEHILKFSLLITHSMIEISILRDWF

SEQ ID NO: 3256355 - protein, 22 aa, Plasmodium falciparum
DLEKTHLVLMYFGSLFKNNHTF

SEQ ID NO: 3256356 - protein, 31 aa, Plasmodium falciparum
DLERTRDLLKKSCKSSKAIEQERRAKEKLQE

SEQ ID NO: 3256357 - protein, 25 aa, Plasmodium falciparum
DLEYKIKLVMFISGICHDIGHPGYN

SEQ ID NO: 3256358 - protein, 26 aa, Plasmodium falciparum
DLEYRDCGKYCRFYKKWIEKKKTEYE

SEQ ID NO: 3256359 - protein, 28 aa, Plasmodium falciparum
DLFDKARAASPCIIFFDEIDSLAKERNS

SEQ ID NO: 3256360 - protein, 24 aa, Plasmodium falciparum
DLFFCTKKNIFPCKNIETVCKNEY

SEQ ID NO: 3256361 - protein, 24 aa, Plasmodium falciparum
DLFIYLFLNYCNLINFNITNNNVS

SEQ ID NO: 3256362 - protein, 25 aa, Plasmodium falciparum
DLFIYLRNFLKSMKLINFIKLDVNI

SEQ ID NO: 3256363 - protein, 26 aa, Plasmodium falciparum
DLFLFNYKFLYTLSYNIHYIYKNYIE

SEQ ID NO: 3256364 - protein, 23 aa, Plasmodium falciparum
DLFYDENIHLIIIGIIRSESNFA

SEQ ID NO: 3256365 - protein, 19 aa, Plasmodium falciparum
DLHVDYLILNYIKKLDVRV

SEQ ID NO: 3256366 - protein, 24 aa, Plasmodium falciparum
DLIKAADKEILWVIKRNNLNINER

SEQ ID NO: 3256367 - protein, 18 aa, Plasmodium falciparum
DLIKKVFSLFNFSNTLKS

SEQ ID NO: 3256368 - protein, 24 aa, Plasmodium falciparum
DLIKSGVVLLKIIKIYRPHLEIIN

SEQ ID NO: 3256369 - protein, 20 aa, Plasmodium falciparum
DLINLLHFMYLYKSIKNKNC

SEQ ID NO: 3256370 - protein, 24 aa, Plasmodium falciparum
DLIYKFHLPITIQMYAIKFLNVVL

SEQ ID NO: 3256371 - protein, 25 aa, Plasmodium falciparum
DLKCPSCAISCSSYRKWIKGKKTQY

SEQ ID NO: 3256372 - protein, 25 aa, Plasmodium falciparum
DLKDCKKYGLFKGMRKQAWKCQYIN

SEQ ID NO: 3256373 - protein, 42 aa, Plasmodium falciparum
DLKDTKKDRIRFHFYFYFFIVKIILLSLLIWTVIYSNNCSNG

SEQ ID NO: 3256374 - protein, 19 aa, Plasmodium falciparum
DLKKLNCNFINKNYIHNTN

SEQ ID NO: 3256375 - protein, 20 aa, Plasmodium falciparum
DLKLRIFSITDILFLIKNVY

SEQ ID NO: 3256376 - protein, 22 aa, Plasmodium falciparum
DLKNIYGLGSLFVNNNDGTNNS

SEQ ID NO: 3256377 - protein, 30 aa, Plasmodium falciparum
DLKRELKFYQIRSYDDMDFYILRNQNKLHI

SEQ ID NO: 3256378 - protein, 23 aa, Plasmodium falciparum
DLKTECKRDFNISQESGLDYKDE

SEQ ID NO: 3256379 - protein, 22 aa, Plasmodium falciparum
DLKTLYIDILYKLKKYNESINV

SEQ ID NO: 3256380 - protein, 18 aa, Plasmodium falciparum
DLKYNKGKNYGWRCIPTG

SEQ ID NO: 3256381 - protein, 20 aa, Plasmodium falciparum
DLKYYALVESLAYILYQCTD

SEQ ID NO: 3256382 - protein, 17 aa, Plasmodium falciparum
DLLAEVCHAAKYEGASI

SEQ ID NO: 3256383 - protein, 17 aa, Plasmodium falciparum
DLLAEVCMAAKYEGETL

SEQ ID NO: 3256384 - protein, 18 aa, Plasmodium falciparum
DLLELLIILITKKHPILN

SEQ ID NO: 3256385 - protein, 19 aa, Plasmodium falciparum
DLLIKRKNLNELKKFSKGG

SEQ ID NO: 3256386 - protein, 42 aa, Plasmodium falciparum
DLLIYLNCFSEIFLLLSPLRIPAFCFSWVELISSKYFMPKFL

SEQ ID NO: 3256387 - protein, 21 aa, Plasmodium falciparum
DLLKKSYLVHIKKLYINSYIK

SEQ ID NO: 3256388 - protein, 23 aa, Plasmodium falciparum
DLLKPFVKHTIKIYGKDFESVDD

SEQ ID NO: 3256389 - protein, 27 aa, Plasmodium falciparum
DLLLFSASIASRLGVKIVEKQKLPLCK

SEQ ID NO: 3256390 - protein, 18 aa, Plasmodium falciparum
DLLLLLKREEEIFEYISN

SEQ ID NO: 3256391 - protein, 29 aa, Plasmodium falciparum
DLLPEIKIVPKILTNISFLLFKNRLKFLL

SEQ ID NO: 3256392 - protein, 24 aa, Plasmodium falciparum
DLLRILYKEIEYMDVDKDLIFCVM

SEQ ID NO: 3256393 - protein, 27 aa, Plasmodium falciparum
DLLSDDMWTRFHLNLHDKCDIKNGKHE

SEQ ID NO: 3256394 - protein, 25 aa, Plasmodium falciparum
DLMELKRILYNLFLEYNPHMNNKQK

SEQ ID NO: 3256395 - protein, 27 aa, Plasmodium falciparum
DLMKRRYELQKAILLNVDENLKEVIDE

SEQ ID NO: 3256396 - protein, 19 aa, Plasmodium falciparum
DLNKICNDILKGVENNSLT

SEQ ID NO: 3256397 - protein, 29 aa, Plasmodium falciparum
DLNKRFNADIVRLWVCCYNFVNRNISISY

SEQ ID NO: 3256398 - protein, 18 aa, Plasmodium falciparum
DLNRQWSNPIGYIHPTIY

SEQ ID NO: 3256399 - protein, 23 aa, Plasmodium falciparum
DLNRYLHKIKHSIYNITNKEDYN

SEQ ID NO: 3256400 - protein, 24 aa, Plasmodium falciparum
DLPDLKINFIVMGAYCFYQKDMKP

SEQ ID NO: 3256401 - protein, 24 aa, Plasmodium falciparum
DLPRKEKYNLLNFKNIKKNTHLNN

SEQ ID NO: 3256402 - protein, 26 aa, Plasmodium falciparum
DLQNMCTCYLFLEWSLKGDENIRSGI

SEQ ID NO: 3256403 - protein, 18 aa, Plasmodium falciparum
DLRKTNQIVFSWNEGQSW

SEQ ID NO: 3256404 - protein, 23 aa, Plasmodium falciparum
DLRKVELQWKFQSKLVNSSNAYI

SEQ ID NO: 3256405 - protein, 20 aa, Plasmodium falciparum
DLRLYKNFYKYILKRRNNLH

SEQ ID NO: 3256406 - protein, 23 aa, Plasmodium falciparum
DLRRAYLKLAMKWHPDKHVNKGS

SEQ ID NO: 3256407 - protein, 28 aa, Plasmodium falciparum
DLRVIENVVLCFKTPLTANLNIFNLTKK

SEQ ID NO: 3256408 - protein, 17 aa, Plasmodium falciparum
DLSCSWRYYCSEFFHVC

SEQ ID NO: 3256409 - protein, 25 aa, Plasmodium falciparum
DLSFKLWNCTNVGLFSGFLKIQSKC

SEQ ID NO: 3256410 - protein, 24 aa, Plasmodium falciparum
DLSICISSGIFKGIRKDIWECGNV

SEQ ID NO: 3256411 - protein, 23 aa, Plasmodium falciparum
DLSLLKSILIYRQRVTRNCVNVF

SEQ ID NO: 3256412 - protein, 19 aa, Plasmodium falciparum
DLSSLKICVEEKIQKMDKN

SEQ ID NO: 3256413 - protein, 28 aa, Plasmodium falciparum
DLSSSCATPCRKYRKWIERKKYEFTEQY

SEQ ID NO: 3256414 - protein, 17 aa, Plasmodium falciparum
DLVFIFHIHIKRKYYNF

SEQ ID NO: 3256415 - protein, 24 aa, Plasmodium falciparum
DLVIQCFPPNYSAVYIHRAGRTGR

SEQ ID NO: 3256416 - protein, 31 aa, Plasmodium falciparum
DLWFNACLLDKCLFFKNNMVSILMKQKYQEN

SEQ ID NO: 3256417 - protein, 25 aa, Plasmodium falciparum
DLWIYIMNLLICFNSQNKYSLSFPQ

SEQ ID NO: 3256418 - protein, 30 aa, Plasmodium falciparum
DLYDEEFLKLFLLVRLFSAVNLVVFLYLHI

SEQ ID NO: 3256419 - protein, 24 aa, Plasmodium falciparum
DLYFSAYCIQLFDYLPIKEKIKML

SEQ ID NO: 3256420 - protein, 20 aa, Plasmodium falciparum
DLYFSVLCFDAQTKSTMPIN

SEQ ID NO: 3256421 - protein, 22 aa, Plasmodium falciparum
DLYKLNIWQADIIKLSSSNQIS

SEQ ID NO: 3256422 - protein, 21 aa, Plasmodium falciparum
DLYNSKICIFNNSYNTKSNKM

SEQ ID NO: 3256423 - protein, 23 aa, Plasmodium falciparum
DLYWQIDLDIHFGKYVMQKANAV

SEQ ID NO: 3256424 - protein, 18 aa, Plasmodium falciparum
DMCFRKFYNNSNISTRIY

SEQ ID NO: 3256425 - protein, 21 aa, Plasmodium falciparum
DMEKLKFVRILLFDNIAVLFK

SEQ ID NO: 3256426 - protein, 17 aa, Plasmodium falciparum
DMFDFFKKMLIIKKTDN

SEQ ID NO: 3256427 - protein, 20 aa, Plasmodium falciparum
DMFKTNFAFKFSEANSPMSL

SEQ ID NO: 3256428 - protein, 24 aa, Plasmodium falciparum
DMFLKYTFQICYELINFKDMNNFL

SEQ ID NO: 3256429 - protein, 24 aa, Plasmodium falciparum
DMFQCNLIYFKNHKRYVYSSKSKK

SEQ ID NO: 3256430 - protein, 24 aa, Plasmodium falciparum
DMHTCKMHDTFFFNFLYFFYNKYS

SEQ ID NO: 3256431 - protein, 57 aa, Plasmodium falciparum
DMICDMKSDVICDMKSDIICDMKSDIICDMKSDIICDMKSDVICDITNDVICDMTND

SEQ ID NO: 3256432 - protein, 27 aa, Plasmodium falciparum
DMIKIIFKYKFDFFNFYPYIVNIILDV

SEQ ID NO: 3256433 - protein, 22 aa, Plasmodium falciparum
DMIKIWFRNLVRQIKNSHINDL

SEQ ID NO: 3256434 - protein, 18 aa, Plasmodium falciparum
DMIKKINLYRLVFYLTQY

SEQ ID NO: 3256435 - protein, 25 aa, Plasmodium falciparum
DMKDILKYFIDFYFENGSYYILDNI

SEQ ID NO: 3256436 - protein, 28 aa, Plasmodium falciparum
DMKEQKFCYNTFWYLAFILNVHVKYLNK

SEQ ID NO: 3256437 - protein, 22 aa, Plasmodium falciparum
DMKKLLGINYVRGCEVIKYSNI

SEQ ID NO: 3256438 - protein, 17 aa, Plasmodium falciparum
DMKLHFEYVDIFKKRKK

SEQ ID NO: 3256439 - protein, 21 aa, Plasmodium falciparum
DMKNTYEIYTFLLKELQKVQE

SEQ ID NO: 3256440 - protein, 26 aa, Plasmodium falciparum
DMLKCFCLQTKMFFSLDIKTMQSLNR

SEQ ID NO: 3256441 - protein, 27 aa, Plasmodium falciparum
DMLLLLNICDRFFRIFLTIYNKNNNHK

SEQ ID NO: 3256442 - protein, 29 aa, Plasmodium falciparum
DMLMINFLFSLPFCIIETPMGYINTNEGN

SEQ ID NO: 3256443 - protein, 21 aa, Plasmodium falciparum
DMLRLYYKYINKYANTEFMKL

SEQ ID NO: 3256444 - protein, 18 aa, Plasmodium falciparum
DMLYYESRIKNFIMSKIL

SEQ ID NO: 3256445 - protein, 24 aa, Plasmodium falciparum
DMMCKICLDLILKDYKCIELINLL

SEQ ID NO: 3256446 - protein, 26 aa, Plasmodium falciparum
DMNISIMCKILYYSVFLRNFIFINNV

SEQ ID NO: 3256447 - protein, 25 aa, Plasmodium falciparum
DMNNYNFYYSCGKNEIRNMNTKEVT

SEQ ID NO: 3256448 - protein, 20 aa, Plasmodium falciparum
DMRKAFNWNLKQLFVYVLVT

SEQ ID NO: 3256449 - protein, 21 aa, Plasmodium falciparum
DMRKYLKNGFIYRNNDEVNEN

SEQ ID NO: 3256450 - protein, 17 aa, Plasmodium falciparum
DMVYDFKKNGIYNKGEK

SEQ ID NO: 3256451 - protein, 25 aa, Plasmodium falciparum
DMYMPFFTVLGTRDWTGNYNAQLLK

SEQ ID NO: 3256452 - protein, 36 aa, Plasmodium falciparum
DNAKNAWIYFSFCGFIGMACSYLFVILTRYYTDYSY

SEQ ID NO: 3256453 - protein, 19 aa, Plasmodium falciparum
DNAYNCLYVGNKIGLFNNV

SEQ ID NO: 3256454 - protein, 32 aa, Plasmodium falciparum
DNCKPCSSFKIYCKNCKSSGGTENKCPKGKIS

SEQ ID NO: 3256455 - protein, 17 aa, Plasmodium falciparum
DNCSFIISMNKSTLDNF

SEQ ID NO: 3256456 - protein, 27 aa, Plasmodium falciparum
DNDSLKVLKFILISTINYDTNEKKITK

SEQ ID NO: 3256457 - protein, 18 aa, Plasmodium falciparum
DNDSYILYNNIIKVLDIL

SEQ ID NO: 3256458 - protein, 26 aa, Plasmodium falciparum
DNEFIKMIRKIMEYDKKRKLKSIQKL

SEQ ID NO: 3256459 - protein, 25 aa, Plasmodium falciparum
DNEIKKGCPTYEMYKDLRKQKWICQ

SEQ ID NO: 3256460 - protein, 27 aa, Plasmodium falciparum
DNELFKIMLDKLVKMGILLIRPYIPLE

SEQ ID NO: 3256461 - protein, 28 aa, Plasmodium falciparum
DNEYKCAFISILCPLLLSIRKLRNKEES

SEQ ID NO: 3256462 - protein, 17 aa, Plasmodium falciparum
DNFFPYIKYECHESENT

SEQ ID NO: 3256463 - protein, 28 aa, Plasmodium falciparum
DNFHFNEIPLLGGFLFKRNEESVDGNIS

SEQ ID NO: 3256464 - protein, 21 aa, Plasmodium falciparum
DNFKTALLLMVALFLKGVNFA

SEQ ID NO: 3256465 - protein, 23 aa, Plasmodium falciparum
DNFKVSFFLNKLLYFFFLPIKPS

SEQ ID NO: 3256466 - protein, 25 aa, Plasmodium falciparum
DNFMRHIYFNLAFTYILLEDYKNAL

SEQ ID NO: 3256467 - protein, 18 aa, Plasmodium falciparum
DNFNYSGDIKWRKQDNLF

SEQ ID NO: 3256468 - protein, 24 aa, Plasmodium falciparum
DNFSDLFLKFIKQFIDHINVHLNN

SEQ ID NO: 3256469 - protein, 20 aa, Plasmodium falciparum
DNGWFPIIKYFEGDNKEGKN

SEQ ID NO: 3256470 - protein, 17 aa, Plasmodium falciparum
DNGYFLEEVFMKWLAAF

SEQ ID NO: 3256471 - protein, 19 aa, Plasmodium falciparum
DNHKFTCWYIKTKDSENKP

SEQ ID NO: 3256472 - protein, 17 aa, Plasmodium falciparum
DNIHGFKYLIDGYEEIN

SEQ ID NO: 3256473 - protein, 17 aa, Plasmodium falciparum
DNIIKIFIENITLDNII

SEQ ID NO: 3256474 - protein, 21 aa, Plasmodium falciparum
DNIKCLALISPMISIENQKRK

SEQ ID NO: 3256475 - protein, 25 aa, Plasmodium falciparum
DNIKILDIFKLYLFPQNNYFHYKNV

SEQ ID NO: 3256476 - protein, 21 aa, Plasmodium falciparum
DNIKKGCYLKCKSQNDEKDNK

SEQ ID NO: 3256477 - protein, 24 aa, Plasmodium falciparum
DNIKKLMYCFLIMVIEINHILNKK

SEQ ID NO: 3256478 - protein, 25 aa, Plasmodium falciparum
DNIKPEVFELINFLKREKKKVYVCT

SEQ ID NO: 3256479 - protein, 36 aa, Plasmodium falciparum
DNIKRGIQDYVLLKCKIFNMVINFYFNPFLYNHPYK

SEQ ID NO: 3256480 - protein, 18 aa, Plasmodium falciparum
DNILKFFSKNKFYITLFT

SEQ ID NO: 3256481 - protein, 29 aa, Plasmodium falciparum
DNILKYHRKAFCWIDEWIDLTIDDIRNLE

SEQ ID NO: 3256482 - protein, 18 aa, Plasmodium falciparum
DNILRKNIEALKMNIRNL

SEQ ID NO: 3256483 - protein, 21 aa, Plasmodium falciparum
DNILTLKWKVYETGVTNNKVD

SEQ ID NO: 3256484 - protein, 17 aa, Plasmodium falciparum
DNIQMIDKFILYKKDNL

SEQ ID NO: 3256485 - protein, 32 aa, Plasmodium falciparum
DNISYSNFLPFLWKKNMSSLNVEYDLEITDEL

SEQ ID NO: 3256486 - protein, 28 aa, Plasmodium falciparum
DNITKYLYKLMCTRLEDICNIQKLLKKI

SEQ ID NO: 3256487 - protein, 31 aa, Plasmodium falciparum
DNKGLSYILPILLKKLYKLNSYIHIFDDEFF

SEQ ID NO: 3256488 - protein, 29 aa, Plasmodium falciparum
DNKIKICCLKILIYLCNYYNNSNKKIFKI

SEQ ID NO: 3256489 - protein, 23 aa, Plasmodium falciparum
DNKIRSFFLFFPNHLFVHLKSKN

SEQ ID NO: 3256490 - protein, 25 aa, Plasmodium falciparum
DNKKCSPCPIGTFSSYVGSIICENC

SEQ ID NO: 3256491 - protein, 26 aa, Plasmodium falciparum
DNKKRIQMCLKDSALAITVTTLTNII

SEQ ID NO: 3256492 - protein, 30 aa, Plasmodium falciparum
DNKLKEALRFLGPISISIAVSDDFPFYKEG

SEQ ID NO: 3256493 - protein, 28 aa, Plasmodium falciparum
DNKLKEALRFLGPISISVAVSDDFAFYK

SEQ ID NO: 3256494 - protein, 22 aa, Plasmodium falciparum
DNKLKYPVFFLVHKNKIKRYHV

SEQ ID NO: 3256495 - protein, 22 aa, Plasmodium falciparum
DNKNYIFFILVNFLILLQILFC

SEQ ID NO: 3256496 - protein, 22 aa, Plasmodium falciparum
DNKSMYRFPIITNENNWSEIDN

SEQ ID NO: 3256497 - protein, 20 aa, Plasmodium falciparum
DNLCYNRNSIQFDDYMDETI

SEQ ID NO: 3256498 - protein, 23 aa, Plasmodium falciparum
DNLECFKINPMIILINSYDQIKT

SEQ ID NO: 3256499 - protein, 21 aa, Plasmodium falciparum
DNLECVFKYKCEDFHVYEINK

SEQ ID NO: 3256500 - protein, 21 aa, Plasmodium falciparum
DNLHKCVGSLLIIDKSYDCKK

SEQ ID NO: 3256501 - protein, 25 aa, Plasmodium falciparum
DNLIMKIWICICMMILEECKKDEGR

SEQ ID NO: 3256502 - protein, 24 aa, Plasmodium falciparum
DNLIRLKMYNIWLELMQNEQMKYY

SEQ ID NO: 3256503 - protein, 23 aa, Plasmodium falciparum
DNLLSLKFHFLIISYKEKIYIYN

SEQ ID NO: 3256504 - protein, 19 aa, Plasmodium falciparum
DNLRCDKNFLYLIDEKKMR

SEQ ID NO: 3256505 - protein, 17 aa, Plasmodium falciparum
DNLRKAFIISAAAETFR

SEQ ID NO: 3256506 - protein, 23 aa, Plasmodium falciparum
DNMVISYSYFYILKHIHLYSYIF

SEQ ID NO: 3256507 - protein, 23 aa, Plasmodium falciparum
DNNDCLLFLYSIINLLKLPTFIM

SEQ ID NO: 3256508 - protein, 23 aa, Plasmodium falciparum
DNNIKCANAEMVSNIYNDKLYQD

SEQ ID NO: 3256509 - protein, 17 aa, Plasmodium falciparum
DNNISCFSTFSDLKEEN

SEQ ID NO: 3256510 - protein, 31 aa, Plasmodium falciparum
DNNKCKKYYHPLCAYLEGYYMDVEVHDDQYI

SEQ ID NO: 3256511 - protein, 36 aa, Plasmodium falciparum
DNNKRCIINLMLYKIFKGYILLLLWVIIILKNEYIY

SEQ ID NO: 3256512 - protein, 24 aa, Plasmodium falciparum
DNNLCVKCTCLQGMNSSCEINKID

SEQ ID NO: 3256513 - protein, 27 aa, Plasmodium falciparum
DNNSYIRWCLSKSFGNIMIYLNVDNIN

SEQ ID NO: 3256514 - protein, 19 aa, Plasmodium falciparum
DNPKKFDWTQVFKDKVTEK

SEQ ID NO: 3256515 - protein, 18 aa, Plasmodium falciparum
DNPLIKRNFDLYKENKEK

SEQ ID NO: 3256516 - protein, 19 aa, Plasmodium falciparum
DNPRFNISSQFIKNIIHIF

SEQ ID NO: 3256517 - protein, 25 aa, Plasmodium falciparum
DNPYMFLKDVLKYHMKYSIQCLFNE

SEQ ID NO: 3256518 - protein, 24 aa, Plasmodium falciparum
DNQELRNALKIYSNWPTFPQLYVN

SEQ ID NO: 3256519 - protein, 17 aa, Plasmodium falciparum
DNQYLHWFREWKNDFCI

SEQ ID NO: 3256520 - protein, 19 aa, Plasmodium falciparum
DNSFLRYLSFYVLSKLLSE

SEQ ID NO: 3256521 - protein, 22 aa, Plasmodium falciparum
DNSKWCRGFRAGSKLLSAAVTL

SEQ ID NO: 3256522 - protein, 19 aa, Plasmodium falciparum
DNSLQFFDHIFFKDYLSDY

SEQ ID NO: 3256523 - protein, 21 aa, Plasmodium falciparum
DNSLVCFKEKSANIFVHNNIS

SEQ ID NO: 3256524 - protein, 23 aa, Plasmodium falciparum
DNSRSPLIHRFFMLDSISSSLII

SEQ ID NO: 3256525 - protein, 41 aa, Plasmodium falciparum
DNTIIKFKLTLPFPHLFLCKPNSLYLNNFIKSISGTTKYYC

SEQ ID NO: 3256526 - protein, 36 aa, Plasmodium falciparum
DNTPTFLSHFVLRPPYFRYLEEWGETFCKERKKKLA

SEQ ID NO: 3256527 - protein, 18 aa, Plasmodium falciparum
DNTTFLLDCFQFIEEENY

SEQ ID NO: 3256528 - protein, 17 aa, Plasmodium falciparum
DNTTICKLLNCDRIINM

SEQ ID NO: 3256529 - protein, 40 aa, Plasmodium falciparum
DNVFHGFGSYPLKKDILGLWWEALSIIKLGFEIITRDFKS

SEQ ID NO: 3256530 - protein, 26 aa, Plasmodium falciparum
DNVPRPFTVFNKFVYKNFPDIYNCLQ

SEQ ID NO: 3256531 - protein, 19 aa, Plasmodium falciparum
DNVRNTFKMMGYSSKNITN

SEQ ID NO: 3256532 - protein, 17 aa, Plasmodium falciparum
DNYASAYLSAIIYEQIS

SEQ ID NO: 3256533 - protein, 27 aa, Plasmodium falciparum
DNYESFLACIWFCFQIVNSALILTFGG

SEQ ID NO: 3256534 - protein, 26 aa, Plasmodium falciparum
DNYFCTNLTMSQCINLICEINLYYLN

SEQ ID NO: 3256535 - protein, 17 aa, Plasmodium falciparum
DNYKEFILLFDEYKLLE

SEQ ID NO: 3256536 - protein, 29 aa, Plasmodium falciparum
DNYMLVRLFKISSIFSFVPEMEVYIKSIR

SEQ ID NO: 3256537 - protein, 22 aa, Plasmodium falciparum
DNYSCPYFYPNIRIRNNNKKEY

SEQ ID NO: 3256538 - protein, 27 aa, Plasmodium falciparum
DPESWWKNHGEHIWNAMVCALTYTDSE

SEQ ID NO: 3256539 - protein, 19 aa, Plasmodium falciparum
DPFIRFHVFTDRSLEDEVD

SEQ ID NO: 3256540 - protein, 21 aa, Plasmodium falciparum
DPFLYNYFNECLKYEQEKYVS

SEQ ID NO: 3256541 - protein, 19 aa, Plasmodium falciparum
DPGYFFLYDFEKLQIHTSY

SEQ ID NO: 3256542 - protein, 24 aa, Plasmodium falciparum
DPHNIRYGFFYSHVGWLLYQKTKY

SEQ ID NO: 3256543 - protein, 17 aa, Plasmodium falciparum
DPKEYNLMLSVECFHSW

SEQ ID NO: 3256544 - protein, 39 aa, Plasmodium falciparum
DPKINVLGLFIFYPCTLFLMRSGIRFAITLNGKSYSVDY

SEQ ID NO: 3256545 - protein, 19 aa, Plasmodium falciparum
DPKTLKWGIHGNMSEGPIV

SEQ ID NO: 3256546 - protein, 23 aa, Plasmodium falciparum
DPLIYRMDLANGKGKINELKEFL

SEQ ID NO: 3256547 - protein, 18 aa, Plasmodium falciparum
DPLYFLGELCKYENILDV

SEQ ID NO: 3256548 - protein, 23 aa, Plasmodium falciparum
DPNCNCPSLFNYINIDTVEACII

SEQ ID NO: 3256549 - protein, 20 aa, Plasmodium falciparum
DPNFLKLREDWWTANRETVW

SEQ ID NO: 3256550 - protein, 19 aa, Plasmodium falciparum
DPPKRKGRNFNENVKREIH

SEQ ID NO: 3256551 - protein, 29 aa, Plasmodium falciparum
DPQTWWNAHAPSIWNAMVCALTYDTNSGG

SEQ ID NO: 3256552 - protein, 18 aa, Plasmodium falciparum
DPSFRRFINFCIISAIIW

SEQ ID NO: 3256553 - protein, 19 aa, Plasmodium falciparum
DPSKVYNFFFISNLSGIYN

SEQ ID NO: 3256554 - protein, 26 aa, Plasmodium falciparum
DPTIVRDFLCSTCGRHCSFYKKWIQR

SEQ ID NO: 3256555 - protein, 20 aa, Plasmodium falciparum
DPVRVIMAVPGINDFVNHDE

SEQ ID NO: 3256556 - protein, 41 aa, Plasmodium falciparum
DPVVTKCGHLFCWLCLSAWIKKNNDCPVCKAEVSKENVIPL

SEQ ID NO: 3256557 - protein, 20 aa, Plasmodium falciparum
DPYFAEYATKLSFILNSSDA

SEQ ID NO: 3256558 - protein, 19 aa, Plasmodium falciparum
DPYFRLSRDIAVKMALHKP

SEQ ID NO: 3256559 - protein, 21 aa, Plasmodium falciparum
DPYFVNFLYQHFIKEFDELKF

SEQ ID NO: 3256560 - protein, 19 aa, Plasmodium falciparum
DQCYLKLGVNITHLNILNR

SEQ ID NO: 3256561 - protein, 27 aa, Plasmodium falciparum
DQECIKCSSVCIPFGPWIKNQKQEFEK

SEQ ID NO: 3256562 - protein, 19 aa, Plasmodium falciparum
DQFCRERITQLQILKERCM

SEQ ID NO: 3256563 - protein, 17 aa, Plasmodium falciparum
DQFLGRKFFPLTTTFLI

SEQ ID NO: 3256564 - protein, 19 aa, Plasmodium falciparum
DQGSFFTSNMVNREVNNLL

SEQ ID NO: 3256565 - protein, 25 aa, Plasmodium falciparum
DQHISDKDNIVWKQTYNNINIVGDK

SEQ ID NO: 3256566 - protein, 23 aa, Plasmodium falciparum
DQHPCGSSFFFNMLNHLKECDTD

SEQ ID NO: 3256567 - protein, 18 aa, Plasmodium falciparum
DQIMKRLEMNSSNKNFSL

SEQ ID NO: 3256568 - protein, 27 aa, Plasmodium falciparum
DQKELNELFNFFFFHIYTLIQGSIYRI

SEQ ID NO: 3256569 - protein, 23 aa, Plasmodium falciparum
DQKFKLICICFGYIINTFLYFLF

SEQ ID NO: 3256570 - protein, 24 aa, Plasmodium falciparum
DQKIKRSRNSSCNKQTHMNCVQEN

SEQ ID NO: 3256571 - protein, 24 aa, Plasmodium falciparum
DQLGRPTIVINFVHFPLVYDNHLL

SEQ ID NO: 3256572 - protein, 19 aa, Plasmodium falciparum
DQLIYCIIYLIYIIQIYIK

SEQ ID NO: 3256573 - protein, 24 aa, Plasmodium falciparum
DQLKLNIVPVFVFLPGPVEYKEYV

SEQ ID NO: 3256574 - protein, 23 aa, Plasmodium falciparum
DQLPSDFFSYLPILKKINMSTIN

SEQ ID NO: 3256575 - protein, 24 aa, Plasmodium falciparum
DQNIFCIRPSRGRQYCILRNSTVS

SEQ ID NO: 3256576 - protein, 17 aa, Plasmodium falciparum
DQWKCRNVCGYVVCKSE

SEQ ID NO: 3256577 - protein, 19 aa, Plasmodium falciparum
DQYFSISFNYTFAKNYNAN

SEQ ID NO: 3256578 - protein, 22 aa, Plasmodium falciparum
DQYVFWSLAFSLMFITIMCLIY

SEQ ID NO: 3256579 - protein, 18 aa, Plasmodium falciparum
DRFCKLFHQKDLVSLDIK

SEQ ID NO: 3256580 - protein, 17 aa, Plasmodium falciparum
DRFGYLLCNCILIRVLN

SEQ ID NO: 3256581 - protein, 22 aa, Plasmodium falciparum
DRFRMRRKRRNFLKLIYKLKYK

SEQ ID NO: 3256582 - protein, 19 aa, Plasmodium falciparum
DRHFCDILRNYDNINYSIY

SEQ ID NO: 3256583 - protein, 23 aa, Plasmodium falciparum
DRINFAFRNIWALSDYMYDEKSE

SEQ ID NO: 3256584 - protein, 19 aa, Plasmodium falciparum
DRIPDFHLCPISNRCMGTS

SEQ ID NO: 3256585 - protein, 24 aa, Plasmodium falciparum
DRIPKSFNKLFGYFSGSQEEEQKE

SEQ ID NO: 3256586 - protein, 21 aa, Plasmodium falciparum
DRIQRITGCTLEYNYNNYNDN

SEQ ID NO: 3256587 - protein, 20 aa, Plasmodium falciparum
DRKDLCIIRDPAHAEDKNKN

SEQ ID NO: 3256588 - protein, 21 aa, Plasmodium falciparum
DRKEHFYDLIIPYSSQEQYNN

SEQ ID NO: 3256589 - protein, 24 aa, Plasmodium falciparum
DRKEIKILLEFLIYKYDINVKCSQ

SEQ ID NO: 3256590 - protein, 23 aa, Plasmodium falciparum
DRKKLCPFYIYPRKFNLSYKSRK

SEQ ID NO: 3256591 - protein, 33 aa, Plasmodium falciparum
DRKNIILNIITRVAFKNYCHYIQQIGSNTNELL

SEQ ID NO: 3256592 - protein, 18 aa, Plasmodium falciparum
DRKRVCRSLDIFYTYNKK

SEQ ID NO: 3256593 - protein, 26 aa, Plasmodium falciparum
DRLKIYEILPGLQVVFIKEIEIKHDV

SEQ ID NO: 3256594 - protein, 22 aa, Plasmodium falciparum
DRLLECLGCSKIFHSKNPFNWM

SEQ ID NO: 3256595 - protein, 19 aa, Plasmodium falciparum
DRLPHINFYLKFQKKDFVQ

SEQ ID NO: 3256596 - protein, 27 aa, Plasmodium falciparum
DRLTFLFADICGFTSWANGVDASEVLT

SEQ ID NO: 3256597 - protein, 18 aa, Plasmodium falciparum
DRNMKYIVDNVIQNSRKN

SEQ ID NO: 3256598 - protein, 17 aa, Plasmodium falciparum
DRNVPIYILEIGAGHGK

SEQ ID NO: 3256599 - protein, 17 aa, Plasmodium falciparum
DRPDMMAKYDVTVTADK

SEQ ID NO: 3256600 - protein, 20 aa, Plasmodium falciparum
DRRRGNVFVLRVAPAGVGSL

SEQ ID NO: 3256601 - protein, 24 aa, Plasmodium falciparum
DRTHHCRVCKSCILKMDHHCPWIY

SEQ ID NO: 3256602 - protein, 20 aa, Plasmodium falciparum
DRTKFVLNFFFVLYYIFYFF

SEQ ID NO: 3256603 - protein, 24 aa, Plasmodium falciparum
DRTNRGGLGLSINKDVRFNMLNNY

SEQ ID NO: 3256604 - protein, 23 aa, Plasmodium falciparum
DRVIFNYINLVLLSKAGTMEDRG

SEQ ID NO: 3256605 - protein, 21 aa, Plasmodium falciparum
DRWPSSSMYLSFQKILSDNKI

SEQ ID NO: 3256606 - protein, 18 aa, Plasmodium falciparum
DRYISILFLRGDSVILIL

SEQ ID NO: 3256607 - protein, 25 aa, Plasmodium falciparum
DRYLEEPFCTFPIYNNIFSNLTHKK

SEQ ID NO: 3256608 - protein, 18 aa, Plasmodium falciparum
DSCICIGSVFNFYFNFGN

SEQ ID NO: 3256609 - protein, 18 aa, Plasmodium falciparum
DSCIKCPINFTTLFETSK

SEQ ID NO: 3256610 - protein, 24 aa, Plasmodium falciparum
DSCQILYKRVIDYINIKEGIKNYI

SEQ ID NO: 3256611 - protein, 23 aa, Plasmodium falciparum
DSCSEFKIKCENGVCSGDTKVEC

SEQ ID NO: 3256612 - protein, 23 aa, Plasmodium falciparum
DSCSPLYFKNICDKCKFIKIKNF

SEQ ID NO: 3256613 - protein, 32 aa, Plasmodium falciparum
DSDKIIPFNVFFQRWLRNFVHDYNKLKQKIHP

SEQ ID NO: 3256614 - protein, 17 aa, Plasmodium falciparum
DSEVVKLQIKINEKSNE

SEQ ID NO: 3256615 - protein, 19 aa, Plasmodium falciparum
DSEVVKLQIKINEKSNELD

SEQ ID NO: 3256616 - protein, 22 aa, Plasmodium falciparum
DSFHMKNIFLLVIHFLFYIILV

SEQ ID NO: 3256617 - protein, 23 aa, Plasmodium falciparum
DSFKIANMQLLFFSFALTGYAYY

SEQ ID NO: 3256618 - protein, 24 aa, Plasmodium falciparum
DSFLEKYSKISFHTFLTPNKLTCK

SEQ ID NO: 3256619 - protein, 18 aa, Plasmodium falciparum
DSFVDLKYYTYNCICEIA

SEQ ID NO: 3256620 - protein, 17 aa, Plasmodium falciparum
DSFYIKNYFILKNTFSL

SEQ ID NO: 3256621 - protein, 27 aa, Plasmodium falciparum
DSIFICMNHIFKLINIINKFKLYQYCK

SEQ ID NO: 3256622 - protein, 20 aa, Plasmodium falciparum
DSIFKPKKLINVSLVAAKFL

SEQ ID NO: 3256623 - protein, 19 aa, Plasmodium falciparum
DSIFLFIFMYLRKLNEQYN

SEQ ID NO: 3256624 - protein, 20 aa, Plasmodium falciparum
DSIFLRIYKYPTLGGDEYFI

SEQ ID NO: 3256625 - protein, 18 aa, Plasmodium falciparum
DSIHWKKKLQRCLEKKNG

SEQ ID NO: 3256626 - protein, 18 aa, Plasmodium falciparum
DSIHWRTKKIKGCLSNGA

SEQ ID NO: 3256627 - protein, 26 aa, Plasmodium falciparum
DSIIVYWDIFKDIVFYINNLLYIKAK

SEQ ID NO: 3256628 - protein, 33 aa, Plasmodium falciparum
DSIKNEWKIPLFSNSFKMSSFITSEKEENKNDD

SEQ ID NO: 3256629 - protein, 24 aa, Plasmodium falciparum
DSIKRKLGHNFLDIISAGKFKIRH

SEQ ID NO: 3256630 - protein, 26 aa, Plasmodium falciparum
DSIKWRAELDKCLKNDKKTCGKKKCN

SEQ ID NO: 3256631 - protein, 26 aa, Plasmodium falciparum
DSIKWRKELDNCLKNENKQCISKCNG

SEQ ID NO: 3256632 - protein, 21 aa, Plasmodium falciparum
DSIPTCICEKSLEDKVEKGCL

SEQ ID NO: 3256633 - protein, 19 aa, Plasmodium falciparum
DSIPTCVCEKSLADKFEKT

SEQ ID NO: 3256634 - protein, 18 aa, Plasmodium falciparum
DSIPTCVCEKSLADKTEK

SEQ ID NO: 3256635 - protein, 20 aa, Plasmodium falciparum
DSIPTCVCEKSLADKTEKFC

SEQ ID NO: 3256636 - protein, 25 aa, Plasmodium falciparum
DSIYLNILYFHFECDVFIKLLNNYK

SEQ ID NO: 3256637 - protein, 18 aa, Plasmodium falciparum
DSIYWRTKKLVKCLKNGN

SEQ ID NO: 3256638 - protein, 23 aa, Plasmodium falciparum
DSKEIKSVLIFLVHTDRYYKESF

SEQ ID NO: 3256639 - protein, 18 aa, Plasmodium falciparum
DSKHIIWFLNFTISENGR

SEQ ID NO: 3256640 - protein, 22 aa, Plasmodium falciparum
DSKIFIWLLIFFRIFNCLFVVT

SEQ ID NO: 3256641 - protein, 20 aa, Plasmodium falciparum
DSKPICTWVRAKEGAARVIQ

SEQ ID NO: 3256642 - protein, 19 aa, Plasmodium falciparum
DSKRALKISPYHNYFNTSI

SEQ ID NO: 3256643 - protein, 23 aa, Plasmodium falciparum
DSKSNAIFSYCYNNFYKNEMDKE

SEQ ID NO: 3256644 - protein, 32 aa, Plasmodium falciparum
DSKYYFCSICGLCEHCNCGKRTLSYKNSWIEK

SEQ ID NO: 3256645 - protein, 18 aa, Plasmodium falciparum
DSLEKCKSPEEIAIKILK

SEQ ID NO: 3256646 - protein, 17 aa, Plasmodium falciparum
DSLFNFFNDIFKFVQSY

SEQ ID NO: 3256647 - protein, 24 aa, Plasmodium falciparum
DSLIDYQQWLSIILKKNINIGNLR

SEQ ID NO: 3256648 - protein, 18 aa, Plasmodium falciparum
DSLTELGFNKSINEKNFY

SEQ ID NO: 3256649 - protein, 17 aa, Plasmodium falciparum
DSMEWKEKLKGCLKNGT

SEQ ID NO: 3256650 - protein, 30 aa, Plasmodium falciparum
DSMIGEFPVRLNLIYFIAIIFKNSSNMNER

SEQ ID NO: 3256651 - protein, 19 aa, Plasmodium falciparum
DSNKFGVVVNYFYAHLPNF

SEQ ID NO: 3256652 - protein, 27 aa, Plasmodium falciparum
DSNLFFKNNFMYFNFLHNYLKEKKDEH

SEQ ID NO: 3256653 - protein, 22 aa, Plasmodium falciparum
DSNNFLLSFLIKGYKNILKSCL

SEQ ID NO: 3256654 - protein, 17 aa, Plasmodium falciparum
DSPKYKTLIEVVLEPSG

SEQ ID NO: 3256655 - protein, 23 aa, Plasmodium falciparum
DSQFPDIFYIPIIIKQDDIDEIN

SEQ ID NO: 3256656 - protein, 25 aa, Plasmodium falciparum
DSQKCKRLNNSIILSFNMNNNNTET

SEQ ID NO: 3256657 - protein, 21 aa, Plasmodium falciparum
DSRFVYKILNILFMNLNKYDM

SEQ ID NO: 3256658 - protein, 23 aa, Plasmodium falciparum
DSRKLNCFIKNEIYDLGCNQRRE

SEQ ID NO: 3256659 - protein, 18 aa, Plasmodium falciparum
DSSLKHNLYFKLKNLNVS

SEQ ID NO: 3256660 - protein, 19 aa, Plasmodium falciparum
DSSNIIPMKFFKKNKKLQE

SEQ ID NO: 3256661 - protein, 24 aa, Plasmodium falciparum
DSTCLKKSILIPITYVSDKKDVCG

SEQ ID NO: 3256662 - protein, 26 aa, Plasmodium falciparum
DSTILCLANKVLRNFWANSITDAVLC

SEQ ID NO: 3256663 - protein, 20 aa, Plasmodium falciparum
DSWTKMIITMLKLVDIEKIS

SEQ ID NO: 3256664 - protein, 21 aa, Plasmodium falciparum
DSYATAWVVNCSFNKKRHDKK

SEQ ID NO: 3256665 - protein, 19 aa, Plasmodium falciparum
DSYIKLSLIKNFNVKYLTT

SEQ ID NO: 3256666 - protein, 18 aa, Plasmodium falciparum
DSYKWNEKQWEQWMKTEG

SEQ ID NO: 3256667 - protein, 32 aa, Plasmodium falciparum
DSYPYIKLRSDWWSANRDKVWKAMTCPQNGIK

SEQ ID NO: 3256668 - protein, 22 aa, Plasmodium falciparum
DSYSFFYKLLCKHYNIKKPKDI

SEQ ID NO: 3256669 - protein, 26 aa, Plasmodium falciparum
DTCDEWSEWSACTHGISTRKCLSDSS

SEQ ID NO: 3256670 - protein, 22 aa, Plasmodium falciparum
DTCPLKEIYTNYHVYKSYIHTK

SEQ ID NO: 3256671 - protein, 28 aa, Plasmodium falciparum
DTEDQFLRFFAEWEEEFCDGLNKHEEQL

SEQ ID NO: 3256672 - protein, 23 aa, Plasmodium falciparum
DTFKELKNDVLLTNDNKLIQKQK

SEQ ID NO: 3256673 - protein, 32 aa, Plasmodium falciparum
DTFNYISLICGLFCNFLSPAFAYISACESNKY

SEQ ID NO: 3256674 - protein, 17 aa, Plasmodium falciparum
DTGNAYFRPTCSNRQGP

SEQ ID NO: 3256675 - protein, 25 aa, Plasmodium falciparum
DTGSLEYYFILNFFKDYESPDFLFL

SEQ ID NO: 3256676 - protein, 19 aa, Plasmodium falciparum
DTHPKKWSHHSLPDNYEGE

SEQ ID NO: 3256677 - protein, 19 aa, Plasmodium falciparum
DTICGSKNLLLNHKGTNQD

SEQ ID NO: 3256678 - protein, 24 aa, Plasmodium falciparum
DTIYKKACANTMGVSINMIYDNFS

SEQ ID NO: 3256679 - protein, 23 aa, Plasmodium falciparum
DTIYYKIIYIYDSIKYILKANKC

SEQ ID NO: 3256680 - protein, 23 aa, Plasmodium falciparum
DTKDILKYQWKIISNNESLDLPI

SEQ ID NO: 3256681 - protein, 20 aa, Plasmodium falciparum
DTKFNILITPSFSTIQNKKD

SEQ ID NO: 3256682 - protein, 22 aa, Plasmodium falciparum
DTKFSFLNFFLFFSNLSNKQNG

SEQ ID NO: 3256683 - protein, 31 aa, Plasmodium falciparum
DTKILKNYLFKGVLYISPFDTNKCFVISKET

SEQ ID NO: 3256684 - protein, 23 aa, Plasmodium falciparum
DTLKDWNESIYFITKKMEENNNE

SEQ ID NO: 3256685 - protein, 44 aa, Plasmodium falciparum
DTLLMPCRHSSFCYDCMKSLRQEKCPICRCLFTSFIKFPLKNVE

SEQ ID NO: 3256686 - protein, 25 aa, Plasmodium falciparum
DTNDLMWLDSYVNFYVYTNKKKKNN

SEQ ID NO: 3256687 - protein, 25 aa, Plasmodium falciparum
DTNIKCYICIERGGAFIQIKNNIFV

SEQ ID NO: 3256688 - protein, 26 aa, Plasmodium falciparum
DTNSLLTMNVHFFFIVLFAYYNFLVP

SEQ ID NO: 3256689 - protein, 20 aa, Plasmodium falciparum
DTNVRWGVIHPCDNRLGNLY

SEQ ID NO: 3256690 - protein, 24 aa, Plasmodium falciparum
DTPDPSIIISFILCSDFPKVKNVY

SEQ ID NO: 3256691 - protein, 35 aa, Plasmodium falciparum
DTQLKWNTYLWGYGFKYYPIFYPKNLHTLLHSHEK

SEQ ID NO: 3256692 - protein, 24 aa, Plasmodium falciparum
DTQNCLYITKFLSNIFCSHLKIIK

SEQ ID NO: 3256693 - protein, 17 aa, Plasmodium falciparum
DTTEFFLETNMKRKNIL

SEQ ID NO: 3256694 - protein, 34 aa, Plasmodium falciparum
DTVEACIIYLLQTMWKFYISYILSIPNELEQYYE

SEQ ID NO: 3256695 - protein, 52 aa, Plasmodium falciparum
DTYINKYLINNGFCLFACPYLDKKGGKRVYEFFKKFHLLDWFYNPNDETCYF

SEQ ID NO: 3256696 - protein, 19 aa, Plasmodium falciparum
DTYLLLNYVRKILENGKTK

SEQ ID NO: 3256697 - protein, 21 aa, Plasmodium falciparum
DTYSALFFQTFFKIVDFKKFF

SEQ ID NO: 3256698 - protein, 24 aa, Plasmodium falciparum
DVAKKVNCFEGIYESKSIRNNVQE

SEQ ID NO: 3256699 - protein, 24 aa, Plasmodium falciparum
DVASFRSAWWDANRKDIWNAMTCN

SEQ ID NO: 3256700 - protein, 23 aa, Plasmodium falciparum
DVCCDLDEIMVLMSNLYLYGFSS

SEQ ID NO: 3256701 - protein, 23 aa, Plasmodium falciparum
DVCINRRSYNKCGFYACDNTFLN

SEQ ID NO: 3256702 - protein, 17 aa, Plasmodium falciparum
DVCKGCQYSCSHFVNWI

SEQ ID NO: 3256703 - protein, 20 aa, Plasmodium falciparum
DVDALKCLQISYSKFDDLDV

SEQ ID NO: 3256704 - protein, 23 aa, Plasmodium falciparum
DVDDLKRNVVYGGGYNENSTTVL

SEQ ID NO: 3256705 - protein, 25 aa, Plasmodium falciparum
DVDFFGSWIKIFSMNGLKLLIFCLS

SEQ ID NO: 3256706 - protein, 18 aa, Plasmodium falciparum
DVDLVKAFVESAAVETFF

SEQ ID NO: 3256707 - protein, 24 aa, Plasmodium falciparum
DVDYCINNQLLLLLALYLCPENYK

SEQ ID NO: 3256708 - protein, 40 aa, Plasmodium falciparum
DVECKRLFIDYEEWFRYRYNQWKGLSEKYIKIKKSKNSGV

SEQ ID NO: 3256709 - protein, 17 aa, Plasmodium falciparum
DVEHMVCGEREINIEVL

SEQ ID NO: 3256710 - protein, 27 aa, Plasmodium falciparum
DVEKKLKKSYFPTFYYLNIKTLNDMIN

SEQ ID NO: 3256711 - protein, 18 aa, Plasmodium falciparum
DVFCIMGLAILCGIFSEF

SEQ ID NO: 3256712 - protein, 26 aa, Plasmodium falciparum
DVFYRCLKILKIICNKYFVYFLAEIQ

SEQ ID NO: 3256713 - protein, 30 aa, Plasmodium falciparum
DVICDKAELIKLLFDIMIRYLNDMLDKKKR

SEQ ID NO: 3256714 - protein, 28 aa, Plasmodium falciparum
DVIETLKEYLLYLCVVYDYYKFYKKDNN

SEQ ID NO: 3256715 - protein, 23 aa, Plasmodium falciparum
DVIYKTKMSILLIQNDLQNIKSV

SEQ ID NO: 3256716 - protein, 23 aa, Plasmodium falciparum
DVKDCKIISCEKSKHCTSIIIRD

SEQ ID NO: 3256717 - protein, 19 aa, Plasmodium falciparum
DVKDIYLYYIFIGLHTNKK

SEQ ID NO: 3256718 - protein, 25 aa, Plasmodium falciparum
DVKGDIRLLLMNSMESPSSHHIASE

SEQ ID NO: 3256719 - protein, 24 aa, Plasmodium falciparum
DVKKGCALELVPLSLSDIEQIANE

SEQ ID NO: 3256720 - protein, 21 aa, Plasmodium falciparum
DVKMIKKWFNLLSYFNNKSEF

SEQ ID NO: 3256721 - protein, 21 aa, Plasmodium falciparum
DVKSIYMIKNFFNQYNDVTNT

SEQ ID NO: 3256722 - protein, 19 aa, Plasmodium falciparum
DVKVCKTVAEALKTSLTDA

SEQ ID NO: 3256723 - protein, 24 aa, Plasmodium falciparum
DVKYLKQNCEFLFCDINNVISSLE

SEQ ID NO: 3256724 - protein, 18 aa, Plasmodium falciparum
DVLCVNYIGSLTFSNKLN

SEQ ID NO: 3256725 - protein, 19 aa, Plasmodium falciparum
DVLIGLFLKIVFNEKKRIY

SEQ ID NO: 3256726 - protein, 27 aa, Plasmodium falciparum
DVLIIFLSFCFFLFIFVELIRKICEHF

SEQ ID NO: 3256727 - protein, 22 aa, Plasmodium falciparum
DVLKVHVFRSVFQNCTNSIDKS

SEQ ID NO: 3256728 - protein, 28 aa, Plasmodium falciparum
DVLKVLYYWLEFCISKLLIEGKVEQWRV

SEQ ID NO: 3256729 - protein, 30 aa, Plasmodium falciparum
DVLLMLTCFPWLLSFCLLYALKYTYKKDKL

SEQ ID NO: 3256730 - protein, 26 aa, Plasmodium falciparum
DVLQRAQTILKYKKDIMNFLKESIYF

SEQ ID NO: 3256731 - protein, 17 aa, Plasmodium falciparum
DVMFFKKKAIQFGSKSK

SEQ ID NO: 3256732 - protein, 30 aa, Plasmodium falciparum
DVNCKYNKIFYKYYISVINDMLCISKNNMI

SEQ ID NO: 3256733 - protein, 20 aa, Plasmodium falciparum
DVNNRISSFYSIKNDKQIEY

SEQ ID NO: 3256734 - protein, 19 aa, Plasmodium falciparum
DVPGGLVLLIFLWTLMAMH

SEQ ID NO: 3256735 - protein, 22 aa, Plasmodium falciparum
DVQKIKYSILKRETSKKDKVNL

SEQ ID NO: 3256736 - protein, 26 aa, Plasmodium falciparum
DVRSRPLPNEPLHFMNINNDNNDNNN

SEQ ID NO: 3256737 - protein, 19 aa, Plasmodium falciparum
DVSLCSLASEGSEKDSSDQ

SEQ ID NO: 3256738 - protein, 25 aa, Plasmodium falciparum
DVSLLKCFIFYIFTQITSILAVCLV

SEQ ID NO: 3256739 - protein, 22 aa, Plasmodium falciparum
DVTSLLKCLKINFKNQSAQSVI

SEQ ID NO: 3256740 - protein, 26 aa, Plasmodium falciparum
DVVIYRCMCALFPYLNVDKNYDVINN

SEQ ID NO: 3256741 - protein, 25 aa, Plasmodium falciparum
DVVKLKVLLLKKAIYFLPVCNKIFQ

SEQ ID NO: 3256742 - protein, 17 aa, Plasmodium falciparum
DVWKCGKFRDVDVCVLK

SEQ ID NO: 3256743 - protein, 26 aa, Plasmodium falciparum
DVYIFGELFSLFLFFFYDSNIIRGEI

SEQ ID NO: 3256744 - protein, 24 aa, Plasmodium falciparum
DVYMRLKRAEGMCILGKLMQKWVK

SEQ ID NO: 3256745 - protein, 24 aa, Plasmodium falciparum
DVYTLYLWVIFCFSKCPYFKVLTN

SEQ ID NO: 3256746 - protein, 26 aa, Plasmodium falciparum
DWEEWFPTIYYNWLAYVNNLEEDFMH

SEQ ID NO: 3256747 - protein, 21 aa, Plasmodium falciparum
DWFTPFPMKIVFPKKNTKIKF

SEQ ID NO: 3256748 - protein, 22 aa, Plasmodium falciparum
DWQAQLKYYWVYDKKINNYTCE

SEQ ID NO: 3256749 - protein, 21 aa, Plasmodium falciparum
DWSNKFCYYLSKHIFTSHMEK

SEQ ID NO: 3256750 - protein, 17 aa, Plasmodium falciparum
DYCKIKTSFFKMERIIS

SEQ ID NO: 3256751 - protein, 17 aa, Plasmodium falciparum
DYCKTCPPNKVSCNVIR

SEQ ID NO: 3256752 - protein, 24 aa, Plasmodium falciparum
DYDGGTLMECYIFPNINYLRLSEM

SEQ ID NO: 3256753 - protein, 28 aa, Plasmodium falciparum
DYDKLCKEVPKFFYLNITFRKKTDHSNN

SEQ ID NO: 3256754 - protein, 26 aa, Plasmodium falciparum
DYFFLKKLGIYFLIKRNEKTAVLCRK

SEQ ID NO: 3256755 - protein, 17 aa, Plasmodium falciparum
DYFKYSFLFYNQHVNTY

SEQ ID NO: 3256756 - protein, 20 aa, Plasmodium falciparum
DYFLLSFFQFIEMLRTHLQL

SEQ ID NO: 3256757 - protein, 18 aa, Plasmodium falciparum
DYFNLNFYLDYYNKKKNE

SEQ ID NO: 3256758 - protein, 24 aa, Plasmodium falciparum
DYFSNFFFFCKTYEDFYIYLNTYY

SEQ ID NO: 3256759 - protein, 25 aa, Plasmodium falciparum
DYGFLKRIYKAFFIFFRCILSSLLI

SEQ ID NO: 3256760 - protein, 17 aa, Plasmodium falciparum
DYHKYINICNINDIFFI

SEQ ID NO: 3256761 - protein, 30 aa, Plasmodium falciparum
DYICLKNKRAGEGMESWNWQIRKNKYNTYD

SEQ ID NO: 3256762 - protein, 23 aa, Plasmodium falciparum
DYIDKCDVCLVGYKGLYTLYFCI

SEQ ID NO: 3256763 - protein, 21 aa, Plasmodium falciparum
DYIDPLIFNIFLDYMKDVYMT

SEQ ID NO: 3256764 - protein, 18 aa, Plasmodium falciparum
DYIFQEKFLLFFHIQCLH

SEQ ID NO: 3256765 - protein, 23 aa, Plasmodium falciparum
DYIKESFDILIFLKNSKNIFFSL

SEQ ID NO: 3256766 - protein, 26 aa, Plasmodium falciparum
DYIKPHWPLILLKYYILPYLILYFLL

SEQ ID NO: 3256767 - protein, 23 aa, Plasmodium falciparum
DYILRYKRKFFFFINKSGNIVKI

SEQ ID NO: 3256768 - protein, 30 aa, Plasmodium falciparum
DYIMYKMVILKALLFYGYFTLYERLSYEFK

SEQ ID NO: 3256769 - protein, 20 aa, Plasmodium falciparum
DYINEFLVSCLINVLTKITY

SEQ ID NO: 3256770 - protein, 19 aa, Plasmodium falciparum
DYIQCFNFIKDDNISFLTE

SEQ ID NO: 3256771 - protein, 18 aa, Plasmodium falciparum
DYIYEYFENYILENKLNG

SEQ ID NO: 3256772 - protein, 22 aa, Plasmodium falciparum
DYKIELIPTMSIYEHFKIILTF

SEQ ID NO: 3256773 - protein, 19 aa, Plasmodium falciparum
DYKKEMPWFDVFKNDKRLK

SEQ ID NO: 3256774 - protein, 24 aa, Plasmodium falciparum
DYLIDRHIFILFNIKERLKRDKKL

SEQ ID NO: 3256775 - protein, 19 aa, Plasmodium falciparum
DYLLGASYKGIPMVSLTSH

SEQ ID NO: 3256776 - protein, 20 aa, Plasmodium falciparum
DYLNISFEYSRALEELRSEM

SEQ ID NO: 3256777 - protein, 24 aa, Plasmodium falciparum
DYLRKYFLRRICCHNNDKFLSQRK

SEQ ID NO: 3256778 - protein, 32 aa, Plasmodium falciparum
DYLRSALIQYCRHMRECFLKILELDKFRERYK

SEQ ID NO: 3256779 - protein, 32 aa, Plasmodium falciparum
DYNCDICKIKNLIKIFIIRESQINNSFLNLMF

SEQ ID NO: 3256780 - protein, 27 aa, Plasmodium falciparum
DYNDIHLFFSFNICIKSVKNNLFLHII

SEQ ID NO: 3256781 - protein, 19 aa, Plasmodium falciparum
DYNGSVIMNNCLFYYQHLI

SEQ ID NO: 3256782 - protein, 19 aa, Plasmodium falciparum
DYNKFIFYHVRKIMKNIFF

SEQ ID NO: 3256783 - protein, 19 aa, Plasmodium falciparum
DYNSFLGIMPFYNKEGKKG

SEQ ID NO: 3256784 - protein, 17 aa, Plasmodium falciparum
DYNYLYSFMKYYYKEYI

SEQ ID NO: 3256785 - protein, 27 aa, Plasmodium falciparum
DYPNHIKKFFLYLSILFLISPFKPFYK

SEQ ID NO: 3256786 - protein, 23 aa, Plasmodium falciparum
DYPVKSCELIENYLIILYENYNC

SEQ ID NO: 3256787 - protein, 24 aa, Plasmodium falciparum
DYQPKRYKNFLIYFNQNYIKKRKN

SEQ ID NO: 3256788 - protein, 18 aa, Plasmodium falciparum
DYRTEDQTHLGIELIEEE

SEQ ID NO: 3256789 - protein, 29 aa, Plasmodium falciparum
DYSTWNLSIIRVFNAWFLAGYGNKNVKVC

SEQ ID NO: 3256790 - protein, 24 aa, Plasmodium falciparum
DYTEIKNTFPFLISTTQGEIIEIN

SEQ ID NO: 3256791 - protein, 37 aa, Plasmodium falciparum
DYTQIKYASGFAIGLIICSSVGFIFRKEINNSEVDFN

SEQ ID NO: 3256792 - protein, 17 aa, Plasmodium falciparum
DYVKISWEKDKKNYYQY

SEQ ID NO: 3256793 - protein, 20 aa, Plasmodium falciparum
DYYIRSFNTFNRFAQNNEMN

SEQ ID NO: 3256794 - protein, 24 aa, Plasmodium falciparum
DYYRCTSTLICLFIDSFYKTLGGD

SEQ ID NO: 3256795 - protein, 20 aa, Plasmodium falciparum
EAAISAWKPKAIAAAIAAAE

SEQ ID NO: 3256796 - protein, 23 aa, Plasmodium falciparum
EAASSFFFFLGFFLSLYILFYSS

SEQ ID NO: 3256797 - protein, 19 aa, Plasmodium falciparum
EAAYAVCACLSKANQKQVG

SEQ ID NO: 3256798 - protein, 19 aa, Plasmodium falciparum
EACSILYSHFLRRQDVYEC

SEQ ID NO: 3256799 - protein, 32 aa, Plasmodium falciparum
EADILIGYSYYFKRVTPIYRKKHICDFTTEDN

SEQ ID NO: 3256800 - protein, 18 aa, Plasmodium falciparum
EADLLFKTFFFKKNKINK

SEQ ID NO: 3256801 - protein, 22 aa, Plasmodium falciparum
EAEIYKFLEILLFSNSYKKPHI

SEQ ID NO: 3256802 - protein, 23 aa, Plasmodium falciparum
EAEMTVAIYMYMRLIGYPNDVIT

SEQ ID NO: 3256803 - protein, 28 aa, Plasmodium falciparum
EAFIKYKKKLLVVILWIKIYMSMLEEYV

SEQ ID NO: 3256804 - protein, 18 aa, Plasmodium falciparum
EAIKPCKTFDDFKSFCGL

SEQ ID NO: 3256805 - protein, 19 aa, Plasmodium falciparum
EAIPTCVCEKSVADKTEKF

SEQ ID NO: 3256806 - protein, 18 aa, Plasmodium falciparum
EAKICSADYLPLYFSDIL

SEQ ID NO: 3256807 - protein, 28 aa, Plasmodium falciparum
EAKIKGKELRSKFIVDMYKQLFDNAIKR

SEQ ID NO: 3256808 - protein, 33 aa, Plasmodium falciparum
EAKIRRIIKYKLNILETYKYYLMKIIIDVYLLN

SEQ ID NO: 3256809 - protein, 19 aa, Plasmodium falciparum
EAKKILVLMEKMKDLKKAQ

SEQ ID NO: 3256810 - protein, 20 aa, Plasmodium falciparum
EAKKMVPKFCKIEEETKEAV

SEQ ID NO: 3256811 - protein, 25 aa, Plasmodium falciparum
EAKKTLCFISMYLGLNYFDLIIKQM

SEQ ID NO: 3256812 - protein, 20 aa, Plasmodium falciparum
EAKNKYLAHRPLEDLMDRKM

SEQ ID NO: 3256813 - protein, 25 aa, Plasmodium falciparum
EAKSCHEIKSSVFLNIKSKKKLKTN

SEQ ID NO: 3256814 - protein, 25 aa, Plasmodium falciparum
EAKYIIKYMFENIFSIYNILEYMFL

SEQ ID NO: 3256815 - protein, 24 aa, Plasmodium falciparum
EALIKLLPFSSIQFLLKRKKWIPL

SEQ ID NO: 3256816 - protein, 23 aa, Plasmodium falciparum
EALKYALCAGKLFNIKEKSQYVE

SEQ ID NO: 3256817 - protein, 17 aa, Plasmodium falciparum
EALQILGKLMQKWSLNV

SEQ ID NO: 3256818 - protein, 19 aa, Plasmodium falciparum
EALSVLAQQLCNLFNAKSK

SEQ ID NO: 3256819 - protein, 22 aa, Plasmodium falciparum
EALTKLLGCSNKLSVNNVKYSD

SEQ ID NO: 3256820 - protein, 20 aa, Plasmodium falciparum
EALTLLIIIFGCCSGSTEKI

SEQ ID NO: 3256821 - protein, 24 aa, Plasmodium falciparum
EAMNKSILISVGWSEDTNVYYVEK

SEQ ID NO: 3256822 - protein, 20 aa, Plasmodium falciparum
EANRYKVWKAMKCATKNSKI

SEQ ID NO: 3256823 - protein, 20 aa, Plasmodium falciparum
EANSLIIYDECEKINPIKIN

SEQ ID NO: 3256824 - protein, 21 aa, Plasmodium falciparum
EAPFGLPRAHPLSLILEHKFK

SEQ ID NO: 3256825 - protein, 23 aa, Plasmodium falciparum
EAQKGVFYFHLFSSLKNFYLCDQ

SEQ ID NO: 3256826 - protein, 31 aa, Plasmodium falciparum
EATLFKSWIPFYTFPFKFGITDCKLLKERGL

SEQ ID NO: 3256827 - protein, 22 aa, Plasmodium falciparum
EAWGWLCGMCFIATSFVEVLAL

SEQ ID NO: 3256828 - protein, 20 aa, Plasmodium falciparum
EAYIYAWNSLENFKGKKLLT

SEQ ID NO: 3256829 - protein, 18 aa, Plasmodium falciparum
EAYYLWKQYHAHNDTTYL

SEQ ID NO: 3256830 - protein, 25 aa, Plasmodium falciparum
ECAKELMECFLKWKNKNYISKNWTF

SEQ ID NO: 3256831 - protein, 19 aa, Plasmodium falciparum
ECAKLFFKNYEDIQSMLKI

SEQ ID NO: 3256832 - protein, 23 aa, Plasmodium falciparum
ECCKYYILLCLYEILKKSENYKY

SEQ ID NO: 3256833 - protein, 21 aa, Plasmodium falciparum
ECDIIKYFLSFLLYDPQVIKK

SEQ ID NO: 3256834 - protein, 23 aa, Plasmodium falciparum
ECEFDRVLSLDGVYIANFLDVNN

SEQ ID NO: 3256835 - protein, 18 aa, Plasmodium falciparum
ECEHCIADVVTSSSLNKI

SEQ ID NO: 3256836 - protein, 21 aa, Plasmodium falciparum
ECELIWILTLNYFDNIKENVF

SEQ ID NO: 3256837 - protein, 20 aa, Plasmodium falciparum
ECIFDRHWNIIINISGNINN

SEQ ID NO: 3256838 - protein, 17 aa, Plasmodium falciparum
ECISANFDFIFNDNIEY

SEQ ID NO: 3256839 - protein, 19 aa, Plasmodium falciparum
ECIVCMKLSKNDNCLNRNK

SEQ ID NO: 3256840 - protein, 17 aa, Plasmodium falciparum
ECKDKFEGDGIYCSYSF

SEQ ID NO: 3256841 - protein, 22 aa, Plasmodium falciparum
ECNANFRLSKNVSYNNNEEEED

SEQ ID NO: 3256842 - protein, 26 aa, Plasmodium falciparum
ECNEIHMKCTFLINEVKNLEKSKSHL

SEQ ID NO: 3256843 - protein, 18 aa, Plasmodium falciparum
ECNLHYRYSEAVISFTVT

SEQ ID NO: 3256844 - protein, 23 aa, Plasmodium falciparum
ECNSLLPCPLNIAEIKTYNIHAT

SEQ ID NO: 3256845 - protein, 27 aa, Plasmodium falciparum
ECRIKKKAGDIYLLLGSPLDSLEIYMS

SEQ ID NO: 3256846 - protein, 18 aa, Plasmodium falciparum
ECSDACKAYKEWLQTWKE

SEQ ID NO: 3256847 - protein, 18 aa, Plasmodium falciparum
ECSISGHFFNDFPLTHFF

SEQ ID NO: 3256848 - protein, 25 aa, Plasmodium falciparum
ECTVAKKAFLDRGLEKMNKRDNLDI

SEQ ID NO: 3256849 - protein, 20 aa, Plasmodium falciparum
ECVPSILIIYTFQPSKEKSA

SEQ ID NO: 3256850 - protein, 28 aa, Plasmodium falciparum
ECYSASFNKWVSFFFPFNVYYFNFFNFS

SEQ ID NO: 3256851 - protein, 26 aa, Plasmodium falciparum
EDCNKSIHLNDNFAKSYIRRSNAYEQ

SEQ ID NO: 3256852 - protein, 24 aa, Plasmodium falciparum
EDCNVKFHLNCAFYSTVIKDPSNN

SEQ ID NO: 3256853 - protein, 23 aa, Plasmodium falciparum
EDEIKTWFLIPHKYVINIIYLFL

SEQ ID NO: 3256854 - protein, 21 aa, Plasmodium falciparum
EDEKLCLLNNVTVYKDYFDKG

SEQ ID NO: 3256855 - protein, 32 aa, Plasmodium falciparum
EDEKLLIGTIFFNFMKYKGLFNKYETDIKNMN

SEQ ID NO: 3256856 - protein, 24 aa, Plasmodium falciparum
EDEPADDVELFLSVMGNMNELEKK

SEQ ID NO: 3256857 - protein, 17 aa, Plasmodium falciparum
EDFCRKKKIYVGIVKKY

SEQ ID NO: 3256858 - protein, 17 aa, Plasmodium falciparum
EDFCRKKKIYVGIVKTY

SEQ ID NO: 3256859 - protein, 18 aa, Plasmodium falciparum
EDFCRKKKIYVGIVKTYC

SEQ ID NO: 3256860 - protein, 18 aa, Plasmodium falciparum
EDFCRKKKKYVDIVKKYC

SEQ ID NO: 3256861 - protein, 18 aa, Plasmodium falciparum
EDFCRKKKKYVDIVKTNC

SEQ ID NO: 3256862 - protein, 18 aa, Plasmodium falciparum
EDFCRKKKKYVDIVKTYC

SEQ ID NO: 3256863 - protein, 18 aa, Plasmodium falciparum
EDFCRKKKKYVNIVKTYC

SEQ ID NO: 3256864 - protein, 22 aa, Plasmodium falciparum
EDFHKVDFLKGIGLGEGKGIKN

SEQ ID NO: 3256865 - protein, 20 aa, Plasmodium falciparum
EDFIAFKYFFNNIICLCNDN

SEQ ID NO: 3256866 - protein, 25 aa, Plasmodium falciparum
EDFKRKIERCRIAWKALSNKIQYLC

SEQ ID NO: 3256867 - protein, 17 aa, Plasmodium falciparum
EDFKWKPLNSLHIEINN

SEQ ID NO: 3256868 - protein, 20 aa, Plasmodium falciparum
EDFLKEKKMEQIIYKNICSN

SEQ ID NO: 3256869 - protein, 17 aa, Plasmodium falciparum
EDFPYDNLIILYLPIEF

SEQ ID NO: 3256870 - protein, 27 aa, Plasmodium falciparum
EDFYFLEFYDKLFVKREPLMQEHLSNK

SEQ ID NO: 3256871 - protein, 19 aa, Plasmodium falciparum
EDHLYSIRNYIECLRNAPY

SEQ ID NO: 3256872 - protein, 18 aa, Plasmodium falciparum
EDIEICKNYFLHKPNKCF

SEQ ID NO: 3256873 - protein, 26 aa, Plasmodium falciparum
EDIEVFKIFIYYSIILKLCDDLIRYE

SEQ ID NO: 3256874 - protein, 18 aa, Plasmodium falciparum
EDIFNYIIETSIKIKNYV

SEQ ID NO: 3256875 - protein, 18 aa, Plasmodium falciparum
EDIFYYKKEDILFTNQQD

SEQ ID NO: 3256876 - protein, 33 aa, Plasmodium falciparum
EDIHKYVNCCLSINLFKLFFFFKKNYHTNDNRN

SEQ ID NO: 3256877 - protein, 17 aa, Plasmodium falciparum
EDIKSFIVFNIAQDNKT

SEQ ID NO: 3256878 - protein, 22 aa, Plasmodium falciparum
EDIKSVKECFDRQTSQRFEEYE

SEQ ID NO: 3256879 - protein, 24 aa, Plasmodium falciparum
EDILKKYLNTFLTLYIKRQSEDVN

SEQ ID NO: 3256880 - protein, 23 aa, Plasmodium falciparum
EDILVLICSDGVWEFISSEEAVN

SEQ ID NO: 3256881 - protein, 23 aa, Plasmodium falciparum
EDIMYKLSQKYIMDIFFHNNKVK

SEQ ID NO: 3256882 - protein, 23 aa, Plasmodium falciparum
EDINFLPCIVFNFERKELEDMTI

SEQ ID NO: 3256883 - protein, 17 aa, Plasmodium falciparum
EDIPCNRLFKDVNYEDV

SEQ ID NO: 3256884 - protein, 19 aa, Plasmodium falciparum
EDIPTCICEKSLADKTEKF

SEQ ID NO: 3256885 - protein, 22 aa, Plasmodium falciparum
EDIPTCICEKSLSDKVEKTCLK

SEQ ID NO: 3256886 - protein, 22 aa, Plasmodium falciparum
EDIPTCICEKSLSGKVEKTCLK

SEQ ID NO: 3256887 - protein, 17 aa, Plasmodium falciparum
EDIPTCVCEKSIADKTE

SEQ ID NO: 3256888 - protein, 18 aa, Plasmodium falciparum
EDIPTCVCEKSLADKTEK

SEQ ID NO: 3256889 - protein, 18 aa, Plasmodium falciparum
EDIPTCVCEKSLADKVEK

SEQ ID NO: 3256890 - protein, 17 aa, Plasmodium falciparum
EDIPTCVCEKSVADKVE

SEQ ID NO: 3256891 - protein, 25 aa, Plasmodium falciparum
EDIQHIFYFLQYVLSSLIYSPSIFF

SEQ ID NO: 3256892 - protein, 17 aa, Plasmodium falciparum
EDIRLKIVQFLYTILSR

SEQ ID NO: 3256893 - protein, 20 aa, Plasmodium falciparum
EDIYYRNSIYNVRDENSYDM

SEQ ID NO: 3256894 - protein, 38 aa, Plasmodium falciparum
EDKIILFYMIFISLFLIFHLMYILFIFLSKENNFTKLF

SEQ ID NO: 3256895 - protein, 20 aa, Plasmodium falciparum
EDKSLFSYVFNSTCRYIISC

SEQ ID NO: 3256896 - protein, 22 aa, Plasmodium falciparum
EDKSPLSLTCFNKLKNKCNMNC

SEQ ID NO: 3256897 - protein, 20 aa, Plasmodium falciparum
EDKVKFVFSQELNKVNDIFN

SEQ ID NO: 3256898 - protein, 18 aa, Plasmodium falciparum
EDLCLFKYVCIGSLDDVD

SEQ ID NO: 3256899 - protein, 22 aa, Plasmodium falciparum
EDLECLIGTLFRDIVLKDGYFL

SEQ ID NO: 3256900 - protein, 23 aa, Plasmodium falciparum
EDLFECLNRLNGKANYIERNNII

SEQ ID NO: 3256901 - protein, 21 aa, Plasmodium falciparum
EDLKFFLKKMDIFVKTFNINS

SEQ ID NO: 3256902 - protein, 19 aa, Plasmodium falciparum
EDLVNVWIQTLGVCKSGGH

SEQ ID NO: 3256903 - protein, 31 aa, Plasmodium falciparum
EDLYYPSVPIKWKLYVGIFFDKKYNYENNED

SEQ ID NO: 3256904 - protein, 20 aa, Plasmodium falciparum
EDMDEPRLCNKKRNVYNENF

SEQ ID NO: 3256905 - protein, 42 aa, Plasmodium falciparum
EDMQSPFDYKRFFRKYTIFAPFILVYFTLMFFVNSTVQNGTM

SEQ ID NO: 3256906 - protein, 27 aa, Plasmodium falciparum
EDMYLFSMDIIIFIGFDKLVLCNINEN

SEQ ID NO: 3256907 - protein, 25 aa, Plasmodium falciparum
EDNFEFIKALHLYMNILCYIIFKKF

SEQ ID NO: 3256908 - protein, 18 aa, Plasmodium falciparum
EDNIPCFILQNYKCKNIL

SEQ ID NO: 3256909 - protein, 17 aa, Plasmodium falciparum
EDNRSVILFSNYEKMNL

SEQ ID NO: 3256910 - protein, 22 aa, Plasmodium falciparum
EDPDKNFSIGFILKSSSVKNCQ

SEQ ID NO: 3256911 - protein, 17 aa, Plasmodium falciparum
EDPFKYYTDIHVDDYSY

SEQ ID NO: 3256912 - protein, 26 aa, Plasmodium falciparum
EDQFLRWFQEWGKIFCTRKKELKEEV

SEQ ID NO: 3256913 - protein, 27 aa, Plasmodium falciparum
EDQIFSVGVFLPFSFIDYINSDYINKL

SEQ ID NO: 3256914 - protein, 19 aa, Plasmodium falciparum
EDQTHLGIELIEEEFKGRN

SEQ ID NO: 3256915 - protein, 25 aa, Plasmodium falciparum
EDRDFLKNEFLSLIVKKFNKNQNDF

SEQ ID NO: 3256916 - protein, 27 aa, Plasmodium falciparum
EDRERLKALFFVAVALAILGIVFIIYI

SEQ ID NO: 3256917 - protein, 19 aa, Plasmodium falciparum
EDRKRLDLLSLKNNSLLNE

SEQ ID NO: 3256918 - protein, 20 aa, Plasmodium falciparum
EDSVFFKRIINVEITPNIKN

SEQ ID NO: 3256919 - protein, 25 aa, Plasmodium falciparum
EDTFGTIIERCMHRFNFNEWSNLLI

SEQ ID NO: 3256920 - protein, 29 aa, Plasmodium falciparum
EDTFLKWKLANVCQLVYLLTKFKHIHKNI

SEQ ID NO: 3256921 - protein, 24 aa, Plasmodium falciparum
EDVKEKWKSSNLSRMDVLKLKNDD

SEQ ID NO: 3256922 - protein, 17 aa, Plasmodium falciparum
EDVKRVSKFAAIDEFIE

SEQ ID NO: 3256923 - protein, 27 aa, Plasmodium falciparum
EDWWDANRAKVWYAITCGAGTSDKYFR

SEQ ID NO: 3256924 - protein, 18 aa, Plasmodium falciparum
EDWWNANRQKVWEVITCG

SEQ ID NO: 3256925 - protein, 26 aa, Plasmodium falciparum
EDWWNNNRLMVWYAITCGAPKEAQYF

SEQ ID NO: 3256926 - protein, 20 aa, Plasmodium falciparum
EDYRISAFRLINVTTNSKLK

SEQ ID NO: 3256927 - protein, 27 aa, Plasmodium falciparum
EDYRRLTVACIIAWKALSNYVQNSCRK

SEQ ID NO: 3256928 - protein, 23 aa, Plasmodium falciparum
EDYSHRRNLFFLNNHMNETKEHT

SEQ ID NO: 3256929 - protein, 21 aa, Plasmodium falciparum
EEARNLRLVILNNRNSALNAN

SEQ ID NO: 3256930 - protein, 20 aa, Plasmodium falciparum
EEATRGCYFFVFNPNDTSNI

SEQ ID NO: 3256931 - protein, 21 aa, Plasmodium falciparum
EECRGDRGGHQYCSGDGHDCT

SEQ ID NO: 3256932 - protein, 21 aa, Plasmodium falciparum
EECVLSLGISHTWLCDPSRFL

SEQ ID NO: 3256933 - protein, 23 aa, Plasmodium falciparum
EEDEKRKGISLNISKCRYFLLPI

SEQ ID NO: 3256934 - protein, 24 aa, Plasmodium falciparum
EEDIMWKTVIEIHMKIIEEDKKQE

SEQ ID NO: 3256935 - protein, 24 aa, Plasmodium falciparum
EEDKKELFRIFNIVQNNSRTNMNK

SEQ ID NO: 3256936 - protein, 30 aa, Plasmodium falciparum
EEDTDCGRDSFFSCSDVEISATKLDDSCIS

SEQ ID NO: 3256937 - protein, 23 aa, Plasmodium falciparum
EEDVLYILCRIIEKKSEDHIILT

SEQ ID NO: 3256938 - protein, 22 aa, Plasmodium falciparum
EEEFILLFNCIKKHINENKFKA

SEQ ID NO: 3256939 - protein, 20 aa, Plasmodium falciparum
EEEILLKYIINFKYDKNKEI

SEQ ID NO: 3256940 - protein, 21 aa, Plasmodium falciparum
EEEKEKIILFINELNSYINDL

SEQ ID NO: 3256941 - protein, 19 aa, Plasmodium falciparum
EEEKIKDNEDWKLYDFKNL

SEQ ID NO: 3256942 - protein, 26 aa, Plasmodium falciparum
EEEKVCYKLKLLTCADDIGNTNQMSS

SEQ ID NO: 3256943 - protein, 28 aa, Plasmodium falciparum
EEELLFNKRFVEFLLPYSNNIAKYIFQY

SEQ ID NO: 3256944 - protein, 23 aa, Plasmodium falciparum
EEELRKAEIIERLYKQESELNEE

SEQ ID NO: 3256945 - protein, 23 aa, Plasmodium falciparum
EEENTCLYKYLNISIHNVHGNES

SEQ ID NO: 3256946 - protein, 18 aa, Plasmodium falciparum
EEERLFNFVSYMEEEVKD

SEQ ID NO: 3256947 - protein, 18 aa, Plasmodium falciparum
EEFCDGLNKHEEQLKSCT

SEQ ID NO: 3256948 - protein, 19 aa, Plasmodium falciparum
EEFCRIKELKLENVKTRCR

SEQ ID NO: 3256949 - protein, 19 aa, Plasmodium falciparum
EEFCRIRKIKLGKVKNECR

SEQ ID NO: 3256950 - protein, 19 aa, Plasmodium falciparum
EEFCRKRNITLKSAKEECQ

SEQ ID NO: 3256951 - protein, 31 aa, Plasmodium falciparum
EEFIYHLDLYKKHIFDIFSITHNDIININKY

SEQ ID NO: 3256952 - protein, 21 aa, Plasmodium falciparum
EEFKQDESFVGDKDQNFDDDY

SEQ ID NO: 3256953 - protein, 22 aa, Plasmodium falciparum
EEFKRQMFYTLGDYRDILFGKN

SEQ ID NO: 3256954 - protein, 26 aa, Plasmodium falciparum
EEFLNVMKEILLKIYYKYNEDDYRKH

SEQ ID NO: 3256955 - protein, 32 aa, Plasmodium falciparum
EEFWTTHGPDIWKGMVCALTYKESKNGDKTIV

SEQ ID NO: 3256956 - protein, 17 aa, Plasmodium falciparum
EEGIWIEPIKIYKSEFT

SEQ ID NO: 3256957 - protein, 21 aa, Plasmodium falciparum
EEGKEALAIKDKLPGGLDEYQ

SEQ ID NO: 3256958 - protein, 26 aa, Plasmodium falciparum
EEGKLIYLLCKICYDKFIISYYIPED

SEQ ID NO: 3256959 - protein, 17 aa, Plasmodium falciparum
EEHIKWEILMNKQENSF

SEQ ID NO: 3256960 - protein, 17 aa, Plasmodium falciparum
EEHLFDNMYFILSSISY

SEQ ID NO: 3256961 - protein, 30 aa, Plasmodium falciparum
EEIDSKFFLNKMLLLILGGSSYMRYSKENY

SEQ ID NO: 3256962 - protein, 17 aa, Plasmodium falciparum
EEIEYFKKISIYDNMMK

SEQ ID NO: 3256963 - protein, 20 aa, Plasmodium falciparum
EEIILMKALKDFNIPKITYE

SEQ ID NO: 3256964 - protein, 17 aa, Plasmodium falciparum
EEIKMLQILLLHINVPR

SEQ ID NO: 3256965 - protein, 17 aa, Plasmodium falciparum
EEILIYIHGYNVKLNHG

SEQ ID NO: 3256966 - protein, 20 aa, Plasmodium falciparum
EEILKIMLSVGLRVLSSISY

SEQ ID NO: 3256967 - protein, 18 aa, Plasmodium falciparum
EEILNYNFLHICKNKCKQ

SEQ ID NO: 3256968 - protein, 27 aa, Plasmodium falciparum
EEINLHFIFCLTLPCLITNIYFLNYNK

SEQ ID NO: 3256969 - protein, 25 aa, Plasmodium falciparum
EEINNVYYIKMCEQLKQENQNFKQL

SEQ ID NO: 3256970 - protein, 21 aa, Plasmodium falciparum
EEIPPKRVLINLWYQSLNIAK

SEQ ID NO: 3256971 - protein, 20 aa, Plasmodium falciparum
EEIPVGFIFICINAFVHSIM

SEQ ID NO: 3256972 - protein, 25 aa, Plasmodium falciparum
EEIREILNTILFIWAKKNPDISYKQ

SEQ ID NO: 3256973 - protein, 22 aa, Plasmodium falciparum
EEIRTCSLFLYLDSVFLNIAAQ

SEQ ID NO: 3256974 - protein, 32 aa, Plasmodium falciparum
EEIYCLRIISRNEIMRYKELIKIMKKGPYYYK

SEQ ID NO: 3256975 - protein, 21 aa, Plasmodium falciparum
EEKCKAFFKHEPCLKNVLRNI

SEQ ID NO: 3256976 - protein, 23 aa, Plasmodium falciparum
EEKCRDKLKIIYKEKLHITNVEK

SEQ ID NO: 3256977 - protein, 29 aa, Plasmodium falciparum
EEKDILSGLFFKELNVIEGNYMPRFEENK

SEQ ID NO: 3256978 - protein, 23 aa, Plasmodium falciparum
EEKHIKEQISIRCTRSQYKNTSN

SEQ ID NO: 3256979 - protein, 24 aa, Plasmodium falciparum
EEKKGYKICHCEHFNFNLQKEKIT

SEQ ID NO: 3256980 - protein, 19 aa, Plasmodium falciparum
EEKKIACEMIKDQIYYLLH

SEQ ID NO: 3256981 - protein, 19 aa, Plasmodium falciparum
EEKKLWKLKKYEIKEKLRK

SEQ ID NO: 3256982 - protein, 25 aa, Plasmodium falciparum
EEKKNCLYFSILIFYDIYETSIINK

SEQ ID NO: 3256983 - protein, 21 aa, Plasmodium falciparum
EEKNKIGILFTCSGPAFINTL

SEQ ID NO: 3256984 - protein, 33 aa, Plasmodium falciparum
EEKNLKKKFLYDSIYKQQSWWSWVTGNKKEIEN

SEQ ID NO: 3256985 - protein, 17 aa, Plasmodium falciparum
EEKRNAMERELEARTES

SEQ ID NO: 3256986 - protein, 22 aa, Plasmodium falciparum
EEKRTFPKYISLVYKEKNKDNE

SEQ ID NO: 3256987 - protein, 27 aa, Plasmodium falciparum
EEKRWKKNVSKKFGYLMSNHFEEKKKN

SEQ ID NO: 3256988 - protein, 23 aa, Plasmodium falciparum
EEKSGESKGEMKILEDSANGKEK

SEQ ID NO: 3256989 - protein, 18 aa, Plasmodium falciparum
EEKSLFHIIMRFLLQEKN

SEQ ID NO: 3256990 - protein, 21 aa, Plasmodium falciparum
EEKYKYMVHNIWCFLLNNEKN

SEQ ID NO: 3256991 - protein, 23 aa, Plasmodium falciparum
EELDITAKLFGKLIKNNLLMDYG

SEQ ID NO: 3256992 - protein, 22 aa, Plasmodium falciparum
EELHEFSCDPLTIIKPIEESNR

SEQ ID NO: 3256993 - protein, 21 aa, Plasmodium falciparum
EELICFYFLIILLLVHIIGTF

SEQ ID NO: 3256994 - protein, 18 aa, Plasmodium falciparum
EELILKNYLIKSVYQNFF

SEQ ID NO: 3256995 - protein, 35 aa, Plasmodium falciparum
EELIRIKCSYYIFVHSLLRYKGASVYKKIFKVIKK

SEQ ID NO: 3256996 - protein, 22 aa, Plasmodium falciparum
EELKIYLCRKKIFEEKYINNSF

SEQ ID NO: 3256997 - protein, 20 aa, Plasmodium falciparum
EELKKGIIPDEFKRQMFYTL

SEQ ID NO: 3256998 - protein, 19 aa, Plasmodium falciparum
EELKRCYEAIYGKHENALY

SEQ ID NO: 3256999 - protein, 24 aa, Plasmodium falciparum
EELKYKMKVVYKIINDIKYNQCFL

SEQ ID NO: 3257000 - protein, 23 aa, Plasmodium falciparum
EELLRLFLPMWNVMLTRRGRKML

SEQ ID NO: 3257001 - protein, 17 aa, Plasmodium falciparum
EELPEKNFLKFLDLRKK

SEQ ID NO: 3257002 - protein, 25 aa, Plasmodium falciparum
EELREVFGPTGVSGVYFEKSRSSWT

SEQ ID NO: 3257003 - protein, 23 aa, Plasmodium falciparum
EELSFNCALFLWYILCLTNAKGF

SEQ ID NO: 3257004 - protein, 22 aa, Plasmodium falciparum
EEMCYSFSCTHNFDIYINHSWK

SEQ ID NO: 3257005 - protein, 21 aa, Plasmodium falciparum
EEMDEFLLWIENRIYLNKQKL

SEQ ID NO: 3257006 - protein, 21 aa, Plasmodium falciparum
EEMILKISPLIKNKNFNPKFV

SEQ ID NO: 3257007 - protein, 19 aa, Plasmodium falciparum
EEMIPEIEIEQVLPEELIE

SEQ ID NO: 3257008 - protein, 21 aa, Plasmodium falciparum
EEMKRVKNLIMEQVIHELMRK

SEQ ID NO: 3257009 - protein, 20 aa, Plasmodium falciparum
EEMLQKYRLVTVGRLDRNTS

SEQ ID NO: 3257010 - protein, 24 aa, Plasmodium falciparum
EENKFCYDENVILFINKNAFFYNL

SEQ ID NO: 3257011 - protein, 20 aa, Plasmodium falciparum
EENKLGGYLYFRGTCGDNEK

SEQ ID NO: 3257012 - protein, 25 aa, Plasmodium falciparum
EENKNLFFYEHEWINIILQIINKDN

SEQ ID NO: 3257013 - protein, 23 aa, Plasmodium falciparum
EENKRFSVHTNFKLFKKEYDPNN

SEQ ID NO: 3257014 - protein, 20 aa, Plasmodium falciparum
EENMGIITFECITNDREPDH

SEQ ID NO: 3257015 - protein, 21 aa, Plasmodium falciparum
EENRILGLVIKTGFITTKGKI

SEQ ID NO: 3257016 - protein, 30 aa, Plasmodium falciparum
EEQKRFNTIILFRASGGFRLLSINESEKYM

SEQ ID NO: 3257017 - protein, 20 aa, Plasmodium falciparum
EERIIKLWAGTWNLCGGDLE

SEQ ID NO: 3257018 - protein, 23 aa, Plasmodium falciparum
EERKKEYKCIIYHSSKMNKDTIQ

SEQ ID NO: 3257019 - protein, 26 aa, Plasmodium falciparum
EERLCKTSCGFDCPVLCITNYDRMEE

SEQ ID NO: 3257020 - protein, 25 aa, Plasmodium falciparum
EERLKRRGGVPLTEAYDIENLIFLG

SEQ ID NO: 3257021 - protein, 18 aa, Plasmodium falciparum
EESFKQSLSIIVSLYNFN

SEQ ID NO: 3257022 - protein, 23 aa, Plasmodium falciparum
EESKGDFLEICLDEFIKKENEYN

SEQ ID NO: 3257023 - protein, 17 aa, Plasmodium falciparum
EESYNFFDTTSFEDETD

SEQ ID NO: 3257024 - protein, 19 aa, Plasmodium falciparum
EETKKNCVCVKTWVEQKKK

SEQ ID NO: 3257025 - protein, 25 aa, Plasmodium falciparum
EETLLNCLVKFVFDDENYLKGKFLR

SEQ ID NO: 3257026 - protein, 30 aa, Plasmodium falciparum
EETNKCLPCLVSGCIRCIKSTLKKGSKSFL

SEQ ID NO: 3257027 - protein, 25 aa, Plasmodium falciparum
EETVCINIKLIIFLFLFIKKKYMTI

SEQ ID NO: 3257028 - protein, 24 aa, Plasmodium falciparum
EETVCLRIDCSISTNEFQCFCTNV

SEQ ID NO: 3257029 - protein, 21 aa, Plasmodium falciparum
EETYKLILKYVEKIKKVRKYL

SEQ ID NO: 3257030 - protein, 18 aa, Plasmodium falciparum
EEVEKRKSVENIIKDKEK

SEQ ID NO: 3257031 - protein, 28 aa, Plasmodium falciparum
EEVFFIELSKLCALFYMKNEEEVIDIKI

SEQ ID NO: 3257032 - protein, 21 aa, Plasmodium falciparum
EEVFILASKCIKTIKKKKYSD

SEQ ID NO: 3257033 - protein, 17 aa, Plasmodium falciparum
EEVKKVIKKKVEKGIKE

SEQ ID NO: 3257034 - protein, 25 aa, Plasmodium falciparum
EEVLKAVCIQLSYLSEDFFDNSDNS

SEQ ID NO: 3257035 - protein, 19 aa, Plasmodium falciparum
EEVNPCKIVEELFKSTKNF

SEQ ID NO: 3257036 - protein, 19 aa, Plasmodium falciparum
EEVNVCSIVGGILTGSGNL

SEQ ID NO: 3257037 - protein, 24 aa, Plasmodium falciparum
EEVREYLASMGFRKFSQIIGRSDL

SEQ ID NO: 3257038 - protein, 23 aa, Plasmodium falciparum
EEVRSDENIHIFRKKNENFVKKI

SEQ ID NO: 3257039 - protein, 26 aa, Plasmodium falciparum
EEVYNWKHKKNFIKDCAEISKKFPRI

SEQ ID NO: 3257040 - protein, 29 aa, Plasmodium falciparum
EEVYPPVYLHQWLLTLFIASLPIKSVIVI

SEQ ID NO: 3257041 - protein, 25 aa, Plasmodium falciparum
EEWFILKKKLEHVVIKYVIKKKKKN

SEQ ID NO: 3257042 - protein, 19 aa, Plasmodium falciparum
EEYANICKEFSKVYDIKKY

SEQ ID NO: 3257043 - protein, 23 aa, Plasmodium falciparum
EEYKEFYFYVNLLRYNNKNKFNH

SEQ ID NO: 3257044 - protein, 20 aa, Plasmodium falciparum
EEYKNFLLRIRIFSRLTPNN

SEQ ID NO: 3257045 - protein, 19 aa, Plasmodium falciparum
EEYKVCQLYFVAKASLEDA

SEQ ID NO: 3257046 - protein, 18 aa, Plasmodium falciparum
EEYMIYFLTFHIYVKQIM

SEQ ID NO: 3257047 - protein, 24 aa, Plasmodium falciparum
EEYNVCKGIIKYVSHFVGYEKLKD

SEQ ID NO: 3257048 - protein, 21 aa, Plasmodium falciparum
EEYSMLINFLHLYKILFQNFL

SEQ ID NO: 3257049 - protein, 26 aa, Plasmodium falciparum
EEYVELRGNIVLFIVYMIRYENMFCY

SEQ ID NO: 3257050 - protein, 20 aa, Plasmodium falciparum
EEYWEKCLYDFEVKLLNASY

SEQ ID NO: 3257051 - protein, 18 aa, Plasmodium falciparum
EEYYMLFNYVILSYIPLY

SEQ ID NO: 3257052 - protein, 22 aa, Plasmodium falciparum
EFCYKGKCVLVDGFYIQMILSF

SEQ ID NO: 3257053 - protein, 20 aa, Plasmodium falciparum
EFDIIKYLFYIIRLVEYSLS

SEQ ID NO: 3257054 - protein, 23 aa, Plasmodium falciparum
EFEDPLFWKHFCLLITTRDENFV

SEQ ID NO: 3257055 - protein, 28 aa, Plasmodium falciparum
EFEKDVRLLFDMKKYIECLTKRSSNNNN

SEQ ID NO: 3257056 - protein, 19 aa, Plasmodium falciparum
EFELICEVHFTSKPNEEIM

SEQ ID NO: 3257057 - protein, 17 aa, Plasmodium falciparum
EFENKMKSSDKLSSSNE

SEQ ID NO: 3257058 - protein, 26 aa, Plasmodium falciparum
EFFCKKKKCFCCIFSMDSFFLTFMCR

SEQ ID NO: 3257059 - protein, 19 aa, Plasmodium falciparum
EFFNEGRILITMHKHFIIV

SEQ ID NO: 3257060 - protein, 19 aa, Plasmodium falciparum
EFFNNLKLRNINIDLDEKK

SEQ ID NO: 3257061 - protein, 22 aa, Plasmodium falciparum
EFFVNNCLFFLCMLKEKQRGVL

SEQ ID NO: 3257062 - protein, 18 aa, Plasmodium falciparum
EFGLKYIYELNMLEDFIL

SEQ ID NO: 3257063 - protein, 20 aa, Plasmodium falciparum
EFHILLFILYIFCIVVYFNN

SEQ ID NO: 3257064 - protein, 27 aa, Plasmodium falciparum
EFIFKSQSSYLFMLYLICISKYGLDDK

SEQ ID NO: 3257065 - protein, 20 aa, Plasmodium falciparum
EFILNFLLGLCLEDKNDISK

SEQ ID NO: 3257066 - protein, 29 aa, Plasmodium falciparum
EFISRPPYFRYLEEWGETFCRQRARMLKQ

SEQ ID NO: 3257067 - protein, 19 aa, Plasmodium falciparum
EFITNLFLSLKDLENKIKR

SEQ ID NO: 3257068 - protein, 25 aa, Plasmodium falciparum
EFITRSCGFLVLIFFLSFIFLFIYF

SEQ ID NO: 3257069 - protein, 29 aa, Plasmodium falciparum
EFIVDYLYFIYLFKWINKLYRKYEKIKQL

SEQ ID NO: 3257070 - protein, 23 aa, Plasmodium falciparum
EFKDMFFLKLFFFTLYLFFISYN

SEQ ID NO: 3257071 - protein, 20 aa, Plasmodium falciparum
EFKDNLIIKIIRTNDVKKRF

SEQ ID NO: 3257072 - protein, 24 aa, Plasmodium falciparum
EFKIHPIEIIASIRTSEHRISRRV

SEQ ID NO: 3257073 - protein, 20 aa, Plasmodium falciparum
EFKTKEIIKKMQYNFKITNI

SEQ ID NO: 3257074 - protein, 20 aa, Plasmodium falciparum
EFKVKCKNGACGDSNTQKKC

SEQ ID NO: 3257075 - protein, 20 aa, Plasmodium falciparum
EFKYKIRILAGIMFAIKTIP

SEQ ID NO: 3257076 - protein, 18 aa, Plasmodium falciparum
EFLFRYIGLDDVYRDTSY

SEQ ID NO: 3257077 - protein, 17 aa, Plasmodium falciparum
EFLIIIFYISFYEHENN

SEQ ID NO: 3257078 - protein, 25 aa, Plasmodium falciparum
EFLILPYTIGVSMNTYFNNYLIEYI

SEQ ID NO: 3257079 - protein, 20 aa, Plasmodium falciparum
EFLILYNRYLFYFRTLEQIN

SEQ ID NO: 3257080 - protein, 20 aa, Plasmodium falciparum
EFMERIYLRIKYIRRDDIHG

SEQ ID NO: 3257081 - protein, 20 aa, Plasmodium falciparum
EFNIFIIINPFYKGRSELPN

SEQ ID NO: 3257082 - protein, 28 aa, Plasmodium falciparum
EFNLLILACRLLWRRTLTKIKEEGKKYL

SEQ ID NO: 3257083 - protein, 26 aa, Plasmodium falciparum
EFNYKHNLSLDFIGDFICKSSNAHIQ

SEQ ID NO: 3257084 - protein, 17 aa, Plasmodium falciparum
EFQHCIINNDPIKIQSV

SEQ ID NO: 3257085 - protein, 24 aa, Plasmodium falciparum
EFRFFLFICIIDILIAIFLFLIID

SEQ ID NO: 3257086 - protein, 28 aa, Plasmodium falciparum
EFRVIVMACRLLWRKTLATLKEEGMLYL

SEQ ID NO: 3257087 - protein, 24 aa, Plasmodium falciparum
EFSLCKINLFIKEAKLLFFNKNIS

SEQ ID NO: 3257088 - protein, 19 aa, Plasmodium falciparum
EFSMRRNKVVISHETLKDI

SEQ ID NO: 3257089 - protein, 34 aa, Plasmodium falciparum
EFTSIRYKRRRWYWRVFYTIMFIIFFPVLFIYRR

SEQ ID NO: 3257090 - protein, 24 aa, Plasmodium falciparum
EFVFKEDLFNLFLKSNIFDNLYEY

SEQ ID NO: 3257091 - protein, 25 aa, Plasmodium falciparum
EFYFLIEFFNNLPILLNGKEDELVM

SEQ ID NO: 3257092 - protein, 31 aa, Plasmodium falciparum
EFYHLRDMLFIFKSYMCPYIEKLPQVKVYKY

SEQ ID NO: 3257093 - protein, 18 aa, Plasmodium falciparum
EFYNHIFPFCKIMNKKWV

SEQ ID NO: 3257094 - protein, 19 aa, Plasmodium falciparum
EFYYIKLIVELDKKMNIKH

SEQ ID NO: 3257095 - protein, 24 aa, Plasmodium falciparum
EFYYLYKGGCTKIFNIVPSIEECI

SEQ ID NO: 3257096 - protein, 24 aa, Plasmodium falciparum
EGACAPYRRLHVCDKNMVKMDTNN

SEQ ID NO: 3257097 - protein, 25 aa, Plasmodium falciparum
EGACAPYRRLHVCDQNLELIKPKNI

SEQ ID NO: 3257098 - protein, 24 aa, Plasmodium falciparum
EGACAPYRRLHVCVRNLENINDYS

SEQ ID NO: 3257099 - protein, 23 aa, Plasmodium falciparum
EGAIQCARRSNLLGVQIKDFELA

SEQ ID NO: 3257100 - protein, 19 aa, Plasmodium falciparum
EGALIVWKPAAIKAAKAAA

SEQ ID NO: 3257101 - protein, 20 aa, Plasmodium falciparum
EGALIVWKPAAIKAAKAAKA

SEQ ID NO: 3257102 - protein, 19 aa, Plasmodium falciparum
EGALYAWKPKALEASIKTA

SEQ ID NO: 3257103 - protein, 19 aa, Plasmodium falciparum
EGALYAWKPNALQTAIEAA

SEQ ID NO: 3257104 - protein, 19 aa, Plasmodium falciparum
EGALYAWKPTAITAAKKAA

SEQ ID NO: 3257105 - protein, 21 aa, Plasmodium falciparum
EGALYAWKPTALKVAIDKAIA

SEQ ID NO: 3257106 - protein, 25 aa, Plasmodium falciparum
EGAMCYPFEVNLGIREAITFTQTGP

SEQ ID NO: 3257107 - protein, 24 aa, Plasmodium falciparum
EGCKKTCECFEKWVGQKKTEWRKI

SEQ ID NO: 3257108 - protein, 32 aa, Plasmodium falciparum
EGCYLFMRLMNVIPLIKLKIYSPLSIIHNDKY

SEQ ID NO: 3257109 - protein, 24 aa, Plasmodium falciparum
EGDISLAEFKNGFNPSGLKNVCQI

SEQ ID NO: 3257110 - protein, 18 aa, Plasmodium falciparum
EGDLVWCNKIPSTCEEED

SEQ ID NO: 3257111 - protein, 24 aa, Plasmodium falciparum
EGECAPYRRLSLCNKNFQKINNID

SEQ ID NO: 3257112 - protein, 22 aa, Plasmodium falciparum
EGEININMSIHFKENTYIKKRN

SEQ ID NO: 3257113 - protein, 21 aa, Plasmodium falciparum
EGEISLNMNMELLNEFENEEN

SEQ ID NO: 3257114 - protein, 20 aa, Plasmodium falciparum
EGEKLLRARDDPCGNGSASD

SEQ ID NO: 3257115 - protein, 27 aa, Plasmodium falciparum
EGFACKNKCKDKCKCVEHWINQKRTQW

SEQ ID NO: 3257116 - protein, 18 aa, Plasmodium falciparum
EGFDGVSIHDEKKKLNVS

SEQ ID NO: 3257117 - protein, 24 aa, Plasmodium falciparum
EGFEDKIFLALYRRLFKKIEYQCY

SEQ ID NO: 3257118 - protein, 32 aa, Plasmodium falciparum
EGGGRKGLPKSFLNRFSKIYFEDLDDFDYFCI

SEQ ID NO: 3257119 - protein, 20 aa, Plasmodium falciparum
EGIILYLKYIARVCSDRNKD

SEQ ID NO: 3257120 - protein, 21 aa, Plasmodium falciparum
EGIISCLFLIILTAMFILFKP

SEQ ID NO: 3257121 - protein, 23 aa, Plasmodium falciparum
EGIKELSFFFPAHIFFNESNSPI

SEQ ID NO: 3257122 - protein, 18 aa, Plasmodium falciparum
EGIKIKMEDWRSENKYNN

SEQ ID NO: 3257123 - protein, 23 aa, Plasmodium falciparum
EGIKLPVSIMIEGYFKNININNS

SEQ ID NO: 3257124 - protein, 19 aa, Plasmodium falciparum
EGIKNYIFDLCCGTGTISI

SEQ ID NO: 3257125 - protein, 26 aa, Plasmodium falciparum
EGILLKEIMSDFILSKYSVIILDEAH

SEQ ID NO: 3257126 - protein, 24 aa, Plasmodium falciparum
EGILPKCIGMGIGGGIVGLLIGVF

SEQ ID NO: 3257127 - protein, 20 aa, Plasmodium falciparum
EGINGFFKGMFFGLLSAIII

SEQ ID NO: 3257128 - protein, 21 aa, Plasmodium falciparum
EGINIKRILNWHEAAKHYKTY

SEQ ID NO: 3257129 - protein, 19 aa, Plasmodium falciparum
EGIRKLLENSFFDLNDDIL

SEQ ID NO: 3257130 - protein, 18 aa, Plasmodium falciparum
EGITMKQNENIVGSVSND

SEQ ID NO: 3257131 - protein, 21 aa, Plasmodium falciparum
EGKCLRLFSSYVPPEGVDPTE

SEQ ID NO: 3257132 - protein, 18 aa, Plasmodium falciparum
EGKGIFKGIRKEEWKCRN

SEQ ID NO: 3257133 - protein, 26 aa, Plasmodium falciparum
EGKIKSLFLRPFPKFKNYKQVNLDTL

SEQ ID NO: 3257134 - protein, 21 aa, Plasmodium falciparum
EGKKYLNFSSFFNAFFELSDI

SEQ ID NO: 3257135 - protein, 32 aa, Plasmodium falciparum
EGKSVKSYNGFFWKWVHDMLIDSMQWRDEHGN

SEQ ID NO: 3257136 - protein, 19 aa, Plasmodium falciparum
EGLIGFFIYMPECEERYTE

SEQ ID NO: 3257137 - protein, 19 aa, Plasmodium falciparum
EGLIIYVCMLLSKFYSFKN

SEQ ID NO: 3257138 - protein, 17 aa, Plasmodium falciparum
EGLKMGFKYIASGPLVR

SEQ ID NO: 3257139 - protein, 38 aa, Plasmodium falciparum
EGMNKCKVKNPEMVFKSGFANVAECRNLNVEGAGNKNS

SEQ ID NO: 3257140 - protein, 35 aa, Plasmodium falciparum
EGNIPKYRINDNILKLLKFYVNYKIKIYQDEKKYN

SEQ ID NO: 3257141 - protein, 30 aa, Plasmodium falciparum
EGNKLVKCFCCGKPSHDECFYIIDNNTYKN

SEQ ID NO: 3257142 - protein, 18 aa, Plasmodium falciparum
EGNVWVYRVAPSHLKSIF

SEQ ID NO: 3257143 - protein, 31 aa, Plasmodium falciparum
EGNWKNQFFKNGKFKNCITYKNKSRYYNNIK

SEQ ID NO: 3257144 - protein, 25 aa, Plasmodium falciparum
EGNWNFLKYFSLDVMLPKRMQHHSF

SEQ ID NO: 3257145 - protein, 31 aa, Plasmodium falciparum
EGQFCLYICLEFIKYLIILNLYFNKYLELLK

SEQ ID NO: 3257146 - protein, 19 aa, Plasmodium falciparum
EGRVWYRMKNEEYIKKTNK

SEQ ID NO: 3257147 - protein, 25 aa, Plasmodium falciparum
EGRYKKEYIDRFFLEELRKHNYMNN

SEQ ID NO: 3257148 - protein, 20 aa, Plasmodium falciparum
EGSCYLMEKLFKKLSEEKKE

SEQ ID NO: 3257149 - protein, 23 aa, Plasmodium falciparum
EGSHPNFRCFLTSEITTNIPISI

SEQ ID NO: 3257150 - protein, 25 aa, Plasmodium falciparum
EGSPCIKDCDKICECVTKWIEKKRT

SEQ ID NO: 3257151 - protein, 20 aa, Plasmodium falciparum
EGTIKFNGGQTFQHTEDCKS

SEQ ID NO: 3257152 - protein, 20 aa, Plasmodium falciparum
EGTIKFNGGQTFQHTNLCDS

SEQ ID NO: 3257153 - protein, 26 aa, Plasmodium falciparum
EGTIPHGFLRQMFYTLGDYRDILVGK

SEQ ID NO: 3257154 - protein, 18 aa, Plasmodium falciparum
EGTVLPFYTFLNIKNKLN

SEQ ID NO: 3257155 - protein, 45 aa, Plasmodium falciparum
EGVDAGGLTREWYSILAKEIFNPNYALFCREGKKSEFNHPNPLSY

SEQ ID NO: 3257156 - protein, 19 aa, Plasmodium falciparum
EGYELKVGMWLSTCSLLIL

SEQ ID NO: 3257157 - protein, 17 aa, Plasmodium falciparum
EGYIKDKLNLFSSPYVQ

SEQ ID NO: 3257158 - protein, 20 aa, Plasmodium falciparum
EGYQSVIIGGINFGYLGFNF

SEQ ID NO: 3257159 - protein, 18 aa, Plasmodium falciparum
EGYQYFRKTACNGGKSST

SEQ ID NO: 3257160 - protein, 18 aa, Plasmodium falciparum
EGYTKCMFHRNNDDIEKL

SEQ ID NO: 3257161 - protein, 18 aa, Plasmodium falciparum
EGYWKKGKRFGYGIFNYY

SEQ ID NO: 3257162 - protein, 26 aa, Plasmodium falciparum
EHCFDVKHIICYSKESLYKKNINNNN

SEQ ID NO: 3257163 - protein, 22 aa, Plasmodium falciparum
EHCFKIKNMLYKNKRMTYYSEN

SEQ ID NO: 3257164 - protein, 20 aa, Plasmodium falciparum
EHCMKDLQIILSYVDVHQCT

SEQ ID NO: 3257165 - protein, 24 aa, Plasmodium falciparum
EHEEIISFAFNQWVKLTSLNNIDN

SEQ ID NO: 3257166 - protein, 36 aa, Plasmodium falciparum
EHELRLKNIYIILLLKRKACDIIIDFCSVLKKQNNN

SEQ ID NO: 3257167 - protein, 20 aa, Plasmodium falciparum
EHEPRPMITTSRYENKISND

SEQ ID NO: 3257168 - protein, 17 aa, Plasmodium falciparum
EHFFKYVLYDFIINYEG

SEQ ID NO: 3257169 - protein, 26 aa, Plasmodium falciparum
EHFIHKRDFINLNILKLIKEKIIQVL

SEQ ID NO: 3257170 - protein, 17 aa, Plasmodium falciparum
EHFSKPYLEESILNSFY

SEQ ID NO: 3257171 - protein, 18 aa, Plasmodium falciparum
EHFSLCFFYSNPIHGDLS

SEQ ID NO: 3257172 - protein, 23 aa, Plasmodium falciparum
EHGRINIIYAKKFYDILKEQYGK

SEQ ID NO: 3257173 - protein, 25 aa, Plasmodium falciparum
EHGTYIGMVILNFYLVVMNTYFFDF

SEQ ID NO: 3257174 - protein, 23 aa, Plasmodium falciparum
EHIAYAIKIFLQEGLFDSDYKRA

SEQ ID NO: 3257175 - protein, 24 aa, Plasmodium falciparum
EHIKIYYIISNFVFFFSKMHKNNI

SEQ ID NO: 3257176 - protein, 19 aa, Plasmodium falciparum
EHILSALSILLKDPYPLLK

SEQ ID NO: 3257177 - protein, 19 aa, Plasmodium falciparum
EHIMKCFKLVDISFIESHI

SEQ ID NO: 3257178 - protein, 19 aa, Plasmodium falciparum
EHIRKLLKILKYVNDNFLF

SEQ ID NO: 3257179 - protein, 19 aa, Plasmodium falciparum
EHIVLSVIITLTIYNFLMF

SEQ ID NO: 3257180 - protein, 17 aa, Plasmodium falciparum
EHIYFNFLFNIHYLHNL

SEQ ID NO: 3257181 - protein, 25 aa, Plasmodium falciparum
EHIYSFTKCFISKILGYDIKPDLEE

SEQ ID NO: 3257182 - protein, 24 aa, Plasmodium falciparum
EHKKECKTNHLINVPSKIDKNKCS

SEQ ID NO: 3257183 - protein, 17 aa, Plasmodium falciparum
EHKKECSKDATFSNNKG

SEQ ID NO: 3257184 - protein, 21 aa, Plasmodium falciparum
EHKNDFILCTYIYLMFYIYDK

SEQ ID NO: 3257185 - protein, 27 aa, Plasmodium falciparum
EHKSIEIPLKYILKHIGRYIYGVDYND

SEQ ID NO: 3257186 - protein, 22 aa, Plasmodium falciparum
EHLLFSNNYMRIIIYILNEKCL

SEQ ID NO: 3257187 - protein, 19 aa, Plasmodium falciparum
EHLLSMSIYHYFYFFHIFR

SEQ ID NO: 3257188 - protein, 17 aa, Plasmodium falciparum
EHLRKTHFLNIMDPSML

SEQ ID NO: 3257189 - protein, 21 aa, Plasmodium falciparum
EHLYNNFIFFIHILNLLPCNF

SEQ ID NO: 3257190 - protein, 34 aa, Plasmodium falciparum
EHNKDRYKVCKKMFRCLFCKRYKKEERLDKIRKD

SEQ ID NO: 3257191 - protein, 25 aa, Plasmodium falciparum
EHPNIKMGSIFIGTKIFSIDTFYIE

SEQ ID NO: 3257192 - protein, 17 aa, Plasmodium falciparum
EHQWRLFEYNMSKWMIE

SEQ ID NO: 3257193 - protein, 18 aa, Plasmodium falciparum
EHRFSKERGAECDDNKIE

SEQ ID NO: 3257194 - protein, 20 aa, Plasmodium falciparum
EHRFSKERGAECDKNKISGS

SEQ ID NO: 3257195 - protein, 17 aa, Plasmodium falciparum
EHSRGIFAKGYLGEVES

SEQ ID NO: 3257196 - protein, 24 aa, Plasmodium falciparum
EHTIKAHFYILDYVNDLENKKKEM

SEQ ID NO: 3257197 - protein, 18 aa, Plasmodium falciparum
EHTKGIFLESFKYTRQKK

SEQ ID NO: 3257198 - protein, 19 aa, Plasmodium falciparum
EHTLKICAHTNVKKKNMES

SEQ ID NO: 3257199 - protein, 23 aa, Plasmodium falciparum
EHTMMLLSCYKKQCKKKKMISFI

SEQ ID NO: 3257200 - protein, 30 aa, Plasmodium falciparum
EHTYPQCFRFFKEWLEDVSNEKMKWEIYLN

SEQ ID NO: 3257201 - protein, 20 aa, Plasmodium falciparum
EHVIYSFLILIGMVKMEIYL

SEQ ID NO: 3257202 - protein, 30 aa, Plasmodium falciparum
EHVVCGISKGVVYIFNLRRSIIVHKLFVNG

SEQ ID NO: 3257203 - protein, 22 aa, Plasmodium falciparum
EHYDIIPIGDFRKSDISEKHPD

SEQ ID NO: 3257204 - protein, 24 aa, Plasmodium falciparum
EHYIYPLAVAKSHFNYFIIKDISF

SEQ ID NO: 3257205 - protein, 20 aa, Plasmodium falciparum
EHYSIYVFFSTFFKNALKEY

SEQ ID NO: 3257206 - protein, 20 aa, Plasmodium falciparum
EHYSKCLQPVIINNNNNNNN

SEQ ID NO: 3257207 - protein, 20 aa, Plasmodium falciparum
EIAAQFWGLEAYQIPTVDAL

SEQ ID NO: 3257208 - protein, 24 aa, Plasmodium falciparum
EIAIRYIKLKGYKFNKVNNIQINK

SEQ ID NO: 3257209 - protein, 23 aa, Plasmodium falciparum
EIAKKLKAFCAQANGDTTNGTGG

SEQ ID NO: 3257210 - protein, 27 aa, Plasmodium falciparum
EICHVTYSFGIMCYVFGFYKFFKIENL

SEQ ID NO: 3257211 - protein, 19 aa, Plasmodium falciparum
EICNIYISLVYKFMNIINT

SEQ ID NO: 3257212 - protein, 17 aa, Plasmodium falciparum
EIDGSFNKWTIIGVNEF

SEQ ID NO: 3257213 - protein, 22 aa, Plasmodium falciparum
EIEDICKYCYLKCDDNINKCTN

SEQ ID NO: 3257214 - protein, 27 aa, Plasmodium falciparum
EIEFYKIIYKSVCSYSHQDTFYEEEIM

SEQ ID NO: 3257215 - protein, 33 aa, Plasmodium falciparum
EIEIARNRYFSSLRCTIYLLFLILILVIIILVV

SEQ ID NO: 3257216 - protein, 35 aa, Plasmodium falciparum
EIENEMSLPFCEANFFKNHFNVFCVKKIFNNLFTY

SEQ ID NO: 3257217 - protein, 17 aa, Plasmodium falciparum
EIENYYFIYKMNRKIEE

SEQ ID NO: 3257218 - protein, 26 aa, Plasmodium falciparum
EIEYKFEIKRCVNIFVNLLKDQNVEY

SEQ ID NO: 3257219 - protein, 24 aa, Plasmodium falciparum
EIFKKRIHKEIKRLKESKVIDDIN

SEQ ID NO: 3257220 - protein, 20 aa, Plasmodium falciparum
EIFYIYIWLLYVCLHKYTYD

SEQ ID NO: 3257221 - protein, 24 aa, Plasmodium falciparum
EIGCLRCGCGLGGVAASVGIFGTV

SEQ ID NO: 3257222 - protein, 37 aa, Plasmodium falciparum
EIGYFSYIYIHNFFHFLSCYLLYDINTLYKFCSNEFN

SEQ ID NO: 3257223 - protein, 32 aa, Plasmodium falciparum
EIHISITKYFFWKEWVLYIFFNLMTCAIINIY

SEQ ID NO: 3257224 - protein, 24 aa, Plasmodium falciparum
EIIDFSNKCDYRFDKNINNKGTFY

SEQ ID NO: 3257225 - protein, 47 aa, Plasmodium falciparum
EIIFENKLNTPWMCMIFPYYFISYFNYKIFCILKCTKKKRVRKNTNL

SEQ ID NO: 3257226 - protein, 18 aa, Plasmodium falciparum
EIIFSWLVFCASRLRLFF

SEQ ID NO: 3257227 - protein, 22 aa, Plasmodium falciparum
EIIIRSLKKWNINKENVCSNKE

SEQ ID NO: 3257228 - protein, 28 aa, Plasmodium falciparum
EIIKSIIKLKHNFNLLIMKKKNILINQC

SEQ ID NO: 3257229 - protein, 18 aa, Plasmodium falciparum
EIILPVKSIHPFKLSNHN

SEQ ID NO: 3257230 - protein, 19 aa, Plasmodium falciparum
EIINLNLKDHIDILNNKKY

SEQ ID NO: 3257231 - protein, 31 aa, Plasmodium falciparum
EIINNASLKSRKLFMNKIWKKKKCLDDEGDK

SEQ ID NO: 3257232 - protein, 18 aa, Plasmodium falciparum
EIIQGGSFTEEIVGQEES

SEQ ID NO: 3257233 - protein, 29 aa, Plasmodium falciparum
EIIYDYIKKNGICPNIDNTLMLVEDSLKR

SEQ ID NO: 3257234 - protein, 24 aa, Plasmodium falciparum
EIIYEFYPEWSYKTNFTLPLPLTT

SEQ ID NO: 3257235 - protein, 18 aa, Plasmodium falciparum
EIIYKEGIPEVLIEEVIP

SEQ ID NO: 3257236 - protein, 17 aa, Plasmodium falciparum
EIKCERNNMSVFTYVAL

SEQ ID NO: 3257237 - protein, 25 aa, Plasmodium falciparum
EIKEINEPIIVPSYYPTTGPNPNTH

SEQ ID NO: 3257238 - protein, 21 aa, Plasmodium falciparum
EIKEVHGFLESGIKQSGSNQI

SEQ ID NO: 3257239 - protein, 23 aa, Plasmodium falciparum
EIKKELFNKLNIILDVNMNMNTD

SEQ ID NO: 3257240 - protein, 18 aa, Plasmodium falciparum
EIKKRFLNQYKMDSDEYY

SEQ ID NO: 3257241 - protein, 24 aa, Plasmodium falciparum
EIKKRLQQYDCIIDFNANKNIITQ

SEQ ID NO: 3257242 - protein, 18 aa, Plasmodium falciparum
EIKLFNFSKYINIKELLD

SEQ ID NO: 3257243 - protein, 23 aa, Plasmodium falciparum
EIKNCNVNRIMCLKHNNEKLKYP

SEQ ID NO: 3257244 - protein, 19 aa, Plasmodium falciparum
EIKNICTFQGNSFMSCTYK

SEQ ID NO: 3257245 - protein, 21 aa, Plasmodium falciparum
EIKNPKILLLNAERKIKYDVL

SEQ ID NO: 3257246 - protein, 21 aa, Plasmodium falciparum
EIKNYVDFMIILKLLSKYIKI

SEQ ID NO: 3257247 - protein, 19 aa, Plasmodium falciparum
EIKRLPFLIHVIGRIGCND

SEQ ID NO: 3257248 - protein, 19 aa, Plasmodium falciparum
EILCILCFATCSCFRSNGI

SEQ ID NO: 3257249 - protein, 23 aa, Plasmodium falciparum
EILDELKSALLYMSQKKSEHVRR

SEQ ID NO: 3257250 - protein, 26 aa, Plasmodium falciparum
EILHRRVEWFYHWFIESASNIEYDYR

SEQ ID NO: 3257251 - protein, 27 aa, Plasmodium falciparum
EILIKILKICWLYKLSHFIDKNVKLCR

SEQ ID NO: 3257252 - protein, 25 aa, Plasmodium falciparum
EILKEIEKFLSFLIENEYTLMDSTE

SEQ ID NO: 3257253 - protein, 24 aa, Plasmodium falciparum
EILLKRLRRNNLRKRRIRRVGKGE

SEQ ID NO: 3257254 - protein, 19 aa, Plasmodium falciparum
EILLKWKTYVHKFLHFCLN

SEQ ID NO: 3257255 - protein, 19 aa, Plasmodium falciparum
EILMVLRYIQIIHYKKYLD

SEQ ID NO: 3257256 - protein, 19 aa, Plasmodium falciparum
EILNCTNFSKIVIGMTNKN

SEQ ID NO: 3257257 - protein, 23 aa, Plasmodium falciparum
EILNKECRHFNYFIDDMKDEFLT

SEQ ID NO: 3257258 - protein, 26 aa, Plasmodium falciparum
EILNKIKIFFTRMLKNTHKLFILPPS

SEQ ID NO: 3257259 - protein, 21 aa, Plasmodium falciparum
EILNMKKCFHSFLNENIVIYE

SEQ ID NO: 3257260 - protein, 19 aa, Plasmodium falciparum
EILSYSGMKTFKLMCNKIC

SEQ ID NO: 3257261 - protein, 38 aa, Plasmodium falciparum
EILVYYILNLFIYYYIWLKCYFVLYNIIYEYIERKDYM

SEQ ID NO: 3257262 - protein, 37 aa, Plasmodium falciparum
EILWNDRAFVFFIFLLLCFIITYGILTVRKHMHSFFI

SEQ ID NO: 3257263 - protein, 20 aa, Plasmodium falciparum
EIMKKILFVKYMYNKIELKI

SEQ ID NO: 3257264 - protein, 20 aa, Plasmodium falciparum
EIMKVYKTFRYCDSLNVLAK

SEQ ID NO: 3257265 - protein, 18 aa, Plasmodium falciparum
EIMMKLIYIDLEKAKSKE

SEQ ID NO: 3257266 - protein, 18 aa, Plasmodium falciparum
EIMMKRMLSTPCKDGTQY

SEQ ID NO: 3257267 - protein, 18 aa, Plasmodium falciparum
EINELCCFSDDIYQSYLL

SEQ ID NO: 3257268 - protein, 20 aa, Plasmodium falciparum
EINETYLSLHIKDVIHNLYV

SEQ ID NO: 3257269 - protein, 21 aa, Plasmodium falciparum
EINFHVFFTFFILIYCILNIY

SEQ ID NO: 3257270 - protein, 20 aa, Plasmodium falciparum
EINIPYIFKTINSIEFKANV

SEQ ID NO: 3257271 - protein, 19 aa, Plasmodium falciparum
EINIRYNSNMIGINNANNN

SEQ ID NO: 3257272 - protein, 18 aa, Plasmodium falciparum
EINKKCLELLLISRRSSI

SEQ ID NO: 3257273 - protein, 20 aa, Plasmodium falciparum
EINLHTSLQYFLNFKMFQNK

SEQ ID NO: 3257274 - protein, 23 aa, Plasmodium falciparum
EINLKRILSNFIITKNVKDNIKK

SEQ ID NO: 3257275 - protein, 19 aa, Plasmodium falciparum
EINLRKCVDQWWKNRYLLE

SEQ ID NO: 3257276 - protein, 19 aa, Plasmodium falciparum
EINNILNIITRNFKCDNCI

SEQ ID NO: 3257277 - protein, 19 aa, Plasmodium falciparum
EINSFKLNYELDEKKYIDE

SEQ ID NO: 3257278 - protein, 21 aa, Plasmodium falciparum
EIPHSYRLYVYNFFIKYLNIN

SEQ ID NO: 3257279 - protein, 25 aa, Plasmodium falciparum
EIPKHKNLLTSFLICEIYGCLYKLN

SEQ ID NO: 3257280 - protein, 24 aa, Plasmodium falciparum
EIPQFHRWLIEWAKQACKEYRIRK

SEQ ID NO: 3257281 - protein, 24 aa, Plasmodium falciparum
EIPQSLRCFVEWTEQFCEERLKKI

SEQ ID NO: 3257282 - protein, 19 aa, Plasmodium falciparum
EIPTMNIMDLFKYNVVFIK

SEQ ID NO: 3257283 - protein, 26 aa, Plasmodium falciparum
EIPTYFRWLHEWGSDFCGTRKRMLGK

SEQ ID NO: 3257284 - protein, 24 aa, Plasmodium falciparum
EIQKEIKALIKYTLEKRKIHFEPI

SEQ ID NO: 3257285 - protein, 21 aa, Plasmodium falciparum
EIQKWCVDCTLFHFFYRNNII

SEQ ID NO: 3257286 - protein, 25 aa, Plasmodium falciparum
EIRALLKRWVDNFFDDYNKIKHKIS

SEQ ID NO: 3257287 - protein, 20 aa, Plasmodium falciparum
EIRGGNNFDEKWRNLTYLVW

SEQ ID NO: 3257288 - protein, 25 aa, Plasmodium falciparum
EIRKYEYIKIFIIGLVLNNDISNGI

SEQ ID NO: 3257289 - protein, 20 aa, Plasmodium falciparum
EISIYICSYIVKYVTNNNII

SEQ ID NO: 3257290 - protein, 21 aa, Plasmodium falciparum
EISKEGLCFIHDDFDEIPQSL

SEQ ID NO: 3257291 - protein, 20 aa, Plasmodium falciparum
EISLIFKSMWMSRVYHENLF

SEQ ID NO: 3257292 - protein, 18 aa, Plasmodium falciparum
EISLNICNIIKEHTYILQ

SEQ ID NO: 3257293 - protein, 28 aa, Plasmodium falciparum
EISQRILLEEIFIFLFIKTIDLLEDNQL

SEQ ID NO: 3257294 - protein, 21 aa, Plasmodium falciparum
EITGEFSVLMLKDLNEDLKHI

SEQ ID NO: 3257295 - protein, 25 aa, Plasmodium falciparum
EITKCDLCKGAFLYSNMKFEEVPSM

SEQ ID NO: 3257296 - protein, 18 aa, Plasmodium falciparum
EIVHDYMFIFLQHIIINK

SEQ ID NO: 3257297 - protein, 18 aa, Plasmodium falciparum
EIVKLFIQLYEYFNEDKA

SEQ ID NO: 3257298 - protein, 24 aa, Plasmodium falciparum
EIVRNKWCLCIGTCIQIENNTGLY

SEQ ID NO: 3257299 - protein, 28 aa, Plasmodium falciparum
EIVYKKLYFINIFFFRELKTHDCYDNTF

SEQ ID NO: 3257300 - protein, 22 aa, Plasmodium falciparum
EIWEECPFPFNYVIYNKRETNL

SEQ ID NO: 3257301 - protein, 18 aa, Plasmodium falciparum
EIYDLLYGKIYIRMTSRE

SEQ ID NO: 3257302 - protein, 19 aa, Plasmodium falciparum
EIYDQFYLLQSLFKNFTLF

SEQ ID NO: 3257303 - protein, 23 aa, Plasmodium falciparum
EIYELPFYGRVKMASAKNLQLIL

SEQ ID NO: 3257304 - protein, 29 aa, Plasmodium falciparum
EIYFKNIRWPSIKLVDIFYKQKNRFHNLI

SEQ ID NO: 3257305 - protein, 24 aa, Plasmodium falciparum
EIYKKKLIWLLGILLSVVIDPIFT

SEQ ID NO: 3257306 - protein, 18 aa, Plasmodium falciparum
EIYLKYSTLYFFVIILPH

SEQ ID NO: 3257307 - protein, 18 aa, Plasmodium falciparum
EIYNFLPNRVYRNQKNSE

SEQ ID NO: 3257308 - protein, 21 aa, Plasmodium falciparum
EIYPFLNYISFKWERDFKPFD

SEQ ID NO: 3257309 - protein, 21 aa, Plasmodium falciparum
EIYRIIKEYVDYDSLIFFCNL

SEQ ID NO: 3257310 - protein, 19 aa, Plasmodium falciparum
EIYSHTLPWFALVDTVYKA

SEQ ID NO: 3257311 - protein, 20 aa, Plasmodium falciparum
EIYSIPFYPIYGNLGLKNVI

SEQ ID NO: 3257312 - protein, 23 aa, Plasmodium falciparum
EIYSYHFCLYMLFFTLYNVLHKY

SEQ ID NO: 3257313 - protein, 18 aa, Plasmodium falciparum
EIYTPSFILMKWLILHVQ

SEQ ID NO: 3257314 - protein, 24 aa, Plasmodium falciparum
EKACLRCGGILGGGLEPTVGLLGT

SEQ ID NO: 3257315 - protein, 17 aa, Plasmodium falciparum
EKADIYSAALILLELLC

SEQ ID NO: 3257316 - protein, 27 aa, Plasmodium falciparum
EKAIDHYTSHDWFRLLRQGNKAQNSIS

SEQ ID NO: 3257317 - protein, 18 aa, Plasmodium falciparum
EKAIKFFKKNNTYFNAKG

SEQ ID NO: 3257318 - protein, 30 aa, Plasmodium falciparum
EKAIKSAESMFKKMQLEVEANYMVDDKENE

SEQ ID NO: 3257319 - protein, 26 aa, Plasmodium falciparum
EKAKHIPFYNCLNICLLVFHEDVDIL

SEQ ID NO: 3257320 - protein, 21 aa, Plasmodium falciparum
EKAKKMFFRNLDFNSSLEVLK

SEQ ID NO: 3257321 - protein, 18 aa, Plasmodium falciparum
EKAPEPKKEKAPAPKKEK

SEQ ID NO: 3257322 - protein, 20 aa, Plasmodium falciparum
EKCIKSSCNCMKKVTEISNY

SEQ ID NO: 3257323 - protein, 22 aa, Plasmodium falciparum
EKCINFPYLFLSILHIKIKLSY

SEQ ID NO: 3257324 - protein, 25 aa, Plasmodium falciparum
EKCINKLKRNILFRNLLEKNNDMLD

SEQ ID NO: 3257325 - protein, 19 aa, Plasmodium falciparum
EKCLAKFKNGFTCFYCGLF

SEQ ID NO: 3257326 - protein, 23 aa, Plasmodium falciparum
EKCNEEKEIYCGDNTNFNVTNNH

SEQ ID NO: 3257327 - protein, 34 aa, Plasmodium falciparum
EKDDFFFEQLIFYKIIYAYILLEYGILSQAQRYV

SEQ ID NO: 3257328 - protein, 26 aa, Plasmodium falciparum
EKDDQECLLRFIGTYNICNSLIPITL

SEQ ID NO: 3257329 - protein, 24 aa, Plasmodium falciparum
EKDEKFIICLFDIYTSKSIHYNIR

SEQ ID NO: 3257330 - protein, 21 aa, Plasmodium falciparum
EKDHIPSLRCHELKYKSKDEI

SEQ ID NO: 3257331 - protein, 26 aa, Plasmodium falciparum
EKDIEWKIYQILTWKYWNLKEFPGVD

SEQ ID NO: 3257332 - protein, 18 aa, Plasmodium falciparum
EKDIKGAISTYFSNSGTT

SEQ ID NO: 3257333 - protein, 23 aa, Plasmodium falciparum
EKDILLDYIRFMDDCNVKYEQNN

SEQ ID NO: 3257334 - protein, 18 aa, Plasmodium falciparum
EKDMKYLLSNIIYVYDKN

SEQ ID NO: 3257335 - protein, 23 aa, Plasmodium falciparum
EKECLRCGGVFGGGVAPSVGLLG

SEQ ID NO: 3257336 - protein, 22 aa, Plasmodium falciparum
EKEFALIYVFYLLIESLKYINQ

SEQ ID NO: 3257337 - protein, 21 aa, Plasmodium falciparum
EKEFFKKKLLVICELRDHNNN

SEQ ID NO: 3257338 - protein, 22 aa, Plasmodium falciparum
EKEFGVSILRVHRFESFIDVEN

SEQ ID NO: 3257339 - protein, 21 aa, Plasmodium falciparum
EKEGFKDVIIFETDDNNIYNY

SEQ ID NO: 3257340 - protein, 26 aa, Plasmodium falciparum
EKEINLKILISCFMSKYAYEYLMLIN

SEQ ID NO: 3257341 - protein, 23 aa, Plasmodium falciparum
EKEIRSGQYYKDFITSRKNIYNI

SEQ ID NO: 3257342 - protein, 23 aa, Plasmodium falciparum
EKEIYEIGKVFDFHIKNESIYFK

SEQ ID NO: 3257343 - protein, 24 aa, Plasmodium falciparum
EKEKDKWVFVEGYDYTNSVIEEEN

SEQ ID NO: 3257344 - protein, 22 aa, Plasmodium falciparum
EKEKFIKSLFHIFDGDNEILQI

SEQ ID NO: 3257345 - protein, 24 aa, Plasmodium falciparum
EKEKKIGGLFCLFNYIKNKNITYY

SEQ ID NO: 3257346 - protein, 22 aa, Plasmodium falciparum
EKEKKVQICINIQNNTNIDLKE

SEQ ID NO: 3257347 - protein, 23 aa, Plasmodium falciparum
EKEKSECLYLCCDIDITKQIMNE

SEQ ID NO: 3257348 - protein, 20 aa, Plasmodium falciparum
EKENFCTFFLENLYDPLNIL

SEQ ID NO: 3257349 - protein, 27 aa, Plasmodium falciparum
EKEPVPKLKLFDLDTYKNMSLDTMLNN

SEQ ID NO: 3257350 - protein, 20 aa, Plasmodium falciparum
EKEQIDFLKAFIFKMKVYGS

SEQ ID NO: 3257351 - protein, 31 aa, Plasmodium falciparum
EKETKVYFHFDIKIIREIIIQILGVDKLPLI

SEQ ID NO: 3257352 - protein, 19 aa, Plasmodium falciparum
EKEVVPFTIGLASNLEISE

SEQ ID NO: 3257353 - protein, 22 aa, Plasmodium falciparum
EKEYPGYQCFFLQTSSDKIKPV

SEQ ID NO: 3257354 - protein, 22 aa, Plasmodium falciparum
EKFCLNCGVNVGGGITLSSGVL

SEQ ID NO: 3257355 - protein, 22 aa, Plasmodium falciparum
EKFIMQKLYFYLYRMNPNDKDD

SEQ ID NO: 3257356 - protein, 17 aa, Plasmodium falciparum
EKFKEKLILAAQKEGSL

SEQ ID NO: 3257357 - protein, 17 aa, Plasmodium falciparum
EKFKRNILRKNNYGYNK

SEQ ID NO: 3257358 - protein, 18 aa, Plasmodium falciparum
EKFLKNKEIYVISTNKLN

SEQ ID NO: 3257359 - protein, 26 aa, Plasmodium falciparum
EKFSKGLCCLFDILLRNLIYNLYYAF

SEQ ID NO: 3257360 - protein, 35 aa, Plasmodium falciparum
EKFSYSLSCAIISRSVLKWKWFKITDTYERLESIT

SEQ ID NO: 3257361 - protein, 26 aa, Plasmodium falciparum
EKFVLYFKFFYRGIINKSEYYFKEEI

SEQ ID NO: 3257362 - protein, 24 aa, Plasmodium falciparum
EKGCLKCGCGLAGVATSVSIIGPI

SEQ ID NO: 3257363 - protein, 24 aa, Plasmodium falciparum
EKGCLKCGCGLGGVAASIGIFGTI

SEQ ID NO: 3257364 - protein, 23 aa, Plasmodium falciparum
EKGCLRCAGVFSGGVAPSVGLLG

SEQ ID NO: 3257365 - protein, 17 aa, Plasmodium falciparum
EKGCLRCGCALGGVAAS

SEQ ID NO: 3257366 - protein, 23 aa, Plasmodium falciparum
EKGCLRCGCALGGVAASVGLFGG

SEQ ID NO: 3257367 - protein, 24 aa, Plasmodium falciparum
EKGCLRCGCALGGVAASVGLFGGL

SEQ ID NO: 3257368 - protein, 23 aa, Plasmodium falciparum
EKGCLRCGGVFGGGVAPGVGLLG

SEQ ID NO: 3257369 - protein, 19 aa, Plasmodium falciparum
EKGCLRCGRNLGVAVPGLG

SEQ ID NO: 3257370 - protein, 23 aa, Plasmodium falciparum
EKGCLRCGSILGAAMPELGSVGG

SEQ ID NO: 3257371 - protein, 23 aa, Plasmodium falciparum
EKGCLRCGSILGAAMPEVGSIGG

SEQ ID NO: 3257372 - protein, 23 aa, Plasmodium falciparum
EKGIKRKNYLFLILEKAKEIPPG

SEQ ID NO: 3257373 - protein, 32 aa, Plasmodium falciparum
EKGISGEHLYEWRNGHINRRDDKIIYKKEKHE

SEQ ID NO: 3257374 - protein, 18 aa, Plasmodium falciparum
EKGKKYFFFINIIVYCIL

SEQ ID NO: 3257375 - protein, 22 aa, Plasmodium falciparum
EKGKYLFLRKCINLNRYKNKII

SEQ ID NO: 3257376 - protein, 25 aa, Plasmodium falciparum
EKGNILSIRTCDKVFLFKVNYKYNI

SEQ ID NO: 3257377 - protein, 19 aa, Plasmodium falciparum
EKGNKFFLNDDFVEKMNEK

SEQ ID NO: 3257378 - protein, 25 aa, Plasmodium falciparum
EKGQEFKSYYSFFYGSIIDMLKDSV

SEQ ID NO: 3257379 - protein, 21 aa, Plasmodium falciparum
EKHKKKKCFLLPKKKLRKRKE

SEQ ID NO: 3257380 - protein, 25 aa, Plasmodium falciparum
EKHLELRKDWWFANRDKVWEAMKCE

SEQ ID NO: 3257381 - protein, 19 aa, Plasmodium falciparum
EKHNILALHYHKKKNILVI

SEQ ID NO: 3257382 - protein, 17 aa, Plasmodium falciparum
EKHSKLGPYIILNTDSY

SEQ ID NO: 3257383 - protein, 28 aa, Plasmodium falciparum
EKIDIWSAACCIVEIFSSKYPYYNLTKN

SEQ ID NO: 3257384 - protein, 37 aa, Plasmodium falciparum
EKIEGRTTYYIWYENMFSFSLYFFLRPYIKKKHILID

SEQ ID NO: 3257385 - protein, 25 aa, Plasmodium falciparum
EKIFFCFPDPHFKRHNWRRRIITIE

SEQ ID NO: 3257386 - protein, 17 aa, Plasmodium falciparum
EKIFGCLTILIEKGVDI

SEQ ID NO: 3257387 - protein, 26 aa, Plasmodium falciparum
EKIFLQLRATYIFSITLREQNFFFSI

SEQ ID NO: 3257388 - protein, 17 aa, Plasmodium falciparum
EKIFNLYIKCSEQQNII

SEQ ID NO: 3257389 - protein, 24 aa, Plasmodium falciparum
EKIGGDIFRLYLLSKMLKQKTKRK

SEQ ID NO: 3257390 - protein, 17 aa, Plasmodium falciparum
EKIHFLRDILSKALKIE

SEQ ID NO: 3257391 - protein, 22 aa, Plasmodium falciparum
EKIHFYDWNNNYFSRGNVSYLK

SEQ ID NO: 3257392 - protein, 20 aa, Plasmodium falciparum
EKIHLLKSFIQFLIIKEIKE

SEQ ID NO: 3257393 - protein, 19 aa, Plasmodium falciparum
EKIIFLKELYNFIINSILM

SEQ ID NO: 3257394 - protein, 18 aa, Plasmodium falciparum
EKIIKKVVPILSFEILDV

SEQ ID NO: 3257395 - protein, 18 aa, Plasmodium falciparum
EKIIKRYIFNNVMNTNRT

SEQ ID NO: 3257396 - protein, 27 aa, Plasmodium falciparum
EKIIRMFPNYDIRLILVDVYPDDLIKY

SEQ ID NO: 3257397 - protein, 18 aa, Plasmodium falciparum
EKIKEAILEKAKKESNKW

SEQ ID NO: 3257398 - protein, 25 aa, Plasmodium falciparum
EKIKEKNCICVLCKEGMSKNNLLAY

SEQ ID NO: 3257399 - protein, 23 aa, Plasmodium falciparum
EKIKELYIPKGHILFNSKFESGN

SEQ ID NO: 3257400 - protein, 25 aa, Plasmodium falciparum
EKIKFCKFLLFILYGLLCFSINLYV

SEQ ID NO: 3257401 - protein, 24 aa, Plasmodium falciparum
EKIKGLRLVYASLHYKYKNNNDYK

SEQ ID NO: 3257402 - protein, 23 aa, Plasmodium falciparum
EKIKNYKARYIVKRAEKNSRVDD

SEQ ID NO: 3257403 - protein, 20 aa, Plasmodium falciparum
EKIKRIHHVILTRKGNVNCN

SEQ ID NO: 3257404 - protein, 23 aa, Plasmodium falciparum
EKILIERYYCKMIHSNKNIKDVI

SEQ ID NO: 3257405 - protein, 24 aa, Plasmodium falciparum
EKINKKIGNKMIIKNSMNKNSFMN

SEQ ID NO: 3257406 - protein, 30 aa, Plasmodium falciparum
EKINKWILRMSMYFLNFKDVMFFKKKAIQF

SEQ ID NO: 3257407 - protein, 41 aa, Plasmodium falciparum
EKINQLEFVFCKMLNLCRLYINGILPFVFTKINTVHYGILS

SEQ ID NO: 3257408 - protein, 19 aa, Plasmodium falciparum
EKIPVCSPKEYFTNITKEY

SEQ ID NO: 3257409 - protein, 23 aa, Plasmodium falciparum
EKIQYYFTEILRIIISCINDADS

SEQ ID NO: 3257410 - protein, 18 aa, Plasmodium falciparum
EKIVPMEVVEELLPEVVE

SEQ ID NO: 3257411 - protein, 22 aa, Plasmodium falciparum
EKIYFLLHCCFMNKENYFAIYF

SEQ ID NO: 3257412 - protein, 25 aa, Plasmodium falciparum
EKKEGAKCKITILSKTLFVLQNFID

SEQ ID NO: 3257413 - protein, 52 aa, Plasmodium falciparum
EKKEKKYAYSNTFKYAGATVLAGLFVLLASVLVFKKVKGFTYKNNDYTNDLQ

SEQ ID NO: 3257414 - protein, 25 aa, Plasmodium falciparum
EKKFKKYLCQCCKHKINHNVLFNTN

SEQ ID NO: 3257415 - protein, 20 aa, Plasmodium falciparum
EKKGNIGIIYDCSYVCQPYK

SEQ ID NO: 3257416 - protein, 26 aa, Plasmodium falciparum
EKKIFKKKLNNIYNRHFICEYKDLII

SEQ ID NO: 3257417 - protein, 21 aa, Plasmodium falciparum
EKKIIFDLFEQFFSQIISLQM

SEQ ID NO: 3257418 - protein, 19 aa, Plasmodium falciparum
EKKINYFLDNIKKYNDTYT

SEQ ID NO: 3257419 - protein, 24 aa, Plasmodium falciparum
EKKISMFFYTFLILYISHVRIFYD

SEQ ID NO: 3257420 - protein, 18 aa, Plasmodium falciparum
EKKKECIEHIIVHHYYKK

SEQ ID NO: 3257421 - protein, 28 aa, Plasmodium falciparum
EKKKICVMLKNYIDHVLFNECKELFVEE

SEQ ID NO: 3257422 - protein, 19 aa, Plasmodium falciparum
EKKKIIISNLLKIQEVKKG

SEQ ID NO: 3257423 - protein, 28 aa, Plasmodium falciparum
EKKKIKSCIFKKLFDFGVKDEDILYFLF

SEQ ID NO: 3257424 - protein, 27 aa, Plasmodium falciparum
EKKKKECIPCPFGNYCIYNPKVKYKAD

SEQ ID NO: 3257425 - protein, 19 aa, Plasmodium falciparum
EKKKKGFFFFKGGNNNNKI

SEQ ID NO: 3257426 - protein, 28 aa, Plasmodium falciparum
EKKKKIYICTSLLLKIFKRIIKKKSNSY

SEQ ID NO: 3257427 - protein, 25 aa, Plasmodium falciparum
EKKKLYELIKFFSFSEGGFQNNKLR

SEQ ID NO: 3257428 - protein, 21 aa, Plasmodium falciparum
EKKKSIDILKIKNIKQKNIQE

SEQ ID NO: 3257429 - protein, 23 aa, Plasmodium falciparum
EKKLKSLNVYKIIHNINKETTYN

SEQ ID NO: 3257430 - protein, 19 aa, Plasmodium falciparum
EKKMFRFFFFKTSEKNDTL

SEQ ID NO: 3257431 - protein, 22 aa, Plasmodium falciparum
EKKMSIYDWYYYYNIMTNKIDE

SEQ ID NO: 3257432 - protein, 26 aa, Plasmodium falciparum
EKKMTIRTGYHFKFNINKKSIHNRNY

SEQ ID NO: 3257433 - protein, 21 aa, Plasmodium falciparum
EKKNFFFFINFMYLQHKLCIS

SEQ ID NO: 3257434 - protein, 25 aa, Plasmodium falciparum
EKKNIKCEIFFKLYLNISTEYILKI

SEQ ID NO: 3257435 - protein, 25 aa, Plasmodium falciparum
EKKNRIKVAIVGAGMAGLSAAYILK

SEQ ID NO: 3257436 - protein, 26 aa, Plasmodium falciparum
EKKNVYCLKFIFVLNNVCDLDKRNND

SEQ ID NO: 3257437 - protein, 22 aa, Plasmodium falciparum
EKKRGGSLFIFIVFFVLSFIYI

SEQ ID NO: 3257438 - protein, 19 aa, Plasmodium falciparum
EKKRSDVCLKNNKDNIIIE

SEQ ID NO: 3257439 - protein, 20 aa, Plasmodium falciparum
EKKSIWFFTGYARNIFQPNS

SEQ ID NO: 3257440 - protein, 18 aa, Plasmodium falciparum
EKKSLGNNFLYIFDTNIK

SEQ ID NO: 3257441 - protein, 29 aa, Plasmodium falciparum
EKKSSVLYKDFKEFILVLINIRKYEKALK

SEQ ID NO: 3257442 - protein, 26 aa, Plasmodium falciparum
EKKVLIKKKMDGVLCDELPQECIDNM

SEQ ID NO: 3257443 - protein, 24 aa, Plasmodium falciparum
EKKYKEKLHIIDLISKKNLYKQIN

SEQ ID NO: 3257444 - protein, 24 aa, Plasmodium falciparum
EKLCTAAYWGIPWHVIVYYENIMN

SEQ ID NO: 3257445 - protein, 24 aa, Plasmodium falciparum
EKLDIYPCIYYIFNEKIYFLKFSK

SEQ ID NO: 3257446 - protein, 19 aa, Plasmodium falciparum
EKLDKCLKNGTKILCKNGC

SEQ ID NO: 3257447 - protein, 21 aa, Plasmodium falciparum
EKLERRKVSFASTKELCLLND

SEQ ID NO: 3257448 - protein, 18 aa, Plasmodium falciparum
EKLFYIKIGVFFVILIIV

SEQ ID NO: 3257449 - protein, 20 aa, Plasmodium falciparum
EKLGSLGYDSICLEKKLIDD

SEQ ID NO: 3257450 - protein, 18 aa, Plasmodium falciparum
EKLICLFLKKNLSLNNYT

SEQ ID NO: 3257451 - protein, 21 aa, Plasmodium falciparum
EKLIHKFTFKKLCNSKAAFNN

SEQ ID NO: 3257452 - protein, 19 aa, Plasmodium falciparum
EKLIIYFLYFWNLIFTHGL

SEQ ID NO: 3257453 - protein, 18 aa, Plasmodium falciparum
EKLIKMYLLLSLLLMPFG

SEQ ID NO: 3257454 - protein, 24 aa, Plasmodium falciparum
EKLILKKYIKMFSIDDEVLNINEK

SEQ ID NO: 3257455 - protein, 20 aa, Plasmodium falciparum
EKLIQCPECNLHYRYSEAVI

SEQ ID NO: 3257456 - protein, 19 aa, Plasmodium falciparum
EKLKGCLKNGTKIKCKNGC

SEQ ID NO: 3257457 - protein, 17 aa, Plasmodium falciparum
EKLKKCKKCKYCKKCEN

SEQ ID NO: 3257458 - protein, 25 aa, Plasmodium falciparum
EKLKNKIVYFFEHIESIELNNIFCN

SEQ ID NO: 3257459 - protein, 24 aa, Plasmodium falciparum
EKLLNMIYYFIVLIISLCLKERKY

SEQ ID NO: 3257460 - protein, 29 aa, Plasmodium falciparum
EKLLNYPLIPVVIQRDIFKYFLQKLKHNS

SEQ ID NO: 3257461 - protein, 26 aa, Plasmodium falciparum
EKLLSNKYVYKWIHNRSPSFDYAQAE

SEQ ID NO: 3257462 - protein, 19 aa, Plasmodium falciparum
EKLNCIFIRPKKYISSNEE

SEQ ID NO: 3257463 - protein, 20 aa, Plasmodium falciparum
EKLNHLPLYYKDSSFYLFNN

SEQ ID NO: 3257464 - protein, 22 aa, Plasmodium falciparum
EKLNISCRFFIQESNPYELDIR

SEQ ID NO: 3257465 - protein, 24 aa, Plasmodium falciparum
EKLNKSCFYFLKNILNNCTCENKN

SEQ ID NO: 3257466 - protein, 19 aa, Plasmodium falciparum
EKLNMNVHLLIGGNNIKYQ

SEQ ID NO: 3257467 - protein, 37 aa, Plasmodium falciparum
EKLQKGLYLLVFRLEEAMLFIKYCDYDMDRIIRGSSS

SEQ ID NO: 3257468 - protein, 25 aa, Plasmodium falciparum
EKLVKGYDCHKCSVACDDFEPWIKN

SEQ ID NO: 3257469 - protein, 20 aa, Plasmodium falciparum
EKMFKEYLLRDASSEAKMLS

SEQ ID NO: 3257470 - protein, 20 aa, Plasmodium falciparum
EKMILIFKCDNKFYITKYGK

SEQ ID NO: 3257471 - protein, 30 aa, Plasmodium falciparum
EKMKNEKNIFVKEIKDMISSRPEKIEEENY

SEQ ID NO: 3257472 - protein, 24 aa, Plasmodium falciparum
EKMKSESKFAFVNYLKDFFQNSPY

SEQ ID NO: 3257473 - protein, 21 aa, Plasmodium falciparum
EKMLIMFQHYFLKMDNNTFVE

SEQ ID NO: 3257474 - protein, 19 aa, Plasmodium falciparum
EKMMKCAKKSDVTNENCAS

SEQ ID NO: 3257475 - protein, 23 aa, Plasmodium falciparum
EKNCLKCGGDIRYGGTELSLLWG

SEQ ID NO: 3257476 - protein, 22 aa, Plasmodium falciparum
EKNCLKCGGIIGTAVPELALLG

SEQ ID NO: 3257477 - protein, 26 aa, Plasmodium falciparum
EKNEFLKLYIFYGQKNLPSMPYTPLF

SEQ ID NO: 3257478 - protein, 27 aa, Plasmodium falciparum
EKNEIYSMLHFSEKAIKFFKKNNTYFN

SEQ ID NO: 3257479 - protein, 21 aa, Plasmodium falciparum
EKNFKKSLCKTFLSYKFDEDT

SEQ ID NO: 3257480 - protein, 21 aa, Plasmodium falciparum
EKNFYLFSLLSNILYNNTSNC

SEQ ID NO: 3257481 - protein, 21 aa, Plasmodium falciparum
EKNICKHLILLTNYIVQDIFY

SEQ ID NO: 3257482 - protein, 21 aa, Plasmodium falciparum
EKNIEFPLVHFQAVTQVVKLE

SEQ ID NO: 3257483 - protein, 22 aa, Plasmodium falciparum
EKNIFFSVPFEFLKNCNYMKMI

SEQ ID NO: 3257484 - protein, 18 aa, Plasmodium falciparum
EKNIFTFNDFFKEIEELN

SEQ ID NO: 3257485 - protein, 24 aa, Plasmodium falciparum
EKNILTFFCDIYFNNHIIEIDGPK

SEQ ID NO: 3257486 - protein, 18 aa, Plasmodium falciparum
EKNIMKSGFNEMYDYNDY

SEQ ID NO: 3257487 - protein, 24 aa, Plasmodium falciparum
EKNIPFYIHINNLISMFGKFVEYF

SEQ ID NO: 3257488 - protein, 19 aa, Plasmodium falciparum
EKNKCKIKESEKSFKKEND

SEQ ID NO: 3257489 - protein, 18 aa, Plasmodium falciparum
EKNKICDNKNKFYNLDKK

SEQ ID NO: 3257490 - protein, 36 aa, Plasmodium falciparum
EKNKIIEMYIFFKRFKKVVISWKMYCKYKKERREDD

SEQ ID NO: 3257491 - protein, 27 aa, Plasmodium falciparum
EKNKYECIPFHLLLILLTILLYIDFLV

SEQ ID NO: 3257492 - protein, 20 aa, Plasmodium falciparum
EKNLKIITIYPHVSVVNAIP

SEQ ID NO: 3257493 - protein, 23 aa, Plasmodium falciparum
EKNLSYFFKMFFTTLYIISFKKK

SEQ ID NO: 3257494 - protein, 25 aa, Plasmodium falciparum
EKNMAIIICYICTEGNINSFFFRNY

SEQ ID NO: 3257495 - protein, 23 aa, Plasmodium falciparum
EKNMCKLFFDIFKNYDIIDNNSI

SEQ ID NO: 3257496 - protein, 37 aa, Plasmodium falciparum
EKNPPKLSDFVLRPPYFRYLEEWGETFCRQRARMLDK

SEQ ID NO: 3257497 - protein, 20 aa, Plasmodium falciparum
EKNVKTIPSYMNNLSDQHIS

SEQ ID NO: 3257498 - protein, 23 aa, Plasmodium falciparum
EKNVMLKNKWMYFLQKLLNQYIH

SEQ ID NO: 3257499 - protein, 20 aa, Plasmodium falciparum
EKNVRYFFFRSMKYVYNEEK

SEQ ID NO: 3257500 - protein, 20 aa, Plasmodium falciparum
EKNWTIGKNMIFLNEKSMNI

SEQ ID NO: 3257501 - protein, 20 aa, Plasmodium falciparum
EKNYLCIIEQKMGYLNINSL

SEQ ID NO: 3257502 - protein, 31 aa, Plasmodium falciparum
EKPIFKYLKCKKVDNVNIFFSYRLNNKNKRN

SEQ ID NO: 3257503 - protein, 28 aa, Plasmodium falciparum
EKPSCATPCGLYKRWIRRKKDEYNKQKS

SEQ ID NO: 3257504 - protein, 17 aa, Plasmodium falciparum
EKQFRDHKRKEALKQKT

SEQ ID NO: 3257505 - protein, 17 aa, Plasmodium falciparum
EKQHVMKIIKRMKNAME

SEQ ID NO: 3257506 - protein, 27 aa, Plasmodium falciparum
EKQHYSELILSMILFLVFIFYMFNEKN

SEQ ID NO: 3257507 - protein, 26 aa, Plasmodium falciparum
EKQKIMPFDAFFFLWLTQMLDDSIEW

SEQ ID NO: 3257508 - protein, 19 aa, Plasmodium falciparum
EKQLKELKIAIDNTNEEKD

SEQ ID NO: 3257509 - protein, 17 aa, Plasmodium falciparum
EKQNFLLGFSLSIPNDL

SEQ ID NO: 3257510 - protein, 22 aa, Plasmodium falciparum
EKQSLYLLVGIPFSTVGLILIT

SEQ ID NO: 3257511 - protein, 23 aa, Plasmodium falciparum
EKQSNWLVTFSFPDLLRGKTTQI

SEQ ID NO: 3257512 - protein, 18 aa, Plasmodium falciparum
EKRAYSYLINKTINNSDD

SEQ ID NO: 3257513 - protein, 23 aa, Plasmodium falciparum
EKREHICFSCGGDIQKNEPLEHS

SEQ ID NO: 3257514 - protein, 20 aa, Plasmodium falciparum
EKREHIDLDDFSKFGCDKNS

SEQ ID NO: 3257515 - protein, 20 aa, Plasmodium falciparum
EKRFGCKEYAYMVYPYLLLL

SEQ ID NO: 3257516 - protein, 23 aa, Plasmodium falciparum
EKRKEKIYSFESFKVECKKKDCD

SEQ ID NO: 3257517 - protein, 23 aa, Plasmodium falciparum
EKRKIHGSFNIFETFNKVENLVR

SEQ ID NO: 3257518 - protein, 25 aa, Plasmodium falciparum
EKRKKLKLILWIKIYMYVWEEVEKD

SEQ ID NO: 3257519 - protein, 19 aa, Plasmodium falciparum
EKRKRIYELAKIYTNNIFD

SEQ ID NO: 3257520 - protein, 19 aa, Plasmodium falciparum
EKRKTGILKKYEKFCKNSD

SEQ ID NO: 3257521 - protein, 18 aa, Plasmodium falciparum
EKRNMLFYKYHENRKRKA

SEQ ID NO: 3257522 - protein, 24 aa, Plasmodium falciparum
EKRREEMLLHIKLILYSIYVITPP

SEQ ID NO: 3257523 - protein, 17 aa, Plasmodium falciparum
EKSDWLISSILSLSHSD

SEQ ID NO: 3257524 - protein, 23 aa, Plasmodium falciparum
EKSEQRKGYLVAMTGDGVNDAPA

SEQ ID NO: 3257525 - protein, 21 aa, Plasmodium falciparum
EKSFFIEHLLLYFLYNRINTI

SEQ ID NO: 3257526 - protein, 30 aa, Plasmodium falciparum
EKSFQFVCFLYCFIILVPFFFILIIFLPWR

SEQ ID NO: 3257527 - protein, 18 aa, Plasmodium falciparum
EKSIFHYKFHIFKEKLKK

SEQ ID NO: 3257528 - protein, 20 aa, Plasmodium falciparum
EKSISPHSYQKVSTKVQNKE

SEQ ID NO: 3257529 - protein, 21 aa, Plasmodium falciparum
EKSKYLSLIHRLHKYYYNIKV

SEQ ID NO: 3257530 - protein, 18 aa, Plasmodium falciparum
EKSLGCNCAGRAENSKED

SEQ ID NO: 3257531 - protein, 19 aa, Plasmodium falciparum
EKSNIFWRNYYLFINQLTK

SEQ ID NO: 3257532 - protein, 25 aa, Plasmodium falciparum
EKSVEKESYLSFDDYKILEKCISKC

SEQ ID NO: 3257533 - protein, 19 aa, Plasmodium falciparum
EKTAFLFGTIFPFFISCFF

SEQ ID NO: 3257534 - protein, 23 aa, Plasmodium falciparum
EKTCLKCGEILGTVVPELGLIGG

SEQ ID NO: 3257535 - protein, 24 aa, Plasmodium falciparum
EKTCLKCGGILGVGVTPSLGLLGE

SEQ ID NO: 3257536 - protein, 27 aa, Plasmodium falciparum
EKTCLKCGGLLGGGVAPGWGLISGLGY

SEQ ID NO: 3257537 - protein, 17 aa, Plasmodium falciparum
EKTETPRNCNIYKENMM

SEQ ID NO: 3257538 - protein, 22 aa, Plasmodium falciparum
EKTKLILFQTIKSILISHIPIE

SEQ ID NO: 3257539 - protein, 22 aa, Plasmodium falciparum
EKTKYMKTLREYFVKSEKEIED

SEQ ID NO: 3257540 - protein, 24 aa, Plasmodium falciparum
EKTRFASIKLKDLINILCGTHMFL

SEQ ID NO: 3257541 - protein, 19 aa, Plasmodium falciparum
EKTRNLCCAVSDYCMSYFT

SEQ ID NO: 3257542 - protein, 19 aa, Plasmodium falciparum
EKTRYIIVIINFLFTLMKT

SEQ ID NO: 3257543 - protein, 24 aa, Plasmodium falciparum
EKVCLKCAQNLGGIVAPSTGVLGE

SEQ ID NO: 3257544 - protein, 18 aa, Plasmodium falciparum
EKVHYIPYNVDIIPINAA

SEQ ID NO: 3257545 - protein, 23 aa, Plasmodium falciparum
EKVKELLYELILLTNKLSIYRKK

SEQ ID NO: 3257546 - protein, 22 aa, Plasmodium falciparum
EKVKISTFFLNFLAECSGNETL

SEQ ID NO: 3257547 - protein, 23 aa, Plasmodium falciparum
EKVPKNDVCLFNISISIKNNHLH

SEQ ID NO: 3257548 - protein, 26 aa, Plasmodium falciparum
EKVQVCLKAFILLSIEKQCINKIIQK

SEQ ID NO: 3257549 - protein, 25 aa, Plasmodium falciparum
EKVYKDCFKCFGAKYKAMSLISHIN

SEQ ID NO: 3257550 - protein, 24 aa, Plasmodium falciparum
EKWWKNHGPSIWNGMLCGLSYDTK

SEQ ID NO: 3257551 - protein, 17 aa, Plasmodium falciparum
EKWYISWMDEFNKNIIC

SEQ ID NO: 3257552 - protein, 18 aa, Plasmodium falciparum
EKWYLFWKEEEINNSHNK

SEQ ID NO: 3257553 - protein, 24 aa, Plasmodium falciparum
EKYCHRCINIRKLIKYEKYNNLKS

SEQ ID NO: 3257554 - protein, 18 aa, Plasmodium falciparum
EKYECLFPIDLSFLRDDI

SEQ ID NO: 3257555 - protein, 20 aa, Plasmodium falciparum
EKYEEKLFKLLHEIKENQEM

SEQ ID NO: 3257556 - protein, 29 aa, Plasmodium falciparum
EKYFFDISFFKRSCLFMFLDEHANKKNHV

SEQ ID NO: 3257557 - protein, 26 aa, Plasmodium falciparum
EKYFKVSINVLNIWKKQLARNQRKEQ

SEQ ID NO: 3257558 - protein, 25 aa, Plasmodium falciparum
EKYFLEVLTCTRTCLLYDKNDQVIK

SEQ ID NO: 3257559 - protein, 24 aa, Plasmodium falciparum
EKYIKICYCFHFYYKNCKDTKNFL

SEQ ID NO: 3257560 - protein, 18 aa, Plasmodium falciparum
EKYIKVISILSLLNDHYK

SEQ ID NO: 3257561 - protein, 20 aa, Plasmodium falciparum
EKYKELPKVITTVKGKHTNN

SEQ ID NO: 3257562 - protein, 32 aa, Plasmodium falciparum
EKYLELKLNSVFYEWYDKKVICVEDFKRKIER

SEQ ID NO: 3257563 - protein, 35 aa, Plasmodium falciparum
EKYLKKLKCKFDYISYFFLNMENFMLWLYKHKISK

SEQ ID NO: 3257564 - protein, 23 aa, Plasmodium falciparum
EKYLKRKFYFAFFNYIKYKNRIH

SEQ ID NO: 3257565 - protein, 33 aa, Plasmodium falciparum
EKYLLLKQYIYKYIFNMLINIMLTIPYNEISFM

SEQ ID NO: 3257566 - protein, 25 aa, Plasmodium falciparum
EKYLNKSRISNILKCVNSFDKNVSV

SEQ ID NO: 3257567 - protein, 25 aa, Plasmodium falciparum
EKYLNVICCVLCIIHFINYFKYVKK

SEQ ID NO: 3257568 - protein, 20 aa, Plasmodium falciparum
EKYMLGIFFMWIWNEGHLWD

SEQ ID NO: 3257569 - protein, 18 aa, Plasmodium falciparum
EKYPIESPEVIFLGQPPI

SEQ ID NO: 3257570 - protein, 26 aa, Plasmodium falciparum
EKYRDVNVFKCSSNVPYKSRKYMKVS

SEQ ID NO: 3257571 - protein, 24 aa, Plasmodium falciparum
EKYRPDIFDIYSLIKKDITYIKDK

SEQ ID NO: 3257572 - protein, 22 aa, Plasmodium falciparum
EKYSIRYFFIIFFFFIFIAIKI

SEQ ID NO: 3257573 - protein, 19 aa, Plasmodium falciparum
EKYSLFGISGKYYKMQQKK

SEQ ID NO: 3257574 - protein, 24 aa, Plasmodium falciparum
EKYYFYKKLNIFQVNYYIKNFLSG

SEQ ID NO: 3257575 - protein, 18 aa, Plasmodium falciparum
ELARSFADIGDIIRGKDL

SEQ ID NO: 3257576 - protein, 20 aa, Plasmodium falciparum
ELCKIMKKKNDWIRSVDHVN

SEQ ID NO: 3257577 - protein, 19 aa, Plasmodium falciparum
ELCKIYHFEINKENNTFYI

SEQ ID NO: 3257578 - protein, 18 aa, Plasmodium falciparum
ELCNFDHTIYEAGNIIVP

SEQ ID NO: 3257579 - protein, 24 aa, Plasmodium falciparum
ELDAEIDKLLGLHGNRHITLFDDI

SEQ ID NO: 3257580 - protein, 26 aa, Plasmodium falciparum
ELDDAYICFFFLIFIDIYKFLTTGFN

SEQ ID NO: 3257581 - protein, 22 aa, Plasmodium falciparum
ELDDYFKFCMKFKKSNQNYDLY

SEQ ID NO: 3257582 - protein, 23 aa, Plasmodium falciparum
ELDGFPYIILLLSSFLWLVYGML

SEQ ID NO: 3257583 - protein, 23 aa, Plasmodium falciparum
ELDKFLLKLNELLSHNNNDIKDL

SEQ ID NO: 3257584 - protein, 19 aa, Plasmodium falciparum
ELDNLIGYLMYQKMIRKKL

SEQ ID NO: 3257585 - protein, 20 aa, Plasmodium falciparum
ELDVLKKLVFGYRKPLDNIK

SEQ ID NO: 3257586 - protein, 17 aa, Plasmodium falciparum
ELEKVKAVIKIKDKLVI

SEQ ID NO: 3257587 - protein, 25 aa, Plasmodium falciparum
ELFFIKAEYVPFFFIIQNILLYNEF

SEQ ID NO: 3257588 - protein, 21 aa, Plasmodium falciparum
ELFFPLMEHLYMYKKKLLINK

SEQ ID NO: 3257589 - protein, 17 aa, Plasmodium falciparum
ELFKEYLNDIINLRNSK

SEQ ID NO: 3257590 - protein, 31 aa, Plasmodium falciparum
ELFSCPNYMKYIKYFIQYYFELINTKNIVDR

SEQ ID NO: 3257591 - protein, 19 aa, Plasmodium falciparum
ELFYFKSYENDLCFDTFDV

SEQ ID NO: 3257592 - protein, 17 aa, Plasmodium falciparum
ELGDKKLDCGIHPEKRL

SEQ ID NO: 3257593 - protein, 37 aa, Plasmodium falciparum
ELGFLRDARRLNVMLTRAKRGVILFGDQFTLANDPAN

SEQ ID NO: 3257594 - protein, 19 aa, Plasmodium falciparum
ELGINFDLISKRMKSVFLF

SEQ ID NO: 3257595 - protein, 19 aa, Plasmodium falciparum
ELGLSAWKTTALKTAIAAA

SEQ ID NO: 3257596 - protein, 42 aa, Plasmodium falciparum
ELHEAQSLKTILIFEIEILFNYFKINVFDYYNKCNIIKSRNL

SEQ ID NO: 3257597 - protein, 34 aa, Plasmodium falciparum
ELHSYYIKTCLNIFKSFFHEYFYLSFINKMEIKK

SEQ ID NO: 3257598 - protein, 19 aa, Plasmodium falciparum
ELHVYGSLLKHDDFKDELN

SEQ ID NO: 3257599 - protein, 18 aa, Plasmodium falciparum
ELIAEFAPEELFEKVIPE

SEQ ID NO: 3257600 - protein, 30 aa, Plasmodium falciparum
ELIELPLKYPEIFMSIGISAPKGVLMHGIP

SEQ ID NO: 3257601 - protein, 23 aa, Plasmodium falciparum
ELIFHCLKIYFTDIKYEEVDVMK

SEQ ID NO: 3257602 - protein, 21 aa, Plasmodium falciparum
ELIICAICLNELDALNLNKEL

SEQ ID NO: 3257603 - protein, 17 aa, Plasmodium falciparum
ELIILLLFICYFLDGIG

SEQ ID NO: 3257604 - protein, 17 aa, Plasmodium falciparum
ELINFFFNDNILLNENN

SEQ ID NO: 3257605 - protein, 20 aa, Plasmodium falciparum
ELINLLKYIFETICYINIST

SEQ ID NO: 3257606 - protein, 20 aa, Plasmodium falciparum
ELIRGVHIFCRMSPKNKEII

SEQ ID NO: 3257607 - protein, 17 aa, Plasmodium falciparum
ELIRTCLKIIKNNHEEF

SEQ ID NO: 3257608 - protein, 17 aa, Plasmodium falciparum
ELIYYKKLITFFKKCYK

SEQ ID NO: 3257609 - protein, 20 aa, Plasmodium falciparum
ELIYYKMILEMYKMREKRAD

SEQ ID NO: 3257610 - protein, 20 aa, Plasmodium falciparum
ELKAKLEISDKWEGITLTKT

SEQ ID NO: 3257611 - protein, 31 aa, Plasmodium falciparum
ELKDNIKCEENVSFNILRRSNKKDQLPLEEK

SEQ ID NO: 3257612 - protein, 22 aa, Plasmodium falciparum
ELKEKKEEITLENKDKQEEIKQ

SEQ ID NO: 3257613 - protein, 23 aa, Plasmodium falciparum
ELKGNPNIEWTFFINEKKNPLNC

SEQ ID NO: 3257614 - protein, 19 aa, Plasmodium falciparum
ELKIYNMTCDNCGKKIINF

SEQ ID NO: 3257615 - protein, 20 aa, Plasmodium falciparum
ELKKDSCPFILLNHKNAHIV

SEQ ID NO: 3257616 - protein, 31 aa, Plasmodium falciparum
ELKRIPYRYSSDFKSFHMFEYFRKNNNNVIV

SEQ ID NO: 3257617 - protein, 24 aa, Plasmodium falciparum
ELKRKIFCSLFFLLCSKMAIIYTP

SEQ ID NO: 3257618 - protein, 34 aa, Plasmodium falciparum
ELKVIKKYACVEFFKMLFLVSLFLITSYYSFIYI

SEQ ID NO: 3257619 - protein, 20 aa, Plasmodium falciparum
ELLAYLPFHCNFFLMIKKKM

SEQ ID NO: 3257620 - protein, 18 aa, Plasmodium falciparum
ELLDCLLYNINIHKTNIN

SEQ ID NO: 3257621 - protein, 18 aa, Plasmodium falciparum
ELLEKSSMYDLINKSKKV

SEQ ID NO: 3257622 - protein, 24 aa, Plasmodium falciparum
ELLFSSSYLSHFFILQRNTYTFST

SEQ ID NO: 3257623 - protein, 24 aa, Plasmodium falciparum
ELLIIRIYLCIKKYLNQNELTAIN

SEQ ID NO: 3257624 - protein, 17 aa, Plasmodium falciparum
ELLIKNDVFPLLVDIFQ

SEQ ID NO: 3257625 - protein, 21 aa, Plasmodium falciparum
ELLISLFDICFLNIDHICKNI

SEQ ID NO: 3257626 - protein, 21 aa, Plasmodium falciparum
ELLKKLKLLFKDNLNINSEWH

SEQ ID NO: 3257627 - protein, 30 aa, Plasmodium falciparum
ELLKRYGEKDVKEYFNLFFRPENVNFFVYG

SEQ ID NO: 3257628 - protein, 18 aa, Plasmodium falciparum
ELLLCSWDNIKPSNISYI

SEQ ID NO: 3257629 - protein, 20 aa, Plasmodium falciparum
ELLLNFMLISLCYYSDSLIF

SEQ ID NO: 3257630 - protein, 25 aa, Plasmodium falciparum
ELLNAFDFHVLEFIKKSIKNNEDYK

SEQ ID NO: 3257631 - protein, 22 aa, Plasmodium falciparum
ELLNEYKFSLNLLNDTKNKLDT

SEQ ID NO: 3257632 - protein, 25 aa, Plasmodium falciparum
ELLNKKMKPFYCNNKNKNKNKNKNK

SEQ ID NO: 3257633 - protein, 28 aa, Plasmodium falciparum
ELLPCADEVLPLLIYVIIKTNPPEIISN

SEQ ID NO: 3257634 - protein, 27 aa, Plasmodium falciparum
ELLRKRKINFDNEICPYKMNYWNNYNN

SEQ ID NO: 3257635 - protein, 19 aa, Plasmodium falciparum
ELLSRAEFYFEYTSDAASR

SEQ ID NO: 3257636 - protein, 17 aa, Plasmodium falciparum
ELLSSIFPYCKLDLQLK

SEQ ID NO: 3257637 - protein, 21 aa, Plasmodium falciparum
ELLYFLKYHKYVHFNTLRIIF

SEQ ID NO: 3257638 - protein, 22 aa, Plasmodium falciparum
ELLYKLNFYFDLLRAKLNDVCA

SEQ ID NO: 3257639 - protein, 25 aa, Plasmodium falciparum
ELNFIKCLGIQILSHLYKEGFIQSS

SEQ ID NO: 3257640 - protein, 45 aa, Plasmodium falciparum
ELNKDSCDYSEEKENIKSMINAYLDKLDLETVRKIHSDISTCIEK

SEQ ID NO: 3257641 - protein, 17 aa, Plasmodium falciparum
ELNKLFLQEKMKKDKKK

SEQ ID NO: 3257642 - protein, 24 aa, Plasmodium falciparum
ELNMLKRICDLQHKELKIAFTSLT

SEQ ID NO: 3257643 - protein, 19 aa, Plasmodium falciparum
ELNNLFVLNIYFPVIKFAI

SEQ ID NO: 3257644 - protein, 20 aa, Plasmodium falciparum
ELNPFFFYISRYMWDMLSFY

SEQ ID NO: 3257645 - protein, 28 aa, Plasmodium falciparum
ELNTPIHIYYYFSWININWNFNFLDNIL

SEQ ID NO: 3257646 - protein, 43 aa, Plasmodium falciparum
ELNVDKIDLILSFKQFYYILDIVNYYFIYSCLVNGLCIEEWLN

SEQ ID NO: 3257647 - protein, 21 aa, Plasmodium falciparum
ELPDDIELLSFFIRKKLVRHN

SEQ ID NO: 3257648 - protein, 27 aa, Plasmodium falciparum
ELPENLKNLFRSCSMIVPDIKFICENM

SEQ ID NO: 3257649 - protein, 20 aa, Plasmodium falciparum
ELPESSKLYSDEEIIKNKKL

SEQ ID NO: 3257650 - protein, 23 aa, Plasmodium falciparum
ELQNSMCADHCSSVWKVISSFAL

SEQ ID NO: 3257651 - protein, 20 aa, Plasmodium falciparum
ELREGIIHLIEYYNEKCNMK

SEQ ID NO: 3257652 - protein, 23 aa, Plasmodium falciparum
ELRERYCSLVELLGDINLFHSYE

SEQ ID NO: 3257653 - protein, 17 aa, Plasmodium falciparum
ELRRKVKHIKNINNMEI

SEQ ID NO: 3257654 - protein, 28 aa, Plasmodium falciparum
ELSCYSESFLFLYRIFKIKKAFLESYKL

SEQ ID NO: 3257655 - protein, 18 aa, Plasmodium falciparum
ELSEFKVLVSAGRYSWRN

SEQ ID NO: 3257656 - protein, 25 aa, Plasmodium falciparum
ELSHYILLKLCLTFMDFEPFYVEIK

SEQ ID NO: 3257657 - protein, 34 aa, Plasmodium falciparum
ELSLDGWVKCELAGCLEAVIFIHGYNTSHLEALQ

SEQ ID NO: 3257658 - protein, 20 aa, Plasmodium falciparum
ELSMWFFKNNINIIKIIKSW

SEQ ID NO: 3257659 - protein, 25 aa, Plasmodium falciparum
ELSYSINYFNGFLFSKMARYKYFHK

SEQ ID NO: 3257660 - protein, 18 aa, Plasmodium falciparum
ELTDIFRLLCKMDSADML

SEQ ID NO: 3257661 - protein, 18 aa, Plasmodium falciparum
ELTEKFGALQTDIRTEDI

SEQ ID NO: 3257662 - protein, 18 aa, Plasmodium falciparum
ELTILIIIKIILNSSNLS

SEQ ID NO: 3257663 - protein, 19 aa, Plasmodium falciparum
ELTYDSSFEFISYEKYFAG

SEQ ID NO: 3257664 - protein, 24 aa, Plasmodium falciparum
ELVDIIRYLSAFNFINKELFSFVY

SEQ ID NO: 3257665 - protein, 25 aa, Plasmodium falciparum
ELVHCKYCNMCVHKNCYLVDSSYLE

SEQ ID NO: 3257666 - protein, 22 aa, Plasmodium falciparum
ELVKLFKYYMEIYIDNFSGNPL

SEQ ID NO: 3257667 - protein, 17 aa, Plasmodium falciparum
ELVKYIICKKCTNLTIL

SEQ ID NO: 3257668 - protein, 20 aa, Plasmodium falciparum
ELVLDFIIHHVFKPPYDACK

SEQ ID NO: 3257669 - protein, 35 aa, Plasmodium falciparum
ELVMSDFDFSFSLTEEIIFLYKIYLIELKKKNILH

SEQ ID NO: 3257670 - protein, 20 aa, Plasmodium falciparum
ELYATMSWAYAFVYNETLNK

SEQ ID NO: 3257671 - protein, 22 aa, Plasmodium falciparum
ELYDEWKCYQIGELTKDGQEGM

SEQ ID NO: 3257672 - protein, 19 aa, Plasmodium falciparum
ELYDTCCDYLLLTRNKDIT

SEQ ID NO: 3257673 - protein, 24 aa, Plasmodium falciparum
ELYKLGIQCDNHLITTISVVVNKN

SEQ ID NO: 3257674 - protein, 26 aa, Plasmodium falciparum
ELYLSDSLFYYELLINMIIYQNLNYE

SEQ ID NO: 3257675 - protein, 23 aa, Plasmodium falciparum
ELYLVKFYCDIILNKNNEMNIII

SEQ ID NO: 3257676 - protein, 25 aa, Plasmodium falciparum
ELYQEWKCYKGDDVVKVENKDEEED

SEQ ID NO: 3257677 - protein, 24 aa, Plasmodium falciparum
ELYTHICYPHIFRKIIVSCNNSLL

SEQ ID NO: 3257678 - protein, 18 aa, Plasmodium falciparum
ELYTLPFSFDKFINEYNY

SEQ ID NO: 3257679 - protein, 18 aa, Plasmodium falciparum
ELYVDSCLVATGRNPNTQ

SEQ ID NO: 3257680 - protein, 20 aa, Plasmodium falciparum
EMAKKIKMESFIFTNSNEED

SEQ ID NO: 3257681 - protein, 18 aa, Plasmodium falciparum
EMERACTLFLNMKNDELN

SEQ ID NO: 3257682 - protein, 17 aa, Plasmodium falciparum
EMGMFKKIFYRIKKIIV

SEQ ID NO: 3257683 - protein, 17 aa, Plasmodium falciparum
EMINLLIHKFLFYIIIF

SEQ ID NO: 3257684 - protein, 25 aa, Plasmodium falciparum
EMISFCMIAKIPPYLGLQGASFLSL

SEQ ID NO: 3257685 - protein, 18 aa, Plasmodium falciparum
EMKEKKENMEILSQLLNY

SEQ ID NO: 3257686 - protein, 19 aa, Plasmodium falciparum
EMKHIHCMSMKHISLIIYN

SEQ ID NO: 3257687 - protein, 18 aa, Plasmodium falciparum
EMKIGYCQKYYINSIPKK

SEQ ID NO: 3257688 - protein, 19 aa, Plasmodium falciparum
EMNCLSCIKIINVILEENK

SEQ ID NO: 3257689 - protein, 26 aa, Plasmodium falciparum
EMNNIFTYLFEWIVFIIKYKEHHKDM

SEQ ID NO: 3257690 - protein, 26 aa, Plasmodium falciparum
EMPVLKPRFVQRSDIYTHFYKNNNNE

SEQ ID NO: 3257691 - protein, 26 aa, Plasmodium falciparum
EMQFLLFKPFFFFIVNPYISYRSYFI

SEQ ID NO: 3257692 - protein, 24 aa, Plasmodium falciparum
EMQKQKCFCFRKEISEDFMDEINE

SEQ ID NO: 3257693 - protein, 22 aa, Plasmodium falciparum
EMQYLYEELQIVYDENQAKTAQ

SEQ ID NO: 3257694 - protein, 20 aa, Plasmodium falciparum
EMSLCFYFLLLNNILRDIKC

SEQ ID NO: 3257695 - protein, 24 aa, Plasmodium falciparum
EMSLFIKVWEHFECIVRCIENFSV

SEQ ID NO: 3257696 - protein, 18 aa, Plasmodium falciparum
EMYHKKKIVKIISNGSFS

SEQ ID NO: 3257697 - protein, 33 aa, Plasmodium falciparum
EMYLEKYLFSIPFLFSSIFTFPHILKYSKRVDV

SEQ ID NO: 3257698 - protein, 19 aa, Plasmodium falciparum
EMYLRDGIEELHMDEPSGD

SEQ ID NO: 3257699 - protein, 19 aa, Plasmodium falciparum
ENAYRIGLLMNQKIQSAKS

SEQ ID NO: 3257700 - protein, 25 aa, Plasmodium falciparum
ENCNYYKEREHILINKLDENNNIKN

SEQ ID NO: 3257701 - protein, 41 aa, Plasmodium falciparum
ENDDPSCVQILFFMGLICKFPILWIIGSIVFCITPSEHRKT

SEQ ID NO: 3257702 - protein, 27 aa, Plasmodium falciparum
ENDEILYALLILCKYPLFPKSTKIEKS

SEQ ID NO: 3257703 - protein, 42 aa, Plasmodium falciparum
ENDHIFYPLSVLKIMKCFNYYYDYFSNIFIRENIKMNLILKE

SEQ ID NO: 3257704 - protein, 25 aa, Plasmodium falciparum
ENDKIKYSIIWSFTNDEKIVVYGTH

SEQ ID NO: 3257705 - protein, 24 aa, Plasmodium falciparum
ENDMKINLGMLLRNDISLFNRSRN

SEQ ID NO: 3257706 - protein, 19 aa, Plasmodium falciparum
ENEASDLMITYCDRHVSLI

SEQ ID NO: 3257707 - protein, 28 aa, Plasmodium falciparum
ENEELKKLMKLFHFRGFTEKIPNEECSK

SEQ ID NO: 3257708 - protein, 17 aa, Plasmodium falciparum
ENEEVFDKLQIVSNENI

SEQ ID NO: 3257709 - protein, 21 aa, Plasmodium falciparum
ENELKNGIPYNNKYDKTNDMI

SEQ ID NO: 3257710 - protein, 19 aa, Plasmodium falciparum
ENERGYYIPHQSSLPQDNR

SEQ ID NO: 3257711 - protein, 19 aa, Plasmodium falciparum
ENERVCILSTNIAETSLTL

SEQ ID NO: 3257712 - protein, 23 aa, Plasmodium falciparum
ENETYNMLSLNYAWGGNHKHMNV

SEQ ID NO: 3257713 - protein, 24 aa, Plasmodium falciparum
ENFCRFKNTILYNEQIKFLFCFHS

SEQ ID NO: 3257714 - protein, 19 aa, Plasmodium falciparum
ENFELLKFSQLFKNPFGPN

SEQ ID NO: 3257715 - protein, 19 aa, Plasmodium falciparum
ENFFHVFLFLQIKKNIYQA

SEQ ID NO: 3257716 - protein, 23 aa, Plasmodium falciparum
ENFFILFCFVFVSIFFVSNVTII

SEQ ID NO: 3257717 - protein, 19 aa, Plasmodium falciparum
ENFHYFLLFFKIKNLLCSS

SEQ ID NO: 3257718 - protein, 19 aa, Plasmodium falciparum
ENFINIFLTHMDKYILLGT

SEQ ID NO: 3257719 - protein, 24 aa, Plasmodium falciparum
ENFKICNMLCLYILKNNYKMKCIL

SEQ ID NO: 3257720 - protein, 23 aa, Plasmodium falciparum
ENFKYNNIFLLPKFYPINKEYAI

SEQ ID NO: 3257721 - protein, 18 aa, Plasmodium falciparum
ENFLKKSYMTSINIRNNK

SEQ ID NO: 3257722 - protein, 18 aa, Plasmodium falciparum
ENFLKYIYPLIVKLSNDD

SEQ ID NO: 3257723 - protein, 18 aa, Plasmodium falciparum
ENFLPSEIYNNIVKNRNI

SEQ ID NO: 3257724 - protein, 17 aa, Plasmodium falciparum
ENFLRNKTCVNFNSLFF

SEQ ID NO: 3257725 - protein, 17 aa, Plasmodium falciparum
ENFMKKFACIIKEKDIF

SEQ ID NO: 3257726 - protein, 18 aa, Plasmodium falciparum
ENFSKRLSIESVEANFLT

SEQ ID NO: 3257727 - protein, 17 aa, Plasmodium falciparum
ENFSRSIYEKSLRNEKE

SEQ ID NO: 3257728 - protein, 31 aa, Plasmodium falciparum
ENFYFLLENCKNCIDQIYFLNQMFKRQNSYF

SEQ ID NO: 3257729 - protein, 17 aa, Plasmodium falciparum
ENGEILWNDRAFVFFIF

SEQ ID NO: 3257730 - protein, 28 aa, Plasmodium falciparum
ENGPNIFALRKRFPLGMNDEDEEGKEAL

SEQ ID NO: 3257731 - protein, 18 aa, Plasmodium falciparum
ENGQIWKKVFEGISGNGE

SEQ ID NO: 3257732 - protein, 20 aa, Plasmodium falciparum
ENHFLILPGGFYLQKEKMLV

SEQ ID NO: 3257733 - protein, 20 aa, Plasmodium falciparum
ENHFSFTILTANSFNLNQNI

SEQ ID NO: 3257734 - protein, 31 aa, Plasmodium falciparum
ENIAIQFTKNWKLLFKNIRNNIITSFINIDN

SEQ ID NO: 3257735 - protein, 17 aa, Plasmodium falciparum
ENICLFLYFLSYNLYAK

SEQ ID NO: 3257736 - protein, 17 aa, Plasmodium falciparum
ENIEFVICLDNLNNSDF

SEQ ID NO: 3257737 - protein, 23 aa, Plasmodium falciparum
ENIESLFILCLLYLNIHKYKESL

SEQ ID NO: 3257738 - protein, 26 aa, Plasmodium falciparum
ENIFFNNIWLLLLRHPEIRTNILNFL

SEQ ID NO: 3257739 - protein, 21 aa, Plasmodium falciparum
ENIFNYDFVMHIYSYVCTHAI

SEQ ID NO: 3257740 - protein, 24 aa, Plasmodium falciparum
ENIFSINPCNFVTKINVKTIYVSG

SEQ ID NO: 3257741 - protein, 17 aa, Plasmodium falciparum
ENIFSLKDDIPIIEDTN

SEQ ID NO: 3257742 - protein, 18 aa, Plasmodium falciparum
ENIFSLSSYDNFHIYNNN

SEQ ID NO: 3257743 - protein, 27 aa, Plasmodium falciparum
ENIIFFQRFFPLFLLVGYANGNIILFL

SEQ ID NO: 3257744 - protein, 22 aa, Plasmodium falciparum
ENIIFYDFHLIKNSNDLDKGTK

SEQ ID NO: 3257745 - protein, 25 aa, Plasmodium falciparum
ENIIKIEMCCIYFNITFECDKNIIF

SEQ ID NO: 3257746 - protein, 18 aa, Plasmodium falciparum
ENIIKLLFNYIFNLNEDY

SEQ ID NO: 3257747 - protein, 21 aa, Plasmodium falciparum
ENIKACLSMNIKQEYKNIMKM

SEQ ID NO: 3257748 - protein, 23 aa, Plasmodium falciparum
ENIKEKKLGVVLSNHNEQIKKKN

SEQ ID NO: 3257749 - protein, 24 aa, Plasmodium falciparum
ENIKEYNFIFILWKHNNMNDLYER

SEQ ID NO: 3257750 - protein, 24 aa, Plasmodium falciparum
ENIKHDICIIKKLIKKIMKKMKKK

SEQ ID NO: 3257751 - protein, 25 aa, Plasmodium falciparum
ENIKKTYDFILKKVLIVKNVWENNT

SEQ ID NO: 3257752 - protein, 26 aa, Plasmodium falciparum
ENIKSITHFARYLFFIAKKIAYSKDS

SEQ ID NO: 3257753 - protein, 19 aa, Plasmodium falciparum
ENILKTYYFFHSLNTYYEK

SEQ ID NO: 3257754 - protein, 25 aa, Plasmodium falciparum
ENILRYPFILNGEKLLNIETNVVVN

SEQ ID NO: 3257755 - protein, 18 aa, Plasmodium falciparum
ENILTLFYIRKNYLKAES

SEQ ID NO: 3257756 - protein, 39 aa, Plasmodium falciparum
ENINTIKLNFDMIWLPFFCIISNFSSWKKPLYSLFFVTY

SEQ ID NO: 3257757 - protein, 25 aa, Plasmodium falciparum
ENIPQFFRWFSEWGDDYCQDKTKMI

SEQ ID NO: 3257758 - protein, 29 aa, Plasmodium falciparum
ENIQYLEFCRFIYLFLLICVDNLKMYKKM

SEQ ID NO: 3257759 - protein, 17 aa, Plasmodium falciparum
ENIRIPLIIVLNDVPPT

SEQ ID NO: 3257760 - protein, 22 aa, Plasmodium falciparum
ENISESISYISYNIHKDNYEQE

SEQ ID NO: 3257761 - protein, 20 aa, Plasmodium falciparum
ENITKFLLYDDKLYMSIYNT

SEQ ID NO: 3257762 - protein, 25 aa, Plasmodium falciparum
ENITLFSMMHIMDFFKSKQKVIECI

SEQ ID NO: 3257763 - protein, 20 aa, Plasmodium falciparum
ENIVCLDCLISYLKKMLRIY

SEQ ID NO: 3257764 - protein, 18 aa, Plasmodium falciparum
ENIYDLIIEYSKQYIVQN

SEQ ID NO: 3257765 - protein, 25 aa, Plasmodium falciparum
ENKAQCNICFMLLYDKKTCDKNCLK

SEQ ID NO: 3257766 - protein, 19 aa, Plasmodium falciparum
ENKDICEILNKFKMNLSKK

SEQ ID NO: 3257767 - protein, 19 aa, Plasmodium falciparum
ENKFLPTVCIKKDKELKDM

SEQ ID NO: 3257768 - protein, 24 aa, Plasmodium falciparum
ENKFRYLFLRDLSYYIDIPRDIKR

SEQ ID NO: 3257769 - protein, 18 aa, Plasmodium falciparum
ENKHLGVGGGEKKKKKKI

SEQ ID NO: 3257770 - protein, 25 aa, Plasmodium falciparum
ENKKIKIACNLARQGVIDLISKSQA

SEQ ID NO: 3257771 - protein, 18 aa, Plasmodium falciparum
ENKKILPFIHNIEYIKVC

SEQ ID NO: 3257772 - protein, 24 aa, Plasmodium falciparum
ENKKSVLNTTNWLSYMNKGNYENV

SEQ ID NO: 3257773 - protein, 26 aa, Plasmodium falciparum
ENKRNVIFLNIFNRYNKIWKELINKK

SEQ ID NO: 3257774 - protein, 19 aa, Plasmodium falciparum
ENKRTSINYIKFKSYCVYN

SEQ ID NO: 3257775 - protein, 17 aa, Plasmodium falciparum
ENKSAGHPFKYQPTKGL

SEQ ID NO: 3257776 - protein, 23 aa, Plasmodium falciparum
ENKSCNSIDYIIEKGIHNNSEYS

SEQ ID NO: 3257777 - protein, 28 aa, Plasmodium falciparum
ENKSYDTFLRWDVLLKQIVYSITNTELT

SEQ ID NO: 3257778 - protein, 34 aa, Plasmodium falciparum
ENKSYLILCILFMKKKLFEEAFVIFSTNLVPDNM

SEQ ID NO: 3257779 - protein, 19 aa, Plasmodium falciparum
ENKVEKGLCNMNINNNYIN

SEQ ID NO: 3257780 - protein, 19 aa, Plasmodium falciparum
ENKVELILIQFLQDIFIYI

SEQ ID NO: 3257781 - protein, 18 aa, Plasmodium falciparum
ENKYNYLFNHLNIFHEKK

SEQ ID NO: 3257782 - protein, 27 aa, Plasmodium falciparum
ENLATIIIQRFESVFNYDEYEQPRQWR

SEQ ID NO: 3257783 - protein, 20 aa, Plasmodium falciparum
ENLGEIYFRGTLRDLDVSYL

SEQ ID NO: 3257784 - protein, 27 aa, Plasmodium falciparum
ENLHLKDIIHLCCIYYNYNVYNKELYD

SEQ ID NO: 3257785 - protein, 17 aa, Plasmodium falciparum
ENLKRLYTLKNNKKGKN

SEQ ID NO: 3257786 - protein, 19 aa, Plasmodium falciparum
ENLLLKFVNLYKEDIKKFE

SEQ ID NO: 3257787 - protein, 23 aa, Plasmodium falciparum
ENLLNIWITLIIKNKKKHEGRYI

SEQ ID NO: 3257788 - protein, 29 aa, Plasmodium falciparum
ENLLNVSLMRFSFDIIYENLLSNSINEVL

SEQ ID NO: 3257789 - protein, 17 aa, Plasmodium falciparum
ENLMKILCYIIEESDES

SEQ ID NO: 3257790 - protein, 22 aa, Plasmodium falciparum
ENLPCLRLPNQENLYDKLDTKL

SEQ ID NO: 3257791 - protein, 20 aa, Plasmodium falciparum
ENLYIYRSLLIILLNKYFCS

SEQ ID NO: 3257792 - protein, 31 aa, Plasmodium falciparum
ENLYLRFSAHLCILRCLYIFSTRLYELYPKI

SEQ ID NO: 3257793 - protein, 27 aa, Plasmodium falciparum
ENLYNILVFKIQYLKVKAINDIKEIIS

SEQ ID NO: 3257794 - protein, 20 aa, Plasmodium falciparum
ENMLFYILHIFELFVEIYED

SEQ ID NO: 3257795 - protein, 31 aa, Plasmodium falciparum
ENMLKNKKLALLRKKRNILKMYYSYSSDNSE

SEQ ID NO: 3257796 - protein, 19 aa, Plasmodium falciparum
ENMNRIIMRNRYEGYQYRL

SEQ ID NO: 3257797 - protein, 20 aa, Plasmodium falciparum
ENMRYCMNRDSCFNYSSNDE

SEQ ID NO: 3257798 - protein, 24 aa, Plasmodium falciparum
ENNCSIKKKKKCYNNDTSKCTKSN

SEQ ID NO: 3257799 - protein, 24 aa, Plasmodium falciparum
ENNCSKWLLWIKRIKRDENLFFEN

SEQ ID NO: 3257800 - protein, 25 aa, Plasmodium falciparum
ENNDAYYYYKHILKTQATNRLRVTK

SEQ ID NO: 3257801 - protein, 25 aa, Plasmodium falciparum
ENNDIYIKLIWKYNMNELERLTNEN

SEQ ID NO: 3257802 - protein, 25 aa, Plasmodium falciparum
ENNELIEKCEFLKSELKNVQGTKRH

SEQ ID NO: 3257803 - protein, 17 aa, Plasmodium falciparum
ENNFEFLLNKVINSKKE

SEQ ID NO: 3257804 - protein, 24 aa, Plasmodium falciparum
ENNFEKVCTFKCEKLEQYLSTDLN

SEQ ID NO: 3257805 - protein, 24 aa, Plasmodium falciparum
ENNFYVKHFFNFVIIYLESLSRHI

SEQ ID NO: 3257806 - protein, 25 aa, Plasmodium falciparum
ENNKCIPCPIGLYYSNSKSINQCIP

SEQ ID NO: 3257807 - protein, 24 aa, Plasmodium falciparum
ENNLFCKHKFFYANKNINEQLTSF

SEQ ID NO: 3257808 - protein, 17 aa, Plasmodium falciparum
ENNLPAETNITIFWLFV

SEQ ID NO: 3257809 - protein, 21 aa, Plasmodium falciparum
ENNLRKAVFGDIKINELEKTK

SEQ ID NO: 3257810 - protein, 18 aa, Plasmodium falciparum
ENNRFLFNKQRDWPRITF

SEQ ID NO: 3257811 - protein, 23 aa, Plasmodium falciparum
ENNSCYYLCPYIFVYKFKGLCFL

SEQ ID NO: 3257812 - protein, 18 aa, Plasmodium falciparum
ENNSELLIERIKRGKEAL

SEQ ID NO: 3257813 - protein, 24 aa, Plasmodium falciparum
ENNSLCYFYNFFLILKEKQFEYMN

SEQ ID NO: 3257814 - protein, 31 aa, Plasmodium falciparum
ENNVRHCVHFSKGFEYLRFICPMRKDNYEGI

SEQ ID NO: 3257815 - protein, 23 aa, Plasmodium falciparum
ENPKNMRPGFCPTPEPERELDEG

SEQ ID NO: 3257816 - protein, 25 aa, Plasmodium falciparum
ENPLFKTSRLFKGIREQKWTCKFKD

SEQ ID NO: 3257817 - protein, 23 aa, Plasmodium falciparum
ENPQEFYEIFANWLKKDFVGNLF

SEQ ID NO: 3257818 - protein, 30 aa, Plasmodium falciparum
ENQLKSGIIPNDFLRLMFYTLADYKDILFS

SEQ ID NO: 3257819 - protein, 18 aa, Plasmodium falciparum
ENQYNWLINGFQKKIIHI

SEQ ID NO: 3257820 - protein, 26 aa, Plasmodium falciparum
ENRKIPIKFITNLNVMLRGIKISLFE

SEQ ID NO: 3257821 - protein, 20 aa, Plasmodium falciparum
ENRLKSYFSNAVEKGKEVFE

SEQ ID NO: 3257822 - protein, 18 aa, Plasmodium falciparum
ENRLLIKVLELIYNSLSF

SEQ ID NO: 3257823 - protein, 27 aa, Plasmodium falciparum
ENRLNNELISFLLYCFNKENEKIKIMV

SEQ ID NO: 3257824 - protein, 22 aa, Plasmodium falciparum
ENRNNLRFELDRNVFNKNEELF

SEQ ID NO: 3257825 - protein, 32 aa, Plasmodium falciparum
ENRTAIEICLYYCKSYILFLLLFYPYLHNYIR

SEQ ID NO: 3257826 - protein, 19 aa, Plasmodium falciparum
ENSDMLFLRSMFFENNTLP

SEQ ID NO: 3257827 - protein, 23 aa, Plasmodium falciparum
ENSELYKSLSIYRSSLEGIYFYR

SEQ ID NO: 3257828 - protein, 23 aa, Plasmodium falciparum
ENSFFKRRYNFYMHKSKHIELQI

SEQ ID NO: 3257829 - protein, 19 aa, Plasmodium falciparum
ENSKNDCACVGKWVQQKGK

SEQ ID NO: 3257830 - protein, 26 aa, Plasmodium falciparum
ENSLLKYCIKFLYLSFFSERFLFKWN

SEQ ID NO: 3257831 - protein, 18 aa, Plasmodium falciparum
ENSSSIFLIYEIILILQK

SEQ ID NO: 3257832 - protein, 23 aa, Plasmodium falciparum
ENSVFCYRKYYRKCNEIMNNSFN

SEQ ID NO: 3257833 - protein, 24 aa, Plasmodium falciparum
ENSVTPWFIKIYLTKIISELYDTK

SEQ ID NO: 3257834 - protein, 25 aa, Plasmodium falciparum
ENSYPAVNACKIWQKTQSFQDVVLS

SEQ ID NO: 3257835 - protein, 26 aa, Plasmodium falciparum
ENTHIYADILFEFIVSIIDDIDISVE

SEQ ID NO: 3257836 - protein, 19 aa, Plasmodium falciparum
ENTKCPLNSNCYVIDDEET

SEQ ID NO: 3257837 - protein, 17 aa, Plasmodium falciparum
ENVCTAITDGGRISFEK

SEQ ID NO: 3257838 - protein, 26 aa, Plasmodium falciparum
ENVDIIAGLCFMNIFLFICSGLKEDE

SEQ ID NO: 3257839 - protein, 24 aa, Plasmodium falciparum
ENVEKLCLTFCIYEKKYPDGEKFT

SEQ ID NO: 3257840 - protein, 25 aa, Plasmodium falciparum
ENVFVEFFLNRCINIIKKTHLIKSR

SEQ ID NO: 3257841 - protein, 24 aa, Plasmodium falciparum
ENVHLKNALLLKEKENDIILNKNI

SEQ ID NO: 3257842 - protein, 22 aa, Plasmodium falciparum
ENVIKLLDFVSIINLHKYILNN

SEQ ID NO: 3257843 - protein, 21 aa, Plasmodium falciparum
ENVLKELTHFLILNNINNNVK

SEQ ID NO: 3257844 - protein, 18 aa, Plasmodium falciparum
ENVMCVECLYKFLFKKYP

SEQ ID NO: 3257845 - protein, 27 aa, Plasmodium falciparum
ENVNCILCSRKGGALKMVKINDYIKID

SEQ ID NO: 3257846 - protein, 21 aa, Plasmodium falciparum
ENVNICYLVNYHRFKYIYKKN

SEQ ID NO: 3257847 - protein, 19 aa, Plasmodium falciparum
ENVYFKYPLNEDINGLEQN

SEQ ID NO: 3257848 - protein, 20 aa, Plasmodium falciparum
ENYEITSFFIKEEINKEKKK

SEQ ID NO: 3257849 - protein, 26 aa, Plasmodium falciparum
ENYFFKLREDWWTANRATVWEAITCS

SEQ ID NO: 3257850 - protein, 17 aa, Plasmodium falciparum
ENYFFLLPLINRNINNE

SEQ ID NO: 3257851 - protein, 25 aa, Plasmodium falciparum
ENYHCSITFSILQLIGFDFLINNED

SEQ ID NO: 3257852 - protein, 19 aa, Plasmodium falciparum
ENYILPLYIYLHVIDYNKA

SEQ ID NO: 3257853 - protein, 33 aa, Plasmodium falciparum
ENYIYDILYICIWIFSLSVSKYRKIRFTSSLAS

SEQ ID NO: 3257854 - protein, 25 aa, Plasmodium falciparum
ENYIYRHYIQFIWDALICNKHIDEK

SEQ ID NO: 3257855 - protein, 21 aa, Plasmodium falciparum
ENYKYMNLFLLFIKLLSVFLN

SEQ ID NO: 3257856 - protein, 18 aa, Plasmodium falciparum
ENYLEAYKIFKLKNKNKN

SEQ ID NO: 3257857 - protein, 19 aa, Plasmodium falciparum
ENYLKCFNDDYMKNGNNRN

SEQ ID NO: 3257858 - protein, 27 aa, Plasmodium falciparum
ENYLKGKFLRGYLMKEVIIKNDSEEIQ

SEQ ID NO: 3257859 - protein, 24 aa, Plasmodium falciparum
ENYLKKSFLQYIFILKNGIYSLIP

SEQ ID NO: 3257860 - protein, 23 aa, Plasmodium falciparum
ENYMNFLNFCFNLYLENNNFEFI

SEQ ID NO: 3257861 - protein, 18 aa, Plasmodium falciparum
ENYMPIERCFNSKNDDHI

SEQ ID NO: 3257862 - protein, 25 aa, Plasmodium falciparum
ENYNEPKLRITLMNCLTNLNIYIKN

SEQ ID NO: 3257863 - protein, 20 aa, Plasmodium falciparum
ENYYFKYMFNIFSFKKQENK

SEQ ID NO: 3257864 - protein, 19 aa, Plasmodium falciparum
ENYYKILYRNVQSGNMSGR

SEQ ID NO: 3257865 - protein, 20 aa, Plasmodium falciparum
EPFILNFFVKNMFILIERLI

SEQ ID NO: 3257866 - protein, 19 aa, Plasmodium falciparum
EPHFKQTHYIYSSNHDNNE

SEQ ID NO: 3257867 - protein, 19 aa, Plasmodium falciparum
EPHSFPYISAEPELRVMKK

SEQ ID NO: 3257868 - protein, 32 aa, Plasmodium falciparum
EPKYNRKFIYGSMYCSFLILGINIASFSILMS

SEQ ID NO: 3257869 - protein, 19 aa, Plasmodium falciparum
EPLLFHFFLKYNKNSHTIN

SEQ ID NO: 3257870 - protein, 39 aa, Plasmodium falciparum
EPLNFFRSGYEVILTCKNCEEILFNSCVQVYCTKTKTEN

SEQ ID NO: 3257871 - protein, 21 aa, Plasmodium falciparum
EPMMLYYIILIYFYKSAKNKY

SEQ ID NO: 3257872 - protein, 42 aa, Plasmodium falciparum
EPNFCLKDIKCIFFYIVYNIFKMCMKCFCSEYFDNLKCHLYY

SEQ ID NO: 3257873 - protein, 20 aa, Plasmodium falciparum
EPNYKDSKKVLSQKKKKKKS

SEQ ID NO: 3257874 - protein, 27 aa, Plasmodium falciparum
EPTRLVEVLDRLFLCFDKCTEQFNCTK

SEQ ID NO: 3257875 - protein, 26 aa, Plasmodium falciparum
EPVLIYKYFECLSLLSDVHDNNKIVP

SEQ ID NO: 3257876 - protein, 23 aa, Plasmodium falciparum
EPVLKRFKIKRLVEKGEHYYVKY

SEQ ID NO: 3257877 - protein, 23 aa, Plasmodium falciparum
EQAKKNYFCDKIKEIMEDLEKLL

SEQ ID NO: 3257878 - protein, 26 aa, Plasmodium falciparum
EQCRKYRKWIDIKFEEFHNQKHKYQG

SEQ ID NO: 3257879 - protein, 29 aa, Plasmodium falciparum
EQCRTFFKHIAYVILEFCGHKNTVIKHKS

SEQ ID NO: 3257880 - protein, 17 aa, Plasmodium falciparum
EQDLIYLGGLGIIDPPR

SEQ ID NO: 3257881 - protein, 25 aa, Plasmodium falciparum
EQFHRIVIICFKPTVKHSHIITSPH

SEQ ID NO: 3257882 - protein, 26 aa, Plasmodium falciparum
EQGLRTLECPLCFFMSNDSYFPWTYK

SEQ ID NO: 3257883 - protein, 27 aa, Plasmodium falciparum
EQHELKYRYKIGIHISDVSFFVTPNSY

SEQ ID NO: 3257884 - protein, 19 aa, Plasmodium falciparum
EQHKCFYIYTGRGPSSLSM

SEQ ID NO: 3257885 - protein, 17 aa, Plasmodium falciparum
EQIHEMSILYGDVISSN

SEQ ID NO: 3257886 - protein, 24 aa, Plasmodium falciparum
EQIKGFYFKDSFFLYKKIKTSFLY

SEQ ID NO: 3257887 - protein, 35 aa, Plasmodium falciparum
EQIKRRRSIMGWNILRNRIKCCKNKMYTSNDFMKT

SEQ ID NO: 3257888 - protein, 26 aa, Plasmodium falciparum
EQIKVHKNFRLFACMNPPIIPNIRMK

SEQ ID NO: 3257889 - protein, 18 aa, Plasmodium falciparum
EQIKYFLQIFHILQENIT

SEQ ID NO: 3257890 - protein, 22 aa, Plasmodium falciparum
EQILYFILEWTQIHPILKKLQI

SEQ ID NO: 3257891 - protein, 20 aa, Plasmodium falciparum
EQISFLLFYQFVKIIMWKYL

SEQ ID NO: 3257892 - protein, 20 aa, Plasmodium falciparum
EQITGILIERLIVHRPHPWG

SEQ ID NO: 3257893 - protein, 25 aa, Plasmodium falciparum
EQIVNHLFTKFPFLKEEEKSLFHII

SEQ ID NO: 3257894 - protein, 24 aa, Plasmodium falciparum
EQLFKESYLFKSVREQNWECKVIN

SEQ ID NO: 3257895 - protein, 20 aa, Plasmodium falciparum
EQLFNYFLFLFFNKSISIIP

SEQ ID NO: 3257896 - protein, 31 aa, Plasmodium falciparum
EQLIMKGRYYATAVRNFVIFKVNYICEYSKC

SEQ ID NO: 3257897 - protein, 20 aa, Plasmodium falciparum
EQLISFKQYCNVLIKKYTHS

SEQ ID NO: 3257898 - protein, 23 aa, Plasmodium falciparum
EQLPIRKIIKLLIVSLFKMSYNR

SEQ ID NO: 3257899 - protein, 25 aa, Plasmodium falciparum
EQLVAYKFLCIIKYYGEKLNYLLLL

SEQ ID NO: 3257900 - protein, 26 aa, Plasmodium falciparum
EQMCKPCSFSKLYCTGENIYIISQSL

SEQ ID NO: 3257901 - protein, 20 aa, Plasmodium falciparum
EQMFKLIIMSATMQSNLFYS

SEQ ID NO: 3257902 - protein, 22 aa, Plasmodium falciparum
EQNFKIYIEKLLNMNNEKDLEN

SEQ ID NO: 3257903 - protein, 21 aa, Plasmodium falciparum
EQQKCFCCYCRQDDMVFPLFS

SEQ ID NO: 3257904 - protein, 26 aa, Plasmodium falciparum
EQRIHCYRIVISIFIFLLNHSRCISE

SEQ ID NO: 3257905 - protein, 19 aa, Plasmodium falciparum
EQSCARKRSLENIIKQLPT

SEQ ID NO: 3257906 - protein, 25 aa, Plasmodium falciparum
EQSFKVKMLRSLFYIIKYKNLCDNL

SEQ ID NO: 3257907 - protein, 20 aa, Plasmodium falciparum
EQSLKKFIRKHVPKRKIKFF

SEQ ID NO: 3257908 - protein, 19 aa, Plasmodium falciparum
EQSYEYLIIYAWGMSILNY

SEQ ID NO: 3257909 - protein, 22 aa, Plasmodium falciparum
EQTRIYKILLLTYCNKISTYQN

SEQ ID NO: 3257910 - protein, 28 aa, Plasmodium falciparum
EQVFNLYKCTLDWEWKNGKNTCKAKSVG

SEQ ID NO: 3257911 - protein, 22 aa, Plasmodium falciparum
EQVNYHLFCFLDIMNYIYMKNK

SEQ ID NO: 3257912 - protein, 17 aa, Plasmodium falciparum
EQWKCYEEKDIKKLVEN

SEQ ID NO: 3257913 - protein, 25 aa, Plasmodium falciparum
EQYKCKLMVYILLIQLCLTDNALPL

SEQ ID NO: 3257914 - protein, 50 aa, Plasmodium falciparum
EQYMYDVRHKLRIYVGLICPKYRRKLFNLRYLILSGSLSINSIVSPQIVT

SEQ ID NO: 3257915 - protein, 29 aa, Plasmodium falciparum
EQYYFKTILKFLLGYPFVVEFIKNNEHKV

SEQ ID NO: 3257916 - protein, 18 aa, Plasmodium falciparum
ERDGEKYCSLNGCDCTKT

SEQ ID NO: 3257917 - protein, 20 aa, Plasmodium falciparum
ERECVYKDIVKHILLKYIKS

SEQ ID NO: 3257918 - protein, 21 aa, Plasmodium falciparum
EREIEKLKEIYGDQFSINKNS

SEQ ID NO: 3257919 - protein, 23 aa, Plasmodium falciparum
EREKEFFNELELFHASSNIGACG

SEQ ID NO: 3257920 - protein, 17 aa, Plasmodium falciparum
EREKFNIMRPSDCNTLF

SEQ ID NO: 3257921 - protein, 18 aa, Plasmodium falciparum
EREKRKGEYFAVKESNIF

SEQ ID NO: 3257922 - protein, 17 aa, Plasmodium falciparum
EREKRRNKKYYTNKNND

SEQ ID NO: 3257923 - protein, 24 aa, Plasmodium falciparum
ERENYLLTCLTFFGTQCICLGYSN

SEQ ID NO: 3257924 - protein, 22 aa, Plasmodium falciparum
ERFRAILPFIINLCLNEVIHPY

SEQ ID NO: 3257925 - protein, 18 aa, Plasmodium falciparum
ERGRERGREKGRDIDRNR

SEQ ID NO: 3257926 - protein, 18 aa, Plasmodium falciparum
ERIENYFFLLPLINRNIN

SEQ ID NO: 3257927 - protein, 18 aa, Plasmodium falciparum
ERIFFLIIFSGIVYFFLD

SEQ ID NO: 3257928 - protein, 24 aa, Plasmodium falciparum
ERIGYIKIIQFFLLVLFWGLLYIL

SEQ ID NO: 3257929 - protein, 17 aa, Plasmodium falciparum
ERIKYKMAVENINNIDK

SEQ ID NO: 3257930 - protein, 17 aa, Plasmodium falciparum
ERIKYLYTYMNDKINNM

SEQ ID NO: 3257931 - protein, 19 aa, Plasmodium falciparum
ERIPTLGFCKEDDRVQEMF

SEQ ID NO: 3257932 - protein, 17 aa, Plasmodium falciparum
ERIVHVNYMKYLYKNNE

SEQ ID NO: 3257933 - protein, 22 aa, Plasmodium falciparum
ERIYHFYSKYFINKILYARNLS

SEQ ID NO: 3257934 - protein, 26 aa, Plasmodium falciparum
ERIYLLLKCLLHSYLNEIKECKSILN

SEQ ID NO: 3257935 - protein, 24 aa, Plasmodium falciparum
ERIYTVKHICHIKKKENLFTITPY

SEQ ID NO: 3257936 - protein, 19 aa, Plasmodium falciparum
ERKIIKKGESYDNYNNSVF

SEQ ID NO: 3257937 - protein, 23 aa, Plasmodium falciparum
ERKKYYFDVHCVDKYMLGIFYIW

SEQ ID NO: 3257938 - protein, 18 aa, Plasmodium falciparum
ERKLEPFKNVPKERNNIN

SEQ ID NO: 3257939 - protein, 19 aa, Plasmodium falciparum
ERKLIPFVYLDKCQSKIQI

SEQ ID NO: 3257940 - protein, 28 aa, Plasmodium falciparum
ERKRLIYDILFCIKIFISKYLYNLHILK

SEQ ID NO: 3257941 - protein, 22 aa, Plasmodium falciparum
ERKRSVHFYPQHLDGNTLKKNL

SEQ ID NO: 3257942 - protein, 22 aa, Plasmodium falciparum
ERKSSDSSFCFLPKEELKTNES

SEQ ID NO: 3257943 - protein, 21 aa, Plasmodium falciparum
ERKYIQHKYVYKKNEHENLIK

SEQ ID NO: 3257944 - protein, 19 aa, Plasmodium falciparum
ERLKEAIYLNKKEKENLEE

SEQ ID NO: 3257945 - protein, 27 aa, Plasmodium falciparum
ERLSIIDNWKLIKFIKFINKLVKYEYR

SEQ ID NO: 3257946 - protein, 30 aa, Plasmodium falciparum
ERMEVFYEFLKKSCTSRFLKKLLSFIEEND

SEQ ID NO: 3257947 - protein, 19 aa, Plasmodium falciparum
ERNLKVIIFAGDENCIGGT

SEQ ID NO: 3257948 - protein, 21 aa, Plasmodium falciparum
ERNYLKKVHKFFLTLQKLLKY

SEQ ID NO: 3257949 - protein, 26 aa, Plasmodium falciparum
ERPPFLRWFIEWGEEFCKKRKEQVDQ

SEQ ID NO: 3257950 - protein, 19 aa, Plasmodium falciparum
ERPYKKWIDHYSIHMDNII

SEQ ID NO: 3257951 - protein, 24 aa, Plasmodium falciparum
ERQKDIWRKWIKKQNFIIYNYINE

SEQ ID NO: 3257952 - protein, 26 aa, Plasmodium falciparum
ERQRNFFRLSKFFFNKYKNKAYKHLL

SEQ ID NO: 3257953 - protein, 19 aa, Plasmodium falciparum
ERRIKRNKYLLSLYNNTNI

SEQ ID NO: 3257954 - protein, 19 aa, Plasmodium falciparum
ERSKLFLIRKELKNKEYTN

SEQ ID NO: 3257955 - protein, 19 aa, Plasmodium falciparum
ERSPCIFINRLNMEGLERK

SEQ ID NO: 3257956 - protein, 20 aa, Plasmodium falciparum
ERYQKCCSNIKKEKYTHGDK

SEQ ID NO: 3257957 - protein, 19 aa, Plasmodium falciparum
ERYTYRYTPLLAYIMIPNF

SEQ ID NO: 3257958 - protein, 19 aa, Plasmodium falciparum
ERYYIMWSNSYDLVYYVDN

SEQ ID NO: 3257959 - protein, 18 aa, Plasmodium falciparum
ESEIKNISFILGNTLNCY

SEQ ID NO: 3257960 - protein, 24 aa, Plasmodium falciparum
ESETIGDIILRILSIIFPDVSPGL

SEQ ID NO: 3257961 - protein, 18 aa, Plasmodium falciparum
ESFAAHFEAHTLKKIQNY

SEQ ID NO: 3257962 - protein, 22 aa, Plasmodium falciparum
ESFEMIKFSKLLETSFEKLKHI

SEQ ID NO: 3257963 - protein, 25 aa, Plasmodium falciparum
ESFLEKKKCSFLYPPHINSDFDLLK

SEQ ID NO: 3257964 - protein, 17 aa, Plasmodium falciparum
ESGDMGIELNVETQLII

SEQ ID NO: 3257965 - protein, 20 aa, Plasmodium falciparum
ESGGLLIKGKVEITFKQLWS

SEQ ID NO: 3257966 - protein, 17 aa, Plasmodium falciparum
ESHFIFYNFSMSFQNEE

SEQ ID NO: 3257967 - protein, 19 aa, Plasmodium falciparum
ESICAEIIASMILGGNLSE

SEQ ID NO: 3257968 - protein, 23 aa, Plasmodium falciparum
ESIHFKIKFNIMSYKKYKMNEDR

SEQ ID NO: 3257969 - protein, 26 aa, Plasmodium falciparum
ESINEFYPYCYIKFEDVLTFSNVFYK

SEQ ID NO: 3257970 - protein, 22 aa, Plasmodium falciparum
ESKCKCKRGFYFVSKDSINFCD

SEQ ID NO: 3257971 - protein, 17 aa, Plasmodium falciparum
ESKDFIFHINIKRYIER

SEQ ID NO: 3257972 - protein, 26 aa, Plasmodium falciparum
ESKDSLIIYNCVYSISFLLYKKSILD

SEQ ID NO: 3257973 - protein, 19 aa, Plasmodium falciparum
ESKFPFGSVGPLWCRQIPY

SEQ ID NO: 3257974 - protein, 20 aa, Plasmodium falciparum
ESKHLLFFINFFLNDQEQNS

SEQ ID NO: 3257975 - protein, 33 aa, Plasmodium falciparum
ESKIHLIVVMYFSFCFYLYLFERGKYAINSTFS

SEQ ID NO: 3257976 - protein, 27 aa, Plasmodium falciparum
ESKRLFSEPVMLCFQLFSDHYLYLLKN

SEQ ID NO: 3257977 - protein, 18 aa, Plasmodium falciparum
ESLEVYKHTIGNIQKEYI

SEQ ID NO: 3257978 - protein, 27 aa, Plasmodium falciparum
ESLFFSKFSFFQCYKLLEYSLKKDIHM

SEQ ID NO: 3257979 - protein, 21 aa, Plasmodium falciparum
ESLKIRRSYLRYCGENESSGN

SEQ ID NO: 3257980 - protein, 25 aa, Plasmodium falciparum
ESLKKLYVDYFWPEMSNYILNMSHY

SEQ ID NO: 3257981 - protein, 24 aa, Plasmodium falciparum
ESLKTCRSLCECDLYTSIYDNDPE

SEQ ID NO: 3257982 - protein, 17 aa, Plasmodium falciparum
ESLKYPPIEIEEGCTCK

SEQ ID NO: 3257983 - protein, 24 aa, Plasmodium falciparum
ESLNRLHVQFVRFCNNNKDLIDEK

SEQ ID NO: 3257984 - protein, 25 aa, Plasmodium falciparum
ESLSNLCILDCDYFIHVVLPFLIKK

SEQ ID NO: 3257985 - protein, 24 aa, Plasmodium falciparum
ESLSSRFYVFIIIILTLLILDIQS

SEQ ID NO: 3257986 - protein, 18 aa, Plasmodium falciparum
ESMKNWILMIYISIITKI

SEQ ID NO: 3257987 - protein, 25 aa, Plasmodium falciparum
ESMSPILRVQFFADFAKQAVHVAKQ

SEQ ID NO: 3257988 - protein, 20 aa, Plasmodium falciparum
ESNFFYDMINEISNKIENSD

SEQ ID NO: 3257989 - protein, 29 aa, Plasmodium falciparum
ESNRIMYLQFKYIYLQSLNITVSFVPPNS

SEQ ID NO: 3257990 - protein, 19 aa, Plasmodium falciparum
ESNYFKWIMNNNSSSKLRE

SEQ ID NO: 3257991 - protein, 26 aa, Plasmodium falciparum
ESNYKIINCLKYLDGKNVKLLENNIY

SEQ ID NO: 3257992 - protein, 19 aa, Plasmodium falciparum
ESPFLWFLPIDNRKGDGIY

SEQ ID NO: 3257993 - protein, 25 aa, Plasmodium falciparum
ESPSMFRRFINFLSFSGNENETEDT

SEQ ID NO: 3257994 - protein, 23 aa, Plasmodium falciparum
ESQLKKFLTFHCYGSIIQLKYNN

SEQ ID NO: 3257995 - protein, 21 aa, Plasmodium falciparum
ESRIKNFIMSKILYKHKYAYN

SEQ ID NO: 3257996 - protein, 34 aa, Plasmodium falciparum
ESRPKRTTTFYGERRLTCDLLELVLNAIMLININ

SEQ ID NO: 3257997 - protein, 18 aa, Plasmodium falciparum
ESSIEDIFKTCPYDNDTC

SEQ ID NO: 3257998 - protein, 26 aa, Plasmodium falciparum
ESSIRYLSFLLLLFIYGVSYILAIIP

SEQ ID NO: 3257999 - protein, 17 aa, Plasmodium falciparum
ESSSICFNKKIYNIIFM

SEQ ID NO: 3258000 - protein, 17 aa, Plasmodium falciparum
ESTFYYNFYSFINRTYV

SEQ ID NO: 3258001 - protein, 19 aa, Plasmodium falciparum
ESTIILCFLNNKNIKHKEN

SEQ ID NO: 3258002 - protein, 23 aa, Plasmodium falciparum
ESTKGCLSMHSIKLKKNKNKIRT

SEQ ID NO: 3258003 - protein, 24 aa, Plasmodium falciparum
ESTTRPGNSFSLPQMTWEFEAPGQ

SEQ ID NO: 3258004 - protein, 24 aa, Plasmodium falciparum
ESVCIINIPYFLGGIKIWKDDELE

SEQ ID NO: 3258005 - protein, 23 aa, Plasmodium falciparum
ESVFDFFFTLYFYQTNDLNNTIV

SEQ ID NO: 3258006 - protein, 24 aa, Plasmodium falciparum
ESVPLIKACIDKSVINNKSNNNNN

SEQ ID NO: 3258007 - protein, 25 aa, Plasmodium falciparum
ESVTRFSLHFKKYASVEVEIIKNFS

SEQ ID NO: 3258008 - protein, 23 aa, Plasmodium falciparum
ESYEFYESEILRITKERMNKMKL

SEQ ID NO: 3258009 - protein, 17 aa, Plasmodium falciparum
ESYIRCVEYGKKKAHYS

SEQ ID NO: 3258010 - protein, 22 aa, Plasmodium falciparum
ESYMTNKQLIEWDTWKEEKRNW

SEQ ID NO: 3258011 - protein, 32 aa, Plasmodium falciparum
ESYYKHINCNLLFLKKILKYSFQQRRKKLKSS

SEQ ID NO: 3258012 - protein, 22 aa, Plasmodium falciparum
ETADLKSSIFIKNIHYNNQPNI

SEQ ID NO: 3258013 - protein, 23 aa, Plasmodium falciparum
ETEHLFREWEIRFAENPFEKQKK

SEQ ID NO: 3258014 - protein, 17 aa, Plasmodium falciparum
ETEKGFVIEKVEETGAV

SEQ ID NO: 3258015 - protein, 24 aa, Plasmodium falciparum
ETEKRKLRFGSFISSELKSKIYNY

SEQ ID NO: 3258016 - protein, 20 aa, Plasmodium falciparum
ETELKFSGDHSGLEELDVLQ

SEQ ID NO: 3258017 - protein, 21 aa, Plasmodium falciparum
ETERIKLWGCTGPNNCNEQEQ

SEQ ID NO: 3258018 - protein, 22 aa, Plasmodium falciparum
ETFCRQRTRMLAKIRGECVKSD

SEQ ID NO: 3258019 - protein, 19 aa, Plasmodium falciparum
ETFKELKLEKKFYENIELY

SEQ ID NO: 3258020 - protein, 27 aa, Plasmodium falciparum
ETFKKNEIILLFLFLDLYELIIVEETT

SEQ ID NO: 3258021 - protein, 21 aa, Plasmodium falciparum
ETFRPAKNCAPCSEFKVKCNG

SEQ ID NO: 3258022 - protein, 21 aa, Plasmodium falciparum
ETFRPAKNCKPCSEFKVKCDY

SEQ ID NO: 3258023 - protein, 18 aa, Plasmodium falciparum
ETFYIISILVHYSNNVLE

SEQ ID NO: 3258024 - protein, 24 aa, Plasmodium falciparum
ETGCLKCGCGLGGVAAGVGIIGGI

SEQ ID NO: 3258025 - protein, 18 aa, Plasmodium falciparum
ETHIRNEIIIDFQNFIYV

SEQ ID NO: 3258026 - protein, 17 aa, Plasmodium falciparum
ETIKGFDCSTCARHCRF

SEQ ID NO: 3258027 - protein, 17 aa, Plasmodium falciparum
ETIKVGFPIYSIKNINK

SEQ ID NO: 3258028 - protein, 23 aa, Plasmodium falciparum
ETKICNKYNLFTLHSNYVFVYET

SEQ ID NO: 3258029 - protein, 24 aa, Plasmodium falciparum
ETKLWLTYWVVFSLFFFIEYLIDI

SEQ ID NO: 3258030 - protein, 23 aa, Plasmodium falciparum
ETKLYKLILFLLFLLILSLSKNI

SEQ ID NO: 3258031 - protein, 23 aa, Plasmodium falciparum
ETKSRIRFSLVILIISILMYYFY

SEQ ID NO: 3258032 - protein, 26 aa, Plasmodium falciparum
ETLIKEKKDCILIYPYTYTKIWNTLT

SEQ ID NO: 3258033 - protein, 38 aa, Plasmodium falciparum
ETLYSNCFLIMINVLLIWEMYLEIPLEILNKMRYSFFE

SEQ ID NO: 3258034 - protein, 18 aa, Plasmodium falciparum
ETLYSYKKYCGVHKKKDD

SEQ ID NO: 3258035 - protein, 24 aa, Plasmodium falciparum
ETNEEIWFPPELYEIHHTPIFLRI

SEQ ID NO: 3258036 - protein, 20 aa, Plasmodium falciparum
ETNKMIIIDPLIFFNLIFTS

SEQ ID NO: 3258037 - protein, 20 aa, Plasmodium falciparum
ETNLKMKIVKKVTFIDEHED

SEQ ID NO: 3258038 - protein, 38 aa, Plasmodium falciparum
ETPFMFLKNIHWLITFPILLYIVFAVRLLFLSIISFIF

SEQ ID NO: 3258039 - protein, 20 aa, Plasmodium falciparum
ETPFPKYGYYAVYREKTNPT

SEQ ID NO: 3258040 - protein, 26 aa, Plasmodium falciparum
ETQIMCLPLYISIVGGLDIFLYNYYN

SEQ ID NO: 3258041 - protein, 25 aa, Plasmodium falciparum
ETRIPSWTDRIFKWSCEKTKNCLVF

SEQ ID NO: 3258042 - protein, 24 aa, Plasmodium falciparum
ETSSKWSDFFFKKNNKKNIKDSYE

SEQ ID NO: 3258043 - protein, 26 aa, Plasmodium falciparum
ETSYEFIELFLTFLLKNYSLLYNKYY

SEQ ID NO: 3258044 - protein, 29 aa, Plasmodium falciparum
ETWDCLIQNAIIRKCYLDLKINFENSTTE

SEQ ID NO: 3258045 - protein, 48 aa, Plasmodium falciparum
ETYHIYKKHLLLTFLRYIKNFLLNICSCVLITQYIFIKCIDLINKYNN

SEQ ID NO: 3258046 - protein, 24 aa, Plasmodium falciparum
ETYIRKGEIVSFHYHRNHIRIKDS

SEQ ID NO: 3258047 - protein, 24 aa, Plasmodium falciparum
ETYKCKYVHQLFAYSIYDYMGRYC

SEQ ID NO: 3258048 - protein, 20 aa, Plasmodium falciparum
ETYKRVPIKNMMICQMIQNH

SEQ ID NO: 3258049 - protein, 18 aa, Plasmodium falciparum
EVCMLSRIYALYKNENIT

SEQ ID NO: 3258050 - protein, 22 aa, Plasmodium falciparum
EVCNMFRLRNFIIFKNMIKKEH

SEQ ID NO: 3258051 - protein, 17 aa, Plasmodium falciparum
EVESSGLVEMILKENYN

SEQ ID NO: 3258052 - protein, 21 aa, Plasmodium falciparum
EVFSIFNTLCLFNIDEKIKIL

SEQ ID NO: 3258053 - protein, 20 aa, Plasmodium falciparum
EVGKIGIPVLILGGKDDEYC

SEQ ID NO: 3258054 - protein, 25 aa, Plasmodium falciparum
EVGKTVSLLGMWYVCNIFYNIENKK

SEQ ID NO: 3258055 - protein, 26 aa, Plasmodium falciparum
EVIFYCLSFRFNIHRNNLFNSIDINE

SEQ ID NO: 3258056 - protein, 22 aa, Plasmodium falciparum
EVIINIFMCLSIHNNIKRLAMF

SEQ ID NO: 3258057 - protein, 24 aa, Plasmodium falciparum
EVIKQYLFHKLRLEYYESIRDQKK

SEQ ID NO: 3258058 - protein, 19 aa, Plasmodium falciparum
EVINLSYFDIFLLLQNIYP

SEQ ID NO: 3258059 - protein, 22 aa, Plasmodium falciparum
EVIPELLVAEVIPEELVAEVIP

SEQ ID NO: 3258060 - protein, 21 aa, Plasmodium falciparum
EVKAPEICKDVIKAPTEPEEK

SEQ ID NO: 3258061 - protein, 22 aa, Plasmodium falciparum
EVKELGILVSFYSFSQCVMCLI

SEQ ID NO: 3258062 - protein, 26 aa, Plasmodium falciparum
EVKGYIPSILFFLLLIFLFQKITLKN

SEQ ID NO: 3258063 - protein, 24 aa, Plasmodium falciparum
EVKNYYLTVFFLDLLYIIKMEDQK

SEQ ID NO: 3258064 - protein, 21 aa, Plasmodium falciparum
EVKQRLRGLAQSYIYNPDESK

SEQ ID NO: 3258065 - protein, 18 aa, Plasmodium falciparum
EVKRRYICYKNKRNDQLY

SEQ ID NO: 3258066 - protein, 21 aa, Plasmodium falciparum
EVLEYVKREWIEFRKSMFDVW

SEQ ID NO: 3258067 - protein, 18 aa, Plasmodium falciparum
EVLFNLLANRGRGKSATL

SEQ ID NO: 3258068 - protein, 18 aa, Plasmodium falciparum
EVLIGYWYHGIPVGPFKC

SEQ ID NO: 3258069 - protein, 18 aa, Plasmodium falciparum
EVLKCKRGDSIQKIKKNY

SEQ ID NO: 3258070 - protein, 20 aa, Plasmodium falciparum
EVLKKLKNTILIKRDIDEIY

SEQ ID NO: 3258071 - protein, 20 aa, Plasmodium falciparum
EVLLCALIGLYTAYINNALE

SEQ ID NO: 3258072 - protein, 25 aa, Plasmodium falciparum
EVLQHGCCLGLGLVCLGDSNDENTY

SEQ ID NO: 3258073 - protein, 25 aa, Plasmodium falciparum
EVLRNIKFIYDYKMKVTKMNALIEP

SEQ ID NO: 3258074 - protein, 35 aa, Plasmodium falciparum
EVLSKIPEPIIREAPKYVPKKPVPPQHIPRGDNVP

SEQ ID NO: 3258075 - protein, 23 aa, Plasmodium falciparum
EVMNRVYICKIMCELYRTLRREK

SEQ ID NO: 3258076 - protein, 19 aa, Plasmodium falciparum
EVNIGPFIVDFLLLNKNHH

SEQ ID NO: 3258077 - protein, 22 aa, Plasmodium falciparum
EVNKKFFLHIYIIYEDMKLLVS

SEQ ID NO: 3258078 - protein, 17 aa, Plasmodium falciparum
EVPNLYLDVFRRNSGDE

SEQ ID NO: 3258079 - protein, 25 aa, Plasmodium falciparum
EVPTMDWAKLIAFGDFSDGVTLHAI

SEQ ID NO: 3258080 - protein, 19 aa, Plasmodium falciparum
EVPTYFDYVPQYLRWFEEW

SEQ ID NO: 3258081 - protein, 27 aa, Plasmodium falciparum
EVQYAYPYIFGFDCKWLGAENELTYIN

SEQ ID NO: 3258082 - protein, 24 aa, Plasmodium falciparum
EVSKCNLCKGAFLYANLKFDNVPS

SEQ ID NO: 3258083 - protein, 27 aa, Plasmodium falciparum
EVSKRLFRLANLYLYTTKFVEDNNNNP

SEQ ID NO: 3258084 - protein, 23 aa, Plasmodium falciparum
EVSVPRLSVSEFKNNDDVSLNKE

SEQ ID NO: 3258085 - protein, 21 aa, Plasmodium falciparum
EVSYFKLINWAPMVTPTIYNQ

SEQ ID NO: 3258086 - protein, 18 aa, Plasmodium falciparum
EVTNKCIIHLKNRWNNNN

SEQ ID NO: 3258087 - protein, 17 aa, Plasmodium falciparum
EVTVWWLSLGILSSIGL

SEQ ID NO: 3258088 - protein, 18 aa, Plasmodium falciparum
EVVCNIFNRSIYRIKRIS

SEQ ID NO: 3258089 - protein, 17 aa, Plasmodium falciparum
EVVKLQIKINEKSNELD

SEQ ID NO: 3258090 - protein, 20 aa, Plasmodium falciparum
EVVRLLQGYLINWDNDMYSE

SEQ ID NO: 3258091 - protein, 18 aa, Plasmodium falciparum
EVYALLPKKLEIFEKKRI

SEQ ID NO: 3258092 - protein, 18 aa, Plasmodium falciparum
EVYATFFVRTELIETYLL

SEQ ID NO: 3258093 - protein, 19 aa, Plasmodium falciparum
EVYKIIGTKLYKHIQETIK

SEQ ID NO: 3258094 - protein, 19 aa, Plasmodium falciparum
EWDRICFDLIELLKSNKKL

SEQ ID NO: 3258095 - protein, 24 aa, Plasmodium falciparum
EWECDKLCNSVVCFLKKKNENGTD

SEQ ID NO: 3258096 - protein, 23 aa, Plasmodium falciparum
EWEKICSDYEKFTSGNVEDIIHK

SEQ ID NO: 3258097 - protein, 18 aa, Plasmodium falciparum
EWISKIINSVEEWEHEYW

SEQ ID NO: 3258098 - protein, 29 aa, Plasmodium falciparum
EWKCHRDFYCSCCIYVSDNYFEMQNHFFL

SEQ ID NO: 3258099 - protein, 23 aa, Plasmodium falciparum
EWKIFRIVGELTFIENFNELNKN

SEQ ID NO: 3258100 - protein, 29 aa, Plasmodium falciparum
EWKKEYDEFPSLRQDFSYNVYSRNRKSSE

SEQ ID NO: 3258101 - protein, 23 aa, Plasmodium falciparum
EWLSDDCWENILILSKFKEFENL

SEQ ID NO: 3258102 - protein, 27 aa, Plasmodium falciparum
EWLSFITRFSICFIHWMKNHDENLINF

SEQ ID NO: 3258103 - protein, 20 aa, Plasmodium falciparum
EWRRRKEISKMFMKQQNDIS

SEQ ID NO: 3258104 - protein, 21 aa, Plasmodium falciparum
EYCKPCPYCGGKFVDGVFRSE

SEQ ID NO: 3258105 - protein, 22 aa, Plasmodium falciparum
EYCLKFLKACIQLKNIISNIVN

SEQ ID NO: 3258106 - protein, 19 aa, Plasmodium falciparum
EYCQACPLCGVEKESNGGG

SEQ ID NO: 3258107 - protein, 26 aa, Plasmodium falciparum
EYCQACPWCGAKRKGKGWEPKEKTCG

SEQ ID NO: 3258108 - protein, 26 aa, Plasmodium falciparum
EYCQACPWCGVVCKSGNCTKNPEGSC

SEQ ID NO: 3258109 - protein, 30 aa, Plasmodium falciparum
EYDLPKFCVLECLKVFYLKRKEKKFSYSKI

SEQ ID NO: 3258110 - protein, 30 aa, Plasmodium falciparum
EYDVIKSYIFEYFHWYLSKKLCTYNQPHVF

SEQ ID NO: 3258111 - protein, 22 aa, Plasmodium falciparum
EYEEFLKLQLLHINSNINTIHK

SEQ ID NO: 3258112 - protein, 22 aa, Plasmodium falciparum
EYEIHPNPIIIEMIDVFHSDIY

SEQ ID NO: 3258113 - protein, 24 aa, Plasmodium falciparum
EYEKEKRINDRFDRIRTSLKKYKL

SEQ ID NO: 3258114 - protein, 17 aa, Plasmodium falciparum
EYETFKQAFATSRISLL

SEQ ID NO: 3258115 - protein, 18 aa, Plasmodium falciparum
EYFDICFDLLKKGNMYYT

SEQ ID NO: 3258116 - protein, 17 aa, Plasmodium falciparum
EYFDICFDLLKNGNMYY

SEQ ID NO: 3258117 - protein, 31 aa, Plasmodium falciparum
EYFKIELSINFSITFIFINILLVFFSTFLYR

SEQ ID NO: 3258118 - protein, 24 aa, Plasmodium falciparum
EYFYLNKYIPVHFELQNKGIINYN

SEQ ID NO: 3258119 - protein, 26 aa, Plasmodium falciparum
EYGDEEMLSCFHRFYESIEANENDLS

SEQ ID NO: 3258120 - protein, 17 aa, Plasmodium falciparum
EYGINFFDICEYDPFPF

SEQ ID NO: 3258121 - protein, 19 aa, Plasmodium falciparum
EYHMPIFFYEHINEEENEI

SEQ ID NO: 3258122 - protein, 19 aa, Plasmodium falciparum
EYIAPEILLNVGHGKAADW

SEQ ID NO: 3258123 - protein, 21 aa, Plasmodium falciparum
EYIEEVIKCITWDDKTFYPFV

SEQ ID NO: 3258124 - protein, 21 aa, Plasmodium falciparum
EYIEKICLLKNINLNKYIKYK

SEQ ID NO: 3258125 - protein, 25 aa, Plasmodium falciparum
EYIFCNFLILLFLYKFLSKEKQKDI

SEQ ID NO: 3258126 - protein, 17 aa, Plasmodium falciparum
EYIIYNIFENVIKTSKE

SEQ ID NO: 3258127 - protein, 26 aa, Plasmodium falciparum
EYIKKDCILDNYILEYKKLYDNLDYY

SEQ ID NO: 3258128 - protein, 17 aa, Plasmodium falciparum
EYIKRYVTIYPEQIIHL

SEQ ID NO: 3258129 - protein, 17 aa, Plasmodium falciparum
EYINVIINYCINNLNNL

SEQ ID NO: 3258130 - protein, 23 aa, Plasmodium falciparum
EYIQELIHLLFVIFQLKKLALNK

SEQ ID NO: 3258131 - protein, 26 aa, Plasmodium falciparum
EYIREVFRQTFLWAPLYVLLILWFST

SEQ ID NO: 3258132 - protein, 18 aa, Plasmodium falciparum
EYIYECIEIFIEDNNTIV

SEQ ID NO: 3258133 - protein, 25 aa, Plasmodium falciparum
EYIYFKNYCHIFFKCIINLIHENCL

SEQ ID NO: 3258134 - protein, 19 aa, Plasmodium falciparum
EYIYFWLVFVNEGYSLSKH

SEQ ID NO: 3258135 - protein, 23 aa, Plasmodium falciparum
EYKEIINDIFLKYFDKHITYKTN

SEQ ID NO: 3258136 - protein, 20 aa, Plasmodium falciparum
EYKHLVPIYLDLKKELKKVN

SEQ ID NO: 3258137 - protein, 24 aa, Plasmodium falciparum
EYKIKYYLEIYKKDILNEITESKV

SEQ ID NO: 3258138 - protein, 24 aa, Plasmodium falciparum
EYKKFSNKNVMSFEFNSDIQNDIG

SEQ ID NO: 3258139 - protein, 20 aa, Plasmodium falciparum
EYKKVILKKLKFMNKRINNY

SEQ ID NO: 3258140 - protein, 20 aa, Plasmodium falciparum
EYKKYCSFLKRTHKKKKKKK

SEQ ID NO: 3258141 - protein, 19 aa, Plasmodium falciparum
EYKNLKKAINYYLIAAHLS

SEQ ID NO: 3258142 - protein, 27 aa, Plasmodium falciparum
EYLAQKSCFEFVYLILYILNNLFLIDE

SEQ ID NO: 3258143 - protein, 21 aa, Plasmodium falciparum
EYLFNRQVFFSKYINKNQGLT

SEQ ID NO: 3258144 - protein, 24 aa, Plasmodium falciparum
EYLIKDISCKLFFTNNKQDQLLKK

SEQ ID NO: 3258145 - protein, 19 aa, Plasmodium falciparum
EYLMGLYVLFFFILLVIAL

SEQ ID NO: 3258146 - protein, 29 aa, Plasmodium falciparum
EYLNLYTCTHILCVLAYLNIKNDEYPYFF

SEQ ID NO: 3258147 - protein, 31 aa, Plasmodium falciparum
EYLNYGILCELRILYELNIIDLIYLLEVEEI

SEQ ID NO: 3258148 - protein, 20 aa, Plasmodium falciparum
EYMFPFYSFILFKFVKMLSL

SEQ ID NO: 3258149 - protein, 22 aa, Plasmodium falciparum
EYMPLRWKSIVFLLAAFIIGCF

SEQ ID NO: 3258150 - protein, 28 aa, Plasmodium falciparum
EYMREIRLLGKCMLSFDEGNNWKNEVMN

SEQ ID NO: 3258151 - protein, 25 aa, Plasmodium falciparum
EYMSPYCLKGIYSIRTDIYSIGVTI

SEQ ID NO: 3258152 - protein, 25 aa, Plasmodium falciparum
EYNFLRILKFFSFFLEHYKNTCSTQ

SEQ ID NO: 3258153 - protein, 19 aa, Plasmodium falciparum
EYNKLCLKNSGTVPKKNGN

SEQ ID NO: 3258154 - protein, 32 aa, Plasmodium falciparum
EYNKVFDILFDYCDIKNKLLILDENVIMDTIQ

SEQ ID NO: 3258155 - protein, 26 aa, Plasmodium falciparum
EYNYFIPIQILYKVKSRYCISLIKDL

SEQ ID NO: 3258156 - protein, 26 aa, Plasmodium falciparum
EYPNCKDYYFSLVFGDLKSSETLKGI

SEQ ID NO: 3258157 - protein, 35 aa, Plasmodium falciparum
EYPNLKYLLSVCSSILFWLNFNKKDNFAIINYHKI

SEQ ID NO: 3258158 - protein, 18 aa, Plasmodium falciparum
EYPYFFNKILNVFRHNIK

SEQ ID NO: 3258159 - protein, 26 aa, Plasmodium falciparum
EYRILIIACRLIWRKLKKNTLQSLEH

SEQ ID NO: 3258160 - protein, 32 aa, Plasmodium falciparum
EYRLTDVLLPSAFPLSVGIAFVALSYFVLKKK

SEQ ID NO: 3258161 - protein, 26 aa, Plasmodium falciparum
EYRRLTVLCRTGWKALYNYVENICKE

SEQ ID NO: 3258162 - protein, 28 aa, Plasmodium falciparum
EYSEGFRNSCIFTMQFILNRINYCKEKI

SEQ ID NO: 3258163 - protein, 26 aa, Plasmodium falciparum
EYSFLRWFVEWGQNFCIRHEKELKQL

SEQ ID NO: 3258164 - protein, 17 aa, Plasmodium falciparum
EYSRLVYKYLQYINKKS

SEQ ID NO: 3258165 - protein, 17 aa, Plasmodium falciparum
EYTPSCYNYTLNDNDGI

SEQ ID NO: 3258166 - protein, 25 aa, Plasmodium falciparum
EYTTFKVLIVYWLEDFLYSYYILKK

SEQ ID NO: 3258167 - protein, 20 aa, Plasmodium falciparum
EYWWTANRNDVWKAITCSAD

SEQ ID NO: 3258168 - protein, 17 aa, Plasmodium falciparum
EYYNCIKSEIKSPEYKC

SEQ ID NO: 3258169 - protein, 22 aa, Plasmodium falciparum
EYYSNYIIFIILKFFENNNIKV

SEQ ID NO: 3258170 - protein, 18 aa, Plasmodium falciparum
FAADKCLVHSILKYIEES

SEQ ID NO: 3258171 - protein, 17 aa, Plasmodium falciparum
FAALSYFLLKKKSKFSV

SEQ ID NO: 3258172 - protein, 17 aa, Plasmodium falciparum
FAAYSFLYFFLISLDKY

SEQ ID NO: 3258173 - protein, 20 aa, Plasmodium falciparum
FACGDCRIGPSTVVQAIAEG

SEQ ID NO: 3258174 - protein, 30 aa, Plasmodium falciparum
FACGIKRKSIKWICRENSEKITVCVPDRKI

SEQ ID NO: 3258175 - protein, 21 aa, Plasmodium falciparum
FACKVQHKLHLAKKEIYFSYL

SEQ ID NO: 3258176 - protein, 19 aa, Plasmodium falciparum
FADATWKTVNEIFMLTKTN

SEQ ID NO: 3258177 - protein, 20 aa, Plasmodium falciparum
FADKKIHLFSNFQNGNNKYI

SEQ ID NO: 3258178 - protein, 24 aa, Plasmodium falciparum
FAEYADNLMAKWFSKGFEEYKREQ

SEQ ID NO: 3258179 - protein, 17 aa, Plasmodium falciparum
FAFAPVVVDMFKLTPSH

SEQ ID NO: 3258180 - protein, 19 aa, Plasmodium falciparum
FAFFNRFLYYLLHQERNIY

SEQ ID NO: 3258181 - protein, 18 aa, Plasmodium falciparum
FAFSCFYCYVDEKYSKEH

SEQ ID NO: 3258182 - protein, 20 aa, Plasmodium falciparum
FAGDLSVCADADIFTGIKEH

SEQ ID NO: 3258183 - protein, 25 aa, Plasmodium falciparum
FAGKKSFKLKIWIDGHKSSKKNYVS

SEQ ID NO: 3258184 - protein, 22 aa, Plasmodium falciparum
FAHIFIYFIICNAIRKNLNENI

SEQ ID NO: 3258185 - protein, 17 aa, Plasmodium falciparum
FAIGYFRKQGFSQKISM

SEQ ID NO: 3258186 - protein, 35 aa, Plasmodium falciparum
FAISACIFGILSAHLKNFIFFSISLWLCLFTGSAL

SEQ ID NO: 3258187 - protein, 22 aa, Plasmodium falciparum
FAKCLKINELLILRIEENLAAD

SEQ ID NO: 3258188 - protein, 20 aa, Plasmodium falciparum
FAKSYIRRSNAYEQLQKYND

SEQ ID NO: 3258189 - protein, 24 aa, Plasmodium falciparum
FALFFPISICYKINGVCDFSSEGL

SEQ ID NO: 3258190 - protein, 26 aa, Plasmodium falciparum
FALMAGILFFQVYRLTKKHYYNRKKT

SEQ ID NO: 3258191 - protein, 20 aa, Plasmodium falciparum
FAMMQYRLMKYIGHLTNTYD

SEQ ID NO: 3258192 - protein, 23 aa, Plasmodium falciparum
FANGRYDKLLSIKKIFMIFYNYL

SEQ ID NO: 3258193 - protein, 28 aa, Plasmodium falciparum
FANQRKNYIISFICYYILKDEDSAINSL

SEQ ID NO: 3258194 - protein, 19 aa, Plasmodium falciparum
FANRDKVWEAMKCEQNGIT

SEQ ID NO: 3258195 - protein, 20 aa, Plasmodium falciparum
FANWLKKDFVGNLFKNDFVF

SEQ ID NO: 3258196 - protein, 18 aa, Plasmodium falciparum
FAPIIPNLCIVLLIYFKA

SEQ ID NO: 3258197 - protein, 17 aa, Plasmodium falciparum
FAQDIYDLYSLTISKDS

SEQ ID NO: 3258198 - protein, 17 aa, Plasmodium falciparum
FARPCTEDGVAEQDTIM

SEQ ID NO: 3258199 - protein, 18 aa, Plasmodium falciparum
FASHGIPVKCFMKKDDLE

SEQ ID NO: 3258200 - protein, 17 aa, Plasmodium falciparum
FASLAFFMSYKIHEFIK

SEQ ID NO: 3258201 - protein, 20 aa, Plasmodium falciparum
FATEIYKELFDIFLKNISLT

SEQ ID NO: 3258202 - protein, 27 aa, Plasmodium falciparum
FATYVLHKILKTCASRWDRTNDRENID

SEQ ID NO: 3258203 - protein, 20 aa, Plasmodium falciparum
FAVICMLSLNLSIFENNNNN

SEQ ID NO: 3258204 - protein, 19 aa, Plasmodium falciparum
FAVIHIYKFFFYKKNIDIF

SEQ ID NO: 3258205 - protein, 21 aa, Plasmodium falciparum
FAVLFSNYFFYEGIEHLNKKK

SEQ ID NO: 3258206 - protein, 22 aa, Plasmodium falciparum
FAVPCKNIFSFSHIPTRRLGYM

SEQ ID NO: 3258207 - protein, 19 aa, Plasmodium falciparum
FAYCITKLLIMFFEEPPAV

SEQ ID NO: 3258208 - protein, 33 aa, Plasmodium falciparum
FAYWSVRSVYTFFGFVLWLLFHYRTRPEVSSLL

SEQ ID NO: 3258209 - protein, 18 aa, Plasmodium falciparum
FCALAAGGLGAFIGNPAD

SEQ ID NO: 3258210 - protein, 17 aa, Plasmodium falciparum
FCCCVGMPVMFTLGCIS

SEQ ID NO: 3258211 - protein, 22 aa, Plasmodium falciparum
FCCDDKYKGCNLYLHIAKTKKL

SEQ ID NO: 3258212 - protein, 17 aa, Plasmodium falciparum
FCDILMIKYYMRKYVRL

SEQ ID NO: 3258213 - protein, 17 aa, Plasmodium falciparum
FCDIPKPLIKISSKQTK

SEQ ID NO: 3258214 - protein, 17 aa, Plasmodium falciparum
FCESVWNQTLAVSQRNM

SEQ ID NO: 3258215 - protein, 25 aa, Plasmodium falciparum
FCFAISYLLYCHIIWNGCYNIYSSS

SEQ ID NO: 3258216 - protein, 27 aa, Plasmodium falciparum
FCFSKKWFSEFSIMWPGQAFSLKIKKI

SEQ ID NO: 3258217 - protein, 27 aa, Plasmodium falciparum
FCGTLEREAAAFLNSLKNGPCKKENGK

SEQ ID NO: 3258218 - protein, 25 aa, Plasmodium falciparum
FCGVPSIYRLLMRLHTYKYIELRIN

SEQ ID NO: 3258219 - protein, 19 aa, Plasmodium falciparum
FCHYKEFVIKKVIYMLINN

SEQ ID NO: 3258220 - protein, 21 aa, Plasmodium falciparum
FCIETIFYKWIDDFMNLCSGI

SEQ ID NO: 3258221 - protein, 18 aa, Plasmodium falciparum
FCIGGSLVTIPVITLKKY

SEQ ID NO: 3258222 - protein, 17 aa, Plasmodium falciparum
FCIKFREIHKIGNTERI

SEQ ID NO: 3258223 - protein, 20 aa, Plasmodium falciparum
FCILLHKWIAGVTVSLSLNS

SEQ ID NO: 3258224 - protein, 17 aa, Plasmodium falciparum
FCILWSALTASRFFEVA

SEQ ID NO: 3258225 - protein, 20 aa, Plasmodium falciparum
FCKGDRTLELELIKQRIING

SEQ ID NO: 3258226 - protein, 21 aa, Plasmodium falciparum
FCKGFPKYVSHEGFLFGKNYK

SEQ ID NO: 3258227 - protein, 23 aa, Plasmodium falciparum
FCKTKNLYFGYSLQPGHFYEISF

SEQ ID NO: 3258228 - protein, 20 aa, Plasmodium falciparum
FCLNCSGSYLKNSRWLSETS

SEQ ID NO: 3258229 - protein, 18 aa, Plasmodium falciparum
FCMNNKCMNDICLGENCE

SEQ ID NO: 3258230 - protein, 18 aa, Plasmodium falciparum
FCNLTCSYQKTKVYTLQL

SEQ ID NO: 3258231 - protein, 26 aa, Plasmodium falciparum
FCNYRKFIDMYSLPYILDVFIMLNKF

SEQ ID NO: 3258232 - protein, 25 aa, Plasmodium falciparum
FCPVGGIKYNSFFILTNVLNEQDKI

SEQ ID NO: 3258233 - protein, 23 aa, Plasmodium falciparum
FCRNQLRYILLLYVKRLIMVLEG

SEQ ID NO: 3258234 - protein, 18 aa, Plasmodium falciparum
FCRQRTRMLEKIKDDCKV

SEQ ID NO: 3258235 - protein, 19 aa, Plasmodium falciparum
FCSFCTYIISLLHYENNII

SEQ ID NO: 3258236 - protein, 18 aa, Plasmodium falciparum
FCSIGSTLLTLIGLALAK

SEQ ID NO: 3258237 - protein, 21 aa, Plasmodium falciparum
FCSLFGYDMYDCVYPSRTARF

SEQ ID NO: 3258238 - protein, 20 aa, Plasmodium falciparum
FCSSALFLLTSILSFKLANV

SEQ ID NO: 3258239 - protein, 17 aa, Plasmodium falciparum
FCSSNFFEKHINYLKIK

SEQ ID NO: 3258240 - protein, 19 aa, Plasmodium falciparum
FCSTNCMNYNLGLLKLINQ

SEQ ID NO: 3258241 - protein, 28 aa, Plasmodium falciparum
FCSYEITSILWAISIILIKSFKNSTYIG

SEQ ID NO: 3258242 - protein, 21 aa, Plasmodium falciparum
FCTFYVISLFFLYISSFCKSI

SEQ ID NO: 3258243 - protein, 24 aa, Plasmodium falciparum
FCVIFGMTFSLLWLPLVLISIYLA

SEQ ID NO: 3258244 - protein, 20 aa, Plasmodium falciparum
FCWIFLISFLYLINVIVCKQ

SEQ ID NO: 3258245 - protein, 17 aa, Plasmodium falciparum
FCYELFYSPNKKLKNRL

SEQ ID NO: 3258246 - protein, 17 aa, Plasmodium falciparum
FCYNGIRIGQGYDIHKI

SEQ ID NO: 3258247 - protein, 25 aa, Plasmodium falciparum
FDCDLIGFFCPFSLNRDYNFVSTSD

SEQ ID NO: 3258248 - protein, 23 aa, Plasmodium falciparum
FDCSDIILQQCELFDNNMIITLS

SEQ ID NO: 3258249 - protein, 18 aa, Plasmodium falciparum
FDCSIYSYCLGPCLENSF

SEQ ID NO: 3258250 - protein, 20 aa, Plasmodium falciparum
FDCYIYIFIFFKYIKHLRNT

SEQ ID NO: 3258251 - protein, 21 aa, Plasmodium falciparum
FDDIFLISIMDLWETNNNNNL

SEQ ID NO: 3258252 - protein, 32 aa, Plasmodium falciparum
FDDPSYTCFRKEAFSSMPYYAGAGVLFIILVI

SEQ ID NO: 3258253 - protein, 20 aa, Plasmodium falciparum
FDDSIKCLLNNIISFSYDLY

SEQ ID NO: 3258254 - protein, 18 aa, Plasmodium falciparum
FDEEFKMFENCASVDVNR

SEQ ID NO: 3258255 - protein, 18 aa, Plasmodium falciparum
FDEFFYVWVRKLLIDSIK

SEQ ID NO: 3258256 - protein, 24 aa, Plasmodium falciparum
FDEFKTSQQLFLLLHLMYKLSQLF

SEQ ID NO: 3258257 - protein, 24 aa, Plasmodium falciparum
FDEKKNIFEFLNPIFNYDNVQNFI

SEQ ID NO: 3258258 - protein, 18 aa, Plasmodium falciparum
FDELGNFFFIYGKKIYVN

SEQ ID NO: 3258259 - protein, 20 aa, Plasmodium falciparum
FDELPWLTSLSDLKNSVTYN

SEQ ID NO: 3258260 - protein, 19 aa, Plasmodium falciparum
FDETFDFFDEDAKRNIDDI

SEQ ID NO: 3258261 - protein, 22 aa, Plasmodium falciparum
FDFGCNIIIKIIEYCSYDKITL

SEQ ID NO: 3258262 - protein, 17 aa, Plasmodium falciparum
FDFISSYLTVDWEMFIN

SEQ ID NO: 3258263 - protein, 23 aa, Plasmodium falciparum
FDFSNSLFKYVMNYLEEINLLNA

SEQ ID NO: 3258264 - protein, 24 aa, Plasmodium falciparum
FDGHKGCFISFFYKEGEHPDDKNL

SEQ ID NO: 3258265 - protein, 25 aa, Plasmodium falciparum
FDHHCPWVGNCIGARNYKYFVYFVF

SEQ ID NO: 3258266 - protein, 20 aa, Plasmodium falciparum
FDIDKCFLYNNHINMDVQTK

SEQ ID NO: 3258267 - protein, 20 aa, Plasmodium falciparum
FDIFIKKYLLNVFVANILWE

SEQ ID NO: 3258268 - protein, 18 aa, Plasmodium falciparum
FDIFRIVADYENIYIISG

SEQ ID NO: 3258269 - protein, 22 aa, Plasmodium falciparum
FDIILRIKVIFIIITIFHVILV

SEQ ID NO: 3258270 - protein, 28 aa, Plasmodium falciparum
FDIMCFQVCDIYEYMCRYEKDDFFFEQL

SEQ ID NO: 3258271 - protein, 24 aa, Plasmodium falciparum
FDISLNILYHFFLLIPLHNHKNVI

SEQ ID NO: 3258272 - protein, 28 aa, Plasmodium falciparum
FDISQSFHIARYAFPFFMQTKQNEKQVH

SEQ ID NO: 3258273 - protein, 17 aa, Plasmodium falciparum
FDKFKIICDQNVNDLLN

SEQ ID NO: 3258274 - protein, 26 aa, Plasmodium falciparum
FDKFLFYCFKQLLSSFFTEDKNIVYM

SEQ ID NO: 3258275 - protein, 18 aa, Plasmodium falciparum
FDKICSISPNELINRFFE

SEQ ID NO: 3258276 - protein, 18 aa, Plasmodium falciparum
FDKIEFFVPPSCDDISLD

SEQ ID NO: 3258277 - protein, 23 aa, Plasmodium falciparum
FDKIHLGHILLLFYSIFLTKNFF

SEQ ID NO: 3258278 - protein, 17 aa, Plasmodium falciparum
FDKIKETILPPVTKKVE

SEQ ID NO: 3258279 - protein, 18 aa, Plasmodium falciparum
FDKKRLVDRQKISQSFLD

SEQ ID NO: 3258280 - protein, 24 aa, Plasmodium falciparum
FDKLFYKLYESLGIILVGIETNTT

SEQ ID NO: 3258281 - protein, 17 aa, Plasmodium falciparum
FDKLQIVSNENIKIKNE

SEQ ID NO: 3258282 - protein, 17 aa, Plasmodium falciparum
FDKMKYLIISKGINGIT

SEQ ID NO: 3258283 - protein, 26 aa, Plasmodium falciparum
FDKNGVCIDSILKLGFSFIEIGTITP

SEQ ID NO: 3258284 - protein, 17 aa, Plasmodium falciparum
FDKSKHRSYKKVSVHIM

SEQ ID NO: 3258285 - protein, 17 aa, Plasmodium falciparum
FDKTCIFLTSPNKFIKL

SEQ ID NO: 3258286 - protein, 17 aa, Plasmodium falciparum
FDKVMNISINQWLRLGL

SEQ ID NO: 3258287 - protein, 19 aa, Plasmodium falciparum
FDLCCGTGTISICASNVLK

SEQ ID NO: 3258288 - protein, 28 aa, Plasmodium falciparum
FDLISKRMKSVFLFYKIDHTLFENSDLS

SEQ ID NO: 3258289 - protein, 17 aa, Plasmodium falciparum
FDLKNEMIFDTLLSSKK

SEQ ID NO: 3258290 - protein, 18 aa, Plasmodium falciparum
FDLLKYLVKEENLMKILC

SEQ ID NO: 3258291 - protein, 18 aa, Plasmodium falciparum
FDLNYKLIIILINEYENY

SEQ ID NO: 3258292 - protein, 19 aa, Plasmodium falciparum
FDLWLFLRGERHGKRTLIN

SEQ ID NO: 3258293 - protein, 17 aa, Plasmodium falciparum
FDLYKCIYIYLYNNIIN

SEQ ID NO: 3258294 - protein, 19 aa, Plasmodium falciparum
FDMICPYLDITNIRIQNKI

SEQ ID NO: 3258295 - protein, 27 aa, Plasmodium falciparum
FDNDILFYLNICTKFYFSKDRNETCQI

SEQ ID NO: 3258296 - protein, 30 aa, Plasmodium falciparum
FDNICKIKLNIIFDKSFLFCFLKNLEKSSY

SEQ ID NO: 3258297 - protein, 18 aa, Plasmodium falciparum
FDNIILLYADQIFNKFTN

SEQ ID NO: 3258298 - protein, 21 aa, Plasmodium falciparum
FDNIIPLIFKKYDIKYIYGLY

SEQ ID NO: 3258299 - protein, 17 aa, Plasmodium falciparum
FDNLGLFIRLMTKCKMN

SEQ ID NO: 3258300 - protein, 29 aa, Plasmodium falciparum
FDNLKCHLYYYLHMLLNYNMEHILCDKIN

SEQ ID NO: 3258301 - protein, 26 aa, Plasmodium falciparum
FDNMYFILSSISYKNVFHMNIMHIHM

SEQ ID NO: 3258302 - protein, 20 aa, Plasmodium falciparum
FDNNFCLFLCNIIIKIFNLD

SEQ ID NO: 3258303 - protein, 21 aa, Plasmodium falciparum
FDNSFSLVKIIFCCSFVLCLS

SEQ ID NO: 3258304 - protein, 18 aa, Plasmodium falciparum
FDNSITFYYYIKEFLLLS

SEQ ID NO: 3258305 - protein, 19 aa, Plasmodium falciparum
FDPILLFSQYIIRLTNDDD

SEQ ID NO: 3258306 - protein, 35 aa, Plasmodium falciparum
FDPNKRISNTVCAANHPWLKYFHILNKTQKNKKNK

SEQ ID NO: 3258307 - protein, 23 aa, Plasmodium falciparum
FDQSICIQNNFLLYDHTLNHLNM

SEQ ID NO: 3258308 - protein, 18 aa, Plasmodium falciparum
FDRKKRIATYPTKSCFPM

SEQ ID NO: 3258309 - protein, 27 aa, Plasmodium falciparum
FDSLSVMLCLLIKVFGLYLDCSSYDLI

SEQ ID NO: 3258310 - protein, 18 aa, Plasmodium falciparum
FDSNASFKLSDEYSSSIY

SEQ ID NO: 3258311 - protein, 24 aa, Plasmodium falciparum
FDSNRLGSKYIYRMNGHHHHNNNN

SEQ ID NO: 3258312 - protein, 36 aa, Plasmodium falciparum
FDSVLRPLWKGITEYRGKVLASFLKAIGLIIPLMDS

SEQ ID NO: 3258313 - protein, 25 aa, Plasmodium falciparum
FDSYCTDCACYYCCCSSSSCPLEND

SEQ ID NO: 3258314 - protein, 18 aa, Plasmodium falciparum
FDTTEYVHRCGRIGRINN

SEQ ID NO: 3258315 - protein, 19 aa, Plasmodium falciparum
FDTYCLVAFIVIGVVAGLA

SEQ ID NO: 3258316 - protein, 25 aa, Plasmodium falciparum
FDVFEYKMLIAANRLLWRKLSDKVQ

SEQ ID NO: 3258317 - protein, 23 aa, Plasmodium falciparum
FDVFKESFLDQMGCSDQDKDEIK

SEQ ID NO: 3258318 - protein, 25 aa, Plasmodium falciparum
FDVFNKYDYIIIYLLNYYLQKNNDI

SEQ ID NO: 3258319 - protein, 29 aa, Plasmodium falciparum
FDVKPRYPLLGGWKFHFFNTFYHFSNLYK

SEQ ID NO: 3258320 - protein, 18 aa, Plasmodium falciparum
FDYIEHFKDIILHKHVIK

SEQ ID NO: 3258321 - protein, 23 aa, Plasmodium falciparum
FDYKHLNFNEGLLIKHNFKKSLK

SEQ ID NO: 3258322 - protein, 26 aa, Plasmodium falciparum
FDYLIKMKGSCFCQKNYICIKDLDSC

SEQ ID NO: 3258323 - protein, 18 aa, Plasmodium falciparum
FDYNLWKKEIQNVKISNN

SEQ ID NO: 3258324 - protein, 24 aa, Plasmodium falciparum
FEAGIPECVICMYDIVLKPNKYCV

SEQ ID NO: 3258325 - protein, 22 aa, Plasmodium falciparum
FECDIIKLFIFILHILIVLFWL

SEQ ID NO: 3258326 - protein, 23 aa, Plasmodium falciparum
FECDILICGTSLLNTLLSVYFSI

SEQ ID NO: 3258327 - protein, 22 aa, Plasmodium falciparum
FEDFCDYINFIIRISKSNNIIA

SEQ ID NO: 3258328 - protein, 25 aa, Plasmodium falciparum
FEDIYNKFILAFGYYLCILNPIRVP

SEQ ID NO: 3258329 - protein, 24 aa, Plasmodium falciparum
FEDMIPVYVTFLFIIHAKTSLRMF

SEQ ID NO: 3258330 - protein, 20 aa, Plasmodium falciparum
FEDNFFKVAYDVILKKITSA

SEQ ID NO: 3258331 - protein, 18 aa, Plasmodium falciparum
FEEKICLEEEIGLDYIDP

SEQ ID NO: 3258332 - protein, 30 aa, Plasmodium falciparum
FEENHSLLLFYFYRCYTHLNYLIKKKNDVY

SEQ ID NO: 3258333 - protein, 24 aa, Plasmodium falciparum
FEEVPEVNTYFRGVFYSNNETDDN

SEQ ID NO: 3258334 - protein, 23 aa, Plasmodium falciparum
FEFKEKKYFLIFNNFLSKQQNQK

SEQ ID NO: 3258335 - protein, 20 aa, Plasmodium falciparum
FEFLNNLLLSIDVGNNDMNN

SEQ ID NO: 3258336 - protein, 20 aa, Plasmodium falciparum
FEFNVSPVLLFLILPINLQY

SEQ ID NO: 3258337 - protein, 21 aa, Plasmodium falciparum
FEFYISYLFLILLNEEKENYI

SEQ ID NO: 3258338 - protein, 27 aa, Plasmodium falciparum
FEGKKCLFFEKSLHVMLSVILNDDDIN

SEQ ID NO: 3258339 - protein, 17 aa, Plasmodium falciparum
FEGNFIFNIVIRTIIIK

SEQ ID NO: 3258340 - protein, 31 aa, Plasmodium falciparum
FEGYLNNLIIKWCYTDLIIILIRDMLSLNCN

SEQ ID NO: 3258341 - protein, 19 aa, Plasmodium falciparum
FEHIESIELNNIFCNILIT

SEQ ID NO: 3258342 - protein, 22 aa, Plasmodium falciparum
FEHIHNLCIHFEEKFKQECIHN

SEQ ID NO: 3258343 - protein, 18 aa, Plasmodium falciparum
FEHINKVGSILCMKFFYN

SEQ ID NO: 3258344 - protein, 24 aa, Plasmodium falciparum
FEHLKDCRAFEVLRNQRERCTYII

SEQ ID NO: 3258345 - protein, 25 aa, Plasmodium falciparum
FEHLQGGIIIYEFYEKRFKKLKLIL

SEQ ID NO: 3258346 - protein, 18 aa, Plasmodium falciparum
FEHPLYRDHLLSINIKIN

SEQ ID NO: 3258347 - protein, 21 aa, Plasmodium falciparum
FEICKSPDLSSYVSIMPYDRF

SEQ ID NO: 3258348 - protein, 25 aa, Plasmodium falciparum
FEIEKDWKINIDMHIDIEKLIKEYK

SEQ ID NO: 3258349 - protein, 24 aa, Plasmodium falciparum
FEIFLECKHFIFDKTGTLTVGKPV

SEQ ID NO: 3258350 - protein, 17 aa, Plasmodium falciparum
FEIILLKNLENILYYEK

SEQ ID NO: 3258351 - protein, 17 aa, Plasmodium falciparum
FEIKDPFYFHDNKNYIF

SEQ ID NO: 3258352 - protein, 19 aa, Plasmodium falciparum
FEIKYCIFYFTKIIKQLIK

SEQ ID NO: 3258353 - protein, 22 aa, Plasmodium falciparum
FEILYLLYELDLFKSPNNETLM

SEQ ID NO: 3258354 - protein, 24 aa, Plasmodium falciparum
FEINICPSSPCSKLSKVVGKGVTR

SEQ ID NO: 3258355 - protein, 32 aa, Plasmodium falciparum
FEIYYYKLDNFFSYKISNIFFSPHNNLHTAIN

SEQ ID NO: 3258356 - protein, 18 aa, Plasmodium falciparum
FEKENIWLTLISAKLRND

SEQ ID NO: 3258357 - protein, 19 aa, Plasmodium falciparum
FEKESICLSDEHMVDDEKK

SEQ ID NO: 3258358 - protein, 29 aa, Plasmodium falciparum
FEKIKLFLKLCSLYCDRKEIKILLEFLIY

SEQ ID NO: 3258359 - protein, 20 aa, Plasmodium falciparum
FEKKFLHECMNFDVLIEQKY

SEQ ID NO: 3258360 - protein, 19 aa, Plasmodium falciparum
FEKKFYRKLNRSIYEINSN

SEQ ID NO: 3258361 - protein, 27 aa, Plasmodium falciparum
FEKLRKRLLYKYKHTFRSKIKNLPDNA

SEQ ID NO: 3258362 - protein, 20 aa, Plasmodium falciparum
FEKRECCEYLIINKASNDIL

SEQ ID NO: 3258363 - protein, 19 aa, Plasmodium falciparum
FEKSRSSWTAQYKVSGGKR

SEQ ID NO: 3258364 - protein, 25 aa, Plasmodium falciparum
FELFTEGCYLFLLPNEKIKSNNIYT

SEQ ID NO: 3258365 - protein, 25 aa, Plasmodium falciparum
FELGIEMWQIKGLVFNELYACAKKT

SEQ ID NO: 3258366 - protein, 17 aa, Plasmodium falciparum
FELLLLPSKLIRLEILY

SEQ ID NO: 3258367 - protein, 26 aa, Plasmodium falciparum
FELMVVWKYSISNLFHKKYIAKKLCF

SEQ ID NO: 3258368 - protein, 21 aa, Plasmodium falciparum
FEMKDIKLADYELNFKSESVL

SEQ ID NO: 3258369 - protein, 18 aa, Plasmodium falciparum
FEMKRKYGKDYGLMKKGE

SEQ ID NO: 3258370 - protein, 18 aa, Plasmodium falciparum
FENIKYVLNKIFFLFHLL

SEQ ID NO: 3258371 - protein, 25 aa, Plasmodium falciparum
FENILTSLLLKPSIFINVLNSLHFI

SEQ ID NO: 3258372 - protein, 25 aa, Plasmodium falciparum
FENISEAYQILGYENRRKLYDLGEY

SEQ ID NO: 3258373 - protein, 25 aa, Plasmodium falciparum
FENLEKYLTCDFVAYDLGMNDWKSL

SEQ ID NO: 3258374 - protein, 23 aa, Plasmodium falciparum
FENLETLFTLYINYNINKKKKKL

SEQ ID NO: 3258375 - protein, 18 aa, Plasmodium falciparum
FENMCKRDIYIRNIYLHY

SEQ ID NO: 3258376 - protein, 19 aa, Plasmodium falciparum
FENMHKLKYENDCINTNKL

SEQ ID NO: 3258377 - protein, 24 aa, Plasmodium falciparum
FENVNARCALLSGPAGIGKTTTAK

SEQ ID NO: 3258378 - protein, 17 aa, Plasmodium falciparum
FEPCGGLFDSNELTSEK

SEQ ID NO: 3258379 - protein, 40 aa, Plasmodium falciparum
FEPFLELLCICKDLSCTNTMCYRSLIRYINVFIQNTILRI

SEQ ID NO: 3258380 - protein, 18 aa, Plasmodium falciparum
FEQKCFFIKIYSIKNDIY

SEQ ID NO: 3258381 - protein, 18 aa, Plasmodium falciparum
FERFEELLLKYFEINFEI

SEQ ID NO: 3258382 - protein, 17 aa, Plasmodium falciparum
FERVELKLNNIIYDKNN

SEQ ID NO: 3258383 - protein, 27 aa, Plasmodium falciparum
FERWNQLRYSLFYTISLMNSSIQYNHN

SEQ ID NO: 3258384 - protein, 17 aa, Plasmodium falciparum
FESDQYVFWSLAFSLMF

SEQ ID NO: 3258385 - protein, 23 aa, Plasmodium falciparum
FESECIPNSWILLDDKTNNQLKK

SEQ ID NO: 3258386 - protein, 18 aa, Plasmodium falciparum
FESFFWSWVSRMLNDSIK

SEQ ID NO: 3258387 - protein, 18 aa, Plasmodium falciparum
FESFVEKFLKEFYYDDEF

SEQ ID NO: 3258388 - protein, 22 aa, Plasmodium falciparum
FESLFIFFLFFAICIFYAIFFK

SEQ ID NO: 3258389 - protein, 36 aa, Plasmodium falciparum
FESYIKRNINFYNIFFKVIIPLLNRITNIFENLETL

SEQ ID NO: 3258390 - protein, 24 aa, Plasmodium falciparum
FETFELSGKIISDIYNVLKKNVLQ

SEQ ID NO: 3258391 - protein, 24 aa, Plasmodium falciparum
FEVICSKHFDILHSWDRISKLNEE

SEQ ID NO: 3258392 - protein, 17 aa, Plasmodium falciparum
FEVKDGWKSGADVSKEH

SEQ ID NO: 3258393 - protein, 21 aa, Plasmodium falciparum
FEVLFKRKKHISLLDKTIFKC

SEQ ID NO: 3258394 - protein, 21 aa, Plasmodium falciparum
FEVLHNLLLKGEFSTLPLEEK

SEQ ID NO: 3258395 - protein, 27 aa, Plasmodium falciparum
FEVNVKMYFIVSGMFILYNRGFFDLII

SEQ ID NO: 3258396 - protein, 20 aa, Plasmodium falciparum
FEVPLVIKLDIEFLQCYIKN

SEQ ID NO: 3258397 - protein, 20 aa, Plasmodium falciparum
FEVSSNLGLLGDVYMSEEIV

SEQ ID NO: 3258398 - protein, 18 aa, Plasmodium falciparum
FEVTCFCPVGGIKYNSFF

SEQ ID NO: 3258399 - protein, 29 aa, Plasmodium falciparum
FEYFFNVLCLLYFLKNIYFDLNYKTNENS

SEQ ID NO: 3258400 - protein, 17 aa, Plasmodium falciparum
FEYICANSTVLHKDIKK

SEQ ID NO: 3258401 - protein, 18 aa, Plasmodium falciparum
FFACNPYVEWIEKQKEQF

SEQ ID NO: 3258402 - protein, 17 aa, Plasmodium falciparum
FFAEMVFNYNTFNGRCI

SEQ ID NO: 3258403 - protein, 27 aa, Plasmodium falciparum
FFAFFIALKYFNRCLGDQLDMGSVHNN

SEQ ID NO: 3258404 - protein, 17 aa, Plasmodium falciparum
FFAIMLIFFLTRKILND

SEQ ID NO: 3258405 - protein, 17 aa, Plasmodium falciparum
FFAKLLKSIYLKNKEEI

SEQ ID NO: 3258406 - protein, 17 aa, Plasmodium falciparum
FFAPFICLLIFSSNHGL

SEQ ID NO: 3258407 - protein, 19 aa, Plasmodium falciparum
FFASFFVLYFAKARNEYDI

SEQ ID NO: 3258408 - protein, 23 aa, Plasmodium falciparum
FFCGIIMNIICEFQRDDKIYDTG

SEQ ID NO: 3258409 - protein, 19 aa, Plasmodium falciparum
FFCPCTEHCRILKKKISTN

SEQ ID NO: 3258410 - protein, 17 aa, Plasmodium falciparum
FFCSLSYRRVTINNELL

SEQ ID NO: 3258411 - protein, 19 aa, Plasmodium falciparum
FFDEQNLRYSFLLNPNNQQ

SEQ ID NO: 3258412 - protein, 23 aa, Plasmodium falciparum
FFDYPFNIHFHIFNWKKYIIDAQ

SEQ ID NO: 3258413 - protein, 19 aa, Plasmodium falciparum
FFEIYLKLLTLINIQPYNL

SEQ ID NO: 3258414 - protein, 17 aa, Plasmodium falciparum
FFENLVLNKKKKENITA

SEQ ID NO: 3258415 - protein, 22 aa, Plasmodium falciparum
FFEYNNYLGPYVKYECSDKSIV

SEQ ID NO: 3258416 - protein, 17 aa, Plasmodium falciparum
FFFCFLYSLLESVTDVI

SEQ ID NO: 3258417 - protein, 17 aa, Plasmodium falciparum
FFFFHLSKEDKMNLLSI

SEQ ID NO: 3258418 - protein, 25 aa, Plasmodium falciparum
FFFFSPKVVNIFLVYEHCMKDLQII

SEQ ID NO: 3258419 - protein, 22 aa, Plasmodium falciparum
FFFKYIYNIFILTCFYITLSSY

SEQ ID NO: 3258420 - protein, 17 aa, Plasmodium falciparum
FFFLFLVILYFNNVVEG

SEQ ID NO: 3258421 - protein, 20 aa, Plasmodium falciparum
FFFLLIFPFSFYFLSSIFKA

SEQ ID NO: 3258422 - protein, 20 aa, Plasmodium falciparum
FFFLMFEKYEHVLKRIYYDN

SEQ ID NO: 3258423 - protein, 18 aa, Plasmodium falciparum
FFFNFPQIKEIIFVNEYE

SEQ ID NO: 3258424 - protein, 19 aa, Plasmodium falciparum
FFFRKDKIFTHGDDMFSSW

SEQ ID NO: 3258425 - protein, 17 aa, Plasmodium falciparum
FFFSLKEYIMFEYKAKK

SEQ ID NO: 3258426 - protein, 19 aa, Plasmodium falciparum
FFFVSICVYITMRRLGLLR

SEQ ID NO: 3258427 - protein, 20 aa, Plasmodium falciparum
FFFWLLKYGKTRSYPKSGHK

SEQ ID NO: 3258428 - protein, 19 aa, Plasmodium falciparum
FFFYFVCVIPSIYLTLTPF

SEQ ID NO: 3258429 - protein, 17 aa, Plasmodium falciparum
FFGKCIHIKPYIISSKI

SEQ ID NO: 3258430 - protein, 24 aa, Plasmodium falciparum
FFGNAWTSMFAFAFMLWYSRIFDP

SEQ ID NO: 3258431 - protein, 24 aa, Plasmodium falciparum
FFGSLSIFCCFSLAAIFSKNRISI

SEQ ID NO: 3258432 - protein, 17 aa, Plasmodium falciparum
FFHCKKKNSVIIPKCSK

SEQ ID NO: 3258433 - protein, 17 aa, Plasmodium falciparum
FFHLLLIASDGVFEYIN

SEQ ID NO: 3258434 - protein, 23 aa, Plasmodium falciparum
FFHSIQNVLCLKKEIKKIKINLN

SEQ ID NO: 3258435 - protein, 17 aa, Plasmodium falciparum
FFHSYKNAIALIKYLNY

SEQ ID NO: 3258436 - protein, 17 aa, Plasmodium falciparum
FFIALFIYDMKKEQPNY

SEQ ID NO: 3258437 - protein, 17 aa, Plasmodium falciparum
FFICQLFYNLIFPLLFI

SEQ ID NO: 3258438 - protein, 21 aa, Plasmodium falciparum
FFIETCVNSCYFDFFEDEEFT

SEQ ID NO: 3258439 - protein, 34 aa, Plasmodium falciparum
FFIFTQCKYIYIKFFRLLVQSIFSSSEFQKVGKL

SEQ ID NO: 3258440 - protein, 19 aa, Plasmodium falciparum
FFIHCRRGRDRTGEFVSAY

SEQ ID NO: 3258441 - protein, 24 aa, Plasmodium falciparum
FFIHFFIILFCFGKNILQNIKYLM

SEQ ID NO: 3258442 - protein, 24 aa, Plasmodium falciparum
FFILENCSFLLLNNPRTHIRFLNL

SEQ ID NO: 3258443 - protein, 20 aa, Plasmodium falciparum
FFIMCSLLTYYIVFFTEKAK

SEQ ID NO: 3258444 - protein, 36 aa, Plasmodium falciparum
FFINFSFFLYCLFLYKINTIYFFLRQIYKQCKYESI

SEQ ID NO: 3258445 - protein, 17 aa, Plasmodium falciparum
FFINTLYTYFQWILTYS

SEQ ID NO: 3258446 - protein, 17 aa, Plasmodium falciparum
FFIPFNVTDFLLKKITK

SEQ ID NO: 3258447 - protein, 30 aa, Plasmodium falciparum
FFIPLSCFSFCLFVMLGILKLFYIKRKSFR

SEQ ID NO: 3258448 - protein, 23 aa, Plasmodium falciparum
FFIRNISKVFLYIIQNINLYDVK

SEQ ID NO: 3258449 - protein, 32 aa, Plasmodium falciparum
FFISFITKVFIKSCITHFIKVCKEFEINEDYN

SEQ ID NO: 3258450 - protein, 24 aa, Plasmodium falciparum
FFITCLICMSIFSLFIFELSSLIS

SEQ ID NO: 3258451 - protein, 29 aa, Plasmodium falciparum
FFIYSCFFPFPSIYSIVIILKYVYLPTLN

SEQ ID NO: 3258452 - protein, 22 aa, Plasmodium falciparum
FFKDIQVSPVVYKIINEKNDKL

SEQ ID NO: 3258453 - protein, 23 aa, Plasmodium falciparum
FFKHSLWHIMLLLALTTYHTQIP

SEQ ID NO: 3258454 - protein, 18 aa, Plasmodium falciparum
FFKKCYKKNIKKNNKKKK

SEQ ID NO: 3258455 - protein, 26 aa, Plasmodium falciparum
FFKKKKRIDLVFNITKKLLARNNIDI

SEQ ID NO: 3258456 - protein, 18 aa, Plasmodium falciparum
FFKKRGRILIADEMGLGK

SEQ ID NO: 3258457 - protein, 27 aa, Plasmodium falciparum
FFKKYMLKKECLLKNSILNKLIIPHDC

SEQ ID NO: 3258458 - protein, 17 aa, Plasmodium falciparum
FFKPAVDEFIKIVQEAG

SEQ ID NO: 3258459 - protein, 17 aa, Plasmodium falciparum
FFKRKINNIKLILENCF

SEQ ID NO: 3258460 - protein, 18 aa, Plasmodium falciparum
FFLCAKLFSLNRMNFLFV

SEQ ID NO: 3258461 - protein, 21 aa, Plasmodium falciparum
FFLCSFYLLYVTCSSNNNNSN

SEQ ID NO: 3258462 - protein, 18 aa, Plasmodium falciparum
FFLFKWLTFKIIRNIFVA

SEQ ID NO: 3258463 - protein, 20 aa, Plasmodium falciparum
FFLFLKRRVICSINESKNVN

SEQ ID NO: 3258464 - protein, 18 aa, Plasmodium falciparum
FFLHICFKIIMRDFMIFQ

SEQ ID NO: 3258465 - protein, 18 aa, Plasmodium falciparum
FFLHLAINHAVICEKDKE

SEQ ID NO: 3258466 - protein, 17 aa, Plasmodium falciparum
FFLITGIALIITFSEKK

SEQ ID NO: 3258467 - protein, 25 aa, Plasmodium falciparum
FFLIYEIYILKSILFNKGDITKNNP

SEQ ID NO: 3258468 - protein, 17 aa, Plasmodium falciparum
FFLLIQGFMNFIVHIKI

SEQ ID NO: 3258469 - protein, 18 aa, Plasmodium falciparum
FFLLPTIDYMKNNICLVC

SEQ ID NO: 3258470 - protein, 23 aa, Plasmodium falciparum
FFLNTLIYIYSFENYLKKSFLQY

SEQ ID NO: 3258471 - protein, 19 aa, Plasmodium falciparum
FFLSLKILNRLLLKNRKMN

SEQ ID NO: 3258472 - protein, 27 aa, Plasmodium falciparum
FFLSRFLLICGFCIELYDNISNDILNV

SEQ ID NO: 3258473 - protein, 48 aa, Plasmodium falciparum
FFMDKLKCVLEVLNIFKFISRIKSYLCKRNRMPYDFNYTLLNVKSVKY

SEQ ID NO: 3258474 - protein, 26 aa, Plasmodium falciparum
FFMHIVKPTLFIKGDMLYYESRIKNF

SEQ ID NO: 3258475 - protein, 19 aa, Plasmodium falciparum
FFMNACFISLLIITVNCFN

SEQ ID NO: 3258476 - protein, 24 aa, Plasmodium falciparum
FFMSEFLYILFLRYNDHILSTTYK

SEQ ID NO: 3258477 - protein, 22 aa, Plasmodium falciparum
FFMSLKRSKNFPISNYDKKNYH

SEQ ID NO: 3258478 - protein, 27 aa, Plasmodium falciparum
FFMSNDSYFPWTYKKRNTHLFQYNNNN

SEQ ID NO: 3258479 - protein, 18 aa, Plasmodium falciparum
FFMTCLPFIIPKHKLGKK

SEQ ID NO: 3258480 - protein, 24 aa, Plasmodium falciparum
FFNEHIQYCILWKSIQTYFNTLHI

SEQ ID NO: 3258481 - protein, 22 aa, Plasmodium falciparum
FFNEINICLKQNILNQINTESN

SEQ ID NO: 3258482 - protein, 17 aa, Plasmodium falciparum
FFNEYKIKNEKIFHANK

SEQ ID NO: 3258483 - protein, 19 aa, Plasmodium falciparum
FFNFMFLMNILGLFLSFFL

SEQ ID NO: 3258484 - protein, 18 aa, Plasmodium falciparum
FFNGFQKLIFISSNLNVN

SEQ ID NO: 3258485 - protein, 20 aa, Plasmodium falciparum
FFNHFPYDVFLKFSGNNQIS

SEQ ID NO: 3258486 - protein, 17 aa, Plasmodium falciparum
FFNIHGLAREEVINNIK

SEQ ID NO: 3258487 - protein, 19 aa, Plasmodium falciparum
FFNILKCVPYIINNGRMSG

SEQ ID NO: 3258488 - protein, 35 aa, Plasmodium falciparum
FFNKLKICSVNQKFKKLIPFYTIHGNHDYPYSYEY

SEQ ID NO: 3258489 - protein, 18 aa, Plasmodium falciparum
FFNPAVLIIKVLSEIYNI

SEQ ID NO: 3258490 - protein, 17 aa, Plasmodium falciparum
FFNPYLINMNWNIMSNI

SEQ ID NO: 3258491 - protein, 25 aa, Plasmodium falciparum
FFNSLKWKYFFYFKKNVNSENFYDN

SEQ ID NO: 3258492 - protein, 18 aa, Plasmodium falciparum
FFNSRIGNKILYGEVGFR

SEQ ID NO: 3258493 - protein, 31 aa, Plasmodium falciparum
FFNSRYIFENIFTWSSLIFSYACNFITPSII

SEQ ID NO: 3258494 - protein, 17 aa, Plasmodium falciparum
FFNTFRRHIPISIYCYS

SEQ ID NO: 3258495 - protein, 19 aa, Plasmodium falciparum
FFNTNKWKKMYSKYEDKLN

SEQ ID NO: 3258496 - protein, 20 aa, Plasmodium falciparum
FFNVLCNYPLSKLAIFNNNN

SEQ ID NO: 3258497 - protein, 18 aa, Plasmodium falciparum
FFPCQIGISIAKKKDIVE

SEQ ID NO: 3258498 - protein, 23 aa, Plasmodium falciparum
FFPHILICLYIPYIKKKNEKQKE

SEQ ID NO: 3258499 - protein, 18 aa, Plasmodium falciparum
FFPNILILECLKKINNHE

SEQ ID NO: 3258500 - protein, 22 aa, Plasmodium falciparum
FFPVFVSIFIFKLIRNHKLKKN

SEQ ID NO: 3258501 - protein, 36 aa, Plasmodium falciparum
FFQHYIIKNKIKYVKHFPHHLMLNFKDLPSTNMKDY

SEQ ID NO: 3258502 - protein, 25 aa, Plasmodium falciparum
FFQKFYECVQNLLPEIVIEHFHDRC

SEQ ID NO: 3258503 - protein, 17 aa, Plasmodium falciparum
FFQLCIELPPDIKRIIN

SEQ ID NO: 3258504 - protein, 23 aa, Plasmodium falciparum
FFQLREDWWTANRETVWKAIRCS

SEQ ID NO: 3258505 - protein, 29 aa, Plasmodium falciparum
FFSFFFLNFFFFFLFHFMSFTPVSYFYDY

SEQ ID NO: 3258506 - protein, 21 aa, Plasmodium falciparum
FFSFVLYFSFIYKHDTEFLLL

SEQ ID NO: 3258507 - protein, 20 aa, Plasmodium falciparum
FFSISSWLIIILLLEVGVDW

SEQ ID NO: 3258508 - protein, 22 aa, Plasmodium falciparum
FFSIYIKRYLDNIYMNKENFFI

SEQ ID NO: 3258509 - protein, 18 aa, Plasmodium falciparum
FFSLCNFFLINLLYVGHL

SEQ ID NO: 3258510 - protein, 17 aa, Plasmodium falciparum
FFSLMNMQYRDYLLRAR

SEQ ID NO: 3258511 - protein, 17 aa, Plasmodium falciparum
FFSRFGYINREKKSMEY

SEQ ID NO: 3258512 - protein, 26 aa, Plasmodium falciparum
FFSYFKKKIGSLFLKKVHSEYITFNK

SEQ ID NO: 3258513 - protein, 23 aa, Plasmodium falciparum
FFSYIKDIMKLYIMNINKNKNKN

SEQ ID NO: 3258514 - protein, 18 aa, Plasmodium falciparum
FFTLICYFILFIFILIAL

SEQ ID NO: 3258515 - protein, 21 aa, Plasmodium falciparum
FFTSKHHIHFKSIKIFLHVHT

SEQ ID NO: 3258516 - protein, 24 aa, Plasmodium falciparum
FFVFLCIFITYILKDVRTYFLVGF

SEQ ID NO: 3258517 - protein, 19 aa, Plasmodium falciparum
FFVFLFFLHICFKIIMRDF

SEQ ID NO: 3258518 - protein, 17 aa, Plasmodium falciparum
FFVHFKFTNEEYTYILK

SEQ ID NO: 3258519 - protein, 17 aa, Plasmodium falciparum
FFVIRNILYNILYTYNF

SEQ ID NO: 3258520 - protein, 29 aa, Plasmodium falciparum
FFVMLPFIFPVIISMCFFLSVFFLNMYYE

SEQ ID NO: 3258521 - protein, 19 aa, Plasmodium falciparum
FFVTVDIKSGWCDGTTITY

SEQ ID NO: 3258522 - protein, 20 aa, Plasmodium falciparum
FFYDNIINFGLCKQNMTYHY

SEQ ID NO: 3258523 - protein, 21 aa, Plasmodium falciparum
FFYDNIKSVYTYNDILRNKDI

SEQ ID NO: 3258524 - protein, 20 aa, Plasmodium falciparum
FFYEESHNFYPYKIPSCISN

SEQ ID NO: 3258525 - protein, 19 aa, Plasmodium falciparum
FFYERTRLGHVHWGDETDY

SEQ ID NO: 3258526 - protein, 25 aa, Plasmodium falciparum
FFYFGDHYFCIILLLNFKYIIEEEN

SEQ ID NO: 3258527 - protein, 21 aa, Plasmodium falciparum
FFYICLQYFNKYFIHLNNIDI

SEQ ID NO: 3258528 - protein, 22 aa, Plasmodium falciparum
FFYKFKEIIFYIHSYSFYDGLN

SEQ ID NO: 3258529 - protein, 17 aa, Plasmodium falciparum
FFYLLILSFILYNKIIN

SEQ ID NO: 3258530 - protein, 23 aa, Plasmodium falciparum
FFYLLKCYFRKMISLLYLYTDEL

SEQ ID NO: 3258531 - protein, 19 aa, Plasmodium falciparum
FFYPFRFGVYKDKGIIVYN

SEQ ID NO: 3258532 - protein, 19 aa, Plasmodium falciparum
FFYQILIDLDRTMYIITKN

SEQ ID NO: 3258533 - protein, 22 aa, Plasmodium falciparum
FFYSEYNSVIYISIIKLKRGNM

SEQ ID NO: 3258534 - protein, 18 aa, Plasmodium falciparum
FFYYCKLLSRVFINKIRN

SEQ ID NO: 3258535 - protein, 18 aa, Plasmodium falciparum
FFYYKKFDYPYIYNVDNN

SEQ ID NO: 3258536 - protein, 17 aa, Plasmodium falciparum
FGADIDALFFIDLLSYI

SEQ ID NO: 3258537 - protein, 18 aa, Plasmodium falciparum
FGAFFFNLFISFLVNKKR

SEQ ID NO: 3258538 - protein, 19 aa, Plasmodium falciparum
FGAPLSYIQIVIKKKNSSL

SEQ ID NO: 3258539 - protein, 19 aa, Plasmodium falciparum
FGEDYCKKYFYRGEKIYEE

SEQ ID NO: 3258540 - protein, 24 aa, Plasmodium falciparum
FGFKNSKVLFGFIVISVIFISQFF

SEQ ID NO: 3258541 - protein, 21 aa, Plasmodium falciparum
FGFLGGFLIGIILKRNQLKYF

SEQ ID NO: 3258542 - protein, 18 aa, Plasmodium falciparum
FGGFFKGIGKGVAGSLVK

SEQ ID NO: 3258543 - protein, 24 aa, Plasmodium falciparum
FGGIRGWRLCFIVVGILSVLLSII

SEQ ID NO: 3258544 - protein, 19 aa, Plasmodium falciparum
FGGMCIGALTILADFLGAL

SEQ ID NO: 3258545 - protein, 19 aa, Plasmodium falciparum
FGICKLRDKIFKSVISIGY

SEQ ID NO: 3258546 - protein, 25 aa, Plasmodium falciparum
FGIIYLFLYLYKIHYYIYKITDMNY

SEQ ID NO: 3258547 - protein, 19 aa, Plasmodium falciparum
FGIQIRKDFNIMYDEKKDI

SEQ ID NO: 3258548 - protein, 19 aa, Plasmodium falciparum
FGISLCMVSIIPVDLNKNT

SEQ ID NO: 3258549 - protein, 20 aa, Plasmodium falciparum
FGITDCKLLKERGLIDKMVY

SEQ ID NO: 3258550 - protein, 19 aa, Plasmodium falciparum
FGKGKRYFSKHAHNTNNSD

SEQ ID NO: 3258551 - protein, 33 aa, Plasmodium falciparum
FGKNIQCFRNLIICSYKYRRMLRTTANKFDEIY

SEQ ID NO: 3258552 - protein, 17 aa, Plasmodium falciparum
FGLCPVSVKENISQEWD

SEQ ID NO: 3258553 - protein, 18 aa, Plasmodium falciparum
FGLTFFILGCMTICGFRG

SEQ ID NO: 3258554 - protein, 17 aa, Plasmodium falciparum
FGNFIFSFLSLYLMISI

SEQ ID NO: 3258555 - protein, 45 aa, Plasmodium falciparum
FGREKYPDIYGFFLIILILYILKYVFKKMMYKLYYNKYGMGKKYS

SEQ ID NO: 3258556 - protein, 23 aa, Plasmodium falciparum
FGRRLSLLIIYNFFFLVSILTSI

SEQ ID NO: 3258557 - protein, 25 aa, Plasmodium falciparum
FGTIFPFFISCFFNSRYIFENIFTW

SEQ ID NO: 3258558 - protein, 23 aa, Plasmodium falciparum
FGVHEVTTLYGLQNTLLKTVKHL

SEQ ID NO: 3258559 - protein, 27 aa, Plasmodium falciparum
FGVVYKGSLIRKVKRNDMLSTEDMGTD

SEQ ID NO: 3258560 - protein, 17 aa, Plasmodium falciparum
FHCNFFLMIKKKMKEKI

SEQ ID NO: 3258561 - protein, 26 aa, Plasmodium falciparum
FHDGLHKAAGWGVRYGPANSCDLEHR

SEQ ID NO: 3258562 - protein, 18 aa, Plasmodium falciparum
FHDGLRKAARLGVIPGPA

SEQ ID NO: 3258563 - protein, 24 aa, Plasmodium falciparum
FHDINRLLVQFSINRINTYINSQL

SEQ ID NO: 3258564 - protein, 17 aa, Plasmodium falciparum
FHERLTKMYSWEKVAEK

SEQ ID NO: 3258565 - protein, 18 aa, Plasmodium falciparum
FHFFNTFYHFSNLYKIKN

SEQ ID NO: 3258566 - protein, 36 aa, Plasmodium falciparum
FHFIKKCYNSFRNCWSIYINIIFKLVTIDLLPIFFY

SEQ ID NO: 3258567 - protein, 31 aa, Plasmodium falciparum
FHFISDNIFCFLKDGYICFMNLLNNEKKYLY

SEQ ID NO: 3258568 - protein, 21 aa, Plasmodium falciparum
FHFWVRHLLNDSIEWRDKLKK

SEQ ID NO: 3258569 - protein, 20 aa, Plasmodium falciparum
FHFWVRHLLNDSIEWREKLD

SEQ ID NO: 3258570 - protein, 19 aa, Plasmodium falciparum
FHFYFLCSSSFAVIIHESE

SEQ ID NO: 3258571 - protein, 18 aa, Plasmodium falciparum
FHHLTIKIFFSIKDYLRC

SEQ ID NO: 3258572 - protein, 19 aa, Plasmodium falciparum
FHHLTSLSLYYEWHEKIYL

SEQ ID NO: 3258573 - protein, 21 aa, Plasmodium falciparum
FHIDKIVQIIIHLDNDVNNIN

SEQ ID NO: 3258574 - protein, 24 aa, Plasmodium falciparum
FHIDMFFNNCINFYSYNYLLWNKQ

SEQ ID NO: 3258575 - protein, 20 aa, Plasmodium falciparum
FHIHIKRKYYNFLFLYILIN

SEQ ID NO: 3258576 - protein, 20 aa, Plasmodium falciparum
FHIIMRFLLQEKNHFYNYYY

SEQ ID NO: 3258577 - protein, 19 aa, Plasmodium falciparum
FHINIKRYIERTIKNIIIL

SEQ ID NO: 3258578 - protein, 19 aa, Plasmodium falciparum
FHINKYFLKSLRKYNFQIS

SEQ ID NO: 3258579 - protein, 24 aa, Plasmodium falciparum
FHKDLYKILLERKIINPYNNMSSL

SEQ ID NO: 3258580 - protein, 22 aa, Plasmodium falciparum
FHKFFLRYKKYVFLEHFISRYV

SEQ ID NO: 3258581 - protein, 17 aa, Plasmodium falciparum
FHKFLTYCNNIFLDKIK

SEQ ID NO: 3258582 - protein, 25 aa, Plasmodium falciparum
FHKIKADLLILFILKGNDYLPKIRE

SEQ ID NO: 3258583 - protein, 18 aa, Plasmodium falciparum
FHKKIIKNPCAIPLVDVI

SEQ ID NO: 3258584 - protein, 20 aa, Plasmodium falciparum
FHKLQIFFYNCFPKVIFDIV

SEQ ID NO: 3258585 - protein, 23 aa, Plasmodium falciparum
FHLKCAIKPGNVHVLLLKENDIL

SEQ ID NO: 3258586 - protein, 17 aa, Plasmodium falciparum
FHLKTSILRNCPILKKK

SEQ ID NO: 3258587 - protein, 17 aa, Plasmodium falciparum
FHLLLMILSPIKKKSYI

SEQ ID NO: 3258588 - protein, 18 aa, Plasmodium falciparum
FHLSEFFLSFLHNKENAN

SEQ ID NO: 3258589 - protein, 18 aa, Plasmodium falciparum
FHNKGKYFLIKKYEKIIA

SEQ ID NO: 3258590 - protein, 21 aa, Plasmodium falciparum
FHNLLKLQVYIIIQISQMLIQ

SEQ ID NO: 3258591 - protein, 18 aa, Plasmodium falciparum
FHNTLRGNEKIEYLKNLK

SEQ ID NO: 3258592 - protein, 29 aa, Plasmodium falciparum
FHQFLRKGSCEKREFLYFINSKRKGWADL

SEQ ID NO: 3258593 - protein, 18 aa, Plasmodium falciparum
FHRLIEFIDRPIFDKYKA

SEQ ID NO: 3258594 - protein, 21 aa, Plasmodium falciparum
FHSFQFLYQFFMNMQSYIRNE

SEQ ID NO: 3258595 - protein, 27 aa, Plasmodium falciparum
FHSIIYLCINNIYAYDLLCILFSDIFC

SEQ ID NO: 3258596 - protein, 24 aa, Plasmodium falciparum
FHSIPKLIFEKVLNFGPIRPNEKK

SEQ ID NO: 3258597 - protein, 25 aa, Plasmodium falciparum
FHVNGLTFIQWVFCFLCCLLDLLIY

SEQ ID NO: 3258598 - protein, 20 aa, Plasmodium falciparum
FHVYDFCVRLNKHINIGNLL

SEQ ID NO: 3258599 - protein, 27 aa, Plasmodium falciparum
FHVYLLFVICMYLWYHAQVHFSMKPPC

SEQ ID NO: 3258600 - protein, 17 aa, Plasmodium falciparum
FHYFFYYGIDNYQNLTI

SEQ ID NO: 3258601 - protein, 18 aa, Plasmodium falciparum
FHYPEISVLFNLDEEDVY

SEQ ID NO: 3258602 - protein, 26 aa, Plasmodium falciparum
FIAFLKKWKYMLSIYLSQLTETQALE

SEQ ID NO: 3258603 - protein, 17 aa, Plasmodium falciparum
FIALFFPSYLKYLKDGT

SEQ ID NO: 3258604 - protein, 26 aa, Plasmodium falciparum
FIALKTCRSLCECDPYISIYDNHPEM

SEQ ID NO: 3258605 - protein, 23 aa, Plasmodium falciparum
FIASCISILGPVMLHMHQNNPEE

SEQ ID NO: 3258606 - protein, 17 aa, Plasmodium falciparum
FICALCSLYFKKWAIWK

SEQ ID NO: 3258607 - protein, 17 aa, Plasmodium falciparum
FICDNIKNDTPIKRITL

SEQ ID NO: 3258608 - protein, 19 aa, Plasmodium falciparum
FICHISRIISLIILTFLDI

SEQ ID NO: 3258609 - protein, 17 aa, Plasmodium falciparum
FICLPKFIHFLNEKGLC

SEQ ID NO: 3258610 - protein, 17 aa, Plasmodium falciparum
FICQNIIKRWKHYIKIK

SEQ ID NO: 3258611 - protein, 23 aa, Plasmodium falciparum
FIDCGFISLYMLYLYALKKKDKK

SEQ ID NO: 3258612 - protein, 24 aa, Plasmodium falciparum
FIDIELEKMLSFIITKSGQKAEIQ

SEQ ID NO: 3258613 - protein, 53 aa, Plasmodium falciparum
FIDLFTQYCNFPRYDVFWNLLIKKEVENFLYLPQFRKSYDYKYNKYIYSLFTI

SEQ ID NO: 3258614 - protein, 25 aa, Plasmodium falciparum
FIDNYKQLPLCIGIQPEDGDENNII

SEQ ID NO: 3258615 - protein, 25 aa, Plasmodium falciparum
FIDTHRYFFKYFIMDLTFNIINYLN

SEQ ID NO: 3258616 - protein, 18 aa, Plasmodium falciparum
FIDYGDFYYTNNIDTNTT

SEQ ID NO: 3258617 - protein, 26 aa, Plasmodium falciparum
FIEASFKIQNYFFLEDILTYYLNNLK

SEQ ID NO: 3258618 - protein, 22 aa, Plasmodium falciparum
FIEIFFMNIFKTIKMKNIYSHF

SEQ ID NO: 3258619 - protein, 17 aa, Plasmodium falciparum
FIEIIFYTLSWVLFHKF

SEQ ID NO: 3258620 - protein, 29 aa, Plasmodium falciparum
FIEILCDFGHIIPIHYISHFIHFFQCNKN

SEQ ID NO: 3258621 - protein, 19 aa, Plasmodium falciparum
FIEIVNLCISILKSIFYHF

SEQ ID NO: 3258622 - protein, 24 aa, Plasmodium falciparum
FIEKENYGIFGINIKNFYTFILHH

SEQ ID NO: 3258623 - protein, 22 aa, Plasmodium falciparum
FIEKYFKIKGIEYNNTNVNNIN

SEQ ID NO: 3258624 - protein, 19 aa, Plasmodium falciparum
FIELNSFYYFNAVNFYGTD

SEQ ID NO: 3258625 - protein, 25 aa, Plasmodium falciparum
FIEMACFPKNFKFHINNLYKTSIEE

SEQ ID NO: 3258626 - protein, 20 aa, Plasmodium falciparum
FIENIRMFLHNSFDEQMKYY

SEQ ID NO: 3258627 - protein, 17 aa, Plasmodium falciparum
FIESLLYNWFLNIKRNE

SEQ ID NO: 3258628 - protein, 17 aa, Plasmodium falciparum
FIETAAIETFFLWHRYK

SEQ ID NO: 3258629 - protein, 18 aa, Plasmodium falciparum
FIFCGIISIVIYVLVILS

SEQ ID NO: 3258630 - protein, 17 aa, Plasmodium falciparum
FIFELGFLMNAHDLLGK

SEQ ID NO: 3258631 - protein, 28 aa, Plasmodium falciparum
FIFFCSVVIFIRFIGYFFCNRYMTEEPY

SEQ ID NO: 3258632 - protein, 28 aa, Plasmodium falciparum
FIFFPYCLIVQLIGCIKLKTSYKHEPIL

SEQ ID NO: 3258633 - protein, 25 aa, Plasmodium falciparum
FIFFRCILSSLLIIYMIRDCIFIFP

SEQ ID NO: 3258634 - protein, 22 aa, Plasmodium falciparum
FIFGSSCFTIFIITKLLLMLRR

SEQ ID NO: 3258635 - protein, 31 aa, Plasmodium falciparum
FIFMAWEIANFYFSILYYKLDLKTILTELFK

SEQ ID NO: 3258636 - protein, 25 aa, Plasmodium falciparum
FIFSKIKSLHFVSSHKVNKDNDKAV

SEQ ID NO: 3258637 - protein, 23 aa, Plasmodium falciparum
FIFYKNCFYFFQITPQIIYIYIY

SEQ ID NO: 3258638 - protein, 30 aa, Plasmodium falciparum
FIGILIEYISFCFDDKINLYFQDAQCVKEG

SEQ ID NO: 3258639 - protein, 20 aa, Plasmodium falciparum
FIGTPCVIKSFTVKENVQYV

SEQ ID NO: 3258640 - protein, 23 aa, Plasmodium falciparum
FIHCFKWFSIPIVFFTFCPGYIR

SEQ ID NO: 3258641 - protein, 26 aa, Plasmodium falciparum
FIHGLRGNALRTWRFSNLYHNGSDYH

SEQ ID NO: 3258642 - protein, 27 aa, Plasmodium falciparum
FIHHIKEKYGLILKFTHGIIYSLSAFI

SEQ ID NO: 3258643 - protein, 27 aa, Plasmodium falciparum
FIHILNEYKLCYNLFPYNIITNKFVNI

SEQ ID NO: 3258644 - protein, 19 aa, Plasmodium falciparum
FIHKIYADFLFEKEQYENA

SEQ ID NO: 3258645 - protein, 26 aa, Plasmodium falciparum
FIHLKISICKGFKLQGYYKKNVFPNS

SEQ ID NO: 3258646 - protein, 22 aa, Plasmodium falciparum
FIICAVILLLFFENDKLDKNSR

SEQ ID NO: 3258647 - protein, 19 aa, Plasmodium falciparum
FIIFFPVLFIYRRIIKRRK

SEQ ID NO: 3258648 - protein, 18 aa, Plasmodium falciparum
FIIFHYFFYYGIDNYQNL

SEQ ID NO: 3258649 - protein, 22 aa, Plasmodium falciparum
FIIFLIYRILIFKKLFTHTYII

SEQ ID NO: 3258650 - protein, 19 aa, Plasmodium falciparum
FIIFLNILFLKPEIYRHIV

SEQ ID NO: 3258651 - protein, 18 aa, Plasmodium falciparum
FIIHCKKNLIPYFIFNNW

SEQ ID NO: 3258652 - protein, 24 aa, Plasmodium falciparum
FIIHSIFELLKNVSMYYANDGGRI

SEQ ID NO: 3258653 - protein, 17 aa, Plasmodium falciparum
FIIILKHKELLQNENYI

SEQ ID NO: 3258654 - protein, 18 aa, Plasmodium falciparum
FIIILLIGNEYCIKENGE

SEQ ID NO: 3258655 - protein, 18 aa, Plasmodium falciparum
FIILRTALTIPLMIYMFI

SEQ ID NO: 3258656 - protein, 31 aa, Plasmodium falciparum
FIILTFLLILSIKYNRYVKKYPYIKTNDDND

SEQ ID NO: 3258657 - protein, 17 aa, Plasmodium falciparum
FIINKLFLEKSKEKKTN

SEQ ID NO: 3258658 - protein, 18 aa, Plasmodium falciparum
FIISEWKNEMNVDYVELY

SEQ ID NO: 3258659 - protein, 35 aa, Plasmodium falciparum
FIITKHEKLHFIILIILCIFISIFKVYYNNKNNLI

SEQ ID NO: 3258660 - protein, 18 aa, Plasmodium falciparum
FIIWNIITLLSMIKPSLL

SEQ ID NO: 3258661 - protein, 19 aa, Plasmodium falciparum
FIIYMLVKHVDIMFDIINM

SEQ ID NO: 3258662 - protein, 23 aa, Plasmodium falciparum
FIKCAAIETFFSWHKFKKDKEKK

SEQ ID NO: 3258663 - protein, 19 aa, Plasmodium falciparum
FIKCPIKGACLEKNKCHKS

SEQ ID NO: 3258664 - protein, 24 aa, Plasmodium falciparum
FIKDKEDRLCFIPNEDHWDNLVLG

SEQ ID NO: 3258665 - protein, 28 aa, Plasmodium falciparum
FIKDSRVKRCRLYFQLYFQELYDFELSF

SEQ ID NO: 3258666 - protein, 18 aa, Plasmodium falciparum
FIKFISSKCILKMSTYYY

SEQ ID NO: 3258667 - protein, 21 aa, Plasmodium falciparum
FIKGLCALYKESVRGVKTSSN

SEQ ID NO: 3258668 - protein, 22 aa, Plasmodium falciparum
FIKHCIAMNLRSYRKCSLYIFN

SEQ ID NO: 3258669 - protein, 18 aa, Plasmodium falciparum
FIKHYGHLNLVYNRALTK

SEQ ID NO: 3258670 - protein, 24 aa, Plasmodium falciparum
FIKIPWSIKLVWAVISDNYPIFGY

SEQ ID NO: 3258671 - protein, 21 aa, Plasmodium falciparum
FIKKKYEKFKERKDYVENDFI

SEQ ID NO: 3258672 - protein, 17 aa, Plasmodium falciparum
FIKMFEQLFNFRKEPND

SEQ ID NO: 3258673 - protein, 22 aa, Plasmodium falciparum
FIKNELSNFLFLKKKISDLFEE

SEQ ID NO: 3258674 - protein, 20 aa, Plasmodium falciparum
FIKNKIIKLFEDLIIEALNF

SEQ ID NO: 3258675 - protein, 26 aa, Plasmodium falciparum
FIKQECINNFLKIKLLIHKMKEKKNN

SEQ ID NO: 3258676 - protein, 27 aa, Plasmodium falciparum
FIKQKIKTGFLYPPFKEERFDEINNFK

SEQ ID NO: 3258677 - protein, 24 aa, Plasmodium falciparum
FIKQNIFLCLSIINGYFIQSKFLC

SEQ ID NO: 3258678 - protein, 24 aa, Plasmodium falciparum
FIKQNWKTIFYYIPLNERIENYFF

SEQ ID NO: 3258679 - protein, 17 aa, Plasmodium falciparum
FIKRKMKAFKKIDHSFI

SEQ ID NO: 3258680 - protein, 17 aa, Plasmodium falciparum
FIKRNLVGCHGFTLFIH

SEQ ID NO: 3258681 - protein, 27 aa, Plasmodium falciparum
FIKRPPYFRYLEEWGENFCKKRTEMLG

SEQ ID NO: 3258682 - protein, 17 aa, Plasmodium falciparum
FIKRPPYFRYLEEWGET

SEQ ID NO: 3258683 - protein, 17 aa, Plasmodium falciparum
FIKRPPYFRYLEEWGQN

SEQ ID NO: 3258684 - protein, 24 aa, Plasmodium falciparum
FIKVLRIIPPYWIEYNIYEMIDTL

SEQ ID NO: 3258685 - protein, 23 aa, Plasmodium falciparum
FIKYSGSVSRFFVTPISMLFNIY

SEQ ID NO: 3258686 - protein, 17 aa, Plasmodium falciparum
FILCLTLAQDKLISRKL

SEQ ID NO: 3258687 - protein, 17 aa, Plasmodium falciparum
FILCSLLGQYIYQYDNK

SEQ ID NO: 3258688 - protein, 18 aa, Plasmodium falciparum
FILDHARVLHKVIKKEKY

SEQ ID NO: 3258689 - protein, 27 aa, Plasmodium falciparum
FILFFIKNWYTRLLILKDIEHMQIAKL

SEQ ID NO: 3258690 - protein, 26 aa, Plasmodium falciparum
FILFHCLNSLIIKYNVKVEGLRLVSR

SEQ ID NO: 3258691 - protein, 25 aa, Plasmodium falciparum
FILIYCILNIYLFHYTYNIFLHHIN

SEQ ID NO: 3258692 - protein, 20 aa, Plasmodium falciparum
FILMGCFIFSFVINAGIGTY

SEQ ID NO: 3258693 - protein, 18 aa, Plasmodium falciparum
FILPGAIKIYGITSNYMK

SEQ ID NO: 3258694 - protein, 24 aa, Plasmodium falciparum
FILPISFICYNFGKKFNMFSYFQK

SEQ ID NO: 3258695 - protein, 25 aa, Plasmodium falciparum
FILPPRLKKSFSYKPNKVINTFEIG

SEQ ID NO: 3258696 - protein, 25 aa, Plasmodium falciparum
FILVSIRYLLNIIYNLIFYDDSGYF

SEQ ID NO: 3258697 - protein, 18 aa, Plasmodium falciparum
FILYKMFLYNDKFYCYID

SEQ ID NO: 3258698 - protein, 24 aa, Plasmodium falciparum
FILYLKRCCKGYVLNVNVVDKDDL

SEQ ID NO: 3258699 - protein, 17 aa, Plasmodium falciparum
FILYLLINKKHVIQYLD

SEQ ID NO: 3258700 - protein, 19 aa, Plasmodium falciparum
FIMCYSLCKLLLNDYIYDP

SEQ ID NO: 3258701 - protein, 26 aa, Plasmodium falciparum
FIMLFLVSMVMSFYFCPIVAAVLTFI

SEQ ID NO: 3258702 - protein, 18 aa, Plasmodium falciparum
FIMLIIYFFVFNKYSKGC

SEQ ID NO: 3258703 - protein, 19 aa, Plasmodium falciparum
FIMRLKRSNMLKFTNFLKT

SEQ ID NO: 3258704 - protein, 23 aa, Plasmodium falciparum
FINEAIYMFEICPYLCIKLKNND

SEQ ID NO: 3258705 - protein, 18 aa, Plasmodium falciparum
FINHNWKNINLINEKLFL

SEQ ID NO: 3258706 - protein, 17 aa, Plasmodium falciparum
FINHYIHIIKNYNDTYL

SEQ ID NO: 3258707 - protein, 18 aa, Plasmodium falciparum
FINIDGIESMTYNKSYIN

SEQ ID NO: 3258708 - protein, 20 aa, Plasmodium falciparum
FINKMWINKFNVFYYITQHV

SEQ ID NO: 3258709 - protein, 24 aa, Plasmodium falciparum
FINLLFKPLRVIFFWTNSTLSLPF

SEQ ID NO: 3258710 - protein, 18 aa, Plasmodium falciparum
FINLSYFVKYIFDCVTNI

SEQ ID NO: 3258711 - protein, 26 aa, Plasmodium falciparum
FINNFFLKMIIIFLIINAYLHPNFER

SEQ ID NO: 3258712 - protein, 21 aa, Plasmodium falciparum
FINNIKFIFENKLFYNIMGYN

SEQ ID NO: 3258713 - protein, 18 aa, Plasmodium falciparum
FINPFPYICFLKILNKPL

SEQ ID NO: 3258714 - protein, 22 aa, Plasmodium falciparum
FINRLPFDIKIVTDSVRKKSET

SEQ ID NO: 3258715 - protein, 35 aa, Plasmodium falciparum
FINSTICFFLSLILFIFKNIHTIKIIRSHIYLSYF

SEQ ID NO: 3258716 - protein, 22 aa, Plasmodium falciparum
FINTLKFSKIVKMDNKNEQIIY

SEQ ID NO: 3258717 - protein, 17 aa, Plasmodium falciparum
FINVCLNLFLRNAKGLN

SEQ ID NO: 3258718 - protein, 18 aa, Plasmodium falciparum
FINWMIPSALNYIKRLYG

SEQ ID NO: 3258719 - protein, 29 aa, Plasmodium falciparum
FINYNCVTFCPFTLIPNCNNVVNFNTIGL

SEQ ID NO: 3258720 - protein, 17 aa, Plasmodium falciparum
FINYPLLKWYITNKTTH

SEQ ID NO: 3258721 - protein, 29 aa, Plasmodium falciparum
FINYRYGCSYEFINFVFTSFHVITNFLVN

SEQ ID NO: 3258722 - protein, 17 aa, Plasmodium falciparum
FIPDVLYFTSIVLLILV

SEQ ID NO: 3258723 - protein, 17 aa, Plasmodium falciparum
FIPFFFLNKNVFSNYNE

SEQ ID NO: 3258724 - protein, 23 aa, Plasmodium falciparum
FIPTDIRCSLWIILKEYHFRSLS

SEQ ID NO: 3258725 - protein, 22 aa, Plasmodium falciparum
FIPTIIKYALCIALIENPEYAC

SEQ ID NO: 3258726 - protein, 27 aa, Plasmodium falciparum
FIPYISFKDFLMFASYNLNELNNLYSK

SEQ ID NO: 3258727 - protein, 24 aa, Plasmodium falciparum
FIQKELFLKIQAMKHILFNDNNFQ

SEQ ID NO: 3258728 - protein, 19 aa, Plasmodium falciparum
FIQKKFFNYEMMKTKSSAC

SEQ ID NO: 3258729 - protein, 19 aa, Plasmodium falciparum
FIQNSFPSIVFGKLLGFAS

SEQ ID NO: 3258730 - protein, 29 aa, Plasmodium falciparum
FIQNTILRIFVLRNYKFIDKTRIDYFKIH

SEQ ID NO: 3258731 - protein, 29 aa, Plasmodium falciparum
FIQSSKISPSIFCLCFSPDIKLKSRSEKV

SEQ ID NO: 3258732 - protein, 26 aa, Plasmodium falciparum
FIQVRKALRIFNCILNSLINNKKVIM

SEQ ID NO: 3258733 - protein, 22 aa, Plasmodium falciparum
FIRGENEFVFFNRILFVNKIYS

SEQ ID NO: 3258734 - protein, 20 aa, Plasmodium falciparum
FIRKALVLTIVIVLLVIVAS

SEQ ID NO: 3258735 - protein, 18 aa, Plasmodium falciparum
FIRKHVPKRKIKFFQKLS

SEQ ID NO: 3258736 - protein, 20 aa, Plasmodium falciparum
FIRKKIEIYFEHHSLENSIR

SEQ ID NO: 3258737 - protein, 17 aa, Plasmodium falciparum
FIRTFFQTFLFSAVNLK

SEQ ID NO: 3258738 - protein, 18 aa, Plasmodium falciparum
FISECLSEVIFIPNTQNN

SEQ ID NO: 3258739 - protein, 29 aa, Plasmodium falciparum
FISEEAYSFTQFCSGIEFIKELGKTTFLN

SEQ ID NO: 3258740 - protein, 24 aa, Plasmodium falciparum
FISEENINCIFVYLFNFMYESSNV

SEQ ID NO: 3258741 - protein, 25 aa, Plasmodium falciparum
FISELKSFFFSILEKIRSSKLLLRF

SEQ ID NO: 3258742 - protein, 23 aa, Plasmodium falciparum
FISFLKIIILDSIRDDLKQGEVV

SEQ ID NO: 3258743 - protein, 25 aa, Plasmodium falciparum
FISGRIKDIINRGGEKIIPNEIDDV

SEQ ID NO: 3258744 - protein, 24 aa, Plasmodium falciparum
FISIGYKLLYPLGVLEANFDKEKL

SEQ ID NO: 3258745 - protein, 25 aa, Plasmodium falciparum
FISKELLHIFFLISHNLRNILSNFP

SEQ ID NO: 3258746 - protein, 22 aa, Plasmodium falciparum
FISKKLRINWIPKKKGLRPLIN

SEQ ID NO: 3258747 - protein, 25 aa, Plasmodium falciparum
FISLKNLRDILLFLRCIIKDEDIKK

SEQ ID NO: 3258748 - protein, 18 aa, Plasmodium falciparum
FISLLIITVNCFNYENFV

SEQ ID NO: 3258749 - protein, 24 aa, Plasmodium falciparum
FISRTFEGINIFPIKQNEKDQDYL

SEQ ID NO: 3258750 - protein, 19 aa, Plasmodium falciparum
FISSENYLVIAGRDALQNE

SEQ ID NO: 3258751 - protein, 25 aa, Plasmodium falciparum
FITDEIRENFEFSEFSFLIDRQQSN

SEQ ID NO: 3258752 - protein, 18 aa, Plasmodium falciparum
FITHIFKSLFLFIETYNY

SEQ ID NO: 3258753 - protein, 20 aa, Plasmodium falciparum
FITTNMCTKLLILAEDRLKI

SEQ ID NO: 3258754 - protein, 19 aa, Plasmodium falciparum
FIVCLFDIAFFAVCVCIWL

SEQ ID NO: 3258755 - protein, 24 aa, Plasmodium falciparum
FIVHARKAWLKGLDPKQNRKIPPL

SEQ ID NO: 3258756 - protein, 29 aa, Plasmodium falciparum
FIVQFEWKSICVIAFIFLLIFIGSNYALS

SEQ ID NO: 3258757 - protein, 17 aa, Plasmodium falciparum
FIVSTLFSFIKRINENS

SEQ ID NO: 3258758 - protein, 20 aa, Plasmodium falciparum
FIVYMIRYENMFCYVVNIIK

SEQ ID NO: 3258759 - protein, 26 aa, Plasmodium falciparum
FIYAYKRLKILKILNISLKACEKNNK

SEQ ID NO: 3258760 - protein, 23 aa, Plasmodium falciparum
FIYCKMKMLLYNSAYNIKNTLLT

SEQ ID NO: 3258761 - protein, 28 aa, Plasmodium falciparum
FIYEDPLEIFSFFQGINWLPELKNRCTS

SEQ ID NO: 3258762 - protein, 32 aa, Plasmodium falciparum
FIYENWFDFTIRFAFVYISWIKKCNKKNNIML

SEQ ID NO: 3258763 - protein, 17 aa, Plasmodium falciparum
FIYFLKQKLNLLIKAMF

SEQ ID NO: 3258764 - protein, 19 aa, Plasmodium falciparum
FIYFLPWPYEALVNVSNKF

SEQ ID NO: 3258765 - protein, 24 aa, Plasmodium falciparum
FIYILCLFIVLYIFDYKEFLFMSF

SEQ ID NO: 3258766 - protein, 23 aa, Plasmodium falciparum
FIYILFFLCLYLNTFNYKYTTSY

SEQ ID NO: 3258767 - protein, 18 aa, Plasmodium falciparum
FIYILKNIYVMLSSHMLT

SEQ ID NO: 3258768 - protein, 21 aa, Plasmodium falciparum
FIYLLKIIILLLITNNRSSNI

SEQ ID NO: 3258769 - protein, 18 aa, Plasmodium falciparum
FIYNEIFINILLNTLKKG

SEQ ID NO: 3258770 - protein, 17 aa, Plasmodium falciparum
FIYNISQNMPIYINCIS

SEQ ID NO: 3258771 - protein, 24 aa, Plasmodium falciparum
FIYNRIHLIICDFFAIMLIFFLTR

SEQ ID NO: 3258772 - protein, 26 aa, Plasmodium falciparum
FIYPSLFYFFSCLKKYDYYTGTPHIT

SEQ ID NO: 3258773 - protein, 19 aa, Plasmodium falciparum
FIYQIPNFIFYFFRYYYRI

SEQ ID NO: 3258774 - protein, 19 aa, Plasmodium falciparum
FIYSEFLSGIDLKLRVFKL

SEQ ID NO: 3258775 - protein, 17 aa, Plasmodium falciparum
FIYSFLEHFKILKKELY

SEQ ID NO: 3258776 - protein, 18 aa, Plasmodium falciparum
FIYSKLYIIINIKKSFYE

SEQ ID NO: 3258777 - protein, 18 aa, Plasmodium falciparum
FIYSSAISEVERLKKVYG

SEQ ID NO: 3258778 - protein, 26 aa, Plasmodium falciparum
FKAKETGILFILGISYCISYYYFDQY

SEQ ID NO: 3258779 - protein, 21 aa, Plasmodium falciparum
FKAVCYNSLKVNHRDFNKNIL

SEQ ID NO: 3258780 - protein, 25 aa, Plasmodium falciparum
FKAYARKALALFILFQFKDSLTNFT

SEQ ID NO: 3258781 - protein, 25 aa, Plasmodium falciparum
FKCDNCIKCDNCLLHFDSSLKHNLY

SEQ ID NO: 3258782 - protein, 21 aa, Plasmodium falciparum
FKCKEYFFKKTNLLTEKKNNN

SEQ ID NO: 3258783 - protein, 17 aa, Plasmodium falciparum
FKCPPSSFHKKLGAKSI

SEQ ID NO: 3258784 - protein, 17 aa, Plasmodium falciparum
FKDACGLKYGPKAPTSW

SEQ ID NO: 3258785 - protein, 23 aa, Plasmodium falciparum
FKDEVLKAIKPCDFDNFKTSCGL

SEQ ID NO: 3258786 - protein, 28 aa, Plasmodium falciparum
FKDEYFPHMFSFFEFVQIFKCLKNYKKI

SEQ ID NO: 3258787 - protein, 18 aa, Plasmodium falciparum
FKDHFVIDYSGRVNNNSF

SEQ ID NO: 3258788 - protein, 34 aa, Plasmodium falciparum
FKDHHFWIPFDYWKASHKRYFYYMYDLIKNKNKR

SEQ ID NO: 3258789 - protein, 17 aa, Plasmodium falciparum
FKDIRHLQHILATLYTV

SEQ ID NO: 3258790 - protein, 24 aa, Plasmodium falciparum
FKDKLFCINSKYSIYLQVDNNENV

SEQ ID NO: 3258791 - protein, 17 aa, Plasmodium falciparum
FKDNCSFIISMNKSTLD

SEQ ID NO: 3258792 - protein, 31 aa, Plasmodium falciparum
FKDNEMYILIILVFMYFKLILKGPLPNDNNN

SEQ ID NO: 3258793 - protein, 17 aa, Plasmodium falciparum
FKEEGSFDLGKRDDNND

SEQ ID NO: 3258794 - protein, 20 aa, Plasmodium falciparum
FKEFSLYSEDRYCIDKKNNT

SEQ ID NO: 3258795 - protein, 21 aa, Plasmodium falciparum
FKEINYFITYYEDIHVLLFYK

SEQ ID NO: 3258796 - protein, 21 aa, Plasmodium falciparum
FKELKLDLIYIKIINVKDDKI

SEQ ID NO: 3258797 - protein, 20 aa, Plasmodium falciparum
FKELSSFYEIVIWSDDNFPV

SEQ ID NO: 3258798 - protein, 22 aa, Plasmodium falciparum
FKENMRYILRLMALLDLSPTIR

SEQ ID NO: 3258799 - protein, 22 aa, Plasmodium falciparum
FKEPLKTFGPLEYCKTCPPNKV

SEQ ID NO: 3258800 - protein, 23 aa, Plasmodium falciparum
FKERRKKKKIYNVIKYNTYYTHN

SEQ ID NO: 3258801 - protein, 17 aa, Plasmodium falciparum
FKERRVNIKSYKILLKC

SEQ ID NO: 3258802 - protein, 24 aa, Plasmodium falciparum
FKFEKELLWKLFMTVRNLKEVSPY

SEQ ID NO: 3258803 - protein, 20 aa, Plasmodium falciparum
FKFISELLILGRLNRFSLCK

SEQ ID NO: 3258804 - protein, 17 aa, Plasmodium falciparum
FKFKIKIAEKLRTLVHF

SEQ ID NO: 3258805 - protein, 27 aa, Plasmodium falciparum
FKFKKKYSSNFLKMFNKNIVKEYTSIN

SEQ ID NO: 3258806 - protein, 17 aa, Plasmodium falciparum
FKFKKRYLKINDFYITF

SEQ ID NO: 3258807 - protein, 20 aa, Plasmodium falciparum
FKFKSYRGRTTKVLKKKKKL

SEQ ID NO: 3258808 - protein, 19 aa, Plasmodium falciparum
FKFKYSKRDYENMKNEKND

SEQ ID NO: 3258809 - protein, 18 aa, Plasmodium falciparum
FKFLELISYSASGLSFYG

SEQ ID NO: 3258810 - protein, 17 aa, Plasmodium falciparum
FKFLLEKYVYMNKYNDP

SEQ ID NO: 3258811 - protein, 20 aa, Plasmodium falciparum
FKFWQCSFVSVVPEIENMFQ

SEQ ID NO: 3258812 - protein, 27 aa, Plasmodium falciparum
FKGDLKESRPCIIPLPPCNELFSHKDN

SEQ ID NO: 3258813 - protein, 20 aa, Plasmodium falciparum
FKGEYDYLIYQAIEEEEKKK

SEQ ID NO: 3258814 - protein, 23 aa, Plasmodium falciparum
FKGKCGTVDAFLGLLNNEKACKE

SEQ ID NO: 3258815 - protein, 19 aa, Plasmodium falciparum
FKGNLKCSQLYNFNNDVYR

SEQ ID NO: 3258816 - protein, 20 aa, Plasmodium falciparum
FKGSEGYLCNNCSNSYDVIH

SEQ ID NO: 3258817 - protein, 19 aa, Plasmodium falciparum
FKHKYLIMNTYKIKKKKKT

SEQ ID NO: 3258818 - protein, 22 aa, Plasmodium falciparum
FKHNWNICLLWIRVILSSSLLI

SEQ ID NO: 3258819 - protein, 25 aa, Plasmodium falciparum
FKIEKHFRKKFLIFYIKMGTGIMYL

SEQ ID NO: 3258820 - protein, 17 aa, Plasmodium falciparum
FKIFKKKWLKFIKKNKS

SEQ ID NO: 3258821 - protein, 30 aa, Plasmodium falciparum
FKIHLLRKDCSTLNFPLDNFIIIYDFLYNI

SEQ ID NO: 3258822 - protein, 25 aa, Plasmodium falciparum
FKIIIKELFKYFIIYEKNLNDEINQ

SEQ ID NO: 3258823 - protein, 32 aa, Plasmodium falciparum
FKIIKTILLRKHLIVFVIINILILFKLNVNTT

SEQ ID NO: 3258824 - protein, 23 aa, Plasmodium falciparum
FKIILKGIYSIKCENEETHIFLN

SEQ ID NO: 3258825 - protein, 17 aa, Plasmodium falciparum
FKIINAFYSSFILTYNK

SEQ ID NO: 3258826 - protein, 21 aa, Plasmodium falciparum
FKIINRKVIKLLINKFKRTNN

SEQ ID NO: 3258827 - protein, 17 aa, Plasmodium falciparum
FKIKCENHNCSSGGNTQ

SEQ ID NO: 3258828 - protein, 22 aa, Plasmodium falciparum
FKIKEFLFSCLDEFSNLKKQLY

SEQ ID NO: 3258829 - protein, 20 aa, Plasmodium falciparum
FKIKKCLFLHDLIICMDYYK

SEQ ID NO: 3258830 - protein, 26 aa, Plasmodium falciparum
FKIKKFIKLYGIENFHHFAVDILNIA

SEQ ID NO: 3258831 - protein, 24 aa, Plasmodium falciparum
FKIKKVGLFLICITLTSVEYVGVL

SEQ ID NO: 3258832 - protein, 25 aa, Plasmodium falciparum
FKIKNLLCSSTRNPFFIFLCIESIN

SEQ ID NO: 3258833 - protein, 20 aa, Plasmodium falciparum
FKILAYNFLHYEQINKKKKQ

SEQ ID NO: 3258834 - protein, 29 aa, Plasmodium falciparum
FKILCITIRPGEVINYVFSEKSFTSCIVL

SEQ ID NO: 3258835 - protein, 24 aa, Plasmodium falciparum
FKILYDIIAFIAIVFILVIIIIYT

SEQ ID NO: 3258836 - protein, 17 aa, Plasmodium falciparum
FKINCKNGKCKSGDGDT

SEQ ID NO: 3258837 - protein, 19 aa, Plasmodium falciparum
FKINCKNGKCSDEEKRKCN

SEQ ID NO: 3258838 - protein, 20 aa, Plasmodium falciparum
FKINHFLSSLFYINKIIPPN

SEQ ID NO: 3258839 - protein, 20 aa, Plasmodium falciparum
FKINIPIFIFSFFYQSQYIH

SEQ ID NO: 3258840 - protein, 17 aa, Plasmodium falciparum
FKINKVYLKEVVDELYS

SEQ ID NO: 3258841 - protein, 21 aa, Plasmodium falciparum
FKINLPLLYFMKNPINIYMED

SEQ ID NO: 3258842 - protein, 19 aa, Plasmodium falciparum
FKINVPKLLRIFFDHKVVN

SEQ ID NO: 3258843 - protein, 20 aa, Plasmodium falciparum
FKIPFHILINRYNINYEIYS

SEQ ID NO: 3258844 - protein, 21 aa, Plasmodium falciparum
FKIRIPYKNSKVIESKINDIL

SEQ ID NO: 3258845 - protein, 20 aa, Plasmodium falciparum
FKISFNILNFLAQIIMCTML

SEQ ID NO: 3258846 - protein, 23 aa, Plasmodium falciparum
FKISLILKLIWFLYFPYPKCELF

SEQ ID NO: 3258847 - protein, 28 aa, Plasmodium falciparum
FKISTEILDMLNILLSRKKGILQELLNT

SEQ ID NO: 3258848 - protein, 17 aa, Plasmodium falciparum
FKIVELLYMSKKKLLNL

SEQ ID NO: 3258849 - protein, 30 aa, Plasmodium falciparum
FKKCFLNNYMKIFINFCNIYNDIIIECLYI

SEQ ID NO: 3258850 - protein, 17 aa, Plasmodium falciparum
FKKCFNRNINNHDDVSK

SEQ ID NO: 3258851 - protein, 20 aa, Plasmodium falciparum
FKKDHMYLALLWIKEKLSLF

SEQ ID NO: 3258852 - protein, 18 aa, Plasmodium falciparum
FKKDITFIPIESRPKRTT

SEQ ID NO: 3258853 - protein, 33 aa, Plasmodium falciparum
FKKDMIEPIEHFPSYKFRSVNDLLYFDYVNHFK

SEQ ID NO: 3258854 - protein, 19 aa, Plasmodium falciparum
FKKEERYYFDIPKNNTGFR

SEQ ID NO: 3258855 - protein, 21 aa, Plasmodium falciparum
FKKGDTFLNMVCIKLKRIYEN

SEQ ID NO: 3258856 - protein, 17 aa, Plasmodium falciparum
FKKHIKPSARRTNLYES

SEQ ID NO: 3258857 - protein, 19 aa, Plasmodium falciparum
FKKIHSILTHYKEIKSELK

SEQ ID NO: 3258858 - protein, 19 aa, Plasmodium falciparum
FKKIPLWIMRQAGRYLPEY

SEQ ID NO: 3258859 - protein, 17 aa, Plasmodium falciparum
FKKISLLLLLILSFLIL

SEQ ID NO: 3258860 - protein, 20 aa, Plasmodium falciparum
FKKKEYFLELGAKYCNDIMD

SEQ ID NO: 3258861 - protein, 19 aa, Plasmodium falciparum
FKKKGFEIFDENISKNLNI

SEQ ID NO: 3258862 - protein, 22 aa, Plasmodium falciparum
FKKKIHMSNIINFFHSIIYLCI

SEQ ID NO: 3258863 - protein, 19 aa, Plasmodium falciparum
FKKKNGRRKKGDLKYVQLF

SEQ ID NO: 3258864 - protein, 21 aa, Plasmodium falciparum
FKKKVQKLMLLMCEINDEYIK

SEQ ID NO: 3258865 - protein, 18 aa, Plasmodium falciparum
FKKKWLKFIKKNKSYNKG

SEQ ID NO: 3258866 - protein, 21 aa, Plasmodium falciparum
FKKKYIFIVTCYFNDFIKGLE

SEQ ID NO: 3258867 - protein, 19 aa, Plasmodium falciparum
FKKLETINELKIRPFPKFY

SEQ ID NO: 3258868 - protein, 17 aa, Plasmodium falciparum
FKKLVYDSIDAIETYIA

SEQ ID NO: 3258869 - protein, 17 aa, Plasmodium falciparum
FKKNLWTLNNILFDVKD

SEQ ID NO: 3258870 - protein, 18 aa, Plasmodium falciparum
FKKNVLFSSMIFSINLNI

SEQ ID NO: 3258871 - protein, 19 aa, Plasmodium falciparum
FKKPLYFFKKNKLQLSLHI

SEQ ID NO: 3258872 - protein, 18 aa, Plasmodium falciparum
FKKSITYTGASARIAHEN

SEQ ID NO: 3258873 - protein, 20 aa, Plasmodium falciparum
FKKSKSYEKFASFTSKINFL

SEQ ID NO: 3258874 - protein, 20 aa, Plasmodium falciparum
FKKYFKGVVKLYVDITEPNL

SEQ ID NO: 3258875 - protein, 22 aa, Plasmodium falciparum
FKKYKIPSTKVVKYIFYDSYVL

SEQ ID NO: 3258876 - protein, 22 aa, Plasmodium falciparum
FKKYKRKVFGSLGIPNGGKGGN

SEQ ID NO: 3258877 - protein, 20 aa, Plasmodium falciparum
FKLESSFFIETIVEANNYYS

SEQ ID NO: 3258878 - protein, 17 aa, Plasmodium falciparum
FKLFKFLNKNVENIDNT

SEQ ID NO: 3258879 - protein, 22 aa, Plasmodium falciparum
FKLICILCYPFFNIILELLYFT

SEQ ID NO: 3258880 - protein, 18 aa, Plasmodium falciparum
FKLIPEYFIFSCFFYYVK

SEQ ID NO: 3258881 - protein, 17 aa, Plasmodium falciparum
FKLKEYYIIINNLLLLN

SEQ ID NO: 3258882 - protein, 17 aa, Plasmodium falciparum
FKLKLPLYKIHHYEDYL

SEQ ID NO: 3258883 - protein, 17 aa, Plasmodium falciparum
FKLYEYISRIDKFSLND

SEQ ID NO: 3258884 - protein, 22 aa, Plasmodium falciparum
FKLYFKKKWKHFNIYIPPSAYI

SEQ ID NO: 3258885 - protein, 31 aa, Plasmodium falciparum
FKLYNFYCACRNFSPSFLFAFSDILLKLTPK

SEQ ID NO: 3258886 - protein, 24 aa, Plasmodium falciparum
FKLYYSCPTSAPLVNTKIKMLQNK

SEQ ID NO: 3258887 - protein, 23 aa, Plasmodium falciparum
FKMDKHFFKCFNILLFSFSQQPN

SEQ ID NO: 3258888 - protein, 26 aa, Plasmodium falciparum
FKMYVPELLCVVLALQTNMFMNKNIL

SEQ ID NO: 3258889 - protein, 20 aa, Plasmodium falciparum
FKNAFINSALPLFLFSEPMP

SEQ ID NO: 3258890 - protein, 19 aa, Plasmodium falciparum
FKNCKNGLEDIKFTYMLIY

SEQ ID NO: 3258891 - protein, 25 aa, Plasmodium falciparum
FKNDFLRKYFNLIFYSRDYWSCRNI

SEQ ID NO: 3258892 - protein, 22 aa, Plasmodium falciparum
FKNEMFFKNIMCDWKNCEDKFI

SEQ ID NO: 3258893 - protein, 19 aa, Plasmodium falciparum
FKNFNMIDHYFKPARGLLI

SEQ ID NO: 3258894 - protein, 23 aa, Plasmodium falciparum
FKNGHINLAHPFIYNEMNKTYTN

SEQ ID NO: 3258895 - protein, 25 aa, Plasmodium falciparum
FKNGICLNCPDGAYCEGGFQKETLL

SEQ ID NO: 3258896 - protein, 20 aa, Plasmodium falciparum
FKNIINLIIHEMKKINKKIK

SEQ ID NO: 3258897 - protein, 22 aa, Plasmodium falciparum
FKNIKKLILYYGNNTFLQTSSL

SEQ ID NO: 3258898 - protein, 38 aa, Plasmodium falciparum
FKNIKTSFNVSGFLGVLVCNFTGMKIKIYDNGISEKYA

SEQ ID NO: 3258899 - protein, 22 aa, Plasmodium falciparum
FKNIPYVDSFYTYMFIYYHKFK

SEQ ID NO: 3258900 - protein, 21 aa, Plasmodium falciparum
FKNKEIIHFIYFKKDKEEKEE

SEQ ID NO: 3258901 - protein, 20 aa, Plasmodium falciparum
FKNKICLEEFIEFINNNSGS

SEQ ID NO: 3258902 - protein, 31 aa, Plasmodium falciparum
FKNKIKIRKDIKCFFLMYYILYKQNVSNNIL

SEQ ID NO: 3258903 - protein, 22 aa, Plasmodium falciparum
FKNKYTSSCINYNMCAISDLST

SEQ ID NO: 3258904 - protein, 17 aa, Plasmodium falciparum
FKNLYFFIHNRIIKREQ

SEQ ID NO: 3258905 - protein, 27 aa, Plasmodium falciparum
FKNNCYFSYCCCCCYLCKNFFSNLICS

SEQ ID NO: 3258906 - protein, 18 aa, Plasmodium falciparum
FKNNIEKLGYAYRDNMNK

SEQ ID NO: 3258907 - protein, 28 aa, Plasmodium falciparum
FKNNIKRICRYIKYYALMERLNIINVCY

SEQ ID NO: 3258908 - protein, 23 aa, Plasmodium falciparum
FKNNLLKKNFRTYFTNYIYTLFN

SEQ ID NO: 3258909 - protein, 19 aa, Plasmodium falciparum
FKNQFIKYLSEFLNFQKRL

SEQ ID NO: 3258910 - protein, 22 aa, Plasmodium falciparum
FKNQLIKLGFLFNWESEINTCD

SEQ ID NO: 3258911 - protein, 36 aa, Plasmodium falciparum
FKNQYLKKFSAYEPVTKFLLTCVSLTQIFEISLIRF

SEQ ID NO: 3258912 - protein, 25 aa, Plasmodium falciparum
FKNRCLYICSILGLSLSLINSQNKE

SEQ ID NO: 3258913 - protein, 20 aa, Plasmodium falciparum
FKNRIIGLLKNKFNVHTSNV

SEQ ID NO: 3258914 - protein, 31 aa, Plasmodium falciparum
FKNRNIFRYRIWRLISCYNYLNYLKIYFNIF

SEQ ID NO: 3258915 - protein, 19 aa, Plasmodium falciparum
FKNSILVNLLGQWQEVESS

SEQ ID NO: 3258916 - protein, 33 aa, Plasmodium falciparum
FKNSTLIYNCEMLRYYIIIGVLQAMSLKFLSTH

SEQ ID NO: 3258917 - protein, 17 aa, Plasmodium falciparum
FKNVDAFSYKEYCDTCP

SEQ ID NO: 3258918 - protein, 18 aa, Plasmodium falciparum
FKNYELNNLFVLNIYFPV

SEQ ID NO: 3258919 - protein, 20 aa, Plasmodium falciparum
FKNYIFSNKYFKQMIHMICT

SEQ ID NO: 3258920 - protein, 17 aa, Plasmodium falciparum
FKPIFPFTLLTRTGLQS

SEQ ID NO: 3258921 - protein, 19 aa, Plasmodium falciparum
FKPNLLFLSAGFDGHQLDY

SEQ ID NO: 3258922 - protein, 19 aa, Plasmodium falciparum
FKPVLKENMRVFNEYETND

SEQ ID NO: 3258923 - protein, 21 aa, Plasmodium falciparum
FKQIDICNIFDFLNEFKSFHK

SEQ ID NO: 3258924 - protein, 20 aa, Plasmodium falciparum
FKQINVIEGLLIMAFMCSKL

SEQ ID NO: 3258925 - protein, 19 aa, Plasmodium falciparum
FKQLENVIYKKIISICKNI

SEQ ID NO: 3258926 - protein, 17 aa, Plasmodium falciparum
FKQLYIIPYLLKDYNVI

SEQ ID NO: 3258927 - protein, 20 aa, Plasmodium falciparum
FKQSLSIIVSLYNFNLLNKE

SEQ ID NO: 3258928 - protein, 19 aa, Plasmodium falciparum
FKQSMIYLACVDKTTNGLE

SEQ ID NO: 3258929 - protein, 22 aa, Plasmodium falciparum
FKRNFCSSTNCDKCIINNFCKY

SEQ ID NO: 3258930 - protein, 18 aa, Plasmodium falciparum
FKRNILRKNNYGYNKTNK

SEQ ID NO: 3258931 - protein, 20 aa, Plasmodium falciparum
FKRNTCDEISKYLREKGIQA

SEQ ID NO: 3258932 - protein, 19 aa, Plasmodium falciparum
FKRNVPIVLIGKDFWSGIL

SEQ ID NO: 3258933 - protein, 20 aa, Plasmodium falciparum
FKRQMFYTFADYRDICLGKD

SEQ ID NO: 3258934 - protein, 24 aa, Plasmodium falciparum
FKRRRNKLKERKMQELHKFKKNYK

SEQ ID NO: 3258935 - protein, 27 aa, Plasmodium falciparum
FKRSNINPEFGCLWESEAIFPEDEILT

SEQ ID NO: 3258936 - protein, 18 aa, Plasmodium falciparum
FKRTPPITKIYLLGTFLL

SEQ ID NO: 3258937 - protein, 20 aa, Plasmodium falciparum
FKRTYEILNKYIGMNRLEKQ

SEQ ID NO: 3258938 - protein, 27 aa, Plasmodium falciparum
FKSFLKCVFISLWKYFIQMEMIDFYQN

SEQ ID NO: 3258939 - protein, 20 aa, Plasmodium falciparum
FKSFSYHVTTFLTYDNNSYF

SEQ ID NO: 3258940 - protein, 35 aa, Plasmodium falciparum
FKSKKKFRFSTAFKKIKRKWLFKKQRTNIYFNENT

SEQ ID NO: 3258941 - protein, 23 aa, Plasmodium falciparum
FKSKLRILKYAFIYLIIFMIISH

SEQ ID NO: 3258942 - protein, 17 aa, Plasmodium falciparum
FKSLTLKHERLQADLLK

SEQ ID NO: 3258943 - protein, 24 aa, Plasmodium falciparum
FKSMPSGLFIYFITNTFFQLFITQ

SEQ ID NO: 3258944 - protein, 20 aa, Plasmodium falciparum
FKSQMFYTLADYRDILFGNN

SEQ ID NO: 3258945 - protein, 21 aa, Plasmodium falciparum
FKSSGKTLAYMNCLVHKIIIQ

SEQ ID NO: 3258946 - protein, 24 aa, Plasmodium falciparum
FKSSSFFSILWVYSYFFICEILQS

SEQ ID NO: 3258947 - protein, 17 aa, Plasmodium falciparum
FKTEGPININFNYYKYP

SEQ ID NO: 3258948 - protein, 25 aa, Plasmodium falciparum
FKTFFKIFFIPFFQCLLKKNNSLEY

SEQ ID NO: 3258949 - protein, 20 aa, Plasmodium falciparum
FKTLTKLFVFNKYKNVLHMD

SEQ ID NO: 3258950 - protein, 18 aa, Plasmodium falciparum
FKTLVCVKRNTLIKYLII

SEQ ID NO: 3258951 - protein, 17 aa, Plasmodium falciparum
FKTSKLCVQDNINNNYK

SEQ ID NO: 3258952 - protein, 18 aa, Plasmodium falciparum
FKTSVLKIGSCRNIKRTI

SEQ ID NO: 3258953 - protein, 17 aa, Plasmodium falciparum
FKTVHLIVQEYNRKKTC

SEQ ID NO: 3258954 - protein, 18 aa, Plasmodium falciparum
FKVGSSIIVIFENKKNFK

SEQ ID NO: 3258955 - protein, 19 aa, Plasmodium falciparum
FKVKCENGKCSGGGKKVNC

SEQ ID NO: 3258956 - protein, 17 aa, Plasmodium falciparum
FKVNKYLSKKKIYKKLF

SEQ ID NO: 3258957 - protein, 34 aa, Plasmodium falciparum
FKVPLETFLSFRNCTVHAYGAFQLYDMQTYINYK

SEQ ID NO: 3258958 - protein, 20 aa, Plasmodium falciparum
FKVTKSYFKEFRKKKKHISM

SEQ ID NO: 3258959 - protein, 19 aa, Plasmodium falciparum
FKYEHEKSINSLTISNINS

SEQ ID NO: 3258960 - protein, 21 aa, Plasmodium falciparum
FKYIFPSYVYSFYISKDLKNI

SEQ ID NO: 3258961 - protein, 17 aa, Plasmodium falciparum
FKYIKSFFLKKDDKDYL

SEQ ID NO: 3258962 - protein, 20 aa, Plasmodium falciparum
FKYILPPKCDIIIRFEIIKI

SEQ ID NO: 3258963 - protein, 21 aa, Plasmodium falciparum
FKYIMKSIIPLGGNIKQLNVS

SEQ ID NO: 3258964 - protein, 31 aa, Plasmodium falciparum
FKYISFFSIDLIDIWKKFFFLLNHFVNNLNL

SEQ ID NO: 3258965 - protein, 20 aa, Plasmodium falciparum
FKYIYLQLYMYFIETYLGID

SEQ ID NO: 3258966 - protein, 20 aa, Plasmodium falciparum
FKYLDYKTHNNFFSSDHKPV

SEQ ID NO: 3258967 - protein, 24 aa, Plasmodium falciparum
FKYMCAKCNLVIYPAKGREQKFLK

SEQ ID NO: 3258968 - protein, 21 aa, Plasmodium falciparum
FKYNKEFSIFLLTLISVLKVE

SEQ ID NO: 3258969 - protein, 17 aa, Plasmodium falciparum
FKYNMRRNHFVSFNISL

SEQ ID NO: 3258970 - protein, 17 aa, Plasmodium falciparum
FKYQYDIINEQYPIIKN

SEQ ID NO: 3258971 - protein, 19 aa, Plasmodium falciparum
FKYSSNYIYSLNITNDSET

SEQ ID NO: 3258972 - protein, 21 aa, Plasmodium falciparum
FKYTLLKLFFERSRKRPTQQI

SEQ ID NO: 3258973 - protein, 29 aa, Plasmodium falciparum
FKYVNSIIIDSLFFFKCINEIKYKSSDNF

SEQ ID NO: 3258974 - protein, 29 aa, Plasmodium falciparum
FLADECMYFMRYCIDKCINLKDEIIKNSS

SEQ ID NO: 3258975 - protein, 17 aa, Plasmodium falciparum
FLCCEGIDQIRGWFQSF

SEQ ID NO: 3258976 - protein, 17 aa, Plasmodium falciparum
FLCKFLNKHTKIFHAAL

SEQ ID NO: 3258977 - protein, 20 aa, Plasmodium falciparum
FLCLFIVILILYASIDISIN

SEQ ID NO: 3258978 - protein, 17 aa, Plasmodium falciparum
FLCNILFNKRNKIINKI

SEQ ID NO: 3258979 - protein, 26 aa, Plasmodium falciparum
FLCNKKGFHFCHRIILRKRTFSFKLI

SEQ ID NO: 3258980 - protein, 25 aa, Plasmodium falciparum
FLCNNLFGCIYFLFNNEYYKYIIDK

SEQ ID NO: 3258981 - protein, 20 aa, Plasmodium falciparum
FLCSIYNLFKSKILENNKLD

SEQ ID NO: 3258982 - protein, 21 aa, Plasmodium falciparum
FLCTFVNLFDMCVTNNTLPSQ

SEQ ID NO: 3258983 - protein, 19 aa, Plasmodium falciparum
FLCTICLRQNDDMFCHFNK

SEQ ID NO: 3258984 - protein, 24 aa, Plasmodium falciparum
FLCYEKWVPGMNFFSLNMIEEETN

SEQ ID NO: 3258985 - protein, 17 aa, Plasmodium falciparum
FLCYNLIVYIYCVSKNA

SEQ ID NO: 3258986 - protein, 24 aa, Plasmodium falciparum
FLDIEKWIRHMFTYIKRYNYMGLP

SEQ ID NO: 3258987 - protein, 26 aa, Plasmodium falciparum
FLDIYKNICCPLELNQIIKTLKENVH

SEQ ID NO: 3258988 - protein, 21 aa, Plasmodium falciparum
FLDKEQRLFFTYNFGDVEPQG

SEQ ID NO: 3258989 - protein, 25 aa, Plasmodium falciparum
FLDLLCGLRDGHFINMSQDDHIFNI

SEQ ID NO: 3258990 - protein, 27 aa, Plasmodium falciparum
FLDNILSLCCSIIFSMITQRTRLLLGR

SEQ ID NO: 3258991 - protein, 23 aa, Plasmodium falciparum
FLDRLKKGPCSKTYNESGEDNNK

SEQ ID NO: 3258992 - protein, 35 aa, Plasmodium falciparum
FLDTIFKFDNSSFFLFNMSFQFVESMSKQNMRGVE

SEQ ID NO: 3258993 - protein, 17 aa, Plasmodium falciparum
FLEAFKIYRNNSKYFAF

SEQ ID NO: 3258994 - protein, 23 aa, Plasmodium falciparum
FLEDMIPMYVTLLFFIHTKTTYY

SEQ ID NO: 3258995 - protein, 20 aa, Plasmodium falciparum
FLEEIKSFFKNMLTTDKSYI

SEQ ID NO: 3258996 - protein, 21 aa, Plasmodium falciparum
FLEHFHYFKYCTVEKYNSMYV

SEQ ID NO: 3258997 - protein, 25 aa, Plasmodium falciparum
FLEHFYPYDNFIFFLKVLNTKSNEE

SEQ ID NO: 3258998 - protein, 17 aa, Plasmodium falciparum
FLENVCLTIGDMENIIY

SEQ ID NO: 3258999 - protein, 25 aa, Plasmodium falciparum
FLERIKIKYTLRIVYIYFVTIMVQL

SEQ ID NO: 3259000 - protein, 25 aa, Plasmodium falciparum
FLESLKHESCKEVVEKVKNFILNFP

SEQ ID NO: 3259001 - protein, 20 aa, Plasmodium falciparum
FLEVYYPLLYLRIIKGKGNI

SEQ ID NO: 3259002 - protein, 18 aa, Plasmodium falciparum
FLEYSELFFNYEKEKKIT

SEQ ID NO: 3259003 - protein, 22 aa, Plasmodium falciparum
FLFDDFYFFIIQNIKLVIEEKE

SEQ ID NO: 3259004 - protein, 27 aa, Plasmodium falciparum
FLFENLKKGFSFLGFWRNQYDQKYIDD

SEQ ID NO: 3259005 - protein, 17 aa, Plasmodium falciparum
FLFENPFFEKKNKDGKE

SEQ ID NO: 3259006 - protein, 18 aa, Plasmodium falciparum
FLFIFILVVWLAFQTNKR

SEQ ID NO: 3259007 - protein, 24 aa, Plasmodium falciparum
FLFIFLICPIKTFILKNNNNLSPY

SEQ ID NO: 3259008 - protein, 17 aa, Plasmodium falciparum
FLFIIPLNEVIYNKYDY

SEQ ID NO: 3259009 - protein, 23 aa, Plasmodium falciparum
FLFKNELYFLAFIKILNLSICNN

SEQ ID NO: 3259010 - protein, 21 aa, Plasmodium falciparum
FLFLFIKKKYMTIFLNSIQMV

SEQ ID NO: 3259011 - protein, 19 aa, Plasmodium falciparum
FLFLFIVYGIFFSSRPILM

SEQ ID NO: 3259012 - protein, 18 aa, Plasmodium falciparum
FLFTLFLLIYMVKYTIVI

SEQ ID NO: 3259013 - protein, 17 aa, Plasmodium falciparum
FLFYIILIKFPNVSITI

SEQ ID NO: 3259014 - protein, 19 aa, Plasmodium falciparum
FLGEVNLELSKYIQKASQI

SEQ ID NO: 3259015 - protein, 18 aa, Plasmodium falciparum
FLGLLIFILHVFMRKNIF

SEQ ID NO: 3259016 - protein, 18 aa, Plasmodium falciparum
FLGLYIWSLIKNARLTLC

SEQ ID NO: 3259017 - protein, 33 aa, Plasmodium falciparum
FLGVCLGFAIWPFFMTIITYRLFYKDNFNNTNY

SEQ ID NO: 3259018 - protein, 25 aa, Plasmodium falciparum
FLHIKRKLNCLFIRNNITDIRNLKY

SEQ ID NO: 3259019 - protein, 19 aa, Plasmodium falciparum
FLHIYDLSSHFIIHLMEYL

SEQ ID NO: 3259020 - protein, 25 aa, Plasmodium falciparum
FLHLKGYFILLCFVNDTIIPYVCSE

SEQ ID NO: 3259021 - protein, 18 aa, Plasmodium falciparum
FLHLYKILFQNFLFYYYN

SEQ ID NO: 3259022 - protein, 20 aa, Plasmodium falciparum
FLHPNPRWIDNKSKPVYIRE

SEQ ID NO: 3259023 - protein, 19 aa, Plasmodium falciparum
FLICCQIPLYGIVTSKSSD

SEQ ID NO: 3259024 - protein, 30 aa, Plasmodium falciparum
FLICNFQYVRKCETLFFKYFLLSLKPIVIN

SEQ ID NO: 3259025 - protein, 38 aa, Plasmodium falciparum
FLICYINTLFLRRVLFCYSYNLSQHFSLYNNSKFVLFK

SEQ ID NO: 3259026 - protein, 22 aa, Plasmodium falciparum
FLIDKKIHIVNNFFKDEDSIFK

SEQ ID NO: 3259027 - protein, 28 aa, Plasmodium falciparum
FLIFLFKRILPQFICLNYPSLRSPYSLN

SEQ ID NO: 3259028 - protein, 17 aa, Plasmodium falciparum
FLIGSFLPICVFTSGFF

SEQ ID NO: 3259029 - protein, 17 aa, Plasmodium falciparum
FLIHICKGIRLQNYKNE

SEQ ID NO: 3259030 - protein, 18 aa, Plasmodium falciparum
FLIICYSYIMLIKKQQVD

SEQ ID NO: 3259031 - protein, 19 aa, Plasmodium falciparum
FLIKKCYSTENIVMSSELC

SEQ ID NO: 3259032 - protein, 22 aa, Plasmodium falciparum
FLILCKYRSILIIKYKNVKNTN

SEQ ID NO: 3259033 - protein, 19 aa, Plasmodium falciparum
FLIPLIFLYNVIRINESII

SEQ ID NO: 3259034 - protein, 17 aa, Plasmodium falciparum
FLIQTAIEAFRYARIFN

SEQ ID NO: 3259035 - protein, 18 aa, Plasmodium falciparum
FLITCSMFYFMNQVIICS

SEQ ID NO: 3259036 - protein, 17 aa, Plasmodium falciparum
FLITSYYSFIYIYNNFM

SEQ ID NO: 3259037 - protein, 18 aa, Plasmodium falciparum
FLIYARLIFQNNLSFIKT

SEQ ID NO: 3259038 - protein, 29 aa, Plasmodium falciparum
FLIYKFKYWKNIFKRYIINGLSYNINPHT

SEQ ID NO: 3259039 - protein, 30 aa, Plasmodium falciparum
FLIYKFLYLLCKHFKMCDVGTFMNFYNNNG

SEQ ID NO: 3259040 - protein, 24 aa, Plasmodium falciparum
FLKALPIKLINSLRIFAENIKIIF

SEQ ID NO: 3259041 - protein, 23 aa, Plasmodium falciparum
FLKCNDCYLPAYFLKNWNYERYN

SEQ ID NO: 3259042 - protein, 22 aa, Plasmodium falciparum
FLKCTYQFFYPFLMLPDLAKWT

SEQ ID NO: 3259043 - protein, 25 aa, Plasmodium falciparum
FLKDERRLNVALTRAKDYLWIIGNR

SEQ ID NO: 3259044 - protein, 24 aa, Plasmodium falciparum
FLKEIYSDYCMIIFGSCNNDIDIY

SEQ ID NO: 3259045 - protein, 20 aa, Plasmodium falciparum
FLKEKNFPLFLFTSGEVYFS

SEQ ID NO: 3259046 - protein, 22 aa, Plasmodium falciparum
FLKERFQVRPGKIENFVFNKKD

SEQ ID NO: 3259047 - protein, 30 aa, Plasmodium falciparum
FLKETDCIQVFKILNIFLIIDNINYIIISL

SEQ ID NO: 3259048 - protein, 18 aa, Plasmodium falciparum
FLKHYKKFIPSLTYSEIL

SEQ ID NO: 3259049 - protein, 20 aa, Plasmodium falciparum
FLKIEKINCLAIFEESYLYV

SEQ ID NO: 3259050 - protein, 22 aa, Plasmodium falciparum
FLKILIVIFLFYTKYYICFFFF

SEQ ID NO: 3259051 - protein, 18 aa, Plasmodium falciparum
FLKKKMKGSKKMYHQKSY

SEQ ID NO: 3259052 - protein, 21 aa, Plasmodium falciparum
FLKKSLKNPFLLIDINKNILD

SEQ ID NO: 3259053 - protein, 21 aa, Plasmodium falciparum
FLKKSSCSLRRLIYERDKGIC

SEQ ID NO: 3259054 - protein, 23 aa, Plasmodium falciparum
FLKMSSYEYSYFIVVNAFNMLNN

SEQ ID NO: 3259055 - protein, 22 aa, Plasmodium falciparum
FLKNCNYMKMIITKKNKVYISN

SEQ ID NO: 3259056 - protein, 17 aa, Plasmodium falciparum
FLKNCSLRKTLIITTLV

SEQ ID NO: 3259057 - protein, 20 aa, Plasmodium falciparum
FLKNFQKILFHNGDNLKLKN

SEQ ID NO: 3259058 - protein, 21 aa, Plasmodium falciparum
FLKNLRGIKFLTYYKNCLLYR

SEQ ID NO: 3259059 - protein, 24 aa, Plasmodium falciparum
FLKNMPKITTLIFMNDGWDNNVKN

SEQ ID NO: 3259060 - protein, 24 aa, Plasmodium falciparum
FLKNREYKELITMQYDYAYLEATK

SEQ ID NO: 3259061 - protein, 21 aa, Plasmodium falciparum
FLKNRLNFIKITYKNDNDYML

SEQ ID NO: 3259062 - protein, 24 aa, Plasmodium falciparum
FLKRFKIYLDEIICRITLTEGNYI

SEQ ID NO: 3259063 - protein, 26 aa, Plasmodium falciparum
FLKRKEIAWRIIIQNILLNIEMWDKY

SEQ ID NO: 3259064 - protein, 24 aa, Plasmodium falciparum
FLKTAFFFHKFVKIPFLFEYFTLF

SEQ ID NO: 3259065 - protein, 18 aa, Plasmodium falciparum
FLKYADYFFHEYKDNVHI

SEQ ID NO: 3259066 - protein, 24 aa, Plasmodium falciparum
FLKYATNCGFILKKKTASKIEIKY

SEQ ID NO: 3259067 - protein, 20 aa, Plasmodium falciparum
FLKYEKWQVPSLIKNIIYSF

SEQ ID NO: 3259068 - protein, 18 aa, Plasmodium falciparum
FLKYWKTYFLCACFLIIG

SEQ ID NO: 3259069 - protein, 25 aa, Plasmodium falciparum
FLLDRNINCPYRFGKIFAGTYGITN

SEQ ID NO: 3259070 - protein, 24 aa, Plasmodium falciparum
FLLECKYSKKISNIFEENYINDIF

SEQ ID NO: 3259071 - protein, 25 aa, Plasmodium falciparum
FLLEINKIYLRREAEFWELDESDSL

SEQ ID NO: 3259072 - protein, 17 aa, Plasmodium falciparum
FLLEKYVYMNKYNDPIN

SEQ ID NO: 3259073 - protein, 34 aa, Plasmodium falciparum
FLLFFSCYNFNLELCYKYEKAIFYNFFKSSVDLF

SEQ ID NO: 3259074 - protein, 26 aa, Plasmodium falciparum
FLLFKNRLKFLLDEYFHKKDYNLLFQ

SEQ ID NO: 3259075 - protein, 25 aa, Plasmodium falciparum
FLLFKSVIITYCLSFSYKEKRKFLK

SEQ ID NO: 3259076 - protein, 23 aa, Plasmodium falciparum
FLLGGFQGVVGWWMVKSGFDKPT

SEQ ID NO: 3259077 - protein, 29 aa, Plasmodium falciparum
FLLIAPLMFCFDDKILLRLFFFKWKRYEI

SEQ ID NO: 3259078 - protein, 18 aa, Plasmodium falciparum
FLLICLLFMFFFLLFIYV

SEQ ID NO: 3259079 - protein, 27 aa, Plasmodium falciparum
FLLIELKLKYFRNLPSYFYMFKVYKKL

SEQ ID NO: 3259080 - protein, 17 aa, Plasmodium falciparum
FLLILLFYYVFPFFPYI

SEQ ID NO: 3259081 - protein, 19 aa, Plasmodium falciparum
FLLKKEIVKNVSYQNLDTH

SEQ ID NO: 3259082 - protein, 26 aa, Plasmodium falciparum
FLLKMNCLYYMLSKNILLKVLSKDNL

SEQ ID NO: 3259083 - protein, 17 aa, Plasmodium falciparum
FLLKSMCQDKFIKFTLM

SEQ ID NO: 3259084 - protein, 18 aa, Plasmodium falciparum
FLLNGVAVITVFFIAIVI

SEQ ID NO: 3259085 - protein, 20 aa, Plasmodium falciparum
FLLQKICFFIMNCLVLLYIM

SEQ ID NO: 3259086 - protein, 24 aa, Plasmodium falciparum
FLLSLRFLFLYKKFNQLGLLFLET

SEQ ID NO: 3259087 - protein, 17 aa, Plasmodium falciparum
FLLSLTYLHLYYRYVNV

SEQ ID NO: 3259088 - protein, 17 aa, Plasmodium falciparum
FLLSPIIKIICNENDKK

SEQ ID NO: 3259089 - protein, 25 aa, Plasmodium falciparum
FLLSSICFLYFTFLYLKKLNLNLNA

SEQ ID NO: 3259090 - protein, 31 aa, Plasmodium falciparum
FLLTNYVCPMSWFFIIRRIVEDVKIFNKKQC

SEQ ID NO: 3259091 - protein, 18 aa, Plasmodium falciparum
FLLTPSCFFQVNRDSCQI

SEQ ID NO: 3259092 - protein, 18 aa, Plasmodium falciparum
FLLVLEPLLPIYIKNITD

SEQ ID NO: 3259093 - protein, 26 aa, Plasmodium falciparum
FLMKIYCLRYYTGIPITTTSYKFSEN

SEQ ID NO: 3259094 - protein, 17 aa, Plasmodium falciparum
FLMKPMLDMSLILENKN

SEQ ID NO: 3259095 - protein, 30 aa, Plasmodium falciparum
FLMNKYFKRVCKLLILSLWYILKNSINCIY

SEQ ID NO: 3259096 - protein, 19 aa, Plasmodium falciparum
FLMQCGFMEYVCRFVDENG

SEQ ID NO: 3259097 - protein, 23 aa, Plasmodium falciparum
FLNDSMYWRGKVGGCLKNKSEKC

SEQ ID NO: 3259098 - protein, 20 aa, Plasmodium falciparum
FLNDSMYWRGKVNSCINNPK

SEQ ID NO: 3259099 - protein, 20 aa, Plasmodium falciparum
FLNEHFPHLMKYIDKEYFEK

SEQ ID NO: 3259100 - protein, 17 aa, Plasmodium falciparum
FLNELYSLSGYDKKNFK

SEQ ID NO: 3259101 - protein, 21 aa, Plasmodium falciparum
FLNERCDYCPVIEEVEETQLF

SEQ ID NO: 3259102 - protein, 18 aa, Plasmodium falciparum
FLNGKICYGQHNKNIYYI

SEQ ID NO: 3259103 - protein, 18 aa, Plasmodium falciparum
FLNGSSWNNNMINISNVQ

SEQ ID NO: 3259104 - protein, 30 aa, Plasmodium falciparum
FLNIFEKYSLFELFKLSFLNIQRKDEKIGN

SEQ ID NO: 3259105 - protein, 22 aa, Plasmodium falciparum
FLNIFSKFFVHFKFTNEEYTYI

SEQ ID NO: 3259106 - protein, 20 aa, Plasmodium falciparum
FLNKFFRDMNVIKVPFLPLY

SEQ ID NO: 3259107 - protein, 18 aa, Plasmodium falciparum
FLNKICIHLENIYDKILT

SEQ ID NO: 3259108 - protein, 18 aa, Plasmodium falciparum
FLNKYKIIHKYINYILSI

SEQ ID NO: 3259109 - protein, 20 aa, Plasmodium falciparum
FLNKYPKWFHKIKADLLILF

SEQ ID NO: 3259110 - protein, 17 aa, Plasmodium falciparum
FLNKYYLNKSCINYNEK

SEQ ID NO: 3259111 - protein, 17 aa, Plasmodium falciparum
FLNLCTSGFFSFIFNKI

SEQ ID NO: 3259112 - protein, 26 aa, Plasmodium falciparum
FLNLKIKYITILCGGFTNALSILPST

SEQ ID NO: 3259113 - protein, 18 aa, Plasmodium falciparum
FLNLLSIVGILLLVGLNN

SEQ ID NO: 3259114 - protein, 25 aa, Plasmodium falciparum
FLNLPRICFYYGKLKATAQLENLTK

SEQ ID NO: 3259115 - protein, 19 aa, Plasmodium falciparum
FLNNSCAFYSFQNKEKCKQ

SEQ ID NO: 3259116 - protein, 23 aa, Plasmodium falciparum
FLNRSMRSFQNIFLMPEVLKRMI

SEQ ID NO: 3259117 - protein, 21 aa, Plasmodium falciparum
FLNRYKNILIVGSDALSNFVD

SEQ ID NO: 3259118 - protein, 20 aa, Plasmodium falciparum
FLNSNIILIFLKRIMRRKSY

SEQ ID NO: 3259119 - protein, 18 aa, Plasmodium falciparum
FLNTSCVNLRLFRTVFLS

SEQ ID NO: 3259120 - protein, 25 aa, Plasmodium falciparum
FLNYHDYKLLKVFFFMLQNSSNKFI

SEQ ID NO: 3259121 - protein, 17 aa, Plasmodium falciparum
FLNYLLSNTLIFISDYF

SEQ ID NO: 3259122 - protein, 17 aa, Plasmodium falciparum
FLPFLKVSPIESKKIPK

SEQ ID NO: 3259123 - protein, 19 aa, Plasmodium falciparum
FLPICVFTSGFFIIEKRNY

SEQ ID NO: 3259124 - protein, 24 aa, Plasmodium falciparum
FLPKQLWFYIIWNIKWVIKYNILN

SEQ ID NO: 3259125 - protein, 17 aa, Plasmodium falciparum
FLPQLVMMLSMIGYLVF

SEQ ID NO: 3259126 - protein, 20 aa, Plasmodium falciparum
FLQHHFKRKSSFVASQLDVK

SEQ ID NO: 3259127 - protein, 21 aa, Plasmodium falciparum
FLQIILFRLTMSNFFVYYNEK

SEQ ID NO: 3259128 - protein, 25 aa, Plasmodium falciparum
FLQKCYFNFSLLSFLWLKNERKNLF

SEQ ID NO: 3259129 - protein, 18 aa, Plasmodium falciparum
FLQKTYLLYEYFIKEGCD

SEQ ID NO: 3259130 - protein, 24 aa, Plasmodium falciparum
FLQSWKVLNDCISFLNKCSTTNNS

SEQ ID NO: 3259131 - protein, 24 aa, Plasmodium falciparum
FLQVKCSYCHKSVCMSSRKMSSKM

SEQ ID NO: 3259132 - protein, 20 aa, Plasmodium falciparum
FLRIKHWITILKIQDIIIEL

SEQ ID NO: 3259133 - protein, 19 aa, Plasmodium falciparum
FLRKKEGLISRGKIKEVID

SEQ ID NO: 3259134 - protein, 25 aa, Plasmodium falciparum
FLRRKENYQRVLLLYNPKFNDGAKR

SEQ ID NO: 3259135 - protein, 24 aa, Plasmodium falciparum
FLRTLGVWLTLLGRLKNDYTDINL

SEQ ID NO: 3259136 - protein, 20 aa, Plasmodium falciparum
FLRYRGCTMDGNTILNSLED

SEQ ID NO: 3259137 - protein, 18 aa, Plasmodium falciparum
FLSFSFKTYKIINFMVYI

SEQ ID NO: 3259138 - protein, 17 aa, Plasmodium falciparum
FLSFYRKYYMKNVRLVF

SEQ ID NO: 3259139 - protein, 18 aa, Plasmodium falciparum
FLSGIDLKLRVFKLKCIM

SEQ ID NO: 3259140 - protein, 25 aa, Plasmodium falciparum
FLSHACSIFTAIPIITYIVKRFDYL

SEQ ID NO: 3259141 - protein, 23 aa, Plasmodium falciparum
FLSIIICIMINFSVDETDRIPTP

SEQ ID NO: 3259142 - protein, 24 aa, Plasmodium falciparum
FLSKLNVIKILSFMNTHKIFLAKY

SEQ ID NO: 3259143 - protein, 24 aa, Plasmodium falciparum
FLSKPRIKHAIFFSTIKNESSHVK

SEQ ID NO: 3259144 - protein, 38 aa, Plasmodium falciparum
FLSNHFCISFPYVSHFKDNFLIRIYDTYINKYLINNGF

SEQ ID NO: 3259145 - protein, 21 aa, Plasmodium falciparum
FLSSFSLILMIIHFLQNVAEP

SEQ ID NO: 3259146 - protein, 22 aa, Plasmodium falciparum
FLSVLFCCVNIFYYNQYCTSPG

SEQ ID NO: 3259147 - protein, 18 aa, Plasmodium falciparum
FLSYAGGYTNNLNLIDLA

SEQ ID NO: 3259148 - protein, 24 aa, Plasmodium falciparum
FLSYHKSSICRRTCEEKEKEHIST

SEQ ID NO: 3259149 - protein, 17 aa, Plasmodium falciparum
FLTFAYVYNGSIMDSVT

SEQ ID NO: 3259150 - protein, 17 aa, Plasmodium falciparum
FLTILGFAFAKAAAMKA

SEQ ID NO: 3259151 - protein, 22 aa, Plasmodium falciparum
FLTKSYICHKYILVSNSSMDQK

SEQ ID NO: 3259152 - protein, 17 aa, Plasmodium falciparum
FLTPFICIIDLKNIFIK

SEQ ID NO: 3259153 - protein, 21 aa, Plasmodium falciparum
FLTSRCTRSSIEMTNNNKNNM

SEQ ID NO: 3259154 - protein, 27 aa, Plasmodium falciparum
FLTYYKNCLLYRPFIKLNKLHLYRYMQ

SEQ ID NO: 3259155 - protein, 18 aa, Plasmodium falciparum
FLVKEYKIENIFFPISVE

SEQ ID NO: 3259156 - protein, 27 aa, Plasmodium falciparum
FLVLKIICLFLLVSFVILYIVLPIPFI

SEQ ID NO: 3259157 - protein, 20 aa, Plasmodium falciparum
FLVMRISWTHAFTTGQHLIC

SEQ ID NO: 3259158 - protein, 18 aa, Plasmodium falciparum
FLVSCLINVLTKITYPKN

SEQ ID NO: 3259159 - protein, 21 aa, Plasmodium falciparum
FLYDLEVIGIIGLKNQLREGV

SEQ ID NO: 3259160 - protein, 17 aa, Plasmodium falciparum
FLYFFKFLYENNSYYFK

SEQ ID NO: 3259161 - protein, 23 aa, Plasmodium falciparum
FLYKKIKTSFLYFACITESDPLH

SEQ ID NO: 3259162 - protein, 18 aa, Plasmodium falciparum
FLYLAYICSNSFPDNISK

SEQ ID NO: 3259163 - protein, 23 aa, Plasmodium falciparum
FLYLCNLHIITLIYIISNNKKFL

SEQ ID NO: 3259164 - protein, 25 aa, Plasmodium falciparum
FLYLFYLTYIFKVVIIYCDSSFNRK

SEQ ID NO: 3259165 - protein, 29 aa, Plasmodium falciparum
FLYMFINITFFFSLKFYPYIEEQNKITNC

SEQ ID NO: 3259166 - protein, 42 aa, Plasmodium falciparum
FLYMSFICLLIRCLILFYICRIIRKKYSVLRTCNVRNSRILS

SEQ ID NO: 3259167 - protein, 17 aa, Plasmodium falciparum
FLYNCRFSIFCILFIFL

SEQ ID NO: 3259168 - protein, 24 aa, Plasmodium falciparum
FLYNHPYKFILIKNLMLIITKEVN

SEQ ID NO: 3259169 - protein, 17 aa, Plasmodium falciparum
FLYREKYSFLIYLFNLF

SEQ ID NO: 3259170 - protein, 18 aa, Plasmodium falciparum
FLYSFKFLFHIFFLNNSN

SEQ ID NO: 3259171 - protein, 19 aa, Plasmodium falciparum
FLYTRSFFFFEELLPVQYI

SEQ ID NO: 3259172 - protein, 17 aa, Plasmodium falciparum
FLYVLLINSQLFNRFLF

SEQ ID NO: 3259173 - protein, 17 aa, Plasmodium falciparum
FLYYLLHQERNIYIIFI

SEQ ID NO: 3259174 - protein, 23 aa, Plasmodium falciparum
FMDRKASCIISIFNRSDKKKEPV

SEQ ID NO: 3259175 - protein, 17 aa, Plasmodium falciparum
FMDYIWIVIMKRENNTF

SEQ ID NO: 3259176 - protein, 25 aa, Plasmodium falciparum
FMERKDIYNLYSFNKEEIKIYIYTI

SEQ ID NO: 3259177 - protein, 18 aa, Plasmodium falciparum
FMFLKKYKSSILVRLLKN

SEQ ID NO: 3259178 - protein, 27 aa, Plasmodium falciparum
FMGAFMIMAVFYKRNIFIFGAKKKKKK

SEQ ID NO: 3259179 - protein, 19 aa, Plasmodium falciparum
FMICLLFLLFVMYLYIIFI

SEQ ID NO: 3259180 - protein, 18 aa, Plasmodium falciparum
FMISSLLSMISSKLKKSR

SEQ ID NO: 3259181 - protein, 18 aa, Plasmodium falciparum
FMKEFDLSGHGKIDIIMF

SEQ ID NO: 3259182 - protein, 17 aa, Plasmodium falciparum
FMKKFACIIKEKDIFQN

SEQ ID NO: 3259183 - protein, 22 aa, Plasmodium falciparum
FMKLNEFLLYYISKETVIALLR

SEQ ID NO: 3259184 - protein, 29 aa, Plasmodium falciparum
FMKSNPYIKLGLCEELYLYSYENNSDHFL

SEQ ID NO: 3259185 - protein, 25 aa, Plasmodium falciparum
FMLKRWCLKILYTLINKIKDMNLFL

SEQ ID NO: 3259186 - protein, 27 aa, Plasmodium falciparum
FMLLKKIFLCIVVYFLSIYFNIINIIY

SEQ ID NO: 3259187 - protein, 25 aa, Plasmodium falciparum
FMLWYMCISVSFFFLLTIFLFPKNR

SEQ ID NO: 3259188 - protein, 17 aa, Plasmodium falciparum
FMMGLLANYGFKFVKKI

SEQ ID NO: 3259189 - protein, 18 aa, Plasmodium falciparum
FMMRRKIRSNSLHDMNDK

SEQ ID NO: 3259190 - protein, 29 aa, Plasmodium falciparum
FMNKEIRNTFEIYILKYINNISIIPRNTS

SEQ ID NO: 3259191 - protein, 18 aa, Plasmodium falciparum
FMNKRINNYFIKDRNIFT

SEQ ID NO: 3259192 - protein, 29 aa, Plasmodium falciparum
FMNNELCEWIELSHLLNIDIDYNDIRNIN

SEQ ID NO: 3259193 - protein, 23 aa, Plasmodium falciparum
FMNYEFWCTFLTVNKKDLSPKKA

SEQ ID NO: 3259194 - protein, 17 aa, Plasmodium falciparum
FMPLYIFYMKKINYKEL

SEQ ID NO: 3259195 - protein, 21 aa, Plasmodium falciparum
FMSEICRLYNGINISMKIQSF

SEQ ID NO: 3259196 - protein, 18 aa, Plasmodium falciparum
FMSFITFMGLYFLFVKEN

SEQ ID NO: 3259197 - protein, 25 aa, Plasmodium falciparum
FMSGFKCGIIILVVNTVGGLFQSLS

SEQ ID NO: 3259198 - protein, 19 aa, Plasmodium falciparum
FMSKYAYEYLMLINPNLNR

SEQ ID NO: 3259199 - protein, 24 aa, Plasmodium falciparum
FMSLGKWIERIGCTVKWFPWLVAL

SEQ ID NO: 3259200 - protein, 17 aa, Plasmodium falciparum
FMTMILVVLNFVVYFKL

SEQ ID NO: 3259201 - protein, 26 aa, Plasmodium falciparum
FMVLKQFKTIYSFKTIYSFNTEETND

SEQ ID NO: 3259202 - protein, 20 aa, Plasmodium falciparum
FMVYYIRSKIYISFFSFFFL

SEQ ID NO: 3259203 - protein, 25 aa, Plasmodium falciparum
FMWHYKWANIYLYKVHKLINITLKD

SEQ ID NO: 3259204 - protein, 20 aa, Plasmodium falciparum
FMWNENLCLLYIKLNLYKKS

SEQ ID NO: 3259205 - protein, 17 aa, Plasmodium falciparum
FMYASVFGGGGTFPDIS

SEQ ID NO: 3259206 - protein, 17 aa, Plasmodium falciparum
FMYKSDSKFSYNKDFDN

SEQ ID NO: 3259207 - protein, 17 aa, Plasmodium falciparum
FMYLKEYTNIIFKYMKF

SEQ ID NO: 3259208 - protein, 19 aa, Plasmodium falciparum
FMYNRFMWQAFVKKNISHS

SEQ ID NO: 3259209 - protein, 25 aa, Plasmodium falciparum
FNCHFKKLLINYLFVTLNPLNVLIF

SEQ ID NO: 3259210 - protein, 18 aa, Plasmodium falciparum
FNCMNHFLYMSTFQYSDI

SEQ ID NO: 3259211 - protein, 17 aa, Plasmodium falciparum
FNCRSCGIECRKYKNWI

SEQ ID NO: 3259212 - protein, 26 aa, Plasmodium falciparum
FNCTYSKRIAKFCVYELKDGNVTNGS

SEQ ID NO: 3259213 - protein, 20 aa, Plasmodium falciparum
FNDFFTYWVAHMLKDSIYWR

SEQ ID NO: 3259214 - protein, 26 aa, Plasmodium falciparum
FNDFLEFCLNLSFSYLHSLTYSDKFR

SEQ ID NO: 3259215 - protein, 18 aa, Plasmodium falciparum
FNDIIMIIYTWRQYIFYK

SEQ ID NO: 3259216 - protein, 25 aa, Plasmodium falciparum
FNDKWRFNYYFKFSFNQVDYELAYH

SEQ ID NO: 3259217 - protein, 46 aa, Plasmodium falciparum
FNDLIKMRIYFLLLYKIKFVRKIKSYLFKKHFVKYIDLLCKYNKDK

SEQ ID NO: 3259218 - protein, 28 aa, Plasmodium falciparum
FNDPHLKPCYLFAVVAGDLKHLSATYIT

SEQ ID NO: 3259219 - protein, 24 aa, Plasmodium falciparum
FNDQKMNVCHLINFNKDIDLNKYT

SEQ ID NO: 3259220 - protein, 18 aa, Plasmodium falciparum
FNDVMIDKNIECINKKEL

SEQ ID NO: 3259221 - protein, 19 aa, Plasmodium falciparum
FNDYLCALVNSLYIYSKDI

SEQ ID NO: 3259222 - protein, 31 aa, Plasmodium falciparum
FNEKIDFRYAEWFLKTYLFYKYKYSDNTHTK

SEQ ID NO: 3259223 - protein, 17 aa, Plasmodium falciparum
FNEKVMDIFVPVDLETK

SEQ ID NO: 3259224 - protein, 23 aa, Plasmodium falciparum
FNFFRIVSNIYYREGMRSFFKGS

SEQ ID NO: 3259225 - protein, 19 aa, Plasmodium falciparum
FNFICLNTLLNYMSYTNDI

SEQ ID NO: 3259226 - protein, 23 aa, Plasmodium falciparum
FNFIFYRYLYYFSRTIYISKSSP

SEQ ID NO: 3259227 - protein, 38 aa, Plasmodium falciparum
FNFINSPNFFFSFSVFYNILFLLIIMLMYIKKNNITRK

SEQ ID NO: 3259228 - protein, 17 aa, Plasmodium falciparum
FNFKNVFSYFHILEIVH

SEQ ID NO: 3259229 - protein, 19 aa, Plasmodium falciparum
FNFLARFLFNNNKIIHLND

SEQ ID NO: 3259230 - protein, 20 aa, Plasmodium falciparum
FNFSKYFLTYIFLRKNENFL

SEQ ID NO: 3259231 - protein, 19 aa, Plasmodium falciparum
FNFWECPFVHEAAEIKKLF

SEQ ID NO: 3259232 - protein, 20 aa, Plasmodium falciparum
FNFYICNFYSLPYHEEALKK

SEQ ID NO: 3259233 - protein, 27 aa, Plasmodium falciparum
FNGFMAEFFKFLDLRNGKVILASDNNS

SEQ ID NO: 3259234 - protein, 18 aa, Plasmodium falciparum
FNGFRSCVEDNLFYNVLK

SEQ ID NO: 3259235 - protein, 17 aa, Plasmodium falciparum
FNGGQTFQHTNLCDSCS

SEQ ID NO: 3259236 - protein, 17 aa, Plasmodium falciparum
FNGNLRRGYFCSTIKYG

SEQ ID NO: 3259237 - protein, 37 aa, Plasmodium falciparum
FNHEKNIFIIFGHSLWFLHFFKYFLKESHKAKTNKLK

SEQ ID NO: 3259238 - protein, 17 aa, Plasmodium falciparum
FNIALFFYYTNERQRNK

SEQ ID NO: 3259239 - protein, 19 aa, Plasmodium falciparum
FNIDIEVIDLISLKPFDME

SEQ ID NO: 3259240 - protein, 19 aa, Plasmodium falciparum
FNIDNEVLNYIYVDLFNIH

SEQ ID NO: 3259241 - protein, 19 aa, Plasmodium falciparum
FNIFCNLYHFYKHIKEDKK

SEQ ID NO: 3259242 - protein, 17 aa, Plasmodium falciparum
FNIFLDYMKDVYMTDEY

SEQ ID NO: 3259243 - protein, 39 aa, Plasmodium falciparum
FNIFLSICLFSSLYLHSYILFLFFNFIFCGIISIVIYVL

SEQ ID NO: 3259244 - protein, 24 aa, Plasmodium falciparum
FNIFRKNNELCFLYINKSHQKIYN

SEQ ID NO: 3259245 - protein, 17 aa, Plasmodium falciparum
FNIFSNLLLPASMVGFV

SEQ ID NO: 3259246 - protein, 49 aa, Plasmodium falciparum
FNIISIMSCMYSFISLYLYFKIYFLSFFLLFFCICIIYIYISNHKPINH

SEQ ID NO: 3259247 - protein, 17 aa, Plasmodium falciparum
FNIKHMYVICLDNESSM

SEQ ID NO: 3259248 - protein, 19 aa, Plasmodium falciparum
FNIKILKKILSKLFYFLQQ

SEQ ID NO: 3259249 - protein, 17 aa, Plasmodium falciparum
FNIKKMMIKNNMLKNKK

SEQ ID NO: 3259250 - protein, 23 aa, Plasmodium falciparum
FNIKYPFSLSDLRDSAKVLFNYL

SEQ ID NO: 3259251 - protein, 25 aa, Plasmodium falciparum
FNILIKKLNFCLCSGDKINKIIQIN

SEQ ID NO: 3259252 - protein, 20 aa, Plasmodium falciparum
FNILIVCYLFIYIGSFSICH

SEQ ID NO: 3259253 - protein, 19 aa, Plasmodium falciparum
FNIYDILYKAFHIDKIVQI

SEQ ID NO: 3259254 - protein, 33 aa, Plasmodium falciparum
FNIYDNFHICFLYPLFVTYFFYYHLFVKHKMDN

SEQ ID NO: 3259255 - protein, 17 aa, Plasmodium falciparum
FNIYGSKFIDNFDIIDT

SEQ ID NO: 3259256 - protein, 26 aa, Plasmodium falciparum
FNIYNYLFKYEHFFFMNSYTLNNFYH

SEQ ID NO: 3259257 - protein, 27 aa, Plasmodium falciparum
FNKDIKKNMVRKFFFKYINLEKECIIY

SEQ ID NO: 3259258 - protein, 17 aa, Plasmodium falciparum
FNKEIKNYVDFMIILKL

SEQ ID NO: 3259259 - protein, 18 aa, Plasmodium falciparum
FNKGEHTFNMNMHNYNNN

SEQ ID NO: 3259260 - protein, 19 aa, Plasmodium falciparum
FNKGEMCMFEKQCNILENI

SEQ ID NO: 3259261 - protein, 18 aa, Plasmodium falciparum
FNKIHFYKLLDIVINIKK

SEQ ID NO: 3259262 - protein, 19 aa, Plasmodium falciparum
FNKIIYKLVKLFKRKLKEK

SEQ ID NO: 3259263 - protein, 23 aa, Plasmodium falciparum
FNKIKDIYLYSSKIIHVILNNLP

SEQ ID NO: 3259264 - protein, 18 aa, Plasmodium falciparum
FNKILYKNFKSIKKQFTM

SEQ ID NO: 3259265 - protein, 23 aa, Plasmodium falciparum
FNKIWWKLYPELISEFREKDNNN

SEQ ID NO: 3259266 - protein, 23 aa, Plasmodium falciparum
FNKKKLRNLILYIHGGPYSIILN

SEQ ID NO: 3259267 - protein, 18 aa, Plasmodium falciparum
FNKKSLREIEYYISSYED

SEQ ID NO: 3259268 - protein, 17 aa, Plasmodium falciparum
FNKKYERKKVVVFNNIE

SEQ ID NO: 3259269 - protein, 21 aa, Plasmodium falciparum
FNKSFAEKCLDNIICAYKNAR

SEQ ID NO: 3259270 - protein, 19 aa, Plasmodium falciparum
FNKVMKYIYSWDINKKENK

SEQ ID NO: 3259271 - protein, 23 aa, Plasmodium falciparum
FNKYCLYGYLSSKVLKLLSSILV

SEQ ID NO: 3259272 - protein, 25 aa, Plasmodium falciparum
FNKYLRVIYEYDLGLLFINEINKLV

SEQ ID NO: 3259273 - protein, 18 aa, Plasmodium falciparum
FNLFIWKIKMEKNIKKGI

SEQ ID NO: 3259274 - protein, 23 aa, Plasmodium falciparum
FNLGNKILLYFVCDYNLGYFEKV

SEQ ID NO: 3259275 - protein, 19 aa, Plasmodium falciparum
FNLIPLFFLSFFWSYIYIY

SEQ ID NO: 3259276 - protein, 30 aa, Plasmodium falciparum
FNLKIIITFMKCVNYLLYMIGIKRKFNMSL

SEQ ID NO: 3259277 - protein, 23 aa, Plasmodium falciparum
FNLKKINILNCLSHEDSYNSFFS

SEQ ID NO: 3259278 - protein, 27 aa, Plasmodium falciparum
FNLKNYRTQHFILFIGATNRYKQLDSA

SEQ ID NO: 3259279 - protein, 18 aa, Plasmodium falciparum
FNLKRNSLAIIIGNVGSG

SEQ ID NO: 3259280 - protein, 17 aa, Plasmodium falciparum
FNLLCIFHINEIRLIQK

SEQ ID NO: 3259281 - protein, 18 aa, Plasmodium falciparum
FNLLCYILNLNTCVSYYT

SEQ ID NO: 3259282 - protein, 18 aa, Plasmodium falciparum
FNLNTPILNDSWLEDVLS

SEQ ID NO: 3259283 - protein, 17 aa, Plasmodium falciparum
FNLPFILFHLDLFSNKE

SEQ ID NO: 3259284 - protein, 31 aa, Plasmodium falciparum
FNLRESIFILCFFYLYNFLSFEILNKFIQNI

SEQ ID NO: 3259285 - protein, 24 aa, Plasmodium falciparum
FNLTCYRIKNKYIIDKKKYIKNNQ

SEQ ID NO: 3259286 - protein, 25 aa, Plasmodium falciparum
FNLVCNIVSSFFFYSFILKKKKIRH

SEQ ID NO: 3259287 - protein, 20 aa, Plasmodium falciparum
FNLYEIEPLITVLKSIINEG

SEQ ID NO: 3259288 - protein, 19 aa, Plasmodium falciparum
FNMKEKFLKLKNMNKNNFA

SEQ ID NO: 3259289 - protein, 17 aa, Plasmodium falciparum
FNMKINLLETWFIQDDL

SEQ ID NO: 3259290 - protein, 17 aa, Plasmodium falciparum
FNMKMLNIEVVELFLSL

SEQ ID NO: 3259291 - protein, 18 aa, Plasmodium falciparum
FNMLSSYINTCIKQKEIK

SEQ ID NO: 3259292 - protein, 26 aa, Plasmodium falciparum
FNNFFNFWVAHMLKDSIYWRTKKLVK

SEQ ID NO: 3259293 - protein, 33 aa, Plasmodium falciparum
FNNFLKYNLNINVFQLAKQWPKGLKDIINKLLS

SEQ ID NO: 3259294 - protein, 36 aa, Plasmodium falciparum
FNNFLYYVICTKGYCSPECALLVFLLSSLNKSDQFR

SEQ ID NO: 3259295 - protein, 25 aa, Plasmodium falciparum
FNNKKKYICSLSIDNNEYNINKKKN

SEQ ID NO: 3259296 - protein, 27 aa, Plasmodium falciparum
FNNLRRLFKCFSLFIGQQKYMDSLADF

SEQ ID NO: 3259297 - protein, 17 aa, Plasmodium falciparum
FNNLYLYHTNPMRYLPH

SEQ ID NO: 3259298 - protein, 31 aa, Plasmodium falciparum
FNNNKVIVLNLIWLKFLNVIFYLLYVKNYLC

SEQ ID NO: 3259299 - protein, 20 aa, Plasmodium falciparum
FNNPIDCINNIFIKEKNNLY

SEQ ID NO: 3259300 - protein, 25 aa, Plasmodium falciparum
FNNTFELFCLFVFVTWALFLNNNGI

SEQ ID NO: 3259301 - protein, 30 aa, Plasmodium falciparum
FNPKLSILCAEILNIYYLFIKKTKKNETKI

SEQ ID NO: 3259302 - protein, 17 aa, Plasmodium falciparum
FNPTHPMFIVKLNEEKL

SEQ ID NO: 3259303 - protein, 26 aa, Plasmodium falciparum
FNQHPHFRSKLSFLEHKNHKDMGIVT

SEQ ID NO: 3259304 - protein, 18 aa, Plasmodium falciparum
FNQSLCDEFKSFQDVKID

SEQ ID NO: 3259305 - protein, 27 aa, Plasmodium falciparum
FNRIILFFHKFVFRKLPYIYFLNFWIY

SEQ ID NO: 3259306 - protein, 23 aa, Plasmodium falciparum
FNRLSLYLFLLYKTCEPSANITN

SEQ ID NO: 3259307 - protein, 17 aa, Plasmodium falciparum
FNRSVMEGIKFVNDEIK

SEQ ID NO: 3259308 - protein, 17 aa, Plasmodium falciparum
FNRTNMNPIKKCHMREK

SEQ ID NO: 3259309 - protein, 24 aa, Plasmodium falciparum
FNSENIYILLFFVYYVNKQIDDLL

SEQ ID NO: 3259310 - protein, 23 aa, Plasmodium falciparum
FNSFISIIAMDVYNNFIVFSYKN

SEQ ID NO: 3259311 - protein, 25 aa, Plasmodium falciparum
FNSIFFDTFISLIFIYYLNNYMKPK

SEQ ID NO: 3259312 - protein, 24 aa, Plasmodium falciparum
FNSKSAFFLCFYMTPSIFANIFYY

SEQ ID NO: 3259313 - protein, 20 aa, Plasmodium falciparum
FNSPHFYFFLQIIKVLLKTF

SEQ ID NO: 3259314 - protein, 24 aa, Plasmodium falciparum
FNSSLKYSMILFLNFPLYPHIILK

SEQ ID NO: 3259315 - protein, 21 aa, Plasmodium falciparum
FNSSNKHWFVYKKSIKEEKKY

SEQ ID NO: 3259316 - protein, 17 aa, Plasmodium falciparum
FNTCIEFTHNDKYEQKC

SEQ ID NO: 3259317 - protein, 17 aa, Plasmodium falciparum
FNTFNRFAQNNEMNDNI

SEQ ID NO: 3259318 - protein, 23 aa, Plasmodium falciparum
FNTKLWAYFTVVFLHLNMKMQAD

SEQ ID NO: 3259319 - protein, 23 aa, Plasmodium falciparum
FNTLYYCIVKGCNIYYKIKKSKE

SEQ ID NO: 3259320 - protein, 17 aa, Plasmodium falciparum
FNTRIIISLVMSLFNLI

SEQ ID NO: 3259321 - protein, 18 aa, Plasmodium falciparum
FNTVIYFYVNLLIPSNFI

SEQ ID NO: 3259322 - protein, 18 aa, Plasmodium falciparum
FNTWKNMVHYFVHNKKYM

SEQ ID NO: 3259323 - protein, 20 aa, Plasmodium falciparum
FNTYLIFSLYERIAMLNYLY

SEQ ID NO: 3259324 - protein, 21 aa, Plasmodium falciparum
FNVDNKFLWNLDKPININMNS

SEQ ID NO: 3259325 - protein, 17 aa, Plasmodium falciparum
FNVKRRKKSSINISDNV

SEQ ID NO: 3259326 - protein, 23 aa, Plasmodium falciparum
FNVKYIKSYFCTNVVKLSNIEKK

SEQ ID NO: 3259327 - protein, 23 aa, Plasmodium falciparum
FNVLKSLYLPILDKLINVNEKII

SEQ ID NO: 3259328 - protein, 20 aa, Plasmodium falciparum
FNVNHICNRFVLDDKPIHDS

SEQ ID NO: 3259329 - protein, 35 aa, Plasmodium falciparum
FNVTPFVEISCVRYEFYNTFTLFIMLWYSHINDHF

SEQ ID NO: 3259330 - protein, 18 aa, Plasmodium falciparum
FNWNCINYAFVNIIYKGL

SEQ ID NO: 3259331 - protein, 18 aa, Plasmodium falciparum
FNYCNKKKFYVRRILVFC

SEQ ID NO: 3259332 - protein, 28 aa, Plasmodium falciparum
FNYELLHFPNLFFYLNYKSYNYLLSSFD

SEQ ID NO: 3259333 - protein, 19 aa, Plasmodium falciparum
FNYEMMKTKSSACAYLALW

SEQ ID NO: 3259334 - protein, 17 aa, Plasmodium falciparum
FNYHSFLSYETIQDINW

SEQ ID NO: 3259335 - protein, 17 aa, Plasmodium falciparum
FNYHVLSSSVPRQIAKN

SEQ ID NO: 3259336 - protein, 19 aa, Plasmodium falciparum
FNYIKSDIQTISFGLVASM

SEQ ID NO: 3259337 - protein, 25 aa, Plasmodium falciparum
FNYLERKASHMSIDYNNNMNFNNNT

SEQ ID NO: 3259338 - protein, 18 aa, Plasmodium falciparum
FNYLRYFVLTNLFFKLFE

SEQ ID NO: 3259339 - protein, 18 aa, Plasmodium falciparum
FNYLSNVDFIFIWRNQRW

SEQ ID NO: 3259340 - protein, 26 aa, Plasmodium falciparum
FNYLVLSMRLYFLFFSYNDILNILNE

SEQ ID NO: 3259341 - protein, 28 aa, Plasmodium falciparum
FNYPNVNILEEWGLMGFDEKTIYDCLNY

SEQ ID NO: 3259342 - protein, 18 aa, Plasmodium falciparum
FNYQCHEILYTIEKKKRY

SEQ ID NO: 3259343 - protein, 21 aa, Plasmodium falciparum
FNYTFNFPMDNFFQLDNKLSF

SEQ ID NO: 3259344 - protein, 18 aa, Plasmodium falciparum
FPCECLYFCINKKKEKNT

SEQ ID NO: 3259345 - protein, 17 aa, Plasmodium falciparum
FPFFFFRRNESYSLNTC

SEQ ID NO: 3259346 - protein, 33 aa, Plasmodium falciparum
FPFFPYILLILYLCWLPQILLDIWRGQRNSVDI

SEQ ID NO: 3259347 - protein, 17 aa, Plasmodium falciparum
FPFIIINLLELVWCQPI

SEQ ID NO: 3259348 - protein, 18 aa, Plasmodium falciparum
FPFLDIIEQYQNISINNI

SEQ ID NO: 3259349 - protein, 17 aa, Plasmodium falciparum
FPFLKEEEKSLFHIIMR

SEQ ID NO: 3259350 - protein, 21 aa, Plasmodium falciparum
FPFNYYKYYYSCEDLMDYVKN

SEQ ID NO: 3259351 - protein, 17 aa, Plasmodium falciparum
FPFRFYKNINNYKCSNV

SEQ ID NO: 3259352 - protein, 20 aa, Plasmodium falciparum
FPFSFYFLSSIFKADFGSST

SEQ ID NO: 3259353 - protein, 20 aa, Plasmodium falciparum
FPHFLFNMWAFYTITNTLLS

SEQ ID NO: 3259354 - protein, 24 aa, Plasmodium falciparum
FPHFTWKSFMVVISIIQLIVFIIS

SEQ ID NO: 3259355 - protein, 20 aa, Plasmodium falciparum
FPIFKIFITTNMCTKLLILA

SEQ ID NO: 3259356 - protein, 32 aa, Plasmodium falciparum
FPIFPHLCIFLVFMLYMLVRFFPDMKMGFKKI

SEQ ID NO: 3259357 - protein, 20 aa, Plasmodium falciparum
FPIQSLMNIIWAMTKTKRNN

SEQ ID NO: 3259358 - protein, 22 aa, Plasmodium falciparum
FPIYVCSCMVIIAYFYKYSSEF

SEQ ID NO: 3259359 - protein, 21 aa, Plasmodium falciparum
FPKNRLFKRFKFSKHPYINDL

SEQ ID NO: 3259360 - protein, 23 aa, Plasmodium falciparum
FPKYSFLKEEERIQEMVSNEKND

SEQ ID NO: 3259361 - protein, 21 aa, Plasmodium falciparum
FPLAGGCLGGAMFHFMICITS

SEQ ID NO: 3259362 - protein, 22 aa, Plasmodium falciparum
FPLCIPCPNYTQAIGARQDTVI

SEQ ID NO: 3259363 - protein, 18 aa, Plasmodium falciparum
FPLIPLFYPHHKPPLFLK

SEQ ID NO: 3259364 - protein, 17 aa, Plasmodium falciparum
FPLKSKYNPNIKKIIEC

SEQ ID NO: 3259365 - protein, 18 aa, Plasmodium falciparum
FPLLKFTVFTLLIWIVTF

SEQ ID NO: 3259366 - protein, 17 aa, Plasmodium falciparum
FPMCTMLARSFADIGDI

SEQ ID NO: 3259367 - protein, 24 aa, Plasmodium falciparum
FPMNMEPFMCHLFFENLIKSYVTY

SEQ ID NO: 3259368 - protein, 25 aa, Plasmodium falciparum
FPNFERNNVISIRFESNIISELPRH

SEQ ID NO: 3259369 - protein, 17 aa, Plasmodium falciparum
FPNFLGKNIPCLVPQGI

SEQ ID NO: 3259370 - protein, 21 aa, Plasmodium falciparum
FPNKKKIIFCYHIMVSKCTED

SEQ ID NO: 3259371 - protein, 21 aa, Plasmodium falciparum
FPNKLLCKISKKSNLYHLHTF

SEQ ID NO: 3259372 - protein, 34 aa, Plasmodium falciparum
FPNLKNVMRLLKFFLKVRTLPSMKQGGLPTIFWM

SEQ ID NO: 3259373 - protein, 31 aa, Plasmodium falciparum
FPNPFFHPSLCNRYGFKFSYICDPNKILSRN

SEQ ID NO: 3259374 - protein, 23 aa, Plasmodium falciparum
FPPVLCVLLCIFLTFYFYTISMN

SEQ ID NO: 3259375 - protein, 18 aa, Plasmodium falciparum
FPQMDDFINKYGYLTNKY

SEQ ID NO: 3259376 - protein, 25 aa, Plasmodium falciparum
FPRKRRRLATFFVFLGNNGKKKNKR

SEQ ID NO: 3259377 - protein, 22 aa, Plasmodium falciparum
FPRNIKLPDPFMSDVKIDLLPE

SEQ ID NO: 3259378 - protein, 22 aa, Plasmodium falciparum
FPRYLLCTYFPYVLIAILITNV

SEQ ID NO: 3259379 - protein, 25 aa, Plasmodium falciparum
FPSFILKIYFLYIFFLAPIFGSLKC

SEQ ID NO: 3259380 - protein, 17 aa, Plasmodium falciparum
FPSKKKHVYLLDKEKKD

SEQ ID NO: 3259381 - protein, 17 aa, Plasmodium falciparum
FPTNFLLNKNIYIPLPV

SEQ ID NO: 3259382 - protein, 17 aa, Plasmodium falciparum
FPTTCNYISKFYLLEIF

SEQ ID NO: 3259383 - protein, 25 aa, Plasmodium falciparum
FPVFDRVYKTGIWRLLVVRMNSKNE

SEQ ID NO: 3259384 - protein, 26 aa, Plasmodium falciparum
FPVPPNHTFVGFPIHFSTIDFTEVKS

SEQ ID NO: 3259385 - protein, 24 aa, Plasmodium falciparum
FPVTYPKKLAFLFLNDICKQFNEE

SEQ ID NO: 3259386 - protein, 27 aa, Plasmodium falciparum
FPYRYNICYIQKSPLVLFNLILSGILV

SEQ ID NO: 3259387 - protein, 21 aa, Plasmodium falciparum
FPYSFKLWYHYIKDSIEMITD

SEQ ID NO: 3259388 - protein, 21 aa, Plasmodium falciparum
FQAAKKHAPCIVFIDEIDAVG

SEQ ID NO: 3259389 - protein, 20 aa, Plasmodium falciparum
FQDVRCIKTKKIVRCFNPFV

SEQ ID NO: 3259390 - protein, 22 aa, Plasmodium falciparum
FQELFYKFIIALLSLFYFIKLI

SEQ ID NO: 3259391 - protein, 34 aa, Plasmodium falciparum
FQFDRNRISQFLIFPPMQCKGLGMQVLEKIYHLS

SEQ ID NO: 3259392 - protein, 23 aa, Plasmodium falciparum
FQFFSEQFITFFPLLKKKKKKRE

SEQ ID NO: 3259393 - protein, 26 aa, Plasmodium falciparum
FQHVEEPFCILLFYKKKLFVSKKINI

SEQ ID NO: 3259394 - protein, 25 aa, Plasmodium falciparum
FQIFIRIKLLLFFFISLFYSSARTL

SEQ ID NO: 3259395 - protein, 20 aa, Plasmodium falciparum
FQIKFCRFTDNYDDISYKYG

SEQ ID NO: 3259396 - protein, 20 aa, Plasmodium falciparum
FQILFCKLIEIQFMLSDKEV

SEQ ID NO: 3259397 - protein, 26 aa, Plasmodium falciparum
FQILRSNYFLLFVIIWSCCEMSFNYI

SEQ ID NO: 3259398 - protein, 24 aa, Plasmodium falciparum
FQIYSLSCFLVFNGGFNSLFQLIQ

SEQ ID NO: 3259399 - protein, 21 aa, Plasmodium falciparum
FQKCIEIWCDIELIKYNIHDE

SEQ ID NO: 3259400 - protein, 20 aa, Plasmodium falciparum
FQKNKMNYIHLDKIKMDKKT

SEQ ID NO: 3259401 - protein, 35 aa, Plasmodium falciparum
FQKTLKYYLFCYMHCWKDVKDLLEYFLQTDNINIK

SEQ ID NO: 3259402 - protein, 18 aa, Plasmodium falciparum
FQLGHSFSASEFWNNVEN

SEQ ID NO: 3259403 - protein, 25 aa, Plasmodium falciparum
FQLKKTFLLDMCEHVHFSYHVIGHM

SEQ ID NO: 3259404 - protein, 17 aa, Plasmodium falciparum
FQLSFIFLSGPLSDILY

SEQ ID NO: 3259405 - protein, 26 aa, Plasmodium falciparum
FQMKKIKSQWIYKIIKHKKINKKNSL

SEQ ID NO: 3259406 - protein, 17 aa, Plasmodium falciparum
FQNLNIYLPLYIIVEIN

SEQ ID NO: 3259407 - protein, 19 aa, Plasmodium falciparum
FQNMKWKDINVENIIKKTY

SEQ ID NO: 3259408 - protein, 18 aa, Plasmodium falciparum
FQNMQLLKCNNYLNCEDI

SEQ ID NO: 3259409 - protein, 25 aa, Plasmodium falciparum
FQPPELCILCNAYANFNKRENTIFD

SEQ ID NO: 3259410 - protein, 26 aa, Plasmodium falciparum
FQQFSVRVQILYECSFILSSIINSII

SEQ ID NO: 3259411 - protein, 22 aa, Plasmodium falciparum
FQRPRRKRFYIIENKKKKNFKN

SEQ ID NO: 3259412 - protein, 19 aa, Plasmodium falciparum
FQRYIYVFIAFVFLMLLFN

SEQ ID NO: 3259413 - protein, 25 aa, Plasmodium falciparum
FQSIPIIALMYLFKYIEEVKLNELN

SEQ ID NO: 3259414 - protein, 24 aa, Plasmodium falciparum
FQSLPENIRIGVFKNDVNKFYEIY

SEQ ID NO: 3259415 - protein, 26 aa, Plasmodium falciparum
FQSLRISYFRQLLRQSLPSAWLSNPF

SEQ ID NO: 3259416 - protein, 18 aa, Plasmodium falciparum
FQSRKGNRLFYLINKKII

SEQ ID NO: 3259417 - protein, 18 aa, Plasmodium falciparum
FQSYDIFNKMVLSQNDEY

SEQ ID NO: 3259418 - protein, 47 aa, Plasmodium falciparum
FQTKIDYIVFCLLFITSLFSIYFCSKGLKYICTFLITIISLIEIYEY

SEQ ID NO: 3259419 - protein, 20 aa, Plasmodium falciparum
FQTLCFCFLIILSCWIFLLR

SEQ ID NO: 3259420 - protein, 40 aa, Plasmodium falciparum
FQTNFCMFFFCKSNYYITLKLYYIFLFLFKYYKYPLRKNF

SEQ ID NO: 3259421 - protein, 25 aa, Plasmodium falciparum
FQYDVFKSCIMYKTISNIRKMLLIS

SEQ ID NO: 3259422 - protein, 20 aa, Plasmodium falciparum
FQYEGCLHYECQVIKTEKNN

SEQ ID NO: 3259423 - protein, 21 aa, Plasmodium falciparum
FQYISICFIHSCSYAYIEPII

SEQ ID NO: 3259424 - protein, 17 aa, Plasmodium falciparum
FRCISYVIHILIFMNKY

SEQ ID NO: 3259425 - protein, 32 aa, Plasmodium falciparum
FRDEWWKVIKKDVWNVISWVFKDKTVCKEDDI

SEQ ID NO: 3259426 - protein, 18 aa, Plasmodium falciparum
FRDIKMDIFKSICNISEK

SEQ ID NO: 3259427 - protein, 18 aa, Plasmodium falciparum
FRDKKVFDSFLFLIENVN

SEQ ID NO: 3259428 - protein, 28 aa, Plasmodium falciparum
FREDVWTCGKVCGYNVCKPKNVNGQNGD

SEQ ID NO: 3259429 - protein, 19 aa, Plasmodium falciparum
FREKFIMRLSAFPLRENFA

SEQ ID NO: 3259430 - protein, 17 aa, Plasmodium falciparum
FREKLVYIGSRAKEMIG

SEQ ID NO: 3259431 - protein, 37 aa, Plasmodium falciparum
FRENKIIFLFFIKIFLFSLFIWELCCFNKEKFQDQIQ

SEQ ID NO: 3259432 - protein, 18 aa, Plasmodium falciparum
FREQFNWLSKTLYESAKK

SEQ ID NO: 3259433 - protein, 18 aa, Plasmodium falciparum
FRFDILKLNMNNYIDKYL

SEQ ID NO: 3259434 - protein, 27 aa, Plasmodium falciparum
FRFLKINLETVRPFEMKDIKLADYELN

SEQ ID NO: 3259435 - protein, 26 aa, Plasmodium falciparum
FRFQNAVCSLPFHLLLMILSPIKKKS

SEQ ID NO: 3259436 - protein, 20 aa, Plasmodium falciparum
FRGLDKIFISKNIFDTLDNI

SEQ ID NO: 3259437 - protein, 21 aa, Plasmodium falciparum
FRILTVVLFSFIILKKKISYS

SEQ ID NO: 3259438 - protein, 17 aa, Plasmodium falciparum
FRKCISTTILNYSYSND

SEQ ID NO: 3259439 - protein, 20 aa, Plasmodium falciparum
FRKLPYIYFLNFWIYNKNDM

SEQ ID NO: 3259440 - protein, 20 aa, Plasmodium falciparum
FRKRDILFYSYIIQNMFMKR

SEQ ID NO: 3259441 - protein, 17 aa, Plasmodium falciparum
FRKTACNGGKSSTPNKC

SEQ ID NO: 3259442 - protein, 18 aa, Plasmodium falciparum
FRLCQTIIVLPKLIKECD

SEQ ID NO: 3259443 - protein, 20 aa, Plasmodium falciparum
FRLLTGMIFLAFSFIIYISL

SEQ ID NO: 3259444 - protein, 22 aa, Plasmodium falciparum
FRLQSYCIVILAGILYVLLHNV

SEQ ID NO: 3259445 - protein, 27 aa, Plasmodium falciparum
FRLVLLDFYYVYFFDLHGNSLYIDDAR

SEQ ID NO: 3259446 - protein, 19 aa, Plasmodium falciparum
FRLYAETGVKVYNETLPTK

SEQ ID NO: 3259447 - protein, 20 aa, Plasmodium falciparum
FRNFDGILPIHIDIDKINEE

SEQ ID NO: 3259448 - protein, 27 aa, Plasmodium falciparum
FRNIKKFMSSFTFVFFFFIFIYAFLLS

SEQ ID NO: 3259449 - protein, 23 aa, Plasmodium falciparum
FRNPKIYFLQICIIDNLKKYRML

SEQ ID NO: 3259450 - protein, 26 aa, Plasmodium falciparum
FRPATNCGPCPVIGVKCKNGNCSDTS

SEQ ID NO: 3259451 - protein, 25 aa, Plasmodium falciparum
FRPRREIYNEIPIPRYIPENIENCV

SEQ ID NO: 3259452 - protein, 22 aa, Plasmodium falciparum
FRRFINFCIISAIIWFIPLYNV

SEQ ID NO: 3259453 - protein, 19 aa, Plasmodium falciparum
FRTIIITDINIIFHLISLV

SEQ ID NO: 3259454 - protein, 26 aa, Plasmodium falciparum
FRTNCLDCLDRTNVFQYYYALFFILY

SEQ ID NO: 3259455 - protein, 22 aa, Plasmodium falciparum
FRTTVMEILPYIVIINNTKMNI

SEQ ID NO: 3259456 - protein, 21 aa, Plasmodium falciparum
FRVDVFFPKIFNSIGNAIPYY

SEQ ID NO: 3259457 - protein, 18 aa, Plasmodium falciparum
FRYIKKEILLSYDNINIK

SEQ ID NO: 3259458 - protein, 17 aa, Plasmodium falciparum
FRYLEEWGEEFCRKQKH

SEQ ID NO: 3259459 - protein, 19 aa, Plasmodium falciparum
FRYLTFLNFLSILFIVVSL

SEQ ID NO: 3259460 - protein, 17 aa, Plasmodium falciparum
FRYNIYFASFYKNYFSF

SEQ ID NO: 3259461 - protein, 20 aa, Plasmodium falciparum
FSAGELCAFSNKYRISTHNI

SEQ ID NO: 3259462 - protein, 18 aa, Plasmodium falciparum
FSAIPNFKKLGVKLGYNI

SEQ ID NO: 3259463 - protein, 18 aa, Plasmodium falciparum
FSAPESFFAASFANSAFF

SEQ ID NO: 3259464 - protein, 22 aa, Plasmodium falciparum
FSAYKLILFIEVKKMNTFVNVD

SEQ ID NO: 3259465 - protein, 22 aa, Plasmodium falciparum
FSCFLLFLPLHIVRTHYAKNEE

SEQ ID NO: 3259466 - protein, 24 aa, Plasmodium falciparum
FSCIYFLIIIWKFSYVYNESYSNI

SEQ ID NO: 3259467 - protein, 18 aa, Plasmodium falciparum
FSDFYLKILVIPNEYKSH

SEQ ID NO: 3259468 - protein, 20 aa, Plasmodium falciparum
FSDVKGWYSPYFYNIKILNN

SEQ ID NO: 3259469 - protein, 26 aa, Plasmodium falciparum
FSEFDSCVYFLFTYKSFCYYIINNEK

SEQ ID NO: 3259470 - protein, 21 aa, Plasmodium falciparum
FSEIKKFYFIRNLKHGTPFIC

SEQ ID NO: 3259471 - protein, 22 aa, Plasmodium falciparum
FSEIYYRSNRIFLYSLMKYCYL

SEQ ID NO: 3259472 - protein, 24 aa, Plasmodium falciparum
FSERFLFKWNNVMKKLIDSEIRDI

SEQ ID NO: 3259473 - protein, 39 aa, Plasmodium falciparum
FSFIYEKLFHIIKVMSIYFNKWIDKWYIIRLNPNDFFYF

SEQ ID NO: 3259474 - protein, 17 aa, Plasmodium falciparum
FSFKKCFNRNINNHDDV

SEQ ID NO: 3259475 - protein, 17 aa, Plasmodium falciparum
FSFKYSSNYIYSLNITN

SEQ ID NO: 3259476 - protein, 25 aa, Plasmodium falciparum
FSFSEFPKEFNILDVVWPYMKQPKE

SEQ ID NO: 3259477 - protein, 25 aa, Plasmodium falciparum
FSFSFEIQTSLLFFVEAILLTIGII

SEQ ID NO: 3259478 - protein, 20 aa, Plasmodium falciparum
FSFTCLKSIITENVVESVKL

SEQ ID NO: 3259479 - protein, 28 aa, Plasmodium falciparum
FSFTEYLSCYIILYFFVFLPNYSYAINI

SEQ ID NO: 3259480 - protein, 21 aa, Plasmodium falciparum
FSFTKCLYFAMIGSKLNELYP

SEQ ID NO: 3259481 - protein, 19 aa, Plasmodium falciparum
FSGVHSCYCCQIVKNKFTY

SEQ ID NO: 3259482 - protein, 24 aa, Plasmodium falciparum
FSGVIMAPVSIFFILYSFYIYLKR

SEQ ID NO: 3259483 - protein, 19 aa, Plasmodium falciparum
FSHIESIYFTFFIMDLYLL

SEQ ID NO: 3259484 - protein, 20 aa, Plasmodium falciparum
FSHIEWSNFINGSNYKSAKG

SEQ ID NO: 3259485 - protein, 18 aa, Plasmodium falciparum
FSHIFNDKFVPLFPLKDI

SEQ ID NO: 3259486 - protein, 22 aa, Plasmodium falciparum
FSICCSCADTPITFESNNSTIY

SEQ ID NO: 3259487 - protein, 17 aa, Plasmodium falciparum
FSIDECGIFPPTGNDED

SEQ ID NO: 3259488 - protein, 17 aa, Plasmodium falciparum
FSIDTLLLILNIYIKNI

SEQ ID NO: 3259489 - protein, 24 aa, Plasmodium falciparum
FSIIPTFFLSDIFEILYLLYELDL

SEQ ID NO: 3259490 - protein, 20 aa, Plasmodium falciparum
FSIYCYKNTLFLYNLMKECK

SEQ ID NO: 3259491 - protein, 29 aa, Plasmodium falciparum
FSIYLYHSWLKRILFVFLSMCILPICYYI

SEQ ID NO: 3259492 - protein, 40 aa, Plasmodium falciparum
FSIYNILEYMFLFPSYPVHLCFTNYCSFVSPPDPLSLKDE

SEQ ID NO: 3259493 - protein, 17 aa, Plasmodium falciparum
FSKELSKLFKKLRTKDP

SEQ ID NO: 3259494 - protein, 18 aa, Plasmodium falciparum
FSKFLKEKFKMIKKKNDI

SEQ ID NO: 3259495 - protein, 29 aa, Plasmodium falciparum
FSKGLSQLIPIKWFKLFSAHELKTLISGK

SEQ ID NO: 3259496 - protein, 18 aa, Plasmodium falciparum
FSKILIPQRIHLIQEPII

SEQ ID NO: 3259497 - protein, 26 aa, Plasmodium falciparum
FSKKKINTFILIKHKFIFHSEWHNIF

SEQ ID NO: 3259498 - protein, 28 aa, Plasmodium falciparum
FSKLHICLFKNVWKFLICHIQVNHFIKN

SEQ ID NO: 3259499 - protein, 22 aa, Plasmodium falciparum
FSKLKFTFIFLHIFVVINILFI

SEQ ID NO: 3259500 - protein, 25 aa, Plasmodium falciparum
FSKLKMRCAIMKKKLSMSMKKNKPN

SEQ ID NO: 3259501 - protein, 19 aa, Plasmodium falciparum
FSKNFFNTNKWKKMYSKYE

SEQ ID NO: 3259502 - protein, 19 aa, Plasmodium falciparum
FSKNGRFLSYAGGYTNNLN

SEQ ID NO: 3259503 - protein, 17 aa, Plasmodium falciparum
FSKSIDCMTRFKNWLYK

SEQ ID NO: 3259504 - protein, 24 aa, Plasmodium falciparum
FSKSLKFGHISVFIFGILYGVINK

SEQ ID NO: 3259505 - protein, 27 aa, Plasmodium falciparum
FSKTFPLLFDFYSNMSMNINEKKIKND

SEQ ID NO: 3259506 - protein, 24 aa, Plasmodium falciparum
FSLFCNFIKIILFVFNIWVFCFST

SEQ ID NO: 3259507 - protein, 17 aa, Plasmodium falciparum
FSLFNIFNLYEKYKINI

SEQ ID NO: 3259508 - protein, 25 aa, Plasmodium falciparum
FSLIMYSLFCGSGIQGMMHAIGDIQ

SEQ ID NO: 3259509 - protein, 23 aa, Plasmodium falciparum
FSLISLYIYYVFFFNNIFSYLLY

SEQ ID NO: 3259510 - protein, 21 aa, Plasmodium falciparum
FSLKNHGFFFFVRKAQDFKSS

SEQ ID NO: 3259511 - protein, 17 aa, Plasmodium falciparum
FSLNAFIYLLIRFFIYF

SEQ ID NO: 3259512 - protein, 17 aa, Plasmodium falciparum
FSLNILLSYLIYKNDDN

SEQ ID NO: 3259513 - protein, 17 aa, Plasmodium falciparum
FSLNMSILYTSRIANTF

SEQ ID NO: 3259514 - protein, 29 aa, Plasmodium falciparum
FSLSIFSFEIYCFEKFYFFIFIFILTVLW

SEQ ID NO: 3259515 - protein, 25 aa, Plasmodium falciparum
FSLSLRMQKNIFKYITPLSNRFNLT

SEQ ID NO: 3259516 - protein, 21 aa, Plasmodium falciparum
FSLYICTGFYNLNGIHNLCKT

SEQ ID NO: 3259517 - protein, 17 aa, Plasmodium falciparum
FSLYPHYVNIHVCKEMI

SEQ ID NO: 3259518 - protein, 20 aa, Plasmodium falciparum
FSMCILKCGYSINNEKEGGI

SEQ ID NO: 3259519 - protein, 50 aa, Plasmodium falciparum
FSMFILRNYFDIMQIMSVMFWYKVILIVIFAWLPFFIIKKVKNIITPSQF

SEQ ID NO: 3259520 - protein, 19 aa, Plasmodium falciparum
FSMGCIIAAHLSVDNKLKI

SEQ ID NO: 3259521 - protein, 18 aa, Plasmodium falciparum
FSMKRIASYPDIFKDFTF

SEQ ID NO: 3259522 - protein, 21 aa, Plasmodium falciparum
FSMLLGHILNLIGWVLMLMSN

SEQ ID NO: 3259523 - protein, 26 aa, Plasmodium falciparum
FSMNGLKLLIFCLSSNDLIVRTISLK

SEQ ID NO: 3259524 - protein, 17 aa, Plasmodium falciparum
FSMSAVHRKENIEHEKK

SEQ ID NO: 3259525 - protein, 18 aa, Plasmodium falciparum
FSNCWKIENGCINITRRN

SEQ ID NO: 3259526 - protein, 24 aa, Plasmodium falciparum
FSNFICPVDDLFYMKKNYGGAIDF

SEQ ID NO: 3259527 - protein, 18 aa, Plasmodium falciparum
FSNFISRAFNTSHTFSDK

SEQ ID NO: 3259528 - protein, 24 aa, Plasmodium falciparum
FSNFYSPDIWKFNCMSSQKDLKHL

SEQ ID NO: 3259529 - protein, 17 aa, Plasmodium falciparum
FSNIFFNVVDNIGTELV

SEQ ID NO: 3259530 - protein, 18 aa, Plasmodium falciparum
FSNIHILVEYSRLVYKYL

SEQ ID NO: 3259531 - protein, 21 aa, Plasmodium falciparum
FSNKLKYVLDERIHKLYYEDK

SEQ ID NO: 3259532 - protein, 25 aa, Plasmodium falciparum
FSNKWLCSFISFYLKNVNALKYISF

SEQ ID NO: 3259533 - protein, 19 aa, Plasmodium falciparum
FSNKYFKQMIHMICTNVGN

SEQ ID NO: 3259534 - protein, 19 aa, Plasmodium falciparum
FSNKYTYGILCYNDSGKNY

SEQ ID NO: 3259535 - protein, 21 aa, Plasmodium falciparum
FSNLFFCKFINFVHNKSHTIE

SEQ ID NO: 3259536 - protein, 18 aa, Plasmodium falciparum
FSNRINLLPYNILLNNSN

SEQ ID NO: 3259537 - protein, 27 aa, Plasmodium falciparum
FSNTIIYNFLKIILKFIHHSTEVEPKL

SEQ ID NO: 3259538 - protein, 31 aa, Plasmodium falciparum
FSNVQKRNCFVLKYYWSIFGIKEGYTENNRR

SEQ ID NO: 3259539 - protein, 17 aa, Plasmodium falciparum
FSNYILKLCAPKNKDAN

SEQ ID NO: 3259540 - protein, 24 aa, Plasmodium falciparum
FSPDLSWYIDVIFKMIEITHKSIF

SEQ ID NO: 3259541 - protein, 17 aa, Plasmodium falciparum
FSPFFPMSSSDIINVNT

SEQ ID NO: 3259542 - protein, 18 aa, Plasmodium falciparum
FSPFRYIFQSAVYHSYYF

SEQ ID NO: 3259543 - protein, 31 aa, Plasmodium falciparum
FSPLKPCEGLECLPQVLFLYVIFLLLCTGIF

SEQ ID NO: 3259544 - protein, 28 aa, Plasmodium falciparum
FSPSTYCKACPLNGVICRGRSQCAANSE

SEQ ID NO: 3259545 - protein, 18 aa, Plasmodium falciparum
FSQDIDHLIPYFKREFFF

SEQ ID NO: 3259546 - protein, 19 aa, Plasmodium falciparum
FSQGVFRLRSIGMNQKIFF

SEQ ID NO: 3259547 - protein, 26 aa, Plasmodium falciparum
FSQRLDVRKGKLWLDILLNSDRRDLD

SEQ ID NO: 3259548 - protein, 19 aa, Plasmodium falciparum
FSRSFGRAASFEVPLQVTL

SEQ ID NO: 3259549 - protein, 17 aa, Plasmodium falciparum
FSSCLYFLHCLNSNNID

SEQ ID NO: 3259550 - protein, 25 aa, Plasmodium falciparum
FSSCSRLSLLGLLCIFLLNFYIYNG

SEQ ID NO: 3259551 - protein, 17 aa, Plasmodium falciparum
FSSFRLIIHSGASNILT

SEQ ID NO: 3259552 - protein, 25 aa, Plasmodium falciparum
FSSIFPSYILLIINYWNGQYINECN

SEQ ID NO: 3259553 - protein, 18 aa, Plasmodium falciparum
FSSILTIFYTINFMEHIN

SEQ ID NO: 3259554 - protein, 17 aa, Plasmodium falciparum
FSSIVNILLYIFMKVIK

SEQ ID NO: 3259555 - protein, 23 aa, Plasmodium falciparum
FSSKLPLLLTRFIKENKMNETTF

SEQ ID NO: 3259556 - protein, 25 aa, Plasmodium falciparum
FSSKNCIYIRLFFGVLLEEINDMIY

SEQ ID NO: 3259557 - protein, 25 aa, Plasmodium falciparum
FSSKRTRSEAYIKLQQFLFNESYIF

SEQ ID NO: 3259558 - protein, 27 aa, Plasmodium falciparum
FSSLDWFYCLFLGLSLFFSVIWGLLFE

SEQ ID NO: 3259559 - protein, 22 aa, Plasmodium falciparum
FSSLLCFLFWQFSVFVSVTHIV

SEQ ID NO: 3259560 - protein, 21 aa, Plasmodium falciparum
FSSSLFKLKYLKYRDTRISNM

SEQ ID NO: 3259561 - protein, 28 aa, Plasmodium falciparum
FSSTLPIKCNINLFYYYIENDIFYFIPL

SEQ ID NO: 3259562 - protein, 18 aa, Plasmodium falciparum
FSSYFYLDNIQLFNEETK

SEQ ID NO: 3259563 - protein, 17 aa, Plasmodium falciparum
FSTATFIGSGREDKDAR

SEQ ID NO: 3259564 - protein, 24 aa, Plasmodium falciparum
FSTCIISYIFINFTKSILFPNIYN

SEQ ID NO: 3259565 - protein, 25 aa, Plasmodium falciparum
FSTDFLFDECINIYFIHLLMQFENK

SEQ ID NO: 3259566 - protein, 19 aa, Plasmodium falciparum
FSTTIFLMFSFYYINNVII

SEQ ID NO: 3259567 - protein, 25 aa, Plasmodium falciparum
FSVAVPFILPLGSLYFFLRYYIDKY

SEQ ID NO: 3259568 - protein, 26 aa, Plasmodium falciparum
FSVCKYPIHLLELIFLTLFHPLLIRF

SEQ ID NO: 3259569 - protein, 19 aa, Plasmodium falciparum
FSVIISWINSMSICDKIVN

SEQ ID NO: 3259570 - protein, 23 aa, Plasmodium falciparum
FSVTIILAIIYYFLPIFLYIILR

SEQ ID NO: 3259571 - protein, 29 aa, Plasmodium falciparum
FSVTLVPVFACFGGAFAIIIILLILGTWM

SEQ ID NO: 3259572 - protein, 17 aa, Plasmodium falciparum
FSYAKLCNTSFVPFGEK

SEQ ID NO: 3259573 - protein, 18 aa, Plasmodium falciparum
FSYAQFFVVFPIYYFLTL

SEQ ID NO: 3259574 - protein, 17 aa, Plasmodium falciparum
FSYARILTVVGHEYFHN

SEQ ID NO: 3259575 - protein, 22 aa, Plasmodium falciparum
FSYEMKEFLPFLKVSPIESKKI

SEQ ID NO: 3259576 - protein, 23 aa, Plasmodium falciparum
FSYLNFFSDLAFFVDGYNIYFYS

SEQ ID NO: 3259577 - protein, 38 aa, Plasmodium falciparum
FSYLNYYIESLRLLYNKLLRNRNLILILAKEIFSKNKK

SEQ ID NO: 3259578 - protein, 19 aa, Plasmodium falciparum
FSYNFCVYGMNYDVWELKR

SEQ ID NO: 3259579 - protein, 17 aa, Plasmodium falciparum
FSYNMIVSGITIFVIVL

SEQ ID NO: 3259580 - protein, 17 aa, Plasmodium falciparum
FSYVCYGYIILILIPCL

SEQ ID NO: 3259581 - protein, 25 aa, Plasmodium falciparum
FSYWDGEYFLRLSLNGTEYNYEQNH

SEQ ID NO: 3259582 - protein, 27 aa, Plasmodium falciparum
FSYYPFYLWPVELMNFIHNFLLSNFNF

SEQ ID NO: 3259583 - protein, 17 aa, Plasmodium falciparum
FTASNFFSYDNYNINEN

SEQ ID NO: 3259584 - protein, 18 aa, Plasmodium falciparum
FTCDHLCELIKILCYFKK

SEQ ID NO: 3259585 - protein, 24 aa, Plasmodium falciparum
FTCKYCFRTDETFTEIGLEKHWIK

SEQ ID NO: 3259586 - protein, 24 aa, Plasmodium falciparum
FTDEIKNLILFLASTILKSGDKKD

SEQ ID NO: 3259587 - protein, 24 aa, Plasmodium falciparum
FTDNFYICVIIKMNKMNMFYSNMD

SEQ ID NO: 3259588 - protein, 17 aa, Plasmodium falciparum
FTERISMLYKYDNNKEE

SEQ ID NO: 3259589 - protein, 21 aa, Plasmodium falciparum
FTFPHILKYSKRVDVKEGIDQ

SEQ ID NO: 3259590 - protein, 20 aa, Plasmodium falciparum
FTFPHVYSVASISRNFEISP

SEQ ID NO: 3259591 - protein, 23 aa, Plasmodium falciparum
FTFTIYLLCISFYLNKKYYLAYF

SEQ ID NO: 3259592 - protein, 26 aa, Plasmodium falciparum
FTGHSFGAALAQISSFYFSKIMDLKN

SEQ ID NO: 3259593 - protein, 18 aa, Plasmodium falciparum
FTGKFPFDVITYKLRKEA

SEQ ID NO: 3259594 - protein, 18 aa, Plasmodium falciparum
FTGTIPWLALSFNTMFFQ

SEQ ID NO: 3259595 - protein, 22 aa, Plasmodium falciparum
FTHMKKSRILSEYQCIENYNFE

SEQ ID NO: 3259596 - protein, 20 aa, Plasmodium falciparum
FTHRCSRNLYGKELSIKPYL

SEQ ID NO: 3259597 - protein, 19 aa, Plasmodium falciparum
FTIGYLINAIICIHLSSKG

SEQ ID NO: 3259598 - protein, 26 aa, Plasmodium falciparum
FTIKFKAIIMRLCLKQNNYYYDIGKI

SEQ ID NO: 3259599 - protein, 25 aa, Plasmodium falciparum
FTIQKRFFVVLSILIGFLLLMLVSI

SEQ ID NO: 3259600 - protein, 18 aa, Plasmodium falciparum
FTKDIKEVITYKNNVTSE

SEQ ID NO: 3259601 - protein, 21 aa, Plasmodium falciparum
FTKGICTRVLMIGTLTGLQWW

SEQ ID NO: 3259602 - protein, 18 aa, Plasmodium falciparum
FTKIIPRDIKRVLTEACI

SEQ ID NO: 3259603 - protein, 19 aa, Plasmodium falciparum
FTKLICPSIEFNKKKDNLI

SEQ ID NO: 3259604 - protein, 21 aa, Plasmodium falciparum
FTKLLKCLLRGYEIDNKNIIN

SEQ ID NO: 3259605 - protein, 27 aa, Plasmodium falciparum
FTKNVFLRNYEICNSSPNYLAFLKNYY

SEQ ID NO: 3259606 - protein, 17 aa, Plasmodium falciparum
FTKRLFLSNPMKIQEKG

SEQ ID NO: 3259607 - protein, 17 aa, Plasmodium falciparum
FTKYEVGEHELLKRYPT

SEQ ID NO: 3259608 - protein, 30 aa, Plasmodium falciparum
FTLDDKIIFKLIFFYYHYKDYVDHIFEKFE

SEQ ID NO: 3259609 - protein, 27 aa, Plasmodium falciparum
FTLELFICLFCIYIFVYPNECKFRKFS

SEQ ID NO: 3259610 - protein, 19 aa, Plasmodium falciparum
FTLHSFKLIPEYFIFSCFF

SEQ ID NO: 3259611 - protein, 20 aa, Plasmodium falciparum
FTLIRFYYIFKTFYRNKKLL

SEQ ID NO: 3259612 - protein, 28 aa, Plasmodium falciparum
FTLIVWCSFLLDKMHMMSDLLRIGLRIL

SEQ ID NO: 3259613 - protein, 29 aa, Plasmodium falciparum
FTLLCGAVCCMLLPYFCRYIIESNFLINW

SEQ ID NO: 3259614 - protein, 18 aa, Plasmodium falciparum
FTLLRKNYLNSINKNLYK

SEQ ID NO: 3259615 - protein, 23 aa, Plasmodium falciparum
FTLRISEEIQKFLLLKEPEEEED

SEQ ID NO: 3259616 - protein, 32 aa, Plasmodium falciparum
FTLSYLMCFSKKLKYFILYFINYKKYIHKVLF

SEQ ID NO: 3259617 - protein, 32 aa, Plasmodium falciparum
FTLTDFMYLIFRWLETYISFNDRDHCTFLTDR

SEQ ID NO: 3259618 - protein, 17 aa, Plasmodium falciparum
FTLVFGNICLKYTSISF

SEQ ID NO: 3259619 - protein, 17 aa, Plasmodium falciparum
FTMCTMLARSFADIGDI

SEQ ID NO: 3259620 - protein, 23 aa, Plasmodium falciparum
FTMKLSDGLFFLFMSNLENEIID

SEQ ID NO: 3259621 - protein, 20 aa, Plasmodium falciparum
FTNLFKKYIESINIKDINNI

SEQ ID NO: 3259622 - protein, 18 aa, Plasmodium falciparum
FTNMCMYKNYVINNIIRN

SEQ ID NO: 3259623 - protein, 25 aa, Plasmodium falciparum
FTNNILFKYVLGYSGTSNDILPEEI

SEQ ID NO: 3259624 - protein, 18 aa, Plasmodium falciparum
FTPNYFKMCSILILNDLL

SEQ ID NO: 3259625 - protein, 17 aa, Plasmodium falciparum
FTPSYLYFENILLCSSE

SEQ ID NO: 3259626 - protein, 18 aa, Plasmodium falciparum
FTPYESRINKEFHTNVDY

SEQ ID NO: 3259627 - protein, 21 aa, Plasmodium falciparum
FTQNFLWKWTQPNSSSLFQAK

SEQ ID NO: 3259628 - protein, 18 aa, Plasmodium falciparum
FTRAYTFLLKNRRENKEK

SEQ ID NO: 3259629 - protein, 18 aa, Plasmodium falciparum
FTRKLKTIYIYNNDIHIK

SEQ ID NO: 3259630 - protein, 22 aa, Plasmodium falciparum
FTSECFNAFFNFIKYIEFYYLY

SEQ ID NO: 3259631 - protein, 22 aa, Plasmodium falciparum
FTSEKFQECHGGYSYCALATLC

SEQ ID NO: 3259632 - protein, 24 aa, Plasmodium falciparum
FTSENRFDFMSGPYVDKNGDVDYQ

SEQ ID NO: 3259633 - protein, 24 aa, Plasmodium falciparum
FTSFDRLYLLILHYEKILKKCIEY

SEQ ID NO: 3259634 - protein, 22 aa, Plasmodium falciparum
FTSLPVIFFVALDKQLPHNILL

SEQ ID NO: 3259635 - protein, 28 aa, Plasmodium falciparum
FTSSKFCGACPFYGVKCNWKTCTEVKEN

SEQ ID NO: 3259636 - protein, 18 aa, Plasmodium falciparum
FTSYLAMVHVRFSTNTSP

SEQ ID NO: 3259637 - protein, 25 aa, Plasmodium falciparum
FTTEIVKFIISFFFYFKEHKFSTIL

SEQ ID NO: 3259638 - protein, 24 aa, Plasmodium falciparum
FTTLEWFLEGQFLKTIEKAYGNED

SEQ ID NO: 3259639 - protein, 22 aa, Plasmodium falciparum
FTTLRRFLGTRMNNLYSKLKSE

SEQ ID NO: 3259640 - protein, 22 aa, Plasmodium falciparum
FTVAICTGGGPGFMEAANKGSK

SEQ ID NO: 3259641 - protein, 19 aa, Plasmodium falciparum
FTVFTLLIWIVTFINNYGN

SEQ ID NO: 3259642 - protein, 25 aa, Plasmodium falciparum
FTWRSISFFIKLIFFGLISLLFWTC

SEQ ID NO: 3259643 - protein, 17 aa, Plasmodium falciparum
FTYESFIKHLNILGRKI

SEQ ID NO: 3259644 - protein, 20 aa, Plasmodium falciparum
FTYIRISLQLIINIIFCLPS

SEQ ID NO: 3259645 - protein, 23 aa, Plasmodium falciparum
FTYLKKMEKTLCMLYYGSYAVLS

SEQ ID NO: 3259646 - protein, 25 aa, Plasmodium falciparum
FVAFIKCLIAPRILNSEKDSLFCSK

SEQ ID NO: 3259647 - protein, 25 aa, Plasmodium falciparum
FVAKLYRYIFKFNLQESYNMKPFLK

SEQ ID NO: 3259648 - protein, 24 aa, Plasmodium falciparum
FVATWKIAFIFFLSLMNLMVSLLI

SEQ ID NO: 3259649 - protein, 24 aa, Plasmodium falciparum
FVCKNEAESLFGIIVKSSNIIGMK

SEQ ID NO: 3259650 - protein, 35 aa, Plasmodium falciparum
FVDHKIVPSVSSFSVFDLYKLFFFDHKELDKINNE

SEQ ID NO: 3259651 - protein, 19 aa, Plasmodium falciparum
FVEEIKLIWDDPKPYIEKE

SEQ ID NO: 3259652 - protein, 18 aa, Plasmodium falciparum
FVEIIGGQIKCFTKIKYR

SEQ ID NO: 3259653 - protein, 32 aa, Plasmodium falciparum
FVESKALSILFRKSFFFHLNKIHNFLKNILYN

SEQ ID NO: 3259654 - protein, 17 aa, Plasmodium falciparum
FVFLCFNDGTNIMLNYF

SEQ ID NO: 3259655 - protein, 21 aa, Plasmodium falciparum
FVFLFCYKYYDSFSDLQINIE

SEQ ID NO: 3259656 - protein, 23 aa, Plasmodium falciparum
FVGDEYGCIFILYINIPIQIDEN

SEQ ID NO: 3259657 - protein, 17 aa, Plasmodium falciparum
FVGLYILVLPIMMYSEK

SEQ ID NO: 3259658 - protein, 24 aa, Plasmodium falciparum
FVHNKKYMCINGYIFDVNNIVENK

SEQ ID NO: 3259659 - protein, 18 aa, Plasmodium falciparum
FVIACIFQQIRIIKTSHY

SEQ ID NO: 3259660 - protein, 17 aa, Plasmodium falciparum
FVICIFLSTNINNLNMS

SEQ ID NO: 3259661 - protein, 17 aa, Plasmodium falciparum
FVIKETFNLLKNRFHII

SEQ ID NO: 3259662 - protein, 38 aa, Plasmodium falciparum
FVILRLPFVNAVLCNIIFLGLFIIRFNGDHFLDKKGLA

SEQ ID NO: 3259663 - protein, 23 aa, Plasmodium falciparum
FVKDEMYPGLAMSRAIGDITSSF

SEQ ID NO: 3259664 - protein, 18 aa, Plasmodium falciparum
FVKELLNYLDGFINSNHN

SEQ ID NO: 3259665 - protein, 23 aa, Plasmodium falciparum
FVKESVIDFILRRKNCNKINLSK

SEQ ID NO: 3259666 - protein, 23 aa, Plasmodium falciparum
FVKKRKRKWLGIYRKFKTLIWGN

SEQ ID NO: 3259667 - protein, 18 aa, Plasmodium falciparum
FVKPLDFVYFGVITMSTV

SEQ ID NO: 3259668 - protein, 23 aa, Plasmodium falciparum
FVKRMNKEYMCFNKLLYKIQQKL

SEQ ID NO: 3259669 - protein, 23 aa, Plasmodium falciparum
FVKSEKFSAFLLSILNDEKNIYD

SEQ ID NO: 3259670 - protein, 21 aa, Plasmodium falciparum
FVKWKEIKDHMNVNKNVSTNT

SEQ ID NO: 3259671 - protein, 24 aa, Plasmodium falciparum
FVLCPEFFHSFIFYIISLGNNIRL

SEQ ID NO: 3259672 - protein, 18 aa, Plasmodium falciparum
FVLELALELEQLFQDIKE

SEQ ID NO: 3259673 - protein, 40 aa, Plasmodium falciparum
FVLFFLFEHFSIFYVYRLISFLTLFLFTPISIYLVKRRNI

SEQ ID NO: 3259674 - protein, 27 aa, Plasmodium falciparum
FVLFHKNKIIVFIIFFFQQVEYMTNEQ

SEQ ID NO: 3259675 - protein, 17 aa, Plasmodium falciparum
FVLFKRNKKFLINKKFC

SEQ ID NO: 3259676 - protein, 18 aa, Plasmodium falciparum
FVLLIIYLDRLIKIHKDI

SEQ ID NO: 3259677 - protein, 17 aa, Plasmodium falciparum
FVLLYIWMRKRRKRSWK

SEQ ID NO: 3259678 - protein, 28 aa, Plasmodium falciparum
FVLSLLYILMCLLLKVKIKEEYILTLNK

SEQ ID NO: 3259679 - protein, 26 aa, Plasmodium falciparum
FVMFLKKFNSFYFKHHINVCLNFMKE

SEQ ID NO: 3259680 - protein, 23 aa, Plasmodium falciparum
FVNFIILIGFTFLLLSYFVYLFV

SEQ ID NO: 3259681 - protein, 26 aa, Plasmodium falciparum
FVNNLIKWKDIFLFFKTFTNQNKEKC

SEQ ID NO: 3259682 - protein, 22 aa, Plasmodium falciparum
FVPATNCKPCSSFKIDCKKAKC

SEQ ID NO: 3259683 - protein, 23 aa, Plasmodium falciparum
FVPISLIVTMSFVKVVQAYFISC

SEQ ID NO: 3259684 - protein, 17 aa, Plasmodium falciparum
FVPPSCDDISLDIFLYC

SEQ ID NO: 3259685 - protein, 27 aa, Plasmodium falciparum
FVQECKICVKIFRNIFPIIQYNYKKLN

SEQ ID NO: 3259686 - protein, 25 aa, Plasmodium falciparum
FVQEHLKQFLELFDALQEPIPKKFL

SEQ ID NO: 3259687 - protein, 17 aa, Plasmodium falciparum
FVQILIKNTNFIQAYVY

SEQ ID NO: 3259688 - protein, 20 aa, Plasmodium falciparum
FVRKSEIYYFNYFLVDLSSQ

SEQ ID NO: 3259689 - protein, 24 aa, Plasmodium falciparum
FVRKSRDLYYRHIITLEQSLTGFD

SEQ ID NO: 3259690 - protein, 21 aa, Plasmodium falciparum
FVRNCYRMHCFDKSFFDLLCD

SEQ ID NO: 3259691 - protein, 24 aa, Plasmodium falciparum
FVRNEIECLCGYTNTYPLRKTFTR

SEQ ID NO: 3259692 - protein, 18 aa, Plasmodium falciparum
FVRQRKKLKSSFHANGDM

SEQ ID NO: 3259693 - protein, 19 aa, Plasmodium falciparum
FVRRKERILVDIYMHSHEA

SEQ ID NO: 3259694 - protein, 26 aa, Plasmodium falciparum
FVRSFCYKICIAGACNSGKSSFNNDL

SEQ ID NO: 3259695 - protein, 18 aa, Plasmodium falciparum
FVRTELIETYLLRNPKQL

SEQ ID NO: 3259696 - protein, 60 aa, Plasmodium falciparum
FVSESYRANDLFGVKKFCYQLLHGATCKSYNEWSEWSGPCEFERRQRIIPLKITNIESTN

SEQ ID NO: 3259697 - protein, 17 aa, Plasmodium falciparum
FVSLCRCLNIPSRICMS

SEQ ID NO: 3259698 - protein, 18 aa, Plasmodium falciparum
FVSLLICIILGWFYNTEY

SEQ ID NO: 3259699 - protein, 25 aa, Plasmodium falciparum
FVSNVPHKLEWLVHNILEVVHFLED

SEQ ID NO: 3259700 - protein, 25 aa, Plasmodium falciparum
FVSPLSNFYFKFENMHKLKYENDCI

SEQ ID NO: 3259701 - protein, 30 aa, Plasmodium falciparum
FVSSLCTYFLHKYSNVIIVIFQTITLLANC

SEQ ID NO: 3259702 - protein, 17 aa, Plasmodium falciparum
FVTELFKYVENMNNNNY

SEQ ID NO: 3259703 - protein, 29 aa, Plasmodium falciparum
FVTLKLLYLKSICLYISLIIDSFLGFHLI

SEQ ID NO: 3259704 - protein, 23 aa, Plasmodium falciparum
FVTSELFLELIIMKEKDFNKHYL

SEQ ID NO: 3259705 - protein, 24 aa, Plasmodium falciparum
FVVFDNKIDLCLHLAEKHEQRGSN

SEQ ID NO: 3259706 - protein, 21 aa, Plasmodium falciparum
FVYEKRFNLNLLKDGSDENKY

SEQ ID NO: 3259707 - protein, 22 aa, Plasmodium falciparum
FVYFILKMLWKYQTIDNKTHSK

SEQ ID NO: 3259708 - protein, 25 aa, Plasmodium falciparum
FVYLFAGKLISFVDFDYILNNTIFY

SEQ ID NO: 3259709 - protein, 26 aa, Plasmodium falciparum
FVYSFLLFIYMCVIRTIKSYKTKHIW

SEQ ID NO: 3259710 - protein, 17 aa, Plasmodium falciparum
FWEIKPWFSKTRKESYI

SEQ ID NO: 3259711 - protein, 17 aa, Plasmodium falciparum
FWEYFKFNIPNFIKKEN

SEQ ID NO: 3259712 - protein, 17 aa, Plasmodium falciparum
FWFFIYFIFHINGIHYY

SEQ ID NO: 3259713 - protein, 18 aa, Plasmodium falciparum
FWFHTNVWRDKAYERDPC

SEQ ID NO: 3259714 - protein, 22 aa, Plasmodium falciparum
FWIKIMGGVLISFSLYLNAYSF

SEQ ID NO: 3259715 - protein, 33 aa, Plasmodium falciparum
FWINHMLKDSIDWRKYIKRCINNSASNECKKNM

SEQ ID NO: 3259716 - protein, 21 aa, Plasmodium falciparum
FWIVFCFTGQPLILFIYYYLW

SEQ ID NO: 3259717 - protein, 18 aa, Plasmodium falciparum
FWLALCININRISYYNEI

SEQ ID NO: 3259718 - protein, 26 aa, Plasmodium falciparum
FWVTYMLNDCIDWKKKITKCINNGTK

SEQ ID NO: 3259719 - protein, 17 aa, Plasmodium falciparum
FYAKLYKRRDIQRSVKN

SEQ ID NO: 3259720 - protein, 23 aa, Plasmodium falciparum
FYANLKIFKDCLDKNELTKGNNS

SEQ ID NO: 3259721 - protein, 28 aa, Plasmodium falciparum
FYASKKVKESVCFSLVIYFPNMDIQKKI

SEQ ID NO: 3259722 - protein, 17 aa, Plasmodium falciparum
FYCDGMGQVKKHGYALR

SEQ ID NO: 3259723 - protein, 23 aa, Plasmodium falciparum
FYCKRKYFTTPFFEHINIPTIHI

SEQ ID NO: 3259724 - protein, 20 aa, Plasmodium falciparum
FYCLSERLIKSFLKIIKLKT

SEQ ID NO: 3259725 - protein, 23 aa, Plasmodium falciparum
FYDDMNILIARDILLFIIDLLCL

SEQ ID NO: 3259726 - protein, 18 aa, Plasmodium falciparum
FYDITSFFKPSSKKLEDN

SEQ ID NO: 3259727 - protein, 17 aa, Plasmodium falciparum
FYDLNLFNDFLCEKLNT

SEQ ID NO: 3259728 - protein, 30 aa, Plasmodium falciparum
FYDLYCFIHLPDFIFINSFLIYSFASLSNN

SEQ ID NO: 3259729 - protein, 26 aa, Plasmodium falciparum
FYDQWSFPLVYSFCINKRSFVLNSIG

SEQ ID NO: 3259730 - protein, 25 aa, Plasmodium falciparum
FYDVKSLKCNFDFLNKLNTQIYGSD

SEQ ID NO: 3259731 - protein, 26 aa, Plasmodium falciparum
FYEHFYLKQVDSFLTLVVNEKLQKYY

SEQ ID NO: 3259732 - protein, 20 aa, Plasmodium falciparum
FYEKISLNLINIFKNDENLL

SEQ ID NO: 3259733 - protein, 18 aa, Plasmodium falciparum
FYEKNFIMCYSLCKLLLN

SEQ ID NO: 3259734 - protein, 47 aa, Plasmodium falciparum
FYEKRFKKLKLILKKIFMYLNIICMIIKYIKLKKWIFNENFDMHTCK

SEQ ID NO: 3259735 - protein, 50 aa, Plasmodium falciparum
FYELNEWKSHMNLLRSALDLRFIRKYKLYKYFFFLKNMIKSTKFKNKKFY

SEQ ID NO: 3259736 - protein, 23 aa, Plasmodium falciparum
FYELNYGYKYMIHFLNGLSVFKI

SEQ ID NO: 3259737 - protein, 24 aa, Plasmodium falciparum
FYERFKKYSSIIWNNNIHNNHNNN

SEQ ID NO: 3259738 - protein, 21 aa, Plasmodium falciparum
FYESFVYKNIPSMDSTKKNNI

SEQ ID NO: 3259739 - protein, 25 aa, Plasmodium falciparum
FYETEFLKALYFYSAIQKNKRDEEY

SEQ ID NO: 3259740 - protein, 17 aa, Plasmodium falciparum
FYFCIGGSLVTIPVITL

SEQ ID NO: 3259741 - protein, 25 aa, Plasmodium falciparum
FYFCPIVAAVLTFIYFINMRVFAVR

SEQ ID NO: 3259742 - protein, 17 aa, Plasmodium falciparum
FYFDLLRAKLNDVCAND

SEQ ID NO: 3259743 - protein, 23 aa, Plasmodium falciparum
FYFFHIITGTLLYEYCYYNEEEK

SEQ ID NO: 3259744 - protein, 18 aa, Plasmodium falciparum
FYFFNIHLYFNCEEDYNI

SEQ ID NO: 3259745 - protein, 17 aa, Plasmodium falciparum
FYFFYFYILMFHNYIDE

SEQ ID NO: 3259746 - protein, 25 aa, Plasmodium falciparum
FYFHYMNEKLFWKDGSVLFTDKIVK

SEQ ID NO: 3259747 - protein, 26 aa, Plasmodium falciparum
FYFIPTLFFIFTIIFSFIFFLAIKSY

SEQ ID NO: 3259748 - protein, 19 aa, Plasmodium falciparum
FYFISRLLSFTAHINEQKE

SEQ ID NO: 3259749 - protein, 21 aa, Plasmodium falciparum
FYFKCRDCDYHLFNTSDKEVS

SEQ ID NO: 3259750 - protein, 24 aa, Plasmodium falciparum
FYFLNCSGGINVLMKYNISLYEVF

SEQ ID NO: 3259751 - protein, 21 aa, Plasmodium falciparum
FYFLTEIFSSLNFLMKDNPQL

SEQ ID NO: 3259752 - protein, 17 aa, Plasmodium falciparum
FYFNIKHMYVICLDNES

SEQ ID NO: 3259753 - protein, 21 aa, Plasmodium falciparum
FYFNIYLFLLFKVPKDSKMKF

SEQ ID NO: 3259754 - protein, 24 aa, Plasmodium falciparum
FYFRTNIFILLNFILCVPKKNIDY

SEQ ID NO: 3259755 - protein, 19 aa, Plasmodium falciparum
FYFSQLGNLVPFYDTKHPY

SEQ ID NO: 3259756 - protein, 19 aa, Plasmodium falciparum
FYFTIKLIIILGNNKNSNL

SEQ ID NO: 3259757 - protein, 20 aa, Plasmodium falciparum
FYFTPNFRKSDLFKNSSVEN

SEQ ID NO: 3259758 - protein, 17 aa, Plasmodium falciparum
FYFVKDIYNNMNEGIST

SEQ ID NO: 3259759 - protein, 23 aa, Plasmodium falciparum
FYGELKIMFFFWLYSDTFQGAGY

SEQ ID NO: 3259760 - protein, 23 aa, Plasmodium falciparum
FYGKLHDFLFLFKNKIKIRKDIK

SEQ ID NO: 3259761 - protein, 18 aa, Plasmodium falciparum
FYHLKLNILILSCIIIQI

SEQ ID NO: 3259762 - protein, 30 aa, Plasmodium falciparum
FYHVSLCILGCLFFENFLFKDFDNSFSLVK

SEQ ID NO: 3259763 - protein, 18 aa, Plasmodium falciparum
FYHYCIYVIYHMNKLKNK

SEQ ID NO: 3259764 - protein, 28 aa, Plasmodium falciparum
FYICKNILWKKSIFFLTIFVMINSAIIS

SEQ ID NO: 3259765 - protein, 17 aa, Plasmodium falciparum
FYIFFLHIDIYVNIYST

SEQ ID NO: 3259766 - protein, 28 aa, Plasmodium falciparum
FYIFLYFYLHRIILKILNLFGYLLITFV

SEQ ID NO: 3259767 - protein, 27 aa, Plasmodium falciparum
FYIFSFPIIFIICYIFDTYWRQRFMLF

SEQ ID NO: 3259768 - protein, 17 aa, Plasmodium falciparum
FYIFSTFEVIIKKASDY

SEQ ID NO: 3259769 - protein, 19 aa, Plasmodium falciparum
FYIHLGRLSNHFYSSINQL

SEQ ID NO: 3259770 - protein, 17 aa, Plasmodium falciparum
FYIHLNVTYVHYKNKLY

SEQ ID NO: 3259771 - protein, 23 aa, Plasmodium falciparum
FYIKEKFKYFPILNIHFYTTSIN

SEQ ID NO: 3259772 - protein, 17 aa, Plasmodium falciparum
FYIKNNLLFHSFTSNDN

SEQ ID NO: 3259773 - protein, 17 aa, Plasmodium falciparum
FYIKQLIINICLPSYSY

SEQ ID NO: 3259774 - protein, 25 aa, Plasmodium falciparum
FYILKRIKFIIYFTSLLNQLIFDMC

SEQ ID NO: 3259775 - protein, 18 aa, Plasmodium falciparum
FYILLKIYRMKNTEIYNF

SEQ ID NO: 3259776 - protein, 22 aa, Plasmodium falciparum
FYILSCVLLIYSFFITGHKFIL

SEQ ID NO: 3259777 - protein, 22 aa, Plasmodium falciparum
FYINKIRCVKGISMETRRFHMH

SEQ ID NO: 3259778 - protein, 28 aa, Plasmodium falciparum
FYINRNTIIPIYFYNNIYKFIDYNTEVF

SEQ ID NO: 3259779 - protein, 25 aa, Plasmodium falciparum
FYIPHCTFSVLSILFIETIILNNQS

SEQ ID NO: 3259780 - protein, 19 aa, Plasmodium falciparum
FYIPKKIRFGPVIEYNDFH

SEQ ID NO: 3259781 - protein, 17 aa, Plasmodium falciparum
FYIQHIFHILISTSSSV

SEQ ID NO: 3259782 - protein, 31 aa, Plasmodium falciparum
FYISRELEEALCIYVSIKFLKYIQTDPYYNI

SEQ ID NO: 3259783 - protein, 21 aa, Plasmodium falciparum
FYISTCDKYAFLNITKYYQCK

SEQ ID NO: 3259784 - protein, 38 aa, Plasmodium falciparum
FYITLSSYYFIISFIFSTLMFFYFCTFYVISLFFLYIS

SEQ ID NO: 3259785 - protein, 18 aa, Plasmodium falciparum
FYIYKKIYKNAYINISYI

SEQ ID NO: 3259786 - protein, 25 aa, Plasmodium falciparum
FYKCASYYNFLFSKYVKYLSINHCL

SEQ ID NO: 3259787 - protein, 19 aa, Plasmodium falciparum
FYKDEIKDHINIYIRDDKI

SEQ ID NO: 3259788 - protein, 23 aa, Plasmodium falciparum
FYKDFYYPYIRPFIERLLYIYQI

SEQ ID NO: 3259789 - protein, 27 aa, Plasmodium falciparum
FYKFFNFKKNKCCYYYGKKVHNQYYNH

SEQ ID NO: 3259790 - protein, 25 aa, Plasmodium falciparum
FYKFQFKISTYIGFIYTSPKLSDHI

SEQ ID NO: 3259791 - protein, 26 aa, Plasmodium falciparum
FYKILKLLCLYLFLYEEEYVLFYGKV

SEQ ID NO: 3259792 - protein, 21 aa, Plasmodium falciparum
FYKLFSSFINIIFPIFKRKEK

SEQ ID NO: 3259793 - protein, 27 aa, Plasmodium falciparum
FYKMYKECVHILLLCIMCTSKFFCLYI

SEQ ID NO: 3259794 - protein, 22 aa, Plasmodium falciparum
FYKNIYTCYKLMCKNEYSNKYL

SEQ ID NO: 3259795 - protein, 20 aa, Plasmodium falciparum
FYKNVINIFLCLYNILYRQN

SEQ ID NO: 3259796 - protein, 18 aa, Plasmodium falciparum
FYKRRMITRSGKNGENEN

SEQ ID NO: 3259797 - protein, 21 aa, Plasmodium falciparum
FYKRYRYGFDRNYVEQKLSLY

SEQ ID NO: 3259798 - protein, 17 aa, Plasmodium falciparum
FYLCYYNNELLECFLKN

SEQ ID NO: 3259799 - protein, 22 aa, Plasmodium falciparum
FYLGDLKLMIGHNSPYEISLIL

SEQ ID NO: 3259800 - protein, 23 aa, Plasmodium falciparum
FYLGSIYELISLCIHHMDHVNKK

SEQ ID NO: 3259801 - protein, 35 aa, Plasmodium falciparum
FYLICDEKILLLYKYRIFLEPYLFISHKNNSNIYK

SEQ ID NO: 3259802 - protein, 18 aa, Plasmodium falciparum
FYLIGFSMGCVIAICFAK

SEQ ID NO: 3259803 - protein, 33 aa, Plasmodium falciparum
FYLKKIILLICGGDGTISIFIDTLIKFFLKQNS

SEQ ID NO: 3259804 - protein, 27 aa, Plasmodium falciparum
FYLLSFLNFYLEDMIKDGSLLYSDMMK

SEQ ID NO: 3259805 - protein, 31 aa, Plasmodium falciparum
FYLSFKEKICLFIKGKYKGTFDNVYEESCES

SEQ ID NO: 3259806 - protein, 25 aa, Plasmodium falciparum
FYLSKNLFYFVKYVFLYFADIYIGF

SEQ ID NO: 3259807 - protein, 20 aa, Plasmodium falciparum
FYLVRVSKILKVLVALITKN

SEQ ID NO: 3259808 - protein, 19 aa, Plasmodium falciparum
FYLYNIVDLLLLLKREEEI

SEQ ID NO: 3259809 - protein, 25 aa, Plasmodium falciparum
FYMEEILFKRYNFNFSNISVTTNKQ

SEQ ID NO: 3259810 - protein, 21 aa, Plasmodium falciparum
FYMINCYLVNYSYCINNNINP

SEQ ID NO: 3259811 - protein, 22 aa, Plasmodium falciparum
FYMLCKCLLLFNKNILFRTIFD

SEQ ID NO: 3259812 - protein, 18 aa, Plasmodium falciparum
FYMTPSIFANIFYYLNNN

SEQ ID NO: 3259813 - protein, 18 aa, Plasmodium falciparum
FYNCFPKVIFDIVTLEFL

SEQ ID NO: 3259814 - protein, 17 aa, Plasmodium falciparum
FYNELYDNYILSYIQTD

SEQ ID NO: 3259815 - protein, 17 aa, Plasmodium falciparum
FYNEWKSVFLQNKNIKH

SEQ ID NO: 3259816 - protein, 25 aa, Plasmodium falciparum
FYNFKLSKHLIHIGNIFHIHNKIDR

SEQ ID NO: 3259817 - protein, 22 aa, Plasmodium falciparum
FYNISSSICFSRNNFYNLATGC

SEQ ID NO: 3259818 - protein, 26 aa, Plasmodium falciparum
FYNKKINDLFCKLRKKCIQEKQNGEH

SEQ ID NO: 3259819 - protein, 18 aa, Plasmodium falciparum
FYNKRIKYDYYYFNKKAY

SEQ ID NO: 3259820 - protein, 20 aa, Plasmodium falciparum
FYNKSIRDYVFFDIAIENKY

SEQ ID NO: 3259821 - protein, 17 aa, Plasmodium falciparum
FYNNLFALYSYVHDYIH

SEQ ID NO: 3259822 - protein, 30 aa, Plasmodium falciparum
FYNPMLKPRLWRLEFFIKYIHNLESQKQKN

SEQ ID NO: 3259823 - protein, 18 aa, Plasmodium falciparum
FYPLDIMEHMLPMEPGNE

SEQ ID NO: 3259824 - protein, 27 aa, Plasmodium falciparum
FYPLIIPFRGAFAFAISAFCITQLGKI

SEQ ID NO: 3259825 - protein, 18 aa, Plasmodium falciparum
FYPSILMHERQCGLSSAY

SEQ ID NO: 3259826 - protein, 17 aa, Plasmodium falciparum
FYPYEYICVNPLNNENI

SEQ ID NO: 3259827 - protein, 20 aa, Plasmodium falciparum
FYQKEIFQEIFLKKNSELDD

SEQ ID NO: 3259828 - protein, 24 aa, Plasmodium falciparum
FYQYWKKNHLNNFNKMKNNDDFNV

SEQ ID NO: 3259829 - protein, 20 aa, Plasmodium falciparum
FYRDNYFYFHCLNKYIKSKN

SEQ ID NO: 3259830 - protein, 21 aa, Plasmodium falciparum
FYRLLKPCASVGFLMVLACLM

SEQ ID NO: 3259831 - protein, 26 aa, Plasmodium falciparum
FYRNVKCILELFGILLHCLNLKKNCK

SEQ ID NO: 3259832 - protein, 18 aa, Plasmodium falciparum
FYRNVLKNEMDVIYVSIS

SEQ ID NO: 3259833 - protein, 21 aa, Plasmodium falciparum
FYRRNTFILNFFKKIHSERKH

SEQ ID NO: 3259834 - protein, 17 aa, Plasmodium falciparum
FYSCVIIALIIFLIDLC

SEQ ID NO: 3259835 - protein, 28 aa, Plasmodium falciparum
FYSDIYAFGIILWEMLSNDIPYNYPFAS

SEQ ID NO: 3259836 - protein, 29 aa, Plasmodium falciparum
FYSIEFICLLLFIFLHFLLFLLSQWNIKI

SEQ ID NO: 3259837 - protein, 28 aa, Plasmodium falciparum
FYSLEFVLRSPNYFSFFIENNMVTVNKE

SEQ ID NO: 3259838 - protein, 20 aa, Plasmodium falciparum
FYSLICCLNSIYIDNYYILK

SEQ ID NO: 3259839 - protein, 19 aa, Plasmodium falciparum
FYSSFPFKLFLHSLYMIFI

SEQ ID NO: 3259840 - protein, 22 aa, Plasmodium falciparum
FYTCNMNMYIGIFITNIKSLLL

SEQ ID NO: 3259841 - protein, 18 aa, Plasmodium falciparum
FYTDVAYELVKYSNGFFE

SEQ ID NO: 3259842 - protein, 26 aa, Plasmodium falciparum
FYTFFKISDTFLLHLLKEFKENKAIN

SEQ ID NO: 3259843 - protein, 20 aa, Plasmodium falciparum
FYTLFRFLFTLFLLIYMVKY

SEQ ID NO: 3259844 - protein, 18 aa, Plasmodium falciparum
FYTVYLFIKHYGHLNLVY

SEQ ID NO: 3259845 - protein, 26 aa, Plasmodium falciparum
FYVHIKRFYFDFFFTILKNINDMEST

SEQ ID NO: 3259846 - protein, 29 aa, Plasmodium falciparum
FYVNPLRKLNCIGCGEFLQTTNEKKSGYV

SEQ ID NO: 3259847 - protein, 24 aa, Plasmodium falciparum
FYVTLHLANLGYIYIMQKPILPEQ

SEQ ID NO: 3259848 - protein, 19 aa, Plasmodium falciparum
FYYFKRKKIKIDFFCVNWF

SEQ ID NO: 3259849 - protein, 24 aa, Plasmodium falciparum
FYYIINFNPNFFKTLYEYIYIESI

SEQ ID NO: 3259850 - protein, 22 aa, Plasmodium falciparum
FYYKKSCFEIPYDIFVHNNVEK

SEQ ID NO: 3259851 - protein, 26 aa, Plasmodium falciparum
FYYKNYMIEKCIYFDNNINNKESHHK

SEQ ID NO: 3259852 - protein, 18 aa, Plasmodium falciparum
FYYLCIVSSYAYILILPC

SEQ ID NO: 3259853 - protein, 19 aa, Plasmodium falciparum
FYYLFKYTLLKLFFERSRK

SEQ ID NO: 3259854 - protein, 18 aa, Plasmodium falciparum
FYYLKNTYILFSVVKVAE

SEQ ID NO: 3259855 - protein, 24 aa, Plasmodium falciparum
FYYLYKSFFLYILPTQHKDGNITN

SEQ ID NO: 3259856 - protein, 29 aa, Plasmodium falciparum
FYYRTHELWKHRLSFLPKCLLQISTMNAK

SEQ ID NO: 3259857 - protein, 26 aa, Plasmodium falciparum
FYYSHVRYPFLLIKCLQMIQLYDVHN

SEQ ID NO: 3259858 - protein, 17 aa, Plasmodium falciparum
FYYSLYVYIFFNYTISR

SEQ ID NO: 3259859 - protein, 23 aa, Plasmodium falciparum
GACAPFRRLHVCDRNLEQIKPHT

SEQ ID NO: 3259860 - protein, 20 aa, Plasmodium falciparum
GACAPFRRQNMCDKNLEYLI

SEQ ID NO: 3259861 - protein, 22 aa, Plasmodium falciparum
GACAPYRRLSLCNKNFQKINNY

SEQ ID NO: 3259862 - protein, 22 aa, Plasmodium falciparum
GACAPYRRLSLCNKNFQNNNND

SEQ ID NO: 3259863 - protein, 20 aa, Plasmodium falciparum
GACAPYRRSSLCDHHLSYMN

SEQ ID NO: 3259864 - protein, 22 aa, Plasmodium falciparum
GADKSICPWVMRNFFAAKDSPR

SEQ ID NO: 3259865 - protein, 21 aa, Plasmodium falciparum
GADSLRLYLINSVAVRAENLK

SEQ ID NO: 3259866 - protein, 19 aa, Plasmodium falciparum
GAFCLIFFSLLGHFVYKSC

SEQ ID NO: 3259867 - protein, 27 aa, Plasmodium falciparum
GAFHSKKILLIFGIIYVVLLNAYICGD

SEQ ID NO: 3259868 - protein, 25 aa, Plasmodium falciparum
GAGDRLVLVGALRRIKSFLRGLFSV

SEQ ID NO: 3259869 - protein, 17 aa, Plasmodium falciparum
GAHRLWSHRAFKAGHIV

SEQ ID NO: 3259870 - protein, 28 aa, Plasmodium falciparum
GAIAPWWGLVCGVGYAGWSHYVPFAISK

SEQ ID NO: 3259871 - protein, 25 aa, Plasmodium falciparum
GAICIPPRRRKLYLHKIEGVDTTDD

SEQ ID NO: 3259872 - protein, 23 aa, Plasmodium falciparum
GAKSYAEMDCKCIEGYYRKEDKC

SEQ ID NO: 3259873 - protein, 26 aa, Plasmodium falciparum
GALGCEYAKLFSLLDMCTRNSEQNTN

SEQ ID NO: 3259874 - protein, 18 aa, Plasmodium falciparum
GALGPEMVNRIGVSLIAY

SEQ ID NO: 3259875 - protein, 25 aa, Plasmodium falciparum
GALKVKDLITEGGPQLLDLTANVVG

SEQ ID NO: 3259876 - protein, 23 aa, Plasmodium falciparum
GASKSFRNYAWFCKGFPKYVSHE

SEQ ID NO: 3259877 - protein, 19 aa, Plasmodium falciparum
GASSIIFLLYQFLKNLEGT

SEQ ID NO: 3259878 - protein, 19 aa, Plasmodium falciparum
GASVISILLGVLISMFMLT

SEQ ID NO: 3259879 - protein, 19 aa, Plasmodium falciparum
GATDFGGPFHEYLSSISRE

SEQ ID NO: 3259880 - protein, 18 aa, Plasmodium falciparum
GATIDIKKAFILLEKVSE

SEQ ID NO: 3259881 - protein, 26 aa, Plasmodium falciparum
GAVVRTAIKFMLFSVAFFQLVMFTFF

SEQ ID NO: 3259882 - protein, 18 aa, Plasmodium falciparum
GAYCFYQKDMKPFQDKNT

SEQ ID NO: 3259883 - protein, 26 aa, Plasmodium falciparum
GCAKECMKYKTWIGKKFEEFKKQENT

SEQ ID NO: 3259884 - protein, 23 aa, Plasmodium falciparum
GCAPNVVCPFVIKTEWGLLKNVS

SEQ ID NO: 3259885 - protein, 23 aa, Plasmodium falciparum
GCDGGHPFYSFLYVLQNELCLGD

SEQ ID NO: 3259886 - protein, 24 aa, Plasmodium falciparum
GCDNIKLVLVLSFLSNIYNIYNPG

SEQ ID NO: 3259887 - protein, 18 aa, Plasmodium falciparum
GCEIILACRCIKRMEELR

SEQ ID NO: 3259888 - protein, 19 aa, Plasmodium falciparum
GCGFSGYLVQFGRRLSLLI

SEQ ID NO: 3259889 - protein, 17 aa, Plasmodium falciparum
GCGKSSLITALAGYFDF

SEQ ID NO: 3259890 - protein, 21 aa, Plasmodium falciparum
GCGKTGIINYMYEKIYGKRKD

SEQ ID NO: 3259891 - protein, 19 aa, Plasmodium falciparum
GCGVKRKDNQWKEKKNGDC

SEQ ID NO: 3259892 - protein, 19 aa, Plasmodium falciparum
GCIHECLVFPMIESLPTFY

SEQ ID NO: 3259893 - protein, 23 aa, Plasmodium falciparum
GCKKNCECFKNWVAQKQQEWKQI

SEQ ID NO: 3259894 - protein, 21 aa, Plasmodium falciparum
GCLGNCTYCKTKFARGDLSSY

SEQ ID NO: 3259895 - protein, 23 aa, Plasmodium falciparum
GCLKCGGVLGGGITPGWGLISGI

SEQ ID NO: 3259896 - protein, 17 aa, Plasmodium falciparum
GCLKKKSFKNFREFSKY

SEQ ID NO: 3259897 - protein, 21 aa, Plasmodium falciparum
GCLRCACGLGGVAAGVGIIGA

SEQ ID NO: 3259898 - protein, 22 aa, Plasmodium falciparum
GCLRCAGVLGGGIAPGWSLVSG

SEQ ID NO: 3259899 - protein, 28 aa, Plasmodium falciparum
GCLRCGCALGGGVAPIWGLVSGLWYATW

SEQ ID NO: 3259900 - protein, 21 aa, Plasmodium falciparum
GCLRCGCALGGVAASVGLFGG

SEQ ID NO: 3259901 - protein, 22 aa, Plasmodium falciparum
GCLRCGCGLGGVAAGVGIFGAL

SEQ ID NO: 3259902 - protein, 22 aa, Plasmodium falciparum
GCLRCGCGLGGVAAGVGIFGTV

SEQ ID NO: 3259903 - protein, 22 aa, Plasmodium falciparum
GCLRCGCGLGGVAASIGLFGGL

SEQ ID NO: 3259904 - protein, 21 aa, Plasmodium falciparum
GCLRCGCGLGGVAASVGLFGG

SEQ ID NO: 3259905 - protein, 22 aa, Plasmodium falciparum
GCLRCGCGLGGVAASVGLFGGL

SEQ ID NO: 3259906 - protein, 22 aa, Plasmodium falciparum
GCLRCGCGLGSVAGSIGLFGAV

SEQ ID NO: 3259907 - protein, 21 aa, Plasmodium falciparum
GCLRCGGVLGGGIAPTFGLIG

SEQ ID NO: 3259908 - protein, 21 aa, Plasmodium falciparum
GCLRCGGVLGGGVMPGFGAIG

SEQ ID NO: 3259909 - protein, 21 aa, Plasmodium falciparum
GCLRCGSVLGGGVMPGFGAIG

SEQ ID NO: 3259910 - protein, 17 aa, Plasmodium falciparum
GCMTICGFRGRMVKKMA

SEQ ID NO: 3259911 - protein, 17 aa, Plasmodium falciparum
GCNCAWKSGNREENDLV

SEQ ID NO: 3259912 - protein, 19 aa, Plasmodium falciparum
GCNDKCECVKEWLSKKKQE

SEQ ID NO: 3259913 - protein, 19 aa, Plasmodium falciparum
GCNNECYTYRSLINRQRYE

SEQ ID NO: 3259914 - protein, 21 aa, Plasmodium falciparum
GCRCYKLEGQNIVLSQSPQLF

SEQ ID NO: 3259915 - protein, 17 aa, Plasmodium falciparum
GCSCNRSLMIFIALMVF

SEQ ID NO: 3259916 - protein, 23 aa, Plasmodium falciparum
GCSLDYLLHKDIYPFIKETEKEK

SEQ ID NO: 3259917 - protein, 17 aa, Plasmodium falciparum
GCTCKDPSPGEVIPEKK

SEQ ID NO: 3259918 - protein, 19 aa, Plasmodium falciparum
GCTKKSRRTKNIKFYNKND

SEQ ID NO: 3259919 - protein, 17 aa, Plasmodium falciparum
GCTNAFMKKGCTYKSND

SEQ ID NO: 3259920 - protein, 24 aa, Plasmodium falciparum
GCVPPRRQNLNMERLDNENEDSVP

SEQ ID NO: 3259921 - protein, 27 aa, Plasmodium falciparum
GCVTFAIACALCLYSNFIGAINKEQRK

SEQ ID NO: 3259922 - protein, 23 aa, Plasmodium falciparum
GDACAPFRRLHVCDRNLEQIDPA

SEQ ID NO: 3259923 - protein, 17 aa, Plasmodium falciparum
GDALIMITKIWKLSYVN

SEQ ID NO: 3259924 - protein, 17 aa, Plasmodium falciparum
GDALPGKAFYFPTNPSY

SEQ ID NO: 3259925 - protein, 23 aa, Plasmodium falciparum
GDAQLIYLPAFFLLIFIIYIVAR

SEQ ID NO: 3259926 - protein, 19 aa, Plasmodium falciparum
GDDYFPFRFYKNINNYKCS

SEQ ID NO: 3259927 - protein, 21 aa, Plasmodium falciparum
GDEFPADVVILYVKNNANAIV

SEQ ID NO: 3259928 - protein, 21 aa, Plasmodium falciparum
GDEHLILFFDRVYFMLRKNGY

SEQ ID NO: 3259929 - protein, 18 aa, Plasmodium falciparum
GDEYKYKAKDDMFCLNYR

SEQ ID NO: 3259930 - protein, 18 aa, Plasmodium falciparum
GDFHLKKKMFAYSVDGTR

SEQ ID NO: 3259931 - protein, 26 aa, Plasmodium falciparum
GDFLCPTCAGHCRFYKKWIKIKKEEF

SEQ ID NO: 3259932 - protein, 18 aa, Plasmodium falciparum
GDGMTRKRWWGKYRKVIW

SEQ ID NO: 3259933 - protein, 28 aa, Plasmodium falciparum
GDGNFSKVFCCRGENKKKCAMKLMCCPL

SEQ ID NO: 3259934 - protein, 18 aa, Plasmodium falciparum
GDIFKVTFRNGGKGSELQ

SEQ ID NO: 3259935 - protein, 19 aa, Plasmodium falciparum
GDIFKVTFRNGGVGKNLNG

SEQ ID NO: 3259936 - protein, 21 aa, Plasmodium falciparum
GDIKHKSCTNGNDVDGVKSKY

SEQ ID NO: 3259937 - protein, 17 aa, Plasmodium falciparum
GDIKWRKQDNLFCNNIL

SEQ ID NO: 3259938 - protein, 19 aa, Plasmodium falciparum
GDILYDYGCEVAYLSCLKN

SEQ ID NO: 3259939 - protein, 18 aa, Plasmodium falciparum
GDILYIPQFEVIPADIIL

SEQ ID NO: 3259940 - protein, 24 aa, Plasmodium falciparum
GDIPNDFLRLMFYTLGDYRDICIG

SEQ ID NO: 3259941 - protein, 21 aa, Plasmodium falciparum
GDISYKLFISSWINLLNNNIA

SEQ ID NO: 3259942 - protein, 18 aa, Plasmodium falciparum
GDKFIGLLEIKNQRFRFL

SEQ ID NO: 3259943 - protein, 25 aa, Plasmodium falciparum
GDKLLRYFFISIFKYELNKININNY

SEQ ID NO: 3259944 - protein, 17 aa, Plasmodium falciparum
GDKYNLFMLNDALLYNI

SEQ ID NO: 3259945 - protein, 21 aa, Plasmodium falciparum
GDLFLIVTLCQYYIIKEIIRN

SEQ ID NO: 3259946 - protein, 18 aa, Plasmodium falciparum
GDLKLFYFIKEAFEKKKR

SEQ ID NO: 3259947 - protein, 29 aa, Plasmodium falciparum
GDLLCPTCARHCRFYKKWINTKRDEFNKQ

SEQ ID NO: 3259948 - protein, 24 aa, Plasmodium falciparum
GDLVCLFENKILLSKVWISRSNIK

SEQ ID NO: 3259949 - protein, 18 aa, Plasmodium falciparum
GDLVDIPLYLDVFEENEE

SEQ ID NO: 3259950 - protein, 17 aa, Plasmodium falciparum
GDMGIELNVETQLIITA

SEQ ID NO: 3259951 - protein, 19 aa, Plasmodium falciparum
GDMGYTFSQRIRRFFLNNN

SEQ ID NO: 3259952 - protein, 20 aa, Plasmodium falciparum
GDNCPHVYASKSFSYIGGVD

SEQ ID NO: 3259953 - protein, 27 aa, Plasmodium falciparum
GDNICKNCKEILKKDVLEHFEKFELNY

SEQ ID NO: 3259954 - protein, 20 aa, Plasmodium falciparum
GDNILYMLLSNFFYISKNIY

SEQ ID NO: 3259955 - protein, 22 aa, Plasmodium falciparum
GDNKLELCRKCGHYEEKVPTKL

SEQ ID NO: 3259956 - protein, 20 aa, Plasmodium falciparum
GDNVPRNIDVNGSKDEYSPE

SEQ ID NO: 3259957 - protein, 22 aa, Plasmodium falciparum
GDPFMRKYFTVFDYDNHTVGFA

SEQ ID NO: 3259958 - protein, 23 aa, Plasmodium falciparum
GDPFMRKYFTVFDYEKESVGFAV

SEQ ID NO: 3259959 - protein, 26 aa, Plasmodium falciparum
GDPTCAICAKCFFASNHKNHIYRLTH

SEQ ID NO: 3259960 - protein, 24 aa, Plasmodium falciparum
GDRKFFGLISVCFSFLALYRAFTP

SEQ ID NO: 3259961 - protein, 22 aa, Plasmodium falciparum
GDSHKCIKNNIKKSIKKQETKE

SEQ ID NO: 3259962 - protein, 18 aa, Plasmodium falciparum
GDSKCGLMTFNLDMYDYE

SEQ ID NO: 3259963 - protein, 19 aa, Plasmodium falciparum
GDSLLTAFVESAAVETFFL

SEQ ID NO: 3259964 - protein, 19 aa, Plasmodium falciparum
GDTAISFNGQKVFGSFKNK

SEQ ID NO: 3259965 - protein, 20 aa, Plasmodium falciparum
GDTGWDVLVFDYLVEKPLDI

SEQ ID NO: 3259966 - protein, 25 aa, Plasmodium falciparum
GDVKNNICNLFLYNFPYQNNIKELN

SEQ ID NO: 3259967 - protein, 19 aa, Plasmodium falciparum
GDVPLWQHIFCGSIAGLME

SEQ ID NO: 3259968 - protein, 20 aa, Plasmodium falciparum
GDVYYKIAYYLKKNRKYMQR

SEQ ID NO: 3259969 - protein, 18 aa, Plasmodium falciparum
GDYKRAKFHQPLLEAAKY

SEQ ID NO: 3259970 - protein, 24 aa, Plasmodium falciparum
GDYLNEILLSLSIHYNKNKIENFF

SEQ ID NO: 3259971 - protein, 20 aa, Plasmodium falciparum
GEDEIDCINFTINVINNQDD

SEQ ID NO: 3259972 - protein, 28 aa, Plasmodium falciparum
GEDIFDFIIKRRKNIFLKIRRKDKINIL

SEQ ID NO: 3259973 - protein, 27 aa, Plasmodium falciparum
GEDPIYICRRLIRIASEDIGLANHDVL

SEQ ID NO: 3259974 - protein, 20 aa, Plasmodium falciparum
GEDTYIWGFENLNTEQNKNS

SEQ ID NO: 3259975 - protein, 21 aa, Plasmodium falciparum
GEEDAKHVLDEFGQQVYNEKV

SEQ ID NO: 3259976 - protein, 20 aa, Plasmodium falciparum
GEEFYNEFYLHNFKNEIKCM

SEQ ID NO: 3259977 - protein, 21 aa, Plasmodium falciparum
GEEIFLSNIFFDYNQNNNIPP

SEQ ID NO: 3259978 - protein, 17 aa, Plasmodium falciparum
GEFKVGSSIIVIFENKK

SEQ ID NO: 3259979 - protein, 22 aa, Plasmodium falciparum
GEGELKLMNWISNYVKNIKNIK

SEQ ID NO: 3259980 - protein, 24 aa, Plasmodium falciparum
GEGGEVFYMYSMKEIRKIPLNKFF

SEQ ID NO: 3259981 - protein, 17 aa, Plasmodium falciparum
GEGNKMIVLRTHDKYDI

SEQ ID NO: 3259982 - protein, 37 aa, Plasmodium falciparum
GEHIKNELLFIGEVVFKFIYYYGLFKDKNKLFYFLQN

SEQ ID NO: 3259983 - protein, 18 aa, Plasmodium falciparum
GEIGCNFAAGMSGGIAYV

SEQ ID NO: 3259984 - protein, 33 aa, Plasmodium falciparum
GEILHKVNLGFCLINARNGIFIYLNGNDLCLDL

SEQ ID NO: 3259985 - protein, 20 aa, Plasmodium falciparum
GEILLRIASIDNTFLKYKSS

SEQ ID NO: 3259986 - protein, 18 aa, Plasmodium falciparum
GEIPIMDWEKLIIFGDFS

SEQ ID NO: 3259987 - protein, 21 aa, Plasmodium falciparum
GEIPPQFLRSMFYTFGDYKDI

SEQ ID NO: 3259988 - protein, 20 aa, Plasmodium falciparum
GEIRSIYFDRNCYHGFICLA

SEQ ID NO: 3259989 - protein, 20 aa, Plasmodium falciparum
GEITNGLLIYNANNYNINND

SEQ ID NO: 3259990 - protein, 28 aa, Plasmodium falciparum
GEKKIEYMICKNCKRKSSNKKLILNFLK

SEQ ID NO: 3259991 - protein, 25 aa, Plasmodium falciparum
GEKLGCIHVKCKYKNVHKQETFFKI

SEQ ID NO: 3259992 - protein, 24 aa, Plasmodium falciparum
GEKNILYKRGMKYDDISDINNNSS

SEQ ID NO: 3259993 - protein, 24 aa, Plasmodium falciparum
GEKNLKFFFLFLIYGFFTTSYISI

SEQ ID NO: 3259994 - protein, 25 aa, Plasmodium falciparum
GEKQRICIARCFLKDSKIIVLDEHA

SEQ ID NO: 3259995 - protein, 17 aa, Plasmodium falciparum
GEKRKSNKIKRKRIKND

SEQ ID NO: 3259996 - protein, 22 aa, Plasmodium falciparum
GELYIFSFFYKFFNFKKNKCCY

SEQ ID NO: 3259997 - protein, 37 aa, Plasmodium falciparum
GEMNPILFYEIIKFQNLYFIIYVYFFKHSYNITFVSK

SEQ ID NO: 3259998 - protein, 21 aa, Plasmodium falciparum
GENFCKKRTEMLGKIKEDCYK

SEQ ID NO: 3259999 - protein, 32 aa, Plasmodium falciparum
GENSYGFCLNMFWVLLCLCEPITVNKINDLDF

SEQ ID NO: 3260000 - protein, 22 aa, Plasmodium falciparum
GEQKWKCKYKCYLDVCEPRNLD

SEQ ID NO: 3260001 - protein, 17 aa, Plasmodium falciparum
GEQRLSDFMLYQISEFT

SEQ ID NO: 3260002 - protein, 23 aa, Plasmodium falciparum
GERIDFVYSLNVFSRIINGLFIL

SEQ ID NO: 3260003 - protein, 22 aa, Plasmodium falciparum
GERVGDILLYFELVQSKDAMKF

SEQ ID NO: 3260004 - protein, 18 aa, Plasmodium falciparum
GESVRYPMEIRIPHNNIR

SEQ ID NO: 3260005 - protein, 19 aa, Plasmodium falciparum
GETDWKIKYPINIFQNLKR

SEQ ID NO: 3260006 - protein, 23 aa, Plasmodium falciparum
GETFCRQRTRMLAKIRGECVKSG

SEQ ID NO: 3260007 - protein, 20 aa, Plasmodium falciparum
GETNSSYAIHGFIAFIISNN

SEQ ID NO: 3260008 - protein, 22 aa, Plasmodium falciparum
GEVDDLRWNYLLYSPYELFTNS

SEQ ID NO: 3260009 - protein, 17 aa, Plasmodium falciparum
GEVYLFVKKIPIEVWIR

SEQ ID NO: 3260010 - protein, 17 aa, Plasmodium falciparum
GEYFCPRCLNVIKSHYN

SEQ ID NO: 3260011 - protein, 19 aa, Plasmodium falciparum
GEYKYDISSDMNLIDYKKQ

SEQ ID NO: 3260012 - protein, 23 aa, Plasmodium falciparum
GEYSHVYVLLFFYLLTTRCIKIY

SEQ ID NO: 3260013 - protein, 22 aa, Plasmodium falciparum
GFCFQLKNIFLFHDKEDSLFYL

SEQ ID NO: 3260014 - protein, 23 aa, Plasmodium falciparum
GFFTYICSTKFFDIKNIIIDDET

SEQ ID NO: 3260015 - protein, 23 aa, Plasmodium falciparum
GFGFRYKLFLLIVIPAITIGIYI

SEQ ID NO: 3260016 - protein, 19 aa, Plasmodium falciparum
GFGSRSKESMLLEYQHNKS

SEQ ID NO: 3260017 - protein, 17 aa, Plasmodium falciparum
GFIGYKCNFSNEGVHNL

SEQ ID NO: 3260018 - protein, 20 aa, Plasmodium falciparum
GFIIKPKFVISTGSNINFKE

SEQ ID NO: 3260019 - protein, 19 aa, Plasmodium falciparum
GFKGKGLYKNAPLYNKYEN

SEQ ID NO: 3260020 - protein, 17 aa, Plasmodium falciparum
GFLATLVHDLIITPIDT

SEQ ID NO: 3260021 - protein, 18 aa, Plasmodium falciparum
GFLFRSANMNTFRLANNL

SEQ ID NO: 3260022 - protein, 31 aa, Plasmodium falciparum
GFLNIQIKIIFKRNPLFLTFLSNIRKPLFYY

SEQ ID NO: 3260023 - protein, 22 aa, Plasmodium falciparum
GFLRLYIFVKRCILPIHRNFDI

SEQ ID NO: 3260024 - protein, 22 aa, Plasmodium falciparum
GFLRTDFFSVTKFFNIYIKNIY

SEQ ID NO: 3260025 - protein, 31 aa, Plasmodium falciparum
GFLSCVIRYNELWLFEPREPLVIKATNLIKQ

SEQ ID NO: 3260026 - protein, 17 aa, Plasmodium falciparum
GFLSFALYALWEIFEHI

SEQ ID NO: 3260027 - protein, 25 aa, Plasmodium falciparum
GFMYAFCFYSIMPLYAYFENVNFYI

SEQ ID NO: 3260028 - protein, 33 aa, Plasmodium falciparum
GFNELNILAIFIFYYQNRCLWDEQYINNDNIFF

SEQ ID NO: 3260029 - protein, 23 aa, Plasmodium falciparum
GFNNKRIVEYEVVPKIVNTTEEG

SEQ ID NO: 3260030 - protein, 18 aa, Plasmodium falciparum
GFNPSGLKNVCQITEKHS

SEQ ID NO: 3260031 - protein, 22 aa, Plasmodium falciparum
GFSMGCVIAICFAKKYIKQVKK

SEQ ID NO: 3260032 - protein, 30 aa, Plasmodium falciparum
GFSSFREFLESTPCWQRRMAQEALLNEYEV

SEQ ID NO: 3260033 - protein, 22 aa, Plasmodium falciparum
GFSSTVCLCQWILDLNETLTLC

SEQ ID NO: 3260034 - protein, 22 aa, Plasmodium falciparum
GFVCSLPLVFGFLIFNLASSDC

SEQ ID NO: 3260035 - protein, 23 aa, Plasmodium falciparum
GFVFCLLYHAFLYHSIKSEHKAK

SEQ ID NO: 3260036 - protein, 20 aa, Plasmodium falciparum
GFVFFLFFMCFYLFDENLLK

SEQ ID NO: 3260037 - protein, 23 aa, Plasmodium falciparum
GFYPEIQKSLLLSSHNEDMIYSL

SEQ ID NO: 3260038 - protein, 18 aa, Plasmodium falciparum
GGAFGMGCIGGYIWHFLK

SEQ ID NO: 3260039 - protein, 27 aa, Plasmodium falciparum
GGANKILPFYIWRSFLKNIQFNVKDQH

SEQ ID NO: 3260040 - protein, 19 aa, Plasmodium falciparum
GGCKKTCECFQKWVVQKGK

SEQ ID NO: 3260041 - protein, 20 aa, Plasmodium falciparum
GGCRLPCSSYTSFMKKSKTQ

SEQ ID NO: 3260042 - protein, 23 aa, Plasmodium falciparum
GGDICKSVNSFNLFEKKNNNNNN

SEQ ID NO: 3260043 - protein, 20 aa, Plasmodium falciparum
GGFLCPDKNLLQEKLKFLES

SEQ ID NO: 3260044 - protein, 25 aa, Plasmodium falciparum
GGHFYQLREDWWIANRHTVWEAITC

SEQ ID NO: 3260045 - protein, 36 aa, Plasmodium falciparum
GGICSCSVGSAFLTILGCAFAKSAALTAFASSESTK

SEQ ID NO: 3260046 - protein, 25 aa, Plasmodium falciparum
GGICSCSVGSFLLTMFGLHAAKAAA

SEQ ID NO: 3260047 - protein, 25 aa, Plasmodium falciparum
GGICSCSVGSFLLTMFGLHAAKVAA

SEQ ID NO: 3260048 - protein, 25 aa, Plasmodium falciparum
GGICSCSVGSFLLTMSGLYFAKAAV

SEQ ID NO: 3260049 - protein, 25 aa, Plasmodium falciparum
GGICSCTLGSALLAYIGTVAAKVAV

SEQ ID NO: 3260050 - protein, 27 aa, Plasmodium falciparum
GGICSCTLGSALLTWIGTIAAKAAILG

SEQ ID NO: 3260051 - protein, 25 aa, Plasmodium falciparum
GGICSCTLGSALLTYIGTVAAKAAI

SEQ ID NO: 3260052 - protein, 19 aa, Plasmodium falciparum
GGICSCTVGSAILTMIGLA

SEQ ID NO: 3260053 - protein, 23 aa, Plasmodium falciparum
GGICSCTVGSALLTMIGLAVAKA

SEQ ID NO: 3260054 - protein, 19 aa, Plasmodium falciparum
GGIFLYEVYGLWNYLNQRE

SEQ ID NO: 3260055 - protein, 22 aa, Plasmodium falciparum
GGINFGYLGFNFSKFMNNKKKI

SEQ ID NO: 3260056 - protein, 25 aa, Plasmodium falciparum
GGITLTGSFILLLPISTRYAKILTD

SEQ ID NO: 3260057 - protein, 18 aa, Plasmodium falciparum
GGITPGWGLISGIVYTGW

SEQ ID NO: 3260058 - protein, 19 aa, Plasmodium falciparum
GGKCKKCKEQCQIFKELVS

SEQ ID NO: 3260059 - protein, 20 aa, Plasmodium falciparum
GGLKEMFFNLEDVFKSESDV

SEQ ID NO: 3260060 - protein, 20 aa, Plasmodium falciparum
GGLPKHHVCNANLMRNGADF

SEQ ID NO: 3260061 - protein, 17 aa, Plasmodium falciparum
GGLRGGIVLVLGLRIEA

SEQ ID NO: 3260062 - protein, 31 aa, Plasmodium falciparum
GGLRYKRLLAEPIFGFDVMYDLFKDNFLEQI

SEQ ID NO: 3260063 - protein, 27 aa, Plasmodium falciparum
GGNFFKLREDWWTANRHTVWEAMTCHA

SEQ ID NO: 3260064 - protein, 20 aa, Plasmodium falciparum
GGNIFLFHNVHVINKKMKFQ

SEQ ID NO: 3260065 - protein, 27 aa, Plasmodium falciparum
GGNILYFRVYELCCLLVISKKNPCKYV

SEQ ID NO: 3260066 - protein, 20 aa, Plasmodium falciparum
GGSCQKLFRHIPLNYAKYLL

SEQ ID NO: 3260067 - protein, 18 aa, Plasmodium falciparum
GGSSNMYPHVPNYTSSSV

SEQ ID NO: 3260068 - protein, 18 aa, Plasmodium falciparum
GGVAPGWGLISGLGYVGW

SEQ ID NO: 3260069 - protein, 22 aa, Plasmodium falciparum
GGVGICTLCSILVSNIGIGYAV

SEQ ID NO: 3260070 - protein, 23 aa, Plasmodium falciparum
GGVGICTLCSLLVSNIGIGYAVT

SEQ ID NO: 3260071 - protein, 20 aa, Plasmodium falciparum
GGVGKRLPFFNFINKLYDEI

SEQ ID NO: 3260072 - protein, 27 aa, Plasmodium falciparum
GGYYISLAHFEFFFLARELIYSKNSTT

SEQ ID NO: 3260073 - protein, 26 aa, Plasmodium falciparum
GHDHYSCSLSSAIYDMCSEAEKKEID

SEQ ID NO: 3260074 - protein, 21 aa, Plasmodium falciparum
GHEIFSFVFLLFFYIKNPYLS

SEQ ID NO: 3260075 - protein, 21 aa, Plasmodium falciparum
GHFYCSILVLILVTTLYKEII

SEQ ID NO: 3260076 - protein, 18 aa, Plasmodium falciparum
GHHTMCFCKIDENNTKEK

SEQ ID NO: 3260077 - protein, 22 aa, Plasmodium falciparum
GHINDIRYYFLLFNKGYMDENV

SEQ ID NO: 3260078 - protein, 24 aa, Plasmodium falciparum
GHMSWEWEPCVALRSVITPFIYYV

SEQ ID NO: 3260079 - protein, 19 aa, Plasmodium falciparum
GHQLICYFYGNKIEKVKNM

SEQ ID NO: 3260080 - protein, 19 aa, Plasmodium falciparum
GHSAYSYDLSISFQELPIN

SEQ ID NO: 3260081 - protein, 29 aa, Plasmodium falciparum
GHTCLKWKDHAKWTMLVSEEFFSQKRVEE

SEQ ID NO: 3260082 - protein, 27 aa, Plasmodium falciparum
GHTFNKCGFKRLALFCYSNVLKKYEQK

SEQ ID NO: 3260083 - protein, 25 aa, Plasmodium falciparum
GHVIKEPYVNLLIKCLSQSKNKDQF

SEQ ID NO: 3260084 - protein, 18 aa, Plasmodium falciparum
GHVNESFMVLSTHLPYND

SEQ ID NO: 3260085 - protein, 17 aa, Plasmodium falciparum
GIACFFMAFVTGANDIA

SEQ ID NO: 3260086 - protein, 17 aa, Plasmodium falciparum
GIAIWLSIALYSAMILF

SEQ ID NO: 3260087 - protein, 17 aa, Plasmodium falciparum
GICALHISPRNLFQSFL

SEQ ID NO: 3260088 - protein, 17 aa, Plasmodium falciparum
GICHLDFSIDNILISKN

SEQ ID NO: 3260089 - protein, 24 aa, Plasmodium falciparum
GICSCSVGSAFLTILGFAFAKAAA

SEQ ID NO: 3260090 - protein, 22 aa, Plasmodium falciparum
GICTALARSFADIGDIIRGKDL

SEQ ID NO: 3260091 - protein, 18 aa, Plasmodium falciparum
GICTCSVGSLFLTLIGLA

SEQ ID NO: 3260092 - protein, 24 aa, Plasmodium falciparum
GIDGGGLFKEFIILLCREIFHENF

SEQ ID NO: 3260093 - protein, 21 aa, Plasmodium falciparum
GIDICDVYKSFTIFSFLSILF

SEQ ID NO: 3260094 - protein, 18 aa, Plasmodium falciparum
GIDKLFINNFFNYINNHS

SEQ ID NO: 3260095 - protein, 17 aa, Plasmodium falciparum
GIEEIKNSLNVHSIFNI

SEQ ID NO: 3260096 - protein, 28 aa, Plasmodium falciparum
GIENARIFLLWILLNIFFSFSIIYIYGW

SEQ ID NO: 3260097 - protein, 17 aa, Plasmodium falciparum
GIFEFMLHCTINLKTIY

SEQ ID NO: 3260098 - protein, 25 aa, Plasmodium falciparum
GIFISHFRSLLGLCSIFSDCIYNIF

SEQ ID NO: 3260099 - protein, 17 aa, Plasmodium falciparum
GIFKGIRKEEWKCRNEC

SEQ ID NO: 3260100 - protein, 22 aa, Plasmodium falciparum
GIGSFLLSCMVLHFLQMHTSTF

SEQ ID NO: 3260101 - protein, 19 aa, Plasmodium falciparum
GIHWNFFLTLCTTFLISNI

SEQ ID NO: 3260102 - protein, 23 aa, Plasmodium falciparum
GIIKHSINLLLRVFKNNNSKKMK

SEQ ID NO: 3260103 - protein, 21 aa, Plasmodium falciparum
GIIKLKHRNGKNVKYTCHKEC

SEQ ID NO: 3260104 - protein, 24 aa, Plasmodium falciparum
GIIPCLGYVTTLFVDKKANKYFYI

SEQ ID NO: 3260105 - protein, 25 aa, Plasmodium falciparum
GIKEGIKVLLNRLNTDFGLSPVRIK

SEQ ID NO: 3260106 - protein, 18 aa, Plasmodium falciparum
GIKFGCFEQFPFVEIIGG

SEQ ID NO: 3260107 - protein, 18 aa, Plasmodium falciparum
GIKFLTYYKNCLLYRPFI

SEQ ID NO: 3260108 - protein, 23 aa, Plasmodium falciparum
GIKPKRFTVEWVEANKERERAEN

SEQ ID NO: 3260109 - protein, 22 aa, Plasmodium falciparum
GIKQCVLCLLHFFKTISEHASE

SEQ ID NO: 3260110 - protein, 23 aa, Plasmodium falciparum
GILLEALIYKCIQYDIINTDIRN

SEQ ID NO: 3260111 - protein, 26 aa, Plasmodium falciparum
GILLIPCLIGYAIYALFYFKYKSWYS

SEQ ID NO: 3260112 - protein, 18 aa, Plasmodium falciparum
GILLKIKNNEKINRNRIF

SEQ ID NO: 3260113 - protein, 21 aa, Plasmodium falciparum
GILNICLNVPVYSPLEIMVKH

SEQ ID NO: 3260114 - protein, 22 aa, Plasmodium falciparum
GILNVRRSDYGFILFDNQKVHI

SEQ ID NO: 3260115 - protein, 17 aa, Plasmodium falciparum
GILTAYDAQKMKLKKAV

SEQ ID NO: 3260116 - protein, 18 aa, Plasmodium falciparum
GILWMPIAITSFLSSQCI

SEQ ID NO: 3260117 - protein, 25 aa, Plasmodium falciparum
GINDEIKRNIPFYINSNNNNNNNNY

SEQ ID NO: 3260118 - protein, 20 aa, Plasmodium falciparum
GINDEIRRNGDIGINGNIGI

SEQ ID NO: 3260119 - protein, 26 aa, Plasmodium falciparum
GINKFSVCLEYLFLVSPKDLYNSGRN

SEQ ID NO: 3260120 - protein, 29 aa, Plasmodium falciparum
GINLPLHRSHILLILSLPTYYTFYEFFLL

SEQ ID NO: 3260121 - protein, 17 aa, Plasmodium falciparum
GINNNFYSPFISFDICN

SEQ ID NO: 3260122 - protein, 17 aa, Plasmodium falciparum
GINPRSGSGYTTSKSFS

SEQ ID NO: 3260123 - protein, 18 aa, Plasmodium falciparum
GIPEGCYFTTLEGVLQIE

SEQ ID NO: 3260124 - protein, 23 aa, Plasmodium falciparum
GIPKEILEIFIYHRLDGYCLKYI

SEQ ID NO: 3260125 - protein, 17 aa, Plasmodium falciparum
GIPLYFDSSALLICIMK

SEQ ID NO: 3260126 - protein, 22 aa, Plasmodium falciparum
GIQQCCPEIFNPFVAKNIYTEV

SEQ ID NO: 3260127 - protein, 20 aa, Plasmodium falciparum
GIRPDYLYIMFSKNANQYYS

SEQ ID NO: 3260128 - protein, 28 aa, Plasmodium falciparum
GIRSDPIRLSIRREKVFTDSYYQLRNKS

SEQ ID NO: 3260129 - protein, 21 aa, Plasmodium falciparum
GISCEICKNLSLCGVHEIGIY

SEQ ID NO: 3260130 - protein, 17 aa, Plasmodium falciparum
GISHGFKTLKFNKNSEH

SEQ ID NO: 3260131 - protein, 24 aa, Plasmodium falciparum
GISKGCSWCKSVSFRKYFSEDYFW

SEQ ID NO: 3260132 - protein, 25 aa, Plasmodium falciparum
GISKKAKLIICKALNNNNAGYISDI

SEQ ID NO: 3260133 - protein, 30 aa, Plasmodium falciparum
GISQFRFLKNLLLVHGRLSYRRISKLVVYM

SEQ ID NO: 3260134 - protein, 33 aa, Plasmodium falciparum
GITALEQFEEYLLCYPSFLSSLLTMNNLRKYNP

SEQ ID NO: 3260135 - protein, 19 aa, Plasmodium falciparum
GIVESCTFGGSEKEKKRNS

SEQ ID NO: 3260136 - protein, 19 aa, Plasmodium falciparum
GIVLSCFSLLFNYTNLVTL

SEQ ID NO: 3260137 - protein, 25 aa, Plasmodium falciparum
GIYALCFLSLLLLDLFNKGKQKSSH

SEQ ID NO: 3260138 - protein, 24 aa, Plasmodium falciparum
GIYGHCSQELVNLLLTGRACSNVF

SEQ ID NO: 3260139 - protein, 18 aa, Plasmodium falciparum
GIYVWKPGALKVAITAAL

SEQ ID NO: 3260140 - protein, 20 aa, Plasmodium falciparum
GKCENNCIYYFLKHFYHSLL

SEQ ID NO: 3260141 - protein, 27 aa, Plasmodium falciparum
GKCGYIYSFLFCKNIWINYKEKKYIIL

SEQ ID NO: 3260142 - protein, 19 aa, Plasmodium falciparum
GKCLYEYYSKNKATLGKNG

SEQ ID NO: 3260143 - protein, 27 aa, Plasmodium falciparum
GKDINLLICPKKLFHFYEKLKKVEEEK

SEQ ID NO: 3260144 - protein, 19 aa, Plasmodium falciparum
GKDIWKGMICALTHGVTNT

SEQ ID NO: 3260145 - protein, 19 aa, Plasmodium falciparum
GKDIWKGMLCALQEAGGKK

SEQ ID NO: 3260146 - protein, 18 aa, Plasmodium falciparum
GKDNILMNSFDVPYKAKE

SEQ ID NO: 3260147 - protein, 20 aa, Plasmodium falciparum
GKDRYCDLNRYDCKRTISAK

SEQ ID NO: 3260148 - protein, 18 aa, Plasmodium falciparum
GKEFFLVSLIPARNLQIL

SEQ ID NO: 3260149 - protein, 17 aa, Plasmodium falciparum
GKEFMLQDFKRWLEDSE

SEQ ID NO: 3260150 - protein, 21 aa, Plasmodium falciparum
GKEIWDGMVCALCYDTKTKEF

SEQ ID NO: 3260151 - protein, 20 aa, Plasmodium falciparum
GKENNIVLCLLDMLEKKATP

SEQ ID NO: 3260152 - protein, 27 aa, Plasmodium falciparum
GKFICPLRLPLCVSEFPSEKIEECEID

SEQ ID NO: 3260153 - protein, 19 aa, Plasmodium falciparum
GKFIPCFINHKIVGNLHKI

SEQ ID NO: 3260154 - protein, 23 aa, Plasmodium falciparum
GKGKNSLICSVYNIRECNFTLLK

SEQ ID NO: 3260155 - protein, 18 aa, Plasmodium falciparum
GKGSKCIKGCVDKWVQQK

SEQ ID NO: 3260156 - protein, 23 aa, Plasmodium falciparum
GKGSLYYTRRKYLFIKRKKENDM

SEQ ID NO: 3260157 - protein, 18 aa, Plasmodium falciparum
GKGYDILFGYPLPNNELI

SEQ ID NO: 3260158 - protein, 19 aa, Plasmodium falciparum
GKHFNMVDVYFCFESFVEK

SEQ ID NO: 3260159 - protein, 17 aa, Plasmodium falciparum
GKIIIRAIISLNYISKD

SEQ ID NO: 3260160 - protein, 19 aa, Plasmodium falciparum
GKIKEWAGIQLKSQVEGGG

SEQ ID NO: 3260161 - protein, 23 aa, Plasmodium falciparum
GKIKTCLFHSLKIEKVDLKILNL

SEQ ID NO: 3260162 - protein, 19 aa, Plasmodium falciparum
GKINFPHFMILPKDIHDIF

SEQ ID NO: 3260163 - protein, 23 aa, Plasmodium falciparum
GKIPDDFLHQMFYTFGDYKDILF

SEQ ID NO: 3260164 - protein, 23 aa, Plasmodium falciparum
GKIPDGFLRQMFYTLADYKDILE

SEQ ID NO: 3260165 - protein, 24 aa, Plasmodium falciparum
GKIPNIGSCYFVIIGHMKPIQLYV

SEQ ID NO: 3260166 - protein, 17 aa, Plasmodium falciparum
GKISSFYKSTNSKVIEV

SEQ ID NO: 3260167 - protein, 23 aa, Plasmodium falciparum
GKIYKKVMKYYFIDYIQKVINTN

SEQ ID NO: 3260168 - protein, 17 aa, Plasmodium falciparum
GKKFFIFERLIKERKYI

SEQ ID NO: 3260169 - protein, 18 aa, Plasmodium falciparum
GKKFKGVRFLNILRYTRF

SEQ ID NO: 3260170 - protein, 17 aa, Plasmodium falciparum
GKKGRKGKNKENEEKVE

SEQ ID NO: 3260171 - protein, 23 aa, Plasmodium falciparum
GKKIKLVIDLSRILYLLEEGLQN

SEQ ID NO: 3260172 - protein, 23 aa, Plasmodium falciparum
GKKIKSFKIYRVNLLCDKIRVRA

SEQ ID NO: 3260173 - protein, 23 aa, Plasmodium falciparum
GKKIPAPPPFLLKKMGDKSKCVL

SEQ ID NO: 3260174 - protein, 26 aa, Plasmodium falciparum
GKKKCNRDCKCFKKWVEQKKEKEWKA

SEQ ID NO: 3260175 - protein, 18 aa, Plasmodium falciparum
GKKKRALAQVFLERGNNN

SEQ ID NO: 3260176 - protein, 23 aa, Plasmodium falciparum
GKKKSFFELWSLFYEIMEEKVYK

SEQ ID NO: 3260177 - protein, 19 aa, Plasmodium falciparum
GKKLLLENFHLINFNIDKF

SEQ ID NO: 3260178 - protein, 19 aa, Plasmodium falciparum
GKKLNIKKLVNYFASDFRN

SEQ ID NO: 3260179 - protein, 21 aa, Plasmodium falciparum
GKKLTQWLMQDWKLIEDDEWE

SEQ ID NO: 3260180 - protein, 30 aa, Plasmodium falciparum
GKKNIYFWLVQICFYASILCSNIISIVIVS

SEQ ID NO: 3260181 - protein, 18 aa, Plasmodium falciparum
GKKNPKCSCYGEDCEEIF

SEQ ID NO: 3260182 - protein, 29 aa, Plasmodium falciparum
GKKNYLPHVKLEMGFCVLFQIEKNEDLNV

SEQ ID NO: 3260183 - protein, 21 aa, Plasmodium falciparum
GKKQMKEFMVMSYPERTIQYK

SEQ ID NO: 3260184 - protein, 18 aa, Plasmodium falciparum
GKKRITLDMDKIEMESED

SEQ ID NO: 3260185 - protein, 24 aa, Plasmodium falciparum
GKKRSSGALSIFGLIRKSSNDNNK

SEQ ID NO: 3260186 - protein, 20 aa, Plasmodium falciparum
GKLASVIGCISVKRPQDLKF

SEQ ID NO: 3260187 - protein, 17 aa, Plasmodium falciparum
GKLFCNYGSMFGENVDN

SEQ ID NO: 3260188 - protein, 23 aa, Plasmodium falciparum
GKLKKDKFFNMGIQNFYNKKKNF

SEQ ID NO: 3260189 - protein, 24 aa, Plasmodium falciparum
GKLKRNEIVYALNILENARACSIK

SEQ ID NO: 3260190 - protein, 19 aa, Plasmodium falciparum
GKLLFSRILDKYVNPPFHL

SEQ ID NO: 3260191 - protein, 19 aa, Plasmodium falciparum
GKLRHFFSILLKSLVIPIA

SEQ ID NO: 3260192 - protein, 18 aa, Plasmodium falciparum
GKLSDIYISYAYYYYNKN

SEQ ID NO: 3260193 - protein, 19 aa, Plasmodium falciparum
GKLSSKFFLIKRKMKENKK

SEQ ID NO: 3260194 - protein, 24 aa, Plasmodium falciparum
GKLYIPLKFPFYIYIENNFKINDT

SEQ ID NO: 3260195 - protein, 19 aa, Plasmodium falciparum
GKMKDLCFDLKDICSKLEL

SEQ ID NO: 3260196 - protein, 18 aa, Plasmodium falciparum
GKMKTCIKDATQDKNSSE

SEQ ID NO: 3260197 - protein, 21 aa, Plasmodium falciparum
GKMKVSFDLLYKDNINEEKNL

SEQ ID NO: 3260198 - protein, 18 aa, Plasmodium falciparum
GKMNELLCTSQVNKKLQY

SEQ ID NO: 3260199 - protein, 24 aa, Plasmodium falciparum
GKNCLKCGGILGGGIPGLGVLGAY

SEQ ID NO: 3260200 - protein, 18 aa, Plasmodium falciparum
GKNIFWWVLPLDKFYYKA

SEQ ID NO: 3260201 - protein, 25 aa, Plasmodium falciparum
GKNIKIIVCGCVPQAEKDMEIFENV

SEQ ID NO: 3260202 - protein, 18 aa, Plasmodium falciparum
GKNKFLCTHFIKDKEDRL

SEQ ID NO: 3260203 - protein, 24 aa, Plasmodium falciparum
GKNKVSYCNILLKSLNIINNLMNL

SEQ ID NO: 3260204 - protein, 23 aa, Plasmodium falciparum
GKNLQYFVCSSIIITFNVFNINI

SEQ ID NO: 3260205 - protein, 31 aa, Plasmodium falciparum
GKNVMPYHPFFWKWVHDMLHDSVEWKTELSK

SEQ ID NO: 3260206 - protein, 18 aa, Plasmodium falciparum
GKNYVLNSYGKVNGINDL

SEQ ID NO: 3260207 - protein, 17 aa, Plasmodium falciparum
GKPGSKFENAYGTSKFN

SEQ ID NO: 3260208 - protein, 19 aa, Plasmodium falciparum
GKQKLYPHFKNIRDHDVYE

SEQ ID NO: 3260209 - protein, 20 aa, Plasmodium falciparum
GKRAIKYNRIFGLSNKIYGE

SEQ ID NO: 3260210 - protein, 22 aa, Plasmodium falciparum
GKRCFILESFYSFLKYYCFYAM

SEQ ID NO: 3260211 - protein, 17 aa, Plasmodium falciparum
GKSCGYPNFNRNNMDAL

SEQ ID NO: 3260212 - protein, 34 aa, Plasmodium falciparum
GKSDGSICIPPRRRKLYLGGFKRLTDGTSVSSEP

SEQ ID NO: 3260213 - protein, 20 aa, Plasmodium falciparum
GKSFLKQIIENFVHIQNEEL

SEQ ID NO: 3260214 - protein, 21 aa, Plasmodium falciparum
GKSGVHNICCVYIRKHKKFLK

SEQ ID NO: 3260215 - protein, 21 aa, Plasmodium falciparum
GKSIDELIKMRIIQTQETYNN

SEQ ID NO: 3260216 - protein, 24 aa, Plasmodium falciparum
GKSIEWFPVISLYYWEINLLDIQL

SEQ ID NO: 3260217 - protein, 20 aa, Plasmodium falciparum
GKSSERKICSFIKDKMDISS

SEQ ID NO: 3260218 - protein, 18 aa, Plasmodium falciparum
GKSTILKLIERLYDPTEG

SEQ ID NO: 3260219 - protein, 25 aa, Plasmodium falciparum
GKSYFPGVIFLMLFFSCFREKFIMR

SEQ ID NO: 3260220 - protein, 25 aa, Plasmodium falciparum
GKTEKLEKFLGLYKENNEAMDFYKS

SEQ ID NO: 3260221 - protein, 24 aa, Plasmodium falciparum
GKTHVACAIIDSWHKQNSNKKILA

SEQ ID NO: 3260222 - protein, 18 aa, Plasmodium falciparum
GKTICYCWSILQELNKNV

SEQ ID NO: 3260223 - protein, 18 aa, Plasmodium falciparum
GKTKCIKNNINMNIEKFT

SEQ ID NO: 3260224 - protein, 23 aa, Plasmodium falciparum
GKTNYFSRVNFKWYKRKKNKSNS

SEQ ID NO: 3260225 - protein, 34 aa, Plasmodium falciparum
GKTTSRLICLLLKCFKYKESALLIGETGCGKTTC

SEQ ID NO: 3260226 - protein, 27 aa, Plasmodium falciparum
GKVCMIGDGINDCFALKTADLGLSLCT

SEQ ID NO: 3260227 - protein, 17 aa, Plasmodium falciparum
GKVKNVINYAILLCIYI

SEQ ID NO: 3260228 - protein, 17 aa, Plasmodium falciparum
GKVLSIYNKFVLRKYEI

SEQ ID NO: 3260229 - protein, 22 aa, Plasmodium falciparum
GKVNRFTRCYLLNNNEFRQYDK

SEQ ID NO: 3260230 - protein, 17 aa, Plasmodium falciparum
GKWEIIDSKYLYVGDII

SEQ ID NO: 3260231 - protein, 27 aa, Plasmodium falciparum
GKYFLIKKYEKIIALAYFTRFNTYLIF

SEQ ID NO: 3260232 - protein, 18 aa, Plasmodium falciparum
GKYKYGRYPEWNCNSQIH

SEQ ID NO: 3260233 - protein, 17 aa, Plasmodium falciparum
GKYLRKYGVLRKFNIEW

SEQ ID NO: 3260234 - protein, 19 aa, Plasmodium falciparum
GKYRKPIFTNHTFMAYYVL

SEQ ID NO: 3260235 - protein, 28 aa, Plasmodium falciparum
GLAILCGIFSEFLSWLFVYRNEKFKKLN

SEQ ID NO: 3260236 - protein, 26 aa, Plasmodium falciparum
GLCIPPRRRKLYVGKLEEWASDEATK

SEQ ID NO: 3260237 - protein, 18 aa, Plasmodium falciparum
GLCRDFRLSEVDVKKLGL

SEQ ID NO: 3260238 - protein, 26 aa, Plasmodium falciparum
GLCVHRIIYCLLYIFNFISLSHINIL

SEQ ID NO: 3260239 - protein, 19 aa, Plasmodium falciparum
GLDAWKAAALVTAKELAEK

SEQ ID NO: 3260240 - protein, 27 aa, Plasmodium falciparum
GLDLKASFKNYAFEFLRKLEIYAKSNL

SEQ ID NO: 3260241 - protein, 30 aa, Plasmodium falciparum
GLEKAHLNEIEFLYNLLINKIFQKDTYAVR

SEQ ID NO: 3260242 - protein, 35 aa, Plasmodium falciparum
GLFDIPSLIDEVGWIPVIFGNVFVCSVAVFCSLMI

SEQ ID NO: 3260243 - protein, 24 aa, Plasmodium falciparum
GLFKDETCCLNRCTNKRIINDKKL

SEQ ID NO: 3260244 - protein, 18 aa, Plasmodium falciparum
GLGGRLGANIKRDKQKEK

SEQ ID NO: 3260245 - protein, 21 aa, Plasmodium falciparum
GLGICKHIKFNASNIEGKIKG

SEQ ID NO: 3260246 - protein, 19 aa, Plasmodium falciparum
GLGIYAWRSAALVTAIQKG

SEQ ID NO: 3260247 - protein, 18 aa, Plasmodium falciparum
GLGTYGWKIAATATAMEL

SEQ ID NO: 3260248 - protein, 19 aa, Plasmodium falciparum
GLGTYGWKSAAIATATNAA

SEQ ID NO: 3260249 - protein, 18 aa, Plasmodium falciparum
GLIARSIFNDTFSVYMDR

SEQ ID NO: 3260250 - protein, 22 aa, Plasmodium falciparum
GLICLNKYKLFFSENQKNILPN

SEQ ID NO: 3260251 - protein, 25 aa, Plasmodium falciparum
GLIYILCILLFLLTSLFRSIVYLIN

SEQ ID NO: 3260252 - protein, 18 aa, Plasmodium falciparum
GLKAMIKVNGFDYIYIYI

SEQ ID NO: 3260253 - protein, 19 aa, Plasmodium falciparum
GLKWLKAKGGNNITVLQFN

SEQ ID NO: 3260254 - protein, 17 aa, Plasmodium falciparum
GLLCGYGAYELVKAAIV

SEQ ID NO: 3260255 - protein, 20 aa, Plasmodium falciparum
GLLGCFLITCSMFYFMNQVI

SEQ ID NO: 3260256 - protein, 24 aa, Plasmodium falciparum
GLLLARTFLSVSFVQSLRGIIGLI

SEQ ID NO: 3260257 - protein, 17 aa, Plasmodium falciparum
GLLLLECTLNMFDINMS

SEQ ID NO: 3260258 - protein, 18 aa, Plasmodium falciparum
GLLNHLAQYCHIHNLSSN

SEQ ID NO: 3260259 - protein, 17 aa, Plasmodium falciparum
GLMKRNIFVFGKYNNIL

SEQ ID NO: 3260260 - protein, 19 aa, Plasmodium falciparum
GLQRASCGSTRFFIPSEIV

SEQ ID NO: 3260261 - protein, 21 aa, Plasmodium falciparum
GLRKAARLGVIPGPANSCDLD

SEQ ID NO: 3260262 - protein, 20 aa, Plasmodium falciparum
GLSSPGNPICHEFGINFNII

SEQ ID NO: 3260263 - protein, 24 aa, Plasmodium falciparum
GLVFSICVYLPFKGSSYDMEHIYE

SEQ ID NO: 3260264 - protein, 20 aa, Plasmodium falciparum
GLVGIELLKYVNYYDNIQAY

SEQ ID NO: 3260265 - protein, 19 aa, Plasmodium falciparum
GLVNLNDCLLYHCRNRRAY

SEQ ID NO: 3260266 - protein, 19 aa, Plasmodium falciparum
GLVSLIGCIYLKVTEKKKN

SEQ ID NO: 3260267 - protein, 18 aa, Plasmodium falciparum
GLYECFKKNGSIESFFLG

SEQ ID NO: 3260268 - protein, 19 aa, Plasmodium falciparum
GLYGPMKGKIDNLSNKPTD

SEQ ID NO: 3260269 - protein, 22 aa, Plasmodium falciparum
GLYKGLIPMLAHIVSKKSIYYF

SEQ ID NO: 3260270 - protein, 17 aa, Plasmodium falciparum
GLYLLMYYILKEHFDIE

SEQ ID NO: 3260271 - protein, 25 aa, Plasmodium falciparum
GLYNLSFVFYFLFFYYIKAYNLNKI

SEQ ID NO: 3260272 - protein, 18 aa, Plasmodium falciparum
GMEILKKYINNFKELEIE

SEQ ID NO: 3260273 - protein, 24 aa, Plasmodium falciparum
GMFLKILIVLLILWEIQNMFEIIY

SEQ ID NO: 3260274 - protein, 23 aa, Plasmodium falciparum
GMFPKMLIALQIIWIFLNAPQKI

SEQ ID NO: 3260275 - protein, 18 aa, Plasmodium falciparum
GMLARQIFTKGGFAEYAD

SEQ ID NO: 3260276 - protein, 23 aa, Plasmodium falciparum
GMNNFKLLPKRNMKRNRKKNLLK

SEQ ID NO: 3260277 - protein, 22 aa, Plasmodium falciparum
GMRNVFTYGNFFNIYNFDLKKL

SEQ ID NO: 3260278 - protein, 21 aa, Plasmodium falciparum
GMYHFRGSMLYVDNSSFPYND

SEQ ID NO: 3260279 - protein, 17 aa, Plasmodium falciparum
GNAFHCILFPLLFVSFS

SEQ ID NO: 3260280 - protein, 18 aa, Plasmodium falciparum
GNCMLKKSKIFEFLTSSF

SEQ ID NO: 3260281 - protein, 20 aa, Plasmodium falciparum
GNDDFSCMYKIKEQDINDLI

SEQ ID NO: 3260282 - protein, 25 aa, Plasmodium falciparum
GNDNIKVIGKRGAYIKNVIDNNNGT

SEQ ID NO: 3260283 - protein, 19 aa, Plasmodium falciparum
GNENLHIIKKGKVENYFND

SEQ ID NO: 3260284 - protein, 25 aa, Plasmodium falciparum
GNERFKIGQKWNYKYIYKIGKNLYI

SEQ ID NO: 3260285 - protein, 22 aa, Plasmodium falciparum
GNESFFTFIDFLRTKKVCNRRN

SEQ ID NO: 3260286 - protein, 19 aa, Plasmodium falciparum
GNETLTWTVDIIDYIDKQI

SEQ ID NO: 3260287 - protein, 21 aa, Plasmodium falciparum
GNFCETSKFGYTFINKIKNNQ

SEQ ID NO: 3260288 - protein, 17 aa, Plasmodium falciparum
GNFFQLREDWWNANRND

SEQ ID NO: 3260289 - protein, 24 aa, Plasmodium falciparum
GNFFSLICVLLFTVMIHKKKSGCQ

SEQ ID NO: 3260290 - protein, 24 aa, Plasmodium falciparum
GNFGIFFEAYFKMLENIKNRNNCE

SEQ ID NO: 3260291 - protein, 26 aa, Plasmodium falciparum
GNFKFLMNFFYPLLIFYIDLYQKEEE

SEQ ID NO: 3260292 - protein, 19 aa, Plasmodium falciparum
GNFKRTASVTSNIYNDLFL

SEQ ID NO: 3260293 - protein, 19 aa, Plasmodium falciparum
GNFLNCFLSSLKNIYSEWI

SEQ ID NO: 3260294 - protein, 23 aa, Plasmodium falciparum
GNFMLYNNMCVIMNKLNINCNNF

SEQ ID NO: 3260295 - protein, 19 aa, Plasmodium falciparum
GNFWYIFSTMFRDYYYSFL

SEQ ID NO: 3260296 - protein, 25 aa, Plasmodium falciparum
GNGARGPICTLAWQYSESRGNVVSA

SEQ ID NO: 3260297 - protein, 18 aa, Plasmodium falciparum
GNGFQIFCCNHLINNNEH

SEQ ID NO: 3260298 - protein, 20 aa, Plasmodium falciparum
GNGLCFSAYYHILVPHHRHI

SEQ ID NO: 3260299 - protein, 50 aa, Plasmodium falciparum
GNGNDLYSFQSCQPCVGKIPCIPKECWDIIREHIKLKIDNPFEHLSTITD

SEQ ID NO: 3260300 - protein, 18 aa, Plasmodium falciparum
GNGSNSKTLKRCNKKKNI

SEQ ID NO: 3260301 - protein, 19 aa, Plasmodium falciparum
GNGVYCFTYNNFSDVTISD

SEQ ID NO: 3260302 - protein, 20 aa, Plasmodium falciparum
GNHIMCPKIRNNQNLKEDVT

SEQ ID NO: 3260303 - protein, 44 aa, Plasmodium falciparum
GNHLKKRFSPTCLIKYICRCFVFKVLIGTSLIRFKNSDLWGKLL

SEQ ID NO: 3260304 - protein, 27 aa, Plasmodium falciparum
GNICKRDCQNKCNCVGEWIKLKKEEWE

SEQ ID NO: 3260305 - protein, 17 aa, Plasmodium falciparum
GNIFSGSTLEYFFLLLK

SEQ ID NO: 3260306 - protein, 18 aa, Plasmodium falciparum
GNIIHSYASFKIQDLVLI

SEQ ID NO: 3260307 - protein, 23 aa, Plasmodium falciparum
GNIKYAIKLIKIFNYELLHFPNL

SEQ ID NO: 3260308 - protein, 23 aa, Plasmodium falciparum
GNIPEEFLRQMFYTLGDYRDILV

SEQ ID NO: 3260309 - protein, 21 aa, Plasmodium falciparum
GNIRALSCTEYKTPESRFEDI

SEQ ID NO: 3260310 - protein, 24 aa, Plasmodium falciparum
GNIYILDFSNIFFKFNKNHLDSYF

SEQ ID NO: 3260311 - protein, 24 aa, Plasmodium falciparum
GNIYKCLETYILKSVEHNKFIDSH

SEQ ID NO: 3260312 - protein, 23 aa, Plasmodium falciparum
GNKFMKKRCKVEQYKVCDSVLFP

SEQ ID NO: 3260313 - protein, 21 aa, Plasmodium falciparum
GNKGLCVSLCNYTDYNYLYYF

SEQ ID NO: 3260314 - protein, 25 aa, Plasmodium falciparum
GNKKFRSNNFLIIYILFTLYSFLPM

SEQ ID NO: 3260315 - protein, 24 aa, Plasmodium falciparum
GNKLKLRIIVILLFLIYIIIFSSQ

SEQ ID NO: 3260316 - protein, 25 aa, Plasmodium falciparum
GNLFYDCYYTEGLIDQGEENEEEKF

SEQ ID NO: 3260317 - protein, 18 aa, Plasmodium falciparum
GNLIPYIISDYFNYYFYN

SEQ ID NO: 3260318 - protein, 22 aa, Plasmodium falciparum
GNLLYRVVSLCIENNYNMVPVI

SEQ ID NO: 3260319 - protein, 18 aa, Plasmodium falciparum
GNLYWLQLHFIRSRFQLS

SEQ ID NO: 3260320 - protein, 25 aa, Plasmodium falciparum
GNMIIRLSSVLTFFTAGLIYILFCS

SEQ ID NO: 3260321 - protein, 18 aa, Plasmodium falciparum
GNNIFMINKIMKRNHIHD

SEQ ID NO: 3260322 - protein, 25 aa, Plasmodium falciparum
GNNKCIYFFEYELRKKTQSFRNKNS

SEQ ID NO: 3260323 - protein, 21 aa, Plasmodium falciparum
GNNYKCILGINKKKLANLDEI

SEQ ID NO: 3260324 - protein, 23 aa, Plasmodium falciparum
GNPFFLFTLFICIFQNFQKYPFY

SEQ ID NO: 3260325 - protein, 21 aa, Plasmodium falciparum
GNPICHEFGINFNIIDPGNGF

SEQ ID NO: 3260326 - protein, 18 aa, Plasmodium falciparum
GNPMKLFTSDIMNNYGNI

SEQ ID NO: 3260327 - protein, 29 aa, Plasmodium falciparum
GNSLDKGTCMKIRIKLGMILPDDKIAPPD

SEQ ID NO: 3260328 - protein, 26 aa, Plasmodium falciparum
GNSMCKAFCLKLGTNIAHGGRTLSVD

SEQ ID NO: 3260329 - protein, 40 aa, Plasmodium falciparum
GNSNLIKEFLIKMKPTFWCLQDIIIYSSLIFHSTYMRYEK

SEQ ID NO: 3260330 - protein, 22 aa, Plasmodium falciparum
GNSQGYRFYALEDEKYARGQYI

SEQ ID NO: 3260331 - protein, 36 aa, Plasmodium falciparum
GNSTFKTTCIIIGCILRCIFSPVFGLLNFSASITEG

SEQ ID NO: 3260332 - protein, 33 aa, Plasmodium falciparum
GNSTMQFGERFWQGFFFGVIIFFVLSKYIRSYK

SEQ ID NO: 3260333 - protein, 22 aa, Plasmodium falciparum
GNTFFDQYIDLHFYNLQKLDNF

SEQ ID NO: 3260334 - protein, 19 aa, Plasmodium falciparum
GNVIFCMILSIYLYIIQNW

SEQ ID NO: 3260335 - protein, 25 aa, Plasmodium falciparum
GNVIRYFLCRALQIPLFAWLRFSSY

SEQ ID NO: 3260336 - protein, 17 aa, Plasmodium falciparum
GNVPPSLVKKGRKHPVG

SEQ ID NO: 3260337 - protein, 17 aa, Plasmodium falciparum
GPANSCDLEHRFYTNIN

SEQ ID NO: 3260338 - protein, 24 aa, Plasmodium falciparum
GPATDNSICTWVMTKQGAARVIQG

SEQ ID NO: 3260339 - protein, 28 aa, Plasmodium falciparum
GPDGFFRFIWINTRNGFKSFLWKNINIF

SEQ ID NO: 3260340 - protein, 20 aa, Plasmodium falciparum
GPFFCLILFYVYNDKWNIKN

SEQ ID NO: 3260341 - protein, 30 aa, Plasmodium falciparum
GPFKCRDFKTGSGFMCIKIGYGKTNCELND

SEQ ID NO: 3260342 - protein, 19 aa, Plasmodium falciparum
GPGIYGWKTAALAAATKDA

SEQ ID NO: 3260343 - protein, 26 aa, Plasmodium falciparum
GPGLCMLNIIGLDFPVPTFILGDPFM

SEQ ID NO: 3260344 - protein, 20 aa, Plasmodium falciparum
GPGMMKVGIGLPKLLIDEKY

SEQ ID NO: 3260345 - protein, 18 aa, Plasmodium falciparum
GPHGHNILSTGLKIKFLL

SEQ ID NO: 3260346 - protein, 18 aa, Plasmodium falciparum
GPITYTINNWIYKNSDKI

SEQ ID NO: 3260347 - protein, 17 aa, Plasmodium falciparum
GPKCFKILIYEEKEEEY

SEQ ID NO: 3260348 - protein, 26 aa, Plasmodium falciparum
GPLEYCKTCPFNGVNCTVRRGTNGCI

SEQ ID NO: 3260349 - protein, 18 aa, Plasmodium falciparum
GPNNSCSFVEGYNKKGDV

SEQ ID NO: 3260350 - protein, 24 aa, Plasmodium falciparum
GPSVLALKCVLVYREKSEDRKIAL

SEQ ID NO: 3260351 - protein, 23 aa, Plasmodium falciparum
GPVARETFCTWVMQKSTAAANVQ

SEQ ID NO: 3260352 - protein, 24 aa, Plasmodium falciparum
GPVARETFCTWVMQKSTAAANVQR

SEQ ID NO: 3260353 - protein, 20 aa, Plasmodium falciparum
GPYIYEYGDYGGLIVMADDL

SEQ ID NO: 3260354 - protein, 19 aa, Plasmodium falciparum
GQCSIRRNEILDTDEKELN

SEQ ID NO: 3260355 - protein, 19 aa, Plasmodium falciparum
GQFILLFILSHFINKRKEN

SEQ ID NO: 3260356 - protein, 23 aa, Plasmodium falciparum
GQGAKRIRQLFAHARSVAPSIVF

SEQ ID NO: 3260357 - protein, 17 aa, Plasmodium falciparum
GQGIPHYIILEQFLENE

SEQ ID NO: 3260358 - protein, 23 aa, Plasmodium falciparum
GQIITLYFPFIIKKNNKVTYITN

SEQ ID NO: 3260359 - protein, 27 aa, Plasmodium falciparum
GQKTLCLYCLALLKFLENDILKCTNIE

SEQ ID NO: 3260360 - protein, 24 aa, Plasmodium falciparum
GQMIFPMCISKIINMYGGKEESLK

SEQ ID NO: 3260361 - protein, 23 aa, Plasmodium falciparum
GQNFLWNRWMEIQTYILDKYKEE

SEQ ID NO: 3260362 - protein, 18 aa, Plasmodium falciparum
GQPFCSCFENYYFEKKSN

SEQ ID NO: 3260363 - protein, 19 aa, Plasmodium falciparum
GQPFSYLWFLPVDKKLKKE

SEQ ID NO: 3260364 - protein, 20 aa, Plasmodium falciparum
GQPLCKGLWAADSVSSDYET

SEQ ID NO: 3260365 - protein, 18 aa, Plasmodium falciparum
GQTLKSFFRTISYKNVSS

SEQ ID NO: 3260366 - protein, 23 aa, Plasmodium falciparum
GQTNVFSSLSWLNVKYDILEMYK

SEQ ID NO: 3260367 - protein, 19 aa, Plasmodium falciparum
GQYPELFVDDVLHIPKKLS

SEQ ID NO: 3260368 - protein, 25 aa, Plasmodium falciparum
GRCGRSGHISFCYLFYSKEDVEKLS

SEQ ID NO: 3260369 - protein, 24 aa, Plasmodium falciparum
GRCKCPDPPKPCDIVKDLFENKDD

SEQ ID NO: 3260370 - protein, 18 aa, Plasmodium falciparum
GRCTRGICVCSVSSVFLT

SEQ ID NO: 3260371 - protein, 22 aa, Plasmodium falciparum
GREKFPNWKCISGDNTRGSESE

SEQ ID NO: 3260372 - protein, 17 aa, Plasmodium falciparum
GRFLRTFENISLIGQGG

SEQ ID NO: 3260373 - protein, 23 aa, Plasmodium falciparum
GRGARLVRILSEFVGVQDALRDE

SEQ ID NO: 3260374 - protein, 18 aa, Plasmodium falciparum
GRGEIPYVTLSKCQCIAG

SEQ ID NO: 3260375 - protein, 25 aa, Plasmodium falciparum
GRGGSELKGLLSLAKGSGVELAAFP

SEQ ID NO: 3260376 - protein, 18 aa, Plasmodium falciparum
GRGYMMADSCAYNSENDC

SEQ ID NO: 3260377 - protein, 17 aa, Plasmodium falciparum
GRHCSFYKKWIQRKKEE

SEQ ID NO: 3260378 - protein, 18 aa, Plasmodium falciparum
GRHPYHILTSSCNEFNSN

SEQ ID NO: 3260379 - protein, 22 aa, Plasmodium falciparum
GRHVLMSGVWFYLYNQLSFISL

SEQ ID NO: 3260380 - protein, 21 aa, Plasmodium falciparum
GRKFFPLTTTFLIKRISTSID

SEQ ID NO: 3260381 - protein, 18 aa, Plasmodium falciparum
GRKKSVIDDLNFLRYNIL

SEQ ID NO: 3260382 - protein, 24 aa, Plasmodium falciparum
GRKYKSILIEGLRRGIGLHYEVLP

SEQ ID NO: 3260383 - protein, 21 aa, Plasmodium falciparum
GRLKHVLNILNKVKIEINKED

SEQ ID NO: 3260384 - protein, 20 aa, Plasmodium falciparum
GRLNTVILDPIITFNVIFGD

SEQ ID NO: 3260385 - protein, 19 aa, Plasmodium falciparum
GRLTILFMLLFVIQIPIMI

SEQ ID NO: 3260386 - protein, 39 aa, Plasmodium falciparum
GRLYKPTEPVNIFRSHNKFMLKEMMWMSIDYYEEKRWKK

SEQ ID NO: 3260387 - protein, 17 aa, Plasmodium falciparum
GRMLKFVTYKWLYNIIS

SEQ ID NO: 3260388 - protein, 17 aa, Plasmodium falciparum
GRNMYRWDHKCTGCFLS

SEQ ID NO: 3260389 - protein, 18 aa, Plasmodium falciparum
GRNSVFVINSLSKNVNYL

SEQ ID NO: 3260390 - protein, 20 aa, Plasmodium falciparum
GRPILIYKSFFSIKKKNNNN

SEQ ID NO: 3260391 - protein, 19 aa, Plasmodium falciparum
GRPLLGQLAMFGRVPLVLL

SEQ ID NO: 3260392 - protein, 24 aa, Plasmodium falciparum
GRRGFDLYGNIIIWNINFKNLKRL

SEQ ID NO: 3260393 - protein, 25 aa, Plasmodium falciparum
GRVLPFFPKEYFLHSSTHEKKDKMA

SEQ ID NO: 3260394 - protein, 26 aa, Plasmodium falciparum
GRVLRVLRGLNLGGVVLCLAPLTFPA

SEQ ID NO: 3260395 - protein, 20 aa, Plasmodium falciparum
GRVNFPTAFGKISTFNKNKR

SEQ ID NO: 3260396 - protein, 18 aa, Plasmodium falciparum
GRYAYYCQKNIFHHLLKQ

SEQ ID NO: 3260397 - protein, 19 aa, Plasmodium falciparum
GRYIPRNIIPGLLSNCSIV

SEQ ID NO: 3260398 - protein, 17 aa, Plasmodium falciparum
GRYRISVFSLVFRMERF

SEQ ID NO: 3260399 - protein, 20 aa, Plasmodium falciparum
GSANIFKGIRKDVWKCGEYC

SEQ ID NO: 3260400 - protein, 19 aa, Plasmodium falciparum
GSANIFKGIRKEQWKCGKV

SEQ ID NO: 3260401 - protein, 19 aa, Plasmodium falciparum
GSDICKGIEKKETRRWKRF

SEQ ID NO: 3260402 - protein, 23 aa, Plasmodium falciparum
GSDIKYVCIFRDKIKNKKYNVAI

SEQ ID NO: 3260403 - protein, 24 aa, Plasmodium falciparum
GSDVYPATKWKKLGKISTNFTKSF

SEQ ID NO: 3260404 - protein, 24 aa, Plasmodium falciparum
GSEWVFFIFVRLVHAFSCLLYGLA

SEQ ID NO: 3260405 - protein, 26 aa, Plasmodium falciparum
GSFDYKEWNKLYLLCEHLDIRIDTLI

SEQ ID NO: 3260406 - protein, 26 aa, Plasmodium falciparum
GSFIPVDLLLIWEVVRLLQGYLINWD

SEQ ID NO: 3260407 - protein, 17 aa, Plasmodium falciparum
GSFKCLFKNKRNKYVRN

SEQ ID NO: 3260408 - protein, 20 aa, Plasmodium falciparum
GSFNKWTIIGVNEFTNRRGK

SEQ ID NO: 3260409 - protein, 25 aa, Plasmodium falciparum
GSGADNSICPWAMENFFAARKIPGK

SEQ ID NO: 3260410 - protein, 27 aa, Plasmodium falciparum
GSGALGCEFLKLLAISGVSSNMDKISN

SEQ ID NO: 3260411 - protein, 27 aa, Plasmodium falciparum
GSICIPPRRRRLYIQKLHEWASRGGDE

SEQ ID NO: 3260412 - protein, 17 aa, Plasmodium falciparum
GSIFKCTINNKLFACKV

SEQ ID NO: 3260413 - protein, 19 aa, Plasmodium falciparum
GSKFKRKRSIFIVLTVSIC

SEQ ID NO: 3260414 - protein, 26 aa, Plasmodium falciparum
GSKIKSNCIYPLFYGNIFNPDNIIFT

SEQ ID NO: 3260415 - protein, 23 aa, Plasmodium falciparum
GSKKLEHYTMLSSGINISSLRHI

SEQ ID NO: 3260416 - protein, 17 aa, Plasmodium falciparum
GSKNLLLNHKGTNQDNN

SEQ ID NO: 3260417 - protein, 19 aa, Plasmodium falciparum
GSLNMLISYQLYYENYNES

SEQ ID NO: 3260418 - protein, 19 aa, Plasmodium falciparum
GSLRFKLEYFQNALGNVAT

SEQ ID NO: 3260419 - protein, 45 aa, Plasmodium falciparum
GSLRPYDERCIRQSRAMFKVYLCTKLLYDRVCEELALYDVEVIIN

SEQ ID NO: 3260420 - protein, 18 aa, Plasmodium falciparum
GSMLINECYLNIFYSPYK

SEQ ID NO: 3260421 - protein, 26 aa, Plasmodium falciparum
GSMSPRLSYLNVFLSFYRKYYMKNVR

SEQ ID NO: 3260422 - protein, 19 aa, Plasmodium falciparum
GSNGGACAPFRRLNLCVRN

SEQ ID NO: 3260423 - protein, 23 aa, Plasmodium falciparum
GSNHCLYSNFFIDQLLSPLYIKI

SEQ ID NO: 3260424 - protein, 31 aa, Plasmodium falciparum
GSNMYDLRFSNSYDFIYKGMEIISGSQRIHN

SEQ ID NO: 3260425 - protein, 30 aa, Plasmodium falciparum
GSPCIKDCKKKCDCVKAWINLKTKEWEEIK

SEQ ID NO: 3260426 - protein, 17 aa, Plasmodium falciparum
GSPTYAVKFIYLKVSSL

SEQ ID NO: 3260427 - protein, 24 aa, Plasmodium falciparum
GSQCVLEIKEIVAFLHIGLNNKHI

SEQ ID NO: 3260428 - protein, 24 aa, Plasmodium falciparum
GSQICTVLARSFADIGDIIRGKDL

SEQ ID NO: 3260429 - protein, 25 aa, Plasmodium falciparum
GSQIWKGMLCALSYDNETRIMNERV

SEQ ID NO: 3260430 - protein, 28 aa, Plasmodium falciparum
GSRLLCSEKKYLDLILMYIFYFLFFHDS

SEQ ID NO: 3260431 - protein, 26 aa, Plasmodium falciparum
GSSCNKFVFVLLRFFKHDNSFLRYLS

SEQ ID NO: 3260432 - protein, 25 aa, Plasmodium falciparum
GSSCPKSCSSYRKWIKIKKDEYEKQ

SEQ ID NO: 3260433 - protein, 17 aa, Plasmodium falciparum
GSSFLKNYTFYYLKNNV

SEQ ID NO: 3260434 - protein, 25 aa, Plasmodium falciparum
GSSGNWRAGFLMSSMEILFKENMRY

SEQ ID NO: 3260435 - protein, 18 aa, Plasmodium falciparum
GSSIRPVILTGDNAYNCL

SEQ ID NO: 3260436 - protein, 32 aa, Plasmodium falciparum
GSSRGKLCEECRSIPLICCNKNVVNIIGDILC

SEQ ID NO: 3260437 - protein, 17 aa, Plasmodium falciparum
GSTLLNVLNNELHKCLH

SEQ ID NO: 3260438 - protein, 21 aa, Plasmodium falciparum
GSTLLRVGLLTGYGCSTLYKY

SEQ ID NO: 3260439 - protein, 21 aa, Plasmodium falciparum
GSVGLFGGFGIYGWKTAALAA

SEQ ID NO: 3260440 - protein, 25 aa, Plasmodium falciparum
GSVGLLFKKIKTFISYSNVDHRRKI

SEQ ID NO: 3260441 - protein, 25 aa, Plasmodium falciparum
GSVSWSEHYCWCQRVLSEFYTQGDE

SEQ ID NO: 3260442 - protein, 19 aa, Plasmodium falciparum
GSYGEIWYAININKNSQYK

SEQ ID NO: 3260443 - protein, 18 aa, Plasmodium falciparum
GSYMKTCTNDETYRNDGD

SEQ ID NO: 3260444 - protein, 24 aa, Plasmodium falciparum
GSYRLKWNLLMPIFMTMILVVLNF

SEQ ID NO: 3260445 - protein, 26 aa, Plasmodium falciparum
GSYYSLMFSRFFCGFSEAAFITIIPP

SEQ ID NO: 3260446 - protein, 18 aa, Plasmodium falciparum
GTCAKLLGDIMEKKRKRE

SEQ ID NO: 3260447 - protein, 17 aa, Plasmodium falciparum
GTCDAVAPGAAKKAEEE

SEQ ID NO: 3260448 - protein, 25 aa, Plasmodium falciparum
GTDILCVYRIYKILLLKNKNKFLQK

SEQ ID NO: 3260449 - protein, 18 aa, Plasmodium falciparum
GTDNINYIICITTCTILF

SEQ ID NO: 3260450 - protein, 17 aa, Plasmodium falciparum
GTFKKLIVVVKELSDKN

SEQ ID NO: 3260451 - protein, 17 aa, Plasmodium falciparum
GTFSIDECGIFPPTGND

SEQ ID NO: 3260452 - protein, 19 aa, Plasmodium falciparum
GTGTISICASNVLKSNDVH

SEQ ID NO: 3260453 - protein, 23 aa, Plasmodium falciparum
GTIPLPFLRQMFYTLADYKDILF

SEQ ID NO: 3260454 - protein, 23 aa, Plasmodium falciparum
GTIPPDFLRQMFYTLGDYRDICI

SEQ ID NO: 3260455 - protein, 23 aa, Plasmodium falciparum
GTIPTDFLRQMFYTLGDYRDLCV

SEQ ID NO: 3260456 - protein, 19 aa, Plasmodium falciparum
GTLESPVLLNVEHCFITIN

SEQ ID NO: 3260457 - protein, 20 aa, Plasmodium falciparum
GTLKSIGWNFGKFLVDKNGE

SEQ ID NO: 3260458 - protein, 20 aa, Plasmodium falciparum
GTLKVFKLYSKLPMKDQMEL

SEQ ID NO: 3260459 - protein, 22 aa, Plasmodium falciparum
GTNFCPISTYAFLVGSKPTFSV

SEQ ID NO: 3260460 - protein, 21 aa, Plasmodium falciparum
GTPTHKQCRCDDKANVDPPTY

SEQ ID NO: 3260461 - protein, 25 aa, Plasmodium falciparum
GTSFCAYDICNIDKINLHYCSSEDI

SEQ ID NO: 3260462 - protein, 21 aa, Plasmodium falciparum
GTSSPSIWLTNLIYELTPYPF

SEQ ID NO: 3260463 - protein, 24 aa, Plasmodium falciparum
GTVPIPMNVHMGGTSISNINHMNN

SEQ ID NO: 3260464 - protein, 21 aa, Plasmodium falciparum
GTYICKAKVNNLFKFNNNCDP

SEQ ID NO: 3260465 - protein, 24 aa, Plasmodium falciparum
GTYLGRLNYYFNIVRTHTTSINKH

SEQ ID NO: 3260466 - protein, 24 aa, Plasmodium falciparum
GVAINIWKPAALKAAIKTAIANSA

SEQ ID NO: 3260467 - protein, 17 aa, Plasmodium falciparum
GVALCLSSILSKSPEQV

SEQ ID NO: 3260468 - protein, 18 aa, Plasmodium falciparum
GVCIYKVEGSVHVTEPNS

SEQ ID NO: 3260469 - protein, 25 aa, Plasmodium falciparum
GVCNIYKKKVYFIGQDYDFLKRKIL

SEQ ID NO: 3260470 - protein, 18 aa, Plasmodium falciparum
GVCTGRNIISPNITCESL

SEQ ID NO: 3260471 - protein, 27 aa, Plasmodium falciparum
GVCVSPRRQGFCLGNLNYLLNDDIYNV

SEQ ID NO: 3260472 - protein, 19 aa, Plasmodium falciparum
GVDCKFCQDDIVIQDELKR

SEQ ID NO: 3260473 - protein, 26 aa, Plasmodium falciparum
GVEVFKKKVCYITLCILKRLNEDENF

SEQ ID NO: 3260474 - protein, 19 aa, Plasmodium falciparum
GVFEPCGIAALVLLILAVV

SEQ ID NO: 3260475 - protein, 25 aa, Plasmodium falciparum
GVGTCAFSSALLGKFGIAAGATAAY

SEQ ID NO: 3260476 - protein, 24 aa, Plasmodium falciparum
GVHDVCLVFITLYFHKFFLRYKKY

SEQ ID NO: 3260477 - protein, 23 aa, Plasmodium falciparum
GVHRTTIARWCNIRNITSNSMNN

SEQ ID NO: 3260478 - protein, 22 aa, Plasmodium falciparum
GVIELGCGLGQISKYLFSKYKN

SEQ ID NO: 3260479 - protein, 18 aa, Plasmodium falciparum
GVIGEGLIGILIFGDEKT

SEQ ID NO: 3260480 - protein, 17 aa, Plasmodium falciparum
GVLFIIISFIWFFLNRT

SEQ ID NO: 3260481 - protein, 21 aa, Plasmodium falciparum
GVLFIWIWNCGHMWKTSFPSE

SEQ ID NO: 3260482 - protein, 24 aa, Plasmodium falciparum
GVLHMCPEDFNLLQQICVDNLLNN

SEQ ID NO: 3260483 - protein, 20 aa, Plasmodium falciparum
GVLLPPRRKNLFLKIDESDI

SEQ ID NO: 3260484 - protein, 28 aa, Plasmodium falciparum
GVLRIFVLKLNYILSVLNFVNQLKNTYA

SEQ ID NO: 3260485 - protein, 25 aa, Plasmodium falciparum
GVLVPPRRQSLCLRITLQDFRTKKK

SEQ ID NO: 3260486 - protein, 22 aa, Plasmodium falciparum
GVLYEMCSNILLGRNEKNNNDI

SEQ ID NO: 3260487 - protein, 28 aa, Plasmodium falciparum
GVNKSICFTCKNINILGKCQKICIKHFL

SEQ ID NO: 3260488 - protein, 18 aa, Plasmodium falciparum
GVQISWRLVYVIEYLGPI

SEQ ID NO: 3260489 - protein, 19 aa, Plasmodium falciparum
GVSCSRKGPTPGKFFFNWK

SEQ ID NO: 3260490 - protein, 22 aa, Plasmodium falciparum
GVTNRHAFNFQYCNIETSIWIE

SEQ ID NO: 3260491 - protein, 18 aa, Plasmodium falciparum
GVTRCISIPYLYDINKES

SEQ ID NO: 3260492 - protein, 24 aa, Plasmodium falciparum
GVVGFSFLCKLLFSLDNAKNAWIY

SEQ ID NO: 3260493 - protein, 21 aa, Plasmodium falciparum
GVVSFVRLSLFEWAKYTNYDF

SEQ ID NO: 3260494 - protein, 18 aa, Plasmodium falciparum
GVYDLTYMFNFIMKSMNE

SEQ ID NO: 3260495 - protein, 26 aa, Plasmodium falciparum
GWADLTETMKNIWMERLTYKMRKYSG

SEQ ID NO: 3260496 - protein, 35 aa, Plasmodium falciparum
GWNEILFFIRMFFKLNVILPLFFAAAFIVSTFVYN

SEQ ID NO: 3260497 - protein, 24 aa, Plasmodium falciparum
GWPPSSETYLFFYFFTNLYLDAYK

SEQ ID NO: 3260498 - protein, 20 aa, Plasmodium falciparum
GYALSLFYFRVFPYSYNDTD

SEQ ID NO: 3260499 - protein, 29 aa, Plasmodium falciparum
GYDIRKCYNGIDLIFLFLSKIKGANVNFI

SEQ ID NO: 3260500 - protein, 23 aa, Plasmodium falciparum
GYEECNFDFPIIVENYLCHEQIR

SEQ ID NO: 3260501 - protein, 18 aa, Plasmodium falciparum
GYESKGFSSYNNMYRIEK

SEQ ID NO: 3260502 - protein, 17 aa, Plasmodium falciparum
GYEYSNLIFELHKIGIN

SEQ ID NO: 3260503 - protein, 19 aa, Plasmodium falciparum
GYFTEKKKKECIPCPFGNY

SEQ ID NO: 3260504 - protein, 18 aa, Plasmodium falciparum
GYIFLLYLKLKKIKWKHP

SEQ ID NO: 3260505 - protein, 19 aa, Plasmodium falciparum
GYIPIKRRDDNLLPHEKAE

SEQ ID NO: 3260506 - protein, 19 aa, Plasmodium falciparum
GYIRNCHPCMSRKISRWDA

SEQ ID NO: 3260507 - protein, 20 aa, Plasmodium falciparum
GYIYFDFLDLFIIFNALDEH

SEQ ID NO: 3260508 - protein, 19 aa, Plasmodium falciparum
GYKKKSFFRNAINKITNYF

SEQ ID NO: 3260509 - protein, 20 aa, Plasmodium falciparum
GYKKVYLKCSNFWYSKDEIY

SEQ ID NO: 3260510 - protein, 19 aa, Plasmodium falciparum
GYKKYMKTCEHFLKRNNLN

SEQ ID NO: 3260511 - protein, 24 aa, Plasmodium falciparum
GYLEPAFLWNQWVERKRYIMEKWK

SEQ ID NO: 3260512 - protein, 29 aa, Plasmodium falciparum
GYLFGSTFWLCFFSEVGLLRSLKNMKGVP

SEQ ID NO: 3260513 - protein, 17 aa, Plasmodium falciparum
GYLHFFSIFVIYKNEIC

SEQ ID NO: 3260514 - protein, 29 aa, Plasmodium falciparum
GYLLNGFIDICIAIFLNIAILQNISGFKT

SEQ ID NO: 3260515 - protein, 20 aa, Plasmodium falciparum
GYLQYFILYDMCIKLFLFFS

SEQ ID NO: 3260516 - protein, 20 aa, Plasmodium falciparum
GYMASCPLTVKGKIKHKTNI

SEQ ID NO: 3260517 - protein, 25 aa, Plasmodium falciparum
GYMLYYKRMIGFVSLHLQLLFIAIM

SEQ ID NO: 3260518 - protein, 19 aa, Plasmodium falciparum
GYMNKCFYFIKNDEYNIED

SEQ ID NO: 3260519 - protein, 25 aa, Plasmodium falciparum
GYNECKTLLSLCLKNENETCINNIS

SEQ ID NO: 3260520 - protein, 26 aa, Plasmodium falciparum
GYNMEVQYPIAHFVSESYRANDLFGV

SEQ ID NO: 3260521 - protein, 22 aa, Plasmodium falciparum
GYNSIKYYALKFVYNNLKNLTF

SEQ ID NO: 3260522 - protein, 22 aa, Plasmodium falciparum
GYNVANYFFYVKIDCAKTNDII

SEQ ID NO: 3260523 - protein, 18 aa, Plasmodium falciparum
GYPNFNRNNMDALKIAEY

SEQ ID NO: 3260524 - protein, 20 aa, Plasmodium falciparum
GYSLKFPNLLFEKSKNVEDV

SEQ ID NO: 3260525 - protein, 23 aa, Plasmodium falciparum
GYSRGSSYLAYYLLPLLKDAEVD

SEQ ID NO: 3260526 - protein, 18 aa, Plasmodium falciparum
GYTEIFTSKFIKIKESEK

SEQ ID NO: 3260527 - protein, 19 aa, Plasmodium falciparum
GYTKVCYNYFYKLKKKLEN

SEQ ID NO: 3260528 - protein, 19 aa, Plasmodium falciparum
GYVAQYYFDVVKCRYEKKE

SEQ ID NO: 3260529 - protein, 25 aa, Plasmodium falciparum
GYVFSTYILYYWSRINEGTLINCFE

SEQ ID NO: 3260530 - protein, 18 aa, Plasmodium falciparum
GYVGSSIITIVWGILITY

SEQ ID NO: 3260531 - protein, 17 aa, Plasmodium falciparum
GYVNIKCEENEAMNKSI

SEQ ID NO: 3260532 - protein, 21 aa, Plasmodium falciparum
GYWLERFSLFLLGLTIAIGVG

SEQ ID NO: 3260533 - protein, 17 aa, Plasmodium falciparum
GYYKLLEPMNLKNVDIE

SEQ ID NO: 3260534 - protein, 19 aa, Plasmodium falciparum
GYYLIVLSLLKYAHQYNMN

SEQ ID NO: 3260535 - protein, 19 aa, Plasmodium falciparum
GYYPIPRFWLSCKHPAHKN

SEQ ID NO: 3260536 - protein, 19 aa, Plasmodium falciparum
HAEDVFLPPRRQHFCTSNL

SEQ ID NO: 3260537 - protein, 25 aa, Plasmodium falciparum
HAFIKKKGFYILCYILFHIQNNHII

SEQ ID NO: 3260538 - protein, 24 aa, Plasmodium falciparum
HAFKKKIFLCNNLDQLIKAHYNYI

SEQ ID NO: 3260539 - protein, 20 aa, Plasmodium falciparum
HAFMHLVRFLSLNIAINSSE

SEQ ID NO: 3260540 - protein, 18 aa, Plasmodium falciparum
HAKPFFLRFFVARIFFKI

SEQ ID NO: 3260541 - protein, 19 aa, Plasmodium falciparum
HALECFLSDCVKSFHQYML

SEQ ID NO: 3260542 - protein, 26 aa, Plasmodium falciparum
HANFYKLREDWWYANRQQVWYAITCG

SEQ ID NO: 3260543 - protein, 19 aa, Plasmodium falciparum
HAPSIIFIDEIDAVGRKRS

SEQ ID NO: 3260544 - protein, 22 aa, Plasmodium falciparum
HARSVAPSIVFIDEIDAIGGKR

SEQ ID NO: 3260545 - protein, 20 aa, Plasmodium falciparum
HAVNELFVFLGSQYSTDEKI

SEQ ID NO: 3260546 - protein, 17 aa, Plasmodium falciparum
HCCFLTCANQLLQIPQF

SEQ ID NO: 3260547 - protein, 22 aa, Plasmodium falciparum
HCDYLFRPFRKLRENLKNVKKY

SEQ ID NO: 3260548 - protein, 18 aa, Plasmodium falciparum
HCEVQCLNGNNEIIHKRC

SEQ ID NO: 3260549 - protein, 18 aa, Plasmodium falciparum
HCGVRKANNGNFVKKSDS

SEQ ID NO: 3260550 - protein, 24 aa, Plasmodium falciparum
HCIEFCFIILYLINIVYSNHNDVL

SEQ ID NO: 3260551 - protein, 26 aa, Plasmodium falciparum
HCLYEDKNTWFKCCQSIVESMYVHFD

SEQ ID NO: 3260552 - protein, 21 aa, Plasmodium falciparum
HCNNSILIVCKIIIGNRLLID

SEQ ID NO: 3260553 - protein, 36 aa, Plasmodium falciparum
HCVDKYMLGIFYIWIWNLNYIWKRADPPNDRTFNNF

SEQ ID NO: 3260554 - protein, 22 aa, Plasmodium falciparum
HDASTLSCCDFIYVIAKGEVVY

SEQ ID NO: 3260555 - protein, 21 aa, Plasmodium falciparum
HDDCYLFPYVLSYLYTNDYNI

SEQ ID NO: 3260556 - protein, 23 aa, Plasmodium falciparum
HDDGDHVKLLFGIDDKNVSNNNN

SEQ ID NO: 3260557 - protein, 26 aa, Plasmodium falciparum
HDDIYLLYFHMCIYNSKKATNVCIKK

SEQ ID NO: 3260558 - protein, 23 aa, Plasmodium falciparum
HDDLKGTLLQKIDIKKEFKNDDE

SEQ ID NO: 3260559 - protein, 48 aa, Plasmodium falciparum
HDDYHSGYVVGLWRDFPRNTFLPWRFSVELFLWDLLNVLPHELPHPAK

SEQ ID NO: 3260560 - protein, 17 aa, Plasmodium falciparum
HDEKRIITFHSFILTLV

SEQ ID NO: 3260561 - protein, 25 aa, Plasmodium falciparum
HDEKVRTGSFFYSKKFRRYMLPIMG

SEQ ID NO: 3260562 - protein, 22 aa, Plasmodium falciparum
HDFHITKIWIAIIFSAITDIEE

SEQ ID NO: 3260563 - protein, 17 aa, Plasmodium falciparum
HDHIKLSFQNQVDSKVY

SEQ ID NO: 3260564 - protein, 20 aa, Plasmodium falciparum
HDIIKWIYRYINNCNIFFKN

SEQ ID NO: 3260565 - protein, 23 aa, Plasmodium falciparum
HDIIYRLHLLFNVFNQNDKNIEN

SEQ ID NO: 3260566 - protein, 27 aa, Plasmodium falciparum
HDILCYKCMNGGELNMCDSYNCNNSWH

SEQ ID NO: 3260567 - protein, 23 aa, Plasmodium falciparum
HDILDCFDHKSGVSYSGEQMFDN

SEQ ID NO: 3260568 - protein, 21 aa, Plasmodium falciparum
HDINKLYCIISSTIHMDIDAD

SEQ ID NO: 3260569 - protein, 25 aa, Plasmodium falciparum
HDINWYTFLFLFRLTSFEEISKKSV

SEQ ID NO: 3260570 - protein, 25 aa, Plasmodium falciparum
HDINWYTFLFLFRLTSFKEIAKKNV

SEQ ID NO: 3260571 - protein, 25 aa, Plasmodium falciparum
HDINWYTFLFLFRLTSFKEIANKNV

SEQ ID NO: 3260572 - protein, 20 aa, Plasmodium falciparum
HDKDRIGVCLDTCHTFAAGY

SEQ ID NO: 3260573 - protein, 19 aa, Plasmodium falciparum
HDKNICKYVTKIYNNNKII

SEQ ID NO: 3260574 - protein, 17 aa, Plasmodium falciparum
HDLKIFYETKLRERNNN

SEQ ID NO: 3260575 - protein, 17 aa, Plasmodium falciparum
HDLLVDVCMAAKYEGES

SEQ ID NO: 3260576 - protein, 19 aa, Plasmodium falciparum
HDLYWQVDLDLHFGNLTVE

SEQ ID NO: 3260577 - protein, 26 aa, Plasmodium falciparum
HDNEERRKRLVILKRRKGQNDKIKCG

SEQ ID NO: 3260578 - protein, 25 aa, Plasmodium falciparum
HDNFQWKFIIELQNFIAKHKNKVFM

SEQ ID NO: 3260579 - protein, 18 aa, Plasmodium falciparum
HDSMPLLLVEPIDDITDE

SEQ ID NO: 3260580 - protein, 18 aa, Plasmodium falciparum
HDSSFIFINFYEERIKKN

SEQ ID NO: 3260581 - protein, 24 aa, Plasmodium falciparum
HDTFLRYFLFYTFQKKSTLFNIYP

SEQ ID NO: 3260582 - protein, 24 aa, Plasmodium falciparum
HDVNWYTFLFLFRITSFQKIAQKN

SEQ ID NO: 3260583 - protein, 22 aa, Plasmodium falciparum
HECGKQLLKSSLCKLNEIKNTI

SEQ ID NO: 3260584 - protein, 18 aa, Plasmodium falciparum
HEDMWLFVIYLLYVSLQK

SEQ ID NO: 3260585 - protein, 21 aa, Plasmodium falciparum
HEEIQRISLDYIFNKKKSSDE

SEQ ID NO: 3260586 - protein, 26 aa, Plasmodium falciparum
HEEWWKNHGEHIWNGMICALTYKDND

SEQ ID NO: 3260587 - protein, 24 aa, Plasmodium falciparum
HEFNKLYNMLSIKMKNKFDSENDM

SEQ ID NO: 3260588 - protein, 21 aa, Plasmodium falciparum
HEFYINFLIEAILIPIKTSHE

SEQ ID NO: 3260589 - protein, 25 aa, Plasmodium falciparum
HEKNKEPGTWCVFISEEKGFAGAVN

SEQ ID NO: 3260590 - protein, 26 aa, Plasmodium falciparum
HELYFFTNNCEYIIFLFYNYHLLIEK

SEQ ID NO: 3260591 - protein, 22 aa, Plasmodium falciparum
HEMGARMPKGVLLVGPPGSGKT

SEQ ID NO: 3260592 - protein, 25 aa, Plasmodium falciparum
HEMHAKFTYPFLLNIFKHMNTNTDK

SEQ ID NO: 3260593 - protein, 23 aa, Plasmodium falciparum
HENYCDPCPIFGIESKNSGWSEV

SEQ ID NO: 3260594 - protein, 26 aa, Plasmodium falciparum
HERILKKLQVLIAEGYKRINEKEKDI

SEQ ID NO: 3260595 - protein, 18 aa, Plasmodium falciparum
HERMHLFGYLTMWMTESK

SEQ ID NO: 3260596 - protein, 25 aa, Plasmodium falciparum
HEVYDLKRPKGRNIKNSEMINNNNN

SEQ ID NO: 3260597 - protein, 21 aa, Plasmodium falciparum
HEYFLNYIIFYYICNLKKVCN

SEQ ID NO: 3260598 - protein, 22 aa, Plasmodium falciparum
HEYKSPFFNYSLFNTYYQFYIY

SEQ ID NO: 3260599 - protein, 18 aa, Plasmodium falciparum
HFASFKYSNEMISKLDSL

SEQ ID NO: 3260600 - protein, 19 aa, Plasmodium falciparum
HFASFKYSNEMISKLDSLF

SEQ ID NO: 3260601 - protein, 25 aa, Plasmodium falciparum
HFDDWLKLINLFVEINYIYKYISSI

SEQ ID NO: 3260602 - protein, 24 aa, Plasmodium falciparum
HFDNKKFCFDYIFVGSKLTFLKEY

SEQ ID NO: 3260603 - protein, 18 aa, Plasmodium falciparum
HFEEKFKQECIHNNVNDV

SEQ ID NO: 3260604 - protein, 18 aa, Plasmodium falciparum
HFEELCGHRGIIFKVKFF

SEQ ID NO: 3260605 - protein, 19 aa, Plasmodium falciparum
HFEKFELNYDIPRKNIKLN

SEQ ID NO: 3260606 - protein, 17 aa, Plasmodium falciparum
HFFDYIFYYDLFKYLYK

SEQ ID NO: 3260607 - protein, 17 aa, Plasmodium falciparum
HFFGFLGGFLIGIILKR

SEQ ID NO: 3260608 - protein, 24 aa, Plasmodium falciparum
HFFNCGYDSFEILLSISPHDLINI

SEQ ID NO: 3260609 - protein, 20 aa, Plasmodium falciparum
HFFNDFPLTHFFNSKIEKNV

SEQ ID NO: 3260610 - protein, 28 aa, Plasmodium falciparum
HFFVLYIICSCFILILSIKHDKYNNESK

SEQ ID NO: 3260611 - protein, 18 aa, Plasmodium falciparum
HFGVLEVFLKSSINADYF

SEQ ID NO: 3260612 - protein, 31 aa, Plasmodium falciparum
HFHNILKILFFWNFELYKNFRKNKIYLNCFQ

SEQ ID NO: 3260613 - protein, 18 aa, Plasmodium falciparum
HFIFIKKDYELMKKNQKI

SEQ ID NO: 3260614 - protein, 19 aa, Plasmodium falciparum
HFIPCYIFFIHNKFNLYPN

SEQ ID NO: 3260615 - protein, 21 aa, Plasmodium falciparum
HFKILEKLLFYDLYYNICTTL

SEQ ID NO: 3260616 - protein, 24 aa, Plasmodium falciparum
HFKILRDFIFFFIIERNNSPLNFC

SEQ ID NO: 3260617 - protein, 21 aa, Plasmodium falciparum
HFKKYKVCRRKSFNGLENMGN

SEQ ID NO: 3260618 - protein, 22 aa, Plasmodium falciparum
HFLKNMFFIFYTKRFIRNGNNK

SEQ ID NO: 3260619 - protein, 24 aa, Plasmodium falciparum
HFLKRKKYAVNIIFNESWEYVNTE

SEQ ID NO: 3260620 - protein, 29 aa, Plasmodium falciparum
HFLNFIYQFWNKRICEVSEYQTLRSTSYS

SEQ ID NO: 3260621 - protein, 23 aa, Plasmodium falciparum
HFLNKTKCIFFYATPHFGSPLSS

SEQ ID NO: 3260622 - protein, 27 aa, Plasmodium falciparum
HFLVKIFACSLFIWTLYVSHNGNVSTN

SEQ ID NO: 3260623 - protein, 30 aa, Plasmodium falciparum
HFMLTYMYFMICNSNIPKGVLYGNHISQNN

SEQ ID NO: 3260624 - protein, 22 aa, Plasmodium falciparum
HFNHIVGFLCGFVFSFLIIAFE

SEQ ID NO: 3260625 - protein, 24 aa, Plasmodium falciparum
HFNNSCVFIQRVLIIPSTEKYDDV

SEQ ID NO: 3260626 - protein, 25 aa, Plasmodium falciparum
HFNPRAFLVFDIIKIFGRLSDKELL

SEQ ID NO: 3260627 - protein, 24 aa, Plasmodium falciparum
HFNTKLYCFFIFKQRNNNEIVDGV

SEQ ID NO: 3260628 - protein, 24 aa, Plasmodium falciparum
HFNTLRIIFDLLITSIESHLYYKV

SEQ ID NO: 3260629 - protein, 25 aa, Plasmodium falciparum
HFNYACQWFLFSFIFSTISIFKFVQ

SEQ ID NO: 3260630 - protein, 27 aa, Plasmodium falciparum
HFQTRYCDILKICIEKKYSLIKNGYNK

SEQ ID NO: 3260631 - protein, 25 aa, Plasmodium falciparum
HFSYEYRKIIKLKIKKILNLFHIKY

SEQ ID NO: 3260632 - protein, 35 aa, Plasmodium falciparum
HFTMKRKKLFVYFIFLSFIINFNFNININFVCSNV

SEQ ID NO: 3260633 - protein, 20 aa, Plasmodium falciparum
HFVFPKKCILILGDEKEGLP

SEQ ID NO: 3260634 - protein, 19 aa, Plasmodium falciparum
HFWVRHLLNDSIEWREGLK

SEQ ID NO: 3260635 - protein, 38 aa, Plasmodium falciparum
HFYEISFWIKCVEGWGNWRKVFELRTDIYDFIILQLRI

SEQ ID NO: 3260636 - protein, 20 aa, Plasmodium falciparum
HFYFFRNIFISHKFQNKIYL

SEQ ID NO: 3260637 - protein, 18 aa, Plasmodium falciparum
HFYIFLKIFFLYLNVYNL

SEQ ID NO: 3260638 - protein, 22 aa, Plasmodium falciparum
HGEAGKPVKWRGSSGNWRAGFL

SEQ ID NO: 3260639 - protein, 19 aa, Plasmodium falciparum
HGEIYLQPLIYNYKNSNIL

SEQ ID NO: 3260640 - protein, 21 aa, Plasmodium falciparum
HGEKMIKILKIKTSKKKKKRA

SEQ ID NO: 3260641 - protein, 18 aa, Plasmodium falciparum
HGGLALGMERYLITLLNL

SEQ ID NO: 3260642 - protein, 29 aa, Plasmodium falciparum
HGHFEDYSKLYIASGVATLVLLGGSITFY

SEQ ID NO: 3260643 - protein, 21 aa, Plasmodium falciparum
HGIPSRMTIGMLIESICGKAA

SEQ ID NO: 3260644 - protein, 20 aa, Plasmodium falciparum
HGKCNSNCVSRKCYTIHHND

SEQ ID NO: 3260645 - protein, 17 aa, Plasmodium falciparum
HGKIDIIMFRNAIKRAI

SEQ ID NO: 3260646 - protein, 20 aa, Plasmodium falciparum
HGKMKCIFSNVLKQHDKVFI

SEQ ID NO: 3260647 - protein, 29 aa, Plasmodium falciparum
HGLDFSFCNLCFFMEFPVNFFHLQQCESR

SEQ ID NO: 3260648 - protein, 46 aa, Plasmodium falciparum
HGSCCFPNVPDIYLFNWKCDDCLKCNKCNYSNLCYINYNEWELHLD

SEQ ID NO: 3260649 - protein, 17 aa, Plasmodium falciparum
HGTKWWNSVNWEHLNLD

SEQ ID NO: 3260650 - protein, 17 aa, Plasmodium falciparum
HGYVGADLAQLCFEAAI

SEQ ID NO: 3260651 - protein, 26 aa, Plasmodium falciparum
HHALYIFLSHILRFYNKMFHITKKKQ

SEQ ID NO: 3260652 - protein, 25 aa, Plasmodium falciparum
HHAYSLPYFNHWLRNFSQSFKSSLI

SEQ ID NO: 3260653 - protein, 17 aa, Plasmodium falciparum
HHCPWINNCVGFFNRRF

SEQ ID NO: 3260654 - protein, 23 aa, Plasmodium falciparum
HHCRTCNKCILKMDHHCPWIGTC

SEQ ID NO: 3260655 - protein, 32 aa, Plasmodium falciparum
HHFMYNEFLKNCKFFSFVLKKKKKITIPEELV

SEQ ID NO: 3260656 - protein, 24 aa, Plasmodium falciparum
HHINIMCIIIIQYLYNTYIKEKNK

SEQ ID NO: 3260657 - protein, 17 aa, Plasmodium falciparum
HHLEKMTCILIFSLKNK

SEQ ID NO: 3260658 - protein, 29 aa, Plasmodium falciparum
HHMIFSSFVRYILCMIITFIFIYNQRKFY

SEQ ID NO: 3260659 - protein, 18 aa, Plasmodium falciparum
HIAEKNALCRHIEHEMNI

SEQ ID NO: 3260660 - protein, 18 aa, Plasmodium falciparum
HIAFLQIILFRLTMSNFF

SEQ ID NO: 3260661 - protein, 17 aa, Plasmodium falciparum
HICELIINIIINSKCYL

SEQ ID NO: 3260662 - protein, 24 aa, Plasmodium falciparum
HIDKRSDVPFIYLKKRRKDIFVVN

SEQ ID NO: 3260663 - protein, 47 aa, Plasmodium falciparum
HIDLSLFRYKLCWILIDFFFYPICKKLTVPMNVHFNINADYINDLLL

SEQ ID NO: 3260664 - protein, 18 aa, Plasmodium falciparum
HIDRRIAYYRMPLKNVLL

SEQ ID NO: 3260665 - protein, 22 aa, Plasmodium falciparum
HIEKIIFLKFFKLEENDKNFFF

SEQ ID NO: 3260666 - protein, 19 aa, Plasmodium falciparum
HIEKMKKITNKAFLYCFIK

SEQ ID NO: 3260667 - protein, 18 aa, Plasmodium falciparum
HIELSPFSFFWGALLSQQ

SEQ ID NO: 3260668 - protein, 29 aa, Plasmodium falciparum
HIESWYNKIGYCIVFFLFSILKIFCTCDD

SEQ ID NO: 3260669 - protein, 18 aa, Plasmodium falciparum
HIFFIYKILYMLKNNDIF

SEQ ID NO: 3260670 - protein, 19 aa, Plasmodium falciparum
HIFFPFFFSLFFIIYIYNI

SEQ ID NO: 3260671 - protein, 18 aa, Plasmodium falciparum
HIFFPITYMDIEKRENCK

SEQ ID NO: 3260672 - protein, 26 aa, Plasmodium falciparum
HIFIDVIKFKLNYNFNKIKIKSKFLY

SEQ ID NO: 3260673 - protein, 26 aa, Plasmodium falciparum
HIFKKVCNLYRGFTLHSFKLIPEYFI

SEQ ID NO: 3260674 - protein, 24 aa, Plasmodium falciparum
HIFNSFKFDKLRLSHIYTQSIIDY

SEQ ID NO: 3260675 - protein, 29 aa, Plasmodium falciparum
HIFPFCKIMNKKWVKIYILPYLLTNIYKS

SEQ ID NO: 3260676 - protein, 26 aa, Plasmodium falciparum
HIFYFICTYPYYIIRKTMAYNFYDIL

SEQ ID NO: 3260677 - protein, 20 aa, Plasmodium falciparum
HIGSALIPHIMNLHKIEDDE

SEQ ID NO: 3260678 - protein, 19 aa, Plasmodium falciparum
HIHAFKFLLEKYVYMNKYN

SEQ ID NO: 3260679 - protein, 27 aa, Plasmodium falciparum
HIHDYKCVKSIYYNKTYFLLYCPNNDE

SEQ ID NO: 3260680 - protein, 17 aa, Plasmodium falciparum
HIHICTMINTLIRNSFL

SEQ ID NO: 3260681 - protein, 18 aa, Plasmodium falciparum
HIHYIKNFTFFKEVLHTY

SEQ ID NO: 3260682 - protein, 18 aa, Plasmodium falciparum
HIHYSYLFNKDIFICGNY

SEQ ID NO: 3260683 - protein, 20 aa, Plasmodium falciparum
HIIESWKNPWYIFYIFVSIF

SEQ ID NO: 3260684 - protein, 18 aa, Plasmodium falciparum
HIIICIAIHIALYILAKH

SEQ ID NO: 3260685 - protein, 24 aa, Plasmodium falciparum
HIILYGSCLLSLIEIKNYNLNSSH

SEQ ID NO: 3260686 - protein, 25 aa, Plasmodium falciparum
HIIPENFISIYLYFIQSRVYNPILF

SEQ ID NO: 3260687 - protein, 21 aa, Plasmodium falciparum
HIIYLFYYFIYLEKIYEHNWK

SEQ ID NO: 3260688 - protein, 31 aa, Plasmodium falciparum
HIIYSLDIGFYILCSINLKIIIYKYNILENF

SEQ ID NO: 3260689 - protein, 20 aa, Plasmodium falciparum
HIKDSLLIRTKYKHIKNYNF

SEQ ID NO: 3260690 - protein, 22 aa, Plasmodium falciparum
HIKEKIKKYWLERVQEANTQLN

SEQ ID NO: 3260691 - protein, 19 aa, Plasmodium falciparum
HIKIFKKQEHPIAVRIKSV

SEQ ID NO: 3260692 - protein, 20 aa, Plasmodium falciparum
HIKIMKWLFEKYLLSEYISG

SEQ ID NO: 3260693 - protein, 26 aa, Plasmodium falciparum
HIKLYKKLKITFKVIFIMITCVITSV

SEQ ID NO: 3260694 - protein, 19 aa, Plasmodium falciparum
HIKQLFKNRINDIPIGGPS

SEQ ID NO: 3260695 - protein, 17 aa, Plasmodium falciparum
HILCPSVSIDTTTTTSS

SEQ ID NO: 3260696 - protein, 23 aa, Plasmodium falciparum
HILDEFWFNLSCQNEIKNIYYKN

SEQ ID NO: 3260697 - protein, 24 aa, Plasmodium falciparum
HILEKLKDTFFLPVYKNKTLNIDN

SEQ ID NO: 3260698 - protein, 22 aa, Plasmodium falciparum
HILIEIKLNYYFKIPYDIKNTF

SEQ ID NO: 3260699 - protein, 19 aa, Plasmodium falciparum
HILKSNFIIGLSKIYCLFP

SEQ ID NO: 3260700 - protein, 27 aa, Plasmodium falciparum
HILLFKWLRCYEPIYKKLNERDKKNKK

SEQ ID NO: 3260701 - protein, 29 aa, Plasmodium falciparum
HILLKQLFCNILYICNWLNKPRKYEWFEW

SEQ ID NO: 3260702 - protein, 30 aa, Plasmodium falciparum
HILLLQFLLCLIRCYVHNDVIKFGEENSLK

SEQ ID NO: 3260703 - protein, 20 aa, Plasmodium falciparum
HILNRIEFISVSFNLRESIF

SEQ ID NO: 3260704 - protein, 24 aa, Plasmodium falciparum
HILPDFFGIEFFNILLEKEIYYYV

SEQ ID NO: 3260705 - protein, 19 aa, Plasmodium falciparum
HILPWKTSLHFCIKDSHLS

SEQ ID NO: 3260706 - protein, 19 aa, Plasmodium falciparum
HILVKKWINKSSMEQRKGR

SEQ ID NO: 3260707 - protein, 17 aa, Plasmodium falciparum
HIMCMSMKKYKAFKRLI

SEQ ID NO: 3260708 - protein, 23 aa, Plasmodium falciparum
HINDKNCRIFFKNIKKQLKINYK

SEQ ID NO: 3260709 - protein, 24 aa, Plasmodium falciparum
HINDLIFISALKFYNYDMLEERMK

SEQ ID NO: 3260710 - protein, 25 aa, Plasmodium falciparum
HINPYFFSFIWRKIGKTTYWEKRKS

SEQ ID NO: 3260711 - protein, 24 aa, Plasmodium falciparum
HINVFLPPLFLSFFDYSKNVKQVS

SEQ ID NO: 3260712 - protein, 35 aa, Plasmodium falciparum
HINVPRLNNFFQLILYCMLNAFYYNMDYVCEEAQK

SEQ ID NO: 3260713 - protein, 29 aa, Plasmodium falciparum
HINYFKRFFFYFIKLDKKLFFPLKSVLKI

SEQ ID NO: 3260714 - protein, 22 aa, Plasmodium falciparum
HIPDIIIYFLFNHVQKIEDISS

SEQ ID NO: 3260715 - protein, 21 aa, Plasmodium falciparum
HIPHYDFLFDGYRRRSLSLTY

SEQ ID NO: 3260716 - protein, 18 aa, Plasmodium falciparum
HIPSEYKANHNINNDITS

SEQ ID NO: 3260717 - protein, 18 aa, Plasmodium falciparum
HIQILFDLYHKCTFNILK

SEQ ID NO: 3260718 - protein, 20 aa, Plasmodium falciparum
HIQNNFSYICIPKINDFNFF

SEQ ID NO: 3260719 - protein, 27 aa, Plasmodium falciparum
HIRKEHWLYIYPCLKNLLFKKKKSKNN

SEQ ID NO: 3260720 - protein, 19 aa, Plasmodium falciparum
HIRKLFSYCDADILRIENN

SEQ ID NO: 3260721 - protein, 21 aa, Plasmodium falciparum
HISCLMFMFFFKDIFFLKKER

SEQ ID NO: 3260722 - protein, 24 aa, Plasmodium falciparum
HISQKEVLAILNIMMKNNKIARIG

SEQ ID NO: 3260723 - protein, 18 aa, Plasmodium falciparum
HISVCDLLQTIIFKENEY

SEQ ID NO: 3260724 - protein, 29 aa, Plasmodium falciparum
HITNGGIFSPEFVPIGVLSSMTAACPLIG

SEQ ID NO: 3260725 - protein, 24 aa, Plasmodium falciparum
HIVKLNVVTLIWLSYLFLLKPHGT

SEQ ID NO: 3260726 - protein, 20 aa, Plasmodium falciparum
HIVMCMFMVIYFFKNKNDHK

SEQ ID NO: 3260727 - protein, 19 aa, Plasmodium falciparum
HIVMPAVDMFFFKSSDNEI

SEQ ID NO: 3260728 - protein, 19 aa, Plasmodium falciparum
HIWKGMIYALTYKDNGEKK

SEQ ID NO: 3260729 - protein, 18 aa, Plasmodium falciparum
HIWNAMVCALTYEEKTSS

SEQ ID NO: 3260730 - protein, 18 aa, Plasmodium falciparum
HIWNAMVCALTYKDNGDK

SEQ ID NO: 3260731 - protein, 19 aa, Plasmodium falciparum
HIWWQLREVERHKFAMMQY

SEQ ID NO: 3260732 - protein, 32 aa, Plasmodium falciparum
HIYEKKRGPNECKEKFLSLIKDDIYKITKLQN

SEQ ID NO: 3260733 - protein, 18 aa, Plasmodium falciparum
HIYFKKIIYVLLNTKYIL

SEQ ID NO: 3260734 - protein, 25 aa, Plasmodium falciparum
HIYFLQYVLKYNFLNFLTNFITTKR

SEQ ID NO: 3260735 - protein, 25 aa, Plasmodium falciparum
HIYIVFKISDLIILNSEKLINHIVN

SEQ ID NO: 3260736 - protein, 21 aa, Plasmodium falciparum
HIYKDRGAVHMNLLKQREKVL

SEQ ID NO: 3260737 - protein, 17 aa, Plasmodium falciparum
HIYKNKYLILYYLHTFY

SEQ ID NO: 3260738 - protein, 20 aa, Plasmodium falciparum
HIYMFYHIVKEFTLSIHFIK

SEQ ID NO: 3260739 - protein, 18 aa, Plasmodium falciparum
HIYVPFKNVHLLKFVYNI

SEQ ID NO: 3260740 - protein, 27 aa, Plasmodium falciparum
HKALYWKVTLCHLSIFYNIAFSYMMLK

SEQ ID NO: 3260741 - protein, 32 aa, Plasmodium falciparum
HKCIYNFRKFYDCWYFDYYIDCKIVDFLKYFF

SEQ ID NO: 3260742 - protein, 26 aa, Plasmodium falciparum
HKCSFWCGFYKKWLANQKQEFLKQKK

SEQ ID NO: 3260743 - protein, 26 aa, Plasmodium falciparum
HKDMKRIYVYRIFKNIFIKNYNHNIT

SEQ ID NO: 3260744 - protein, 24 aa, Plasmodium falciparum
HKDVEKLFRKNIKFNKNFTRNSFL

SEQ ID NO: 3260745 - protein, 24 aa, Plasmodium falciparum
HKEIKLPIRRCAILGKMDNWNARK

SEQ ID NO: 3260746 - protein, 28 aa, Plasmodium falciparum
HKEKNILIAKAFIPFNLLLKKNKTKISV

SEQ ID NO: 3260747 - protein, 22 aa, Plasmodium falciparum
HKEKYFYTDRMNFDEMSSFLLK

SEQ ID NO: 3260748 - protein, 25 aa, Plasmodium falciparum
HKELLKFKNFTVFNVLNNEKIVNNS

SEQ ID NO: 3260749 - protein, 22 aa, Plasmodium falciparum
HKFFLCYLKIEIIEDDGIRIVK

SEQ ID NO: 3260750 - protein, 19 aa, Plasmodium falciparum
HKGYIKKPILFQTKIIPIR

SEQ ID NO: 3260751 - protein, 26 aa, Plasmodium falciparum
HKHILLNLFLVFFYKSVLFICINNLF

SEQ ID NO: 3260752 - protein, 18 aa, Plasmodium falciparum
HKICNNVLRKCYSIKGNI

SEQ ID NO: 3260753 - protein, 17 aa, Plasmodium falciparum
HKILKEHINQMDIIKQE

SEQ ID NO: 3260754 - protein, 33 aa, Plasmodium falciparum
HKINFNQFISIWNIMCILFWDTDEINNFTFLQK

SEQ ID NO: 3260755 - protein, 19 aa, Plasmodium falciparum
HKINILFNLLDILFLYFSK

SEQ ID NO: 3260756 - protein, 24 aa, Plasmodium falciparum
HKINYCLYDGLIIILDILNDKIVE

SEQ ID NO: 3260757 - protein, 19 aa, Plasmodium falciparum
HKIVIGYIPFLTIFVGYAL

SEQ ID NO: 3260758 - protein, 27 aa, Plasmodium falciparum
HKKGKFKRLFLFIGFQSIPIIALMYLF

SEQ ID NO: 3260759 - protein, 21 aa, Plasmodium falciparum
HKKIEICDFIEPLVIVLILIL

SEQ ID NO: 3260760 - protein, 25 aa, Plasmodium falciparum
HKKIFRILLLILFYFSLPTFPFSKK

SEQ ID NO: 3260761 - protein, 19 aa, Plasmodium falciparum
HKKKCSVTDTIGLNERMIS

SEQ ID NO: 3260762 - protein, 25 aa, Plasmodium falciparum
HKKNKKSNICVITFNRKDKNNESII

SEQ ID NO: 3260763 - protein, 25 aa, Plasmodium falciparum
HKKYFKEYINIITFVICIFLSTNIN

SEQ ID NO: 3260764 - protein, 21 aa, Plasmodium falciparum
HKKYFLSSHIHLYFDSLKDVI

SEQ ID NO: 3260765 - protein, 20 aa, Plasmodium falciparum
HKLLHCLNNMIDYKFIHFIK

SEQ ID NO: 3260766 - protein, 18 aa, Plasmodium falciparum
HKLNEEWTIEHNEDLLDI

SEQ ID NO: 3260767 - protein, 20 aa, Plasmodium falciparum
HKLNNILYFINIYFHLNEYI

SEQ ID NO: 3260768 - protein, 17 aa, Plasmodium falciparum
HKLRFIRTSSSSLDENL

SEQ ID NO: 3260769 - protein, 20 aa, Plasmodium falciparum
HKLRSVYTYHDYTDNLENEE

SEQ ID NO: 3260770 - protein, 20 aa, Plasmodium falciparum
HKLYFNFHVTTNYKESKILK

SEQ ID NO: 3260771 - protein, 31 aa, Plasmodium falciparum
HKNDMLWFLLRIFLLLKLPVHCLALILYCKN

SEQ ID NO: 3260772 - protein, 23 aa, Plasmodium falciparum
HKNDSVIRYSLCGLLDYENKKNL

SEQ ID NO: 3260773 - protein, 24 aa, Plasmodium falciparum
HKNNSIWLFYFVVENFLFIVTLNN

SEQ ID NO: 3260774 - protein, 19 aa, Plasmodium falciparum
HKNVECVYPYAGNNINHNF

SEQ ID NO: 3260775 - protein, 40 aa, Plasmodium falciparum
HKNYLFTVTFIKNFLLFILIDIFFMLSYIIKTHYYKCIFD

SEQ ID NO: 3260776 - protein, 18 aa, Plasmodium falciparum
HKPPRGITREDWWKEYGS

SEQ ID NO: 3260777 - protein, 23 aa, Plasmodium falciparum
HKRCNDDIEKKCNGNNKCIYFFE

SEQ ID NO: 3260778 - protein, 24 aa, Plasmodium falciparum
HKRNCKGIKYLYCRLKNNPDMIKI

SEQ ID NO: 3260779 - protein, 24 aa, Plasmodium falciparum
HKRSRKSMNIEYSFINPFLNKYKE

SEQ ID NO: 3260780 - protein, 21 aa, Plasmodium falciparum
HKSDQICIFNSNNIHSVPIFN

SEQ ID NO: 3260781 - protein, 20 aa, Plasmodium falciparum
HKSFQYNLELFLISRKLLRY

SEQ ID NO: 3260782 - protein, 20 aa, Plasmodium falciparum
HKSKLSNMYAHLSNLDLFLC

SEQ ID NO: 3260783 - protein, 21 aa, Plasmodium falciparum
HKSNHIYIIYNYKKKLFVQKC

SEQ ID NO: 3260784 - protein, 19 aa, Plasmodium falciparum
HKSNRCSMKRKEKHEENNG

SEQ ID NO: 3260785 - protein, 20 aa, Plasmodium falciparum
HKTNLFFKNFNLIYYKNTSY

SEQ ID NO: 3260786 - protein, 17 aa, Plasmodium falciparum
HKTVMGFEKKKRRNKHE

SEQ ID NO: 3260787 - protein, 18 aa, Plasmodium falciparum
HKYCKLIDYKHKYNNNSI

SEQ ID NO: 3260788 - protein, 19 aa, Plasmodium falciparum
HKYFHGSDICLNCINIEQR

SEQ ID NO: 3260789 - protein, 21 aa, Plasmodium falciparum
HKYIELLCELKVTNSIKEQLE

SEQ ID NO: 3260790 - protein, 21 aa, Plasmodium falciparum
HKYKHLLSSCELMYRSFLGFY

SEQ ID NO: 3260791 - protein, 23 aa, Plasmodium falciparum
HKYLARYHFSWFEKEKIINKEQK

SEQ ID NO: 3260792 - protein, 20 aa, Plasmodium falciparum
HKYMKKKKCIITIDAYSNNL

SEQ ID NO: 3260793 - protein, 23 aa, Plasmodium falciparum
HLAHAQNKFRNCKNNMLDNHNKS

SEQ ID NO: 3260794 - protein, 30 aa, Plasmodium falciparum
HLAVLLSFGADCIYPYILYESLQFIKFADN

SEQ ID NO: 3260795 - protein, 24 aa, Plasmodium falciparum
HLCGNRINYCSSYFHFFDKNQEDI

SEQ ID NO: 3260796 - protein, 25 aa, Plasmodium falciparum
HLEEDTSKCYLHFSQKNEEGKNFND

SEQ ID NO: 3260797 - protein, 17 aa, Plasmodium falciparum
HLEHLQGEMQYLYEELQ

SEQ ID NO: 3260798 - protein, 21 aa, Plasmodium falciparum
HLFEWKKREYELSNKKEENNL

SEQ ID NO: 3260799 - protein, 19 aa, Plasmodium falciparum
HLFFQKFAKCLKINELLIL

SEQ ID NO: 3260800 - protein, 27 aa, Plasmodium falciparum
HLFKFFKKNCFLNQGMTYIVWKVLTYV

SEQ ID NO: 3260801 - protein, 18 aa, Plasmodium falciparum
HLFQTGIYKKVQVIKILK

SEQ ID NO: 3260802 - protein, 19 aa, Plasmodium falciparum
HLGSFSFDILRLCEQNKEL

SEQ ID NO: 3260803 - protein, 18 aa, Plasmodium falciparum
HLINEIIIDTSFFKENYD

SEQ ID NO: 3260804 - protein, 33 aa, Plasmodium falciparum
HLIPLVYKCKMIESFDSFFLLLCIDKNKEHVFA

SEQ ID NO: 3260805 - protein, 23 aa, Plasmodium falciparum
HLIYKNIIICIDILINNDDISNH

SEQ ID NO: 3260806 - protein, 27 aa, Plasmodium falciparum
HLKIKAFIYKCLLRLLQSYEKSTESRV

SEQ ID NO: 3260807 - protein, 27 aa, Plasmodium falciparum
HLKNIILHILKGLLFSSNVIHNELDNI

SEQ ID NO: 3260808 - protein, 21 aa, Plasmodium falciparum
HLKRAIDIYENIYLYNFTKNK

SEQ ID NO: 3260809 - protein, 21 aa, Plasmodium falciparum
HLKRRKKLFYLKDVDFGVLKD

SEQ ID NO: 3260810 - protein, 23 aa, Plasmodium falciparum
HLLFKDVCVNLNKLFTNLYTNDN

SEQ ID NO: 3260811 - protein, 37 aa, Plasmodium falciparum
HLLGHLYPFVDWVWLKSDLLAWAPVLNRFDDLLRKYI

SEQ ID NO: 3260812 - protein, 21 aa, Plasmodium falciparum
HLLIIKAHRFLNAYEKYERNG

SEQ ID NO: 3260813 - protein, 30 aa, Plasmodium falciparum
HLLIILPIFLKENFNLLTYDIKVYLINIFF

SEQ ID NO: 3260814 - protein, 21 aa, Plasmodium falciparum
HLLKNKNFYLISCEESNYYTL

SEQ ID NO: 3260815 - protein, 22 aa, Plasmodium falciparum
HLLLNIRFYYNIFHSTYKKNAY

SEQ ID NO: 3260816 - protein, 26 aa, Plasmodium falciparum
HLLLYFLYNRINTIYELFYNFYFTYL

SEQ ID NO: 3260817 - protein, 17 aa, Plasmodium falciparum
HLLMLKIYISDFDKLLK

SEQ ID NO: 3260818 - protein, 35 aa, Plasmodium falciparum
HLMNRLIYFLFNYFIMPLIRRFFFLTKSEQTLHKT

SEQ ID NO: 3260819 - protein, 20 aa, Plasmodium falciparum
HLNEFMSLDIEKVIYDNYYE

SEQ ID NO: 3260820 - protein, 23 aa, Plasmodium falciparum
HLNINEVFLLLQLSQNINCVHIK

SEQ ID NO: 3260821 - protein, 17 aa, Plasmodium falciparum
HLNKLYIYDIFIKRNLV

SEQ ID NO: 3260822 - protein, 24 aa, Plasmodium falciparum
HLNMCMYKLEACLEKKNFDDIYST

SEQ ID NO: 3260823 - protein, 24 aa, Plasmodium falciparum
HLPFANDLFMWAYLFMDNFIYFFE

SEQ ID NO: 3260824 - protein, 24 aa, Plasmodium falciparum
HLPKDKFIAGGFSNCIHKVIDSLR

SEQ ID NO: 3260825 - protein, 20 aa, Plasmodium falciparum
HLRKRLILHKNIPKIPNNDK

SEQ ID NO: 3260826 - protein, 18 aa, Plasmodium falciparum
HLSLILKKNINIINNNNM

SEQ ID NO: 3260827 - protein, 24 aa, Plasmodium falciparum
HLSNYIKVLERIASEYLNDPPINY

SEQ ID NO: 3260828 - protein, 22 aa, Plasmodium falciparum
HLTNLIKYFTKIECYDNEIKNV

SEQ ID NO: 3260829 - protein, 19 aa, Plasmodium falciparum
HLVMSLLYFFLNRISVSSH

SEQ ID NO: 3260830 - protein, 23 aa, Plasmodium falciparum
HLVPCIYPRMLVTVNEKLESLPV

SEQ ID NO: 3260831 - protein, 23 aa, Plasmodium falciparum
HLYDVRINSFIKRFKNNYPSNQG

SEQ ID NO: 3260832 - protein, 26 aa, Plasmodium falciparum
HLYEKKKCFLYFFFHKNKKKKIKKIK

SEQ ID NO: 3260833 - protein, 20 aa, Plasmodium falciparum
HLYSKGYVNIKCEENEAMNK

SEQ ID NO: 3260834 - protein, 35 aa, Plasmodium falciparum
HLYTISIILYWNFFKNILLILPIFFYQAYASWSCV

SEQ ID NO: 3260835 - protein, 19 aa, Plasmodium falciparum
HLYYFKPNLLFLSAGFDGH

SEQ ID NO: 3260836 - protein, 22 aa, Plasmodium falciparum
HMCKEKIKIFINEYISFNLKSA

SEQ ID NO: 3260837 - protein, 21 aa, Plasmodium falciparum
HMEPNMKFGHFERKSLPFFDD

SEQ ID NO: 3260838 - protein, 21 aa, Plasmodium falciparum
HMFCTCSCGSTANSNMENKNS

SEQ ID NO: 3260839 - protein, 25 aa, Plasmodium falciparum
HMGHLKSIFLGYSLSNLFHFCNYQI

SEQ ID NO: 3260840 - protein, 17 aa, Plasmodium falciparum
HMIHEFKELVNKKHDDY

SEQ ID NO: 3260841 - protein, 23 aa, Plasmodium falciparum
HMILLYFSFNFLKMSSYEYSYFI

SEQ ID NO: 3260842 - protein, 17 aa, Plasmodium falciparum
HMISCILQKLYIKMNKR

SEQ ID NO: 3260843 - protein, 25 aa, Plasmodium falciparum
HMKILRYDIFLQISYILKKNIFPLS

SEQ ID NO: 3260844 - protein, 19 aa, Plasmodium falciparum
HMKKGNGYNRRNENDNIDN

SEQ ID NO: 3260845 - protein, 18 aa, Plasmodium falciparum
HMKKKILDEFFFDIYNDY

SEQ ID NO: 3260846 - protein, 19 aa, Plasmodium falciparum
HMMETYKFYGYEKEEKYLL

SEQ ID NO: 3260847 - protein, 24 aa, Plasmodium falciparum
HMNIKDFFFFNIYIDNMNKCITKK

SEQ ID NO: 3260848 - protein, 19 aa, Plasmodium falciparum
HMRKERRVHQKKKNSKVSI

SEQ ID NO: 3260849 - protein, 18 aa, Plasmodium falciparum
HMTNVFLNYLNKIILHFY

SEQ ID NO: 3260850 - protein, 21 aa, Plasmodium falciparum
HMVYGRPYYWVPPPPALEYTK

SEQ ID NO: 3260851 - protein, 18 aa, Plasmodium falciparum
HMYNFCLKQNGLSNDEFN

SEQ ID NO: 3260852 - protein, 21 aa, Plasmodium falciparum
HMYSLKLPVYFINDRIKDDTN

SEQ ID NO: 3260853 - protein, 17 aa, Plasmodium falciparum
HNDILKKKLEYIDKQLL

SEQ ID NO: 3260854 - protein, 17 aa, Plasmodium falciparum
HNDLSFITSFEHNNNMY

SEQ ID NO: 3260855 - protein, 24 aa, Plasmodium falciparum
HNFEKKYNMRWGNDASSLSENVGN

SEQ ID NO: 3260856 - protein, 21 aa, Plasmodium falciparum
HNFLGYMLPTHVNFIYYLYSI

SEQ ID NO: 3260857 - protein, 32 aa, Plasmodium falciparum
HNFNIPPLRLLFLYDVPYKFNKDIKKNMVRKF

SEQ ID NO: 3260858 - protein, 28 aa, Plasmodium falciparum
HNFYLRVFNFLLNFIKRTKNVINIVLCI

SEQ ID NO: 3260859 - protein, 18 aa, Plasmodium falciparum
HNGFLKNEFIPIIEECLK

SEQ ID NO: 3260860 - protein, 24 aa, Plasmodium falciparum
HNHYPCFNHYGGKRESIKKMCRHF

SEQ ID NO: 3260861 - protein, 17 aa, Plasmodium falciparum
HNIDMSNFFVAQRKKDP

SEQ ID NO: 3260862 - protein, 28 aa, Plasmodium falciparum
HNILLYLLCIIDFKLNEVLCILQKSSSV

SEQ ID NO: 3260863 - protein, 22 aa, Plasmodium falciparum
HNIPCIKFSPDDNFLLSCSVDK

SEQ ID NO: 3260864 - protein, 17 aa, Plasmodium falciparum
HNIPINIIINFLCFVEK

SEQ ID NO: 3260865 - protein, 22 aa, Plasmodium falciparum
HNIPKKHLYYLDLNKLEILKLC

SEQ ID NO: 3260866 - protein, 21 aa, Plasmodium falciparum
HNIPKKILFKLWNKAYNDLIC

SEQ ID NO: 3260867 - protein, 17 aa, Plasmodium falciparum
HNIPLNNVELIFKYSKQ

SEQ ID NO: 3260868 - protein, 32 aa, Plasmodium falciparum
HNIRFKFKNEIIFIYNCLKSSLVSLIKLDLKD

SEQ ID NO: 3260869 - protein, 19 aa, Plasmodium falciparum
HNISFYKRHEHILHLSNNK

SEQ ID NO: 3260870 - protein, 26 aa, Plasmodium falciparum
HNIYFTLYMCHLMRVAIFSNKLNQFI

SEQ ID NO: 3260871 - protein, 25 aa, Plasmodium falciparum
HNIYKKRFFLLITHLSSLIFMYSIC

SEQ ID NO: 3260872 - protein, 23 aa, Plasmodium falciparum
HNIYYRYRIDITQSKFFKFNKKQ

SEQ ID NO: 3260873 - protein, 18 aa, Plasmodium falciparum
HNKHKSFNYHVLSSSVPR

SEQ ID NO: 3260874 - protein, 20 aa, Plasmodium falciparum
HNKLSLCIGILRYIDISSLS

SEQ ID NO: 3260875 - protein, 24 aa, Plasmodium falciparum
HNKLVKRRVLLALMKRKKKDKRKS

SEQ ID NO: 3260876 - protein, 24 aa, Plasmodium falciparum
HNLCLKLISLISIIHNVNEKAIKS

SEQ ID NO: 3260877 - protein, 24 aa, Plasmodium falciparum
HNLLKRFLILLIYSSNVINMVGMC

SEQ ID NO: 3260878 - protein, 18 aa, Plasmodium falciparum
HNLLLIIKYVYTVHKNNN

SEQ ID NO: 3260879 - protein, 22 aa, Plasmodium falciparum
HNLLVEVCLAAKYEGESITGRY

SEQ ID NO: 3260880 - protein, 19 aa, Plasmodium falciparum
HNLRIFFKEFTGINTYLRK

SEQ ID NO: 3260881 - protein, 20 aa, Plasmodium falciparum
HNLSFYFILHLFQTKFHVFN

SEQ ID NO: 3260882 - protein, 17 aa, Plasmodium falciparum
HNLWKKKSFIDLTNSIS

SEQ ID NO: 3260883 - protein, 24 aa, Plasmodium falciparum
HNLYLKCIINIKINFMEFCKNSAF

SEQ ID NO: 3260884 - protein, 25 aa, Plasmodium falciparum
HNMYHKFYMSLLFKIINAFYSSFIL

SEQ ID NO: 3260885 - protein, 24 aa, Plasmodium falciparum
HNNIKRLAMFLILQLLVHRYPKIR

SEQ ID NO: 3260886 - protein, 20 aa, Plasmodium falciparum
HNNKMCWKLGKKDYNIYEQS

SEQ ID NO: 3260887 - protein, 19 aa, Plasmodium falciparum
HNPFLLKFIDKMVLENDTV

SEQ ID NO: 3260888 - protein, 19 aa, Plasmodium falciparum
HNPVSCCFQMFKMKNDEDI

SEQ ID NO: 3260889 - protein, 29 aa, Plasmodium falciparum
HNQIPTFCWKSIWSYSLLFYGFKFKETTK

SEQ ID NO: 3260890 - protein, 31 aa, Plasmodium falciparum
HNRFKCIHYIKHFYRFNKLKSIKDYKYNCNI

SEQ ID NO: 3260891 - protein, 17 aa, Plasmodium falciparum
HNRWVYCELESKELLAL

SEQ ID NO: 3260892 - protein, 18 aa, Plasmodium falciparum
HNSHFCSTTHSFKTNNTY

SEQ ID NO: 3260893 - protein, 17 aa, Plasmodium falciparum
HNVHIFMDKEKYYGKKK

SEQ ID NO: 3260894 - protein, 24 aa, Plasmodium falciparum
HNVKEGLCSFDYTVSMTCCSILDN

SEQ ID NO: 3260895 - protein, 19 aa, Plasmodium falciparum
HNVYFKALISDMFFGVHEV

SEQ ID NO: 3260896 - protein, 18 aa, Plasmodium falciparum
HNVYKKIYYYKIKEGMLP

SEQ ID NO: 3260897 - protein, 20 aa, Plasmodium falciparum
HNYFNCFSYNPNAIFSLLQK

SEQ ID NO: 3260898 - protein, 17 aa, Plasmodium falciparum
HNYFPFILDRNINKKLN

SEQ ID NO: 3260899 - protein, 19 aa, Plasmodium falciparum
HNYIRLLLIFNKLFLFVLY

SEQ ID NO: 3260900 - protein, 17 aa, Plasmodium falciparum
HNYNYPYHMYNIKNTGD

SEQ ID NO: 3260901 - protein, 31 aa, Plasmodium falciparum
HNYTANSIQIIWLWDVLQEFDENKKASFLQF

SEQ ID NO: 3260902 - protein, 17 aa, Plasmodium falciparum
HNYVHFLKGLPVHLKNI

SEQ ID NO: 3260903 - protein, 19 aa, Plasmodium falciparum
HPLDIYYKMYIKKRRKSNK

SEQ ID NO: 3260904 - protein, 18 aa, Plasmodium falciparum
HPLKGIKIGLYIFNNFHN

SEQ ID NO: 3260905 - protein, 17 aa, Plasmodium falciparum
HPLNFQYIFIIVDVLIG

SEQ ID NO: 3260906 - protein, 25 aa, Plasmodium falciparum
HPLYLDFYLSFAWYNKGSNNEKAFL

SEQ ID NO: 3260907 - protein, 23 aa, Plasmodium falciparum
HPNFEKLFIKYFFFVIINDNDDD

SEQ ID NO: 3260908 - protein, 26 aa, Plasmodium falciparum
HPSTIPGLLEVGWKKETREITKKVQH

SEQ ID NO: 3260909 - protein, 19 aa, Plasmodium falciparum
HPVGPILLVVFIFVVIGSV

SEQ ID NO: 3260910 - protein, 26 aa, Plasmodium falciparum
HPYDDSICFLSSCNKEHIITNKQDIN

SEQ ID NO: 3260911 - protein, 21 aa, Plasmodium falciparum
HPYFISLLIFRLKQIKEQDNN

SEQ ID NO: 3260912 - protein, 23 aa, Plasmodium falciparum
HQAEYIPIILFFLNNVKNDLYNC

SEQ ID NO: 3260913 - protein, 31 aa, Plasmodium falciparum
HQILRILRWLRKWNKFILPLKYWSEIDYINV

SEQ ID NO: 3260914 - protein, 28 aa, Plasmodium falciparum
HQRSMLYVFAKYIFNKNVFLELGELHIL

SEQ ID NO: 3260915 - protein, 26 aa, Plasmodium falciparum
HQTYLIDLLLRYCKMFYKDPLSNKKI

SEQ ID NO: 3260916 - protein, 18 aa, Plasmodium falciparum
HQYAWSRSYQDQMVLNFI

SEQ ID NO: 3260917 - protein, 27 aa, Plasmodium falciparum
HQYILYKYRLAMLSLIIIKTNHLTNLK

SEQ ID NO: 3260918 - protein, 17 aa, Plasmodium falciparum
HRCIGGICSCSVGSAFL

SEQ ID NO: 3260919 - protein, 17 aa, Plasmodium falciparum
HRCIGGICSCTLGSALL

SEQ ID NO: 3260920 - protein, 18 aa, Plasmodium falciparum
HRCIGGICSCTLGSALLA

SEQ ID NO: 3260921 - protein, 18 aa, Plasmodium falciparum
HRCIGGICSCTLGSALLT

SEQ ID NO: 3260922 - protein, 17 aa, Plasmodium falciparum
HRCIGGICSCTVGSALL

SEQ ID NO: 3260923 - protein, 20 aa, Plasmodium falciparum
HRCTVTFLGILYFILIFSGT

SEQ ID NO: 3260924 - protein, 20 aa, Plasmodium falciparum
HRENMYTFKMNIMNKEKTKN

SEQ ID NO: 3260925 - protein, 24 aa, Plasmodium falciparum
HRFNFNEWSNLLIVQHIYNNYMSK

SEQ ID NO: 3260926 - protein, 17 aa, Plasmodium falciparum
HRFYFSGDTAYLKKDFE

SEQ ID NO: 3260927 - protein, 20 aa, Plasmodium falciparum
HRIEKETPLMVAAQYGHSRI

SEQ ID NO: 3260928 - protein, 17 aa, Plasmodium falciparum
HRISSKLSKTILVTLGL

SEQ ID NO: 3260929 - protein, 22 aa, Plasmodium falciparum
HRKSTWCKIKHDLQCDFIKEHP

SEQ ID NO: 3260930 - protein, 25 aa, Plasmodium falciparum
HRKTKTWSLVNTFFALLSIIYFITT

SEQ ID NO: 3260931 - protein, 21 aa, Plasmodium falciparum
HRNGFEYEFHILLSKLKINKK

SEQ ID NO: 3260932 - protein, 29 aa, Plasmodium falciparum
HRNGKNVKYTCHKECLYFNNYTFNHIYGN

SEQ ID NO: 3260933 - protein, 23 aa, Plasmodium falciparum
HRNSICLYEEIIVEILNYNVDDD

SEQ ID NO: 3260934 - protein, 18 aa, Plasmodium falciparum
HRPHMYPHNFPMRNESVG

SEQ ID NO: 3260935 - protein, 17 aa, Plasmodium falciparum
HRSLCECELYAQSNYEN

SEQ ID NO: 3260936 - protein, 18 aa, Plasmodium falciparum
HRSLCECELYMPNYDNDP

SEQ ID NO: 3260937 - protein, 20 aa, Plasmodium falciparum
HRYKRMNILNFKSRISEEKR

SEQ ID NO: 3260938 - protein, 22 aa, Plasmodium falciparum
HSCGSRLFFNGFRSCVEDNLFY

SEQ ID NO: 3260939 - protein, 18 aa, Plasmodium falciparum
HSEKQCIDISFNNIKYTY

SEQ ID NO: 3260940 - protein, 22 aa, Plasmodium falciparum
HSEYCQPCPLCGVKKKDGGNEW

SEQ ID NO: 3260941 - protein, 23 aa, Plasmodium falciparum
HSFESCAPCVGKIRFIPPECELI

SEQ ID NO: 3260942 - protein, 18 aa, Plasmodium falciparum
HSFIKDVLFCNLTIDKTN

SEQ ID NO: 3260943 - protein, 20 aa, Plasmodium falciparum
HSFNKYDFIRFVCSPNKSKQ

SEQ ID NO: 3260944 - protein, 17 aa, Plasmodium falciparum
HSKCINVKMVLTLATYL

SEQ ID NO: 3260945 - protein, 24 aa, Plasmodium falciparum
HSKGWKRKKKLFIIYSKNIVSYSY

SEQ ID NO: 3260946 - protein, 34 aa, Plasmodium falciparum
HSKNSFVMKVSYYLSYICSYIFSNKYHMLLPYYD

SEQ ID NO: 3260947 - protein, 17 aa, Plasmodium falciparum
HSKSIKMLIEKRLNDIL

SEQ ID NO: 3260948 - protein, 21 aa, Plasmodium falciparum
HSLKDFLFNRLKMLVSNISRE

SEQ ID NO: 3260949 - protein, 17 aa, Plasmodium falciparum
HSMIPKNVVEKIDNKGK

SEQ ID NO: 3260950 - protein, 17 aa, Plasmodium falciparum
HSNAILGSIGWTYENVA

SEQ ID NO: 3260951 - protein, 18 aa, Plasmodium falciparum
HSNFLFKKSKSYEKFASF

SEQ ID NO: 3260952 - protein, 17 aa, Plasmodium falciparum
HSNKPCYIYQFFDKQNY

SEQ ID NO: 3260953 - protein, 30 aa, Plasmodium falciparum
HSNNIIKLWNLKKSEMNKVMNEKRDIDEIN

SEQ ID NO: 3260954 - protein, 25 aa, Plasmodium falciparum
HSPLVRFFIMILNFDVIKKCLDDVY

SEQ ID NO: 3260955 - protein, 23 aa, Plasmodium falciparum
HSQFYFKKIKSIININIQELSTN

SEQ ID NO: 3260956 - protein, 24 aa, Plasmodium falciparum
HSRIVCMLICVYGVQVNKKDIKGN

SEQ ID NO: 3260957 - protein, 22 aa, Plasmodium falciparum
HSSDVLHLLPFFDHNGPFEYVK

SEQ ID NO: 3260958 - protein, 23 aa, Plasmodium falciparum
HSSKYFLHDKFLGIVKKFVQKNY

SEQ ID NO: 3260959 - protein, 18 aa, Plasmodium falciparum
HSSLQRGKHIKVNKKNEN

SEQ ID NO: 3260960 - protein, 26 aa, Plasmodium falciparum
HSTFSLNYYCCLGGEEIFLSNIFFDY

SEQ ID NO: 3260961 - protein, 25 aa, Plasmodium falciparum
HSVKLNTCRSLPIGSLNELKAYKSL

SEQ ID NO: 3260962 - protein, 19 aa, Plasmodium falciparum
HSWTTFTMETFIKCKISLE

SEQ ID NO: 3260963 - protein, 20 aa, Plasmodium falciparum
HSYASFKIQDLVLIKYLLNK

SEQ ID NO: 3260964 - protein, 25 aa, Plasmodium falciparum
HSYFMEFMLRLSIIDNEMLYRKGGN

SEQ ID NO: 3260965 - protein, 29 aa, Plasmodium falciparum
HSYMFSYLRLCTVPLYIYLYFDIPLSHTL

SEQ ID NO: 3260966 - protein, 24 aa, Plasmodium falciparum
HSYPKEGAYIYGLYLDGANYDVEK

SEQ ID NO: 3260967 - protein, 23 aa, Plasmodium falciparum
HTDFLKYGNKYNVDVDQNINITN

SEQ ID NO: 3260968 - protein, 22 aa, Plasmodium falciparum
HTDKYLIFLYELCYIDLCINNY

SEQ ID NO: 3260969 - protein, 22 aa, Plasmodium falciparum
HTDYCDPCSKFIVKCENGKCSN

SEQ ID NO: 3260970 - protein, 18 aa, Plasmodium falciparum
HTHYHYYYDYSIYSEKKK

SEQ ID NO: 3260971 - protein, 17 aa, Plasmodium falciparum
HTIKCNMITALSKYIIK

SEQ ID NO: 3260972 - protein, 23 aa, Plasmodium falciparum
HTKCKEDFFFFFVNKNYKRRIIV

SEQ ID NO: 3260973 - protein, 26 aa, Plasmodium falciparum
HTLPKKCPRGLGIPNIIKERNSINNC

SEQ ID NO: 3260974 - protein, 18 aa, Plasmodium falciparum
HTNGIKCEDKRKSTSIHM

SEQ ID NO: 3260975 - protein, 19 aa, Plasmodium falciparum
HTNHLKNGISISSDDDIFI

SEQ ID NO: 3260976 - protein, 19 aa, Plasmodium falciparum
HTPICTSRVLSECDKQSSI

SEQ ID NO: 3260977 - protein, 17 aa, Plasmodium falciparum
HTSKFFKYSKWKYDFIS

SEQ ID NO: 3260978 - protein, 27 aa, Plasmodium falciparum
HTYIYIKKRICDEIENNNIINLFKKAK

SEQ ID NO: 3260979 - protein, 23 aa, Plasmodium falciparum
HTYKKRSSNQFYFLENEKNKLKE

SEQ ID NO: 3260980 - protein, 25 aa, Plasmodium falciparum
HVCDICNKTGAVIQCSYDHEKLKSG

SEQ ID NO: 3260981 - protein, 20 aa, Plasmodium falciparum
HVCGVSALVYSVCYNQGFIP

SEQ ID NO: 3260982 - protein, 19 aa, Plasmodium falciparum
HVECLKILLRLNKIDKIKD

SEQ ID NO: 3260983 - protein, 20 aa, Plasmodium falciparum
HVEDNFYIKDDRMISPSKKI

SEQ ID NO: 3260984 - protein, 26 aa, Plasmodium falciparum
HVEEIFFFYDYVCEFIKRKRWEKEKK

SEQ ID NO: 3260985 - protein, 26 aa, Plasmodium falciparum
HVEEVLSMLSRIYIYIINYALKRGNG

SEQ ID NO: 3260986 - protein, 17 aa, Plasmodium falciparum
HVERIKYKMAVENINNI

SEQ ID NO: 3260987 - protein, 18 aa, Plasmodium falciparum
HVFPKVYPHHTIYNDYNK

SEQ ID NO: 3260988 - protein, 23 aa, Plasmodium falciparum
HVFSKCADILSCEKKNKKKKKKN

SEQ ID NO: 3260989 - protein, 19 aa, Plasmodium falciparum
HVKKKSIAFFPMRKNNGIK

SEQ ID NO: 3260990 - protein, 29 aa, Plasmodium falciparum
HVKNYFFHISLYFIKSLLCSRNNFNDLIK

SEQ ID NO: 3260991 - protein, 25 aa, Plasmodium falciparum
HVKQQRFSWFLAVVTLLIFIYFLYF

SEQ ID NO: 3260992 - protein, 18 aa, Plasmodium falciparum
HVLNNVKSLKNWTDDNDE

SEQ ID NO: 3260993 - protein, 21 aa, Plasmodium falciparum
HVLYRRLKININKYEEYLKSK

SEQ ID NO: 3260994 - protein, 17 aa, Plasmodium falciparum
HVMFKKMARIMIDNFFN

SEQ ID NO: 3260995 - protein, 24 aa, Plasmodium falciparum
HVPDTRFYDILGVGVNADMKEISE

SEQ ID NO: 3260996 - protein, 17 aa, Plasmodium falciparum
HVPTRLAVIKAFEQGVE

SEQ ID NO: 3260997 - protein, 26 aa, Plasmodium falciparum
HVQGCKECKPLFTFWDTVANYFHLEN

SEQ ID NO: 3260998 - protein, 31 aa, Plasmodium falciparum
HVSDCIKCYPFFLDKLNGINIIKEYDIIIDC

SEQ ID NO: 3260999 - protein, 32 aa, Plasmodium falciparum
HVSGILMRIWLNCSFTFIAYGFFIPNMNSFIS

SEQ ID NO: 3261000 - protein, 22 aa, Plasmodium falciparum
HVVIKWRGKPVFVKHRTPEDIQ

SEQ ID NO: 3261001 - protein, 22 aa, Plasmodium falciparum
HVVLPLLFSYNIEKIYENPVRT

SEQ ID NO: 3261002 - protein, 19 aa, Plasmodium falciparum
HVYVIKQIILDFAIYKNIL

SEQ ID NO: 3261003 - protein, 24 aa, Plasmodium falciparum
HVYYWKYLTELNIKCNNNNNNDKN

SEQ ID NO: 3261004 - protein, 27 aa, Plasmodium falciparum
HWEEILMLCQIFKILKIKNDILVDYIE

SEQ ID NO: 3261005 - protein, 35 aa, Plasmodium falciparum
HWENIKTIYCKNMQNKIVFVLAMKIFQIKKLYPNN

SEQ ID NO: 3261006 - protein, 20 aa, Plasmodium falciparum
HYACDRGYIDIVKYLVNQGA

SEQ ID NO: 3261007 - protein, 28 aa, Plasmodium falciparum
HYACKAIGMPECQTSLIYAVMVLCKSAK

SEQ ID NO: 3261008 - protein, 34 aa, Plasmodium falciparum
HYAIKSVNFLPILFFKFISLFKYFFKYEYVYKNY

SEQ ID NO: 3261009 - protein, 18 aa, Plasmodium falciparum
HYALSFLLYTHFTSPIRR

SEQ ID NO: 3261010 - protein, 23 aa, Plasmodium falciparum
HYCPWVANCVGFYNYKFFLLSLF

SEQ ID NO: 3261011 - protein, 26 aa, Plasmodium falciparum
HYCTPCFSACSLYKIWVANQKKEFEK

SEQ ID NO: 3261012 - protein, 21 aa, Plasmodium falciparum
HYEFLKNADFTNYFRQGYQLP

SEQ ID NO: 3261013 - protein, 25 aa, Plasmodium falciparum
HYEKKKKSCIIWLSFTSNMISSGLR

SEQ ID NO: 3261014 - protein, 25 aa, Plasmodium falciparum
HYENKRNTIGFFFYGNINIRKYIYK

SEQ ID NO: 3261015 - protein, 21 aa, Plasmodium falciparum
HYFELYKKYKKIFLDKKKDIN

SEQ ID NO: 3261016 - protein, 25 aa, Plasmodium falciparum
HYFHISCARIHKLFFEFDYNFLKTH

SEQ ID NO: 3261017 - protein, 33 aa, Plasmodium falciparum
HYFIYCFTKFSQILFFILRKFGYFLVILTLLTC

SEQ ID NO: 3261018 - protein, 20 aa, Plasmodium falciparum
HYFLDILKNFIFINDNFVYK

SEQ ID NO: 3261019 - protein, 23 aa, Plasmodium falciparum
HYHYLYKALCDFLSTKYKTNKLL

SEQ ID NO: 3261020 - protein, 21 aa, Plasmodium falciparum
HYIKDFIHIIINYFIMNKYMI

SEQ ID NO: 3261021 - protein, 24 aa, Plasmodium falciparum
HYIKEMRGKMYIKDIVTHFYNLDT

SEQ ID NO: 3261022 - protein, 17 aa, Plasmodium falciparum
HYISEGDKKMIIFDKEK

SEQ ID NO: 3261023 - protein, 34 aa, Plasmodium falciparum
HYKKYEEFLVCYGKIIYFNEMKNIYICSENKQNA

SEQ ID NO: 3261024 - protein, 20 aa, Plasmodium falciparum
HYLCYCCFVNIRSKYNTESF

SEQ ID NO: 3261025 - protein, 18 aa, Plasmodium falciparum
HYLDISKFISIFEIILLK

SEQ ID NO: 3261026 - protein, 17 aa, Plasmodium falciparum
HYLFSSIANHLRYPNSH

SEQ ID NO: 3261027 - protein, 17 aa, Plasmodium falciparum
HYLNKIVLFLKEKLKQF

SEQ ID NO: 3261028 - protein, 25 aa, Plasmodium falciparum
HYLRKKLKYLKSGIRSDPIRLSIRR

SEQ ID NO: 3261029 - protein, 20 aa, Plasmodium falciparum
HYMLHVFEIYYYKLDNFFSY

SEQ ID NO: 3261030 - protein, 18 aa, Plasmodium falciparum
HYMYFKYSSDQSIFVNYN

SEQ ID NO: 3261031 - protein, 17 aa, Plasmodium falciparum
HYNMLHIPHAVLKHLYS

SEQ ID NO: 3261032 - protein, 18 aa, Plasmodium falciparum
HYNPDVFYMLSLLSLTDK

SEQ ID NO: 3261033 - protein, 21 aa, Plasmodium falciparum
HYPGLIPKLYKVVYEPVNNNT

SEQ ID NO: 3261034 - protein, 22 aa, Plasmodium falciparum
HYPGLTPKLYKVLYEPECANCN

SEQ ID NO: 3261035 - protein, 20 aa, Plasmodium falciparum
HYRKDYKPSGFIINNVTLNI

SEQ ID NO: 3261036 - protein, 20 aa, Plasmodium falciparum
HYTFCLLKKNTVIGGVCFRP

SEQ ID NO: 3261037 - protein, 37 aa, Plasmodium falciparum
HYVFCILSLGLLPLILSWFPIFYFRLLHSACTLNECE

SEQ ID NO: 3261038 - protein, 21 aa, Plasmodium falciparum
HYYCINMKTKKIWNYILDTYI

SEQ ID NO: 3261039 - protein, 18 aa, Plasmodium falciparum
HYYCLSGITMFSQHKNIS

SEQ ID NO: 3261040 - protein, 18 aa, Plasmodium falciparum
HYYFKKRKYDLFNNFINI

SEQ ID NO: 3261041 - protein, 18 aa, Plasmodium falciparum
HYYGYLRLFHLILINEGQ

SEQ ID NO: 3261042 - protein, 18 aa, Plasmodium falciparum
HYYIGGFFLEGATFDITN

SEQ ID NO: 3261043 - protein, 24 aa, Plasmodium falciparum
IAAEKLCKIIEKFILTKDDASKPE

SEQ ID NO: 3261044 - protein, 23 aa, Plasmodium falciparum
IACIKASALSAQFVAGTIKCCKL

SEQ ID NO: 3261045 - protein, 17 aa, Plasmodium falciparum
IADMKRKIFCSIEKEKK

SEQ ID NO: 3261046 - protein, 17 aa, Plasmodium falciparum
IAEMLISYYENRESMYN

SEQ ID NO: 3261047 - protein, 24 aa, Plasmodium falciparum
IAFFAVCVCIWLYLRKNRDENKIN

SEQ ID NO: 3261048 - protein, 17 aa, Plasmodium falciparum
IAFYCLKNYDYINCYYI

SEQ ID NO: 3261049 - protein, 30 aa, Plasmodium falciparum
IAGCSNGLLVIWKLPPNFNGISVLNSKINE

SEQ ID NO: 3261050 - protein, 25 aa, Plasmodium falciparum
IAHYKLMRKSCDFLFPSNKWTVNYI

SEQ ID NO: 3261051 - protein, 18 aa, Plasmodium falciparum
IAIFKRFTKWNGLSITIY

SEQ ID NO: 3261052 - protein, 20 aa, Plasmodium falciparum
IAIICRFLYIVGSFYIIRGL

SEQ ID NO: 3261053 - protein, 18 aa, Plasmodium falciparum
IAIINNRHIILYGSCLLS

SEQ ID NO: 3261054 - protein, 21 aa, Plasmodium falciparum
IAIPCFTMLYMLDEIVHTTMT

SEQ ID NO: 3261055 - protein, 17 aa, Plasmodium falciparum
IAIVECFLLGSIFDTIK

SEQ ID NO: 3261056 - protein, 30 aa, Plasmodium falciparum
IAKEIKDLFSFCFKVLYFYVYKYIQSLYQY

SEQ ID NO: 3261057 - protein, 23 aa, Plasmodium falciparum
IAKKCVSYLTTLIFVLLFLIIIK

SEQ ID NO: 3261058 - protein, 17 aa, Plasmodium falciparum
IAKQLCKLFDHMCKKEL

SEQ ID NO: 3261059 - protein, 17 aa, Plasmodium falciparum
IALAFKIISNMKHEHIL

SEQ ID NO: 3261060 - protein, 22 aa, Plasmodium falciparum
IALCQAVSALIRNSNTPQAFLI

SEQ ID NO: 3261061 - protein, 17 aa, Plasmodium falciparum
IALLMNIFMAILDTSFN

SEQ ID NO: 3261062 - protein, 26 aa, Plasmodium falciparum
IALSNCYSIYLKKFIQVCQYMCDNIL

SEQ ID NO: 3261063 - protein, 18 aa, Plasmodium falciparum
IAMTCTHASINRSKIAKL

SEQ ID NO: 3261064 - protein, 36 aa, Plasmodium falciparum
IANHLRYPNSHTHYFSCLLLWIFKVSNTEIINEQIT

SEQ ID NO: 3261065 - protein, 24 aa, Plasmodium falciparum
IANILWSLSILNVYSRNVFEDGLY

SEQ ID NO: 3261066 - protein, 25 aa, Plasmodium falciparum
IAPGWGLICGVGYVGWTQYAAATVL

SEQ ID NO: 3261067 - protein, 17 aa, Plasmodium falciparum
IAPGWGLVSGIGYSTWT

SEQ ID NO: 3261068 - protein, 31 aa, Plasmodium falciparum
IAPIAWTLTFLLKCFYNLWVEYFTKGKTITV

SEQ ID NO: 3261069 - protein, 18 aa, Plasmodium falciparum
IAPMPFFRTTVMEILPYI

SEQ ID NO: 3261070 - protein, 27 aa, Plasmodium falciparum
IAQEMKYFKSIEILDKYLFKILNTEYK

SEQ ID NO: 3261071 - protein, 20 aa, Plasmodium falciparum
IAQIASCLLFYKHIGHTKYR

SEQ ID NO: 3261072 - protein, 24 aa, Plasmodium falciparum
IAQKENFKLLSLCTRNEYADLFND

SEQ ID NO: 3261073 - protein, 26 aa, Plasmodium falciparum
IARCLSVQCCVIFVNHRIPIFTILYD

SEQ ID NO: 3261074 - protein, 25 aa, Plasmodium falciparum
IARYTWKVENPKAYIFALHGVTTHL

SEQ ID NO: 3261075 - protein, 19 aa, Plasmodium falciparum
IASINKFVVLISATLVLSF

SEQ ID NO: 3261076 - protein, 25 aa, Plasmodium falciparum
IASTLTEFQVNLLLKDLEKKKVNKC

SEQ ID NO: 3261077 - protein, 22 aa, Plasmodium falciparum
IASYFLFQCAKLIKLLKKQIYI

SEQ ID NO: 3261078 - protein, 21 aa, Plasmodium falciparum
IATFLLFFLFSSFRLIIHSGA

SEQ ID NO: 3261079 - protein, 21 aa, Plasmodium falciparum
IATGLAVLVGGIIGTALYASR

SEQ ID NO: 3261080 - protein, 22 aa, Plasmodium falciparum
IATSPRIKGIFQEKYYCKTYSI

SEQ ID NO: 3261081 - protein, 21 aa, Plasmodium falciparum
IATTYAAVCVFIYLHDEENNF

SEQ ID NO: 3261082 - protein, 23 aa, Plasmodium falciparum
IATWACKHLALGCFGLNRQDALI

SEQ ID NO: 3261083 - protein, 17 aa, Plasmodium falciparum
IAVSGFLATLVHDLIIT

SEQ ID NO: 3261084 - protein, 17 aa, Plasmodium falciparum
IAYASSPFVKINLNNNK

SEQ ID NO: 3261085 - protein, 19 aa, Plasmodium falciparum
IAYMLKIYNNWSINSQTKS

SEQ ID NO: 3261086 - protein, 18 aa, Plasmodium falciparum
IAYYINEFILYLIENTQF

SEQ ID NO: 3261087 - protein, 19 aa, Plasmodium falciparum
ICARVKRGLTDTSLPGSVY

SEQ ID NO: 3261088 - protein, 17 aa, Plasmodium falciparum
ICASLGIHSILFKKQKS

SEQ ID NO: 3261089 - protein, 30 aa, Plasmodium falciparum
ICAYKIKYFYINIHLLKTVVCIFLKAQKVS

SEQ ID NO: 3261090 - protein, 17 aa, Plasmodium falciparum
ICCALQYLHSNNIIHRD

SEQ ID NO: 3261091 - protein, 19 aa, Plasmodium falciparum
ICDDYDYLLFYIIILYIND

SEQ ID NO: 3261092 - protein, 20 aa, Plasmodium falciparum
ICDKISYLTQSFVICPHINY

SEQ ID NO: 3261093 - protein, 18 aa, Plasmodium falciparum
ICDKKLDSTLSFNNLIKI

SEQ ID NO: 3261094 - protein, 21 aa, Plasmodium falciparum
ICDSFCNIYIYKILINDFLFL

SEQ ID NO: 3261095 - protein, 18 aa, Plasmodium falciparum
ICEEGICNNNPLDPGTEN

SEQ ID NO: 3261096 - protein, 17 aa, Plasmodium falciparum
ICEPCKTGTFKNYVGDD

SEQ ID NO: 3261097 - protein, 26 aa, Plasmodium falciparum
ICFFFCLFLTNVVYEYVHVLNSKKRK

SEQ ID NO: 3261098 - protein, 25 aa, Plasmodium falciparum
ICFFMKKKIKNILSYNPYYIHIESW

SEQ ID NO: 3261099 - protein, 23 aa, Plasmodium falciparum
ICFIILKVCLSKNINLNDEGKKK

SEQ ID NO: 3261100 - protein, 19 aa, Plasmodium falciparum
ICFILCLTGLNAHRTSKRG

SEQ ID NO: 3261101 - protein, 25 aa, Plasmodium falciparum
ICGRNAISTFFTRRGNIIRPQAAAG

SEQ ID NO: 3261102 - protein, 23 aa, Plasmodium falciparum
ICGTSAGSIVAAWICTRTNNELL

SEQ ID NO: 3261103 - protein, 30 aa, Plasmodium falciparum
ICIFLLFILFNYFCCALRSYKKYKVTTFIG

SEQ ID NO: 3261104 - protein, 24 aa, Plasmodium falciparum
ICIGDSMAAIGGMLYPWPKIKNTN

SEQ ID NO: 3261105 - protein, 25 aa, Plasmodium falciparum
ICIGDSMAAIGGMLYPWPKIKNTNN

SEQ ID NO: 3261106 - protein, 20 aa, Plasmodium falciparum
ICIIYYFNLNFFSVSAKNIN

SEQ ID NO: 3261107 - protein, 26 aa, Plasmodium falciparum
ICILDMCLYIHLLLKHKENKISIYNN

SEQ ID NO: 3261108 - protein, 19 aa, Plasmodium falciparum
ICILKKLNYDLSIPTPYSL

SEQ ID NO: 3261109 - protein, 22 aa, Plasmodium falciparum
ICIPDRRVQLCITALQDLKNSG

SEQ ID NO: 3261110 - protein, 20 aa, Plasmodium falciparum
ICISIFCTFFSFLDIPVFWP

SEQ ID NO: 3261111 - protein, 19 aa, Plasmodium falciparum
ICIYIGPIFSFFTCIISYF

SEQ ID NO: 3261112 - protein, 21 aa, Plasmodium falciparum
ICIYMKNYLFKFIGDDLSSLK

SEQ ID NO: 3261113 - protein, 24 aa, Plasmodium falciparum
ICKDKKEKKRNCIIQSRNGTGKSM

SEQ ID NO: 3261114 - protein, 27 aa, Plasmodium falciparum
ICKEIQNNCLIGYILKENNFYIDENIS

SEQ ID NO: 3261115 - protein, 38 aa, Plasmodium falciparum
ICKEKKKRTSIAFSGGIYSSFLLYAFVKYLKNVKNRQS

SEQ ID NO: 3261116 - protein, 25 aa, Plasmodium falciparum
ICKIRTVCNSTCRINSCNYCSCIFD

SEQ ID NO: 3261117 - protein, 43 aa, Plasmodium falciparum
ICKLKKKINCKLNFCSDDFFFILKFSYNYVFLLNIQKKKNVCF

SEQ ID NO: 3261118 - protein, 25 aa, Plasmodium falciparum
ICKMLKKEDDLFHIFLLLKNLCNDP

SEQ ID NO: 3261119 - protein, 17 aa, Plasmodium falciparum
ICKNFLIRHNIYDMYTF

SEQ ID NO: 3261120 - protein, 19 aa, Plasmodium falciparum
ICLDIKKLVDYNMYMNHFF

SEQ ID NO: 3261121 - protein, 20 aa, Plasmodium falciparum
ICLEKLCKKEYNIIFFNCAN

SEQ ID NO: 3261122 - protein, 19 aa, Plasmodium falciparum
ICLFLYFLSYNLYAKVNNE

SEQ ID NO: 3261123 - protein, 17 aa, Plasmodium falciparum
ICLFMKNVVSNIFYPGI

SEQ ID NO: 3261124 - protein, 19 aa, Plasmodium falciparum
ICLLFALKCKYPKQIHLIR

SEQ ID NO: 3261125 - protein, 27 aa, Plasmodium falciparum
ICLLLKRLTLTYFYKLQEYFKLEKKQD

SEQ ID NO: 3261126 - protein, 29 aa, Plasmodium falciparum
ICLLLNALMIWKLLVVFTGCESPVVVVLS

SEQ ID NO: 3261127 - protein, 26 aa, Plasmodium falciparum
ICLNIFCYIFIIKISMLYTGAPIALL

SEQ ID NO: 3261128 - protein, 21 aa, Plasmodium falciparum
ICLPTRIGFSKAFMSMVDGIK

SEQ ID NO: 3261129 - protein, 24 aa, Plasmodium falciparum
ICLRCGCGLGGVALGVGLFGGLGI

SEQ ID NO: 3261130 - protein, 19 aa, Plasmodium falciparum
ICLTYEFHHNFYILINKTN

SEQ ID NO: 3261131 - protein, 25 aa, Plasmodium falciparum
ICLYYLCSSIYFIKLTYYNFNLGTF

SEQ ID NO: 3261132 - protein, 21 aa, Plasmodium falciparum
ICMQFFTLCIYECRNNKMKND

SEQ ID NO: 3261133 - protein, 18 aa, Plasmodium falciparum
ICNISSCGKYIYIERFDT

SEQ ID NO: 3261134 - protein, 21 aa, Plasmodium falciparum
ICNKKEIIIAFYYPKSNNYIN

SEQ ID NO: 3261135 - protein, 20 aa, Plasmodium falciparum
ICNKLSVLREYFDVTHAYVI

SEQ ID NO: 3261136 - protein, 20 aa, Plasmodium falciparum
ICNLNGYFYLFNIYKNEEGK

SEQ ID NO: 3261137 - protein, 21 aa, Plasmodium falciparum
ICNYTFPMAINLLTLNNDENI

SEQ ID NO: 3261138 - protein, 21 aa, Plasmodium falciparum
ICSAIVFELYKLLLKDENTKI

SEQ ID NO: 3261139 - protein, 18 aa, Plasmodium falciparum
ICSFFFTMGIWQYKKMKK

SEQ ID NO: 3261140 - protein, 18 aa, Plasmodium falciparum
ICSFPSYHNYFLYINYLK

SEQ ID NO: 3261141 - protein, 23 aa, Plasmodium falciparum
ICSILLKYKYVYKYFKKYYYNKY

SEQ ID NO: 3261142 - protein, 20 aa, Plasmodium falciparum
ICSLSTYYMALSWGAYIFIT

SEQ ID NO: 3261143 - protein, 27 aa, Plasmodium falciparum
ICSMITSIVDFCFKYNLTRDLILNEDK

SEQ ID NO: 3261144 - protein, 25 aa, Plasmodium falciparum
ICTEAFVFFLCILNKKNMVFKKNIL

SEQ ID NO: 3261145 - protein, 17 aa, Plasmodium falciparum
ICTEMKQKNFLLYIYDL

SEQ ID NO: 3261146 - protein, 21 aa, Plasmodium falciparum
ICTNYFLAFFEDIYFNKHQLN

SEQ ID NO: 3261147 - protein, 19 aa, Plasmodium falciparum
ICTPKLFSEYIFSKKKINT

SEQ ID NO: 3261148 - protein, 20 aa, Plasmodium falciparum
ICTVLARSFADIGDIVRGKD

SEQ ID NO: 3261149 - protein, 20 aa, Plasmodium falciparum
ICTVLARSFADIGDIVRGRD

SEQ ID NO: 3261150 - protein, 20 aa, Plasmodium falciparum
ICVDMSKNLCAHINNTNNHI

SEQ ID NO: 3261151 - protein, 28 aa, Plasmodium falciparum
ICVENKRLLSILIFYTFVYYYNNNNNNN

SEQ ID NO: 3261152 - protein, 25 aa, Plasmodium falciparum
ICVPPRRRKLYIGKIKEWAGIQLKS

SEQ ID NO: 3261153 - protein, 23 aa, Plasmodium falciparum
ICVPPRRRKLYIQKLPDVEFDDK

SEQ ID NO: 3261154 - protein, 29 aa, Plasmodium falciparum
ICVPPRRRKLYLGGFKRLTDGTAVSSETT

SEQ ID NO: 3261155 - protein, 24 aa, Plasmodium falciparum
ICVPPRRRRLYVGGLTKLTSAGTS

SEQ ID NO: 3261156 - protein, 26 aa, Plasmodium falciparum
ICVPPRRRRLYVGGLTKWAEKQSSQG

SEQ ID NO: 3261157 - protein, 30 aa, Plasmodium falciparum
ICVPPRRRRLYVGGLTKWAKKYTGNTGESK

SEQ ID NO: 3261158 - protein, 25 aa, Plasmodium falciparum
ICVPPRRRRLYVGHLQKWAEKYNKV

SEQ ID NO: 3261159 - protein, 24 aa, Plasmodium falciparum
ICVPPRRRRLYVGKLEQWANKHNT

SEQ ID NO: 3261160 - protein, 25 aa, Plasmodium falciparum
ICVPPRRRRLYVGRLTKWAESKQVT

SEQ ID NO: 3261161 - protein, 24 aa, Plasmodium falciparum
ICVPPRRRRLYVTPLTRLAGGDGN

SEQ ID NO: 3261162 - protein, 24 aa, Plasmodium falciparum
ICVPPRRRRLYVTPLTTWASGGTT

SEQ ID NO: 3261163 - protein, 19 aa, Plasmodium falciparum
ICVSYNMKSHTFKRSISNL

SEQ ID NO: 3261164 - protein, 20 aa, Plasmodium falciparum
ICYDYCSMLNIWDKIFNNTV

SEQ ID NO: 3261165 - protein, 21 aa, Plasmodium falciparum
ICYFYTLLMYCIAKLHLSNNY

SEQ ID NO: 3261166 - protein, 25 aa, Plasmodium falciparum
ICYMHEINYLYPFFLENKKFIEHIK

SEQ ID NO: 3261167 - protein, 27 aa, Plasmodium falciparum
IDCKIVDFLKYFFSMKPFFLYIIKEDI

SEQ ID NO: 3261168 - protein, 32 aa, Plasmodium falciparum
IDDFMNLCSGIRRIDIKSGDYLNEILLSLSIH

SEQ ID NO: 3261169 - protein, 17 aa, Plasmodium falciparum
IDDIKMLCRSHVNDIIR

SEQ ID NO: 3261170 - protein, 25 aa, Plasmodium falciparum
IDDIKRLIVEHGLVKYFIKGIHLMY

SEQ ID NO: 3261171 - protein, 20 aa, Plasmodium falciparum
IDDKCSFGHVLNTFNKYDIN

SEQ ID NO: 3261172 - protein, 24 aa, Plasmodium falciparum
IDECFCALSNIILAILKGKLKIEY

SEQ ID NO: 3261173 - protein, 17 aa, Plasmodium falciparum
IDECGIFPPTGNDEDQS

SEQ ID NO: 3261174 - protein, 17 aa, Plasmodium falciparum
IDECLNMLCKNDNSYNY

SEQ ID NO: 3261175 - protein, 25 aa, Plasmodium falciparum
IDEDIKYAANMAAYFSKARKMEKTL

SEQ ID NO: 3261176 - protein, 17 aa, Plasmodium falciparum
IDEEIFLYQNCNINIHK

SEQ ID NO: 3261177 - protein, 24 aa, Plasmodium falciparum
IDEFYKHIEMCFLLLNNCKDNYIS

SEQ ID NO: 3261178 - protein, 31 aa, Plasmodium falciparum
IDEGFFDISIDIFFKYKWNNLLHISVCDLLQ

SEQ ID NO: 3261179 - protein, 18 aa, Plasmodium falciparum
IDEGVLFCTQGILERILE

SEQ ID NO: 3261180 - protein, 20 aa, Plasmodium falciparum
IDEIDSIGISRCMNNDMSFS

SEQ ID NO: 3261181 - protein, 25 aa, Plasmodium falciparum
IDENHELMDKWSLIKNCTNGKWIDC

SEQ ID NO: 3261182 - protein, 18 aa, Plasmodium falciparum
IDENHLLYNYIKILKDIE

SEQ ID NO: 3261183 - protein, 25 aa, Plasmodium falciparum
IDENNCIDIYWGIKCFTCEKKYHAN

SEQ ID NO: 3261184 - protein, 24 aa, Plasmodium falciparum
IDEVKDLFCTGDFLNIPRNARLAS

SEQ ID NO: 3261185 - protein, 21 aa, Plasmodium falciparum
IDFKILFYMDNYRMEKTVTAK

SEQ ID NO: 3261186 - protein, 24 aa, Plasmodium falciparum
IDFKLHDACIVVRGLGHVLPRRLR

SEQ ID NO: 3261187 - protein, 19 aa, Plasmodium falciparum
IDFLSAFKKNLYVVNFYNN

SEQ ID NO: 3261188 - protein, 18 aa, Plasmodium falciparum
IDFVHFFFYSIYKRIQYL

SEQ ID NO: 3261189 - protein, 17 aa, Plasmodium falciparum
IDFYDEFLFHKNKYYDN

SEQ ID NO: 3261190 - protein, 24 aa, Plasmodium falciparum
IDFYNLCYFMESITLLKIQNKKLY

SEQ ID NO: 3261191 - protein, 19 aa, Plasmodium falciparum
IDGKEELFFLGKNKVSYCN

SEQ ID NO: 3261192 - protein, 23 aa, Plasmodium falciparum
IDGLDFYNCIFLKKGEKRLVRKV

SEQ ID NO: 3261193 - protein, 19 aa, Plasmodium falciparum
IDGLFRKSIKYAVDKYKID

SEQ ID NO: 3261194 - protein, 19 aa, Plasmodium falciparum
IDGLKILLDPVFKIELISF

SEQ ID NO: 3261195 - protein, 20 aa, Plasmodium falciparum
IDGNFIGQWEMEALKYQNTS

SEQ ID NO: 3261196 - protein, 29 aa, Plasmodium falciparum
IDGTKCADVVLCLFKDGSIENSCFDELGY

SEQ ID NO: 3261197 - protein, 28 aa, Plasmodium falciparum
IDHLIPYFKREFFFKTLIGNNIILLLAK

SEQ ID NO: 3261198 - protein, 17 aa, Plasmodium falciparum
IDIALNWPQKVKYPNAF

SEQ ID NO: 3261199 - protein, 19 aa, Plasmodium falciparum
IDICKDSFIYLNLKLKNMF

SEQ ID NO: 3261200 - protein, 24 aa, Plasmodium falciparum
IDIDKELPLLVIFKDKLFCINSKY

SEQ ID NO: 3261201 - protein, 24 aa, Plasmodium falciparum
IDIDLLCDMIKRDVTYSCKLEINE

SEQ ID NO: 3261202 - protein, 17 aa, Plasmodium falciparum
IDIEIHYIKSIIEIQLY

SEQ ID NO: 3261203 - protein, 29 aa, Plasmodium falciparum
IDIFFPSRTKYNWIIHLIFIFLNSSSIIL

SEQ ID NO: 3261204 - protein, 26 aa, Plasmodium falciparum
IDIFFSAPCTYLFSKFIFVFEHQIDI

SEQ ID NO: 3261205 - protein, 18 aa, Plasmodium falciparum
IDIFKEINLHTSLQYFLN

SEQ ID NO: 3261206 - protein, 23 aa, Plasmodium falciparum
IDIFKSNILYFLKYKDEEYEETQ

SEQ ID NO: 3261207 - protein, 20 aa, Plasmodium falciparum
IDIFLGFLIFLLLYFNVINL

SEQ ID NO: 3261208 - protein, 28 aa, Plasmodium falciparum
IDIIMFRNAIKRAISCRKKFIKSLKGQE

SEQ ID NO: 3261209 - protein, 17 aa, Plasmodium falciparum
IDILKKKIKGEITILST

SEQ ID NO: 3261210 - protein, 17 aa, Plasmodium falciparum
IDILKYMKYEKCLNILS

SEQ ID NO: 3261211 - protein, 27 aa, Plasmodium falciparum
IDINLSVRCPLNYHGIFRKGNKLYKSI

SEQ ID NO: 3261212 - protein, 24 aa, Plasmodium falciparum
IDIRKNWYFDKYIIFKDIRHLQHI

SEQ ID NO: 3261213 - protein, 20 aa, Plasmodium falciparum
IDISKIIHRYICKKYYLYKS

SEQ ID NO: 3261214 - protein, 20 aa, Plasmodium falciparum
IDITKMYPYLKVIKYDRIYT

SEQ ID NO: 3261215 - protein, 17 aa, Plasmodium falciparum
IDITYKKKNEWILKRED

SEQ ID NO: 3261216 - protein, 20 aa, Plasmodium falciparum
IDIYEKIFLKDNLNKGLEEI

SEQ ID NO: 3261217 - protein, 24 aa, Plasmodium falciparum
IDIYKEKYKIISLLLNMFNNCLNG

SEQ ID NO: 3261218 - protein, 18 aa, Plasmodium falciparum
IDKALCISDFNFLLIQKS

SEQ ID NO: 3261219 - protein, 24 aa, Plasmodium falciparum
IDKDVIEALTLYLSMGSARKKIVQ

SEQ ID NO: 3261220 - protein, 20 aa, Plasmodium falciparum
IDKFKKYKCDVYISTSSNRE

SEQ ID NO: 3261221 - protein, 18 aa, Plasmodium falciparum
IDKHEWWNNFKINKGKEN

SEQ ID NO: 3261222 - protein, 17 aa, Plasmodium falciparum
IDKKEENIGIFILLNCQ

SEQ ID NO: 3261223 - protein, 25 aa, Plasmodium falciparum
IDKKGNKYFIVFAGHILEEYISSLL

SEQ ID NO: 3261224 - protein, 25 aa, Plasmodium falciparum
IDKKLLCILEIFLISYEKKINHNIF

SEQ ID NO: 3261225 - protein, 21 aa, Plasmodium falciparum
IDKLCYRKYNNVVVIIKNVNK

SEQ ID NO: 3261226 - protein, 21 aa, Plasmodium falciparum
IDKLKEAFPIPNLFDPSFEKA

SEQ ID NO: 3261227 - protein, 17 aa, Plasmodium falciparum
IDKRIQNKFSIINIDDI

SEQ ID NO: 3261228 - protein, 17 aa, Plasmodium falciparum
IDKSIQIYKYIVDTYEN

SEQ ID NO: 3261229 - protein, 30 aa, Plasmodium falciparum
IDKTLTFIKEFYPPLLRGGKDSDPENKQTG

SEQ ID NO: 3261230 - protein, 24 aa, Plasmodium falciparum
IDLFPPDFDFILNFLNNSLDRKDK

SEQ ID NO: 3261231 - protein, 24 aa, Plasmodium falciparum
IDLIARTYCKSHLEGLKKVYSYDN

SEQ ID NO: 3261232 - protein, 17 aa, Plasmodium falciparum
IDLIFSIFLYFDNFVYK

SEQ ID NO: 3261233 - protein, 17 aa, Plasmodium falciparum
IDLIKLANDPLNIHRNG

SEQ ID NO: 3261234 - protein, 22 aa, Plasmodium falciparum
IDLISKGDICFEVHNNNEIYST

SEQ ID NO: 3261235 - protein, 17 aa, Plasmodium falciparum
IDLISLKPFDMETIEKS

SEQ ID NO: 3261236 - protein, 19 aa, Plasmodium falciparum
IDLISNFIILPLITYNYYF

SEQ ID NO: 3261237 - protein, 20 aa, Plasmodium falciparum
IDLSCIHYSMLLGNKNERAL

SEQ ID NO: 3261238 - protein, 19 aa, Plasmodium falciparum
IDLSKACLTNYVLLQKEVS

SEQ ID NO: 3261239 - protein, 17 aa, Plasmodium falciparum
IDLYLSYFYLLSKINMI

SEQ ID NO: 3261240 - protein, 30 aa, Plasmodium falciparum
IDMPWMHKLSCFRDDIIFLCYIYQRCIYKV

SEQ ID NO: 3261241 - protein, 28 aa, Plasmodium falciparum
IDMRGTYCAISICSMCHILTNEVKKNVE

SEQ ID NO: 3261242 - protein, 17 aa, Plasmodium falciparum
IDMSNFFVAQRKKDPIE

SEQ ID NO: 3261243 - protein, 27 aa, Plasmodium falciparum
IDMYIYIICYYFMKRSNIQELLINVKQ

SEQ ID NO: 3261244 - protein, 17 aa, Plasmodium falciparum
IDNCGIKGFLEKNDTIK

SEQ ID NO: 3261245 - protein, 19 aa, Plasmodium falciparum
IDNCLRNYYCFPNEMKKLK

SEQ ID NO: 3261246 - protein, 18 aa, Plasmodium falciparum
IDNKSKPVYIREFKIHPI

SEQ ID NO: 3261247 - protein, 26 aa, Plasmodium falciparum
IDNLCLKKKIYLLGLNYDEYILLRGS

SEQ ID NO: 3261248 - protein, 20 aa, Plasmodium falciparum
IDNLKIFIFDEFYNIEDDNE

SEQ ID NO: 3261249 - protein, 24 aa, Plasmodium falciparum
IDNLTRLLLLIGVLLIFMYALFNN

SEQ ID NO: 3261250 - protein, 22 aa, Plasmodium falciparum
IDNSLVYMYQFFQQISKQIVFS

SEQ ID NO: 3261251 - protein, 18 aa, Plasmodium falciparum
IDNTFPLISIDQMNGIIQ

SEQ ID NO: 3261252 - protein, 24 aa, Plasmodium falciparum
IDNVWTRFESLCSYHNIPKKILFK

SEQ ID NO: 3261253 - protein, 24 aa, Plasmodium falciparum
IDNYINIICIHFLRAENRKKHIKK

SEQ ID NO: 3261254 - protein, 26 aa, Plasmodium falciparum
IDNYKKKYQCVLQWISRKEEEWKKIK

SEQ ID NO: 3261255 - protein, 19 aa, Plasmodium falciparum
IDPNLKINLPYNIISLYKL

SEQ ID NO: 3261256 - protein, 17 aa, Plasmodium falciparum
IDPYKSKIFFLINPNGD

SEQ ID NO: 3261257 - protein, 25 aa, Plasmodium falciparum
IDQFLRWLTEWAQQYCKEKLIKAHI

SEQ ID NO: 3261258 - protein, 17 aa, Plasmodium falciparum
IDRGRYIIFEDMKKKRK

SEQ ID NO: 3261259 - protein, 25 aa, Plasmodium falciparum
IDRKFLKKNITIMIEVLKEIFFKEY

SEQ ID NO: 3261260 - protein, 31 aa, Plasmodium falciparum
IDRLNIYRFFLRVAQSISMTKYKDILSIIMK

SEQ ID NO: 3261261 - protein, 17 aa, Plasmodium falciparum
IDRNKCIILDIYKDKQN

SEQ ID NO: 3261262 - protein, 20 aa, Plasmodium falciparum
IDRRYKLAKEHLKKEQEEKN

SEQ ID NO: 3261263 - protein, 25 aa, Plasmodium falciparum
IDSIICIKDKISFLYDDKKLYNTNE

SEQ ID NO: 3261264 - protein, 17 aa, Plasmodium falciparum
IDSLKYFNKTSCIESYM

SEQ ID NO: 3261265 - protein, 23 aa, Plasmodium falciparum
IDSLWGELIFAYVASKITEPIRI

SEQ ID NO: 3261266 - protein, 25 aa, Plasmodium falciparum
IDSMYWRKELKSCINNKRGKCKNKK

SEQ ID NO: 3261267 - protein, 26 aa, Plasmodium falciparum
IDSNVLQLLIYPSFFFQNNLDNDLII

SEQ ID NO: 3261268 - protein, 17 aa, Plasmodium falciparum
IDSSLCEPWKCYKGEDV

SEQ ID NO: 3261269 - protein, 17 aa, Plasmodium falciparum
IDTCMKEEYILSKTILE

SEQ ID NO: 3261270 - protein, 19 aa, Plasmodium falciparum
IDVFWKIHEEINFKQKKEN

SEQ ID NO: 3261271 - protein, 25 aa, Plasmodium falciparum
IDVLYKLLFQYPQIFYIFHVLASLK

SEQ ID NO: 3261272 - protein, 24 aa, Plasmodium falciparum
IDVMFEPRVKRFVPSRTRKTHVVG

SEQ ID NO: 3261273 - protein, 18 aa, Plasmodium falciparum
IDVVGRIKLHGTLYKHNI

SEQ ID NO: 3261274 - protein, 17 aa, Plasmodium falciparum
IDVVYLNNFFPLESFYN

SEQ ID NO: 3261275 - protein, 19 aa, Plasmodium falciparum
IDYDNLFKMSSYTSSVLSN

SEQ ID NO: 3261276 - protein, 33 aa, Plasmodium falciparum
IDYIKLFYLNICSHEIFKLIIINNEHITNVKIY

SEQ ID NO: 3261277 - protein, 17 aa, Plasmodium falciparum
IDYLRFVTAHVTIIYLF

SEQ ID NO: 3261278 - protein, 25 aa, Plasmodium falciparum
IDYMKNNICLVCFTSYKKSELVHCK

SEQ ID NO: 3261279 - protein, 17 aa, Plasmodium falciparum
IDYQKLFEKKICDKNQI

SEQ ID NO: 3261280 - protein, 21 aa, Plasmodium falciparum
IDYSLICFLNKYKIIHKYINY

SEQ ID NO: 3261281 - protein, 27 aa, Plasmodium falciparum
IEACLKKLEVYYSFSSFEDVICENNKG

SEQ ID NO: 3261282 - protein, 22 aa, Plasmodium falciparum
IEAIYFKLFNLVKIIKKKICVL

SEQ ID NO: 3261283 - protein, 20 aa, Plasmodium falciparum
IEALRNYFLSIISNIFQLNH

SEQ ID NO: 3261284 - protein, 19 aa, Plasmodium falciparum
IEATISLRLIDKIQGNIDG

SEQ ID NO: 3261285 - protein, 18 aa, Plasmodium falciparum
IECAKGYTNSFMTSLCVK

SEQ ID NO: 3261286 - protein, 17 aa, Plasmodium falciparum
IECCKIDKDKYSLRRSK

SEQ ID NO: 3261287 - protein, 24 aa, Plasmodium falciparum
IEDIFDCLYRIFSDTCPNVKSGGI

SEQ ID NO: 3261288 - protein, 24 aa, Plasmodium falciparum
IEDIKTRLKSILYPNNLDSEYKNI

SEQ ID NO: 3261289 - protein, 38 aa, Plasmodium falciparum
IEDIYFLFNRFFYFLLMYIRKFCCFSNKKDTNIPQNEA

SEQ ID NO: 3261290 - protein, 30 aa, Plasmodium falciparum
IEDYFFIKRFLPICEEFLLKNEDNVFFHFF

SEQ ID NO: 3261291 - protein, 20 aa, Plasmodium falciparum
IEECDICIVNSCTVKNPSEE

SEQ ID NO: 3261292 - protein, 25 aa, Plasmodium falciparum
IEECIKLNIHHFMFFPVIREENKTV

SEQ ID NO: 3261293 - protein, 17 aa, Plasmodium falciparum
IEECLLSSLKIYPLENN

SEQ ID NO: 3261294 - protein, 17 aa, Plasmodium falciparum
IEEECINIIFKIQNVEN

SEQ ID NO: 3261295 - protein, 31 aa, Plasmodium falciparum
IEENKLITFLLCWICHLYFLNNICNNKLVQG

SEQ ID NO: 3261296 - protein, 18 aa, Plasmodium falciparum
IEESCFDIKSFNNISNGK

SEQ ID NO: 3261297 - protein, 17 aa, Plasmodium falciparum
IEEYQRIACSSFDKKTF

SEQ ID NO: 3261298 - protein, 17 aa, Plasmodium falciparum
IEEYYLKKTENISLNNK

SEQ ID NO: 3261299 - protein, 23 aa, Plasmodium falciparum
IEFERRMNLIFIFQDPLTIVYEG

SEQ ID NO: 3261300 - protein, 27 aa, Plasmodium falciparum
IEFFIYFMNLLKICFEHPLYRDHLLSI

SEQ ID NO: 3261301 - protein, 23 aa, Plasmodium falciparum
IEFKCQEGYKIIGTTNIGVCTGR

SEQ ID NO: 3261302 - protein, 25 aa, Plasmodium falciparum
IEFYRKKDCTFVYKFFNDTLPTGST

SEQ ID NO: 3261303 - protein, 19 aa, Plasmodium falciparum
IEFYYTCDNYEVFMKLNGS

SEQ ID NO: 3261304 - protein, 19 aa, Plasmodium falciparum
IEGLITCIIFIFKYKNSLL

SEQ ID NO: 3261305 - protein, 20 aa, Plasmodium falciparum
IEHAFDFFKDLGITSYLFRQ

SEQ ID NO: 3261306 - protein, 21 aa, Plasmodium falciparum
IEHILCMIRFFMDFLNIKYTH

SEQ ID NO: 3261307 - protein, 25 aa, Plasmodium falciparum
IEHLIRYTNILAIFFSYDIFDELYL

SEQ ID NO: 3261308 - protein, 25 aa, Plasmodium falciparum
IEHMFKWRLFYNFCKKSPSPCNYFK

SEQ ID NO: 3261309 - protein, 20 aa, Plasmodium falciparum
IEIDPLFFLFFQNFKYFNEL

SEQ ID NO: 3261310 - protein, 17 aa, Plasmodium falciparum
IEIFHLFYHKKYNIKKL

SEQ ID NO: 3261311 - protein, 19 aa, Plasmodium falciparum
IEIIIPFIIKEKGEEKNLH

SEQ ID NO: 3261312 - protein, 17 aa, Plasmodium falciparum
IEIIKYIYTNDDLKNKK

SEQ ID NO: 3261313 - protein, 23 aa, Plasmodium falciparum
IEIRIIIWRCTMLTNKDNINKTM

SEQ ID NO: 3261314 - protein, 26 aa, Plasmodium falciparum
IEIRKLNELRLINGIKEQKELKDNES

SEQ ID NO: 3261315 - protein, 22 aa, Plasmodium falciparum
IEIRPLIHFKDLKHITIIKKYE

SEQ ID NO: 3261316 - protein, 22 aa, Plasmodium falciparum
IEIRPVECFEYIHIEGREHKLS

SEQ ID NO: 3261317 - protein, 17 aa, Plasmodium falciparum
IEIYKFHINEFNKLHEK

SEQ ID NO: 3261318 - protein, 29 aa, Plasmodium falciparum
IEIYNIYEKCFFYLYDIYMYIEKYETVLV

SEQ ID NO: 3261319 - protein, 25 aa, Plasmodium falciparum
IEKCPECKCTKKNLQDVFELTFDGK

SEQ ID NO: 3261320 - protein, 31 aa, Plasmodium falciparum
IEKDKKCGKEEIKLLRTLTEYICITKEQKRN

SEQ ID NO: 3261321 - protein, 29 aa, Plasmodium falciparum
IEKDKLLFCPKAFVIYEVLKRKLENKDEF

SEQ ID NO: 3261322 - protein, 17 aa, Plasmodium falciparum
IEKDYLFLIENLKDILE

SEQ ID NO: 3261323 - protein, 19 aa, Plasmodium falciparum
IEKEICKNIFFNINSNETY

SEQ ID NO: 3261324 - protein, 28 aa, Plasmodium falciparum
IEKEKYWRKIWLLIYTLINLILIKCKLY

SEQ ID NO: 3261325 - protein, 25 aa, Plasmodium falciparum
IEKFFIRLIDMMTFILTLILSKKTL

SEQ ID NO: 3261326 - protein, 24 aa, Plasmodium falciparum
IEKGCLRCGFGLSGVAGSIGLFGA

SEQ ID NO: 3261327 - protein, 26 aa, Plasmodium falciparum
IEKGNLFNFSIEWIFKSNNIVVRVQN

SEQ ID NO: 3261328 - protein, 17 aa, Plasmodium falciparum
IEKIWNILDNMIKYKQN

SEQ ID NO: 3261329 - protein, 22 aa, Plasmodium falciparum
IEKIYFLLAILGTLSVVSLYLY

SEQ ID NO: 3261330 - protein, 25 aa, Plasmodium falciparum
IEKKFCYECYSKIILNKIKKKKEKQ

SEQ ID NO: 3261331 - protein, 22 aa, Plasmodium falciparum
IEKKLHSIFSLMNIKNSDINNK

SEQ ID NO: 3261332 - protein, 18 aa, Plasmodium falciparum
IEKKRIEEVMKLYEEEKK

SEQ ID NO: 3261333 - protein, 33 aa, Plasmodium falciparum
IEKKVICSHLLNIFAAFQMCFEIIRKYKNAELE

SEQ ID NO: 3261334 - protein, 22 aa, Plasmodium falciparum
IEKLKYAILQGKQINYKIKDDI

SEQ ID NO: 3261335 - protein, 17 aa, Plasmodium falciparum
IEKNCGIKFNMETLPNN

SEQ ID NO: 3261336 - protein, 21 aa, Plasmodium falciparum
IEKRKECYQKINGKPFRKKKK

SEQ ID NO: 3261337 - protein, 26 aa, Plasmodium falciparum
IEKRKKLKLILWIQIYMYVWEEVEKD

SEQ ID NO: 3261338 - protein, 24 aa, Plasmodium falciparum
IEKYACIENSWILCGNEEINLKRI

SEQ ID NO: 3261339 - protein, 25 aa, Plasmodium falciparum
IEKYFKYEHVKILLKQLFNMFDNEL

SEQ ID NO: 3261340 - protein, 21 aa, Plasmodium falciparum
IELAFPKCFEHLFKKKKFFEL

SEQ ID NO: 3261341 - protein, 23 aa, Plasmodium falciparum
IELEAFIFGCFLYSWNDILTNNI

SEQ ID NO: 3261342 - protein, 21 aa, Plasmodium falciparum
IELINLMKIISVYGSIKKYMK

SEQ ID NO: 3261343 - protein, 20 aa, Plasmodium falciparum
IELMKDIYFLGQVPFFDLVA

SEQ ID NO: 3261344 - protein, 22 aa, Plasmodium falciparum
IELVMWCCVLYIFRYRGDVLYF

SEQ ID NO: 3261345 - protein, 30 aa, Plasmodium falciparum
IELYIPNFWRSIKSVNEIKSLTGNYYDFYY

SEQ ID NO: 3261346 - protein, 21 aa, Plasmodium falciparum
IEMEKDLLINKTETFNKWSKQ

SEQ ID NO: 3261347 - protein, 20 aa, Plasmodium falciparum
IEMEYLKVLNGFTLVDNKKL

SEQ ID NO: 3261348 - protein, 25 aa, Plasmodium falciparum
IEMYIVISILLTFGLVFSICVYLPF

SEQ ID NO: 3261349 - protein, 29 aa, Plasmodium falciparum
IENALIVSTCYRWPLLIDPQLQGLKWLKA

SEQ ID NO: 3261350 - protein, 25 aa, Plasmodium falciparum
IENARFYGFLFTWFKNHRKAQKVNE

SEQ ID NO: 3261351 - protein, 18 aa, Plasmodium falciparum
IENCVKCALEKNNEIYND

SEQ ID NO: 3261352 - protein, 27 aa, Plasmodium falciparum
IENIHFKNKIILFFIFTQCKYIYIKFF

SEQ ID NO: 3261353 - protein, 30 aa, Plasmodium falciparum
IENKEIIEYCFWRLVSIFESECIPNSWILL

SEQ ID NO: 3261354 - protein, 22 aa, Plasmodium falciparum
IENKRMILIPSLSKGFNDFLEF

SEQ ID NO: 3261355 - protein, 19 aa, Plasmodium falciparum
IENMKLCVVQEEYQQWDII

SEQ ID NO: 3261356 - protein, 26 aa, Plasmodium falciparum
IENNLNCKYSFMVYTLYIIVNALFNI

SEQ ID NO: 3261357 - protein, 22 aa, Plasmodium falciparum
IENPYISTLCDLIYSEETTNEF

SEQ ID NO: 3261358 - protein, 21 aa, Plasmodium falciparum
IENSLLCIFDLQDGDNNNNIN

SEQ ID NO: 3261359 - protein, 40 aa, Plasmodium falciparum
IENYQTWSLREVIQWLMLCNVPVKWLISFYKNNITGDKLK

SEQ ID NO: 3261360 - protein, 20 aa, Plasmodium falciparum
IEPIGYLKSYYSFSYSNISK

SEQ ID NO: 3261361 - protein, 18 aa, Plasmodium falciparum
IEPIKIYKSEFTKKSSNN

SEQ ID NO: 3261362 - protein, 23 aa, Plasmodium falciparum
IEPRFCFIRDSSYCISKPDYMNS

SEQ ID NO: 3261363 - protein, 26 aa, Plasmodium falciparum
IEQEMCYRKNPLIYKCDEDMLKYKML

SEQ ID NO: 3261364 - protein, 23 aa, Plasmodium falciparum
IEQFPPDVLINWQKSVIHNINHN

SEQ ID NO: 3261365 - protein, 17 aa, Plasmodium falciparum
IEQLLLSLIHNLENKKK

SEQ ID NO: 3261366 - protein, 20 aa, Plasmodium falciparum
IERGIIYHKTLRYVLEKLKL

SEQ ID NO: 3261367 - protein, 17 aa, Plasmodium falciparum
IERILYLLFLLDKYKNF

SEQ ID NO: 3261368 - protein, 19 aa, Plasmodium falciparum
IERKWLMYYFTKVVSKYFL

SEQ ID NO: 3261369 - protein, 17 aa, Plasmodium falciparum
IESALNFTIPFLEKNEI

SEQ ID NO: 3261370 - protein, 46 aa, Plasmodium falciparum
IESHLYYKVVSDILGLRLHSGLFISIFKYYLNYFLSPYTLQKDICP

SEQ ID NO: 3261371 - protein, 21 aa, Plasmodium falciparum
IESIKLLMNRVFDELFYYTKR

SEQ ID NO: 3261372 - protein, 23 aa, Plasmodium falciparum
IESIKYKSVFDIKNDLILMKNVI

SEQ ID NO: 3261373 - protein, 17 aa, Plasmodium falciparum
IESKKYIVRRFDKRRNE

SEQ ID NO: 3261374 - protein, 19 aa, Plasmodium falciparum
IESLEVYKHTIGNIQKEYI

SEQ ID NO: 3261375 - protein, 17 aa, Plasmodium falciparum
IESMNSLLLVNEHNDEL

SEQ ID NO: 3261376 - protein, 25 aa, Plasmodium falciparum
IESRYKNDCNFIFRNNLELYFNIVK

SEQ ID NO: 3261377 - protein, 22 aa, Plasmodium falciparum
IESSCYMFRLNENIIIDATKWG

SEQ ID NO: 3261378 - protein, 17 aa, Plasmodium falciparum
IESSGAKILKTKKYINN

SEQ ID NO: 3261379 - protein, 25 aa, Plasmodium falciparum
IESTLRIIQLMWLFDMDNAGTLYPN

SEQ ID NO: 3261380 - protein, 20 aa, Plasmodium falciparum
IESVKLCFENLKGLNKSFEE

SEQ ID NO: 3261381 - protein, 27 aa, Plasmodium falciparum
IESYELKEIFFLDVLRDVSKQMNKMSI

SEQ ID NO: 3261382 - protein, 29 aa, Plasmodium falciparum
IETFKYTKIRIFFNILKLIIEKKINEILI

SEQ ID NO: 3261383 - protein, 26 aa, Plasmodium falciparum
IETICRLKLKIVFIIFNNNGIYGNRD

SEQ ID NO: 3261384 - protein, 17 aa, Plasmodium falciparum
IETKYADIYSFKNYLNT

SEQ ID NO: 3261385 - protein, 23 aa, Plasmodium falciparum
IETNSICSIKFQKTKTSVFSFTN

SEQ ID NO: 3261386 - protein, 20 aa, Plasmodium falciparum
IETTKVCLIGSGGDSSHDLI

SEQ ID NO: 3261387 - protein, 17 aa, Plasmodium falciparum
IEYCLTKQDASSIQMLR

SEQ ID NO: 3261388 - protein, 25 aa, Plasmodium falciparum
IEYGFIKKWIQPMIPISRTGKKVAI

SEQ ID NO: 3261389 - protein, 20 aa, Plasmodium falciparum
IEYIYKYLFYESFNVNGWII

SEQ ID NO: 3261390 - protein, 17 aa, Plasmodium falciparum
IEYKLNNFELMHFLKNK

SEQ ID NO: 3261391 - protein, 17 aa, Plasmodium falciparum
IEYKRIFNLNSRKFTDE

SEQ ID NO: 3261392 - protein, 18 aa, Plasmodium falciparum
IEYLKFKYQYDIINEQYP

SEQ ID NO: 3261393 - protein, 20 aa, Plasmodium falciparum
IEYMCLFIIHETHNFYLTYE

SEQ ID NO: 3261394 - protein, 38 aa, Plasmodium falciparum
IEYNYKIDSYHFLKKLYYSVFNEPRICYTSINEQIKHI

SEQ ID NO: 3261395 - protein, 21 aa, Plasmodium falciparum
IEYSKAIKLENEFLSLNEDIF

SEQ ID NO: 3261396 - protein, 25 aa, Plasmodium falciparum
IEYSNLWKMKCKITDDIEEKIKSYQ

SEQ ID NO: 3261397 - protein, 18 aa, Plasmodium falciparum
IEYYLKYVYFFVIFENLV

SEQ ID NO: 3261398 - protein, 21 aa, Plasmodium falciparum
IFAHLIFKGIGISISNHNLEE

SEQ ID NO: 3261399 - protein, 23 aa, Plasmodium falciparum
IFATSVRVGRSFSPEDFIKTTVQ

SEQ ID NO: 3261400 - protein, 22 aa, Plasmodium falciparum
IFCFYVSFYILFITLFTKKNCL

SEQ ID NO: 3261401 - protein, 27 aa, Plasmodium falciparum
IFCIYSRCLCNISLHPSLADFFVENLR

SEQ ID NO: 3261402 - protein, 20 aa, Plasmodium falciparum
IFCNELRNSFSDFRNSFIGD

SEQ ID NO: 3261403 - protein, 19 aa, Plasmodium falciparum
IFDFFNEKVMDIFVPVDLE

SEQ ID NO: 3261404 - protein, 17 aa, Plasmodium falciparum
IFDGRVCVPPRRQHICD

SEQ ID NO: 3261405 - protein, 20 aa, Plasmodium falciparum
IFDKYFKPLFSYIALCKGSL

SEQ ID NO: 3261406 - protein, 19 aa, Plasmodium falciparum
IFDLSWSRDNEHVVCGISK

SEQ ID NO: 3261407 - protein, 27 aa, Plasmodium falciparum
IFDNIIQLSCEIFKTLLNFIEITKDSS

SEQ ID NO: 3261408 - protein, 21 aa, Plasmodium falciparum
IFDTYWRQRFMLFGTALLQFI

SEQ ID NO: 3261409 - protein, 23 aa, Plasmodium falciparum
IFDVIRFFLYNNIITKRNAHNHI

SEQ ID NO: 3261410 - protein, 35 aa, Plasmodium falciparum
IFDYKEFLFMSFFCFLLLYGFNIFLSICLFSSLYL

SEQ ID NO: 3261411 - protein, 23 aa, Plasmodium falciparum
IFEFLDIRYVYIKKKNIFVELYF

SEQ ID NO: 3261412 - protein, 17 aa, Plasmodium falciparum
IFEGDSIIKTMENKPNL

SEQ ID NO: 3261413 - protein, 17 aa, Plasmodium falciparum
IFEKINQLEFVFCKMLN

SEQ ID NO: 3261414 - protein, 17 aa, Plasmodium falciparum
IFEKLKLQEINNFAKQY

SEQ ID NO: 3261415 - protein, 34 aa, Plasmodium falciparum
IFEKNLYPYNCLKMLEKCLLFLSSVNNNKLCYYL

SEQ ID NO: 3261416 - protein, 23 aa, Plasmodium falciparum
IFEKPKRLFVIFLKDLIIISCGS

SEQ ID NO: 3261417 - protein, 26 aa, Plasmodium falciparum
IFEKYYLLLKMQKYILQYKHYSKNNL

SEQ ID NO: 3261418 - protein, 22 aa, Plasmodium falciparum
IFELLILFKNCLLREDLSNIIR

SEQ ID NO: 3261419 - protein, 22 aa, Plasmodium falciparum
IFEPRIEIIELNWHVRYYRHLT

SEQ ID NO: 3261420 - protein, 22 aa, Plasmodium falciparum
IFEQKFAKLFLYSNEQFNKIFF

SEQ ID NO: 3261421 - protein, 17 aa, Plasmodium falciparum
IFEVILLIIMIKIISDQ

SEQ ID NO: 3261422 - protein, 27 aa, Plasmodium falciparum
IFEYFHFFIKDLFLMLSDENKDIQKQA

SEQ ID NO: 3261423 - protein, 17 aa, Plasmodium falciparum
IFFAFNMLSIFLFSLPI

SEQ ID NO: 3261424 - protein, 17 aa, Plasmodium falciparum
IFFCHAGTFAIFPSITA

SEQ ID NO: 3261425 - protein, 18 aa, Plasmodium falciparum
IFFDLVFLFYLYDYSVNL

SEQ ID NO: 3261426 - protein, 26 aa, Plasmodium falciparum
IFFFFFKKAYFIESLFKDNRRKNILR

SEQ ID NO: 3261427 - protein, 22 aa, Plasmodium falciparum
IFFFSYKWYYQRNVWTHLHKIF

SEQ ID NO: 3261428 - protein, 19 aa, Plasmodium falciparum
IFFIHILNLLPCNFSLLSN

SEQ ID NO: 3261429 - protein, 18 aa, Plasmodium falciparum
IFFISYIIQLCFNTKYIY

SEQ ID NO: 3261430 - protein, 17 aa, Plasmodium falciparum
IFFKSNILLYLNKYDII

SEQ ID NO: 3261431 - protein, 22 aa, Plasmodium falciparum
IFFLKFERIIDMSITILTNISV

SEQ ID NO: 3261432 - protein, 20 aa, Plasmodium falciparum
IFFMSFKILEALLVCISILL

SEQ ID NO: 3261433 - protein, 22 aa, Plasmodium falciparum
IFFNCANNIYNYYIEFYQYIKN

SEQ ID NO: 3261434 - protein, 19 aa, Plasmodium falciparum
IFFNEWLHRTFGRAIGLFF

SEQ ID NO: 3261435 - protein, 17 aa, Plasmodium falciparum
IFFNYYLLLRLLLPLLF

SEQ ID NO: 3261436 - protein, 30 aa, Plasmodium falciparum
IFFSCSTHIFKNVFPFLFMLTGIATQHGNL

SEQ ID NO: 3261437 - protein, 19 aa, Plasmodium falciparum
IFFSFLIKKNEGSKMRDND

SEQ ID NO: 3261438 - protein, 26 aa, Plasmodium falciparum
IFFSFSIIYIYGWFIFNSSLNYYNIK

SEQ ID NO: 3261439 - protein, 26 aa, Plasmodium falciparum
IFFSKEYFLHINFYLIIKIICLVLFS

SEQ ID NO: 3261440 - protein, 22 aa, Plasmodium falciparum
IFFSLFILYYFYLGYIRGYLSV

SEQ ID NO: 3261441 - protein, 19 aa, Plasmodium falciparum
IFFTFYILKKYYHTWFQLS

SEQ ID NO: 3261442 - protein, 17 aa, Plasmodium falciparum
IFFTKIIFINIYHIYYK

SEQ ID NO: 3261443 - protein, 20 aa, Plasmodium falciparum
IFFYIHFKINVPKLLRIFFD

SEQ ID NO: 3261444 - protein, 39 aa, Plasmodium falciparum
IFFYQAYASWSCVKIYPELLYTFFSIFWVFIPIIYYMFL

SEQ ID NO: 3261445 - protein, 18 aa, Plasmodium falciparum
IFFYRKILIYEFLDNYFI

SEQ ID NO: 3261446 - protein, 18 aa, Plasmodium falciparum
IFGDHEFIIIIFYFIITP

SEQ ID NO: 3261447 - protein, 23 aa, Plasmodium falciparum
IFGDLFRYKYYFFEESKKVNEIK

SEQ ID NO: 3261448 - protein, 29 aa, Plasmodium falciparum
IFGMLKWKYHRVFNILKAFILLVLLIINA

SEQ ID NO: 3261449 - protein, 22 aa, Plasmodium falciparum
IFHIMNANLLPYMINENYNNIF

SEQ ID NO: 3261450 - protein, 20 aa, Plasmodium falciparum
IFHNSLRKNIQLMFIDQGYE

SEQ ID NO: 3261451 - protein, 20 aa, Plasmodium falciparum
IFHSYFFSFVLYFSFIYKHD

SEQ ID NO: 3261452 - protein, 24 aa, Plasmodium falciparum
IFICCFKEKKFVLYDMKKKTEYLS

SEQ ID NO: 3261453 - protein, 19 aa, Plasmodium falciparum
IFICKKCKHIYKDIKECRE

SEQ ID NO: 3261454 - protein, 19 aa, Plasmodium falciparum
IFIDIRIITLEYFYLYLDV

SEQ ID NO: 3261455 - protein, 19 aa, Plasmodium falciparum
IFIGTSIGYIFHYTGLYEF

SEQ ID NO: 3261456 - protein, 20 aa, Plasmodium falciparum
IFIGVIYYQRLRHMAYDKAQ

SEQ ID NO: 3261457 - protein, 25 aa, Plasmodium falciparum
IFIHIWRFAPDSIILIIYTILTLWF

SEQ ID NO: 3261458 - protein, 17 aa, Plasmodium falciparum
IFIILKFFENNNIKVIC

SEQ ID NO: 3261459 - protein, 25 aa, Plasmodium falciparum
IFIITIKIMTVFLFVLSLLNQFSKN

SEQ ID NO: 3261460 - protein, 26 aa, Plasmodium falciparum
IFIKCISEFLFLLLLVYNEVFEIFLR

SEQ ID NO: 3261461 - protein, 24 aa, Plasmodium falciparum
IFIKSIKVSINWSEVEQYNSYYNI

SEQ ID NO: 3261462 - protein, 24 aa, Plasmodium falciparum
IFILFCCDLIILMFVRIKKLILSF

SEQ ID NO: 3261463 - protein, 17 aa, Plasmodium falciparum
IFILIIFLYLNEKVICS

SEQ ID NO: 3261464 - protein, 19 aa, Plasmodium falciparum
IFILLNCVMDIYYIMEYTY

SEQ ID NO: 3261465 - protein, 21 aa, Plasmodium falciparum
IFILTCFYITLSSYYFIISFI

SEQ ID NO: 3261466 - protein, 26 aa, Plasmodium falciparum
IFINIPRYICSSYIFVKENEINYNMY

SEQ ID NO: 3261467 - protein, 17 aa, Plasmodium falciparum
IFISFYLINKHWQRALK

SEQ ID NO: 3261468 - protein, 19 aa, Plasmodium falciparum
IFITHNINKIFRLLLRNNV

SEQ ID NO: 3261469 - protein, 24 aa, Plasmodium falciparum
IFIWLEQNIRLFNDLLLFYIRNDK

SEQ ID NO: 3261470 - protein, 17 aa, Plasmodium falciparum
IFKCLKNDDNKVLLLSL

SEQ ID NO: 3261471 - protein, 22 aa, Plasmodium falciparum
IFKDFTKLLSLNNHYIIGEIVN

SEQ ID NO: 3261472 - protein, 24 aa, Plasmodium falciparum
IFKDLGSAFRIFGESLKKIHNDGN

SEQ ID NO: 3261473 - protein, 17 aa, Plasmodium falciparum
IFKFCKKLFSFSPQILH

SEQ ID NO: 3261474 - protein, 28 aa, Plasmodium falciparum
IFKGKYFWRELACFLRNLGIFASINLLL

SEQ ID NO: 3261475 - protein, 25 aa, Plasmodium falciparum
IFKGSNFWKGLGIYLGTLSGAVLGQ

SEQ ID NO: 3261476 - protein, 19 aa, Plasmodium falciparum
IFKKILLKINRYFQDNNDY

SEQ ID NO: 3261477 - protein, 36 aa, Plasmodium falciparum
IFKSYENITLFLFKRLFKCFLRYEGLVNNVSEKKIN

SEQ ID NO: 3261478 - protein, 26 aa, Plasmodium falciparum
IFLCCNNKFLTICIFGKQDIRDDNIT

SEQ ID NO: 3261479 - protein, 20 aa, Plasmodium falciparum
IFLCSCFTYIWILLTVLCNI

SEQ ID NO: 3261480 - protein, 17 aa, Plasmodium falciparum
IFLCSSGGPFQNLTMDE

SEQ ID NO: 3261481 - protein, 19 aa, Plasmodium falciparum
IFLCYIYQRCIYKVDKNRN

SEQ ID NO: 3261482 - protein, 27 aa, Plasmodium falciparum
IFLEIDRIIKFLIKYDDICDQINYVFN

SEQ ID NO: 3261483 - protein, 17 aa, Plasmodium falciparum
IFLEIIEKIKMILCCNI

SEQ ID NO: 3261484 - protein, 36 aa, Plasmodium falciparum
IFLFKEKKLDWFVFFLLKILMRKLWFDKHDDHDNYY

SEQ ID NO: 3261485 - protein, 18 aa, Plasmodium falciparum
IFLIMIFIPSDKINITSN

SEQ ID NO: 3261486 - protein, 25 aa, Plasmodium falciparum
IFLISGCLNITCKDSFNISLRTNKN

SEQ ID NO: 3261487 - protein, 19 aa, Plasmodium falciparum
IFLKARIISLDKFLNNTHF

SEQ ID NO: 3261488 - protein, 19 aa, Plasmodium falciparum
IFLKKEYDNNLIITYLLIK

SEQ ID NO: 3261489 - protein, 19 aa, Plasmodium falciparum
IFLKRIMRRKSYPYKITQI

SEQ ID NO: 3261490 - protein, 33 aa, Plasmodium falciparum
IFLLKHILIVLLICFNIYYGLYYIVFLTLILIT

SEQ ID NO: 3261491 - protein, 26 aa, Plasmodium falciparum
IFLLKNHFNLIYGLRNMKIYKIVLFC

SEQ ID NO: 3261492 - protein, 18 aa, Plasmodium falciparum
IFLLRAGDLIPCNCIEYN

SEQ ID NO: 3261493 - protein, 19 aa, Plasmodium falciparum
IFLNIYVERSFISHNDVIF

SEQ ID NO: 3261494 - protein, 23 aa, Plasmodium falciparum
IFLNPNYIYLIFFILSKIKYEYL

SEQ ID NO: 3261495 - protein, 28 aa, Plasmodium falciparum
IFLPISSNFFLYSILFLLEYLKDSQKKK

SEQ ID NO: 3261496 - protein, 18 aa, Plasmodium falciparum
IFLQEGLFDSDYKRAQEV

SEQ ID NO: 3261497 - protein, 22 aa, Plasmodium falciparum
IFLQFIKAVIMRGHMESSYLIR

SEQ ID NO: 3261498 - protein, 27 aa, Plasmodium falciparum
IFLQFLKIKTEWVLVELNNLEEKYHHY

SEQ ID NO: 3261499 - protein, 26 aa, Plasmodium falciparum
IFLQKKINKFFSFFKYIFSYIYDDVV

SEQ ID NO: 3261500 - protein, 26 aa, Plasmodium falciparum
IFLQSLSELCLTPWVKKSTHNLIRLQ

SEQ ID NO: 3261501 - protein, 21 aa, Plasmodium falciparum
IFLRSRKSVPSAFTHKISDDD

SEQ ID NO: 3261502 - protein, 17 aa, Plasmodium falciparum
IFLSLIINNLNKVKYNL

SEQ ID NO: 3261503 - protein, 17 aa, Plasmodium falciparum
IFLSRLISYDEIQICLQ

SEQ ID NO: 3261504 - protein, 19 aa, Plasmodium falciparum
IFLSYSLFIFRFCSLSNLK

SEQ ID NO: 3261505 - protein, 21 aa, Plasmodium falciparum
IFLTFLCILFCNDIIITKVKR

SEQ ID NO: 3261506 - protein, 17 aa, Plasmodium falciparum
IFLVVKFSYPSIWNTNK

SEQ ID NO: 3261507 - protein, 31 aa, Plasmodium falciparum
IFLYEYLKNVIIKRCNMIFKEQLDINYSIFY

SEQ ID NO: 3261508 - protein, 17 aa, Plasmodium falciparum
IFLYFIIFIGCVHVVFS

SEQ ID NO: 3261509 - protein, 28 aa, Plasmodium falciparum
IFLYIILRLIFFVVILILVFLKRKSPTP

SEQ ID NO: 3261510 - protein, 19 aa, Plasmodium falciparum
IFLYNICTIHCLIYENKKE

SEQ ID NO: 3261511 - protein, 19 aa, Plasmodium falciparum
IFLYTCIYTPLKRKTPYNT

SEQ ID NO: 3261512 - protein, 17 aa, Plasmodium falciparum
IFMCLLSIANLSLFTYF

SEQ ID NO: 3261513 - protein, 17 aa, Plasmodium falciparum
IFMKFYTVYLFIKHYGH

SEQ ID NO: 3261514 - protein, 19 aa, Plasmodium falciparum
IFMKGCHKSDHYIENNMVN

SEQ ID NO: 3261515 - protein, 27 aa, Plasmodium falciparum
IFMKVIKRFIKSFVILIYSDVYTVFHK

SEQ ID NO: 3261516 - protein, 19 aa, Plasmodium falciparum
IFNFIKRVYTVSSNTDVQN

SEQ ID NO: 3261517 - protein, 22 aa, Plasmodium falciparum
IFNIFKKKYETYVDMKTIESKY

SEQ ID NO: 3261518 - protein, 23 aa, Plasmodium falciparum
IFNIFKKKYETYVDMKTIESKYT

SEQ ID NO: 3261519 - protein, 24 aa, Plasmodium falciparum
IFNKCMLTFGCIYKNHIILPTIYL

SEQ ID NO: 3261520 - protein, 24 aa, Plasmodium falciparum
IFNKKFLKKVWAFGKYLERQTPVS

SEQ ID NO: 3261521 - protein, 17 aa, Plasmodium falciparum
IFNKLLIICKNIIDDNS

SEQ ID NO: 3261522 - protein, 25 aa, Plasmodium falciparum
IFNLKLCNKTLCSIICKHILISFYY

SEQ ID NO: 3261523 - protein, 19 aa, Plasmodium falciparum
IFNNCIHFISLLNSLGDTF

SEQ ID NO: 3261524 - protein, 26 aa, Plasmodium falciparum
IFNNMLKEQLKFFFLSLYIIKINSFN

SEQ ID NO: 3261525 - protein, 23 aa, Plasmodium falciparum
IFNSCLGVLLLIHLNVKNKGLSS

SEQ ID NO: 3261526 - protein, 24 aa, Plasmodium falciparum
IFNYTFRYSKIIKLLYLNKKGKRL

SEQ ID NO: 3261527 - protein, 25 aa, Plasmodium falciparum
IFPHFTWKSFMVVISIIQLIVFIIS

SEQ ID NO: 3261528 - protein, 22 aa, Plasmodium falciparum
IFPNILNKLFLVYINNFLQKNN

SEQ ID NO: 3261529 - protein, 25 aa, Plasmodium falciparum
IFPTKDFPYIIAWILGAIIAGTLFV

SEQ ID NO: 3261530 - protein, 23 aa, Plasmodium falciparum
IFPYCKLDLQLKLQFKKVTFNNS

SEQ ID NO: 3261531 - protein, 22 aa, Plasmodium falciparum
IFQYCQGCYIATYCSEKCKLTH

SEQ ID NO: 3261532 - protein, 28 aa, Plasmodium falciparum
IFRKIITRKKIRQFICENEKKKKKKYLQ

SEQ ID NO: 3261533 - protein, 18 aa, Plasmodium falciparum
IFRLLSFLYIQLLSKKKT

SEQ ID NO: 3261534 - protein, 22 aa, Plasmodium falciparum
IFRNKNNILSYFLILPSFFFMN

SEQ ID NO: 3261535 - protein, 17 aa, Plasmodium falciparum
IFRQVLESLSYLHKQKI

SEQ ID NO: 3261536 - protein, 30 aa, Plasmodium falciparum
IFSEKLPSWVYKIFYLFNFVIDIDIRLLFF

SEQ ID NO: 3261537 - protein, 23 aa, Plasmodium falciparum
IFSFFCLFFYFLHIIYFSLFNNI

SEQ ID NO: 3261538 - protein, 19 aa, Plasmodium falciparum
IFSGILFCGVPSIYRLLMR

SEQ ID NO: 3261539 - protein, 32 aa, Plasmodium falciparum
IFSGLSSFFFGFFNSVFSFFTFLFIGTLNQIQ

SEQ ID NO: 3261540 - protein, 20 aa, Plasmodium falciparum
IFSGSTLEYFFLLLKERNIN

SEQ ID NO: 3261541 - protein, 41 aa, Plasmodium falciparum
IFSIFYILLCCYYKNFIHFIISFTIIFFICINNEKNYESYR

SEQ ID NO: 3261542 - protein, 21 aa, Plasmodium falciparum
IFSILRKSMTIIFNLNEQVLY

SEQ ID NO: 3261543 - protein, 38 aa, Plasmodium falciparum
IFSNDMWKSKIKVIIEKCLQFIPSRRCTFKELYEDIKK

SEQ ID NO: 3261544 - protein, 18 aa, Plasmodium falciparum
IFSNVLKQHDKVFIFLYK

SEQ ID NO: 3261545 - protein, 26 aa, Plasmodium falciparum
IFSQCFCRRLFKLFMGFIYTFLFLFS

SEQ ID NO: 3261546 - protein, 17 aa, Plasmodium falciparum
IFSSLNFLMKDNPQLIY

SEQ ID NO: 3261547 - protein, 27 aa, Plasmodium falciparum
IFSTLFKIFFPLVIFALYNILIQINFK

SEQ ID NO: 3261548 - protein, 18 aa, Plasmodium falciparum
IFSYCNMRHNLNVVFNDI

SEQ ID NO: 3261549 - protein, 19 aa, Plasmodium falciparum
IFSYDIFYKLFNIYFNMYI

SEQ ID NO: 3261550 - protein, 17 aa, Plasmodium falciparum
IFSYKIIIAEGLLSLCL

SEQ ID NO: 3261551 - protein, 24 aa, Plasmodium falciparum
IFTCKSCKKTECINKNKYVHINYL

SEQ ID NO: 3261552 - protein, 17 aa, Plasmodium falciparum
IFTFCSLIGLLFKDLIK

SEQ ID NO: 3261553 - protein, 27 aa, Plasmodium falciparum
IFTFICVFISVLFKWTEDDKFRNGSHF

SEQ ID NO: 3261554 - protein, 21 aa, Plasmodium falciparum
IFTRKIHYELSRTLSEKHQLI

SEQ ID NO: 3261555 - protein, 28 aa, Plasmodium falciparum
IFTSIFYFIFGLIFCLNNSFQKINTSIL

SEQ ID NO: 3261556 - protein, 19 aa, Plasmodium falciparum
IFVCLAVYFVLTLKDGAGY

SEQ ID NO: 3261557 - protein, 19 aa, Plasmodium falciparum
IFVESICKKKTCVRIYIDK

SEQ ID NO: 3261558 - protein, 17 aa, Plasmodium falciparum
IFVILMIVFSLNAFIYL

SEQ ID NO: 3261559 - protein, 17 aa, Plasmodium falciparum
IFVKGINKNTSFYNEKY

SEQ ID NO: 3261560 - protein, 27 aa, Plasmodium falciparum
IFVLLKYSIYTILLWIVTITYNNYTYN

SEQ ID NO: 3261561 - protein, 22 aa, Plasmodium falciparum
IFVLRISLAILYHFNINNLFTM

SEQ ID NO: 3261562 - protein, 25 aa, Plasmodium falciparum
IFVREICLGLTIFLLTSYPLYFFKK

SEQ ID NO: 3261563 - protein, 17 aa, Plasmodium falciparum
IFWYLYIKSKFVKKQNM

SEQ ID NO: 3261564 - protein, 30 aa, Plasmodium falciparum
IFYDNIESYWIRWNKLNFEHFIFEKTNIED

SEQ ID NO: 3261565 - protein, 22 aa, Plasmodium falciparum
IFYEHFSKYISLIYNNSLQNIF

SEQ ID NO: 3261566 - protein, 17 aa, Plasmodium falciparum
IFYEYIKTYTINIIREN

SEQ ID NO: 3261567 - protein, 24 aa, Plasmodium falciparum
IFYFIFICCILRDICIIKKKREHI

SEQ ID NO: 3261568 - protein, 19 aa, Plasmodium falciparum
IFYFIPLSKRKNVYLHPLR

SEQ ID NO: 3261569 - protein, 19 aa, Plasmodium falciparum
IFYFVCLLLVIQIVLILLY

SEQ ID NO: 3261570 - protein, 19 aa, Plasmodium falciparum
IFYIKSKVFQRFRNLLERD

SEQ ID NO: 3261571 - protein, 25 aa, Plasmodium falciparum
IFYIMQCLLYLKLDYHMFYKSVLNM

SEQ ID NO: 3261572 - protein, 24 aa, Plasmodium falciparum
IFYLEKYFHVIRIKNMFTYHLNWL

SEQ ID NO: 3261573 - protein, 17 aa, Plasmodium falciparum
IFYLFNFIKQLKILDLY

SEQ ID NO: 3261574 - protein, 19 aa, Plasmodium falciparum
IFYNIAFSYMMLKRYNDSI

SEQ ID NO: 3261575 - protein, 18 aa, Plasmodium falciparum
IFYNLSFTKLTLGRLLYL

SEQ ID NO: 3261576 - protein, 18 aa, Plasmodium falciparum
IFYNYYIMINFIITLLNK

SEQ ID NO: 3261577 - protein, 21 aa, Plasmodium falciparum
IGAKLPKGILLSGEPGTGKTL

SEQ ID NO: 3261578 - protein, 18 aa, Plasmodium falciparum
IGASLSIYFYLDLPLLRT

SEQ ID NO: 3261579 - protein, 18 aa, Plasmodium falciparum
IGCLLKIAQVLNEQNYYD

SEQ ID NO: 3261580 - protein, 17 aa, Plasmodium falciparum
IGCSFVIVCFYVLEYST

SEQ ID NO: 3261581 - protein, 17 aa, Plasmodium falciparum
IGDAFLLVWKYQKKEYS

SEQ ID NO: 3261582 - protein, 19 aa, Plasmodium falciparum
IGDIKRFLDIISKNKIHNY

SEQ ID NO: 3261583 - protein, 26 aa, Plasmodium falciparum
IGEFKMLVMINRFLWRKIKKDLYDTN

SEQ ID NO: 3261584 - protein, 21 aa, Plasmodium falciparum
IGEIIYFLYLLNHFNNYELLN

SEQ ID NO: 3261585 - protein, 17 aa, Plasmodium falciparum
IGELAAFPDTCKRVEQY

SEQ ID NO: 3261586 - protein, 19 aa, Plasmodium falciparum
IGERHIISFDFSREHMNII

SEQ ID NO: 3261587 - protein, 18 aa, Plasmodium falciparum
IGFFLEFIALTFLFMSYW

SEQ ID NO: 3261588 - protein, 23 aa, Plasmodium falciparum
IGGCFIMKIKLSFDNFLLSIFSI

SEQ ID NO: 3261589 - protein, 17 aa, Plasmodium falciparum
IGGRILIYVWAYEQEEN

SEQ ID NO: 3261590 - protein, 18 aa, Plasmodium falciparum
IGGVLTCFDCTCIEWCHH

SEQ ID NO: 3261591 - protein, 24 aa, Plasmodium falciparum
IGIFPRLVKIVPTCAILFSTYHYF

SEQ ID NO: 3261592 - protein, 17 aa, Plasmodium falciparum
IGIGFAAFTYFLLKKKT

SEQ ID NO: 3261593 - protein, 25 aa, Plasmodium falciparum
IGIIARLALHFDNIRKKYPHFFNSR

SEQ ID NO: 3261594 - protein, 25 aa, Plasmodium falciparum
IGIIGICIQCYFIILSDTYYKTGDE

SEQ ID NO: 3261595 - protein, 21 aa, Plasmodium falciparum
IGIIIYRVFLKNCSLRKTLII

SEQ ID NO: 3261596 - protein, 20 aa, Plasmodium falciparum
IGIINCMRYFNLYKNYNNLS

SEQ ID NO: 3261597 - protein, 25 aa, Plasmodium falciparum
IGIIRSESNFAYFSHLIQAIQFDCE

SEQ ID NO: 3261598 - protein, 30 aa, Plasmodium falciparum
IGIKRKFNMSLSRIWYFFNNIDKIEEIDEK

SEQ ID NO: 3261599 - protein, 17 aa, Plasmodium falciparum
IGIKVFISSIITYKEPA

SEQ ID NO: 3261600 - protein, 23 aa, Plasmodium falciparum
IGIRSRSRRGIPLKKKSERNNSK

SEQ ID NO: 3261601 - protein, 21 aa, Plasmodium falciparum
IGIVFTFRLLTGMIFLAFSFI

SEQ ID NO: 3261602 - protein, 24 aa, Plasmodium falciparum
IGKKGPIFICEYINKFMDLYFEEN

SEQ ID NO: 3261603 - protein, 20 aa, Plasmodium falciparum
IGKRLYFFLYQSLLYGNNMK

SEQ ID NO: 3261604 - protein, 20 aa, Plasmodium falciparum
IGKSVVHGRTGPLRGDMEAE

SEQ ID NO: 3261605 - protein, 20 aa, Plasmodium falciparum
IGLDFDRLYFCSKYIQIKYF

SEQ ID NO: 3261606 - protein, 17 aa, Plasmodium falciparum
IGLEFADIYTALGSEIT

SEQ ID NO: 3261607 - protein, 20 aa, Plasmodium falciparum
IGLFFSFKFFYIYIIIPLYA

SEQ ID NO: 3261608 - protein, 18 aa, Plasmodium falciparum
IGLFGAVAINIWKPAALD

SEQ ID NO: 3261609 - protein, 28 aa, Plasmodium falciparum
IGLFGEVAINIWKPVAFDAAITAALNAN

SEQ ID NO: 3261610 - protein, 18 aa, Plasmodium falciparum
IGLFGGLGIYAWRSAALV

SEQ ID NO: 3261611 - protein, 18 aa, Plasmodium falciparum
IGLFGGVAINIWKPAALK

SEQ ID NO: 3261612 - protein, 18 aa, Plasmodium falciparum
IGLFPSILYFIFVLFYQL

SEQ ID NO: 3261613 - protein, 22 aa, Plasmodium falciparum
IGLIYRPGHKLAMEKGKELEYI

SEQ ID NO: 3261614 - protein, 18 aa, Plasmodium falciparum
IGLLGGPGIYGWKTAALA

SEQ ID NO: 3261615 - protein, 20 aa, Plasmodium falciparum
IGLLGGPGIYVWKIAALAAA

SEQ ID NO: 3261616 - protein, 17 aa, Plasmodium falciparum
IGLLSFIILFYLLMRNM

SEQ ID NO: 3261617 - protein, 19 aa, Plasmodium falciparum
IGLSLHGWKNKKYEMIEYY

SEQ ID NO: 3261618 - protein, 19 aa, Plasmodium falciparum
IGLYCIISGYYNYGYKIFT

SEQ ID NO: 3261619 - protein, 33 aa, Plasmodium falciparum
IGNIWFNYVYEIEILELLFLCFFLVPFCGNHLK

SEQ ID NO: 3261620 - protein, 27 aa, Plasmodium falciparum
IGNLGRNNIYINFSNTIIYNFLKIILK

SEQ ID NO: 3261621 - protein, 23 aa, Plasmodium falciparum
IGNMKGRCIINTSLNSYTLKRNC

SEQ ID NO: 3261622 - protein, 24 aa, Plasmodium falciparum
IGNSQCEWSEKLFLVEDDEESVTR

SEQ ID NO: 3261623 - protein, 24 aa, Plasmodium falciparum
IGNSSFKLAYAFFLLSLLYFIMII

SEQ ID NO: 3261624 - protein, 32 aa, Plasmodium falciparum
IGNYIPHDFMKLCLKNERFNISSLYMINIQNY

SEQ ID NO: 3261625 - protein, 22 aa, Plasmodium falciparum
IGSEPFDLIFVHSSFVSNYYNY

SEQ ID NO: 3261626 - protein, 38 aa, Plasmodium falciparum
IGTIEFRNELFLFVVEKWRLLSKFYYMDKYRSIYKIEK

SEQ ID NO: 3261627 - protein, 29 aa, Plasmodium falciparum
IGTLRIATFVSLVFKHNFFANGILTTKNI

SEQ ID NO: 3261628 - protein, 21 aa, Plasmodium falciparum
IGTTYAKFVKKISVLKQEKLS

SEQ ID NO: 3261629 - protein, 17 aa, Plasmodium falciparum
IGVAFLNNDMLHFRKYY

SEQ ID NO: 3261630 - protein, 20 aa, Plasmodium falciparum
IGVCALSFTVTKIAGSTAAA

SEQ ID NO: 3261631 - protein, 18 aa, Plasmodium falciparum
IGVIKDFYEPVHVKNLTN

SEQ ID NO: 3261632 - protein, 17 aa, Plasmodium falciparum
IGVKTIYVILRLLLTEM

SEQ ID NO: 3261633 - protein, 24 aa, Plasmodium falciparum
IGYCSSYNFLPINNFYTEKYDFIE

SEQ ID NO: 3261634 - protein, 26 aa, Plasmodium falciparum
IHCHLFMLRLLYKCYMNKLKNKYVYE

SEQ ID NO: 3261635 - protein, 17 aa, Plasmodium falciparum
IHDPISFAQDIYDLYSL

SEQ ID NO: 3261636 - protein, 28 aa, Plasmodium falciparum
IHEELFKRIVCDVARDKIKLNRKIKKLK

SEQ ID NO: 3261637 - protein, 20 aa, Plasmodium falciparum
IHFLPCKYYENSELISMQNL

SEQ ID NO: 3261638 - protein, 18 aa, Plasmodium falciparum
IHFLTYWILYSFYTYFES

SEQ ID NO: 3261639 - protein, 19 aa, Plasmodium falciparum
IHFLYYVLCSMLITTIPLL

SEQ ID NO: 3261640 - protein, 22 aa, Plasmodium falciparum
IHHIKMAYKIFSDIYTNKSTVD

SEQ ID NO: 3261641 - protein, 25 aa, Plasmodium falciparum
IHHKYGGWFEFGGAIHLKNMNYVEP

SEQ ID NO: 3261642 - protein, 26 aa, Plasmodium falciparum
IHHPPIYCPKGSLILGTTIESTDIHK

SEQ ID NO: 3261643 - protein, 23 aa, Plasmodium falciparum
IHICKIKNIPQCNTKESLNLISV

SEQ ID NO: 3261644 - protein, 17 aa, Plasmodium falciparum
IHIFYTFLHFHNVYFSS

SEQ ID NO: 3261645 - protein, 32 aa, Plasmodium falciparum
IHIGCELIKLIEICLDLSLVIFNNIDEIENID

SEQ ID NO: 3261646 - protein, 31 aa, Plasmodium falciparum
IHILNIICTLWRSFLDKMITLRLEEERLAME

SEQ ID NO: 3261647 - protein, 27 aa, Plasmodium falciparum
IHILNIKKYYSIMSFFLSEKLPIIKRK

SEQ ID NO: 3261648 - protein, 19 aa, Plasmodium falciparum
IHIPLYFEKIHFVEIVLFL

SEQ ID NO: 3261649 - protein, 19 aa, Plasmodium falciparum
IHIPYKFNGSIEKINEKKS

SEQ ID NO: 3261650 - protein, 29 aa, Plasmodium falciparum
IHIYLIKKIYLFWCYSCKSNDNSFFKNVM

SEQ ID NO: 3261651 - protein, 21 aa, Plasmodium falciparum
IHKDDRIKGITSREKNAEEIN

SEQ ID NO: 3261652 - protein, 24 aa, Plasmodium falciparum
IHKFSVIIRRIVKNEIVHVNMFNE

SEQ ID NO: 3261653 - protein, 25 aa, Plasmodium falciparum
IHKIYGFYISHCFLKLDHMSVNKLC

SEQ ID NO: 3261654 - protein, 23 aa, Plasmodium falciparum
IHKKESLHALYICKKNNKTLHGK

SEQ ID NO: 3261655 - protein, 19 aa, Plasmodium falciparum
IHKLLKYKNQIILNSILYI

SEQ ID NO: 3261656 - protein, 39 aa, Plasmodium falciparum
IHKSDIILEYVLKYNLFIFFKRLQLFYFMNTKKDLLFIY

SEQ ID NO: 3261657 - protein, 21 aa, Plasmodium falciparum
IHKYIPIYMYIIYYDKNQKIR

SEQ ID NO: 3261658 - protein, 22 aa, Plasmodium falciparum
IHKYMHNICLDIKKLVDYNMYM

SEQ ID NO: 3261659 - protein, 17 aa, Plasmodium falciparum
IHKYYLWSSLKSTLYNR

SEQ ID NO: 3261660 - protein, 24 aa, Plasmodium falciparum
IHLEEVKISILWTLTKYQKYIDPL

SEQ ID NO: 3261661 - protein, 18 aa, Plasmodium falciparum
IHLFIKMNGYYIGNLFLT

SEQ ID NO: 3261662 - protein, 29 aa, Plasmodium falciparum
IHLIHLQLHREIYCFKPFDFPIFKIFITT

SEQ ID NO: 3261663 - protein, 21 aa, Plasmodium falciparum
IHLINCPFLALSATIGNINCF

SEQ ID NO: 3261664 - protein, 17 aa, Plasmodium falciparum
IHLKSTFIKDKTSVEKN

SEQ ID NO: 3261665 - protein, 22 aa, Plasmodium falciparum
IHLLTLCILSMFYLNNKRFIFK

SEQ ID NO: 3261666 - protein, 17 aa, Plasmodium falciparum
IHLYFNCEEDYNISENE

SEQ ID NO: 3261667 - protein, 17 aa, Plasmodium falciparum
IHLYILILKSTRLVTNI

SEQ ID NO: 3261668 - protein, 18 aa, Plasmodium falciparum
IHLYTGLILYKIDTNVYL

SEQ ID NO: 3261669 - protein, 17 aa, Plasmodium falciparum
IHMLMLFSSLNILSNNI

SEQ ID NO: 3261670 - protein, 21 aa, Plasmodium falciparum
IHMNYIKSYFNGIFNEWIKTS

SEQ ID NO: 3261671 - protein, 18 aa, Plasmodium falciparum
IHMQNVIIKLYLNEVKNR

SEQ ID NO: 3261672 - protein, 18 aa, Plasmodium falciparum
IHMYKLWKNEKLLKKRMD

SEQ ID NO: 3261673 - protein, 19 aa, Plasmodium falciparum
IHNFKNFFIKDCVSKYTSR

SEQ ID NO: 3261674 - protein, 18 aa, Plasmodium falciparum
IHNKDIFKYDYPEYLNLC

SEQ ID NO: 3261675 - protein, 22 aa, Plasmodium falciparum
IHNKLHKCVQCDDIQIINAQEM

SEQ ID NO: 3261676 - protein, 19 aa, Plasmodium falciparum
IHNLFSCINFYIIFLYILK

SEQ ID NO: 3261677 - protein, 20 aa, Plasmodium falciparum
IHNLPILLFKTLKENKQISL

SEQ ID NO: 3261678 - protein, 24 aa, Plasmodium falciparum
IHNNLRPSSYIDMEHIAKGRDNTS

SEQ ID NO: 3261679 - protein, 30 aa, Plasmodium falciparum
IHQRHYKSFLNILGTCIIPIKVIDTHDEYK

SEQ ID NO: 3261680 - protein, 24 aa, Plasmodium falciparum
IHRCIKKRAKGERDWACNDKNTKE

SEQ ID NO: 3261681 - protein, 18 aa, Plasmodium falciparum
IHRIFPQFSIFSLTLYVT

SEQ ID NO: 3261682 - protein, 17 aa, Plasmodium falciparum
IHRRKGNNVLLNLIFVS

SEQ ID NO: 3261683 - protein, 19 aa, Plasmodium falciparum
IHRSLCECDLYTSTYDNDP

SEQ ID NO: 3261684 - protein, 27 aa, Plasmodium falciparum
IHSHLKYIIKFGYNYLKEVLENIFHIN

SEQ ID NO: 3261685 - protein, 25 aa, Plasmodium falciparum
IHSLKRSHSCPVLIKESPADNNEEM

SEQ ID NO: 3261686 - protein, 19 aa, Plasmodium falciparum
IHSPIEICKYMFNNIYNNI

SEQ ID NO: 3261687 - protein, 25 aa, Plasmodium falciparum
IHSSGSLFFKIPIKGKRYMKINNLD

SEQ ID NO: 3261688 - protein, 26 aa, Plasmodium falciparum
IHSSIGFVCNGLFWEYFKFNIPNFIK

SEQ ID NO: 3261689 - protein, 35 aa, Plasmodium falciparum
IHTFFNIYMSLKLIHPFLDLLYYKMCMENNLKKCN

SEQ ID NO: 3261690 - protein, 19 aa, Plasmodium falciparum
IHTIFLIFVAVCIEKYVLL

SEQ ID NO: 3261691 - protein, 19 aa, Plasmodium falciparum
IHVAKHIFEVILLIIMIKI

SEQ ID NO: 3261692 - protein, 25 aa, Plasmodium falciparum
IHVCSIKKFNKSCCLVNKKKTHKFI

SEQ ID NO: 3261693 - protein, 19 aa, Plasmodium falciparum
IHVGIMRFAKSMKTDIGYE

SEQ ID NO: 3261694 - protein, 18 aa, Plasmodium falciparum
IHVTGIYLEVFLCILEKL

SEQ ID NO: 3261695 - protein, 19 aa, Plasmodium falciparum
IHYLYKYKKCFDCGKNYVL

SEQ ID NO: 3261696 - protein, 21 aa, Plasmodium falciparum
IIADHFNCFVYGKNVDEAYEN

SEQ ID NO: 3261697 - protein, 17 aa, Plasmodium falciparum
IIALKLEIFKGRFGSPN

SEQ ID NO: 3261698 - protein, 17 aa, Plasmodium falciparum
IIALLALLYNENESNGD

SEQ ID NO: 3261699 - protein, 23 aa, Plasmodium falciparum
IICAHLYGSIFIYTLLPKKEIIK

SEQ ID NO: 3261700 - protein, 17 aa, Plasmodium falciparum
IICCNVTSIYGYIHNVR

SEQ ID NO: 3261701 - protein, 17 aa, Plasmodium falciparum
IICCSNISYFCIFLKFF

SEQ ID NO: 3261702 - protein, 24 aa, Plasmodium falciparum
IICDGVCIDSFYHLVQTNLPYWHN

SEQ ID NO: 3261703 - protein, 19 aa, Plasmodium falciparum
IICENCPYGSTTKSIGSKS

SEQ ID NO: 3261704 - protein, 18 aa, Plasmodium falciparum
IICETIHNPIINWDTKPG

SEQ ID NO: 3261705 - protein, 18 aa, Plasmodium falciparum
IICKDIKSNLLLNPSEIN

SEQ ID NO: 3261706 - protein, 26 aa, Plasmodium falciparum
IICNYCFFSYICLVLFLSSFDDSTLS

SEQ ID NO: 3261707 - protein, 17 aa, Plasmodium falciparum
IICSCVMNNKWFLFCRR

SEQ ID NO: 3261708 - protein, 26 aa, Plasmodium falciparum
IIDFFIGVIIINVFFFEYVKCQGKFV

SEQ ID NO: 3261709 - protein, 23 aa, Plasmodium falciparum
IIDFKIINHFILNKIFENISINC

SEQ ID NO: 3261710 - protein, 22 aa, Plasmodium falciparum
IIDGEYVFPLKYFYDEKKYKNQ

SEQ ID NO: 3261711 - protein, 21 aa, Plasmodium falciparum
IIDIIDIFKEYLLLIQQEIHT

SEQ ID NO: 3261712 - protein, 22 aa, Plasmodium falciparum
IIDLKLLMYNGMLRRKNRERLS

SEQ ID NO: 3261713 - protein, 17 aa, Plasmodium falciparum
IIDLKSYVKNLILGLSN

SEQ ID NO: 3261714 - protein, 20 aa, Plasmodium falciparum
IIDLLNLYKTDDWISNVEEL

SEQ ID NO: 3261715 - protein, 18 aa, Plasmodium falciparum
IIDSKYLYVGDIIELSVG

SEQ ID NO: 3261716 - protein, 24 aa, Plasmodium falciparum
IIEECLKNNLNIFSCDRNIHIVKN

SEQ ID NO: 3261717 - protein, 18 aa, Plasmodium falciparum
IIEFLLCELNHILKKTWQ

SEQ ID NO: 3261718 - protein, 35 aa, Plasmodium falciparum
IIEGLLCIITGVILKLSLIYIYCTYFMNIYIIKDY

SEQ ID NO: 3261719 - protein, 19 aa, Plasmodium falciparum
IIEICIKLNIKILSVFSFS

SEQ ID NO: 3261720 - protein, 18 aa, Plasmodium falciparum
IIEIDGPKHFFLYYNYEY

SEQ ID NO: 3261721 - protein, 23 aa, Plasmodium falciparum
IIEIPRLNLTLKRNNIDIKINTN

SEQ ID NO: 3261722 - protein, 21 aa, Plasmodium falciparum
IIEKADCLLRDTQKSGNIGRY

SEQ ID NO: 3261723 - protein, 24 aa, Plasmodium falciparum
IIEKKRKGLYYVIVDTINNLYNTT

SEQ ID NO: 3261724 - protein, 25 aa, Plasmodium falciparum
IIELYRKRNKFGFIKGISNNKKLIN

SEQ ID NO: 3261725 - protein, 18 aa, Plasmodium falciparum
IIENFPFFNSSMLPLYSS

SEQ ID NO: 3261726 - protein, 17 aa, Plasmodium falciparum
IIERCLYNINIMRSNIQ

SEQ ID NO: 3261727 - protein, 18 aa, Plasmodium falciparum
IIESTCFCKPGFYVTYDY

SEQ ID NO: 3261728 - protein, 25 aa, Plasmodium falciparum
IIEYLKKYSNIWYIDIEKYHSKSIK

SEQ ID NO: 3261729 - protein, 19 aa, Plasmodium falciparum
IIEYRKWRAKSKYRSPAKQ

SEQ ID NO: 3261730 - protein, 17 aa, Plasmodium falciparum
IIFCTSITAGSFFFFIS

SEQ ID NO: 3261731 - protein, 19 aa, Plasmodium falciparum
IIFFISRFDIHRHILTNDV

SEQ ID NO: 3261732 - protein, 35 aa, Plasmodium falciparum
IIFFNMIYLMVLFVVCFIGGILLGFLTTSYTSEIN

SEQ ID NO: 3261733 - protein, 18 aa, Plasmodium falciparum
IIFFSMFVYFFVYFYFIP

SEQ ID NO: 3261734 - protein, 24 aa, Plasmodium falciparum
IIFGNCWRITMRLYNNNNNNNNSN

SEQ ID NO: 3261735 - protein, 28 aa, Plasmodium falciparum
IIFGNFFVVHFFLCFKIPNNKITNVLTY

SEQ ID NO: 3261736 - protein, 17 aa, Plasmodium falciparum
IIFIFKYKNSLLGSVLF

SEQ ID NO: 3261737 - protein, 19 aa, Plasmodium falciparum
IIFIPGFPVLVGIVSVGFC

SEQ ID NO: 3261738 - protein, 18 aa, Plasmodium falciparum
IIFITALSMMEFPVLPML

SEQ ID NO: 3261739 - protein, 25 aa, Plasmodium falciparum
IIFKGSNFWKGLGIYLCTLSGAALG

SEQ ID NO: 3261740 - protein, 18 aa, Plasmodium falciparum
IIFLKILFTYSFISILLM

SEQ ID NO: 3261741 - protein, 18 aa, Plasmodium falciparum
IIFPCFTTLIITFLSFNI

SEQ ID NO: 3261742 - protein, 18 aa, Plasmodium falciparum
IIFPECSHLVLTEKSYEL

SEQ ID NO: 3261743 - protein, 19 aa, Plasmodium falciparum
IIFPFERFEELLLKYFEIN

SEQ ID NO: 3261744 - protein, 19 aa, Plasmodium falciparum
IIFPNVFFIDIYKSFKKHF

SEQ ID NO: 3261745 - protein, 21 aa, Plasmodium falciparum
IIFQLGGLHKFMNWNSPILTD

SEQ ID NO: 3261746 - protein, 25 aa, Plasmodium falciparum
IIFSCSICILFIFIHFLINLIENDM

SEQ ID NO: 3261747 - protein, 18 aa, Plasmodium falciparum
IIFSCVRSKLEVLENSKL

SEQ ID NO: 3261748 - protein, 17 aa, Plasmodium falciparum
IIFVICVTVWIINFKHF

SEQ ID NO: 3261749 - protein, 19 aa, Plasmodium falciparum
IIGNLPFYITSQILFCLLD

SEQ ID NO: 3261750 - protein, 19 aa, Plasmodium falciparum
IIGTLPLCRNILYREKVDI

SEQ ID NO: 3261751 - protein, 18 aa, Plasmodium falciparum
IIGYIKLIHILKSVRSSK

SEQ ID NO: 3261752 - protein, 18 aa, Plasmodium falciparum
IIHIDFGYILNIYPGISI

SEQ ID NO: 3261753 - protein, 24 aa, Plasmodium falciparum
IIHKNEFLALFLTKRIEEEVFLKK

SEQ ID NO: 3261754 - protein, 17 aa, Plasmodium falciparum
IIHSLFFYNKLIYLRIV

SEQ ID NO: 3261755 - protein, 21 aa, Plasmodium falciparum
IIHVYPFIYLRIKHVKITQML

SEQ ID NO: 3261756 - protein, 27 aa, Plasmodium falciparum
IIIECLYIQLLLFFFKYMIQTLSYEIS

SEQ ID NO: 3261757 - protein, 27 aa, Plasmodium falciparum
IIIEIIPQLFIKYVNFFYPYIYNNDVS

SEQ ID NO: 3261758 - protein, 18 aa, Plasmodium falciparum
IIIFFLLFFSCYNFNLEL

SEQ ID NO: 3261759 - protein, 24 aa, Plasmodium falciparum
IIIFLKWVSCKKYIFSVFVFLCCF

SEQ ID NO: 3261760 - protein, 17 aa, Plasmodium falciparum
IIIFLSIESLEEILSVF

SEQ ID NO: 3261761 - protein, 20 aa, Plasmodium falciparum
IIIFVFPFVLKNMIHSDDSQ

SEQ ID NO: 3261762 - protein, 17 aa, Plasmodium falciparum
IIIHFLKNPIAIYLYNH

SEQ ID NO: 3261763 - protein, 17 aa, Plasmodium falciparum
IIIIFKYIQNYHDNMNF

SEQ ID NO: 3261764 - protein, 18 aa, Plasmodium falciparum
IIIIIIIIIIITFLIVIM

SEQ ID NO: 3261765 - protein, 19 aa, Plasmodium falciparum
IIIILSLNYSKYIQSFFFN

SEQ ID NO: 3261766 - protein, 31 aa, Plasmodium falciparum
IIIKYIITILFYIHCDLFFKHISYLENMYIS

SEQ ID NO: 3261767 - protein, 18 aa, Plasmodium falciparum
IIILGKYLQLSFCTICIA

SEQ ID NO: 3261768 - protein, 17 aa, Plasmodium falciparum
IIILLLITNNRSSNICK

SEQ ID NO: 3261769 - protein, 20 aa, Plasmodium falciparum
IIINICKILTYNTIENNSIN

SEQ ID NO: 3261770 - protein, 25 aa, Plasmodium falciparum
IIINPEIIPIFLILLFAIFIVAYLV

SEQ ID NO: 3261771 - protein, 26 aa, Plasmodium falciparum
IIINWKKEINCIFNLLNKLTYLKIRD

SEQ ID NO: 3261772 - protein, 17 aa, Plasmodium falciparum
IIIPLSLNFILQKDTKK

SEQ ID NO: 3261773 - protein, 17 aa, Plasmodium falciparum
IIIQPYIKWLFIKLKKS

SEQ ID NO: 3261774 - protein, 17 aa, Plasmodium falciparum
IIIRAIISLNYISKDIV

SEQ ID NO: 3261775 - protein, 23 aa, Plasmodium falciparum
IIIRRAQCSLNIEKYKDFFMNIY

SEQ ID NO: 3261776 - protein, 30 aa, Plasmodium falciparum
IIIRRSRRKGLRAFDNIKIMKRFRLFNKTI

SEQ ID NO: 3261777 - protein, 25 aa, Plasmodium falciparum
IIISMWCVFAIYLTIRIMSPDNFDW

SEQ ID NO: 3261778 - protein, 17 aa, Plasmodium falciparum
IIISVAFFFLHFYLLSE

SEQ ID NO: 3261779 - protein, 24 aa, Plasmodium falciparum
IIITKSIRENICINIVKENYISIN

SEQ ID NO: 3261780 - protein, 18 aa, Plasmodium falciparum
IIITLLLNILWLNVHKYI

SEQ ID NO: 3261781 - protein, 25 aa, Plasmodium falciparum
IIIVCVIALIGLICFLVENKESILE

SEQ ID NO: 3261782 - protein, 34 aa, Plasmodium falciparum
IIKAKKKKINFCEFSFTFSYNFKTLYTFFYTTKK

SEQ ID NO: 3261783 - protein, 24 aa, Plasmodium falciparum
IIKECKKDKCYLLYNENKDSSYYY

SEQ ID NO: 3261784 - protein, 22 aa, Plasmodium falciparum
IIKECVDNLLFINRYLVEEMLE

SEQ ID NO: 3261785 - protein, 20 aa, Plasmodium falciparum
IIKECVSIILQMYDISKKQH

SEQ ID NO: 3261786 - protein, 17 aa, Plasmodium falciparum
IIKEKKKNCSYDFQKID

SEQ ID NO: 3261787 - protein, 18 aa, Plasmodium falciparum
IIKENFLKSYLSLVKQNK

SEQ ID NO: 3261788 - protein, 23 aa, Plasmodium falciparum
IIKESWRRWARIDTVDDMTLVIL

SEQ ID NO: 3261789 - protein, 17 aa, Plasmodium falciparum
IIKFCLHYISMKKIITL

SEQ ID NO: 3261790 - protein, 18 aa, Plasmodium falciparum
IIKFRYTHELWAKKKGVG

SEQ ID NO: 3261791 - protein, 25 aa, Plasmodium falciparum
IIKIYSFQSAHPFFFTTVKRKDILN

SEQ ID NO: 3261792 - protein, 22 aa, Plasmodium falciparum
IIKKKRRKFIFTAKKQSSYSNT

SEQ ID NO: 3261793 - protein, 23 aa, Plasmodium falciparum
IIKKKVTFCPKIKRCSHSKNKKL

SEQ ID NO: 3261794 - protein, 21 aa, Plasmodium falciparum
IIKKMFKLYINIIKKEYNNKN

SEQ ID NO: 3261795 - protein, 19 aa, Plasmodium falciparum
IIKKTKCPFLSNTKVLYNK

SEQ ID NO: 3261796 - protein, 26 aa, Plasmodium falciparum
IIKNCLSSLIWRLSIINPNLPRTIER

SEQ ID NO: 3261797 - protein, 28 aa, Plasmodium falciparum
IIKNLFWSNLVELFLKYNNLNKYKKILN

SEQ ID NO: 3261798 - protein, 17 aa, Plasmodium falciparum
IIKNVKCDNRIFSNFNQ

SEQ ID NO: 3261799 - protein, 22 aa, Plasmodium falciparum
IIKQQGLATYEFVEEEKSLTDK

SEQ ID NO: 3261800 - protein, 27 aa, Plasmodium falciparum
IIKRLKGYRLSYSEYKLLIRTMNDMFK

SEQ ID NO: 3261801 - protein, 17 aa, Plasmodium falciparum
IIKRWKHYIKIKRLKKH

SEQ ID NO: 3261802 - protein, 22 aa, Plasmodium falciparum
IIKSCTMFSLLSISYFLKDSFY

SEQ ID NO: 3261803 - protein, 24 aa, Plasmodium falciparum
IIKSIKELLCSLNVKEDIQVDNSY

SEQ ID NO: 3261804 - protein, 19 aa, Plasmodium falciparum
IIKTCKKYIILTDTVSNLF

SEQ ID NO: 3261805 - protein, 21 aa, Plasmodium falciparum
IIKTEGILFGSIDVFRLILIK

SEQ ID NO: 3261806 - protein, 26 aa, Plasmodium falciparum
IIKTNMLYYFVLYILKYIKYKIKKRM

SEQ ID NO: 3261807 - protein, 18 aa, Plasmodium falciparum
IIKYDCNNEIYLKDINKI

SEQ ID NO: 3261808 - protein, 18 aa, Plasmodium falciparum
IIKYFLINKNYVLIKIFY

SEQ ID NO: 3261809 - protein, 23 aa, Plasmodium falciparum
IIKYKLDRKFIRFLKTNYKKNII

SEQ ID NO: 3261810 - protein, 33 aa, Plasmodium falciparum
IIKYSNPFKSLFLYRIINYFTMVDLYKVKGITF

SEQ ID NO: 3261811 - protein, 19 aa, Plasmodium falciparum
IILCINNKLYFGIIKKKKD

SEQ ID NO: 3261812 - protein, 18 aa, Plasmodium falciparum
IILCLKMIIKAADLSHNC

SEQ ID NO: 3261813 - protein, 21 aa, Plasmodium falciparum
IILCLLLFLSSNCYGKSNLRN

SEQ ID NO: 3261814 - protein, 24 aa, Plasmodium falciparum
IILDIKLVIKKAVERVLCDKGVSQ

SEQ ID NO: 3261815 - protein, 18 aa, Plasmodium falciparum
IILFFLLFFYDYYSNNYK

SEQ ID NO: 3261816 - protein, 19 aa, Plasmodium falciparum
IILGTLFFAYILYVKYNYN

SEQ ID NO: 3261817 - protein, 18 aa, Plasmodium falciparum
IILIILFIKYNVVNGLLK

SEQ ID NO: 3261818 - protein, 22 aa, Plasmodium falciparum
IILIIYLCFLIKKSGILENEHV

SEQ ID NO: 3261819 - protein, 19 aa, Plasmodium falciparum
IILIKSFKNSTYIGNNINV

SEQ ID NO: 3261820 - protein, 17 aa, Plasmodium falciparum
IILIYSLFILIKMYLVC

SEQ ID NO: 3261821 - protein, 26 aa, Plasmodium falciparum
IILKGEFLRNVNFYDLSILLASHSDT

SEQ ID NO: 3261822 - protein, 23 aa, Plasmodium falciparum
IILKKKLFSTWVFLWNKYINFRT

SEQ ID NO: 3261823 - protein, 17 aa, Plasmodium falciparum
IILKLCDDLIRYEYIER

SEQ ID NO: 3261824 - protein, 24 aa, Plasmodium falciparum
IILKLNEYLIWLLILHKNDSVIRY

SEQ ID NO: 3261825 - protein, 24 aa, Plasmodium falciparum
IILLCREIFHENFILFQNVENHTL

SEQ ID NO: 3261826 - protein, 17 aa, Plasmodium falciparum
IILLFLLFPLNIFLSFS

SEQ ID NO: 3261827 - protein, 27 aa, Plasmodium falciparum
IILLVTLLYRYTFLGLLFGRKKKDVKK

SEQ ID NO: 3261828 - protein, 25 aa, Plasmodium falciparum
IILNEYKNIFIFFAASGFDVLCVNY

SEQ ID NO: 3261829 - protein, 17 aa, Plasmodium falciparum
IILNFSYIFYLNKKLSL

SEQ ID NO: 3261830 - protein, 29 aa, Plasmodium falciparum
IILNHIRTLINFILCINHFSIYSILILIK

SEQ ID NO: 3261831 - protein, 19 aa, Plasmodium falciparum
IILNVCLWNSISSYDIEFN

SEQ ID NO: 3261832 - protein, 20 aa, Plasmodium falciparum
IILQHFILDLIKCCDNPRFN

SEQ ID NO: 3261833 - protein, 23 aa, Plasmodium falciparum
IILQLRILSISYRLPTQKIGFTA

SEQ ID NO: 3261834 - protein, 23 aa, Plasmodium falciparum
IILQSCLNKVHLIVVFTNNILKI

SEQ ID NO: 3261835 - protein, 23 aa, Plasmodium falciparum
IILSQILLCIKINEEIIKIIQPL

SEQ ID NO: 3261836 - protein, 25 aa, Plasmodium falciparum
IILSRLHIPAGIYLLFYSSLYGYFL

SEQ ID NO: 3261837 - protein, 19 aa, Plasmodium falciparum
IILSSVIQICLTYRLGRKN

SEQ ID NO: 3261838 - protein, 19 aa, Plasmodium falciparum
IILSYCYLLKRNKVLYGHI

SEQ ID NO: 3261839 - protein, 18 aa, Plasmodium falciparum
IILTLKYIYENIGYNQLL

SEQ ID NO: 3261840 - protein, 32 aa, Plasmodium falciparum
IIMSFRYSSYFMKKWREVFEHFINKGIQAETY

SEQ ID NO: 3261841 - protein, 24 aa, Plasmodium falciparum
IIMYRKNNIFHFFTNVCIYNNTNY

SEQ ID NO: 3261842 - protein, 17 aa, Plasmodium falciparum
IIMYRLFILYFIPSIIQ

SEQ ID NO: 3261843 - protein, 17 aa, Plasmodium falciparum
IINASWGSSHFDVNLHL

SEQ ID NO: 3261844 - protein, 22 aa, Plasmodium falciparum
IINDLRFQINMRRNYNYEIIEN

SEQ ID NO: 3261845 - protein, 24 aa, Plasmodium falciparum
IINESLKSYVLFTLNLLFKLNNVD

SEQ ID NO: 3261846 - protein, 23 aa, Plasmodium falciparum
IINFFIFVTFNIKNESKYSNTFI

SEQ ID NO: 3261847 - protein, 23 aa, Plasmodium falciparum
IINFLKLKLSFVRDVGIDAWEES

SEQ ID NO: 3261848 - protein, 21 aa, Plasmodium falciparum
IINILLFGHIVFLLLCLLTMN

SEQ ID NO: 3261849 - protein, 18 aa, Plasmodium falciparum
IINIMNIEFEFHITRDGI

SEQ ID NO: 3261850 - protein, 20 aa, Plasmodium falciparum
IINKCLKILINNIDKFCSYE

SEQ ID NO: 3261851 - protein, 17 aa, Plasmodium falciparum
IINKLYFDYFISTSHYM

SEQ ID NO: 3261852 - protein, 19 aa, Plasmodium falciparum
IINKSEYYFKEEIIKKYGE

SEQ ID NO: 3261853 - protein, 24 aa, Plasmodium falciparum
IINKTHFIYFFLNNSLHDILNIFN

SEQ ID NO: 3261854 - protein, 24 aa, Plasmodium falciparum
IINLCKLQLCLYEFFLPTKSTNNG

SEQ ID NO: 3261855 - protein, 20 aa, Plasmodium falciparum
IINLCYRKYNNVSIINKFFL

SEQ ID NO: 3261856 - protein, 21 aa, Plasmodium falciparum
IINLFVCNLFYHLKNIGKNIH

SEQ ID NO: 3261857 - protein, 19 aa, Plasmodium falciparum
IINLLELVWCQPIQYKENP

SEQ ID NO: 3261858 - protein, 22 aa, Plasmodium falciparum
IINLLKLPTFIMISIEIHRYYF

SEQ ID NO: 3261859 - protein, 21 aa, Plasmodium falciparum
IINLYKSCFSIFKEHIYICNK

SEQ ID NO: 3261860 - protein, 31 aa, Plasmodium falciparum
IINMCLYLLYLYYLCNVLYKCVRINNVLKGD

SEQ ID NO: 3261861 - protein, 19 aa, Plasmodium falciparum
IINMMCVAVKFLKEKCPNK

SEQ ID NO: 3261862 - protein, 25 aa, Plasmodium falciparum
IINNDGFFYKGFEYHNYLCIKNNKL

SEQ ID NO: 3261863 - protein, 24 aa, Plasmodium falciparum
IINNFKCLRRFLLNICDKNTITNF

SEQ ID NO: 3261864 - protein, 24 aa, Plasmodium falciparum
IINNYKAAGFFLIKADINNNNNNN

SEQ ID NO: 3261865 - protein, 17 aa, Plasmodium falciparum
IINRIPSIYMYTKKKTL

SEQ ID NO: 3261866 - protein, 17 aa, Plasmodium falciparum
IINSCGFNNMGCDKVTE

SEQ ID NO: 3261867 - protein, 18 aa, Plasmodium falciparum
IINSIYIIRCLIKNDVDL

SEQ ID NO: 3261868 - protein, 26 aa, Plasmodium falciparum
IINTKCNALLRKQRVLYEEKGDVVLT

SEQ ID NO: 3261869 - protein, 26 aa, Plasmodium falciparum
IINTKCNVLLRKQRVLYEEKKDVSKE

SEQ ID NO: 3261870 - protein, 27 aa, Plasmodium falciparum
IINTLPLLHYTFSTSLIFPKKNEKIEC

SEQ ID NO: 3261871 - protein, 25 aa, Plasmodium falciparum
IINVCTIPRIISPIKLYNFTMKNTH

SEQ ID NO: 3261872 - protein, 17 aa, Plasmodium falciparum
IINYNFVRTVPIEEKLF

SEQ ID NO: 3261873 - protein, 20 aa, Plasmodium falciparum
IINYSICNMIDYFYFYHYSY

SEQ ID NO: 3261874 - protein, 17 aa, Plasmodium falciparum
IIPCNNESYNLHINKRS

SEQ ID NO: 3261875 - protein, 23 aa, Plasmodium falciparum
IIPCPRHRLPIINYKTNKLMYSH

SEQ ID NO: 3261876 - protein, 30 aa, Plasmodium falciparum
IIPDIYEYFTRYNLLNEFSRNILKNFYHKD

SEQ ID NO: 3261877 - protein, 19 aa, Plasmodium falciparum
IIPHEFKRQMYYTFGDYRD

SEQ ID NO: 3261878 - protein, 22 aa, Plasmodium falciparum
IIPKGWVFFSIFFWVFIMLLLF

SEQ ID NO: 3261879 - protein, 26 aa, Plasmodium falciparum
IIPQKILSLIFFKLLIVYNPYYFIQV

SEQ ID NO: 3261880 - protein, 24 aa, Plasmodium falciparum
IIPYTCYICNDFPHKDIEKDYIRN

SEQ ID NO: 3261881 - protein, 45 aa, Plasmodium falciparum
IIPYVKEFDRNLIICFLYSVLHSIFYIMCNIFLYNLEKEKKIFQG

SEQ ID NO: 3261882 - protein, 19 aa, Plasmodium falciparum
IIQEANIFPSITIQNNNNN

SEQ ID NO: 3261883 - protein, 34 aa, Plasmodium falciparum
IIQENDGTFCFKKDPSFIPVLYIYHNDDEFRFTF

SEQ ID NO: 3261884 - protein, 36 aa, Plasmodium falciparum
IIQFCTELIYNLIIQKKYLKCEHLKKSIKKIVKIDK

SEQ ID NO: 3261885 - protein, 22 aa, Plasmodium falciparum
IIQICKICRILDFNISHLMLIG

SEQ ID NO: 3261886 - protein, 32 aa, Plasmodium falciparum
IIQISSFFSFYFKLFSNMWILLISELMGLYFV

SEQ ID NO: 3261887 - protein, 18 aa, Plasmodium falciparum
IIQKIRLLIVFPNNHIVI

SEQ ID NO: 3261888 - protein, 17 aa, Plasmodium falciparum
IIQLKFFSNKILNNYNI

SEQ ID NO: 3261889 - protein, 24 aa, Plasmodium falciparum
IIQLRIVTGLPIILLGDFNISYRN

SEQ ID NO: 3261890 - protein, 30 aa, Plasmodium falciparum
IIQNILRISFNFTYFFSAEFFFFNDNMNLN

SEQ ID NO: 3261891 - protein, 23 aa, Plasmodium falciparum
IIQSVCKKEAGAALSSGSDHVKE

SEQ ID NO: 3261892 - protein, 26 aa, Plasmodium falciparum
IIRALFKRWLEYFLQDYNKINAKISY

SEQ ID NO: 3261893 - protein, 18 aa, Plasmodium falciparum
IIRCIKYVLRKIGTLDNE

SEQ ID NO: 3261894 - protein, 19 aa, Plasmodium falciparum
IIRESFRKLCFYTNKKNYK

SEQ ID NO: 3261895 - protein, 19 aa, Plasmodium falciparum
IIRICLVGLFDCCCYINVI

SEQ ID NO: 3261896 - protein, 19 aa, Plasmodium falciparum
IIRLQIIKKYRIINIRMNR

SEQ ID NO: 3261897 - protein, 23 aa, Plasmodium falciparum
IIRLSLILICIYIFSFVDTSRIY

SEQ ID NO: 3261898 - protein, 19 aa, Plasmodium falciparum
IIRMLKKKFLSSSYTPTLL

SEQ ID NO: 3261899 - protein, 22 aa, Plasmodium falciparum
IIRRISPTNIKNVYNDALKKNI

SEQ ID NO: 3261900 - protein, 20 aa, Plasmodium falciparum
IISFDFSREHMNIIKNLENK

SEQ ID NO: 3261901 - protein, 20 aa, Plasmodium falciparum
IISGDLFDSSFCTYLGFSTM

SEQ ID NO: 3261902 - protein, 19 aa, Plasmodium falciparum
IISHIKLNDGIYFDKNKYD

SEQ ID NO: 3261903 - protein, 18 aa, Plasmodium falciparum
IISIGRNFLLFIIEYIKE

SEQ ID NO: 3261904 - protein, 25 aa, Plasmodium falciparum
IISIILSFVVLISFKYLEEKYSIES

SEQ ID NO: 3261905 - protein, 24 aa, Plasmodium falciparum
IISIKIIIDIFTFINSYYDTHDNN

SEQ ID NO: 3261906 - protein, 18 aa, Plasmodium falciparum
IISLERIKMILGCLKNPY

SEQ ID NO: 3261907 - protein, 23 aa, Plasmodium falciparum
IISLLRIMNEFLLKDILLQKKTN

SEQ ID NO: 3261908 - protein, 28 aa, Plasmodium falciparum
IISLVQIRGSIPLFWKQHSMSSHVNIQR

SEQ ID NO: 3261909 - protein, 25 aa, Plasmodium falciparum
IISMSCTLFSLLDANYHGYLLNGFI

SEQ ID NO: 3261910 - protein, 19 aa, Plasmodium falciparum
IISNFSLNVIYNFLQINKN

SEQ ID NO: 3261911 - protein, 18 aa, Plasmodium falciparum
IISSIIFDMICPYLDITN

SEQ ID NO: 3261912 - protein, 20 aa, Plasmodium falciparum
IISVIIVLIGFLFFYIPFVY

SEQ ID NO: 3261913 - protein, 19 aa, Plasmodium falciparum
IISYPSLKKRMEFIDNCMK

SEQ ID NO: 3261914 - protein, 23 aa, Plasmodium falciparum
IITENYIPYKSCIEQIDDIDYNK

SEQ ID NO: 3261915 - protein, 21 aa, Plasmodium falciparum
IITFPFLFGIMYGDVGHGLCI

SEQ ID NO: 3261916 - protein, 19 aa, Plasmodium falciparum
IITSAWWVYYNQVSKSAPS

SEQ ID NO: 3261917 - protein, 27 aa, Plasmodium falciparum
IITYCYKSCIFLNLLCKNYPNNILTSN

SEQ ID NO: 3261918 - protein, 18 aa, Plasmodium falciparum
IITYIWHIDICILLFLLY

SEQ ID NO: 3261919 - protein, 24 aa, Plasmodium falciparum
IITYLILCTEFYYILIGTSNNLMW

SEQ ID NO: 3261920 - protein, 18 aa, Plasmodium falciparum
IIVCIARVHTILNCILMS

SEQ ID NO: 3261921 - protein, 18 aa, Plasmodium falciparum
IIVGTSFLFISPYLCAKA

SEQ ID NO: 3261922 - protein, 21 aa, Plasmodium falciparum
IIVIILYVWLRKRRKNSWKHE

SEQ ID NO: 3261923 - protein, 17 aa, Plasmodium falciparum
IIVSSIMFLAYNIIYSI

SEQ ID NO: 3261924 - protein, 18 aa, Plasmodium falciparum
IIVVFVIYINLCISHINI

SEQ ID NO: 3261925 - protein, 27 aa, Plasmodium falciparum
IIYEYMKNKCLFSYLHCIKYKHVYIST

SEQ ID NO: 3261926 - protein, 20 aa, Plasmodium falciparum
IIYFATYLFEMFSKNIYELH

SEQ ID NO: 3261927 - protein, 18 aa, Plasmodium falciparum
IIYFFSFFFMYVYINSRY

SEQ ID NO: 3261928 - protein, 20 aa, Plasmodium falciparum
IIYHELYVELLHVNKNLQNE

SEQ ID NO: 3261929 - protein, 22 aa, Plasmodium falciparum
IIYHLLDIIIFFLLFFSCYNFN

SEQ ID NO: 3261930 - protein, 17 aa, Plasmodium falciparum
IIYIISFVKKRKRKWLG

SEQ ID NO: 3261931 - protein, 24 aa, Plasmodium falciparum
IIYILEYIHYIGLHNLSAKKYKNN

SEQ ID NO: 3261932 - protein, 26 aa, Plasmodium falciparum
IIYINALIRFCLFELRMDNLFISSNM

SEQ ID NO: 3261933 - protein, 19 aa, Plasmodium falciparum
IIYKHWKKGYETFIHDLKK

SEQ ID NO: 3261934 - protein, 17 aa, Plasmodium falciparum
IIYKKSKDGEMERKKFI

SEQ ID NO: 3261935 - protein, 21 aa, Plasmodium falciparum
IIYKLIHKFILHQPLYEVMYK

SEQ ID NO: 3261936 - protein, 22 aa, Plasmodium falciparum
IIYLFCELLCKYFYDIIFYLDE

SEQ ID NO: 3261937 - protein, 21 aa, Plasmodium falciparum
IIYLFLKKICTLFHKNMYSLY

SEQ ID NO: 3261938 - protein, 22 aa, Plasmodium falciparum
IIYLIACKNIPFSEKNPLKYIH

SEQ ID NO: 3261939 - protein, 22 aa, Plasmodium falciparum
IIYLKITVVSFYFFHNFDNYFS

SEQ ID NO: 3261940 - protein, 25 aa, Plasmodium falciparum
IIYLLCVMEKIILYTPFYIFFIQPN

SEQ ID NO: 3261941 - protein, 18 aa, Plasmodium falciparum
IIYMKTPVAIKIHDLKDS

SEQ ID NO: 3261942 - protein, 28 aa, Plasmodium falciparum
IIYNDIFYYFPCKCLTNILNNYSNKNEV

SEQ ID NO: 3261943 - protein, 25 aa, Plasmodium falciparum
IIYNSCSIKKILTWKIDKISYLNQK

SEQ ID NO: 3261944 - protein, 18 aa, Plasmodium falciparum
IIYRINMCNQEFVKNLSG

SEQ ID NO: 3261945 - protein, 17 aa, Plasmodium falciparum
IIYSRIRTLLTHVLIIL

SEQ ID NO: 3261946 - protein, 32 aa, Plasmodium falciparum
IIYTCFYIIFCKIKLIKLMKIIYKINKNDCEY

SEQ ID NO: 3261947 - protein, 18 aa, Plasmodium falciparum
IIYYEPWIKRCMLTDDKC

SEQ ID NO: 3261948 - protein, 25 aa, Plasmodium falciparum
IIYYHISYCKSLICLKKQNDKYNHI

SEQ ID NO: 3261949 - protein, 21 aa, Plasmodium falciparum
IIYYNSLFNFCNIIRNEMFHF

SEQ ID NO: 3261950 - protein, 18 aa, Plasmodium falciparum
IKAIDIIRKLFIYTNINI

SEQ ID NO: 3261951 - protein, 23 aa, Plasmodium falciparum
IKAKHFQHALNICNPSSLRERQV

SEQ ID NO: 3261952 - protein, 17 aa, Plasmodium falciparum
IKAKRRIQEICRDAQYI

SEQ ID NO: 3261953 - protein, 17 aa, Plasmodium falciparum
IKARYDIIQEIRKYLLK

SEQ ID NO: 3261954 - protein, 19 aa, Plasmodium falciparum
IKASKYLKYFPYIVQRNEE

SEQ ID NO: 3261955 - protein, 21 aa, Plasmodium falciparum
IKAYIPKLFYYFKRKKIKIDF

SEQ ID NO: 3261956 - protein, 21 aa, Plasmodium falciparum
IKCAAVETFFAWHEFTKEKER

SEQ ID NO: 3261957 - protein, 17 aa, Plasmodium falciparum
IKCIDFISLHLLYLSSY

SEQ ID NO: 3261958 - protein, 19 aa, Plasmodium falciparum
IKCIEKYKGSPYYEINNKC

SEQ ID NO: 3261959 - protein, 20 aa, Plasmodium falciparum
IKCKTCRHLHKYDNLINEDI

SEQ ID NO: 3261960 - protein, 30 aa, Plasmodium falciparum
IKCNMITALSKYIIKYIFTFNKKFIQNYEK

SEQ ID NO: 3261961 - protein, 20 aa, Plasmodium falciparum
IKCRYALGLIYIYFNNFECM

SEQ ID NO: 3261962 - protein, 19 aa, Plasmodium falciparum
IKCSIILNRNAYYVCTLFN

SEQ ID NO: 3261963 - protein, 26 aa, Plasmodium falciparum
IKDAVLNLDMCFIPYISFKDFLMFAS

SEQ ID NO: 3261964 - protein, 17 aa, Plasmodium falciparum
IKDCNYSSGGIYHIPCN

SEQ ID NO: 3261965 - protein, 17 aa, Plasmodium falciparum
IKDDIYLSDDCNEDEDI

SEQ ID NO: 3261966 - protein, 18 aa, Plasmodium falciparum
IKDDIYYILKNAYAKYFK

SEQ ID NO: 3261967 - protein, 27 aa, Plasmodium falciparum
IKDEIPFFKKYNEDFFYKNKKLKDLSK

SEQ ID NO: 3261968 - protein, 30 aa, Plasmodium falciparum
IKDEKGKIFWKEQILNYRISSLHRYKRMNI

SEQ ID NO: 3261969 - protein, 24 aa, Plasmodium falciparum
IKDEKRIVDNYSIEMHAEKNITNP

SEQ ID NO: 3261970 - protein, 17 aa, Plasmodium falciparum
IKDELLKNYNILAHSHF

SEQ ID NO: 3261971 - protein, 27 aa, Plasmodium falciparum
IKDGEWKYFFCVLFYLQNNIGLKNDII

SEQ ID NO: 3261972 - protein, 20 aa, Plasmodium falciparum
IKDIINYRINFFDYNNILHI

SEQ ID NO: 3261973 - protein, 20 aa, Plasmodium falciparum
IKDIVKYLFFSYFIIFNSME

SEQ ID NO: 3261974 - protein, 21 aa, Plasmodium falciparum
IKDIYLKYFLFQNYFVLLIHG

SEQ ID NO: 3261975 - protein, 20 aa, Plasmodium falciparum
IKDIYLMIRINLFKYLHMIY

SEQ ID NO: 3261976 - protein, 22 aa, Plasmodium falciparum
IKDKICKHIVPLVIKEIYLYIN

SEQ ID NO: 3261977 - protein, 29 aa, Plasmodium falciparum
IKDLVCSYNNIFYIYKIIYLLKDKIYIEN

SEQ ID NO: 3261978 - protein, 33 aa, Plasmodium falciparum
IKDNEDWKLYDFKNLKEKYKFQMNMKDSEINQL

SEQ ID NO: 3261979 - protein, 17 aa, Plasmodium falciparum
IKDNIKVLFNIDYIENN

SEQ ID NO: 3261980 - protein, 17 aa, Plasmodium falciparum
IKDPFYFHDNKNYIFFI

SEQ ID NO: 3261981 - protein, 24 aa, Plasmodium falciparum
IKDSHLSCFFFQKFYECVQNLLPE

SEQ ID NO: 3261982 - protein, 19 aa, Plasmodium falciparum
IKDSISIYMKKACELYHKR

SEQ ID NO: 3261983 - protein, 26 aa, Plasmodium falciparum
IKDVVKFYLEHFIIFSSSTGVISFLY

SEQ ID NO: 3261984 - protein, 18 aa, Plasmodium falciparum
IKDYRRKNVLNIFNMNNN

SEQ ID NO: 3261985 - protein, 18 aa, Plasmodium falciparum
IKECLNIYDHFPIYFFKD

SEQ ID NO: 3261986 - protein, 21 aa, Plasmodium falciparum
IKECNLYNYMWVCDEKIRYNN

SEQ ID NO: 3261987 - protein, 30 aa, Plasmodium falciparum
IKEDFRVNCKNSIYECRGICDKGYKFKPYA

SEQ ID NO: 3261988 - protein, 24 aa, Plasmodium falciparum
IKEEIKNNILIFYVLIYHIKKDII

SEQ ID NO: 3261989 - protein, 20 aa, Plasmodium falciparum
IKEFFFYFYCILIICEINTP

SEQ ID NO: 3261990 - protein, 21 aa, Plasmodium falciparum
IKEFVMNRIFKRNCNDTNNYD

SEQ ID NO: 3261991 - protein, 22 aa, Plasmodium falciparum
IKEGNFYYEYVMKKYIYMFIDH

SEQ ID NO: 3261992 - protein, 45 aa, Plasmodium falciparum
IKEHIKNKITWNVLYALKLIYNNFSFFFSYNFYNLHNKILDNLIY

SEQ ID NO: 3261993 - protein, 24 aa, Plasmodium falciparum
IKEICHIELIPIIYNKILQEKDKK

SEQ ID NO: 3261994 - protein, 24 aa, Plasmodium falciparum
IKEIRSKDVGIYFFSDDSIYSKNI

SEQ ID NO: 3261995 - protein, 19 aa, Plasmodium falciparum
IKEKIKIFFEQNGNKEAAP

SEQ ID NO: 3261996 - protein, 24 aa, Plasmodium falciparum
IKEKILKLLILLKHEDIYLKKFSK

SEQ ID NO: 3261997 - protein, 20 aa, Plasmodium falciparum
IKEKIYFLLIEKTNISINNR

SEQ ID NO: 3261998 - protein, 23 aa, Plasmodium falciparum
IKEKNNICQYKFKDIEKNNNIDI

SEQ ID NO: 3261999 - protein, 21 aa, Plasmodium falciparum
IKEKRRGECNFPINNQRCNNN

SEQ ID NO: 3262000 - protein, 23 aa, Plasmodium falciparum
IKELKNVWWILNRNKVWESMRCG

SEQ ID NO: 3262001 - protein, 23 aa, Plasmodium falciparum
IKELNFNTVYTFLFWPENEYLED

SEQ ID NO: 3262002 - protein, 20 aa, Plasmodium falciparum
IKELYSLSSVHNIRDIECGY

SEQ ID NO: 3262003 - protein, 27 aa, Plasmodium falciparum
IKEMIKELLYRKDINTFKKTYLTNIMK

SEQ ID NO: 3262004 - protein, 24 aa, Plasmodium falciparum
IKEMKICKIRTYLSSLSNYVNNIS

SEQ ID NO: 3262005 - protein, 27 aa, Plasmodium falciparum
IKENFRIDISFLKIFFLLNDVRQINLN

SEQ ID NO: 3262006 - protein, 18 aa, Plasmodium falciparum
IKENIRFVLKNIYRKLYG

SEQ ID NO: 3262007 - protein, 25 aa, Plasmodium falciparum
IKENKWSCGNVCGYNVCKPKKVNGE

SEQ ID NO: 3262008 - protein, 21 aa, Plasmodium falciparum
IKENQKLFEFKDINEKNVPSS

SEQ ID NO: 3262009 - protein, 20 aa, Plasmodium falciparum
IKEPKDCFSQVYIDKKVYKL

SEQ ID NO: 3262010 - protein, 25 aa, Plasmodium falciparum
IKEQKGDDSLKCEESFYFDENGYFK

SEQ ID NO: 3262011 - protein, 24 aa, Plasmodium falciparum
IKEREGCLRKSYDIKNDVEEDVSV

SEQ ID NO: 3262012 - protein, 20 aa, Plasmodium falciparum
IKERILKCEVPIYNSNNKIK

SEQ ID NO: 3262013 - protein, 30 aa, Plasmodium falciparum
IKERLFLCLICLLVIIWLIYFCYKNHIFLS

SEQ ID NO: 3262014 - protein, 21 aa, Plasmodium falciparum
IKESILKGSIYVNLHHLSKKI

SEQ ID NO: 3262015 - protein, 26 aa, Plasmodium falciparum
IKESNNCLNYSWGIDKYDYTLLQTIE

SEQ ID NO: 3262016 - protein, 27 aa, Plasmodium falciparum
IKETFNLLKNRFHIIGESNNINYNNNN

SEQ ID NO: 3262017 - protein, 20 aa, Plasmodium falciparum
IKETILPPVTKKVEDYEEKL

SEQ ID NO: 3262018 - protein, 21 aa, Plasmodium falciparum
IKEYICIHLTISLFIILIECF

SEQ ID NO: 3262019 - protein, 25 aa, Plasmodium falciparum
IKEYRYENNVSFFLSILSKIIVIYC

SEQ ID NO: 3262020 - protein, 25 aa, Plasmodium falciparum
IKEYYKLKHIFSIFQKLKIEHLYIL

SEQ ID NO: 3262021 - protein, 21 aa, Plasmodium falciparum
IKEYYLNYLREFERIHDNLKK

SEQ ID NO: 3262022 - protein, 31 aa, Plasmodium falciparum
IKFCNDLKLYREILILICIIIIKNDENEIYI

SEQ ID NO: 3262023 - protein, 19 aa, Plasmodium falciparum
IKFGAVWCKPCNKIKEYFK

SEQ ID NO: 3262024 - protein, 19 aa, Plasmodium falciparum
IKFKYKILNTSFYKNNIYM

SEQ ID NO: 3262025 - protein, 24 aa, Plasmodium falciparum
IKFLCSYLDCVLYLGNRINKLLLR

SEQ ID NO: 3262026 - protein, 24 aa, Plasmodium falciparum
IKFLRTFFPIVFFISICASAYSYT

SEQ ID NO: 3262027 - protein, 17 aa, Plasmodium falciparum
IKFMNVTVIYRIKKDNF

SEQ ID NO: 3262028 - protein, 25 aa, Plasmodium falciparum
IKFNMLINCVNYLFLINEDKILLKK

SEQ ID NO: 3262029 - protein, 25 aa, Plasmodium falciparum
IKFPLYIKFEEELFKSYRKVEIKKD

SEQ ID NO: 3262030 - protein, 25 aa, Plasmodium falciparum
IKFTSIIMPLYVYKILISNVANFPN

SEQ ID NO: 3262031 - protein, 18 aa, Plasmodium falciparum
IKFYAYNNICIYENKDYI

SEQ ID NO: 3262032 - protein, 18 aa, Plasmodium falciparum
IKFYPFLQNIILKELNYY

SEQ ID NO: 3262033 - protein, 25 aa, Plasmodium falciparum
IKGDILCMLVHFFSKIKEFDLNYKL

SEQ ID NO: 3262034 - protein, 30 aa, Plasmodium falciparum
IKGFDCSTCARHCRFYKKWIERKKDEFTEQ

SEQ ID NO: 3262035 - protein, 19 aa, Plasmodium falciparum
IKGFIPIVLSYLYMYPNNI

SEQ ID NO: 3262036 - protein, 20 aa, Plasmodium falciparum
IKGIRYTFVIIGIKVFISSI

SEQ ID NO: 3262037 - protein, 17 aa, Plasmodium falciparum
IKGLLFVYTFDDNISNE

SEQ ID NO: 3262038 - protein, 25 aa, Plasmodium falciparum
IKGNLKRYYSSRMVQETDKTGNEKC

SEQ ID NO: 3262039 - protein, 21 aa, Plasmodium falciparum
IKGRLKLQCFINKEDKYTDEK

SEQ ID NO: 3262040 - protein, 39 aa, Plasmodium falciparum
IKGRRKLWRISIFKIILIILFLCLFKKNDVLILKDECFD

SEQ ID NO: 3262041 - protein, 19 aa, Plasmodium falciparum
IKGSIYIFIILRTALTIPL

SEQ ID NO: 3262042 - protein, 30 aa, Plasmodium falciparum
IKGYKFAYNKIKAVKRRGSFKTNQQNQYEN

SEQ ID NO: 3262043 - protein, 23 aa, Plasmodium falciparum
IKGYRVLCLAVNILDNNMYKENI

SEQ ID NO: 3262044 - protein, 20 aa, Plasmodium falciparum
IKGYYYYPFMKNIKKFIYED

SEQ ID NO: 3262045 - protein, 19 aa, Plasmodium falciparum
IKHKFIFHSEWHNIFRSFM

SEQ ID NO: 3262046 - protein, 17 aa, Plasmodium falciparum
IKHKISHCINSGNKSTC

SEQ ID NO: 3262047 - protein, 28 aa, Plasmodium falciparum
IKHKSLLWIYHFINILNIHFYNIFDSSP

SEQ ID NO: 3262048 - protein, 17 aa, Plasmodium falciparum
IKHLIYLEHKFLKLITK

SEQ ID NO: 3262049 - protein, 17 aa, Plasmodium falciparum
IKHLLLVDYKKKEKYES

SEQ ID NO: 3262050 - protein, 18 aa, Plasmodium falciparum
IKHMKYLISFNKLILNDL

SEQ ID NO: 3262051 - protein, 17 aa, Plasmodium falciparum
IKHPLLKHVAGINIYED

SEQ ID NO: 3262052 - protein, 17 aa, Plasmodium falciparum
IKHWNHIYHKWLHEENK

SEQ ID NO: 3262053 - protein, 24 aa, Plasmodium falciparum
IKICIDTLYFFKGYNSHLCLSILS

SEQ ID NO: 3262054 - protein, 19 aa, Plasmodium falciparum
IKIFEKFFERMNKHRVNYL

SEQ ID NO: 3262055 - protein, 21 aa, Plasmodium falciparum
IKIFIADSFSYLLKKLSLHDL

SEQ ID NO: 3262056 - protein, 18 aa, Plasmodium falciparum
IKIFIPFFSLHQINMCSV

SEQ ID NO: 3262057 - protein, 17 aa, Plasmodium falciparum
IKIGLHMDRSNYNNENI

SEQ ID NO: 3262058 - protein, 26 aa, Plasmodium falciparum
IKIHPKFKALIYLAFDSSIKEVITSI

SEQ ID NO: 3262059 - protein, 17 aa, Plasmodium falciparum
IKIINIMNIEFEFHITR

SEQ ID NO: 3262060 - protein, 19 aa, Plasmodium falciparum
IKIIRSCKEYNTFRDSYNL

SEQ ID NO: 3262061 - protein, 25 aa, Plasmodium falciparum
IKIIRSHIYLSYFNIFLDYFRNNNL

SEQ ID NO: 3262062 - protein, 30 aa, Plasmodium falciparum
IKIITLYYFVCFYMCPPLLYDTNKQTYDKE

SEQ ID NO: 3262063 - protein, 17 aa, Plasmodium falciparum
IKIKGTSHLNPFFSSLF

SEQ ID NO: 3262064 - protein, 24 aa, Plasmodium falciparum
IKIKKRYVKDISIYNFCCDDKYKG

SEQ ID NO: 3262065 - protein, 21 aa, Plasmodium falciparum
IKIKNVFFFFYTCNMNMYIGI

SEQ ID NO: 3262066 - protein, 25 aa, Plasmodium falciparum
IKILKKNIYFLLSYKSIIMKNVMKM

SEQ ID NO: 3262067 - protein, 30 aa, Plasmodium falciparum
IKILNIHSCNIYKLKYKVHSLLSEGKQLKN

SEQ ID NO: 3262068 - protein, 19 aa, Plasmodium falciparum
IKINETIKLFKQIKNERQN

SEQ ID NO: 3262069 - protein, 19 aa, Plasmodium falciparum
IKINFKLKIEKNVNKLVYI

SEQ ID NO: 3262070 - protein, 18 aa, Plasmodium falciparum
IKINISYFQIIKILNLCL

SEQ ID NO: 3262071 - protein, 19 aa, Plasmodium falciparum
IKINKCICDLNYIKEGEID

SEQ ID NO: 3262072 - protein, 20 aa, Plasmodium falciparum
IKINQVCLNKKIILTSKNKK

SEQ ID NO: 3262073 - protein, 27 aa, Plasmodium falciparum
IKIPASFNQKIIKSFFQKEYGMYHFRG

SEQ ID NO: 3262074 - protein, 26 aa, Plasmodium falciparum
IKIPKIRHDHTFAFLLNYSDISETKK

SEQ ID NO: 3262075 - protein, 23 aa, Plasmodium falciparum
IKIQIWILVCVFLYLIENICLFL

SEQ ID NO: 3262076 - protein, 24 aa, Plasmodium falciparum
IKIRIISFLSFWFTKCMIIWCHIK

SEQ ID NO: 3262077 - protein, 23 aa, Plasmodium falciparum
IKIRLKRARGMKKLGILMQKVAR

SEQ ID NO: 3262078 - protein, 21 aa, Plasmodium falciparum
IKISLSNFYFFYSSTLFILFS

SEQ ID NO: 3262079 - protein, 28 aa, Plasmodium falciparum
IKISSTIFHGYAYVFFLFFHKHSIFYNN

SEQ ID NO: 3262080 - protein, 19 aa, Plasmodium falciparum
IKISYKILKDYMLNGQSKK

SEQ ID NO: 3262081 - protein, 20 aa, Plasmodium falciparum
IKIVFKNYMEYIRKCHMNEK

SEQ ID NO: 3262082 - protein, 29 aa, Plasmodium falciparum
IKIVKSCYDFRFTYNINVELYDIGPEVNI

SEQ ID NO: 3262083 - protein, 24 aa, Plasmodium falciparum
IKIVYKCISDICIIGYEQSGKSSI

SEQ ID NO: 3262084 - protein, 21 aa, Plasmodium falciparum
IKIYEKITCKNFITFYELKED

SEQ ID NO: 3262085 - protein, 23 aa, Plasmodium falciparum
IKIYHLFYRNYYCNLNMSEILHI

SEQ ID NO: 3262086 - protein, 17 aa, Plasmodium falciparum
IKIYKNWKGYRNYDIVG

SEQ ID NO: 3262087 - protein, 19 aa, Plasmodium falciparum
IKIYNFIESIFFQLFTIYV

SEQ ID NO: 3262088 - protein, 19 aa, Plasmodium falciparum
IKIYYIFLEHFGFLYFIYD

SEQ ID NO: 3262089 - protein, 17 aa, Plasmodium falciparum
IKKAFILLEKVSELHKM

SEQ ID NO: 3262090 - protein, 19 aa, Plasmodium falciparum
IKKAMLVYKNMIYFVCRFL

SEQ ID NO: 3262091 - protein, 22 aa, Plasmodium falciparum
IKKCDILICSASIPGKTSPKLV

SEQ ID NO: 3262092 - protein, 17 aa, Plasmodium falciparum
IKKDIGIIIANNNNNNN

SEQ ID NO: 3262093 - protein, 22 aa, Plasmodium falciparum
IKKDYFNITAWIFFNNLICIEK

SEQ ID NO: 3262094 - protein, 24 aa, Plasmodium falciparum
IKKEEIKFLFLNIMKSLGPFHVNS

SEQ ID NO: 3262095 - protein, 20 aa, Plasmodium falciparum
IKKGISLGFYEIFSKNKYDN

SEQ ID NO: 3262096 - protein, 20 aa, Plasmodium falciparum
IKKGTLLLCDNSRDNKMNTY

SEQ ID NO: 3262097 - protein, 21 aa, Plasmodium falciparum
IKKHENSDCIILIKKLIKIKN

SEQ ID NO: 3262098 - protein, 18 aa, Plasmodium falciparum
IKKIERFFITIELEPNMT

SEQ ID NO: 3262099 - protein, 21 aa, Plasmodium falciparum
IKKIFKYSFLLPEREYSKLSN

SEQ ID NO: 3262100 - protein, 26 aa, Plasmodium falciparum
IKKIISSIFLFCFIYSEFDIYQNVIY

SEQ ID NO: 3262101 - protein, 17 aa, Plasmodium falciparum
IKKIMYKKVKLYYVQDE

SEQ ID NO: 3262102 - protein, 18 aa, Plasmodium falciparum
IKKIRYNKFRIFDKSYLA

SEQ ID NO: 3262103 - protein, 19 aa, Plasmodium falciparum
IKKIYKMFCKHRDNEEYVY

SEQ ID NO: 3262104 - protein, 21 aa, Plasmodium falciparum
IKKKCNLLYHKNDILHDMPNY

SEQ ID NO: 3262105 - protein, 20 aa, Plasmodium falciparum
IKKKCYNEYISIQNMIRNYK

SEQ ID NO: 3262106 - protein, 21 aa, Plasmodium falciparum
IKKKFPWIFYLKNIIKNKDTS

SEQ ID NO: 3262107 - protein, 23 aa, Plasmodium falciparum
IKKKIHAIFEKYFKVSINVLNIW

SEQ ID NO: 3262108 - protein, 21 aa, Plasmodium falciparum
IKKKIKRIHCHNNFSEYLYKG

SEQ ID NO: 3262109 - protein, 17 aa, Plasmodium falciparum
IKKKITHEYIWNRIRNM

SEQ ID NO: 3262110 - protein, 24 aa, Plasmodium falciparum
IKKKKCIIHSSLLFEKNYLTIARY

SEQ ID NO: 3262111 - protein, 27 aa, Plasmodium falciparum
IKKKKKNAFKNFCIALSDIFFTNLSFK

SEQ ID NO: 3262112 - protein, 25 aa, Plasmodium falciparum
IKKKKRGSYFLSRNFTKFLFFLFFH

SEQ ID NO: 3262113 - protein, 19 aa, Plasmodium falciparum
IKKKLQLFINTHSPTMVNI

SEQ ID NO: 3262114 - protein, 21 aa, Plasmodium falciparum
IKKKLRFIINKLFLEKSKEKK

SEQ ID NO: 3262115 - protein, 27 aa, Plasmodium falciparum
IKKKNLFCYTNHLSLLYFTYIYSLNKF

SEQ ID NO: 3262116 - protein, 18 aa, Plasmodium falciparum
IKKLCAHGNFKNYYYERY

SEQ ID NO: 3262117 - protein, 18 aa, Plasmodium falciparum
IKKLLKKYSNTIVIQLKK

SEQ ID NO: 3262118 - protein, 30 aa, Plasmodium falciparum
IKKLMENKAVFSLNTIEQFLLLHKINNETG

SEQ ID NO: 3262119 - protein, 26 aa, Plasmodium falciparum
IKKLYYCSDIKKIYFSTSINRCKNLF

SEQ ID NO: 3262120 - protein, 20 aa, Plasmodium falciparum
IKKMIIYTFYIIKNSKQLIK

SEQ ID NO: 3262121 - protein, 20 aa, Plasmodium falciparum
IKKMLENLWDLYIDIKNIYK

SEQ ID NO: 3262122 - protein, 21 aa, Plasmodium falciparum
IKKNCYEFKGKNVVLNNAIYD

SEQ ID NO: 3262123 - protein, 18 aa, Plasmodium falciparum
IKKNEFTNTLFFNTLGKN

SEQ ID NO: 3262124 - protein, 21 aa, Plasmodium falciparum
IKKNFFMEFYLSIMVEKPKIY

SEQ ID NO: 3262125 - protein, 20 aa, Plasmodium falciparum
IKKNINILFRKWYTQHVYYN

SEQ ID NO: 3262126 - protein, 19 aa, Plasmodium falciparum
IKKNLLINIWIRLIGIHMI

SEQ ID NO: 3262127 - protein, 26 aa, Plasmodium falciparum
IKKNNIMWKNYLKFLNNIIIDKLIHL

SEQ ID NO: 3262128 - protein, 24 aa, Plasmodium falciparum
IKKQSCPLLYIILSILYITYCMEC

SEQ ID NO: 3262129 - protein, 17 aa, Plasmodium falciparum
IKKRELIEINEKQKREI

SEQ ID NO: 3262130 - protein, 21 aa, Plasmodium falciparum
IKKRGTFDYENIQIMITTDES

SEQ ID NO: 3262131 - protein, 19 aa, Plasmodium falciparum
IKKRILNILQLYQSKETKN

SEQ ID NO: 3262132 - protein, 19 aa, Plasmodium falciparum
IKKRNGGCFTVNDKCPKDF

SEQ ID NO: 3262133 - protein, 22 aa, Plasmodium falciparum
IKKSEGNICSYVIAYYNLNIYI

SEQ ID NO: 3262134 - protein, 19 aa, Plasmodium falciparum
IKKSLPYLLFLILYLISFS

SEQ ID NO: 3262135 - protein, 19 aa, Plasmodium falciparum
IKKSSYRLLGSLKENNRRK

SEQ ID NO: 3262136 - protein, 17 aa, Plasmodium falciparum
IKKSVLFDIDKYNDVEF

SEQ ID NO: 3262137 - protein, 17 aa, Plasmodium falciparum
IKKTFSFENEEKLPDQI

SEQ ID NO: 3262138 - protein, 20 aa, Plasmodium falciparum
IKKWDLWGSFIVYITLSICI

SEQ ID NO: 3262139 - protein, 24 aa, Plasmodium falciparum
IKKYCFKIILSAVEYISLENLVIF

SEQ ID NO: 3262140 - protein, 22 aa, Plasmodium falciparum
IKKYEFFYIHMIYKKLMCHNNK

SEQ ID NO: 3262141 - protein, 21 aa, Plasmodium falciparum
IKKYTCLNLKMKIGNSQCEWS

SEQ ID NO: 3262142 - protein, 19 aa, Plasmodium falciparum
IKKYVFLDAIYNLDVHYKL

SEQ ID NO: 3262143 - protein, 23 aa, Plasmodium falciparum
IKLAKRLKDKWVTFFKNYNNNLF

SEQ ID NO: 3262144 - protein, 17 aa, Plasmodium falciparum
IKLCKKDLIDIGAIKKP

SEQ ID NO: 3262145 - protein, 25 aa, Plasmodium falciparum
IKLINGSSLCFCLYFDKNVINTVYI

SEQ ID NO: 3262146 - protein, 24 aa, Plasmodium falciparum
IKLKEKFKIIVYASLYFFTCDYLY

SEQ ID NO: 3262147 - protein, 21 aa, Plasmodium falciparum
IKLKSHITFISFDNVYNSLEK

SEQ ID NO: 3262148 - protein, 20 aa, Plasmodium falciparum
IKLLGLCSEKIGVKTIYVIL

SEQ ID NO: 3262149 - protein, 17 aa, Plasmodium falciparum
IKLLIHKMKEKKNNLKL

SEQ ID NO: 3262150 - protein, 22 aa, Plasmodium falciparum
IKLLNSFLILRDIHVIEVELIR

SEQ ID NO: 3262151 - protein, 19 aa, Plasmodium falciparum
IKLLRYINTILSFNINHSY

SEQ ID NO: 3262152 - protein, 31 aa, Plasmodium falciparum
IKLLSMPIISSLLFVYPVMYLIHMKGRHNEI

SEQ ID NO: 3262153 - protein, 19 aa, Plasmodium falciparum
IKLNELFHHINVIKYKCLF

SEQ ID NO: 3262154 - protein, 18 aa, Plasmodium falciparum
IKLNHVFNKDIINIFENI

SEQ ID NO: 3262155 - protein, 19 aa, Plasmodium falciparum
IKLNIKILSVFSFSLLNYN

SEQ ID NO: 3262156 - protein, 22 aa, Plasmodium falciparum
IKLPEYNIHYSIINNVVINYST

SEQ ID NO: 3262157 - protein, 18 aa, Plasmodium falciparum
IKLPFLLHNITISFDGYH

SEQ ID NO: 3262158 - protein, 22 aa, Plasmodium falciparum
IKLPQTHMENVRYVSTEKQHNI

SEQ ID NO: 3262159 - protein, 19 aa, Plasmodium falciparum
IKLQALLLEKKEKIREEYI

SEQ ID NO: 3262160 - protein, 28 aa, Plasmodium falciparum
IKLRNDLKEYAFKSIQFIQDKIKKHKDE

SEQ ID NO: 3262161 - protein, 17 aa, Plasmodium falciparum
IKLSFDEYIYFVSTRLF

SEQ ID NO: 3262162 - protein, 21 aa, Plasmodium falciparum
IKLSQKLLIYFIPLINSTVKR

SEQ ID NO: 3262163 - protein, 21 aa, Plasmodium falciparum
IKLTLVVTYIHFISKYINILL

SEQ ID NO: 3262164 - protein, 19 aa, Plasmodium falciparum
IKLYDTLNFLLNFLYIFKM

SEQ ID NO: 3262165 - protein, 20 aa, Plasmodium falciparum
IKLYIHIYVSFFFLFHSYCT

SEQ ID NO: 3262166 - protein, 20 aa, Plasmodium falciparum
IKMDIFKSICNISEKSPLYI

SEQ ID NO: 3262167 - protein, 17 aa, Plasmodium falciparum
IKMILGCLKNPYMNYDI

SEQ ID NO: 3262168 - protein, 19 aa, Plasmodium falciparum
IKMKIKRKIEDSKVTLRTV

SEQ ID NO: 3262169 - protein, 25 aa, Plasmodium falciparum
IKMLIEKRLNDILRYRQNLYHQLNM

SEQ ID NO: 3262170 - protein, 27 aa, Plasmodium falciparum
IKMLLKYYRNYIYKFICLLLGENKFLY

SEQ ID NO: 3262171 - protein, 20 aa, Plasmodium falciparum
IKMLQILLLHINVPRLNNFF

SEQ ID NO: 3262172 - protein, 17 aa, Plasmodium falciparum
IKMLYIFFNNNLLNLFK

SEQ ID NO: 3262173 - protein, 18 aa, Plasmodium falciparum
IKNCNIHSLVSLIYSFGK

SEQ ID NO: 3262174 - protein, 22 aa, Plasmodium falciparum
IKNEEPICGYYNYCTFKRIKLR

SEQ ID NO: 3262175 - protein, 21 aa, Plasmodium falciparum
IKNEEQCLVGGKTDFDNLLIV

SEQ ID NO: 3262176 - protein, 17 aa, Plasmodium falciparum
IKNELWNNPSYLILHKY

SEQ ID NO: 3262177 - protein, 25 aa, Plasmodium falciparum
IKNFRKKWWNEFREKLWEAMLSEHK

SEQ ID NO: 3262178 - protein, 17 aa, Plasmodium falciparum
IKNGHFFLREQEKDIYI

SEQ ID NO: 3262179 - protein, 21 aa, Plasmodium falciparum
IKNICDILEYILYVDDKDCMD

SEQ ID NO: 3262180 - protein, 22 aa, Plasmodium falciparum
IKNIFCDDCIYVIKKQQSLNSS

SEQ ID NO: 3262181 - protein, 22 aa, Plasmodium falciparum
IKNIKIYLSLMTKIYYNNRKVQ

SEQ ID NO: 3262182 - protein, 31 aa, Plasmodium falciparum
IKNIPFNIHICTCSYVNLKYKKILIKKDESN

SEQ ID NO: 3262183 - protein, 19 aa, Plasmodium falciparum
IKNISSFIIYEKFIIFILN

SEQ ID NO: 3262184 - protein, 20 aa, Plasmodium falciparum
IKNIYYLFICFNDINNIILF

SEQ ID NO: 3262185 - protein, 19 aa, Plasmodium falciparum
IKNKDFYLFLSCAKTENII

SEQ ID NO: 3262186 - protein, 17 aa, Plasmodium falciparum
IKNKIIHLIALKIINFI

SEQ ID NO: 3262187 - protein, 24 aa, Plasmodium falciparum
IKNKKYNVAIPFKKNIPLIKVLNE

SEQ ID NO: 3262188 - protein, 31 aa, Plasmodium falciparum
IKNKYLLERQKIIWLKCIKRNKYILEKWKNE

SEQ ID NO: 3262189 - protein, 26 aa, Plasmodium falciparum
IKNLEHIKYNYIYAIIDVDEFMYYYK

SEQ ID NO: 3262190 - protein, 19 aa, Plasmodium falciparum
IKNLFRILILSKLHIGVYN

SEQ ID NO: 3262191 - protein, 19 aa, Plasmodium falciparum
IKNLYSFDLLCFKYKNIAN

SEQ ID NO: 3262192 - protein, 26 aa, Plasmodium falciparum
IKNMFLKILKCRDLSNTEPREYHLPL

SEQ ID NO: 3262193 - protein, 26 aa, Plasmodium falciparum
IKNMLFKHKFFFFVFFYIFLIYSFSK

SEQ ID NO: 3262194 - protein, 20 aa, Plasmodium falciparum
IKNNFFQKILFDDMVCSKKK

SEQ ID NO: 3262195 - protein, 23 aa, Plasmodium falciparum
IKNNLKHLLNFYIEKEEGNKTKN

SEQ ID NO: 3262196 - protein, 17 aa, Plasmodium falciparum
IKNNLLFHSFTSNDNPI

SEQ ID NO: 3262197 - protein, 21 aa, Plasmodium falciparum
IKNNNCISFSDYERSIKNFSI

SEQ ID NO: 3262198 - protein, 22 aa, Plasmodium falciparum
IKNQSCFLNPCTHKNNDKRNSY

SEQ ID NO: 3262199 - protein, 25 aa, Plasmodium falciparum
IKNRMMRKYIYLCIQYLLRLREKYK

SEQ ID NO: 3262200 - protein, 26 aa, Plasmodium falciparum
IKNSLFLNSYDICFITAMNDFVFYFL

SEQ ID NO: 3262201 - protein, 18 aa, Plasmodium falciparum
IKNSLNVHSIFNIDTSIF

SEQ ID NO: 3262202 - protein, 17 aa, Plasmodium falciparum
IKNSSCKHYNIKKNSME

SEQ ID NO: 3262203 - protein, 17 aa, Plasmodium falciparum
IKNSYKIILLLLKCLNI

SEQ ID NO: 3262204 - protein, 24 aa, Plasmodium falciparum
IKNTACKLYALIISYYGESVDSSF

SEQ ID NO: 3262205 - protein, 33 aa, Plasmodium falciparum
IKNTASLMKCKRVFSYVIILHFLMNSICVTYSD

SEQ ID NO: 3262206 - protein, 21 aa, Plasmodium falciparum
IKNTFKYFWYNDFCINVSNIF

SEQ ID NO: 3262207 - protein, 26 aa, Plasmodium falciparum
IKNVHKRFGYLLLIDNFDFVYEDLLK

SEQ ID NO: 3262208 - protein, 25 aa, Plasmodium falciparum
IKNVLRKIIKFIKGYVKDIIKEINV

SEQ ID NO: 3262209 - protein, 18 aa, Plasmodium falciparum
IKNYCFNHRFVIHNNDTL

SEQ ID NO: 3262210 - protein, 17 aa, Plasmodium falciparum
IKNYITSFLEGFQNLID

SEQ ID NO: 3262211 - protein, 19 aa, Plasmodium falciparum
IKNYSWKFAQKIMNNPTQF

SEQ ID NO: 3262212 - protein, 17 aa, Plasmodium falciparum
IKPDLLTPTSFLHKTYN

SEQ ID NO: 3262213 - protein, 18 aa, Plasmodium falciparum
IKPFNFIDNSLVYMYQFF

SEQ ID NO: 3262214 - protein, 17 aa, Plasmodium falciparum
IKPHIYILCINKNYENI

SEQ ID NO: 3262215 - protein, 21 aa, Plasmodium falciparum
IKPKDLCFLINYAHTNNIDNT

SEQ ID NO: 3262216 - protein, 25 aa, Plasmodium falciparum
IKPKEKICFVNGVYKKQINKIHFVV

SEQ ID NO: 3262217 - protein, 17 aa, Plasmodium falciparum
IKPSLLVYYYIINEHIS

SEQ ID NO: 3262218 - protein, 24 aa, Plasmodium falciparum
IKPVHKLEINFGYESFDHEKKKKE

SEQ ID NO: 3262219 - protein, 18 aa, Plasmodium falciparum
IKPYESFYYHPINTNKCF

SEQ ID NO: 3262220 - protein, 19 aa, Plasmodium falciparum
IKQGNDFWFTNNLQLLPIK

SEQ ID NO: 3262221 - protein, 26 aa, Plasmodium falciparum
IKQHFFFKKKIKEFNVKLGGDNVTNK

SEQ ID NO: 3262222 - protein, 37 aa, Plasmodium falciparum
IKQHYVYNISFAQLIYFMLIFLYKIFFQPIKTTDTML

SEQ ID NO: 3262223 - protein, 22 aa, Plasmodium falciparum
IKQKIFFYEHIFLNIHNVYFYL

SEQ ID NO: 3262224 - protein, 17 aa, Plasmodium falciparum
IKQKYPLTYSKRLEEIE

SEQ ID NO: 3262225 - protein, 21 aa, Plasmodium falciparum
IKQLDASIEISKFINDPVHYL

SEQ ID NO: 3262226 - protein, 25 aa, Plasmodium falciparum
IKQNIFCLLSKLIKHILNSEINIYT

SEQ ID NO: 3262227 - protein, 31 aa, Plasmodium falciparum
IKQTPILLHHNFKSLIKLTSSCINFENKRHY

SEQ ID NO: 3262228 - protein, 19 aa, Plasmodium falciparum
IKQYLAHIVDHWVDPQKVS

SEQ ID NO: 3262229 - protein, 23 aa, Plasmodium falciparum
IKQYLIHFIYKFFYCHHEKKKKF

SEQ ID NO: 3262230 - protein, 20 aa, Plasmodium falciparum
IKRFFPFEPYKIQLNFMRLF

SEQ ID NO: 3262231 - protein, 25 aa, Plasmodium falciparum
IKRKDYGSRFFIFSLKIKSSKEEFT

SEQ ID NO: 3262232 - protein, 17 aa, Plasmodium falciparum
IKRKKKKACDMKKIWYI

SEQ ID NO: 3262233 - protein, 24 aa, Plasmodium falciparum
IKRKRKVLFSYLKTHIHFNSQQIN

SEQ ID NO: 3262234 - protein, 26 aa, Plasmodium falciparum
IKRKSCSMNSNILLRYIPKNPKGKNN

SEQ ID NO: 3262235 - protein, 18 aa, Plasmodium falciparum
IKRLISIFRNKLYLNSRN

SEQ ID NO: 3262236 - protein, 22 aa, Plasmodium falciparum
IKRLRKFNYFILNKCLIEKYNN

SEQ ID NO: 3262237 - protein, 23 aa, Plasmodium falciparum
IKRNQVYRLIKMYSSYDPMESNY

SEQ ID NO: 3262238 - protein, 24 aa, Plasmodium falciparum
IKRQIYFYYCVLFLEVYYPLLYLR

SEQ ID NO: 3262239 - protein, 18 aa, Plasmodium falciparum
IKRTKLIKTRNFIKKDNQ

SEQ ID NO: 3262240 - protein, 19 aa, Plasmodium falciparum
IKRYHVIDIKIERYVPSYI

SEQ ID NO: 3262241 - protein, 20 aa, Plasmodium falciparum
IKSAFTFGGITSVEYEGAAS

SEQ ID NO: 3262242 - protein, 18 aa, Plasmodium falciparum
IKSDIFFHNDFLIYKNIK

SEQ ID NO: 3262243 - protein, 17 aa, Plasmodium falciparum
IKSDRIVYQKILKDLLK

SEQ ID NO: 3262244 - protein, 28 aa, Plasmodium falciparum
IKSEIMKIIAMCGIRISLNILIFYMYDI

SEQ ID NO: 3262245 - protein, 21 aa, Plasmodium falciparum
IKSFCLKRLNSNCIMWDTLMK

SEQ ID NO: 3262246 - protein, 17 aa, Plasmodium falciparum
IKSFIVFNIAQDNKTKE

SEQ ID NO: 3262247 - protein, 17 aa, Plasmodium falciparum
IKSGWCDGTTITYKGEG

SEQ ID NO: 3262248 - protein, 22 aa, Plasmodium falciparum
IKSIKIDLLYILKNDYNKIIIL

SEQ ID NO: 3262249 - protein, 21 aa, Plasmodium falciparum
IKSKELCEIFLRSLKNDQGSV

SEQ ID NO: 3262250 - protein, 20 aa, Plasmodium falciparum
IKSKRILSDFNLKHHKYTKL

SEQ ID NO: 3262251 - protein, 25 aa, Plasmodium falciparum
IKSMLYIIFCLIKYYHNIKNFIAQE

SEQ ID NO: 3262252 - protein, 18 aa, Plasmodium falciparum
IKSNLAVTNWINNRRSIY

SEQ ID NO: 3262253 - protein, 21 aa, Plasmodium falciparum
IKSNLRSGSSNSRNRINEEKH

SEQ ID NO: 3262254 - protein, 19 aa, Plasmodium falciparum
IKSRNGIDLSSNIDNDERF

SEQ ID NO: 3262255 - protein, 33 aa, Plasmodium falciparum
IKSRTHTKVLLFSYFCFFVYTWYVNIVCVYPLN

SEQ ID NO: 3262256 - protein, 19 aa, Plasmodium falciparum
IKSSNQFNVMILKDNICNP

SEQ ID NO: 3262257 - protein, 17 aa, Plasmodium falciparum
IKSSYYINFNIQITPIL

SEQ ID NO: 3262258 - protein, 19 aa, Plasmodium falciparum
IKSTLKKGSKSFLSISDNL

SEQ ID NO: 3262259 - protein, 23 aa, Plasmodium falciparum
IKSVDKKGSFSFHHLKGAYPSNV

SEQ ID NO: 3262260 - protein, 17 aa, Plasmodium falciparum
IKSVPCYNSYYIKKGQN

SEQ ID NO: 3262261 - protein, 24 aa, Plasmodium falciparum
IKSYIKKNIKGFLNISTSEKSNNM

SEQ ID NO: 3262262 - protein, 26 aa, Plasmodium falciparum
IKTCDKKCNCAGKWIKLKQDEWENIK

SEQ ID NO: 3262263 - protein, 28 aa, Plasmodium falciparum
IKTDKGFLFLLNILKFIYTKFISLPFNP

SEQ ID NO: 3262264 - protein, 17 aa, Plasmodium falciparum
IKTERKIFSYIIFSHYK

SEQ ID NO: 3262265 - protein, 18 aa, Plasmodium falciparum
IKTFKYISFFSIDLIDIW

SEQ ID NO: 3262266 - protein, 25 aa, Plasmodium falciparum
IKTKFKRKDFQNFFYFLKEQRYYSS

SEQ ID NO: 3262267 - protein, 19 aa, Plasmodium falciparum
IKTNIFFKKKKKILQDYVI

SEQ ID NO: 3262268 - protein, 23 aa, Plasmodium falciparum
IKTPIYCFRKYIFSHKNYMNILD

SEQ ID NO: 3262269 - protein, 18 aa, Plasmodium falciparum
IKTQDILKREEIIIQDTF

SEQ ID NO: 3262270 - protein, 17 aa, Plasmodium falciparum
IKTRFIEQYNYNDTEMK

SEQ ID NO: 3262271 - protein, 19 aa, Plasmodium falciparum
IKTSIRYRKKTNLNSTSYI

SEQ ID NO: 3262272 - protein, 24 aa, Plasmodium falciparum
IKTSRLVVLSTYSFLGQNGLAFYI

SEQ ID NO: 3262273 - protein, 19 aa, Plasmodium falciparum
IKTYCMGKTFANFIDSYGF

SEQ ID NO: 3262274 - protein, 21 aa, Plasmodium falciparum
IKVDTLLLLCIYESLKNISKN

SEQ ID NO: 3262275 - protein, 17 aa, Plasmodium falciparum
IKVEPVVPRAIGEPMEN

SEQ ID NO: 3262276 - protein, 23 aa, Plasmodium falciparum
IKVKLNFNSCIILPYNHYNISSD

SEQ ID NO: 3262277 - protein, 21 aa, Plasmodium falciparum
IKVKNFFSIIEEFFYLEKKKK

SEQ ID NO: 3262278 - protein, 29 aa, Plasmodium falciparum
IKVNHCMKISGIIKWMYRYNDLNKDVLDN

SEQ ID NO: 3262279 - protein, 22 aa, Plasmodium falciparum
IKVNVKNGIHFNVEKNKNNSSV

SEQ ID NO: 3262280 - protein, 25 aa, Plasmodium falciparum
IKWKKEFNFDLPINHLDSFAKMWMK

SEQ ID NO: 3262281 - protein, 20 aa, Plasmodium falciparum
IKYASFVLVNLALITLISSI

SEQ ID NO: 3262282 - protein, 19 aa, Plasmodium falciparum
IKYASKFFKFMKEHNKVYK

SEQ ID NO: 3262283 - protein, 17 aa, Plasmodium falciparum
IKYEYFYKIKLSSYSTD

SEQ ID NO: 3262284 - protein, 20 aa, Plasmodium falciparum
IKYFIDDPVDIIRKGENQYC

SEQ ID NO: 3262285 - protein, 18 aa, Plasmodium falciparum
IKYFKNVEMCILRHNKEY

SEQ ID NO: 3262286 - protein, 17 aa, Plasmodium falciparum
IKYFLKNNILIKNISCA

SEQ ID NO: 3262287 - protein, 25 aa, Plasmodium falciparum
IKYFNKIKHSFFYNKKGFSFIQNFK

SEQ ID NO: 3262288 - protein, 20 aa, Plasmodium falciparum
IKYFSCIGKFHDYEKIENFG

SEQ ID NO: 3262289 - protein, 19 aa, Plasmodium falciparum
IKYFSLISLSFEKLKIYYS

SEQ ID NO: 3262290 - protein, 18 aa, Plasmodium falciparum
IKYIEFYYLYKGGCTKIF

SEQ ID NO: 3262291 - protein, 17 aa, Plasmodium falciparum
IKYIFSFNFIFLILSIF

SEQ ID NO: 3262292 - protein, 31 aa, Plasmodium falciparum
IKYIKKIINRACKYLEFSICSYYKNYEQSIH

SEQ ID NO: 3262293 - protein, 19 aa, Plasmodium falciparum
IKYILSIKAVISIYYIYGD

SEQ ID NO: 3262294 - protein, 23 aa, Plasmodium falciparum
IKYIPIFLLKIFQGDSFNDISFI

SEQ ID NO: 3262295 - protein, 21 aa, Plasmodium falciparum
IKYIRIEYIYSLLYSANNRNK

SEQ ID NO: 3262296 - protein, 17 aa, Plasmodium falciparum
IKYKKKLELLKIIDTKI

SEQ ID NO: 3262297 - protein, 17 aa, Plasmodium falciparum
IKYKNIFLKKQKKYQKY

SEQ ID NO: 3262298 - protein, 17 aa, Plasmodium falciparum
IKYKPLFMFVEDSSSFL

SEQ ID NO: 3262299 - protein, 21 aa, Plasmodium falciparum
IKYKYSHVCHSMLCINHQIMI

SEQ ID NO: 3262300 - protein, 24 aa, Plasmodium falciparum
IKYLCILICLSVFISLYKISLTCY

SEQ ID NO: 3262301 - protein, 21 aa, Plasmodium falciparum
IKYMWLHHSLVIFKLLIDTNL

SEQ ID NO: 3262302 - protein, 20 aa, Plasmodium falciparum
IKYNAAITLNHIYKINQYDL

SEQ ID NO: 3262303 - protein, 28 aa, Plasmodium falciparum
IKYNHILFLFICVKNIFHKYINNLWIEK

SEQ ID NO: 3262304 - protein, 19 aa, Plasmodium falciparum
IKYNIKWLTLFFHSLIQYF

SEQ ID NO: 3262305 - protein, 24 aa, Plasmodium falciparum
IKYNKKFELCLNVKNSYMNKKKKY

SEQ ID NO: 3262306 - protein, 17 aa, Plasmodium falciparum
IKYNLIFILKSFSQNNN

SEQ ID NO: 3262307 - protein, 17 aa, Plasmodium falciparum
IKYNLNDLIPFFYKNNY

SEQ ID NO: 3262308 - protein, 29 aa, Plasmodium falciparum
IKYNRCSLLHYFQCNDIIYSLYMFTNCDQ

SEQ ID NO: 3262309 - protein, 19 aa, Plasmodium falciparum
IKYRMLTQYAKPILSSNNI

SEQ ID NO: 3262310 - protein, 20 aa, Plasmodium falciparum
IKYYLCPACKNRKEEYYKYD

SEQ ID NO: 3262311 - protein, 27 aa, Plasmodium falciparum
IKYYSFKRVIILSITISICIFIFCIFK

SEQ ID NO: 3262312 - protein, 28 aa, Plasmodium falciparum
ILAAELLIMIGCIFLKIKNVQKYLQIFK

SEQ ID NO: 3262313 - protein, 17 aa, Plasmodium falciparum
ILCELRNGNKSPLISKS

SEQ ID NO: 3262314 - protein, 17 aa, Plasmodium falciparum
ILDCIFVIILTCRSFYA

SEQ ID NO: 3262315 - protein, 18 aa, Plasmodium falciparum
ILDGFKYKIIIKRKTDNI

SEQ ID NO: 3262316 - protein, 20 aa, Plasmodium falciparum
ILDIILRILKIRGNKKKREK

SEQ ID NO: 3262317 - protein, 23 aa, Plasmodium falciparum
ILDKDLFFYISYYLYIHNNNINK

SEQ ID NO: 3262318 - protein, 20 aa, Plasmodium falciparum
ILDKYLFKILNTEYKIYLNA

SEQ ID NO: 3262319 - protein, 43 aa, Plasmodium falciparum
ILDLKVVLFEAYDKGCLVCILPMVCKILESIKLSKNFKPPNPW

SEQ ID NO: 3262320 - protein, 24 aa, Plasmodium falciparum
ILDSFLFFIIHIFYTFLHFHNVYF

SEQ ID NO: 3262321 - protein, 18 aa, Plasmodium falciparum
ILDYIEVVDLIRSHCSKI

SEQ ID NO: 3262322 - protein, 17 aa, Plasmodium falciparum
ILEDINFFEDSNDDDYS

SEQ ID NO: 3262323 - protein, 23 aa, Plasmodium falciparum
ILEKIMPFLSCNKVKKNYNKLTK

SEQ ID NO: 3262324 - protein, 27 aa, Plasmodium falciparum
ILEKKICKLLLGYYKYKKIHNLINNTF

SEQ ID NO: 3262325 - protein, 17 aa, Plasmodium falciparum
ILELLNTYIKIIIITPQ

SEQ ID NO: 3262326 - protein, 18 aa, Plasmodium falciparum
ILENICLHLYFEVHDDTK

SEQ ID NO: 3262327 - protein, 18 aa, Plasmodium falciparum
ILERKIFDYYTFVKRYFT

SEQ ID NO: 3262328 - protein, 18 aa, Plasmodium falciparum
ILFARLLSGFGIGLVTVS

SEQ ID NO: 3262329 - protein, 18 aa, Plasmodium falciparum
ILFFLYKHNNLLIIKLYI

SEQ ID NO: 3262330 - protein, 24 aa, Plasmodium falciparum
ILFFNFLCSYSYEKYIIKYFEKRE

SEQ ID NO: 3262331 - protein, 18 aa, Plasmodium falciparum
ILFFRAINGLALGSIGPI

SEQ ID NO: 3262332 - protein, 26 aa, Plasmodium falciparum
ILFFTKNISFVWKILSLFVILILLYF

SEQ ID NO: 3262333 - protein, 17 aa, Plasmodium falciparum
ILFGCALGMLQLIFIDT

SEQ ID NO: 3262334 - protein, 18 aa, Plasmodium falciparum
ILFGISVLFMILSFFTLP

SEQ ID NO: 3262335 - protein, 20 aa, Plasmodium falciparum
ILFIDAEWKCAVFRENPIIS

SEQ ID NO: 3262336 - protein, 20 aa, Plasmodium falciparum
ILFIFFHVAGNFVLSNANTN

SEQ ID NO: 3262337 - protein, 23 aa, Plasmodium falciparum
ILFIIRFIVIRGSKYRYENNSEL

SEQ ID NO: 3262338 - protein, 26 aa, Plasmodium falciparum
ILFILCVIQIKILLSKEGSYGNLQNL

SEQ ID NO: 3262339 - protein, 24 aa, Plasmodium falciparum
ILFLKPEIYRHIVFNRIKYHDKFI

SEQ ID NO: 3262340 - protein, 18 aa, Plasmodium falciparum
ILFMSSTVRIINKCGIPL

SEQ ID NO: 3262341 - protein, 19 aa, Plasmodium falciparum
ILFNECLLTGININTIFYD

SEQ ID NO: 3262342 - protein, 22 aa, Plasmodium falciparum
ILFNILIGYYFFIVINNVVGNL

SEQ ID NO: 3262343 - protein, 25 aa, Plasmodium falciparum
ILFNMCNYNNWKLLINVFLHHLPFI

SEQ ID NO: 3262344 - protein, 22 aa, Plasmodium falciparum
ILFRYNKFDVLHTVNKSLDTYI

SEQ ID NO: 3262345 - protein, 24 aa, Plasmodium falciparum
ILFSGSFCAIFWFKKQNKLHGLTF

SEQ ID NO: 3262346 - protein, 18 aa, Plasmodium falciparum
ILFTCSGPAFINTLSGLY

SEQ ID NO: 3262347 - protein, 17 aa, Plasmodium falciparum
ILFTETFITPKFIALFF

SEQ ID NO: 3262348 - protein, 27 aa, Plasmodium falciparum
ILFVFISFFTIFLLPLLYLTFKQKKYI

SEQ ID NO: 3262349 - protein, 35 aa, Plasmodium falciparum
ILFYIYQKFILMKYLKKKSNVYMFYYIPSAEKQNC

SEQ ID NO: 3262350 - protein, 23 aa, Plasmodium falciparum
ILFYMCADIIIYLSRNNFYDFIN

SEQ ID NO: 3262351 - protein, 17 aa, Plasmodium falciparum
ILGFLSFSKKFPKSTPT

SEQ ID NO: 3262352 - protein, 25 aa, Plasmodium falciparum
ILGLIPRISYRNHPFDDLPQSEFFM

SEQ ID NO: 3262353 - protein, 21 aa, Plasmodium falciparum
ILGQIRYDYVLDELLKKDELL

SEQ ID NO: 3262354 - protein, 25 aa, Plasmodium falciparum
ILGRKIELINCDFNSNIYFDQFHFL

SEQ ID NO: 3262355 - protein, 17 aa, Plasmodium falciparum
ILGSIGWTYENVATKYL

SEQ ID NO: 3262356 - protein, 18 aa, Plasmodium falciparum
ILGSYSIMSSAVFSCIDY

SEQ ID NO: 3262357 - protein, 34 aa, Plasmodium falciparum
ILHDYFIFRINIFFFNWFLLHIYKIKLKNTSYIE

SEQ ID NO: 3262358 - protein, 24 aa, Plasmodium falciparum
ILHIFYKYKINIFELDNHFLKVAK

SEQ ID NO: 3262359 - protein, 26 aa, Plasmodium falciparum
ILHKLLSDNKLEFVSYFYFLDLLYKV

SEQ ID NO: 3262360 - protein, 18 aa, Plasmodium falciparum
ILHKTRNGKYCSFSDYEM

SEQ ID NO: 3262361 - protein, 17 aa, Plasmodium falciparum
ILHLSIMNSLISYSFIN

SEQ ID NO: 3262362 - protein, 17 aa, Plasmodium falciparum
ILHQFYLSIYIKEYYFF

SEQ ID NO: 3262363 - protein, 21 aa, Plasmodium falciparum
ILHYKDHIKLFYPSNFYMFVN

SEQ ID NO: 3262364 - protein, 26 aa, Plasmodium falciparum
ILICGYLMPIELCIMEIAKMIFDEND

SEQ ID NO: 3262365 - protein, 24 aa, Plasmodium falciparum
ILIGEYFIYLIIYFRNIKIKKNPL

SEQ ID NO: 3262366 - protein, 20 aa, Plasmodium falciparum
ILIICVTWIQYVLKKLQNKY

SEQ ID NO: 3262367 - protein, 24 aa, Plasmodium falciparum
ILIIFLVYVNLDFFKSNINVKAIH

SEQ ID NO: 3262368 - protein, 20 aa, Plasmodium falciparum
ILIILGGYIFKFKEILNKKY

SEQ ID NO: 3262369 - protein, 18 aa, Plasmodium falciparum
ILIIPRFFHCKKKNSVII

SEQ ID NO: 3262370 - protein, 23 aa, Plasmodium falciparum
ILIKHLDILLGNYYIYNYNIYSE

SEQ ID NO: 3262371 - protein, 17 aa, Plasmodium falciparum
ILIKKWVVWTFKNCDNI

SEQ ID NO: 3262372 - protein, 26 aa, Plasmodium falciparum
ILIKNYKCIFIWYMNIIIDILLNSLD

SEQ ID NO: 3262373 - protein, 19 aa, Plasmodium falciparum
ILILFKLNVNTTYEFSSLK

SEQ ID NO: 3262374 - protein, 26 aa, Plasmodium falciparum
ILINKHYWINISIIFNLTIDLIYVIL

SEQ ID NO: 3262375 - protein, 21 aa, Plasmodium falciparum
ILINLKCAYNLSRVKTKLSKY

SEQ ID NO: 3262376 - protein, 24 aa, Plasmodium falciparum
ILIQCLHFKGAYKIRNKNNNNMSD

SEQ ID NO: 3262377 - protein, 30 aa, Plasmodium falciparum
ILIQIPMDIILKVLCPNVFISSYKKTNIIN

SEQ ID NO: 3262378 - protein, 17 aa, Plasmodium falciparum
ILIRIILMLSFIYCIRS

SEQ ID NO: 3262379 - protein, 24 aa, Plasmodium falciparum
ILISFRLFLVRSIHYKKSNPFLLY

SEQ ID NO: 3262380 - protein, 24 aa, Plasmodium falciparum
ILISKILLIYIMKYIFGHIDNNIL

SEQ ID NO: 3262381 - protein, 20 aa, Plasmodium falciparum
ILISLAIFGVIFLFIFSNKH

SEQ ID NO: 3262382 - protein, 25 aa, Plasmodium falciparum
ILISLKYDLDIDVFYRCLKILKIIC

SEQ ID NO: 3262383 - protein, 17 aa, Plasmodium falciparum
ILITILVYILLFYINDF

SEQ ID NO: 3262384 - protein, 18 aa, Plasmodium falciparum
ILITLLFINLNNIFLPSI

SEQ ID NO: 3262385 - protein, 17 aa, Plasmodium falciparum
ILITPSFSTIQNKKDIN

SEQ ID NO: 3262386 - protein, 18 aa, Plasmodium falciparum
ILKAIKFLEKKDEKDEEK

SEQ ID NO: 3262387 - protein, 22 aa, Plasmodium falciparum
ILKARLKLIHNFINKKKNKKCN

SEQ ID NO: 3262388 - protein, 18 aa, Plasmodium falciparum
ILKCLKFCEKMFLSTNHN

SEQ ID NO: 3262389 - protein, 23 aa, Plasmodium falciparum
ILKDLKHEVIIRMNTSLTNIVSY

SEQ ID NO: 3262390 - protein, 21 aa, Plasmodium falciparum
ILKECYECHLGHMKNNENMEK

SEQ ID NO: 3262391 - protein, 17 aa, Plasmodium falciparum
ILKEELEIIRNNFHILK

SEQ ID NO: 3262392 - protein, 21 aa, Plasmodium falciparum
ILKEILCKLRNKVSFMYNINF

SEQ ID NO: 3262393 - protein, 17 aa, Plasmodium falciparum
ILKENFLYLNIPKSIKR

SEQ ID NO: 3262394 - protein, 17 aa, Plasmodium falciparum
ILKENKYIFQVFNNLKR

SEQ ID NO: 3262395 - protein, 23 aa, Plasmodium falciparum
ILKESFFHKSLKFMDYIWIVIMK

SEQ ID NO: 3262396 - protein, 24 aa, Plasmodium falciparum
ILKFFYNCEFIFKEDIEREEYIMK

SEQ ID NO: 3262397 - protein, 23 aa, Plasmodium falciparum
ILKHLKLRHFINFTRKKNRRDRK

SEQ ID NO: 3262398 - protein, 20 aa, Plasmodium falciparum
ILKIFSKFFVIPKLSYDQFK

SEQ ID NO: 3262399 - protein, 26 aa, Plasmodium falciparum
ILKIHKWKDAIPFYSYNYEKLLKKVM

SEQ ID NO: 3262400 - protein, 21 aa, Plasmodium falciparum
ILKINMCIEQIFNIMIEESHN

SEQ ID NO: 3262401 - protein, 24 aa, Plasmodium falciparum
ILKKDMYSSLVIRINPIFLKILHF

SEQ ID NO: 3262402 - protein, 18 aa, Plasmodium falciparum
ILKKIYFLKGNKLDDIQI

SEQ ID NO: 3262403 - protein, 26 aa, Plasmodium falciparum
ILKKKEIRTFYEFLNTFMILQDLNCL

SEQ ID NO: 3262404 - protein, 21 aa, Plasmodium falciparum
ILKKKIKGEITILSTTLNGYE

SEQ ID NO: 3262405 - protein, 20 aa, Plasmodium falciparum
ILKKKLKIYDIQWHEEYEKK

SEQ ID NO: 3262406 - protein, 23 aa, Plasmodium falciparum
ILKKRLLQFEDWDVISFPFWEIK

SEQ ID NO: 3262407 - protein, 18 aa, Plasmodium falciparum
ILKLLAIFYIKLSKNTKF

SEQ ID NO: 3262408 - protein, 22 aa, Plasmodium falciparum
ILKMIHMKQMFKICTTNYYQNT

SEQ ID NO: 3262409 - protein, 20 aa, Plasmodium falciparum
ILKNICIQINHLMTNVKNNN

SEQ ID NO: 3262410 - protein, 20 aa, Plasmodium falciparum
ILKNIIKFIFLATTRSYDVD

SEQ ID NO: 3262411 - protein, 22 aa, Plasmodium falciparum
ILKNIYFKKFHITFDHIYQNCN

SEQ ID NO: 3262412 - protein, 19 aa, Plasmodium falciparum
ILKNSYFKIHLLRKDCSTL

SEQ ID NO: 3262413 - protein, 23 aa, Plasmodium falciparum
ILKNYYLKSVYVMDKKKEMWENL

SEQ ID NO: 3262414 - protein, 19 aa, Plasmodium falciparum
ILKSIKVVVIFIKNNLKHL

SEQ ID NO: 3262415 - protein, 25 aa, Plasmodium falciparum
ILKYIFRCIQYYWSDKLKEEYCHRS

SEQ ID NO: 3262416 - protein, 33 aa, Plasmodium falciparum
ILKYNVLDIPLKIILFPLYFFPLYNDVYSLEIK

SEQ ID NO: 3262417 - protein, 20 aa, Plasmodium falciparum
ILKYPNYFYVISLYRKNVRF

SEQ ID NO: 3262418 - protein, 17 aa, Plasmodium falciparum
ILLAFLVLHALLYMKYK

SEQ ID NO: 3262419 - protein, 17 aa, Plasmodium falciparum
ILLCDNLNVMGEAVYES

SEQ ID NO: 3262420 - protein, 19 aa, Plasmodium falciparum
ILLDPVFKIELISFKGIVR

SEQ ID NO: 3262421 - protein, 29 aa, Plasmodium falciparum
ILLDYILKCGITFFFIFILLRSHIFIQNK

SEQ ID NO: 3262422 - protein, 19 aa, Plasmodium falciparum
ILLEGTYNILSPMYNNRRV

SEQ ID NO: 3262423 - protein, 18 aa, Plasmodium falciparum
ILLERLLGINKITSLKVM

SEQ ID NO: 3262424 - protein, 21 aa, Plasmodium falciparum
ILLEYYNIFKASTCLQLSNQP

SEQ ID NO: 3262425 - protein, 28 aa, Plasmodium falciparum
ILLFIIDLLCLFKLHSIYIKKKYCESIL

SEQ ID NO: 3262426 - protein, 25 aa, Plasmodium falciparum
ILLFKEIMNPFFIFQIFAMIVWSLD

SEQ ID NO: 3262427 - protein, 17 aa, Plasmodium falciparum
ILLFKNLYFFNIHLISL

SEQ ID NO: 3262428 - protein, 25 aa, Plasmodium falciparum
ILLFLCKANERIIFLSNFYMLKNKY

SEQ ID NO: 3262429 - protein, 67 aa, Plasmodium falciparum
ILLFLETAIIKFLFLLTCRDINLSFLHILSFISYKFVIMCALIITKIFFYFLYFMYASVFGGGGTFP

SEQ ID NO: 3262430 - protein, 18 aa, Plasmodium falciparum
ILLFLLYVIIPIEFINTI

SEQ ID NO: 3262431 - protein, 20 aa, Plasmodium falciparum
ILLFNYKYHFLWENNYFNIL

SEQ ID NO: 3262432 - protein, 20 aa, Plasmodium falciparum
ILLFRTNFYSKFSYLLFDMR

SEQ ID NO: 3262433 - protein, 24 aa, Plasmodium falciparum
ILLHSIFSFFAFKNDMQFWYKNES

SEQ ID NO: 3262434 - protein, 20 aa, Plasmodium falciparum
ILLIYGIRIYFGLKKLDLKY

SEQ ID NO: 3262435 - protein, 24 aa, Plasmodium falciparum
ILLKENRLLFLLDFYEKNSNCNNI

SEQ ID NO: 3262436 - protein, 39 aa, Plasmodium falciparum
ILLLFYKLLHSFGPHIICVKTINKYCLKFNEMMDKAVKT

SEQ ID NO: 3262437 - protein, 24 aa, Plasmodium falciparum
ILLLKYRILECMKLKDKDVNDSNT

SEQ ID NO: 3262438 - protein, 17 aa, Plasmodium falciparum
ILLLLIDNSCCPLLHEH

SEQ ID NO: 3262439 - protein, 18 aa, Plasmodium falciparum
ILLLWSFNPKLSILCAEI

SEQ ID NO: 3262440 - protein, 19 aa, Plasmodium falciparum
ILLMGTLSYDFFKSYISKK

SEQ ID NO: 3262441 - protein, 18 aa, Plasmodium falciparum
ILLNEIYFILLKKNLYFH

SEQ ID NO: 3262442 - protein, 17 aa, Plasmodium falciparum
ILLNLLKNILIKIQEEN

SEQ ID NO: 3262443 - protein, 26 aa, Plasmodium falciparum
ILLSDAEKKCIHFLMHVNYKTNNNMY

SEQ ID NO: 3262444 - protein, 17 aa, Plasmodium falciparum
ILLSYLIYKNDDNSNYS

SEQ ID NO: 3262445 - protein, 26 aa, Plasmodium falciparum
ILLVCYFPYFIYETMRRFLILYNNIY

SEQ ID NO: 3262446 - protein, 18 aa, Plasmodium falciparum
ILLWCGEIVKNIKNKKIT

SEQ ID NO: 3262447 - protein, 17 aa, Plasmodium falciparum
ILLYFIKPLFAFLTDSV

SEQ ID NO: 3262448 - protein, 18 aa, Plasmodium falciparum
ILLYIDFLVIKQIGKEIY

SEQ ID NO: 3262449 - protein, 19 aa, Plasmodium falciparum
ILLYIFMKVIKRFIKSFVI

SEQ ID NO: 3262450 - protein, 27 aa, Plasmodium falciparum
ILLYKRWFPDNLICFPFLSKHRKNHNK

SEQ ID NO: 3262451 - protein, 26 aa, Plasmodium falciparum
ILMDKFCLLNSIPLIESGIEGLKASS

SEQ ID NO: 3262452 - protein, 17 aa, Plasmodium falciparum
ILMGCAVLPHLKDLVQI

SEQ ID NO: 3262453 - protein, 17 aa, Plasmodium falciparum
ILMIPFISNMYWFTFVM

SEQ ID NO: 3262454 - protein, 23 aa, Plasmodium falciparum
ILMLNLPIYFFFKNKLYVKTSFT

SEQ ID NO: 3262455 - protein, 19 aa, Plasmodium falciparum
ILMNIKLHIEYNIIFYISL

SEQ ID NO: 3262456 - protein, 25 aa, Plasmodium falciparum
ILMPTMCFQFFYPRTEKIRWIHVAK

SEQ ID NO: 3262457 - protein, 25 aa, Plasmodium falciparum
ILMSATRSPLFLTFKTIPPSLNQLL

SEQ ID NO: 3262458 - protein, 24 aa, Plasmodium falciparum
ILMSLCLRFDYYLFKNNIHKGNLK

SEQ ID NO: 3262459 - protein, 27 aa, Plasmodium falciparum
ILNCDYCNKHVYPLIKTYTPLFVYIMI

SEQ ID NO: 3262460 - protein, 19 aa, Plasmodium falciparum
ILNCKKILCKYKYKNNING

SEQ ID NO: 3262461 - protein, 23 aa, Plasmodium falciparum
ILNCLMHIVVLIKMYFFTSESVY

SEQ ID NO: 3262462 - protein, 17 aa, Plasmodium falciparum
ILNDRYINFKIFKKGEE

SEQ ID NO: 3262463 - protein, 26 aa, Plasmodium falciparum
ILNDVPLSFIYFKKIYFLLLNNEKDI

SEQ ID NO: 3262464 - protein, 20 aa, Plasmodium falciparum
ILNEELYEYINIINKVDKKK

SEQ ID NO: 3262465 - protein, 20 aa, Plasmodium falciparum
ILNEGFDFINKCAKESNVSG

SEQ ID NO: 3262466 - protein, 26 aa, Plasmodium falciparum
ILNFISRFQFVDVFISLFIVSSLNLY

SEQ ID NO: 3262467 - protein, 28 aa, Plasmodium falciparum
ILNIESLLIICCSLGISESQFLELLNVD

SEQ ID NO: 3262468 - protein, 18 aa, Plasmodium falciparum
ILNIFYLAYPKRILTLNL

SEQ ID NO: 3262469 - protein, 24 aa, Plasmodium falciparum
ILNILKKVYYRYEHNLSNEYYNIY

SEQ ID NO: 3262470 - protein, 20 aa, Plasmodium falciparum
ILNILKLAKLILHNINTIKI

SEQ ID NO: 3262471 - protein, 18 aa, Plasmodium falciparum
ILNILYIYPQLYVSCIIS

SEQ ID NO: 3262472 - protein, 26 aa, Plasmodium falciparum
ILNIMKYILFFSCTKKYTNVCLLLFD

SEQ ID NO: 3262473 - protein, 19 aa, Plasmodium falciparum
ILNIPRKSTLLSEDNKNDD

SEQ ID NO: 3262474 - protein, 25 aa, Plasmodium falciparum
ILNKFRISKHIAILGGNPGLNVNNT

SEQ ID NO: 3262475 - protein, 19 aa, Plasmodium falciparum
ILNKLPFDIPQVSNNLGPT

SEQ ID NO: 3262476 - protein, 17 aa, Plasmodium falciparum
ILNKMNYSFAYRDKKLI

SEQ ID NO: 3262477 - protein, 33 aa, Plasmodium falciparum
ILNKTKLKIFWEVVDEFLSWIINTSDLFPQLNT

SEQ ID NO: 3262478 - protein, 24 aa, Plasmodium falciparum
ILNKYGEGFLSNFINKLNYHNNNK

SEQ ID NO: 3262479 - protein, 21 aa, Plasmodium falciparum
ILNLLPCNFSLLSNKHNEDNI

SEQ ID NO: 3262480 - protein, 31 aa, Plasmodium falciparum
ILNLMFLLLSRCMCIHVIKSFNFNYNCNYCL

SEQ ID NO: 3262481 - protein, 20 aa, Plasmodium falciparum
ILNMCIKCLYKDNNNNNNNN

SEQ ID NO: 3262482 - protein, 17 aa, Plasmodium falciparum
ILNQLWVEKYRPKNLNE

SEQ ID NO: 3262483 - protein, 17 aa, Plasmodium falciparum
ILNRNMKNFIYFNFPNV

SEQ ID NO: 3262484 - protein, 18 aa, Plasmodium falciparum
ILNSKIIMKFYKFSYNFF

SEQ ID NO: 3262485 - protein, 46 aa, Plasmodium falciparum
ILNTFDLRVTIFNVFWLREWTEFNYRLTGSIGRFSINITKNTVSLF

SEQ ID NO: 3262486 - protein, 17 aa, Plasmodium falciparum
ILNVYSRNVFEDGLYEC

SEQ ID NO: 3262487 - protein, 18 aa, Plasmodium falciparum
ILPFCLFHEHPITFNPTY

SEQ ID NO: 3262488 - protein, 24 aa, Plasmodium falciparum
ILPGAVPFPRFDLIHHDLDVNQTR

SEQ ID NO: 3262489 - protein, 29 aa, Plasmodium falciparum
ILPKNLRAYRFFSYFFYKFKEIIFYIHSY

SEQ ID NO: 3262490 - protein, 21 aa, Plasmodium falciparum
ILPNLFIFYKFQKIIQKPSRA

SEQ ID NO: 3262491 - protein, 26 aa, Plasmodium falciparum
ILPRLSLDIFKNFILNLLTMGDSSIT

SEQ ID NO: 3262492 - protein, 19 aa, Plasmodium falciparum
ILPSNCIFFPNNKYNSIYN

SEQ ID NO: 3262493 - protein, 17 aa, Plasmodium falciparum
ILPYIVIINNTKMNIVF

SEQ ID NO: 3262494 - protein, 23 aa, Plasmodium falciparum
ILQCQNKDILQCQNIYHNLQDKS

SEQ ID NO: 3262495 - protein, 18 aa, Plasmodium falciparum
ILQISYWFSCLFYLNYEI

SEQ ID NO: 3262496 - protein, 28 aa, Plasmodium falciparum
ILQKYFLSFKFWYFYLRYQGIDKMKKLF

SEQ ID NO: 3262497 - protein, 25 aa, Plasmodium falciparum
ILQLNDCLFKKGILKDTEDNIFFNY

SEQ ID NO: 3262498 - protein, 17 aa, Plasmodium falciparum
ILRDFKNTIYFIFNIIK

SEQ ID NO: 3262499 - protein, 22 aa, Plasmodium falciparum
ILRDIKCVFFFNLESEKNTINA

SEQ ID NO: 3262500 - protein, 23 aa, Plasmodium falciparum
ILRFYPYNFTWPFDSLQINCIDQ

SEQ ID NO: 3262501 - protein, 22 aa, Plasmodium falciparum
ILRGSQPFFSKKILNKKILKTP

SEQ ID NO: 3262502 - protein, 18 aa, Plasmodium falciparum
ILRMLNMKIAFFDITVLG

SEQ ID NO: 3262503 - protein, 21 aa, Plasmodium falciparum
ILRRKNCNKINLSKNSEMLLY

SEQ ID NO: 3262504 - protein, 18 aa, Plasmodium falciparum
ILRWLNGKDAYPYEYWNN

SEQ ID NO: 3262505 - protein, 20 aa, Plasmodium falciparum
ILRYLNYIHCKLINKYAPDP

SEQ ID NO: 3262506 - protein, 18 aa, Plasmodium falciparum
ILRYRRKSRMKKKFQYIK

SEQ ID NO: 3262507 - protein, 23 aa, Plasmodium falciparum
ILSENNIIYSLDFFVQENITKDS

SEQ ID NO: 3262508 - protein, 23 aa, Plasmodium falciparum
ILSFLLYKGIPWKRENYYTYLNI

SEQ ID NO: 3262509 - protein, 18 aa, Plasmodium falciparum
ILSGGTFWKNYPLPDIMK

SEQ ID NO: 3262510 - protein, 24 aa, Plasmodium falciparum
ILSKKGILFLFILIGFVLKKPDEI

SEQ ID NO: 3262511 - protein, 30 aa, Plasmodium falciparum
ILSKYFKGSIIFRLVRCIHRRKGNNVLLNL

SEQ ID NO: 3262512 - protein, 20 aa, Plasmodium falciparum
ILSKYILNMIKKIKFIKDAV

SEQ ID NO: 3262513 - protein, 22 aa, Plasmodium falciparum
ILSLICYLSLISLVLFFILIVS

SEQ ID NO: 3262514 - protein, 19 aa, Plasmodium falciparum
ILSLLSNIRYLLTCNKRQP

SEQ ID NO: 3262515 - protein, 27 aa, Plasmodium falciparum
ILSPGYIKELLKFYNFSKMKMKPKTNE

SEQ ID NO: 3262516 - protein, 34 aa, Plasmodium falciparum
ILSPNIKQIISFRFFLFCLNFKGIINIYNIKNQQ

SEQ ID NO: 3262517 - protein, 25 aa, Plasmodium falciparum
ILSTGLKIKFLLLNFINIAVNIFIS

SEQ ID NO: 3262518 - protein, 24 aa, Plasmodium falciparum
ILSTRRKECKISYGEYNTSPLVLE

SEQ ID NO: 3262519 - protein, 29 aa, Plasmodium falciparum
ILTAEKYLSLSIIKKAIKIYAHKEQFLKT

SEQ ID NO: 3262520 - protein, 26 aa, Plasmodium falciparum
ILTFHLFCLFLRIAPIHITQTYFLFK

SEQ ID NO: 3262521 - protein, 17 aa, Plasmodium falciparum
ILTFICSLLKEINYIDE

SEQ ID NO: 3262522 - protein, 23 aa, Plasmodium falciparum
ILTFIKERLFYIVSIEKDKRHYI

SEQ ID NO: 3262523 - protein, 21 aa, Plasmodium falciparum
ILTFRGIYFSEWIILTLNKIF

SEQ ID NO: 3262524 - protein, 37 aa, Plasmodium falciparum
ILTGNLPLDFCLNLVEKLKCLSLCVSIVLRSLIKKKN

SEQ ID NO: 3262525 - protein, 25 aa, Plasmodium falciparum
ILTISDDLTFCFYRIENNKKIYYSI

SEQ ID NO: 3262526 - protein, 18 aa, Plasmodium falciparum
ILTKCFELNKSTGKELGC

SEQ ID NO: 3262527 - protein, 18 aa, Plasmodium falciparum
ILTKEILVYYILNLFIYY

SEQ ID NO: 3262528 - protein, 15 aa, Plasmodium falciparum
ILTKIIIMWKKLMMI

SEQ ID NO: 3262529 - protein, 19 aa, Plasmodium falciparum
ILTLCNFKLYKKKFLNKFN

SEQ ID NO: 3262530 - protein, 19 aa, Plasmodium falciparum
ILTRFKKLVYDSIDAIETY

SEQ ID NO: 3262531 - protein, 18 aa, Plasmodium falciparum
ILTTILWIQIHMMVLEES

SEQ ID NO: 3262532 - protein, 17 aa, Plasmodium falciparum
ILTTLFILFIPLILFVF

SEQ ID NO: 3262533 - protein, 21 aa, Plasmodium falciparum
ILTYYKFPFLDIIEQYQNISI

SEQ ID NO: 3262534 - protein, 18 aa, Plasmodium falciparum
ILVCKICTRDYKTVNNNN

SEQ ID NO: 3262535 - protein, 19 aa, Plasmodium falciparum
ILVFFMWKYHKIYSKSVQI

SEQ ID NO: 3262536 - protein, 20 aa, Plasmodium falciparum
ILVFLKRKSPTPKRILKKLK

SEQ ID NO: 3262537 - protein, 20 aa, Plasmodium falciparum
ILVKGLCYNSQMYVKENEIY

SEQ ID NO: 3262538 - protein, 24 aa, Plasmodium falciparum
ILVNNEYFIIFLINANCRHQNNIC

SEQ ID NO: 3262539 - protein, 26 aa, Plasmodium falciparum
ILWFNDIKPFFPLFNYPNDDNKQNKF

SEQ ID NO: 3262540 - protein, 18 aa, Plasmodium falciparum
ILWSLILKYSKYCRKKLI

SEQ ID NO: 3262541 - protein, 21 aa, Plasmodium falciparum
ILYCSKIVIAVHMFTKKIYRI

SEQ ID NO: 3262542 - protein, 18 aa, Plasmodium falciparum
ILYDCFIYNIKYSYEKNL

SEQ ID NO: 3262543 - protein, 23 aa, Plasmodium falciparum
ILYDVKNIFLFFYGYGIPPCHIK

SEQ ID NO: 3262544 - protein, 18 aa, Plasmodium falciparum
ILYEELKDSCDLIYHFIA

SEQ ID NO: 3262545 - protein, 17 aa, Plasmodium falciparum
ILYEVKFSRKIKHVPFT

SEQ ID NO: 3262546 - protein, 18 aa, Plasmodium falciparum
ILYFSKFFMNACFISLLI

SEQ ID NO: 3262547 - protein, 18 aa, Plasmodium falciparum
ILYGNIIFFPSYNFLNDF

SEQ ID NO: 3262548 - protein, 31 aa, Plasmodium falciparum
ILYIEWTKYIFIFTCFITFIFSYYLIIKNYG

SEQ ID NO: 3262549 - protein, 20 aa, Plasmodium falciparum
ILYIHFLKLAYRNTVKKILK

SEQ ID NO: 3262550 - protein, 18 aa, Plasmodium falciparum
ILYIYKWIYIQIYLIIYH

SEQ ID NO: 3262551 - protein, 19 aa, Plasmodium falciparum
ILYKHKDKWIKKKKTNIGK

SEQ ID NO: 3262552 - protein, 17 aa, Plasmodium falciparum
ILYKILGNFIYGLNDEE

SEQ ID NO: 3262553 - protein, 22 aa, Plasmodium falciparum
ILYKNIDCVLLRNMYHNKEFDF

SEQ ID NO: 3262554 - protein, 18 aa, Plasmodium falciparum
ILYKRFKNSILVNLLGQW

SEQ ID NO: 3262555 - protein, 23 aa, Plasmodium falciparum
ILYLKKLLYHYLSSFTNQTVETI

SEQ ID NO: 3262556 - protein, 23 aa, Plasmodium falciparum
ILYNEIFSLLLIEPYNDIDNLLN

SEQ ID NO: 3262557 - protein, 22 aa, Plasmodium falciparum
ILYREDFFKLLILINKKYKKKT

SEQ ID NO: 3262558 - protein, 19 aa, Plasmodium falciparum
ILYTYNFHLHNFLNTFCKE

SEQ ID NO: 3262559 - protein, 22 aa, Plasmodium falciparum
IMDIFRLYSFYDYYRKYKKRKV

SEQ ID NO: 3262560 - protein, 24 aa, Plasmodium falciparum
IMDLKRKYLINALYYSKRCYHILS

SEQ ID NO: 3262561 - protein, 18 aa, Plasmodium falciparum
IMDNISIYKCIEVSVELT

SEQ ID NO: 3262562 - protein, 20 aa, Plasmodium falciparum
IMEFRKCAINGISYGKGLTE

SEQ ID NO: 3262563 - protein, 19 aa, Plasmodium falciparum
IMEILNIFFFYFNDNNSYI

SEQ ID NO: 3262564 - protein, 17 aa, Plasmodium falciparum
IMEIMDLCIKYMYEESV

SEQ ID NO: 3262565 - protein, 33 aa, Plasmodium falciparum
IMENYWKRRIYIYKIKFFLSRTRKIRKRLDLLK

SEQ ID NO: 3262566 - protein, 18 aa, Plasmodium falciparum
IMESCLYEDIFFFRNEEH

SEQ ID NO: 3262567 - protein, 17 aa, Plasmodium falciparum
IMFERWNQLRYSLFYTI

SEQ ID NO: 3262568 - protein, 20 aa, Plasmodium falciparum
IMFNMCIAEMLISYYENRES

SEQ ID NO: 3262569 - protein, 18 aa, Plasmodium falciparum
IMGIINCSKSFSFYVLSS

SEQ ID NO: 3262570 - protein, 19 aa, Plasmodium falciparum
IMGNNLPSYMTWISRSVND

SEQ ID NO: 3262571 - protein, 23 aa, Plasmodium falciparum
IMHPHLYASGIIKLYKEKNYVRI

SEQ ID NO: 3262572 - protein, 17 aa, Plasmodium falciparum
IMIFFVLIFFNFFMFTF

SEQ ID NO: 3262573 - protein, 18 aa, Plasmodium falciparum
IMIIHICAIQYGSFFFHF

SEQ ID NO: 3262574 - protein, 19 aa, Plasmodium falciparum
IMIIYTWRQYIFYKTYMNK

SEQ ID NO: 3262575 - protein, 20 aa, Plasmodium falciparum
IMIKNCIYLTQSILVIDKSV

SEQ ID NO: 3262576 - protein, 18 aa, Plasmodium falciparum
IMIPNFFVHFSFGKILFS

SEQ ID NO: 3262577 - protein, 26 aa, Plasmodium falciparum
IMKELLKRWLEYFLEDYNKIKHKISH

SEQ ID NO: 3262578 - protein, 23 aa, Plasmodium falciparum
IMKGWERKELYLFNNYDEEEKMI

SEQ ID NO: 3262579 - protein, 18 aa, Plasmodium falciparum
IMKHRYSEFLPISKKQSF

SEQ ID NO: 3262580 - protein, 17 aa, Plasmodium falciparum
IMKIFSIEYEKYRPDIF

SEQ ID NO: 3262581 - protein, 23 aa, Plasmodium falciparum
IMKPCTELYHFLKSLGCTETDSS

SEQ ID NO: 3262582 - protein, 24 aa, Plasmodium falciparum
IMKYLKNRKAIYMKNMSRYIDDIK

SEQ ID NO: 3262583 - protein, 19 aa, Plasmodium falciparum
IMLLLIALVRLNFGQREKL

SEQ ID NO: 3262584 - protein, 21 aa, Plasmodium falciparum
IMLSVGLRVLSSISYHYLYEK

SEQ ID NO: 3262585 - protein, 19 aa, Plasmodium falciparum
IMLYTLRTFFFLIFQHYHS

SEQ ID NO: 3262586 - protein, 32 aa, Plasmodium falciparum
IMMYIKCLYNLIRIISLVMFFFVFINTSLSYP

SEQ ID NO: 3262587 - protein, 38 aa, Plasmodium falciparum
IMNGNRLPIFLGIDVCRLVYWCCVVYILQNNQMHKHYK

SEQ ID NO: 3262588 - protein, 28 aa, Plasmodium falciparum
IMNHSCGDARVAINIIDFAVQRMDKQNL

SEQ ID NO: 3262589 - protein, 20 aa, Plasmodium falciparum
IMNLIKYIMDHLENMQVENI

SEQ ID NO: 3262590 - protein, 18 aa, Plasmodium falciparum
IMNNLFCYGIGLIDNNNN

SEQ ID NO: 3262591 - protein, 19 aa, Plasmodium falciparum
IMNRKIFLHECINNVINIL

SEQ ID NO: 3262592 - protein, 19 aa, Plasmodium falciparum
IMPGIYFGICKLRDKIFKS

SEQ ID NO: 3262593 - protein, 17 aa, Plasmodium falciparum
IMQRKNLEYTQSVLNKY

SEQ ID NO: 3262594 - protein, 24 aa, Plasmodium falciparum
IMSIMNFSYLCFNIYKENKVKISK

SEQ ID NO: 3262595 - protein, 20 aa, Plasmodium falciparum
IMTYKLFAIVLLCIHSPIEI

SEQ ID NO: 3262596 - protein, 25 aa, Plasmodium falciparum
IMVSVIFYLCYFFYFLTYSYEIIFL

SEQ ID NO: 3262597 - protein, 17 aa, Plasmodium falciparum
IMWSIGIGFAAFTYFYL

SEQ ID NO: 3262598 - protein, 17 aa, Plasmodium falciparum
IMWSIGIGFATFTYFYL

SEQ ID NO: 3262599 - protein, 25 aa, Plasmodium falciparum
IMYIILRIVIFFTKMKCSTNLTRKE

SEQ ID NO: 3262600 - protein, 17 aa, Plasmodium falciparum
INADTFFSNYLCKDLLI

SEQ ID NO: 3262601 - protein, 17 aa, Plasmodium falciparum
INAFKYSYDLSNVIRNY

SEQ ID NO: 3262602 - protein, 20 aa, Plasmodium falciparum
INAIDRYTCFVSYEKIIRMF

SEQ ID NO: 3262603 - protein, 21 aa, Plasmodium falciparum
INCFYSWLQNVLLKKGRSIND

SEQ ID NO: 3262604 - protein, 21 aa, Plasmodium falciparum
INCKYLTLINLKLILLSYMSI

SEQ ID NO: 3262605 - protein, 23 aa, Plasmodium falciparum
INCLHALASYLFPNNIFQINDNV

SEQ ID NO: 3262606 - protein, 17 aa, Plasmodium falciparum
INDAKLGKCRKGCKNPC

SEQ ID NO: 3262607 - protein, 26 aa, Plasmodium falciparum
INDDLKNIILLFGRIAEPYYPKAVEQ

SEQ ID NO: 3262608 - protein, 29 aa, Plasmodium falciparum
INDESSLIYWCYKNDIPIFCPGLTDGSLG

SEQ ID NO: 3262609 - protein, 18 aa, Plasmodium falciparum
INDIILLEKIVCPSIYRQ

SEQ ID NO: 3262610 - protein, 24 aa, Plasmodium falciparum
INDIKYNQCFLFINNTYEGIQVIK

SEQ ID NO: 3262611 - protein, 18 aa, Plasmodium falciparum
INDILKLIEIKKVVNTQE

SEQ ID NO: 3262612 - protein, 25 aa, Plasmodium falciparum
INDILKRYRLLNCIINKFIMNKNKV

SEQ ID NO: 3262613 - protein, 23 aa, Plasmodium falciparum
INDKCSLATLFNIDFNCQNNIRR

SEQ ID NO: 3262614 - protein, 24 aa, Plasmodium falciparum
INDLKLRNVFFYCIDAFSNAALQK

SEQ ID NO: 3262615 - protein, 22 aa, Plasmodium falciparum
INDLLTFLHFLYFFKQSQYNDL

SEQ ID NO: 3262616 - protein, 22 aa, Plasmodium falciparum
INDLTCHPNNKISIGSNEEIKN

SEQ ID NO: 3262617 - protein, 29 aa, Plasmodium falciparum
INDLTITIGTLFFCYTKYKNIYCNKVPII

SEQ ID NO: 3262618 - protein, 21 aa, Plasmodium falciparum
INDNFPLNIYITLKRSYYLKN

SEQ ID NO: 3262619 - protein, 31 aa, Plasmodium falciparum
INDNIRLLKHKDFCFKFPTFINYKNEIRITE

SEQ ID NO: 3262620 - protein, 28 aa, Plasmodium falciparum
INDPEFFKLREDWWTANRATVWKAITCH

SEQ ID NO: 3262621 - protein, 36 aa, Plasmodium falciparum
INDPEFFKLREDWWTANRATVWKAITCHAGESDKYF

SEQ ID NO: 3262622 - protein, 20 aa, Plasmodium falciparum
INDQYIRYIILRRKYCSTYL

SEQ ID NO: 3262623 - protein, 17 aa, Plasmodium falciparum
INECHYDQGVIIYDHKR

SEQ ID NO: 3262624 - protein, 26 aa, Plasmodium falciparum
INEEWIKMELYLCNIYGINEKWMGIT

SEQ ID NO: 3262625 - protein, 25 aa, Plasmodium falciparum
INEFKKRFFNIFINCEVKVYINEEE

SEQ ID NO: 3262626 - protein, 23 aa, Plasmodium falciparum
INEFRMIIDANKFAWKKLNENVK

SEQ ID NO: 3262627 - protein, 20 aa, Plasmodium falciparum
INEGLAILDIFNYIKSDIQT

SEQ ID NO: 3262628 - protein, 24 aa, Plasmodium falciparum
INEGTLINCFELFFIKAEYVPFFF

SEQ ID NO: 3262629 - protein, 17 aa, Plasmodium falciparum
INEHLFKKCDIRKEDLL

SEQ ID NO: 3262630 - protein, 21 aa, Plasmodium falciparum
INEIIFLKYYIKIDEQKDNLI

SEQ ID NO: 3262631 - protein, 22 aa, Plasmodium falciparum
INEIKLSVSAMETFLNIIDGKT

SEQ ID NO: 3262632 - protein, 25 aa, Plasmodium falciparum
INEIKRKFYNLSLKYYPKMNKDKNL

SEQ ID NO: 3262633 - protein, 23 aa, Plasmodium falciparum
INEIPKIVTIRAVLDPGELYECS

SEQ ID NO: 3262634 - protein, 22 aa, Plasmodium falciparum
INEKRDGQAINERQDGQIINEK

SEQ ID NO: 3262635 - protein, 17 aa, Plasmodium falciparum
INELHIILKELKIEENK

SEQ ID NO: 3262636 - protein, 31 aa, Plasmodium falciparum
INELKERRASRRPMMVKMQRGMKDEVDEWIK

SEQ ID NO: 3262637 - protein, 17 aa, Plasmodium falciparum
INELKLKGYKVGQLYDF

SEQ ID NO: 3262638 - protein, 28 aa, Plasmodium falciparum
INENFCYKGYFPMCFICDKDVSLDSMIN

SEQ ID NO: 3262639 - protein, 25 aa, Plasmodium falciparum
INENIDIYSLFLIIKYLKYHIYSNE

SEQ ID NO: 3262640 - protein, 19 aa, Plasmodium falciparum
INENIKIGLHMDRSNYNNE

SEQ ID NO: 3262641 - protein, 19 aa, Plasmodium falciparum
INENLKHLLSLQDENFTYL

SEQ ID NO: 3262642 - protein, 18 aa, Plasmodium falciparum
INERKHQYAWSRSYQDQM

SEQ ID NO: 3262643 - protein, 28 aa, Plasmodium falciparum
INESFLRKYWFCLKNLHLFHKTYNNHVL

SEQ ID NO: 3262644 - protein, 22 aa, Plasmodium falciparum
INEVYMKFLSLFNSQNYICDDM

SEQ ID NO: 3262645 - protein, 19 aa, Plasmodium falciparum
INEYLIRNIFDVSMNSFIY

SEQ ID NO: 3262646 - protein, 19 aa, Plasmodium falciparum
INFDSLHGCFCKKGYEPIN

SEQ ID NO: 3262647 - protein, 25 aa, Plasmodium falciparum
INFFTRLSLLLFIYVHYKTSDKLYE

SEQ ID NO: 3262648 - protein, 17 aa, Plasmodium falciparum
INFHTGILFLSYPLSKT

SEQ ID NO: 3262649 - protein, 24 aa, Plasmodium falciparum
INFIDIIIAYAYHFFPKAVNDFTQ

SEQ ID NO: 3262650 - protein, 27 aa, Plasmodium falciparum
INFIISDIELHWKYKTIKQIFKTMKEY

SEQ ID NO: 3262651 - protein, 22 aa, Plasmodium falciparum
INFILSYKYNFIVYLNVDKVSF

SEQ ID NO: 3262652 - protein, 22 aa, Plasmodium falciparum
INFKPILCSSQFNLDTNAQIFL

SEQ ID NO: 3262653 - protein, 18 aa, Plasmodium falciparum
INFLCIFIPTLFDMNNMD

SEQ ID NO: 3262654 - protein, 18 aa, Plasmodium falciparum
INFLKEIFYNISNENYSN

SEQ ID NO: 3262655 - protein, 25 aa, Plasmodium falciparum
INFLKIKYFFYMFIKDFYDKKILSF

SEQ ID NO: 3262656 - protein, 24 aa, Plasmodium falciparum
INFLKSIFVYILLLSNFKYEFSRL

SEQ ID NO: 3262657 - protein, 17 aa, Plasmodium falciparum
INFLKYWGVNEFFSEIF

SEQ ID NO: 3262658 - protein, 17 aa, Plasmodium falciparum
INFLLMFYYNYDYIIQF

SEQ ID NO: 3262659 - protein, 26 aa, Plasmodium falciparum
INFLSQGFIICWCGKDNCKDHEYLTK

SEQ ID NO: 3262660 - protein, 17 aa, Plasmodium falciparum
INFNFFWLSGIKETVNK

SEQ ID NO: 3262661 - protein, 21 aa, Plasmodium falciparum
INFSIEYMLIYCIIICDYYKN

SEQ ID NO: 3262662 - protein, 24 aa, Plasmodium falciparum
INFSVELWNSFYSYLYVYTILPEV

SEQ ID NO: 3262663 - protein, 22 aa, Plasmodium falciparum
INFYNLGKRKGYYLAKKQKKEQ

SEQ ID NO: 3262664 - protein, 19 aa, Plasmodium falciparum
INGCHGKCDCFQKWIEQKK

SEQ ID NO: 3262665 - protein, 17 aa, Plasmodium falciparum
INGEIALTISFKNFSYN

SEQ ID NO: 3262666 - protein, 19 aa, Plasmodium falciparum
INGEIPLKKEKWMWKTILE

SEQ ID NO: 3262667 - protein, 25 aa, Plasmodium falciparum
INGIKIYIEASMFYLTPDLFLTQIN

SEQ ID NO: 3262668 - protein, 24 aa, Plasmodium falciparum
INGKFMFQKVEFIERFFSDEYINN

SEQ ID NO: 3262669 - protein, 20 aa, Plasmodium falciparum
INGLCLNSGIDLILSTDFKI

SEQ ID NO: 3262670 - protein, 19 aa, Plasmodium falciparum
INGLIKLFCTYLIHENVHY

SEQ ID NO: 3262671 - protein, 20 aa, Plasmodium falciparum
INGLRELFINHILLNKEDHP

SEQ ID NO: 3262672 - protein, 25 aa, Plasmodium falciparum
INGQCKPCAFFYNKNKGCRNGDSCE

SEQ ID NO: 3262673 - protein, 17 aa, Plasmodium falciparum
INHFYKYSNIYNEDDVK

SEQ ID NO: 3262674 - protein, 20 aa, Plasmodium falciparum
INHILYKINIILSQDKRDKK

SEQ ID NO: 3262675 - protein, 20 aa, Plasmodium falciparum
INHKNVRGGCFVNNYSLEVK

SEQ ID NO: 3262676 - protein, 19 aa, Plasmodium falciparum
INHLDSFAKMWMKEKKRCK

SEQ ID NO: 3262677 - protein, 30 aa, Plasmodium falciparum
INHVIIPSLFYLYMNFLKFIVTNHIKLDFI

SEQ ID NO: 3262678 - protein, 20 aa, Plasmodium falciparum
INHVLIFLIRSCNNTILRYG

SEQ ID NO: 3262679 - protein, 17 aa, Plasmodium falciparum
INIALIYTNMLKNCYYI

SEQ ID NO: 3262680 - protein, 17 aa, Plasmodium falciparum
INIASCYKVLRNYNKSL

SEQ ID NO: 3262681 - protein, 26 aa, Plasmodium falciparum
INIDETMSFYFKLRYYNIIKTYITHL

SEQ ID NO: 3262682 - protein, 24 aa, Plasmodium falciparum
INIDIILIILWFFVLYSFSYNIVE

SEQ ID NO: 3262683 - protein, 21 aa, Plasmodium falciparum
INIDNAFNILKLLNTQILLYF

SEQ ID NO: 3262684 - protein, 23 aa, Plasmodium falciparum
INIDVCILSKFFVLFNNIEYIQD

SEQ ID NO: 3262685 - protein, 24 aa, Plasmodium falciparum
INIEKCLECTLLVQNNDTSSECFT

SEQ ID NO: 3262686 - protein, 17 aa, Plasmodium falciparum
INIFKLALKQNAYFKSA

SEQ ID NO: 3262687 - protein, 19 aa, Plasmodium falciparum
INIFLCLYNILYRQNKIYS

SEQ ID NO: 3262688 - protein, 18 aa, Plasmodium falciparum
INIFYQNVFNMLKYNNHN

SEQ ID NO: 3262689 - protein, 23 aa, Plasmodium falciparum
INIGNLLDFFSFYFDIIEETNNK

SEQ ID NO: 3262690 - protein, 17 aa, Plasmodium falciparum
INIGTFNTCEGIIKPHE

SEQ ID NO: 3262691 - protein, 29 aa, Plasmodium falciparum
INIHNIIKFKLNFKIAIKKINILQDKIFI

SEQ ID NO: 3262692 - protein, 17 aa, Plasmodium falciparum
INIIDDFFLYHKYNKQE

SEQ ID NO: 3262693 - protein, 21 aa, Plasmodium falciparum
INIIFCLPSMIIKNFKRIKML

SEQ ID NO: 3262694 - protein, 22 aa, Plasmodium falciparum
INIIFHLISLVFYYCLCYNKKN

SEQ ID NO: 3262695 - protein, 19 aa, Plasmodium falciparum
INIINIMYSFIYIDRFKCL

SEQ ID NO: 3262696 - protein, 17 aa, Plasmodium falciparum
INIKCSFNIKKSFNKNK

SEQ ID NO: 3262697 - protein, 24 aa, Plasmodium falciparum
INIKDHLICISLDVVQKIMISKKK

SEQ ID NO: 3262698 - protein, 24 aa, Plasmodium falciparum
INIKELHFFFLYLLVIDIIQGKNN

SEQ ID NO: 3262699 - protein, 22 aa, Plasmodium falciparum
INIKESLIFISLTCLKNNFNIS

SEQ ID NO: 3262700 - protein, 19 aa, Plasmodium falciparum
INIKHKFSNNVFDTNDKTN

SEQ ID NO: 3262701 - protein, 17 aa, Plasmodium falciparum
INIKKFYTFYCVKCDYK

SEQ ID NO: 3262702 - protein, 24 aa, Plasmodium falciparum
INILHACLKLLARLHDAGLCHLDL

SEQ ID NO: 3262703 - protein, 30 aa, Plasmodium falciparum
INILIKRNVSFINFYSWIFFKDISIKKNRL

SEQ ID NO: 3262704 - protein, 31 aa, Plasmodium falciparum
INILKDYLYIYLKKYFDDIILLFEYFFSMSS

SEQ ID NO: 3262705 - protein, 27 aa, Plasmodium falciparum
INILLVFFSTFLYRNIKKVNDPDSYKT

SEQ ID NO: 3262706 - protein, 26 aa, Plasmodium falciparum
INILNYCLLFSFFLFYASYFFFINGI

SEQ ID NO: 3262707 - protein, 29 aa, Plasmodium falciparum
INILSSVHRKGRILYDSFLEINKLENDKK

SEQ ID NO: 3262708 - protein, 31 aa, Plasmodium falciparum
INILYKCTKCNIYVHKYCYGIYPKNKSEDFL

SEQ ID NO: 3262709 - protein, 21 aa, Plasmodium falciparum
INIMPHYIYKLILLKDNQKDK

SEQ ID NO: 3262710 - protein, 18 aa, Plasmodium falciparum
INIMYQKRSQVLEFLDIV

SEQ ID NO: 3262711 - protein, 25 aa, Plasmodium falciparum
ININFGFSIPFIFKSKTTNILNISN

SEQ ID NO: 3262712 - protein, 17 aa, Plasmodium falciparum
ININWNFNFLDNILSLC

SEQ ID NO: 3262713 - protein, 17 aa, Plasmodium falciparum
INIPTIHINDYFCSGNK

SEQ ID NO: 3262714 - protein, 28 aa, Plasmodium falciparum
INIPYFGIFCSKLENWIISALRDNILKY

SEQ ID NO: 3262715 - protein, 19 aa, Plasmodium falciparum
INIQIPWSSLGKNPVCVLI

SEQ ID NO: 3262716 - protein, 19 aa, Plasmodium falciparum
INIRKLYKNMLHHPLFENV

SEQ ID NO: 3262717 - protein, 24 aa, Plasmodium falciparum
INIRTNIFLFVYLFAGKLISFVDF

SEQ ID NO: 3262718 - protein, 25 aa, Plasmodium falciparum
INISCIKLNYLFCLIHKLENVNENL

SEQ ID NO: 3262719 - protein, 25 aa, Plasmodium falciparum
INISELFDFSFNYNKKLYLIIDIID

SEQ ID NO: 3262720 - protein, 23 aa, Plasmodium falciparum
INISILFNFLFFLLSKYTKNKKK

SEQ ID NO: 3262721 - protein, 19 aa, Plasmodium falciparum
INITHLFPPLYSFIKNTTE

SEQ ID NO: 3262722 - protein, 30 aa, Plasmodium falciparum
INITYIKYKICLMKSLLKISLKYIQEKKYT

SEQ ID NO: 3262723 - protein, 17 aa, Plasmodium falciparum
INIWKKKLGNIKCTSSS

SEQ ID NO: 3262724 - protein, 20 aa, Plasmodium falciparum
INIYCYRTYKSYLNNIYHIN

SEQ ID NO: 3262725 - protein, 17 aa, Plasmodium falciparum
INIYSFIKFLKEKNILS

SEQ ID NO: 3262726 - protein, 31 aa, Plasmodium falciparum
INIYYYKLFIEMFIPLLICVDTKECYHNINN

SEQ ID NO: 3262727 - protein, 22 aa, Plasmodium falciparum
INKCMNKIIIIFVIHKYWQILK

SEQ ID NO: 3262728 - protein, 27 aa, Plasmodium falciparum
INKDEFITFLLNWKIYIIYRINNNNND

SEQ ID NO: 3262729 - protein, 23 aa, Plasmodium falciparum
INKDKKKMCPIRYYDNNRGEYNL

SEQ ID NO: 3262730 - protein, 23 aa, Plasmodium falciparum
INKECKVKEYMKLFRSNRNIFDA

SEQ ID NO: 3262731 - protein, 22 aa, Plasmodium falciparum
INKEHIENIFFVHKVNDINVNA

SEQ ID NO: 3262732 - protein, 17 aa, Plasmodium falciparum
INKEMFLLGDFKKHLFQ

SEQ ID NO: 3262733 - protein, 24 aa, Plasmodium falciparum
INKESRLSNFSSISNFSITSKNKN

SEQ ID NO: 3262734 - protein, 26 aa, Plasmodium falciparum
INKEWIKCKKLDVKKFNNDFYYLLSA

SEQ ID NO: 3262735 - protein, 17 aa, Plasmodium falciparum
INKFFYIYILKYINDKL

SEQ ID NO: 3262736 - protein, 24 aa, Plasmodium falciparum
INKFGKKFLQCFNECNKIRKNENI

SEQ ID NO: 3262737 - protein, 18 aa, Plasmodium falciparum
INKFIKRYFHVDMGQINE

SEQ ID NO: 3262738 - protein, 27 aa, Plasmodium falciparum
INKFKTFCIKLLYIMTLFNISFTNISI

SEQ ID NO: 3262739 - protein, 18 aa, Plasmodium falciparum
INKFNVFYYITQHVNIHK

SEQ ID NO: 3262740 - protein, 21 aa, Plasmodium falciparum
INKFYIKNVILDFVSFNIMIC

SEQ ID NO: 3262741 - protein, 17 aa, Plasmodium falciparum
INKGCLCNSICNIYLNN

SEQ ID NO: 3262742 - protein, 18 aa, Plasmodium falciparum
INKHHIINSIKILQFLRN

SEQ ID NO: 3262743 - protein, 21 aa, Plasmodium falciparum
INKHIFLFSFEKVHIYIYDFF

SEQ ID NO: 3262744 - protein, 24 aa, Plasmodium falciparum
INKIFRLLLRNNVNFECIKNHIRF

SEQ ID NO: 3262745 - protein, 20 aa, Plasmodium falciparum
INKIILKRKKVCKIILLVIL

SEQ ID NO: 3262746 - protein, 25 aa, Plasmodium falciparum
INKIKYGICFERVFVSYKKKICVDR

SEQ ID NO: 3262747 - protein, 17 aa, Plasmodium falciparum
INKILSYIIYNYRKAEI

SEQ ID NO: 3262748 - protein, 17 aa, Plasmodium falciparum
INKINGFFYPRKIQNKK

SEQ ID NO: 3262749 - protein, 17 aa, Plasmodium falciparum
INKIPCHGEDKKKMRVI

SEQ ID NO: 3262750 - protein, 18 aa, Plasmodium falciparum
INKISKFLVNFLKHLLSF

SEQ ID NO: 3262751 - protein, 32 aa, Plasmodium falciparum
INKIVTIFCYYKYYHLYFLKGHIEEIKQEIKR

SEQ ID NO: 3262752 - protein, 17 aa, Plasmodium falciparum
INKKEFNVNNLLMINLD

SEQ ID NO: 3262753 - protein, 25 aa, Plasmodium falciparum
INKKICLTHHSLIYNLVQYFKRFYS

SEQ ID NO: 3262754 - protein, 24 aa, Plasmodium falciparum
INKKNCIYSCVLFDLRNVKLSNLH

SEQ ID NO: 3262755 - protein, 34 aa, Plasmodium falciparum
INKKRGRGGKRCPLHFFSARNSYELGACEHINCS

SEQ ID NO: 3262756 - protein, 20 aa, Plasmodium falciparum
INKKRYYKFMSWNNTKEIKN

SEQ ID NO: 3262757 - protein, 21 aa, Plasmodium falciparum
INKKSVFGFFYLTKVQKKRPN

SEQ ID NO: 3262758 - protein, 34 aa, Plasmodium falciparum
INKKYCDIKFFLYICSYIIYYICKVLQIDDYNNI

SEQ ID NO: 3262759 - protein, 17 aa, Plasmodium falciparum
INKLLLRNVYFFMNFLK

SEQ ID NO: 3262760 - protein, 25 aa, Plasmodium falciparum
INKLMKKKAIFILLNLKRSIERIFD

SEQ ID NO: 3262761 - protein, 23 aa, Plasmodium falciparum
INKLPKWLLNFIDPKYCIIDEKS

SEQ ID NO: 3262762 - protein, 27 aa, Plasmodium falciparum
INKMFEICSSFLIYLHSLFTVYKMTSK

SEQ ID NO: 3262763 - protein, 18 aa, Plasmodium falciparum
INKMNEWLAIKNYINEIN

SEQ ID NO: 3262764 - protein, 24 aa, Plasmodium falciparum
INKNLFMKEFINFCDNYCNNIKNF

SEQ ID NO: 3262765 - protein, 22 aa, Plasmodium falciparum
INKNSPLFCEVINLFTSLLKRI

SEQ ID NO: 3262766 - protein, 23 aa, Plasmodium falciparum
INKQLIKLFCVFLNKVHYSIESG

SEQ ID NO: 3262767 - protein, 21 aa, Plasmodium falciparum
INKRLLRIINYIIDNQMNKVT

SEQ ID NO: 3262768 - protein, 27 aa, Plasmodium falciparum
INKRSKVKHIFLNTIICISQLTYEGFK

SEQ ID NO: 3262769 - protein, 18 aa, Plasmodium falciparum
INKTIAFQFFKKVDYNNE

SEQ ID NO: 3262770 - protein, 21 aa, Plasmodium falciparum
INKTRKGRYVKRNNEIKDGSR

SEQ ID NO: 3262771 - protein, 19 aa, Plasmodium falciparum
INKYNKYVMNKFCKKWKKR

SEQ ID NO: 3262772 - protein, 19 aa, Plasmodium falciparum
INLASKVSSATWLIYLYEL

SEQ ID NO: 3262773 - protein, 19 aa, Plasmodium falciparum
INLDITVQWDKKCNNNISC

SEQ ID NO: 3262774 - protein, 23 aa, Plasmodium falciparum
INLFHKWLYRHRDMCEKWENHHE

SEQ ID NO: 3262775 - protein, 23 aa, Plasmodium falciparum
INLFKKYILIHIYNINKIHDHVI

SEQ ID NO: 3262776 - protein, 18 aa, Plasmodium falciparum
INLIELYFDNVYNYVDRK

SEQ ID NO: 3262777 - protein, 18 aa, Plasmodium falciparum
INLIKSIINKWEIIPFIN

SEQ ID NO: 3262778 - protein, 25 aa, Plasmodium falciparum
INLITLALLGCVTYYKEHYYLNKEE

SEQ ID NO: 3262779 - protein, 22 aa, Plasmodium falciparum
INLIYQCLSFVFVGSCDQILNR

SEQ ID NO: 3262780 - protein, 21 aa, Plasmodium falciparum
INLKCVEYSKLNKYNFCSKCR

SEQ ID NO: 3262781 - protein, 19 aa, Plasmodium falciparum
INLKDCFHINNSRILSDVD

SEQ ID NO: 3262782 - protein, 30 aa, Plasmodium falciparum
INLKLSLGRLRKILNKSIVKREELRHLSNR

SEQ ID NO: 3262783 - protein, 24 aa, Plasmodium falciparum
INLKNDIFCIAGLHNLCPRRILSI

SEQ ID NO: 3262784 - protein, 17 aa, Plasmodium falciparum
INLKQLYILLANKKFIE

SEQ ID NO: 3262785 - protein, 17 aa, Plasmodium falciparum
INLKYSCEYDKKGKNKL

SEQ ID NO: 3262786 - protein, 20 aa, Plasmodium falciparum
INLLAIIGIVLSCFSLLFNY

SEQ ID NO: 3262787 - protein, 31 aa, Plasmodium falciparum
INLLFNLSIDRFRLVINRKYIFFKKKKRIDL

SEQ ID NO: 3262788 - protein, 22 aa, Plasmodium falciparum
INLLIHKFLFYIIIFFIMYLNY

SEQ ID NO: 3262789 - protein, 19 aa, Plasmodium falciparum
INLLKNRITHISINNKCIH

SEQ ID NO: 3262790 - protein, 21 aa, Plasmodium falciparum
INLLNIMTFFVEFIKHMNKYL

SEQ ID NO: 3262791 - protein, 19 aa, Plasmodium falciparum
INLLSKIWGISRHKKKMFL

SEQ ID NO: 3262792 - protein, 25 aa, Plasmodium falciparum
INLNKPCIWSQVWTGAKYSIHNVNS

SEQ ID NO: 3262793 - protein, 19 aa, Plasmodium falciparum
INLSCLFKHYNYLVQNITI

SEQ ID NO: 3262794 - protein, 25 aa, Plasmodium falciparum
INLSCNVCTLIFFYDISSKLFNSDF

SEQ ID NO: 3262795 - protein, 18 aa, Plasmodium falciparum
INLWKIYKNELIHFYTTL

SEQ ID NO: 3262796 - protein, 17 aa, Plasmodium falciparum
INLYSSKNIYSYAVSLE

SEQ ID NO: 3262797 - protein, 25 aa, Plasmodium falciparum
INMFILAFVGFVWFILSLRKFSLKY

SEQ ID NO: 3262798 - protein, 18 aa, Plasmodium falciparum
INMLLFRSFNLFYYFINY

SEQ ID NO: 3262799 - protein, 23 aa, Plasmodium falciparum
INMNKLLYIYKCMHIQCMHNLTP

SEQ ID NO: 3262800 - protein, 24 aa, Plasmodium falciparum
INMPLNINYPYGISKDEMIHFKNY

SEQ ID NO: 3262801 - protein, 29 aa, Plasmodium falciparum
INNDLGLYFYFLVGFIIKKKNCTISLKLN

SEQ ID NO: 3262802 - protein, 23 aa, Plasmodium falciparum
INNFSYHMLYYFNYTIKTNKFIQ

SEQ ID NO: 3262803 - protein, 33 aa, Plasmodium falciparum
INNGFKIRCFQLLKNYICPSTFNVNSNNIDTNK

SEQ ID NO: 3262804 - protein, 24 aa, Plasmodium falciparum
INNHIDYYIKLFLQIRKNEFLNNF

SEQ ID NO: 3262805 - protein, 17 aa, Plasmodium falciparum
INNIGSVGLLFKKIKTF

SEQ ID NO: 3262806 - protein, 19 aa, Plasmodium falciparum
INNILFYKRNIHILNKYVD

SEQ ID NO: 3262807 - protein, 27 aa, Plasmodium falciparum
INNKDKCKGKCKCVSESKLMNESKIKN

SEQ ID NO: 3262808 - protein, 31 aa, Plasmodium falciparum
INNKECKYIEMLVIYILYSYEILRTILHIYE

SEQ ID NO: 3262809 - protein, 19 aa, Plasmodium falciparum
INNKFSYLFEKRIKDEHMK

SEQ ID NO: 3262810 - protein, 20 aa, Plasmodium falciparum
INNLISMFGKFVEYFLYMLK

SEQ ID NO: 3262811 - protein, 18 aa, Plasmodium falciparum
INNLKMWSAHEIFKDVGL

SEQ ID NO: 3262812 - protein, 18 aa, Plasmodium falciparum
INNLKQYFFFPSKDENIR

SEQ ID NO: 3262813 - protein, 23 aa, Plasmodium falciparum
INNLKTFICKSAFAEAKRLKKVY

SEQ ID NO: 3262814 - protein, 26 aa, Plasmodium falciparum
INNLRHFVFVLSLFCRFFNLYKTKLK

SEQ ID NO: 3262815 - protein, 17 aa, Plasmodium falciparum
INNSFSIYKNVGNTYDN

SEQ ID NO: 3262816 - protein, 18 aa, Plasmodium falciparum
INNSIKLYLIYNNNINFD

SEQ ID NO: 3262817 - protein, 24 aa, Plasmodium falciparum
INNSVCSQIFNFIHNMRKEIRQIK

SEQ ID NO: 3262818 - protein, 21 aa, Plasmodium falciparum
INNWKECYSHIKKKLNIKGMD

SEQ ID NO: 3262819 - protein, 23 aa, Plasmodium falciparum
INNYKYNLIKGYHNNVKSNMGTG

SEQ ID NO: 3262820 - protein, 18 aa, Plasmodium falciparum
INPAISTIITFPFLFGIM

SEQ ID NO: 3262821 - protein, 18 aa, Plasmodium falciparum
INPLEVFTKAYSFYNKYF

SEQ ID NO: 3262822 - protein, 19 aa, Plasmodium falciparum
INPNICNNINRSKEKYDNI

SEQ ID NO: 3262823 - protein, 23 aa, Plasmodium falciparum
INPRSCMYLNFYLNLEVTNVYVC

SEQ ID NO: 3262824 - protein, 23 aa, Plasmodium falciparum
INQCIHKLYNIMVIKQKNTYNYI

SEQ ID NO: 3262825 - protein, 24 aa, Plasmodium falciparum
INQLFPYFFNSFFYTYPLNLISYL

SEQ ID NO: 3262826 - protein, 19 aa, Plasmodium falciparum
INQVFEWLPIGAIVEDKIL

SEQ ID NO: 3262827 - protein, 24 aa, Plasmodium falciparum
INRKHLLVFLLMFNLVGIYLFYMK

SEQ ID NO: 3262828 - protein, 20 aa, Plasmodium falciparum
INRLQILYDVVGVRHLAKWR

SEQ ID NO: 3262829 - protein, 50 aa, Plasmodium falciparum
INRNVPLIVVSLFNLKFFLQKDIISIYNFLNFYLNIDIYDSYKILYDTLL

SEQ ID NO: 3262830 - protein, 20 aa, Plasmodium falciparum
INRPWCNNIFPFIYNYIQYK

SEQ ID NO: 3262831 - protein, 26 aa, Plasmodium falciparum
INRSELQNVYKYIIKLKENYIKKCVL

SEQ ID NO: 3262832 - protein, 29 aa, Plasmodium falciparum
INRTSKLQIIFSLIVGFMLFPTFKEYGFL

SEQ ID NO: 3262833 - protein, 26 aa, Plasmodium falciparum
INRYIKYKCVYFFFNTQYTYSFVNTY

SEQ ID NO: 3262834 - protein, 17 aa, Plasmodium falciparum
INSCIRKKYNFINQLSD

SEQ ID NO: 3262835 - protein, 28 aa, Plasmodium falciparum
INSDKFMIRRACCKLLYDMINLIFCKKM

SEQ ID NO: 3262836 - protein, 21 aa, Plasmodium falciparum
INSEWFKKGYMNFNNFNNRKE

SEQ ID NO: 3262837 - protein, 20 aa, Plasmodium falciparum
INSFAYWFGSFLIKRGTILV

SEQ ID NO: 3262838 - protein, 25 aa, Plasmodium falciparum
INSFFFRNYLDVFFILFLKIIYLNE

SEQ ID NO: 3262839 - protein, 28 aa, Plasmodium falciparum
INSFMFRYLRKFGRFIIYFLLLFFISII

SEQ ID NO: 3262840 - protein, 17 aa, Plasmodium falciparum
INSIKRLGVTKNNKIIV

SEQ ID NO: 3262841 - protein, 20 aa, Plasmodium falciparum
INSKDIFLFRSLSTYLEEKS

SEQ ID NO: 3262842 - protein, 29 aa, Plasmodium falciparum
INSKSVVIFLFRFLNTFPYSHKIKNSIKT

SEQ ID NO: 3262843 - protein, 21 aa, Plasmodium falciparum
INSKVKFSYEEVYFIIRYYVK

SEQ ID NO: 3262844 - protein, 18 aa, Plasmodium falciparum
INSLEKMMKCAKKSDVTN

SEQ ID NO: 3262845 - protein, 18 aa, Plasmodium falciparum
INSLSLIILYFLCTIYYE

SEQ ID NO: 3262846 - protein, 20 aa, Plasmodium falciparum
INSLTLYVGTYICKAKVNNL

SEQ ID NO: 3262847 - protein, 28 aa, Plasmodium falciparum
INSLYFRRLLLLYTFLLFFLLFLMIFNM

SEQ ID NO: 3262848 - protein, 21 aa, Plasmodium falciparum
INSNFLLKSVRLFEESLGIRK

SEQ ID NO: 3262849 - protein, 19 aa, Plasmodium falciparum
INSSNCLISSTLINTNNSD

SEQ ID NO: 3262850 - protein, 25 aa, Plasmodium falciparum
INSSSKYFIHLCIYYIYNNEKSKFL

SEQ ID NO: 3262851 - protein, 19 aa, Plasmodium falciparum
INSTIVKYRMHAYNEILKC

SEQ ID NO: 3262852 - protein, 21 aa, Plasmodium falciparum
INSTLWFSMYLIMKRMLIDEC

SEQ ID NO: 3262853 - protein, 25 aa, Plasmodium falciparum
INSTRPNTEYSLGYTYFHFMELNAN

SEQ ID NO: 3262854 - protein, 25 aa, Plasmodium falciparum
INSYDFLLRNSVYFYRSNMFTKYIT

SEQ ID NO: 3262855 - protein, 20 aa, Plasmodium falciparum
INSYEFFGSEPIELYDVKSN

SEQ ID NO: 3262856 - protein, 19 aa, Plasmodium falciparum
INSYICFKSKTYSHLPYPN

SEQ ID NO: 3262857 - protein, 26 aa, Plasmodium falciparum
INSYNIFPYGGIYYHDIIIKDVLKFF

SEQ ID NO: 3262858 - protein, 17 aa, Plasmodium falciparum
INSYNIWEKQFFSNNKF

SEQ ID NO: 3262859 - protein, 24 aa, Plasmodium falciparum
INTAVDFFKIYWILYNEILINIFY

SEQ ID NO: 3262860 - protein, 34 aa, Plasmodium falciparum
INTIKPFLYFLFIFILKECENYQLLYYIKNYISF

SEQ ID NO: 3262861 - protein, 25 aa, Plasmodium falciparum
INTIRWSFNGLFLASCDSGGTLVCY

SEQ ID NO: 3262862 - protein, 27 aa, Plasmodium falciparum
INTLKRFNEILLYLTSWIDIFHTSEEE

SEQ ID NO: 3262863 - protein, 24 aa, Plasmodium falciparum
INTNKCFLTFSYTNIMECKNDKNF

SEQ ID NO: 3262864 - protein, 30 aa, Plasmodium falciparum
INTNKLWSKCLWKPVFFILPDVNNNSDNNV

SEQ ID NO: 3262865 - protein, 33 aa, Plasmodium falciparum
INTNTIYYRIFCCTLCGMSGGFVNIFSEQIISV

SEQ ID NO: 3262866 - protein, 18 aa, Plasmodium falciparum
INTPIIIFMNLIKIINKY

SEQ ID NO: 3262867 - protein, 17 aa, Plasmodium falciparum
INTRESYDIFYSYLKLS

SEQ ID NO: 3262868 - protein, 25 aa, Plasmodium falciparum
INTVLKGGASIFFLFEVYYNNDIQN

SEQ ID NO: 3262869 - protein, 25 aa, Plasmodium falciparum
INTYDLLCKLNFITHVCLMEKNHSE

SEQ ID NO: 3262870 - protein, 24 aa, Plasmodium falciparum
INTYIKRCINNLCLNLKNDDIDYY

SEQ ID NO: 3262871 - protein, 18 aa, Plasmodium falciparum
INTYKYHCEEFFIYPQIN

SEQ ID NO: 3262872 - protein, 18 aa, Plasmodium falciparum
INTYLFKIFNSIYKLVIV

SEQ ID NO: 3262873 - protein, 18 aa, Plasmodium falciparum
INVEGCNFWVAEVYDNNF

SEQ ID NO: 3262874 - protein, 24 aa, Plasmodium falciparum
INVKAKGVSVLYTFHIQIENEDLK

SEQ ID NO: 3262875 - protein, 25 aa, Plasmodium falciparum
INVKFIFFYILKIFFYLKNNPYSTI

SEQ ID NO: 3262876 - protein, 30 aa, Plasmodium falciparum
INVLIYILSVCYKYCRIIKGGISSGADEQY

SEQ ID NO: 3262877 - protein, 17 aa, Plasmodium falciparum
INVSYNIPKTGMLHSNI

SEQ ID NO: 3262878 - protein, 22 aa, Plasmodium falciparum
INVYRYLERGLYIFKFDDDSNK

SEQ ID NO: 3262879 - protein, 29 aa, Plasmodium falciparum
INVYSKNDWLLGFLYRYMEWKINVAGLIA

SEQ ID NO: 3262880 - protein, 24 aa, Plasmodium falciparum
INYADYHLPLILCILNVIDKNYSP

SEQ ID NO: 3262881 - protein, 19 aa, Plasmodium falciparum
INYEILYNNSLFKLIQDIL

SEQ ID NO: 3262882 - protein, 22 aa, Plasmodium falciparum
INYERVYSWELGKEALTKLLGC

SEQ ID NO: 3262883 - protein, 20 aa, Plasmodium falciparum
INYFPRNPYFFTIYQIFNPK

SEQ ID NO: 3262884 - protein, 22 aa, Plasmodium falciparum
INYHKISSFILLIFSCAMLAID

SEQ ID NO: 3262885 - protein, 29 aa, Plasmodium falciparum
INYHPLIKFKSCLMNCFKEINNTEKSVEK

SEQ ID NO: 3262886 - protein, 29 aa, Plasmodium falciparum
INYIILCLLFYRYCYFFYTYNSFIFSYLF

SEQ ID NO: 3262887 - protein, 17 aa, Plasmodium falciparum
INYIKCKIEDYFKNVEV

SEQ ID NO: 3262888 - protein, 24 aa, Plasmodium falciparum
INYIKFKSYCVYNIIEMTNMFFFY

SEQ ID NO: 3262889 - protein, 23 aa, Plasmodium falciparum
INYIYKISKWYIIKENKLLKELQ

SEQ ID NO: 3262890 - protein, 27 aa, Plasmodium falciparum
INYKHIIFRLKCEVQIKNSYLENEKRK

SEQ ID NO: 3262891 - protein, 27 aa, Plasmodium falciparum
INYKIWRYMPCPFKIISYNKNKLDILK

SEQ ID NO: 3262892 - protein, 24 aa, Plasmodium falciparum
INYLKNMYFLLLSKRMKECLYNLK

SEQ ID NO: 3262893 - protein, 23 aa, Plasmodium falciparum
INYLMMMFYYFSFLKVSNGTLDN

SEQ ID NO: 3262894 - protein, 39 aa, Plasmodium falciparum
INYLPWAFKIFLTCLIIELRIINEFVIPYKKVVNRYKIL

SEQ ID NO: 3262895 - protein, 17 aa, Plasmodium falciparum
INYLRLSEMLYEQKKAV

SEQ ID NO: 3262896 - protein, 26 aa, Plasmodium falciparum
INYNGFMYCMRYIPYVIPDFPLSTSH

SEQ ID NO: 3262897 - protein, 24 aa, Plasmodium falciparum
INYNKLIKEFGCSKITENHIKRIE

SEQ ID NO: 3262898 - protein, 23 aa, Plasmodium falciparum
INYPIFKKSFHFYVSIQTLEEKY

SEQ ID NO: 3262899 - protein, 18 aa, Plasmodium falciparum
INYQYKLLSLEYFANIAN

SEQ ID NO: 3262900 - protein, 25 aa, Plasmodium falciparum
INYSFPSLFSYFIKNMQSLSFISHF

SEQ ID NO: 3262901 - protein, 25 aa, Plasmodium falciparum
INYTKNFSILLGFHYFLINNINLNK

SEQ ID NO: 3262902 - protein, 25 aa, Plasmodium falciparum
INYTTKDYCRWLRKGHRSKALNDHV

SEQ ID NO: 3262903 - protein, 24 aa, Plasmodium falciparum
INYVEAYFIYKLVLYIKNIISKHQ

SEQ ID NO: 3262904 - protein, 22 aa, Plasmodium falciparum
INYVKYIYCISFLNYYIDLNEL

SEQ ID NO: 3262905 - protein, 18 aa, Plasmodium falciparum
INYYCDYHDHMLKGTDYC

SEQ ID NO: 3262906 - protein, 17 aa, Plasmodium falciparum
IPANWVINDEEMMNKST

SEQ ID NO: 3262907 - protein, 25 aa, Plasmodium falciparum
IPDDFKRLMFYTLGDYRDIVVRGVA

SEQ ID NO: 3262908 - protein, 24 aa, Plasmodium falciparum
IPDEFKRQMFYTFGDYRDIFFGTD

SEQ ID NO: 3262909 - protein, 24 aa, Plasmodium falciparum
IPDEFKRQMFYTLGDYKDILYSGD

SEQ ID NO: 3262910 - protein, 22 aa, Plasmodium falciparum
IPDGFLRQMFYTLADYKDILYS

SEQ ID NO: 3262911 - protein, 23 aa, Plasmodium falciparum
IPDGFLRQMFYTLGDYRDILFSG

SEQ ID NO: 3262912 - protein, 20 aa, Plasmodium falciparum
IPDNMKISIILDAATKQDCL

SEQ ID NO: 3262913 - protein, 24 aa, Plasmodium falciparum
IPEDFKRQMFYTFGDYRDFLFGTD

SEQ ID NO: 3262914 - protein, 24 aa, Plasmodium falciparum
IPEDFKRQMFYTFGDYRDLFLGRY

SEQ ID NO: 3262915 - protein, 24 aa, Plasmodium falciparum
IPEDFKRQMFYTLGDYRDILFGKD

SEQ ID NO: 3262916 - protein, 26 aa, Plasmodium falciparum
IPEEFKRQMFYTFGDFRDLCLGNDIG

SEQ ID NO: 3262917 - protein, 22 aa, Plasmodium falciparum
IPEEFKRQMFYTLGDYADIFFG

SEQ ID NO: 3262918 - protein, 24 aa, Plasmodium falciparum
IPEEFKRQMFYTLGDYRDILVRGG

SEQ ID NO: 3262919 - protein, 22 aa, Plasmodium falciparum
IPELIYRIFWKYFSQNFNIINE

SEQ ID NO: 3262920 - protein, 26 aa, Plasmodium falciparum
IPEPKKCIFCDSGYYIKKKKCISCTT

SEQ ID NO: 3262921 - protein, 18 aa, Plasmodium falciparum
IPERIKILNKRYNYYKDF

SEQ ID NO: 3262922 - protein, 22 aa, Plasmodium falciparum
IPEVFLRQMFYTLGDYRDICVG

SEQ ID NO: 3262923 - protein, 22 aa, Plasmodium falciparum
IPEVLVEEIIYKEGIPEVLIEE

SEQ ID NO: 3262924 - protein, 26 aa, Plasmodium falciparum
IPEYRREFKKILGYHNFSSKSSLDTS

SEQ ID NO: 3262925 - protein, 17 aa, Plasmodium falciparum
IPFARKCAIRNTIKYNY

SEQ ID NO: 3262926 - protein, 17 aa, Plasmodium falciparum
IPFILYIHNHIVYNYNF

SEQ ID NO: 3262927 - protein, 20 aa, Plasmodium falciparum
IPFIVSLLHSLKIMISSNLF

SEQ ID NO: 3262928 - protein, 22 aa, Plasmodium falciparum
IPFMILRFYFLAFFFSNIHFQP

SEQ ID NO: 3262929 - protein, 17 aa, Plasmodium falciparum
IPFNLKIRANELDVLKK

SEQ ID NO: 3262930 - protein, 21 aa, Plasmodium falciparum
IPFSIKLLWAPIVDSVYNKRI

SEQ ID NO: 3262931 - protein, 24 aa, Plasmodium falciparum
IPFVPELDLNFFLASCLYNKLNYK

SEQ ID NO: 3262932 - protein, 27 aa, Plasmodium falciparum
IPFWARTRLNVWGNYNMVLKVEFLFFW

SEQ ID NO: 3262933 - protein, 17 aa, Plasmodium falciparum
IPFYEWNKCYGRLEKVK

SEQ ID NO: 3262934 - protein, 19 aa, Plasmodium falciparum
IPHDCKKGTMILNQNIHLN

SEQ ID NO: 3262935 - protein, 22 aa, Plasmodium falciparum
IPHICEILYIQIFFKEKEKKQI

SEQ ID NO: 3262936 - protein, 19 aa, Plasmodium falciparum
IPHKYVINIIYLFLNILLT

SEQ ID NO: 3262937 - protein, 24 aa, Plasmodium falciparum
IPIDIWLKQFEMMQMYNGEFIENG

SEQ ID NO: 3262938 - protein, 21 aa, Plasmodium falciparum
IPIDIWLKQYKLMNEYDGEYL

SEQ ID NO: 3262939 - protein, 18 aa, Plasmodium falciparum
IPIELPKQRLKYIGEYLN

SEQ ID NO: 3262940 - protein, 24 aa, Plasmodium falciparum
IPIFKAPLIFGPYFPGEVFDINIY

SEQ ID NO: 3262941 - protein, 20 aa, Plasmodium falciparum
IPIFTILYDHIYKIITKLKD

SEQ ID NO: 3262942 - protein, 27 aa, Plasmodium falciparum
IPIGKLFSFPILISIYGQIIIQLFFVM

SEQ ID NO: 3262943 - protein, 19 aa, Plasmodium falciparum
IPIHNCIYIPNISSYILNF

SEQ ID NO: 3262944 - protein, 17 aa, Plasmodium falciparum
IPIICLSATLGISYGLC

SEQ ID NO: 3262945 - protein, 20 aa, Plasmodium falciparum
IPINIIINFLCFVEKQYNNV

SEQ ID NO: 3262946 - protein, 17 aa, Plasmodium falciparum
IPIPGDSRFKRIKNFLE

SEQ ID NO: 3262947 - protein, 18 aa, Plasmodium falciparum
IPITRLLCECELYELANY

SEQ ID NO: 3262948 - protein, 18 aa, Plasmodium falciparum
IPITRLLCECELYSPDNY

SEQ ID NO: 3262949 - protein, 18 aa, Plasmodium falciparum
IPITRLLCECELYSPSNY

SEQ ID NO: 3262950 - protein, 18 aa, Plasmodium falciparum
IPITRLLCECELYTPANY

SEQ ID NO: 3262951 - protein, 25 aa, Plasmodium falciparum
IPIYIKKKVAVFFYDNIINFGLCKQ

SEQ ID NO: 3262952 - protein, 18 aa, Plasmodium falciparum
IPIYPYGVIQKLNIFNSR

SEQ ID NO: 3262953 - protein, 18 aa, Plasmodium falciparum
IPKEIKVPFRPRREIYNE

SEQ ID NO: 3262954 - protein, 21 aa, Plasmodium falciparum
IPKQYKYLGFNGININKENRY

SEQ ID NO: 3262955 - protein, 27 aa, Plasmodium falciparum
IPKSIKRYLFFISFAEFKRSPFFLSTM

SEQ ID NO: 3262956 - protein, 20 aa, Plasmodium falciparum
IPLAALLVSCLYLESIFSYD

SEQ ID NO: 3262957 - protein, 19 aa, Plasmodium falciparum
IPLEHILGIVINYYDTFSS

SEQ ID NO: 3262958 - protein, 25 aa, Plasmodium falciparum
IPLENVCGINIIKTFYLDNSNMYIF

SEQ ID NO: 3262959 - protein, 26 aa, Plasmodium falciparum
IPLESNFFFFFFSFFFIYINNVSIAR

SEQ ID NO: 3262960 - protein, 21 aa, Plasmodium falciparum
IPLFLFYQFADFLNLFYLCVS

SEQ ID NO: 3262961 - protein, 21 aa, Plasmodium falciparum
IPLFYKWKLLNIYIIDHLKFL

SEQ ID NO: 3262962 - protein, 17 aa, Plasmodium falciparum
IPLIYKNDLLIYNFQNK

SEQ ID NO: 3262963 - protein, 21 aa, Plasmodium falciparum
IPLNNVELIFKYSKQIIKKIN

SEQ ID NO: 3262964 - protein, 32 aa, Plasmodium falciparum
IPLTDCSNVLYCGNCPFSSSPKDQCASIKTLN

SEQ ID NO: 3262965 - protein, 17 aa, Plasmodium falciparum
IPNDAFLNMYIRNNDDD

SEQ ID NO: 3262966 - protein, 19 aa, Plasmodium falciparum
IPNDFFKKNIHILINKMDE

SEQ ID NO: 3262967 - protein, 25 aa, Plasmodium falciparum
IPNIKNIDCLSTFYHKKRHIYLSFL

SEQ ID NO: 3262968 - protein, 24 aa, Plasmodium falciparum
IPNIMEINNFLLILINILKQKGNN

SEQ ID NO: 3262969 - protein, 20 aa, Plasmodium falciparum
IPNNCEILGIAEIPFIPIPN

SEQ ID NO: 3262970 - protein, 20 aa, Plasmodium falciparum
IPNRCLGTLINLCSDGSTGY

SEQ ID NO: 3262971 - protein, 27 aa, Plasmodium falciparum
IPNSSSIPFYFTHMRLSRNDNMENDLM

SEQ ID NO: 3262972 - protein, 23 aa, Plasmodium falciparum
IPPEIKNKLKIVDCEQYIMDYTN

SEQ ID NO: 3262973 - protein, 17 aa, Plasmodium falciparum
IPPYLNFNFNLMEEGDK

SEQ ID NO: 3262974 - protein, 21 aa, Plasmodium falciparum
IPQFVQELIKFTRKNKLWKEQ

SEQ ID NO: 3262975 - protein, 25 aa, Plasmodium falciparum
IPQHFLDTFSVHFVKIVNYMQLYFY

SEQ ID NO: 3262976 - protein, 23 aa, Plasmodium falciparum
IPQKRKRHCGMYMNKKLYYHERR

SEQ ID NO: 3262977 - protein, 26 aa, Plasmodium falciparum
IPQPFRWLSEWSETYCLAQKDLLETM

SEQ ID NO: 3262978 - protein, 35 aa, Plasmodium falciparum
IPQPLRWISEWGEQFCLYQKHLLESMKICENCKKN

SEQ ID NO: 3262979 - protein, 27 aa, Plasmodium falciparum
IPQRLRWMMEWAEWYCKYQSKAYSELR

SEQ ID NO: 3262980 - protein, 25 aa, Plasmodium falciparum
IPQRLRWMSEWSEYFCNVLNKEIDE

SEQ ID NO: 3262981 - protein, 27 aa, Plasmodium falciparum
IPQRLRWMTEWAEWFCKAQSQEYDKLF

SEQ ID NO: 3262982 - protein, 25 aa, Plasmodium falciparum
IPQRLRWMTEWAEWFCKEQSQAYET

SEQ ID NO: 3262983 - protein, 25 aa, Plasmodium falciparum
IPQRLRWMTEWAEWFCKMQSQEYEV

SEQ ID NO: 3262984 - protein, 26 aa, Plasmodium falciparum
IPQRLRWMTEWAEWFCKMQSQEYNKL

SEQ ID NO: 3262985 - protein, 26 aa, Plasmodium falciparum
IPQRLRWMTEWAEWYCKAQKEAYDKL

SEQ ID NO: 3262986 - protein, 26 aa, Plasmodium falciparum
IPQRLRWMTEWAEWYCKAQKKEYDEL

SEQ ID NO: 3262987 - protein, 26 aa, Plasmodium falciparum
IPQRLRWMTEWAEWYCKEQSRLYDKL

SEQ ID NO: 3262988 - protein, 25 aa, Plasmodium falciparum
IPQRLRWMTEWAEWYCKMQSQEYKK

SEQ ID NO: 3262989 - protein, 26 aa, Plasmodium falciparum
IPQRLRWMTEWAEWYCKYQAEAYKTL

SEQ ID NO: 3262990 - protein, 26 aa, Plasmodium falciparum
IPQRLRWMTEWSEWFCKEQSKLYGEL

SEQ ID NO: 3262991 - protein, 25 aa, Plasmodium falciparum
IPQRLRWMTEWSEWYCKMQSQEYEK

SEQ ID NO: 3262992 - protein, 19 aa, Plasmodium falciparum
IPRKVWRFIKKIAKKCKRV

SEQ ID NO: 3262993 - protein, 19 aa, Plasmodium falciparum
IPSDLLVEEILRFTYNILD

SEQ ID NO: 3262994 - protein, 18 aa, Plasmodium falciparum
IPSGTFFNNPENIRGTEK

SEQ ID NO: 3262995 - protein, 24 aa, Plasmodium falciparum
IPSINYRTTPGLVYILNRYFSGEK

SEQ ID NO: 3262996 - protein, 30 aa, Plasmodium falciparum
IPSVHKNVHVSFCFGNNGTFFYSKNSKIKY

SEQ ID NO: 3262997 - protein, 18 aa, Plasmodium falciparum
IPTCVFKKSVAVKVEKIC

SEQ ID NO: 3262998 - protein, 23 aa, Plasmodium falciparum
IPTEPKGSFYRTVNAYRINRYFM

SEQ ID NO: 3262999 - protein, 25 aa, Plasmodium falciparum
IPTIKNIKDLFCVNNKFDWSCSIPN

SEQ ID NO: 3263000 - protein, 22 aa, Plasmodium falciparum
IPTNLDISLKCINRNERHINSL

SEQ ID NO: 3263001 - protein, 22 aa, Plasmodium falciparum
IPTPFLRQMFYTLGDYRDILVR

SEQ ID NO: 3263002 - protein, 25 aa, Plasmodium falciparum
IPTYFRYLHEWGQNFCKERKKRLQK

SEQ ID NO: 3263003 - protein, 19 aa, Plasmodium falciparum
IPVQYFLMKSFSLHFTHLF

SEQ ID NO: 3263004 - protein, 26 aa, Plasmodium falciparum
IPVVKYYSNLCAFKVKDYVTCSIHKF

SEQ ID NO: 3263005 - protein, 23 aa, Plasmodium falciparum
IPVYKYTIINGKLYKDLEAFTQD

SEQ ID NO: 3263006 - protein, 24 aa, Plasmodium falciparum
IPYKRSLCYDTLFNQMIKESTFPS

SEQ ID NO: 3263007 - protein, 19 aa, Plasmodium falciparum
IPYNKHWENIKTIYCKNMQ

SEQ ID NO: 3263008 - protein, 20 aa, Plasmodium falciparum
IPYVCIIQILGLSLLGQRVC

SEQ ID NO: 3263009 - protein, 30 aa, Plasmodium falciparum
IPYVIRYLLNELICLNVTIRLNMKSVENVF

SEQ ID NO: 3263010 - protein, 27 aa, Plasmodium falciparum
IPYVYKVKFLFLFCSLFNIYQKEYESG

SEQ ID NO: 3263011 - protein, 18 aa, Plasmodium falciparum
IQANGQPFCSCFENYYFE

SEQ ID NO: 3263012 - protein, 18 aa, Plasmodium falciparum
IQANKSFSSKLFISEDNK

SEQ ID NO: 3263013 - protein, 18 aa, Plasmodium falciparum
IQCFKLLKRKLFSIDDKK

SEQ ID NO: 3263014 - protein, 19 aa, Plasmodium falciparum
IQCIPNIYLDDCINNQYTH

SEQ ID NO: 3263015 - protein, 18 aa, Plasmodium falciparum
IQCLYNFTMDDANHIMDN

SEQ ID NO: 3263016 - protein, 19 aa, Plasmodium falciparum
IQCQKNCTIYHDIEKNSYV

SEQ ID NO: 3263017 - protein, 21 aa, Plasmodium falciparum
IQDCLILSLFNLKFINEHESK

SEQ ID NO: 3263018 - protein, 17 aa, Plasmodium falciparum
IQDIIYKYFCLHYDFSN

SEQ ID NO: 3263019 - protein, 20 aa, Plasmodium falciparum
IQDILCLKYEDYIKSLPEAF

SEQ ID NO: 3263020 - protein, 17 aa, Plasmodium falciparum
IQEFLYQTVKFFKALKD

SEQ ID NO: 3263021 - protein, 18 aa, Plasmodium falciparum
IQEFNLFINRNINKNIIL

SEQ ID NO: 3263022 - protein, 25 aa, Plasmodium falciparum
IQELYKELFEQINIQGENIDNIDSQ

SEQ ID NO: 3263023 - protein, 17 aa, Plasmodium falciparum
IQESGYLYPFDHLEKKK

SEQ ID NO: 3263024 - protein, 18 aa, Plasmodium falciparum
IQFCCNPITYAMIGINYY

SEQ ID NO: 3263025 - protein, 20 aa, Plasmodium falciparum
IQFLFHFNLATLKLMNFLNL

SEQ ID NO: 3263026 - protein, 25 aa, Plasmodium falciparum
IQFLLKRKKWIPLLYTMYNKKEFVK

SEQ ID NO: 3263027 - protein, 20 aa, Plasmodium falciparum
IQFNKYFYKLIINKLSYYKI

SEQ ID NO: 3263028 - protein, 30 aa, Plasmodium falciparum
IQFVLPYKPIRMFYSNNFLFFVNIINKSKD

SEQ ID NO: 3263029 - protein, 25 aa, Plasmodium falciparum
IQGRRKCYSWLYFSSYRSNNIIYKE

SEQ ID NO: 3263030 - protein, 17 aa, Plasmodium falciparum
IQHKGLGKCLVLVAEII

SEQ ID NO: 3263031 - protein, 24 aa, Plasmodium falciparum
IQHLREMLKETGFDGGSGIGVAKE

SEQ ID NO: 3263032 - protein, 27 aa, Plasmodium falciparum
IQIEDQGNCAISWIFASKYYLETLKCM

SEQ ID NO: 3263033 - protein, 17 aa, Plasmodium falciparum
IQIFKSKISFPSFNLNT

SEQ ID NO: 3263034 - protein, 17 aa, Plasmodium falciparum
IQIFSLWFLLFHFIKRE

SEQ ID NO: 3263035 - protein, 17 aa, Plasmodium falciparum
IQILGLSLLGQRVCLYI

SEQ ID NO: 3263036 - protein, 18 aa, Plasmodium falciparum
IQIPILLNRKDQITFLKK

SEQ ID NO: 3263037 - protein, 17 aa, Plasmodium falciparum
IQIPIMIYANFLFSKQE

SEQ ID NO: 3263038 - protein, 32 aa, Plasmodium falciparum
IQISQMLIQFILKIITLWIINMMNNIIMYLSI

SEQ ID NO: 3263039 - protein, 19 aa, Plasmodium falciparum
IQIVKKCKDMIKTIKVPKK

SEQ ID NO: 3263040 - protein, 23 aa, Plasmodium falciparum
IQIWINCLFCFGYNINKNLGVYP

SEQ ID NO: 3263041 - protein, 23 aa, Plasmodium falciparum
IQKCLTILCTFFRHIHKFSDVPD

SEQ ID NO: 3263042 - protein, 17 aa, Plasmodium falciparum
IQKGRIWKREENGEKKK

SEQ ID NO: 3263043 - protein, 18 aa, Plasmodium falciparum
IQKHVLKNNILHYYMILK

SEQ ID NO: 3263044 - protein, 23 aa, Plasmodium falciparum
IQKKICFLKEEIDYYKNNENSFI

SEQ ID NO: 3263045 - protein, 18 aa, Plasmodium falciparum
IQKLHEWASRGGDEATKS

SEQ ID NO: 3263046 - protein, 17 aa, Plasmodium falciparum
IQKMKAPNDKLIMILNC

SEQ ID NO: 3263047 - protein, 22 aa, Plasmodium falciparum
IQKRKAWKNCYNVNKNTCKYLY

SEQ ID NO: 3263048 - protein, 23 aa, Plasmodium falciparum
IQKTEYCIIIFLEFIEFLKKIIQ

SEQ ID NO: 3263049 - protein, 20 aa, Plasmodium falciparum
IQKVLKYAFRVPEYVIYLGC

SEQ ID NO: 3263050 - protein, 19 aa, Plasmodium falciparum
IQKVMKWEKTILSLLFENN

SEQ ID NO: 3263051 - protein, 19 aa, Plasmodium falciparum
IQLCNIMQSKGLEEKLKTD

SEQ ID NO: 3263052 - protein, 24 aa, Plasmodium falciparum
IQLGSSVRTSICPNEYGDKFIGLL

SEQ ID NO: 3263053 - protein, 18 aa, Plasmodium falciparum
IQLIIFKIINNIFINEEE

SEQ ID NO: 3263054 - protein, 38 aa, Plasmodium falciparum
IQLLCTLHTYIFCNFVYFKTYIEECFIKLYKYKLCFLI

SEQ ID NO: 3263055 - protein, 17 aa, Plasmodium falciparum
IQLLYVLIFSLKENTHI

SEQ ID NO: 3263056 - protein, 22 aa, Plasmodium falciparum
IQMCKLKYAIPVIKNTTNIIYK

SEQ ID NO: 3263057 - protein, 17 aa, Plasmodium falciparum
IQMHIYLFIYLGICGYR

SEQ ID NO: 3263058 - protein, 19 aa, Plasmodium falciparum
IQMILSFIVGIIINKYILS

SEQ ID NO: 3263059 - protein, 17 aa, Plasmodium falciparum
IQMLYYLIMKPANMDLL

SEQ ID NO: 3263060 - protein, 19 aa, Plasmodium falciparum
IQMVQELQLKNVIIDKKNE

SEQ ID NO: 3263061 - protein, 18 aa, Plasmodium falciparum
IQNDIFLNCIYKYRNDFD

SEQ ID NO: 3263062 - protein, 33 aa, Plasmodium falciparum
IQNNLFIYISLFKSVLFIISEILFFIDPTNNLY

SEQ ID NO: 3263063 - protein, 26 aa, Plasmodium falciparum
IQPTLKRVVPVAVDRAIREIIASILE

SEQ ID NO: 3263064 - protein, 20 aa, Plasmodium falciparum
IQPYIKWLFIKLKKSYMKLD

SEQ ID NO: 3263065 - protein, 29 aa, Plasmodium falciparum
IQQIFISCMLFKLNRIFGNHYKKKNINKQ

SEQ ID NO: 3263066 - protein, 19 aa, Plasmodium falciparum
IQQSEVFEQVFNLYKCTLD

SEQ ID NO: 3263067 - protein, 25 aa, Plasmodium falciparum
IQRPNICTFYGICIKSNKLMLLLEY

SEQ ID NO: 3263068 - protein, 18 aa, Plasmodium falciparum
IQRRPESVFVPASKVAAD

SEQ ID NO: 3263069 - protein, 23 aa, Plasmodium falciparum
IQRSSLLSIKAFKEHNKKLINSY

SEQ ID NO: 3263070 - protein, 17 aa, Plasmodium falciparum
IQRTLCTKFFNELSNMY

SEQ ID NO: 3263071 - protein, 33 aa, Plasmodium falciparum
IQSKLCKIERCINNLKSLFTWYDGILVSSLKKG

SEQ ID NO: 3263072 - protein, 23 aa, Plasmodium falciparum
IQSRSRMLLTYFFSTLICHKRYF

SEQ ID NO: 3263073 - protein, 25 aa, Plasmodium falciparum
IQSVGARLIGFIKILQKKIHLNNNE

SEQ ID NO: 3263074 - protein, 17 aa, Plasmodium falciparum
IQTLRGLIHNNIIKMYD

SEQ ID NO: 3263075 - protein, 17 aa, Plasmodium falciparum
IQTRGRFGVTVAPAECV

SEQ ID NO: 3263076 - protein, 26 aa, Plasmodium falciparum
IQTVLKFSFIYIHFFNSISKKTYNVK

SEQ ID NO: 3263077 - protein, 20 aa, Plasmodium falciparum
IQVIKMLKKMNVPSYYTSSK

SEQ ID NO: 3263078 - protein, 18 aa, Plasmodium falciparum
IQVLVEFIIIFSTAICTS

SEQ ID NO: 3263079 - protein, 25 aa, Plasmodium falciparum
IQYFIKLFYYLSFYNPIFSILFLNL

SEQ ID NO: 3263080 - protein, 18 aa, Plasmodium falciparum
IQYKELKYLFNIWNKKYK

SEQ ID NO: 3263081 - protein, 19 aa, Plasmodium falciparum
IQYKIWIYQYFNEWKNYIK

SEQ ID NO: 3263082 - protein, 21 aa, Plasmodium falciparum
IQYLLPQSCFKHFKNIEFIFK

SEQ ID NO: 3263083 - protein, 21 aa, Plasmodium falciparum
IRAAEDIAHIGLHLKNNDTKN

SEQ ID NO: 3263084 - protein, 25 aa, Plasmodium falciparum
IRALFKRWLEHFLEDYNKINDKISH

SEQ ID NO: 3263085 - protein, 24 aa, Plasmodium falciparum
IRALFKRWVENFFDDYKKIKHKIS

SEQ ID NO: 3263086 - protein, 25 aa, Plasmodium falciparum
IRALFKRWVEYFFEDYNKIKNKISH

SEQ ID NO: 3263087 - protein, 25 aa, Plasmodium falciparum
IRALIKRWLEYFLEDYNKIKHKISD

SEQ ID NO: 3263088 - protein, 25 aa, Plasmodium falciparum
IRALIKRWLEYFLEDYNKIRKKLKS

SEQ ID NO: 3263089 - protein, 25 aa, Plasmodium falciparum
IRALIKRWLEYLFEDYNRIRKKLNH

SEQ ID NO: 3263090 - protein, 22 aa, Plasmodium falciparum
IRALKSILLVLGVQNMTPPIKD

SEQ ID NO: 3263091 - protein, 25 aa, Plasmodium falciparum
IRALLKRWVEYFLEDYNKIKHKISH

SEQ ID NO: 3263092 - protein, 18 aa, Plasmodium falciparum
IRALTNMKSHYAYYTHIM

SEQ ID NO: 3263093 - protein, 18 aa, Plasmodium falciparum
IRCLKKGSLLSVLICSLS

SEQ ID NO: 3263094 - protein, 19 aa, Plasmodium falciparum
IRDFIKFDYISGMCGDGSN

SEQ ID NO: 3263095 - protein, 19 aa, Plasmodium falciparum
IRDVLKLPFRVDIYNRFKI

SEQ ID NO: 3263096 - protein, 19 aa, Plasmodium falciparum
IRDYIFPIYLKLCKDEVAT

SEQ ID NO: 3263097 - protein, 18 aa, Plasmodium falciparum
IREDVWKCGKFRDVDVCV

SEQ ID NO: 3263098 - protein, 20 aa, Plasmodium falciparum
IREISIWKIPQEIRKIRENI

SEQ ID NO: 3263099 - protein, 25 aa, Plasmodium falciparum
IREKKLRFICSIPKPLNNKEREILL

SEQ ID NO: 3263100 - protein, 20 aa, Plasmodium falciparum
IREKLDCINNIDIIIELLCE

SEQ ID NO: 3263101 - protein, 25 aa, Plasmodium falciparum
IRENCYYPNIFLYNYYRNRIKKNIL

SEQ ID NO: 3263102 - protein, 25 aa, Plasmodium falciparum
IRENIKMNLILKERCLIMKDIENIK

SEQ ID NO: 3263103 - protein, 23 aa, Plasmodium falciparum
IRENQHIISICWFGKPKNIIKNK

SEQ ID NO: 3263104 - protein, 24 aa, Plasmodium falciparum
IRERFYKYILVHILDLSFEKNYAS

SEQ ID NO: 3263105 - protein, 21 aa, Plasmodium falciparum
IREYKNLQSLFSYNKNKIEDH

SEQ ID NO: 3263106 - protein, 17 aa, Plasmodium falciparum
IRFKHHMIFSSFVRYIL

SEQ ID NO: 3263107 - protein, 21 aa, Plasmodium falciparum
IRGKDLWGIQDFKDLQTKLVT

SEQ ID NO: 3263108 - protein, 38 aa, Plasmodium falciparum
IRGRKNILIFLLKIFLFSPLIWILIYSEYFTVVKNYNK

SEQ ID NO: 3263109 - protein, 19 aa, Plasmodium falciparum
IRGSGKIFDGRVCVPPRRQ

SEQ ID NO: 3263110 - protein, 29 aa, Plasmodium falciparum
IRGWFQSFFFVFFCLNWINQRKKTRSQLL

SEQ ID NO: 3263111 - protein, 17 aa, Plasmodium falciparum
IRHIYFDTFGKYASITH

SEQ ID NO: 3263112 - protein, 24 aa, Plasmodium falciparum
IRHKYVLEFLSWVKLSTRIYQNTS

SEQ ID NO: 3263113 - protein, 18 aa, Plasmodium falciparum
IRIDTLIIRLINILERNN

SEQ ID NO: 3263114 - protein, 26 aa, Plasmodium falciparum
IRIEKMIKYCLERNQAILVYGNNGTG

SEQ ID NO: 3263115 - protein, 19 aa, Plasmodium falciparum
IRIIKEIREKLYIPNLNMR

SEQ ID NO: 3263116 - protein, 27 aa, Plasmodium falciparum
IRIILMLSFIYCIRSFFIYVTTLPCPI

SEQ ID NO: 3263117 - protein, 19 aa, Plasmodium falciparum
IRIKCFNKYLKHEVHKIYN

SEQ ID NO: 3263118 - protein, 27 aa, Plasmodium falciparum
IRIKLNMYKVYLSVIIIFFCFEIILHT

SEQ ID NO: 3263119 - protein, 19 aa, Plasmodium falciparum
IRIKNMFTYHLNWLAPTEN

SEQ ID NO: 3263120 - protein, 17 aa, Plasmodium falciparum
IRIKRSVLNIFSNSRNN

SEQ ID NO: 3263121 - protein, 24 aa, Plasmodium falciparum
IRIKRYGNFFLFFIIYIFTILHII

SEQ ID NO: 3263122 - protein, 21 aa, Plasmodium falciparum
IRINKCNFIDTLIMFYILLKN

SEQ ID NO: 3263123 - protein, 20 aa, Plasmodium falciparum
IRISGPLSKMILEILLHKGK

SEQ ID NO: 3263124 - protein, 19 aa, Plasmodium falciparum
IRIYIHILFFIFYIINNEK

SEQ ID NO: 3263125 - protein, 17 aa, Plasmodium falciparum
IRKDCPDLENLYKSYIN

SEQ ID NO: 3263126 - protein, 22 aa, Plasmodium falciparum
IRKDEWKCGKFCDVDVCVLENF

SEQ ID NO: 3263127 - protein, 24 aa, Plasmodium falciparum
IRKDKCKKYFISTCEENKIVYKKK

SEQ ID NO: 3263128 - protein, 19 aa, Plasmodium falciparum
IRKDVWKCGEYCGVDICEP

SEQ ID NO: 3263129 - protein, 18 aa, Plasmodium falciparum
IRKDVWKCGNVCGLDICS

SEQ ID NO: 3263130 - protein, 19 aa, Plasmodium falciparum
IRKIQSFCVLYMDIKKYKY

SEQ ID NO: 3263131 - protein, 27 aa, Plasmodium falciparum
IRKIVSLFKECMYYFMCFNEKDGQFLD

SEQ ID NO: 3263132 - protein, 20 aa, Plasmodium falciparum
IRKKYIHFFFLKKQKYKNMT

SEQ ID NO: 3263133 - protein, 23 aa, Plasmodium falciparum
IRKLKLCTILSFSCPMIGVGGMN

SEQ ID NO: 3263134 - protein, 23 aa, Plasmodium falciparum
IRKNEFLQFMIVRRYKYVGEENA

SEQ ID NO: 3263135 - protein, 27 aa, Plasmodium falciparum
IRKNVCIKYLRFLYYLKKIKFRKEWNR

SEQ ID NO: 3263136 - protein, 21 aa, Plasmodium falciparum
IRKPLFYYKLPVQFEPLYCQY

SEQ ID NO: 3263137 - protein, 21 aa, Plasmodium falciparum
IRKSPSWFSYQNFRNILFLKK

SEQ ID NO: 3263138 - protein, 17 aa, Plasmodium falciparum
IRKTVKYKYNINSAMSY

SEQ ID NO: 3263139 - protein, 28 aa, Plasmodium falciparum
IRKVDGIIYICLFIILKLSSNKNICKNL

SEQ ID NO: 3263140 - protein, 21 aa, Plasmodium falciparum
IRKVKCYFCKMKNNNNNNNNN

SEQ ID NO: 3263141 - protein, 19 aa, Plasmodium falciparum
IRLCHMAGIRVFMITGDNI

SEQ ID NO: 3263142 - protein, 23 aa, Plasmodium falciparum
IRLLCECELYAAPNYDNSEMKVV

SEQ ID NO: 3263143 - protein, 16 aa, Plasmodium falciparum
IRLLIVFPNNHIVILT

SEQ ID NO: 3263144 - protein, 21 aa, Plasmodium falciparum
IRLLTEYKDTLQIKVEQKSLR

SEQ ID NO: 3263145 - protein, 24 aa, Plasmodium falciparum
IRLQTLRIFYYYIIQSNYFSKHNI

SEQ ID NO: 3263146 - protein, 19 aa, Plasmodium falciparum
IRLTFKHTFQNLNIYLPLY

SEQ ID NO: 3263147 - protein, 20 aa, Plasmodium falciparum
IRLVCKIIKFILITIYRLIK

SEQ ID NO: 3263148 - protein, 24 aa, Plasmodium falciparum
IRLYALKLSILFISHISKSNHIIN

SEQ ID NO: 3263149 - protein, 25 aa, Plasmodium falciparum
IRLYSHSFIGYGWIDSLFRVNIYLC

SEQ ID NO: 3263150 - protein, 34 aa, Plasmodium falciparum
IRMKPYLPQIAGILRWRLNTPLPKVRQQSADLIS

SEQ ID NO: 3263151 - protein, 28 aa, Plasmodium falciparum
IRNASDIFFRQIIMSLKIYYQEKNDTYA

SEQ ID NO: 3263152 - protein, 18 aa, Plasmodium falciparum
IRNEEIYNILGKVTSENL

SEQ ID NO: 3263153 - protein, 25 aa, Plasmodium falciparum
IRNENFCLFNKYLIVNNRDKINITK

SEQ ID NO: 3263154 - protein, 17 aa, Plasmodium falciparum
IRNKGCMHINNTDIINL

SEQ ID NO: 3263155 - protein, 24 aa, Plasmodium falciparum
IRNKICDFLEILYLNKYESLNIYN

SEQ ID NO: 3263156 - protein, 26 aa, Plasmodium falciparum
IRNKLKEIFLCLCYISNHKLYFNLLL

SEQ ID NO: 3263157 - protein, 26 aa, Plasmodium falciparum
IRNLYCGYSLCLLNFIPYLLITSKLN

SEQ ID NO: 3263158 - protein, 20 aa, Plasmodium falciparum
IRNNFLPIFFELFKRTNDYN

SEQ ID NO: 3263159 - protein, 21 aa, Plasmodium falciparum
IRNNKLCSFIHKNFENLEKYL

SEQ ID NO: 3263160 - protein, 18 aa, Plasmodium falciparum
IRNNYYLILLKIYICNIL

SEQ ID NO: 3263161 - protein, 21 aa, Plasmodium falciparum
IRNSKFLTCLNDELNRQIAMY

SEQ ID NO: 3263162 - protein, 19 aa, Plasmodium falciparum
IRNSRFLYFDREHKLLVIK

SEQ ID NO: 3263163 - protein, 17 aa, Plasmodium falciparum
IRNTIKYNYSCNNTEYT

SEQ ID NO: 3263164 - protein, 21 aa, Plasmodium falciparum
IRNVGFLLRWFNYNKTPSKNI

SEQ ID NO: 3263165 - protein, 25 aa, Plasmodium falciparum
IRNYCSYILCSLKIFCKTNILIYNF

SEQ ID NO: 3263166 - protein, 20 aa, Plasmodium falciparum
IRNYIECLRNAPYIDDPLWG

SEQ ID NO: 3263167 - protein, 21 aa, Plasmodium falciparum
IRNYRAFREQFNWLSKTLYES

SEQ ID NO: 3263168 - protein, 19 aa, Plasmodium falciparum
IRPFEIVKRDIFLKCVLPY

SEQ ID NO: 3263169 - protein, 20 aa, Plasmodium falciparum
IRQCFVCTTVQLICNVVLII

SEQ ID NO: 3263170 - protein, 18 aa, Plasmodium falciparum
IRQIFNLSLQNVYLNQQN

SEQ ID NO: 3263171 - protein, 25 aa, Plasmodium falciparum
IRQIKYIIHTILFFKNNDPMKHMLL

SEQ ID NO: 3263172 - protein, 23 aa, Plasmodium falciparum
IRRDVFFFNLLKSVIKKKTSEDM

SEQ ID NO: 3263173 - protein, 17 aa, Plasmodium falciparum
IRRIRYNSIPKYLWSSV

SEQ ID NO: 3263174 - protein, 24 aa, Plasmodium falciparum
IRRRVKPSIKLFSKLRSFLELARI

SEQ ID NO: 3263175 - protein, 21 aa, Plasmodium falciparum
IRRSHVSSCSYRRAHNNIKYD

SEQ ID NO: 3263176 - protein, 19 aa, Plasmodium falciparum
IRRVYRKEDDIIDNFTLKK

SEQ ID NO: 3263177 - protein, 27 aa, Plasmodium falciparum
IRSGKYIPIEFFQGYIIHKNEFLALFL

SEQ ID NO: 3263178 - protein, 23 aa, Plasmodium falciparum
IRSKIYISFFSFFFLNFFFFFLF

SEQ ID NO: 3263179 - protein, 26 aa, Plasmodium falciparum
IRSKWMRYRMEVFILLLIGVLSFIIR

SEQ ID NO: 3263180 - protein, 20 aa, Plasmodium falciparum
IRSLVPIKYINYFKSSILIN

SEQ ID NO: 3263181 - protein, 18 aa, Plasmodium falciparum
IRSNKIISHIDDYYKLDI

SEQ ID NO: 3263182 - protein, 24 aa, Plasmodium falciparum
IRSNRYLGLYARGKFMDHIVSTPS

SEQ ID NO: 3263183 - protein, 19 aa, Plasmodium falciparum
IRTKCKLHNIKWIEGKLPA

SEQ ID NO: 3263184 - protein, 33 aa, Plasmodium falciparum
IRTNAILCLKYLFECKQIKYIFMLKKDKNEKFE

SEQ ID NO: 3263185 - protein, 18 aa, Plasmodium falciparum
IRTNYSFFQQIRRFKKKT

SEQ ID NO: 3263186 - protein, 19 aa, Plasmodium falciparum
IRTSFQIYENVNLEFDKEK

SEQ ID NO: 3263187 - protein, 31 aa, Plasmodium falciparum
IRTYKYYMEKGIKEIVAIFIFDDLNITKARE

SEQ ID NO: 3263188 - protein, 18 aa, Plasmodium falciparum
IRVGDIILIKSKQRVPAD

SEQ ID NO: 3263189 - protein, 25 aa, Plasmodium falciparum
IRVLFKRWIENFLKDHNKIKDKISL

SEQ ID NO: 3263190 - protein, 21 aa, Plasmodium falciparum
IRYKTKISVLSFMKRNVLHLS

SEQ ID NO: 3263191 - protein, 26 aa, Plasmodium falciparum
IRYLCVCVLYIISFFNYHSFLSYETI

SEQ ID NO: 3263192 - protein, 21 aa, Plasmodium falciparum
IRYNSIPKYLWSSVGITKDNE

SEQ ID NO: 3263193 - protein, 20 aa, Plasmodium falciparum
IRYNYVIPKTFLEYIYFYKN

SEQ ID NO: 3263194 - protein, 17 aa, Plasmodium falciparum
ISADIMPGIYFGICKLR

SEQ ID NO: 3263195 - protein, 35 aa, Plasmodium falciparum
ISAGYSDYCIKKFCYLRKLLFIYGSKHLYTISIIL

SEQ ID NO: 3263196 - protein, 18 aa, Plasmodium falciparum
ISAKLFLKDMDVHVSDCI

SEQ ID NO: 3263197 - protein, 25 aa, Plasmodium falciparum
ISANICSFIVYIFSMFILRNYFDIM

SEQ ID NO: 3263198 - protein, 20 aa, Plasmodium falciparum
ISAPKIRFFPEIHKQKLRGK

SEQ ID NO: 3263199 - protein, 35 aa, Plasmodium falciparum
ISAPWKVRVSIDFYRCPITNFGRVFQIIIIDHVNV

SEQ ID NO: 3263200 - protein, 21 aa, Plasmodium falciparum
ISAREKYNLIKEEIKYLNEDL

SEQ ID NO: 3263201 - protein, 19 aa, Plasmodium falciparum
ISCLINIIFYLISKKGVTI

SEQ ID NO: 3263202 - protein, 18 aa, Plasmodium falciparum
ISCYKSGVPYNIPNINME

SEQ ID NO: 3263203 - protein, 20 aa, Plasmodium falciparum
ISCYRKCNYSVVGHDPNNKY

SEQ ID NO: 3263204 - protein, 25 aa, Plasmodium falciparum
ISDDGIATIFIKLILQIVKNKSEIY

SEQ ID NO: 3263205 - protein, 25 aa, Plasmodium falciparum
ISDDSCFPCPLYTYTLNQGATSILQ

SEQ ID NO: 3263206 - protein, 23 aa, Plasmodium falciparum
ISDEILKKCFINVCDSIIGGVTF

SEQ ID NO: 3263207 - protein, 19 aa, Plasmodium falciparum
ISDELYLNGYNYKDMKNIR

SEQ ID NO: 3263208 - protein, 17 aa, Plasmodium falciparum
ISDFIWLLFKCIGKNKF

SEQ ID NO: 3263209 - protein, 33 aa, Plasmodium falciparum
ISDMPVYVNFVYYKYSCVTNWVNLVNNLKDSFD

SEQ ID NO: 3263210 - protein, 29 aa, Plasmodium falciparum
ISDNFYSLWICILKLIYKMFHQKKEEIVK

SEQ ID NO: 3263211 - protein, 26 aa, Plasmodium falciparum
ISDNSLKNKLCFEFSKTNHHHNNNNN

SEQ ID NO: 3263212 - protein, 26 aa, Plasmodium falciparum
ISDYCLKFFNPKSIEYFDCTQKEFDD

SEQ ID NO: 3263213 - protein, 23 aa, Plasmodium falciparum
ISDYKFNFMEGLKDFYKVCEKKK

SEQ ID NO: 3263214 - protein, 18 aa, Plasmodium falciparum
ISEGLNLSEERVEKALTS

SEQ ID NO: 3263215 - protein, 24 aa, Plasmodium falciparum
ISEHCVNIYPSLYYYNKLDNKHNL

SEQ ID NO: 3263216 - protein, 18 aa, Plasmodium falciparum
ISEISWRIFHQEHTTFSS

SEQ ID NO: 3263217 - protein, 25 aa, Plasmodium falciparum
ISEIYYRFIKFITMIEIYLCVIEEI

SEQ ID NO: 3263218 - protein, 17 aa, Plasmodium falciparum
ISERIKYLYTYMNDKIN

SEQ ID NO: 3263219 - protein, 28 aa, Plasmodium falciparum
ISFEIPKEAYILKIFCIHIDEQNYDEDI

SEQ ID NO: 3263220 - protein, 25 aa, Plasmodium falciparum
ISFIRRICKVLFFYFYGYIFKYDKY

SEQ ID NO: 3263221 - protein, 30 aa, Plasmodium falciparum
ISFIYNNFHNFKIIIFLPSIKKHFNIQYNK

SEQ ID NO: 3263222 - protein, 17 aa, Plasmodium falciparum
ISFKELKLDLIYIKIIN

SEQ ID NO: 3263223 - protein, 25 aa, Plasmodium falciparum
ISFKTKEIVCFKIRYYEIPLTVFKK

SEQ ID NO: 3263224 - protein, 31 aa, Plasmodium falciparum
ISFLYDFILNFLIELFRIIKINEINSLSLII

SEQ ID NO: 3263225 - protein, 17 aa, Plasmodium falciparum
ISFLYPNTINYFASLLK

SEQ ID NO: 3263226 - protein, 17 aa, Plasmodium falciparum
ISFLYSVILTRGLHNVK

SEQ ID NO: 3263227 - protein, 25 aa, Plasmodium falciparum
ISFMSNMGSSIFKDVVNNKSRSSYN

SEQ ID NO: 3263228 - protein, 19 aa, Plasmodium falciparum
ISFNFKKNLLAIGSNTHNI

SEQ ID NO: 3263229 - protein, 19 aa, Plasmodium falciparum
ISFQPLFDVILCDNNNNNN

SEQ ID NO: 3263230 - protein, 39 aa, Plasmodium falciparum
ISFTSLYWSFSIHKAFMEFLFIIACVSFTIIYSYILCSR

SEQ ID NO: 3263231 - protein, 17 aa, Plasmodium falciparum
ISGECLLTLTSILDLSA

SEQ ID NO: 3263232 - protein, 26 aa, Plasmodium falciparum
ISGGNECFICPSIIYDAVINSRALYI

SEQ ID NO: 3263233 - protein, 26 aa, Plasmodium falciparum
ISGKEFSLDCSYTFEISLFGIQIRKD

SEQ ID NO: 3263234 - protein, 25 aa, Plasmodium falciparum
ISGSIYKKYILVLIKILYHSYKLSY

SEQ ID NO: 3263235 - protein, 30 aa, Plasmodium falciparum
ISGTTKYYCKTYYYNLVRFPTFQEFINSLK

SEQ ID NO: 3263236 - protein, 17 aa, Plasmodium falciparum
ISHCIDNGKGNICKNKC

SEQ ID NO: 3263237 - protein, 20 aa, Plasmodium falciparum
ISHFIYFFLNMNIELDEEAS

SEQ ID NO: 3263238 - protein, 20 aa, Plasmodium falciparum
ISHIKCIKYTYVLFILHLFI

SEQ ID NO: 3263239 - protein, 35 aa, Plasmodium falciparum
ISHILEALFEYKCPVEWIITPFLEFLNNFINDYCE

SEQ ID NO: 3263240 - protein, 27 aa, Plasmodium falciparum
ISHKHRLVLMFFKKYIYKLLNKQNMFI

SEQ ID NO: 3263241 - protein, 19 aa, Plasmodium falciparum
ISHLMLIGFGGSGKQSLIK

SEQ ID NO: 3263242 - protein, 22 aa, Plasmodium falciparum
ISICACASFLCETEKVHFNPIH

SEQ ID NO: 3263243 - protein, 17 aa, Plasmodium falciparum
ISIEALVYILNTLDITN

SEQ ID NO: 3263244 - protein, 21 aa, Plasmodium falciparum
ISIFFSNIFRKLAKEESNVVA

SEQ ID NO: 3263245 - protein, 17 aa, Plasmodium falciparum
ISIFKGGHKHVVNKKKK

SEQ ID NO: 3263246 - protein, 25 aa, Plasmodium falciparum
ISIFLLLLCIYNWIRCLKKGSLLSV

SEQ ID NO: 3263247 - protein, 19 aa, Plasmodium falciparum
ISIHLKRKNIYTINKYLNN

SEQ ID NO: 3263248 - protein, 25 aa, Plasmodium falciparum
ISIHSCKNLPLVLVYLSKKIKLNFY

SEQ ID NO: 3263249 - protein, 33 aa, Plasmodium falciparum
ISIIEFTLLYTREVNKWRGAIFATHKPSSSVYN

SEQ ID NO: 3263250 - protein, 17 aa, Plasmodium falciparum
ISIKEYILNILVQILNK

SEQ ID NO: 3263251 - protein, 21 aa, Plasmodium falciparum
ISIKINYSFLLNVEKNKIIEM

SEQ ID NO: 3263252 - protein, 18 aa, Plasmodium falciparum
ISILDIYLHFFLNIYTLN

SEQ ID NO: 3263253 - protein, 24 aa, Plasmodium falciparum
ISILKIWYLFIICFIPYSFIMEPI

SEQ ID NO: 3263254 - protein, 20 aa, Plasmodium falciparum
ISILKSIFYHFCLNQYNLIK

SEQ ID NO: 3263255 - protein, 22 aa, Plasmodium falciparum
ISILLQCFTDNYVIANRMESNL

SEQ ID NO: 3263256 - protein, 18 aa, Plasmodium falciparum
ISINLALHYVIYNEKSSK

SEQ ID NO: 3263257 - protein, 22 aa, Plasmodium falciparum
ISIQQNLLWNKWIERKRYIIEK

SEQ ID NO: 3263258 - protein, 24 aa, Plasmodium falciparum
ISISCLNLIISIIVRLVLDINSFF

SEQ ID NO: 3263259 - protein, 17 aa, Plasmodium falciparum
ISISVAVSDDFAFYKEG

SEQ ID NO: 3263260 - protein, 29 aa, Plasmodium falciparum
ISISVHLFCFFLLLLFLKFSLNTVSINIY

SEQ ID NO: 3263261 - protein, 23 aa, Plasmodium falciparum
ISITSILLLCFIFTNLKTFMEKI

SEQ ID NO: 3263262 - protein, 17 aa, Plasmodium falciparum
ISIVPFEGYLPYDKSGD

SEQ ID NO: 3263263 - protein, 31 aa, Plasmodium falciparum
ISKCAHDYYKKYRIMLALELQANLAQSIQEK

SEQ ID NO: 3263264 - protein, 22 aa, Plasmodium falciparum
ISKCRYFLLPIVGILYIILLNI

SEQ ID NO: 3263265 - protein, 26 aa, Plasmodium falciparum
ISKCSAIQRKGRAGRILYLLKKNKKN

SEQ ID NO: 3263266 - protein, 23 aa, Plasmodium falciparum
ISKCSTSHDFICRLRKRYETLIS

SEQ ID NO: 3263267 - protein, 19 aa, Plasmodium falciparum
ISKDLMSKVINRWLNNDIY

SEQ ID NO: 3263268 - protein, 18 aa, Plasmodium falciparum
ISKEEFNPFFNFFENDKN

SEQ ID NO: 3263269 - protein, 19 aa, Plasmodium falciparum
ISKERCIMLILAKHTGEIF

SEQ ID NO: 3263270 - protein, 17 aa, Plasmodium falciparum
ISKKIFIHFKSLTPAII

SEQ ID NO: 3263271 - protein, 24 aa, Plasmodium falciparum
ISKKKEIIHDLSFPVPISTNEKLS

SEQ ID NO: 3263272 - protein, 26 aa, Plasmodium falciparum
ISKKLFLPCFFSEYFYSLYKENENDT

SEQ ID NO: 3263273 - protein, 20 aa, Plasmodium falciparum
ISKLEKWKLEGYNMDMENNN

SEQ ID NO: 3263274 - protein, 28 aa, Plasmodium falciparum
ISKRLLVMKKPWRLPKNVELQINNVYHL

SEQ ID NO: 3263275 - protein, 25 aa, Plasmodium falciparum
ISKSELPMCNKILIENKMSILRDIY

SEQ ID NO: 3263276 - protein, 24 aa, Plasmodium falciparum
ISKTKRSLIFQRFYNILFNLNYAL

SEQ ID NO: 3263277 - protein, 26 aa, Plasmodium falciparum
ISKVPLLPPECWNIVRIHEKLKINDP

SEQ ID NO: 3263278 - protein, 24 aa, Plasmodium falciparum
ISKVYCKKELKGIISSNETNDTNH

SEQ ID NO: 3263279 - protein, 18 aa, Plasmodium falciparum
ISKWNWENIQFKWIDYEN

SEQ ID NO: 3263280 - protein, 22 aa, Plasmodium falciparum
ISKYAIEYSVIYSLIGIDINEY

SEQ ID NO: 3263281 - protein, 26 aa, Plasmodium falciparum
ISKYLLSAYEKYGLNVFIKVLVYKND

SEQ ID NO: 3263282 - protein, 24 aa, Plasmodium falciparum
ISLCSSHSAIIRSMAQFILYKFIK

SEQ ID NO: 3263283 - protein, 17 aa, Plasmodium falciparum
ISLDIFLPMNKQYCSKN

SEQ ID NO: 3263284 - protein, 17 aa, Plasmodium falciparum
ISLDKYNSFALIKTISE

SEQ ID NO: 3263285 - protein, 22 aa, Plasmodium falciparum
ISLEKIAQCIMFNKNCFNIYDI

SEQ ID NO: 3263286 - protein, 18 aa, Plasmodium falciparum
ISLENCIDLGSTNTCMYN

SEQ ID NO: 3263287 - protein, 32 aa, Plasmodium falciparum
ISLFSFALSIWICLFLFKIILSIMIVSYTISE

SEQ ID NO: 3263288 - protein, 22 aa, Plasmodium falciparum
ISLICVFSFLLSRICSILSNFT

SEQ ID NO: 3263289 - protein, 22 aa, Plasmodium falciparum
ISLICYCILLFIALSFLIYYVY

SEQ ID NO: 3263290 - protein, 24 aa, Plasmodium falciparum
ISLKFLCLSLYMIGFYYVFLYNSF

SEQ ID NO: 3263291 - protein, 31 aa, Plasmodium falciparum
ISLKIILIFFYYYICKKICMQFFTLCIYECR

SEQ ID NO: 3263292 - protein, 20 aa, Plasmodium falciparum
ISLLGKRKISQDSIKDELSR

SEQ ID NO: 3263293 - protein, 18 aa, Plasmodium falciparum
ISLLIFPYISHLCIYNTI

SEQ ID NO: 3263294 - protein, 37 aa, Plasmodium falciparum
ISLLRYDLLVYFSFIKPEILFSIFSKYFLFLSSYNKN

SEQ ID NO: 3263295 - protein, 24 aa, Plasmodium falciparum
ISLLSQIIIHFSILIYGWKLACVY

SEQ ID NO: 3263296 - protein, 18 aa, Plasmodium falciparum
ISLMIPQSWDIFNEKNIP

SEQ ID NO: 3263297 - protein, 20 aa, Plasmodium falciparum
ISLNSCTALGDIKNKNNMNN

SEQ ID NO: 3263298 - protein, 26 aa, Plasmodium falciparum
ISLPDLKSRYSIFKAILKNTPLNEDV

SEQ ID NO: 3263299 - protein, 19 aa, Plasmodium falciparum
ISLQLIINIIFCLPSMIIK

SEQ ID NO: 3263300 - protein, 17 aa, Plasmodium falciparum
ISLSKKYLKIKICGDHI

SEQ ID NO: 3263301 - protein, 28 aa, Plasmodium falciparum
ISLTRYTSLYIHKFFKSVTLLKGNFLYK

SEQ ID NO: 3263302 - protein, 23 aa, Plasmodium falciparum
ISLYIKLNLFYSHDLFIDIQEKI

SEQ ID NO: 3263303 - protein, 20 aa, Plasmodium falciparum
ISLYKLLFSFFMNLGSVDST

SEQ ID NO: 3263304 - protein, 24 aa, Plasmodium falciparum
ISLYKLRYYKNLFFKNYSTITKND

SEQ ID NO: 3263305 - protein, 19 aa, Plasmodium falciparum
ISLYKTYIFIFPEELEKEN

SEQ ID NO: 3263306 - protein, 20 aa, Plasmodium falciparum
ISLYPMDYFNSIDYLKYNNY

SEQ ID NO: 3263307 - protein, 18 aa, Plasmodium falciparum
ISLYYYKYLLNIIQTNDT

SEQ ID NO: 3263308 - protein, 20 aa, Plasmodium falciparum
ISMCRYDIPLSLKKLIKYTE

SEQ ID NO: 3263309 - protein, 24 aa, Plasmodium falciparum
ISMKNSNIHLFWTSEKLKNFVENE

SEQ ID NO: 3263310 - protein, 27 aa, Plasmodium falciparum
ISMLLKSSFSSFILESIGWTYENVSNI

SEQ ID NO: 3263311 - protein, 29 aa, Plasmodium falciparum
ISMSCISLYLTKLCLFIIPIYGLSVLCLL

SEQ ID NO: 3263312 - protein, 25 aa, Plasmodium falciparum
ISMTYDCILILFKYINELKEVSAFR

SEQ ID NO: 3263313 - protein, 19 aa, Plasmodium falciparum
ISNACDLNKFESLFPQMDC

SEQ ID NO: 3263314 - protein, 21 aa, Plasmodium falciparum
ISNAECTKCLTPYTTDGQIGS

SEQ ID NO: 3263315 - protein, 27 aa, Plasmodium falciparum
ISNCFSRDFLHTILLCNYVTIIEDLRK

SEQ ID NO: 3263316 - protein, 19 aa, Plasmodium falciparum
ISNDELRNEINLQYLNIQK

SEQ ID NO: 3263317 - protein, 31 aa, Plasmodium falciparum
ISNDIKCKCFFLHCLCKILSNYHNSHFINDL

SEQ ID NO: 3263318 - protein, 18 aa, Plasmodium falciparum
ISNIFKAILIQVNNTIYM

SEQ ID NO: 3263319 - protein, 18 aa, Plasmodium falciparum
ISNIIAGIGLKLSLYYIN

SEQ ID NO: 3263320 - protein, 22 aa, Plasmodium falciparum
ISNIVLLYFFSAFSFLNSYFIY

SEQ ID NO: 3263321 - protein, 18 aa, Plasmodium falciparum
ISNKIYVIKCSRKEQKLF

SEQ ID NO: 3263322 - protein, 17 aa, Plasmodium falciparum
ISNKLEHFIRIEREYDK

SEQ ID NO: 3263323 - protein, 20 aa, Plasmodium falciparum
ISNLCLELVYNLCLKGDSVI

SEQ ID NO: 3263324 - protein, 23 aa, Plasmodium falciparum
ISNREFFYVYNLYETKNILQNYQ

SEQ ID NO: 3263325 - protein, 20 aa, Plasmodium falciparum
ISNRKILEVFSDVLTSIESV

SEQ ID NO: 3263326 - protein, 17 aa, Plasmodium falciparum
ISNRLFDDLTYLLVSEH

SEQ ID NO: 3263327 - protein, 18 aa, Plasmodium falciparum
ISNTDAYTNITLQDIENN

SEQ ID NO: 3263328 - protein, 22 aa, Plasmodium falciparum
ISNTFFCYSNLYTRGIINKNDI

SEQ ID NO: 3263329 - protein, 18 aa, Plasmodium falciparum
ISNYGEFLLLQSSSRVIS

SEQ ID NO: 3263330 - protein, 31 aa, Plasmodium falciparum
ISPCFSAPFFEEFIYRFFVLKSLNLFMNINY

SEQ ID NO: 3263331 - protein, 20 aa, Plasmodium falciparum
ISPDAIKLGLDKSLLERFVM

SEQ ID NO: 3263332 - protein, 22 aa, Plasmodium falciparum
ISPEILILVIILHLWIIKKQKI

SEQ ID NO: 3263333 - protein, 20 aa, Plasmodium falciparum
ISPELFLKKLIVSGISEQIF

SEQ ID NO: 3263334 - protein, 35 aa, Plasmodium falciparum
ISPKRNCVLINLPYRKCIIFKDFLLYIPTFTNSTI

SEQ ID NO: 3263335 - protein, 26 aa, Plasmodium falciparum
ISPLKRFNSVLSFLGCHVCNKIFEVN

SEQ ID NO: 3263336 - protein, 29 aa, Plasmodium falciparum
ISPMSEYIWWSWLLLQGVIVFGTLFHSNY

SEQ ID NO: 3263337 - protein, 17 aa, Plasmodium falciparum
ISQEWDEHFVFMRRNSY

SEQ ID NO: 3263338 - protein, 17 aa, Plasmodium falciparum
ISQILLKYIYNTYLEKT

SEQ ID NO: 3263339 - protein, 17 aa, Plasmodium falciparum
ISQKKKCIRNFVNIYDH

SEQ ID NO: 3263340 - protein, 30 aa, Plasmodium falciparum
ISQLFLFNKFHIVLSYIFRILYYIYVYINN

SEQ ID NO: 3263341 - protein, 30 aa, Plasmodium falciparum
ISQNKFQLSCAVCLEPLYSENLSKIISYIF

SEQ ID NO: 3263342 - protein, 39 aa, Plasmodium falciparum
ISQNMPIYINCISSIIVNICRTFLFHKPLIPFKKVIYKS

SEQ ID NO: 3263343 - protein, 19 aa, Plasmodium falciparum
ISRKIKFFIQILFSLSPNT

SEQ ID NO: 3263344 - protein, 25 aa, Plasmodium falciparum
ISRRVLHIVDALPLDTPSMRIRLIS

SEQ ID NO: 3263345 - protein, 20 aa, Plasmodium falciparum
ISRTHIVIVDFNIFRKNNEL

SEQ ID NO: 3263346 - protein, 29 aa, Plasmodium falciparum
ISSALFFANLGRGFLCPRTFFESQEWRNI

SEQ ID NO: 3263347 - protein, 24 aa, Plasmodium falciparum
ISSCFFWLNDVKIIIIGIIILALA

SEQ ID NO: 3263348 - protein, 17 aa, Plasmodium falciparum
ISSCLMYLMIMVCESTW

SEQ ID NO: 3263349 - protein, 19 aa, Plasmodium falciparum
ISSCNLTFYSNISNKSENI

SEQ ID NO: 3263350 - protein, 17 aa, Plasmodium falciparum
ISSFILFLVFIICVMLF

SEQ ID NO: 3263351 - protein, 18 aa, Plasmodium falciparum
ISSFLKEEENIILHNYNF

SEQ ID NO: 3263352 - protein, 20 aa, Plasmodium falciparum
ISSFNILLLLAQFLNSQSFI

SEQ ID NO: 3263353 - protein, 20 aa, Plasmodium falciparum
ISSHIPLITQMAFIPTDIRC

SEQ ID NO: 3263354 - protein, 32 aa, Plasmodium falciparum
ISSKALKFSQFFYINKIFIFMHNFNRFKNNIL

SEQ ID NO: 3263355 - protein, 27 aa, Plasmodium falciparum
ISSKKKRCFYIPIAIYIGKRNELDKYE

SEQ ID NO: 3263356 - protein, 17 aa, Plasmodium falciparum
ISSKPSLLYNFNTNTKS

SEQ ID NO: 3263357 - protein, 17 aa, Plasmodium falciparum
ISSKRAIVHVTKLNDHL

SEQ ID NO: 3263358 - protein, 19 aa, Plasmodium falciparum
ISSLHRYKRMNILNFKSRI

SEQ ID NO: 3263359 - protein, 22 aa, Plasmodium falciparum
ISSLYINILILYYIITQKEKTN

SEQ ID NO: 3263360 - protein, 19 aa, Plasmodium falciparum
ISSLYKLYIEYIIKKKFHS

SEQ ID NO: 3263361 - protein, 18 aa, Plasmodium falciparum
ISSMQLYVGWIFIFIYWI

SEQ ID NO: 3263362 - protein, 23 aa, Plasmodium falciparum
ISSNDVWKCIGICTSKEKCSLYN

SEQ ID NO: 3263363 - protein, 18 aa, Plasmodium falciparum
ISSQFIKNIIHIFFDIIN

SEQ ID NO: 3263364 - protein, 38 aa, Plasmodium falciparum
ISSQISNDIKMFWFFMLNEIRPDLVPVDLDHKIKNKNH

SEQ ID NO: 3263365 - protein, 35 aa, Plasmodium falciparum
ISSSCIQSSIYFFLYKYICYHFFSIFIQNILYKIM

SEQ ID NO: 3263366 - protein, 19 aa, Plasmodium falciparum
ISSSCSSLERLPSYEKKLL

SEQ ID NO: 3263367 - protein, 19 aa, Plasmodium falciparum
ISSSFKWVFTNVLLRSTSM

SEQ ID NO: 3263368 - protein, 17 aa, Plasmodium falciparum
ISSSILIFCINQTKPCI

SEQ ID NO: 3263369 - protein, 18 aa, Plasmodium falciparum
ISSSMSLLSIFFVIMSFK

SEQ ID NO: 3263370 - protein, 27 aa, Plasmodium falciparum
ISSYIFVCVTFLYSFIIFKCSSYSVKM

SEQ ID NO: 3263371 - protein, 25 aa, Plasmodium falciparum
ISTCQKCIMIYYFLQKKLVEKISSN

SEQ ID NO: 3263372 - protein, 18 aa, Plasmodium falciparum
ISTCRVIKSGGTGWEYKS

SEQ ID NO: 3263373 - protein, 24 aa, Plasmodium falciparum
ISTCVKKNRFSVLSEAYKEENLLV

SEQ ID NO: 3263374 - protein, 21 aa, Plasmodium falciparum
ISTDIICGFPYESEQDHQNTV

SEQ ID NO: 3263375 - protein, 18 aa, Plasmodium falciparum
ISTHLNIVFTPTKANGNT

SEQ ID NO: 3263376 - protein, 24 aa, Plasmodium falciparum
ISTLCAASFGQLCSDTFGIFFGYV

SEQ ID NO: 3263377 - protein, 33 aa, Plasmodium falciparum
ISTLLIEFFKFYGYKYKSGIIAIRDINGYYQNF

SEQ ID NO: 3263378 - protein, 20 aa, Plasmodium falciparum
ISVALVSLFFIKILAYIYKQ

SEQ ID NO: 3263379 - protein, 19 aa, Plasmodium falciparum
ISVCLYDLNKPMPLKIKKI

SEQ ID NO: 3263380 - protein, 31 aa, Plasmodium falciparum
ISVCSSILKNVCSYLLILLGSLGWGIVIPTL

SEQ ID NO: 3263381 - protein, 23 aa, Plasmodium falciparum
ISVEIKLKCGLTDYQNMYDRYNI

SEQ ID NO: 3263382 - protein, 24 aa, Plasmodium falciparum
ISVKENFNPLGFNESLLGMSKNEK

SEQ ID NO: 3263383 - protein, 27 aa, Plasmodium falciparum
ISVKHLKINLGLLYTYIHTINMINIIL

SEQ ID NO: 3263384 - protein, 30 aa, Plasmodium falciparum
ISVKILKYIIYFNIYIKRYNGSIYKKNIQN

SEQ ID NO: 3263385 - protein, 21 aa, Plasmodium falciparum
ISVLDIFLCYLFLIVELLVFL

SEQ ID NO: 3263386 - protein, 18 aa, Plasmodium falciparum
ISVLFKFVMNTLRKLIHN

SEQ ID NO: 3263387 - protein, 17 aa, Plasmodium falciparum
ISVLFNLDEEDVYKYCL

SEQ ID NO: 3263388 - protein, 32 aa, Plasmodium falciparum
ISVNKCFYLPFICLKGECPNFIHITFVDENGK

SEQ ID NO: 3263389 - protein, 19 aa, Plasmodium falciparum
ISVRIISVKILKYIIYFNI

SEQ ID NO: 3263390 - protein, 19 aa, Plasmodium falciparum
ISVSKFLYNICKNLGVYYK

SEQ ID NO: 3263391 - protein, 17 aa, Plasmodium falciparum
ISWTHAFTTGQHLISAF

SEQ ID NO: 3263392 - protein, 23 aa, Plasmodium falciparum
ISYCNKFFYEFLNNILDCFISLS

SEQ ID NO: 3263393 - protein, 27 aa, Plasmodium falciparum
ISYEVKELIYLFGFSDLHIVKSKINIQ

SEQ ID NO: 3263394 - protein, 25 aa, Plasmodium falciparum
ISYEYNIKISFDNFWNIADPENNYV

SEQ ID NO: 3263395 - protein, 24 aa, Plasmodium falciparum
ISYEYVIMSILFYFYNITTINYEH

SEQ ID NO: 3263396 - protein, 23 aa, Plasmodium falciparum
ISYFHLRGSGGLMCHKDEEGVRK

SEQ ID NO: 3263397 - protein, 19 aa, Plasmodium falciparum
ISYFLTREIYNFSGAALLS

SEQ ID NO: 3263398 - protein, 25 aa, Plasmodium falciparum
ISYKLKVVECLLEFIKNELYILICK

SEQ ID NO: 3263399 - protein, 22 aa, Plasmodium falciparum
ISYKSIFLFQIFLFLIYFLVLL

SEQ ID NO: 3263400 - protein, 26 aa, Plasmodium falciparum
ISYLEYKQFFNLFLYILKEFEIHIKN

SEQ ID NO: 3263401 - protein, 23 aa, Plasmodium falciparum
ISYLTVQVGFFFDVTILNIIPIF

SEQ ID NO: 3263402 - protein, 18 aa, Plasmodium falciparum
ISYNIFRKLILVVTDELI

SEQ ID NO: 3263403 - protein, 18 aa, Plasmodium falciparum
ISYNLWKQNHIYISLKKE

SEQ ID NO: 3263404 - protein, 23 aa, Plasmodium falciparum
ISYPSVCVITYFILFNISTVFYG

SEQ ID NO: 3263405 - protein, 21 aa, Plasmodium falciparum
ISYRKDSLLEFEKKITNILND

SEQ ID NO: 3263406 - protein, 21 aa, Plasmodium falciparum
ISYVLKCVIDYIPNYNDIVIM

SEQ ID NO: 3263407 - protein, 22 aa, Plasmodium falciparum
ISYVMCVKIFCSLILYYMYILK

SEQ ID NO: 3263408 - protein, 33 aa, Plasmodium falciparum
ISYYCLINSCALLQFLPCLLYVYNISYENYFIH

SEQ ID NO: 3263409 - protein, 17 aa, Plasmodium falciparum
ISYYVGEIMKEMMEGQN

SEQ ID NO: 3263410 - protein, 20 aa, Plasmodium falciparum
ITACKCANIAYKTCTHCMTI

SEQ ID NO: 3263411 - protein, 21 aa, Plasmodium falciparum
ITACRIGWKTVSNAVQHQCDT

SEQ ID NO: 3263412 - protein, 17 aa, Plasmodium falciparum
ITAGSFFFFISILFIYL

SEQ ID NO: 3263413 - protein, 27 aa, Plasmodium falciparum
ITALFGHVCNIISWILIGLQKGNSNII

SEQ ID NO: 3263414 - protein, 26 aa, Plasmodium falciparum
ITAVLLLCSSTAFFFIKNSNEPHHIF

SEQ ID NO: 3263415 - protein, 22 aa, Plasmodium falciparum
ITCAAIETYFAWLRYKKINTEA

SEQ ID NO: 3263416 - protein, 17 aa, Plasmodium falciparum
ITCKADTGNAYFRPTCS

SEQ ID NO: 3263417 - protein, 21 aa, Plasmodium falciparum
ITCLKIGSGYMKKDEKCKKDI

SEQ ID NO: 3263418 - protein, 21 aa, Plasmodium falciparum
ITCYMYKKANATHIYRKKILL

SEQ ID NO: 3263419 - protein, 18 aa, Plasmodium falciparum
ITDIFLFQNSLALLLTGF

SEQ ID NO: 3263420 - protein, 17 aa, Plasmodium falciparum
ITECRRNKWEQLHKNDQ

SEQ ID NO: 3263421 - protein, 25 aa, Plasmodium falciparum
ITEMLSVVLLPYINFHIPFVYMKIN

SEQ ID NO: 3263422 - protein, 20 aa, Plasmodium falciparum
ITFEEFWNFLVSNLPLNNYL

SEQ ID NO: 3263423 - protein, 26 aa, Plasmodium falciparum
ITFFSSEIFLVGWIIDLLKQYLSLIT

SEQ ID NO: 3263424 - protein, 19 aa, Plasmodium falciparum
ITFHPCISSSDYINKTYTF

SEQ ID NO: 3263425 - protein, 21 aa, Plasmodium falciparum
ITFIIFCIGILYFTNKSSAHN

SEQ ID NO: 3263426 - protein, 21 aa, Plasmodium falciparum
ITFSCCIKDILYVGSKDGIIY

SEQ ID NO: 3263427 - protein, 20 aa, Plasmodium falciparum
ITFSYLFKAFENMKINDLIF

SEQ ID NO: 3263428 - protein, 18 aa, Plasmodium falciparum
ITGELKFYNIQYLFYPTQ

SEQ ID NO: 3263429 - protein, 22 aa, Plasmodium falciparum
ITGKLNYFGTFSLKIFAKTYFQ

SEQ ID NO: 3263430 - protein, 24 aa, Plasmodium falciparum
ITGVCKLNNFLLVGCNNGSVKVYD

SEQ ID NO: 3263431 - protein, 30 aa, Plasmodium falciparum
ITHKSIFQEVWFRLVQIITGFVEGDGKNSS

SEQ ID NO: 3263432 - protein, 33 aa, Plasmodium falciparum
ITHTIRIRCAECVDFDLCVNCFSTGKEMKSDKC

SEQ ID NO: 3263433 - protein, 19 aa, Plasmodium falciparum
ITICPTCRTFVSGPSTVDG

SEQ ID NO: 3263434 - protein, 19 aa, Plasmodium falciparum
ITICTALTLTLALLFMNCQ

SEQ ID NO: 3263435 - protein, 17 aa, Plasmodium falciparum
ITIHLPATIDITSISIQ

SEQ ID NO: 3263436 - protein, 18 aa, Plasmodium falciparum
ITIILYYLFTMWINGDKN

SEQ ID NO: 3263437 - protein, 17 aa, Plasmodium falciparum
ITIISILCNITIYFVFI

SEQ ID NO: 3263438 - protein, 24 aa, Plasmodium falciparum
ITIKNPFSHIIFYSSHPVIALYLK

SEQ ID NO: 3263439 - protein, 20 aa, Plasmodium falciparum
ITILFYFYKTFYNFHTKKNE

SEQ ID NO: 3263440 - protein, 17 aa, Plasmodium falciparum
ITILINVKEEIKIKDKL

SEQ ID NO: 3263441 - protein, 18 aa, Plasmodium falciparum
ITILSIFFFVIFTGIHTV

SEQ ID NO: 3263442 - protein, 18 aa, Plasmodium falciparum
ITKCSLNLLDAMFNGYYY

SEQ ID NO: 3263443 - protein, 19 aa, Plasmodium falciparum
ITKIYKMLMHMKIKYKEDN

SEQ ID NO: 3263444 - protein, 23 aa, Plasmodium falciparum
ITKLKDFNFLSANHKKDYRSSSI

SEQ ID NO: 3263445 - protein, 22 aa, Plasmodium falciparum
ITKRKNNVFNFISFSDTEGKEE

SEQ ID NO: 3263446 - protein, 29 aa, Plasmodium falciparum
ITKSICIWYLRYNRKLIMNSSSFSEIIKN

SEQ ID NO: 3263447 - protein, 18 aa, Plasmodium falciparum
ITKYKDFHFFVRKKRNGK

SEQ ID NO: 3263448 - protein, 31 aa, Plasmodium falciparum
ITLESWNKYIIPFVRKFITHFNINNNQINFS

SEQ ID NO: 3263449 - protein, 22 aa, Plasmodium falciparum
ITLGGLFGSLGYKSWKNKNKSK

SEQ ID NO: 3263450 - protein, 35 aa, Plasmodium falciparum
ITLIKIYELFILYKYKYKKILTFFFHDVEDEHIEK

SEQ ID NO: 3263451 - protein, 17 aa, Plasmodium falciparum
ITLKQNLIWANEKFLEA

SEQ ID NO: 3263452 - protein, 17 aa, Plasmodium falciparum
ITLKYYLDILFKEKIKE

SEQ ID NO: 3263453 - protein, 18 aa, Plasmodium falciparum
ITLLFNIMNCYNNFNNTL

SEQ ID NO: 3263454 - protein, 25 aa, Plasmodium falciparum
ITLLKLKFVDLIKSIPVFKNVMRTV

SEQ ID NO: 3263455 - protein, 24 aa, Plasmodium falciparum
ITLLNFSNSYGFFSGVIMAPVSIF

SEQ ID NO: 3263456 - protein, 29 aa, Plasmodium falciparum
ITLMINNIRFCICFCNFDIYKYIETKSYY

SEQ ID NO: 3263457 - protein, 24 aa, Plasmodium falciparum
ITLREQNFFFSILLFPLINIDYFS

SEQ ID NO: 3263458 - protein, 18 aa, Plasmodium falciparum
ITLSLLINNFPLSHVPNK

SEQ ID NO: 3263459 - protein, 24 aa, Plasmodium falciparum
ITMFYKKHVTNLCNIINNKIIIIK

SEQ ID NO: 3263460 - protein, 18 aa, Plasmodium falciparum
ITNILLLFEKVQEWADLS

SEQ ID NO: 3263461 - protein, 34 aa, Plasmodium falciparum
ITNIVKYHCCIILSKICLLCIKNQLNRFGSAGVM

SEQ ID NO: 3263462 - protein, 30 aa, Plasmodium falciparum
ITNQKSMLYRIFLKVMKSFKNLSVQQCIRN

SEQ ID NO: 3263463 - protein, 18 aa, Plasmodium falciparum
ITNYKWKDVTIILDTDNN

SEQ ID NO: 3263464 - protein, 23 aa, Plasmodium falciparum
ITPKEGIELHVIFKKHDIKALNE

SEQ ID NO: 3263465 - protein, 23 aa, Plasmodium falciparum
ITPNRRILPSITYIDKYTIYVNG

SEQ ID NO: 3263466 - protein, 25 aa, Plasmodium falciparum
ITPVSRFFLTFSLGVYTSMVINKIY

SEQ ID NO: 3263467 - protein, 23 aa, Plasmodium falciparum
ITRACSISLGFVMFQKEREADSL

SEQ ID NO: 3263468 - protein, 17 aa, Plasmodium falciparum
ITRKRFFNSNATLTDNS

SEQ ID NO: 3263469 - protein, 23 aa, Plasmodium falciparum
ITRRNCSLSVLTMLPKKGLPITC

SEQ ID NO: 3263470 - protein, 17 aa, Plasmodium falciparum
ITRSSCSYEEEFVDVDN

SEQ ID NO: 3263471 - protein, 20 aa, Plasmodium falciparum
ITSFLLWYLFLFLWFYYNIK

SEQ ID NO: 3263472 - protein, 28 aa, Plasmodium falciparum
ITSFLSSQCIFNFLPIYINLISQAFKKT

SEQ ID NO: 3263473 - protein, 17 aa, Plasmodium falciparum
ITSIYILLANNFIYDGR

SEQ ID NO: 3263474 - protein, 18 aa, Plasmodium falciparum
ITSKECFELSRDIVRTTI

SEQ ID NO: 3263475 - protein, 18 aa, Plasmodium falciparum
ITSLKIDSLFGIFLLIIS

SEQ ID NO: 3263476 - protein, 22 aa, Plasmodium falciparum
ITSYFVCAGIGGGIAAVLTNPL

SEQ ID NO: 3263477 - protein, 18 aa, Plasmodium falciparum
ITTCKRKILNITKNICSC

SEQ ID NO: 3263478 - protein, 23 aa, Plasmodium falciparum
ITTFFYDNCFSHIDIKTYCNDHT

SEQ ID NO: 3263479 - protein, 20 aa, Plasmodium falciparum
ITVALNIIKMILLNKKFTQF

SEQ ID NO: 3263480 - protein, 18 aa, Plasmodium falciparum
ITVTIQMIQIFKSIHLYI

SEQ ID NO: 3263481 - protein, 20 aa, Plasmodium falciparum
ITWAVTIYIFFGMINVSSYN

SEQ ID NO: 3263482 - protein, 20 aa, Plasmodium falciparum
ITYCMECIVCMKLSKNDNCL

SEQ ID NO: 3263483 - protein, 29 aa, Plasmodium falciparum
ITYEKIYNFLLQIILTGYMIKNADYRLTL

SEQ ID NO: 3263484 - protein, 18 aa, Plasmodium falciparum
ITYFFFKALHNYFKTKEE

SEQ ID NO: 3263485 - protein, 23 aa, Plasmodium falciparum
ITYILKYLSKILFSLSLQKFNID

SEQ ID NO: 3263486 - protein, 18 aa, Plasmodium falciparum
ITYKCAFSEIINDKNMII

SEQ ID NO: 3263487 - protein, 17 aa, Plasmodium falciparum
ITYKKKNEWILKREDNA

SEQ ID NO: 3263488 - protein, 20 aa, Plasmodium falciparum
ITYPFTRLFKNLSNSYKHNN

SEQ ID NO: 3263489 - protein, 25 aa, Plasmodium falciparum
ITYPWYVKESSFCFNIKKKKKIKIN

SEQ ID NO: 3263490 - protein, 25 aa, Plasmodium falciparum
ITYSSIICLLLFLLLSGITYMHYFI

SEQ ID NO: 3263491 - protein, 18 aa, Plasmodium falciparum
ITYYFKLIVNKIESKRLF

SEQ ID NO: 3263492 - protein, 18 aa, Plasmodium falciparum
IVADYENIYIISGEGLII

SEQ ID NO: 3263493 - protein, 17 aa, Plasmodium falciparum
IVAQFYSFEVCKKYYEN

SEQ ID NO: 3263494 - protein, 17 aa, Plasmodium falciparum
IVCNIIAYHIFISTDQN

SEQ ID NO: 3263495 - protein, 20 aa, Plasmodium falciparum
IVDAFKLIGINLSYDDLDKY

SEQ ID NO: 3263496 - protein, 22 aa, Plasmodium falciparum
IVDKTWLLWILIKLNIHKEEKY

SEQ ID NO: 3263497 - protein, 28 aa, Plasmodium falciparum
IVEDVKIFNKKQCELIYEILKCTVLFNY

SEQ ID NO: 3263498 - protein, 22 aa, Plasmodium falciparum
IVEKYSKCHLNIHNLNNDYINK

SEQ ID NO: 3263499 - protein, 18 aa, Plasmodium falciparum
IVESLLINLFKSIPQSDQ

SEQ ID NO: 3263500 - protein, 23 aa, Plasmodium falciparum
IVFFLCLLGIYVLPYTNNLPNKN

SEQ ID NO: 3263501 - protein, 35 aa, Plasmodium falciparum
IVFFPLYILLFFTRYHIRLLFVLLIFYILIIFIID

SEQ ID NO: 3263502 - protein, 21 aa, Plasmodium falciparum
IVFIFLMVFFKKEPIFRFNMP

SEQ ID NO: 3263503 - protein, 17 aa, Plasmodium falciparum
IVFSSSVSSVFVSLICT

SEQ ID NO: 3263504 - protein, 19 aa, Plasmodium falciparum
IVFTPFLIFLFKRILPQFI

SEQ ID NO: 3263505 - protein, 18 aa, Plasmodium falciparum
IVGACKWFLISKDSGKLF

SEQ ID NO: 3263506 - protein, 17 aa, Plasmodium falciparum
IVGGSLFVFGNLWNVTD

SEQ ID NO: 3263507 - protein, 29 aa, Plasmodium falciparum
IVHAKVPIIKCFFNYTKLSVDISFNQLSA

SEQ ID NO: 3263508 - protein, 19 aa, Plasmodium falciparum
IVHCGVEWGSQEYVLCNEK

SEQ ID NO: 3263509 - protein, 18 aa, Plasmodium falciparum
IVHTCDYYQPLYLKEDKE

SEQ ID NO: 3263510 - protein, 23 aa, Plasmodium falciparum
IVICLLVWLWPSRGKLMGKDKTE

SEQ ID NO: 3263511 - protein, 20 aa, Plasmodium falciparum
IVIFITFFYILLNILHDNLF

SEQ ID NO: 3263512 - protein, 19 aa, Plasmodium falciparum
IVIHYLLWNLINYIFNVNN

SEQ ID NO: 3263513 - protein, 18 aa, Plasmodium falciparum
IVIPCPQKNLLMHKNDKV

SEQ ID NO: 3263514 - protein, 19 aa, Plasmodium falciparum
IVISCTIVILSVGWNLLFS

SEQ ID NO: 3263515 - protein, 17 aa, Plasmodium falciparum
IVITLSLHVLKVPANIL

SEQ ID NO: 3263516 - protein, 26 aa, Plasmodium falciparum
IVKDFSNCIKIFFIFYKYGYILKKEL

SEQ ID NO: 3263517 - protein, 18 aa, Plasmodium falciparum
IVKEFTLSIHFIKTENIV

SEQ ID NO: 3263518 - protein, 20 aa, Plasmodium falciparum
IVKNDIYLFLQILKNIFYEL

SEQ ID NO: 3263519 - protein, 19 aa, Plasmodium falciparum
IVKREELRHLSNRAYYHDM

SEQ ID NO: 3263520 - protein, 17 aa, Plasmodium falciparum
IVLCFLYLLFLYISSTP

SEQ ID NO: 3263521 - protein, 32 aa, Plasmodium falciparum
IVLFRNMIKMALSFYFLYKINVHLFIVSLFIV

SEQ ID NO: 3263522 - protein, 20 aa, Plasmodium falciparum
IVLIDYNFLYSLKTDGKNQF

SEQ ID NO: 3263523 - protein, 23 aa, Plasmodium falciparum
IVLKKTCGFFITMNPGYAGRTEL

SEQ ID NO: 3263524 - protein, 18 aa, Plasmodium falciparum
IVLKRIHDPISFAQDIYD

SEQ ID NO: 3263525 - protein, 18 aa, Plasmodium falciparum
IVLLCIALMLLIIYLILR

SEQ ID NO: 3263526 - protein, 37 aa, Plasmodium falciparum
IVLLICIILLIKLGIPSTYLFAGRLTILFMLLFVIQI

SEQ ID NO: 3263527 - protein, 19 aa, Plasmodium falciparum
IVLPIPFILYIHNHIVYNY

SEQ ID NO: 3263528 - protein, 17 aa, Plasmodium falciparum
IVLRHTFNREIKFSSLF

SEQ ID NO: 3263529 - protein, 20 aa, Plasmodium falciparum
IVLSLLKYAHQYNMNVTKSN

SEQ ID NO: 3263530 - protein, 35 aa, Plasmodium falciparum
IVNHIRYPNSHTHYFSCLILFIFSQSNDIIIQEQI

SEQ ID NO: 3263531 - protein, 19 aa, Plasmodium falciparum
IVNIFLMQFFRVIEYHADD

SEQ ID NO: 3263532 - protein, 24 aa, Plasmodium falciparum
IVNKFKSDVFSLGLSLSTVLIENG

SEQ ID NO: 3263533 - protein, 23 aa, Plasmodium falciparum
IVNNFFFFFKIFQNVNNLLFSQN

SEQ ID NO: 3263534 - protein, 29 aa, Plasmodium falciparum
IVNNFLKNLAYRFLRLHYIHINLINNCIY

SEQ ID NO: 3263535 - protein, 25 aa, Plasmodium falciparum
IVNTIKSLVLYILILSLVLTSISLS

SEQ ID NO: 3263536 - protein, 23 aa, Plasmodium falciparum
IVNYFPFKIFLKNMLYYHKYQNE

SEQ ID NO: 3263537 - protein, 23 aa, Plasmodium falciparum
IVQKRLGERITILACSLMTFLAF

SEQ ID NO: 3263538 - protein, 25 aa, Plasmodium falciparum
IVQSLKRHTHVLIKRIIYDLKKIVH

SEQ ID NO: 3263539 - protein, 24 aa, Plasmodium falciparum
IVREYVFYKLLLKILSYFSYFYIF

SEQ ID NO: 3263540 - protein, 26 aa, Plasmodium falciparum
IVRNIKICIHFVINLIIPKCLNALKR

SEQ ID NO: 3263541 - protein, 24 aa, Plasmodium falciparum
IVRRGLMRGDLLIWSKILNKDDFY

SEQ ID NO: 3263542 - protein, 27 aa, Plasmodium falciparum
IVRYFIYKLFHTCFIYQIPNFIFYFFR

SEQ ID NO: 3263543 - protein, 21 aa, Plasmodium falciparum
IVSKRLPSYIKKEKINLTRNS

SEQ ID NO: 3263544 - protein, 23 aa, Plasmodium falciparum
IVSLQRIFICMQLYSLVLCAKKK

SEQ ID NO: 3263545 - protein, 22 aa, Plasmodium falciparum
IVSVGFCILIFMGKKSAKNYFS

SEQ ID NO: 3263546 - protein, 18 aa, Plasmodium falciparum
IVTCFLFFHIWLLINAMT

SEQ ID NO: 3263547 - protein, 19 aa, Plasmodium falciparum
IVTCVLYYLNIYRKNERLI

SEQ ID NO: 3263548 - protein, 25 aa, Plasmodium falciparum
IVTILPLSIFMCWTSASEKLSKNIP

SEQ ID NO: 3263549 - protein, 18 aa, Plasmodium falciparum
IVTIVSMISALAFFEMYK

SEQ ID NO: 3263550 - protein, 30 aa, Plasmodium falciparum
IVTKYDYLLCVSLFSSYLINKEKSSKDADK

SEQ ID NO: 3263551 - protein, 18 aa, Plasmodium falciparum
IVTLMKFLFEKKLTVNDL

SEQ ID NO: 3263552 - protein, 39 aa, Plasmodium falciparum
IVTVSTLCFLTSPTSGVWFGGFVCDLFGGYKNTNYSKTI

SEQ ID NO: 3263553 - protein, 23 aa, Plasmodium falciparum
IVVDGWKWLINYLSEEVQNKIFL

SEQ ID NO: 3263554 - protein, 17 aa, Plasmodium falciparum
IVVFFIWFILTFFDIVN

SEQ ID NO: 3263555 - protein, 18 aa, Plasmodium falciparum
IVVKGVLLYAHFREHPET

SEQ ID NO: 3263556 - protein, 17 aa, Plasmodium falciparum
IVVLKRRVGIYTYDSSK

SEQ ID NO: 3263557 - protein, 18 aa, Plasmodium falciparum
IVWIYKYILLFLNIQIYC

SEQ ID NO: 3263558 - protein, 17 aa, Plasmodium falciparum
IVYFFNYSLMFKFFIYV

SEQ ID NO: 3263559 - protein, 17 aa, Plasmodium falciparum
IVYKNNYGFLYVNSKNI

SEQ ID NO: 3263560 - protein, 18 aa, Plasmodium falciparum
IVYMFSISLFFTNILYNI

SEQ ID NO: 3263561 - protein, 17 aa, Plasmodium falciparum
IVYSAKFGTNDIIKDKL

SEQ ID NO: 3263562 - protein, 20 aa, Plasmodium falciparum
IVYSRHCAIMDLFYFSVYEI

SEQ ID NO: 3263563 - protein, 23 aa, Plasmodium falciparum
IWFLMSTWHGVIFIVPYILCYFF

SEQ ID NO: 3263564 - protein, 18 aa, Plasmodium falciparum
IWFTLLLKNLNYITENCI

SEQ ID NO: 3263565 - protein, 22 aa, Plasmodium falciparum
IWHIDICILLFLLYVIIPIEFI

SEQ ID NO: 3263566 - protein, 22 aa, Plasmodium falciparum
IWIISLFCFATYVLHKILKTCA

SEQ ID NO: 3263567 - protein, 17 aa, Plasmodium falciparum
IWLGRTFLNCSILKKQY

SEQ ID NO: 3263568 - protein, 22 aa, Plasmodium falciparum
IWNGMICALTYRDSEEKGGTPT

SEQ ID NO: 3263569 - protein, 17 aa, Plasmodium falciparum
IWNGMLCGLSYDTKTKH

SEQ ID NO: 3263570 - protein, 37 aa, Plasmodium falciparum
IWSLIKNARLTLCITCVFPLIYVCGVICNKKVKLNKK

SEQ ID NO: 3263571 - protein, 25 aa, Plasmodium falciparum
IWYDYWKFDFWFPFSSIEYNLQPSF

SEQ ID NO: 3263572 - protein, 21 aa, Plasmodium falciparum
IWYSRAYKYALFCIKYFDKFC

SEQ ID NO: 3263573 - protein, 18 aa, Plasmodium falciparum
IYAKCAIQKMREGNVFSY

SEQ ID NO: 3263574 - protein, 18 aa, Plasmodium falciparum
IYALSLLERIFYRKEKEN

SEQ ID NO: 3263575 - protein, 17 aa, Plasmodium falciparum
IYASYIFIICAVILLLF

SEQ ID NO: 3263576 - protein, 17 aa, Plasmodium falciparum
IYCFFIITVHGGLENDL

SEQ ID NO: 3263577 - protein, 17 aa, Plasmodium falciparum
IYCKNGYHFIYKTNKIE

SEQ ID NO: 3263578 - protein, 37 aa, Plasmodium falciparum
IYDDTKKCYFIFYKNKCTSCLITHNILNVPIEGIKKK

SEQ ID NO: 3263579 - protein, 18 aa, Plasmodium falciparum
IYDHVFFLLNYHCINNEE

SEQ ID NO: 3263580 - protein, 17 aa, Plasmodium falciparum
IYDHYMSVMSFIDKWNK

SEQ ID NO: 3263581 - protein, 22 aa, Plasmodium falciparum
IYDIIKNFYITIEYDERKNKCL

SEQ ID NO: 3263582 - protein, 24 aa, Plasmodium falciparum
IYDIPCPCFKELLYESMLSPFFIF

SEQ ID NO: 3263583 - protein, 25 aa, Plasmodium falciparum
IYDIYDYLFIYKMSDISFKCACKFL

SEQ ID NO: 3263584 - protein, 18 aa, Plasmodium falciparum
IYDKANKRWKLRNQRIYK

SEQ ID NO: 3263585 - protein, 17 aa, Plasmodium falciparum
IYDKILFYNIYKKLQTQ

SEQ ID NO: 3263586 - protein, 17 aa, Plasmodium falciparum
IYDKLFIYKYLIILNYK

SEQ ID NO: 3263587 - protein, 18 aa, Plasmodium falciparum
IYDKLKLFKGKTNMKSSI

SEQ ID NO: 3263588 - protein, 19 aa, Plasmodium falciparum
IYDKYVCFILNQNVKSLND

SEQ ID NO: 3263589 - protein, 25 aa, Plasmodium falciparum
IYDLGRSDAHLWLFVEYLNVGIYLY

SEQ ID NO: 3263590 - protein, 23 aa, Plasmodium falciparum
IYDLYMYLEFLRRKNKVPHEYAG

SEQ ID NO: 3263591 - protein, 17 aa, Plasmodium falciparum
IYDNYGLSKEINEINLI

SEQ ID NO: 3263592 - protein, 19 aa, Plasmodium falciparum
IYDSYKILYDTLLEKMEIY

SEQ ID NO: 3263593 - protein, 25 aa, Plasmodium falciparum
IYEARNRIGGKFFFSTRTDKSYIGQ

SEQ ID NO: 3263594 - protein, 17 aa, Plasmodium falciparum
IYECTNCVIYILIMLVV

SEQ ID NO: 3263595 - protein, 28 aa, Plasmodium falciparum
IYEDILSCLCFFPNLKYIKKSETNDLEK

SEQ ID NO: 3263596 - protein, 17 aa, Plasmodium falciparum
IYEDLFLIYNKNIQVYK

SEQ ID NO: 3263597 - protein, 25 aa, Plasmodium falciparum
IYEEALRFYISVNVPSNFGQITDNE

SEQ ID NO: 3263598 - protein, 24 aa, Plasmodium falciparum
IYEFFICLCEKYTILSTYLNTLFF

SEQ ID NO: 3263599 - protein, 25 aa, Plasmodium falciparum
IYEIFKIIKKDGIICGFFRGNCVNI

SEQ ID NO: 3263600 - protein, 28 aa, Plasmodium falciparum
IYEIIKNKIFYFFTFFKVEKNLINLFFK

SEQ ID NO: 3263601 - protein, 18 aa, Plasmodium falciparum
IYEILAYNFNHLDSYQYN

SEQ ID NO: 3263602 - protein, 21 aa, Plasmodium falciparum
IYEILLKLSKFLNIKFDLNFD

SEQ ID NO: 3263603 - protein, 17 aa, Plasmodium falciparum
IYEKILIIVCVINYDMD

SEQ ID NO: 3263604 - protein, 26 aa, Plasmodium falciparum
IYELIKEILKIKVISLCMNKQIMFAS

SEQ ID NO: 3263605 - protein, 19 aa, Plasmodium falciparum
IYELISYDMLICMTKINSL

SEQ ID NO: 3263606 - protein, 25 aa, Plasmodium falciparum
IYELNKCKSYRSIMIKDIQNKIDYK

SEQ ID NO: 3263607 - protein, 24 aa, Plasmodium falciparum
IYERLRTKVLWYIQKIEYLKFKYQ

SEQ ID NO: 3263608 - protein, 29 aa, Plasmodium falciparum
IYETFDLLFSVVCILFNYEFFNFYMEKKI

SEQ ID NO: 3263609 - protein, 39 aa, Plasmodium falciparum
IYFCCCLDYIDIISLKMFIHNFIKTCVIPYISMLTNDIN

SEQ ID NO: 3263610 - protein, 17 aa, Plasmodium falciparum
IYFDTFGKYASITHIPN

SEQ ID NO: 3263611 - protein, 19 aa, Plasmodium falciparum
IYFFKSCDNNIIIIYDKYK

SEQ ID NO: 3263612 - protein, 19 aa, Plasmodium falciparum
IYFFLKYSPIISFEKYRSI

SEQ ID NO: 3263613 - protein, 20 aa, Plasmodium falciparum
IYFICPNYMYINNIYNNINM

SEQ ID NO: 3263614 - protein, 24 aa, Plasmodium falciparum
IYFIFCDYLKKLFRYGNYFVQVLV

SEQ ID NO: 3263615 - protein, 17 aa, Plasmodium falciparum
IYFILSIYSCRKNNNMI

SEQ ID NO: 3263616 - protein, 17 aa, Plasmodium falciparum
IYFIVYGNIQFDDITQN

SEQ ID NO: 3263617 - protein, 18 aa, Plasmodium falciparum
IYFIYIKVLIDFYNKKED

SEQ ID NO: 3263618 - protein, 17 aa, Plasmodium falciparum
IYFLCFLSFLYGIRKFN

SEQ ID NO: 3263619 - protein, 34 aa, Plasmodium falciparum
IYFLCKYSSGYLPLERIIKLFMDVIFGHFIKFIN

SEQ ID NO: 3263620 - protein, 17 aa, Plasmodium falciparum
IYFLFIIPLNEVIYNKY

SEQ ID NO: 3263621 - protein, 18 aa, Plasmodium falciparum
IYFLIKKLKVEIIEPSII

SEQ ID NO: 3263622 - protein, 27 aa, Plasmodium falciparum
IYFLILHRFIFFYILRGIFYKYKEFLL

SEQ ID NO: 3263623 - protein, 17 aa, Plasmodium falciparum
IYFLLLKYMSIFFPRNN

SEQ ID NO: 3263624 - protein, 18 aa, Plasmodium falciparum
IYFLVLPSIFLFPLCNEF

SEQ ID NO: 3263625 - protein, 18 aa, Plasmodium falciparum
IYFNFLFNIHYLHNLNDH

SEQ ID NO: 3263626 - protein, 19 aa, Plasmodium falciparum
IYFRGTLRDLDVSYLNIKV

SEQ ID NO: 3263627 - protein, 23 aa, Plasmodium falciparum
IYFRKEFVNEINFECIEKEERWY

SEQ ID NO: 3263628 - protein, 22 aa, Plasmodium falciparum
IYFRLYECFKKKKTLENINPND

SEQ ID NO: 3263629 - protein, 24 aa, Plasmodium falciparum
IYFSRSNKVLILMCVIFFSCSTHI

SEQ ID NO: 3263630 - protein, 17 aa, Plasmodium falciparum
IYFTYFKQINVIEGLLI

SEQ ID NO: 3263631 - protein, 17 aa, Plasmodium falciparum
IYFVCRFLISKTFCDNS

SEQ ID NO: 3263632 - protein, 18 aa, Plasmodium falciparum
IYFVINFVHEKLYSMTTK

SEQ ID NO: 3263633 - protein, 23 aa, Plasmodium falciparum
IYFVLACVLLIYIRIRNKATSTF

SEQ ID NO: 3263634 - protein, 17 aa, Plasmodium falciparum
IYGCVLNSLSFPTIQIN

SEQ ID NO: 3263635 - protein, 20 aa, Plasmodium falciparum
IYGDCIYDNYGLSKEINEIN

SEQ ID NO: 3263636 - protein, 22 aa, Plasmodium falciparum
IYGEVINILYIIKDDDIKNYIN

SEQ ID NO: 3263637 - protein, 20 aa, Plasmodium falciparum
IYGHMYGHMYDLFNINKNSY

SEQ ID NO: 3263638 - protein, 24 aa, Plasmodium falciparum
IYGILSFIKICYGNYASYSNNTYL

SEQ ID NO: 3263639 - protein, 22 aa, Plasmodium falciparum
IYGKTFFRHVVFYMYEGIANVF

SEQ ID NO: 3263640 - protein, 29 aa, Plasmodium falciparum
IYGRAALLMFLQFYESWIVFIKTFLTSEK

SEQ ID NO: 3263641 - protein, 26 aa, Plasmodium falciparum
IYGRKICLNISFFILLIIFILSFITV

SEQ ID NO: 3263642 - protein, 23 aa, Plasmodium falciparum
IYGSLKYLLYFLSNKLICKKKIK

SEQ ID NO: 3263643 - protein, 17 aa, Plasmodium falciparum
IYHCIKNEINYEYNSEL

SEQ ID NO: 3263644 - protein, 25 aa, Plasmodium falciparum
IYHIKIYFIYIDFLVLKIICLFLLV

SEQ ID NO: 3263645 - protein, 18 aa, Plasmodium falciparum
IYHILSFEKNQKLFFNKI

SEQ ID NO: 3263646 - protein, 17 aa, Plasmodium falciparum
IYHRLDGYCLKYIDKKI

SEQ ID NO: 3263647 - protein, 20 aa, Plasmodium falciparum
IYHTSFEICYDYKEIEEHDI

SEQ ID NO: 3263648 - protein, 21 aa, Plasmodium falciparum
IYICYRFFGHHYIINCMIQIF

SEQ ID NO: 3263649 - protein, 26 aa, Plasmodium falciparum
IYIFFCLTLHVFICITQYYNNNKGLC

SEQ ID NO: 3263650 - protein, 17 aa, Plasmodium falciparum
IYIFQFFNNLIRRDILY

SEQ ID NO: 3263651 - protein, 24 aa, Plasmodium falciparum
IYIICVNLGLGFPKEQVRTEFFNY

SEQ ID NO: 3263652 - protein, 19 aa, Plasmodium falciparum
IYIIIPTFISLILQIYHVE

SEQ ID NO: 3263653 - protein, 25 aa, Plasmodium falciparum
IYIIITCAFGFISAIYIIHIFINKW

SEQ ID NO: 3263654 - protein, 19 aa, Plasmodium falciparum
IYIILKQKFLNKLNEIIQN

SEQ ID NO: 3263655 - protein, 24 aa, Plasmodium falciparum
IYIKHKFIQLSFIFFIIIFKYFIF

SEQ ID NO: 3263656 - protein, 17 aa, Plasmodium falciparum
IYIKNVLLYCLCSCLCY

SEQ ID NO: 3263657 - protein, 25 aa, Plasmodium falciparum
IYILLEISLLLSYHNYFNCFSYNPN

SEQ ID NO: 3263658 - protein, 20 aa, Plasmodium falciparum
IYINDCFINSTICFFLSLIL

SEQ ID NO: 3263659 - protein, 18 aa, Plasmodium falciparum
IYIPETFLSLYLGLSNLV

SEQ ID NO: 3263660 - protein, 18 aa, Plasmodium falciparum
IYIPFIYKTYKILLQIFD

SEQ ID NO: 3263661 - protein, 25 aa, Plasmodium falciparum
IYIQNFRHPSRFISEEAYSFTQFCS

SEQ ID NO: 3263662 - protein, 27 aa, Plasmodium falciparum
IYIQVITFFYLFHIIKCVHIISYNNAR

SEQ ID NO: 3263663 - protein, 25 aa, Plasmodium falciparum
IYISKRAFSVFLFYLFFFLFFHFYF

SEQ ID NO: 3263664 - protein, 18 aa, Plasmodium falciparum
IYISLFFNNYINHNLLKR

SEQ ID NO: 3263665 - protein, 18 aa, Plasmodium falciparum
IYISLHFLNNIILKLNYN

SEQ ID NO: 3263666 - protein, 26 aa, Plasmodium falciparum
IYISRKQNMCIIIGTIKIDHMFCTCS

SEQ ID NO: 3263667 - protein, 17 aa, Plasmodium falciparum
IYISYAYYYYNKNEYTN

SEQ ID NO: 3263668 - protein, 18 aa, Plasmodium falciparum
IYISYFLFCHHLFNIFLR

SEQ ID NO: 3263669 - protein, 23 aa, Plasmodium falciparum
IYIYECLYTLLNIYHYNNNNNNN

SEQ ID NO: 3263670 - protein, 21 aa, Plasmodium falciparum
IYIYYFSVCLINIKIKNNNFV

SEQ ID NO: 3263671 - protein, 24 aa, Plasmodium falciparum
IYKCKQTNVLKIFYQVEGKIKDNI

SEQ ID NO: 3263672 - protein, 19 aa, Plasmodium falciparum
IYKDFKKVFQIEEQMRQMN

SEQ ID NO: 3263673 - protein, 17 aa, Plasmodium falciparum
IYKDIKNFISINEHKSI

SEQ ID NO: 3263674 - protein, 27 aa, Plasmodium falciparum
IYKFNIPRITFTWIHRQDVIIAIHLTQ

SEQ ID NO: 3263675 - protein, 21 aa, Plasmodium falciparum
IYKILFTKKMKVRRMKHYFFD

SEQ ID NO: 3263676 - protein, 20 aa, Plasmodium falciparum
IYKKRIELHKEDYFSNFFFF

SEQ ID NO: 3263677 - protein, 21 aa, Plasmodium falciparum
IYKKYRLIFFAVILKPILLII

SEQ ID NO: 3263678 - protein, 20 aa, Plasmodium falciparum
IYKLIKCISKIFYPLKNQNI

SEQ ID NO: 3263679 - protein, 25 aa, Plasmodium falciparum
IYKLLIKSIYFFKGDINYDNLMAVM

SEQ ID NO: 3263680 - protein, 21 aa, Plasmodium falciparum
IYKLLNRIQVTVTFGKGNIYS

SEQ ID NO: 3263681 - protein, 22 aa, Plasmodium falciparum
IYKMKHKLSRCYIKEETNKNKK

SEQ ID NO: 3263682 - protein, 25 aa, Plasmodium falciparum
IYKNIMHPIFFPGYYNTIHFRYYNY

SEQ ID NO: 3263683 - protein, 24 aa, Plasmodium falciparum
IYKNNKLYECIQIKKDVDELYNIY

SEQ ID NO: 3263684 - protein, 22 aa, Plasmodium falciparum
IYKNVFKKVLIKISKSKSINDL

SEQ ID NO: 3263685 - protein, 21 aa, Plasmodium falciparum
IYKTPLCLIFTPKEILITCIL

SEQ ID NO: 3263686 - protein, 36 aa, Plasmodium falciparum
IYKYELRNEFFRVIKKLRYSYEHLFNMKHINNNVKN

SEQ ID NO: 3263687 - protein, 18 aa, Plasmodium falciparum
IYKYPTLGGDEYFITFQG

SEQ ID NO: 3263688 - protein, 18 aa, Plasmodium falciparum
IYLCCKLNIMKRIKNKNF

SEQ ID NO: 3263689 - protein, 24 aa, Plasmodium falciparum
IYLCSRNYLEFILNSIIEFENFKK

SEQ ID NO: 3263690 - protein, 25 aa, Plasmodium falciparum
IYLCTCILFSFLVGIFIMPGKSTNN

SEQ ID NO: 3263691 - protein, 17 aa, Plasmodium falciparum
IYLDIFQFFKILKQKNF

SEQ ID NO: 3263692 - protein, 40 aa, Plasmodium falciparum
IYLETMVWIGLSEVFIYLNVCPKLIIYFFHIINTYINFYL

SEQ ID NO: 3263693 - protein, 39 aa, Plasmodium falciparum
IYLEVFLCILEKLKYKCPLLKDHITNIIMFNKNKYDNVS

SEQ ID NO: 3263694 - protein, 18 aa, Plasmodium falciparum
IYLFCYIFLIHYLCYTFK

SEQ ID NO: 3263695 - protein, 17 aa, Plasmodium falciparum
IYLFLQILKNIFYELYT

SEQ ID NO: 3263696 - protein, 25 aa, Plasmodium falciparum
IYLHWKNILLFISFLNKNEIKEGNF

SEQ ID NO: 3263697 - protein, 19 aa, Plasmodium falciparum
IYLILRYGRKKKMKKKLQY

SEQ ID NO: 3263698 - protein, 19 aa, Plasmodium falciparum
IYLILRYRRKIKMNKKLQY

SEQ ID NO: 3263699 - protein, 20 aa, Plasmodium falciparum
IYLILRYRRKIKMNKKLQYI

SEQ ID NO: 3263700 - protein, 23 aa, Plasmodium falciparum
IYLKCKKDLISLEKITLEALEKG

SEQ ID NO: 3263701 - protein, 23 aa, Plasmodium falciparum
IYLKDDFVKYISFFYIKPQDTNI

SEQ ID NO: 3263702 - protein, 17 aa, Plasmodium falciparum
IYLKLYNTFKFIMNNIY

SEQ ID NO: 3263703 - protein, 19 aa, Plasmodium falciparum
IYLLAHFLVLSLAYLSYNE

SEQ ID NO: 3263704 - protein, 34 aa, Plasmodium falciparum
IYLLKELSNMFSFLLDIIKICFFNNYKNNYNKLI

SEQ ID NO: 3263705 - protein, 26 aa, Plasmodium falciparum
IYLLLCICALLLYFFIFCLSIKEYKD

SEQ ID NO: 3263706 - protein, 22 aa, Plasmodium falciparum
IYLLRRHFHIWKYYIDKKKEYK

SEQ ID NO: 3263707 - protein, 19 aa, Plasmodium falciparum
IYLLWRKIRPSKKKTKKFL

SEQ ID NO: 3263708 - protein, 18 aa, Plasmodium falciparum
IYLNGWFVIMSFINVPEI

SEQ ID NO: 3263709 - protein, 20 aa, Plasmodium falciparum
IYLNKEIKINISYFQIIKIL

SEQ ID NO: 3263710 - protein, 23 aa, Plasmodium falciparum
IYLPLIRKKIRMSKNYFDLQLKK

SEQ ID NO: 3263711 - protein, 18 aa, Plasmodium falciparum
IYLSIAIICRFLYIVGSF

SEQ ID NO: 3263712 - protein, 23 aa, Plasmodium falciparum
IYLSRNCPLFNLILNPVGENKVE

SEQ ID NO: 3263713 - protein, 17 aa, Plasmodium falciparum
IYLSSTMGFPFKIKKNS

SEQ ID NO: 3263714 - protein, 21 aa, Plasmodium falciparum
IYLVENIHIYILFKKIHQTNI

SEQ ID NO: 3263715 - protein, 25 aa, Plasmodium falciparum
IYLVKRRNIKFFLIFTNTVRLLIWG

SEQ ID NO: 3263716 - protein, 20 aa, Plasmodium falciparum
IYLYIIQNWIHFYKLNKNKK

SEQ ID NO: 3263717 - protein, 24 aa, Plasmodium falciparum
IYLYKSLNVLLIFFIPTMLGIDNN

SEQ ID NO: 3263718 - protein, 28 aa, Plasmodium falciparum
IYLYRDCIISFFLLYIFILYLYKYYNHI

SEQ ID NO: 3263719 - protein, 31 aa, Plasmodium falciparum
IYMIRDCIFIFPFVIILIYFFVFKRFSRGCK

SEQ ID NO: 3263720 - protein, 19 aa, Plasmodium falciparum
IYMKKACELYHKRGKDGDR

SEQ ID NO: 3263721 - protein, 22 aa, Plasmodium falciparum
IYMNVHLCIISFELLSTYISKN

SEQ ID NO: 3263722 - protein, 19 aa, Plasmodium falciparum
IYNCFLFLLEIIKLSIHTG

SEQ ID NO: 3263723 - protein, 26 aa, Plasmodium falciparum
IYNCSLCKCTFNFNKIFHFFEKTYHE

SEQ ID NO: 3263724 - protein, 24 aa, Plasmodium falciparum
IYNDMFLRIGKIVTNKRKKYFLIY

SEQ ID NO: 3263725 - protein, 20 aa, Plasmodium falciparum
IYNECITFFLKTHQFLKEEE

SEQ ID NO: 3263726 - protein, 17 aa, Plasmodium falciparum
IYNEICEYKVKLKKFKD

SEQ ID NO: 3263727 - protein, 17 aa, Plasmodium falciparum
IYNENKDMCSLDEDILY

SEQ ID NO: 3263728 - protein, 26 aa, Plasmodium falciparum
IYNFKDIRLFIKIFLRYYKKEQETFN

SEQ ID NO: 3263729 - protein, 26 aa, Plasmodium falciparum
IYNFRCKHCNYVLFNDNEIIKHDFKI

SEQ ID NO: 3263730 - protein, 17 aa, Plasmodium falciparum
IYNFVGLFMSFVNLIFV

SEQ ID NO: 3263731 - protein, 32 aa, Plasmodium falciparum
IYNFYLRKDIIQFFTCNLIQLYIKDTKNCDLY

SEQ ID NO: 3263732 - protein, 25 aa, Plasmodium falciparum
IYNIEEWYYIYPIIIILSLNYSKYI

SEQ ID NO: 3263733 - protein, 18 aa, Plasmodium falciparum
IYNILTIYQDNHIKDEQK

SEQ ID NO: 3263734 - protein, 26 aa, Plasmodium falciparum
IYNKFFYKKREFFKDNKIQLSMRRKK

SEQ ID NO: 3263735 - protein, 18 aa, Plasmodium falciparum
IYNKIIFSKIIKRATIIS

SEQ ID NO: 3263736 - protein, 28 aa, Plasmodium falciparum
IYNLDVHYKLMFFKSIYTLNFYNSPFLK

SEQ ID NO: 3263737 - protein, 19 aa, Plasmodium falciparum
IYNLECKFLEKLKKAGSFH

SEQ ID NO: 3263738 - protein, 20 aa, Plasmodium falciparum
IYNLEVCNKNIFGKYSSNWQ

SEQ ID NO: 3263739 - protein, 20 aa, Plasmodium falciparum
IYNLKDWLFSRQRYWGEPFP

SEQ ID NO: 3263740 - protein, 26 aa, Plasmodium falciparum
IYNNELLYFLKIFFFFYDNEVYNKYN

SEQ ID NO: 3263741 - protein, 17 aa, Plasmodium falciparum
IYNSCIVLNSLVHLNIL

SEQ ID NO: 3263742 - protein, 18 aa, Plasmodium falciparum
IYNSESWKKSLHILCKHN

SEQ ID NO: 3263743 - protein, 18 aa, Plasmodium falciparum
IYNSLSFGYVKKIELYEY

SEQ ID NO: 3263744 - protein, 17 aa, Plasmodium falciparum
IYNVYYIYMWRQKQESF

SEQ ID NO: 3263745 - protein, 18 aa, Plasmodium falciparum
IYNWKLGIRCLNKYLDLS

SEQ ID NO: 3263746 - protein, 19 aa, Plasmodium falciparum
IYNWYNKRLIYFIRKKIEI

SEQ ID NO: 3263747 - protein, 18 aa, Plasmodium falciparum
IYPCEITPFTKIEKWYNN

SEQ ID NO: 3263748 - protein, 29 aa, Plasmodium falciparum
IYPQLYVSCIISLFYLFILDNEIFEKYFN

SEQ ID NO: 3263749 - protein, 31 aa, Plasmodium falciparum
IYQEIKNLLLCIGFVEIYIFYVMIKVDTLLL

SEQ ID NO: 3263750 - protein, 27 aa, Plasmodium falciparum
IYQKRILYCVFYINIGVITSFLILMNS

SEQ ID NO: 3263751 - protein, 25 aa, Plasmodium falciparum
IYQKRTNFELSLFILKNKNNEKIQN

SEQ ID NO: 3263752 - protein, 22 aa, Plasmodium falciparum
IYQQEIIKDFIIDNEKPLDENG

SEQ ID NO: 3263753 - protein, 26 aa, Plasmodium falciparum
IYQSFIKYDVDIINSLTLYVGTYICK

SEQ ID NO: 3263754 - protein, 18 aa, Plasmodium falciparum
IYQSFPIYQIKNFSKDNE

SEQ ID NO: 3263755 - protein, 18 aa, Plasmodium falciparum
IYREIKFVLKTNNPSLLC

SEQ ID NO: 3263756 - protein, 19 aa, Plasmodium falciparum
IYRKNKYNICINIINIILK

SEQ ID NO: 3263757 - protein, 24 aa, Plasmodium falciparum
IYRLKIKQICNILNFINSSYNIKL

SEQ ID NO: 3263758 - protein, 21 aa, Plasmodium falciparum
IYRVDILIFFLLFIQNKKTKN

SEQ ID NO: 3263759 - protein, 23 aa, Plasmodium falciparum
IYSFGVILWEMIHRKIPFSDMKN

SEQ ID NO: 3263760 - protein, 28 aa, Plasmodium falciparum
IYSFLIFYIICCLFYFFFSTNLKTTLSL

SEQ ID NO: 3263761 - protein, 17 aa, Plasmodium falciparum
IYSGMIWFIVPVSSVVI

SEQ ID NO: 3263762 - protein, 19 aa, Plasmodium falciparum
IYSIISIFCLFDYNNVNRT

SEQ ID NO: 3263763 - protein, 23 aa, Plasmodium falciparum
IYSIPLYFLKDFFRNDDNIVSSK

SEQ ID NO: 3263764 - protein, 19 aa, Plasmodium falciparum
IYSKCSWLTMFKIHKPYFI

SEQ ID NO: 3263765 - protein, 19 aa, Plasmodium falciparum
IYSLCSMIYYYLGNEKYVE

SEQ ID NO: 3263766 - protein, 18 aa, Plasmodium falciparum
IYSLIFFSFCFMWTIGDY

SEQ ID NO: 3263767 - protein, 19 aa, Plasmodium falciparum
IYSLYYFNRVIKWYNYILP

SEQ ID NO: 3263768 - protein, 17 aa, Plasmodium falciparum
IYSSGIYLLDCSTHLYL

SEQ ID NO: 3263769 - protein, 17 aa, Plasmodium falciparum
IYSSINILYNILEVTKK

SEQ ID NO: 3263770 - protein, 17 aa, Plasmodium falciparum
IYSSQLFNINKYEKFIK

SEQ ID NO: 3263771 - protein, 17 aa, Plasmodium falciparum
IYSTCFVVNEGNPNLRN

SEQ ID NO: 3263772 - protein, 31 aa, Plasmodium falciparum
IYSWITIFLDIIFKKIFSFINITSLYNSRGT

SEQ ID NO: 3263773 - protein, 18 aa, Plasmodium falciparum
IYTFISYFGFFQVSSDFF

SEQ ID NO: 3263774 - protein, 28 aa, Plasmodium falciparum
IYTKRYIFKFLKYFTIKKKFTDIVITKI

SEQ ID NO: 3263775 - protein, 24 aa, Plasmodium falciparum
IYTLMCISHFLVIMSKFKKCKSYL

SEQ ID NO: 3263776 - protein, 19 aa, Plasmodium falciparum
IYTNLYGDRYVRLHTTHMN

SEQ ID NO: 3263777 - protein, 21 aa, Plasmodium falciparum
IYTRKSFCIDKNYNMNISYNR

SEQ ID NO: 3263778 - protein, 18 aa, Plasmodium falciparum
IYTRYKGLHFDKDAFIFK

SEQ ID NO: 3263779 - protein, 28 aa, Plasmodium falciparum
IYTSYDISLCILKWYIYQIYRYEEEKKK

SEQ ID NO: 3263780 - protein, 23 aa, Plasmodium falciparum
IYTYSSLVPIVFGVSLASIKELS

SEQ ID NO: 3263781 - protein, 17 aa, Plasmodium falciparum
IYVFFYLFVHINNIINS

SEQ ID NO: 3263782 - protein, 24 aa, Plasmodium falciparum
IYVGLPIFLIPWLLKLRNQPELFY

SEQ ID NO: 3263783 - protein, 29 aa, Plasmodium falciparum
IYVIKCSRKEQKLFFLVEAEKRIHITEWK

SEQ ID NO: 3263784 - protein, 18 aa, Plasmodium falciparum
IYVILRLLLTEMKKNLHN

SEQ ID NO: 3263785 - protein, 30 aa, Plasmodium falciparum
IYVVFRILAYTTLCIFLYIGSYTSELQIRY

SEQ ID NO: 3263786 - protein, 29 aa, Plasmodium falciparum
IYVYKFKICNFVLNKIEFIHISKYIIYII

SEQ ID NO: 3263787 - protein, 18 aa, Plasmodium falciparum
IYVYPSFIKNIIKPLENA

SEQ ID NO: 3263788 - protein, 17 aa, Plasmodium falciparum
IYYDYLFICFDKQDVTT

SEQ ID NO: 3263789 - protein, 17 aa, Plasmodium falciparum
IYYEGEILKSFNYYIKP

SEQ ID NO: 3263790 - protein, 18 aa, Plasmodium falciparum
IYYEKYIGLKNLYKTFDL

SEQ ID NO: 3263791 - protein, 20 aa, Plasmodium falciparum
IYYFFIKGYISLVLVNINRA

SEQ ID NO: 3263792 - protein, 22 aa, Plasmodium falciparum
IYYFKVPRFIASIISLVCSFLL

SEQ ID NO: 3263793 - protein, 19 aa, Plasmodium falciparum
IYYFLTLHRLKNVWYIYII

SEQ ID NO: 3263794 - protein, 17 aa, Plasmodium falciparum
IYYFNYFLVDLSSQLSF

SEQ ID NO: 3263795 - protein, 18 aa, Plasmodium falciparum
IYYIALYLLCILKKKDVF

SEQ ID NO: 3263796 - protein, 19 aa, Plasmodium falciparum
IYYILNCIYMLIKLIKQKD

SEQ ID NO: 3263797 - protein, 27 aa, Plasmodium falciparum
IYYILRTYLFLLLYNSFHIIRENCYYP

SEQ ID NO: 3263798 - protein, 20 aa, Plasmodium falciparum
IYYIYIILIILCFEKKVCTD

SEQ ID NO: 3263799 - protein, 33 aa, Plasmodium falciparum
IYYKEVSSLLCHICNLLICFPWITNGYNNKENE

SEQ ID NO: 3263800 - protein, 17 aa, Plasmodium falciparum
IYYKKLITFFKKCYKKN

SEQ ID NO: 3263801 - protein, 22 aa, Plasmodium falciparum
IYYKYHIWRIFLNFLYVGKFSL

SEQ ID NO: 3263802 - protein, 19 aa, Plasmodium falciparum
IYYKYRYVRGTLKNIITKM

SEQ ID NO: 3263803 - protein, 20 aa, Plasmodium falciparum
IYYLIYCINLSIFSCNYEGL

SEQ ID NO: 3263804 - protein, 17 aa, Plasmodium falciparum
IYYNIYIHRDILTHSYN

SEQ ID NO: 3263805 - protein, 31 aa, Plasmodium falciparum
IYYNKCFLSYNISCSFLFKQEKLSSMKKRYA

SEQ ID NO: 3263806 - protein, 19 aa, Plasmodium falciparum
IYYNYVYKYKNLISPHILN

SEQ ID NO: 3263807 - protein, 19 aa, Plasmodium falciparum
IYYPCCTEEQEIIIYYEVD

SEQ ID NO: 3263808 - protein, 18 aa, Plasmodium falciparum
IYYWIIKNSWSKKWGENG

SEQ ID NO: 3263809 - protein, 29 aa, Plasmodium falciparum
IYYYILIVSICYKDKNFLSLLLSKYELFY

SEQ ID NO: 3263810 - protein, 18 aa, Plasmodium falciparum
IYYYYTALNKYKIILTHL

SEQ ID NO: 3263811 - protein, 18 aa, Plasmodium falciparum
KAAACASSTVSVEVSSIV

SEQ ID NO: 3263812 - protein, 29 aa, Plasmodium falciparum
KAAKVPEKRPLGIKLHWQLLPTHKIEGTV

SEQ ID NO: 3263813 - protein, 19 aa, Plasmodium falciparum
KAAVASLVYYGEAFQNCVS

SEQ ID NO: 3263814 - protein, 20 aa, Plasmodium falciparum
KACKEVKDGGKIHFEKVNST

SEQ ID NO: 3263815 - protein, 20 aa, Plasmodium falciparum
KACKEVKDGGTIDFKQVNST

SEQ ID NO: 3263816 - protein, 22 aa, Plasmodium falciparum
KADKELSEALPIMNKAKDAVNC

SEQ ID NO: 3263817 - protein, 24 aa, Plasmodium falciparum
KADLYKYFLSPWENIWKRKRNSLI

SEQ ID NO: 3263818 - protein, 17 aa, Plasmodium falciparum
KADNFLIEYLNKEYYEL

SEQ ID NO: 3263819 - protein, 18 aa, Plasmodium falciparum
KADPRFVKSTLYQIPLFS

SEQ ID NO: 3263820 - protein, 24 aa, Plasmodium falciparum
KAEEKFKVCIDVLQFMRRENIKFL

SEQ ID NO: 3263821 - protein, 20 aa, Plasmodium falciparum
KAEFKDILLYLYTYMLDDCQ

SEQ ID NO: 3263822 - protein, 23 aa, Plasmodium falciparum
KAENKGACVPPRREKFCVSLLAK

SEQ ID NO: 3263823 - protein, 24 aa, Plasmodium falciparum
KAEVYKVLLKRISYTIYNIFLKTM

SEQ ID NO: 3263824 - protein, 19 aa, Plasmodium falciparum
KAFFNILILLCLNNEHILK

SEQ ID NO: 3263825 - protein, 22 aa, Plasmodium falciparum
KAGEDMNKVWSLIFSNNNIIVE

SEQ ID NO: 3263826 - protein, 30 aa, Plasmodium falciparum
KAIKCTDKCKGDCKCFERWVEQKREEWTNI

SEQ ID NO: 3263827 - protein, 17 aa, Plasmodium falciparum
KAIQPCKDLDKFQDSSY

SEQ ID NO: 3263828 - protein, 27 aa, Plasmodium falciparum
KAISYILCNYFKFMPIEITMIINSYSK

SEQ ID NO: 3263829 - protein, 20 aa, Plasmodium falciparum
KAITCKADASSAYFHATCSD

SEQ ID NO: 3263830 - protein, 19 aa, Plasmodium falciparum
KAITCNAGGYSYFRKTCGG

SEQ ID NO: 3263831 - protein, 19 aa, Plasmodium falciparum
KAIYFLPVCNKIFQDKNKK

SEQ ID NO: 3263832 - protein, 17 aa, Plasmodium falciparum
KAKEIIFMLNKINFFST

SEQ ID NO: 3263833 - protein, 20 aa, Plasmodium falciparum
KAKESLRDSLLIKAYHFILV

SEQ ID NO: 3263834 - protein, 17 aa, Plasmodium falciparum
KAKFEGVEDLKHKNKKL

SEQ ID NO: 3263835 - protein, 22 aa, Plasmodium falciparum
KAKHPKKNCILIKKYKKMSSQW

SEQ ID NO: 3263836 - protein, 24 aa, Plasmodium falciparum
KAKKFFLYNEFVHIGGYMRKEKKI

SEQ ID NO: 3263837 - protein, 17 aa, Plasmodium falciparum
KAKMYVHKEGLFSKPKV

SEQ ID NO: 3263838 - protein, 19 aa, Plasmodium falciparum
KAKSILLVHMMYLTIDSDE

SEQ ID NO: 3263839 - protein, 22 aa, Plasmodium falciparum
KALEIFYFLRIYCINISSEQII

SEQ ID NO: 3263840 - protein, 19 aa, Plasmodium falciparum
KALFNPLMDFFKLYLNKDD

SEQ ID NO: 3263841 - protein, 25 aa, Plasmodium falciparum
KALKDRVKRKFKYSKRVSTYHYYAH

SEQ ID NO: 3263842 - protein, 24 aa, Plasmodium falciparum
KALKNHFVNFFLLKRKQYEKKFIK

SEQ ID NO: 3263843 - protein, 23 aa, Plasmodium falciparum
KALPFILPFVPPFMVYKYGYAKT

SEQ ID NO: 3263844 - protein, 17 aa, Plasmodium falciparum
KALRTIFYYLNYNNKIN

SEQ ID NO: 3263845 - protein, 18 aa, Plasmodium falciparum
KALTCNAPYEAQYFIKPS

SEQ ID NO: 3263846 - protein, 19 aa, Plasmodium falciparum
KALVYLKFGYINRALQIFL

SEQ ID NO: 3263847 - protein, 24 aa, Plasmodium falciparum
KANDLFYKQINNIIINSNQLKNEA

SEQ ID NO: 3263848 - protein, 30 aa, Plasmodium falciparum
KANEILKLNFSFRSKKKFLIVNYNDVLYKD

SEQ ID NO: 3263849 - protein, 19 aa, Plasmodium falciparum
KANNIYHFEFIKYCTNLIN

SEQ ID NO: 3263850 - protein, 18 aa, Plasmodium falciparum
KANRNIIFSLCILGTFLV

SEQ ID NO: 3263851 - protein, 18 aa, Plasmodium falciparum
KANSIIIYDFIFNYNKIL

SEQ ID NO: 3263852 - protein, 19 aa, Plasmodium falciparum
KANTFISIGYKLLYPLGVL

SEQ ID NO: 3263853 - protein, 28 aa, Plasmodium falciparum
KAQECIKQIISYKENFFHVFLFLQIKKN

SEQ ID NO: 3263854 - protein, 24 aa, Plasmodium falciparum
KAQKEAYDKLKVCEKCMDNGKCTQ

SEQ ID NO: 3263855 - protein, 17 aa, Plasmodium falciparum
KARFKNTKLYSNFGSYR

SEQ ID NO: 3263856 - protein, 27 aa, Plasmodium falciparum
KASCAKVTLKIVFYINQKKVYHIFLQY

SEQ ID NO: 3263857 - protein, 20 aa, Plasmodium falciparum
KASEIYRPLTHCIIREIIRK

SEQ ID NO: 3263858 - protein, 28 aa, Plasmodium falciparum
KASSIFDCSCKRGYGILNERRNAYSNTI

SEQ ID NO: 3263859 - protein, 23 aa, Plasmodium falciparum
KATFYKLITIILMEKNEYKNYVL

SEQ ID NO: 3263860 - protein, 27 aa, Plasmodium falciparum
KATIMPRGMSLGVTWKIPISDKYSQKI

SEQ ID NO: 3263861 - protein, 37 aa, Plasmodium falciparum
KAVKEVRSSIRLRSLLKAVLKWGNYVNYGINDNEDLV

SEQ ID NO: 3263862 - protein, 30 aa, Plasmodium falciparum
KAVRKKIRLKRAEAMLILGNLMLEISGISG

SEQ ID NO: 3263863 - protein, 19 aa, Plasmodium falciparum
KAYEFKKPLYFFKKNKLQL

SEQ ID NO: 3263864 - protein, 20 aa, Plasmodium falciparum
KAYNINMIFTKLLILILFDT

SEQ ID NO: 3263865 - protein, 24 aa, Plasmodium falciparum
KAYVYKWRQCLNIIRKGGHNLEQR

SEQ ID NO: 3263866 - protein, 21 aa, Plasmodium falciparum
KCCNELKYEERILKCMQCQSF

SEQ ID NO: 3263867 - protein, 17 aa, Plasmodium falciparum
KCDICDQKFYFFSLYTL

SEQ ID NO: 3263868 - protein, 20 aa, Plasmodium falciparum
KCDICIKNNVFVIFEDIFLN

SEQ ID NO: 3263869 - protein, 27 aa, Plasmodium falciparum
KCDNIKLMIYLCDMIYIYFYILKIKGK

SEQ ID NO: 3263870 - protein, 24 aa, Plasmodium falciparum
KCEDACKVYEEWLQGWKDQYKKQS

SEQ ID NO: 3263871 - protein, 19 aa, Plasmodium falciparum
KCEDKRKSTSIHMEDINNS

SEQ ID NO: 3263872 - protein, 20 aa, Plasmodium falciparum
KCEFTKYNIVDLFYKNKVSE

SEQ ID NO: 3263873 - protein, 25 aa, Plasmodium falciparum
KCEKCKPGYYKKSVGNFICIKGCPI

SEQ ID NO: 3263874 - protein, 23 aa, Plasmodium falciparum
KCEKECKVYEQFIKQWKPQYEQQ

SEQ ID NO: 3263875 - protein, 36 aa, Plasmodium falciparum
KCENIVSKFCKKCNLLIKKNRDVLKIINSISLNDVV

SEQ ID NO: 3263876 - protein, 21 aa, Plasmodium falciparum
KCERNNMSVFTYVALINRSYN

SEQ ID NO: 3263877 - protein, 18 aa, Plasmodium falciparum
KCFMSPYYYDNIKTEESV

SEQ ID NO: 3263878 - protein, 26 aa, Plasmodium falciparum
KCGFNEFFPYRGIKGSYGFIAPELFH

SEQ ID NO: 3263879 - protein, 33 aa, Plasmodium falciparum
KCGMNCKDDCGCFKRWVEKKQQEWGEIKEHFGK

SEQ ID NO: 3263880 - protein, 20 aa, Plasmodium falciparum
KCGNVCGYVVCKSENGNGEK

SEQ ID NO: 3263881 - protein, 26 aa, Plasmodium falciparum
KCGRFFRLPLCVVIYYIILMSQFIKT

SEQ ID NO: 3263882 - protein, 39 aa, Plasmodium falciparum
KCGTNIKRKGFIFYRNFYFVLFLLVYIFQSFNECPFNHY

SEQ ID NO: 3263883 - protein, 18 aa, Plasmodium falciparum
KCHIRESVEYFVQNLDEE

SEQ ID NO: 3263884 - protein, 24 aa, Plasmodium falciparum
KCIDEFFHISIDFDKTIIKKDSYS

SEQ ID NO: 3263885 - protein, 19 aa, Plasmodium falciparum
KCIKKILQKYLIDFYKNVY

SEQ ID NO: 3263886 - protein, 25 aa, Plasmodium falciparum
KCIKYVCELTKFKLLDLSYILDIIS

SEQ ID NO: 3263887 - protein, 20 aa, Plasmodium falciparum
KCILCFLALGSIPIGYINRK

SEQ ID NO: 3263888 - protein, 32 aa, Plasmodium falciparum
KCINCSKGSICIGGFKFKSLRELIKNQYYINL

SEQ ID NO: 3263889 - protein, 24 aa, Plasmodium falciparum
KCINIYPCFFMYISYDKYKRRIMN

SEQ ID NO: 3263890 - protein, 21 aa, Plasmodium falciparum
KCINLSLTVLRIMQGNKNYFI

SEQ ID NO: 3263891 - protein, 20 aa, Plasmodium falciparum
KCINVKMVLTLATYLYEKKY

SEQ ID NO: 3263892 - protein, 19 aa, Plasmodium falciparum
KCIPCPPHTFTKITGATSI

SEQ ID NO: 3263893 - protein, 26 aa, Plasmodium falciparum
KCIYYIKIFINKGIFKVWLNDSYNND

SEQ ID NO: 3263894 - protein, 19 aa, Plasmodium falciparum
KCKDIKLFIINEINNYIKA

SEQ ID NO: 3263895 - protein, 20 aa, Plasmodium falciparum
KCKDQILFNLKSKWMKQNIL

SEQ ID NO: 3263896 - protein, 23 aa, Plasmodium falciparum
KCKEECKKECECFQKWIDKKEKE

SEQ ID NO: 3263897 - protein, 24 aa, Plasmodium falciparum
KCKEKLVCIYFMDHLKKRSYLLEK

SEQ ID NO: 3263898 - protein, 21 aa, Plasmodium falciparum
KCKMYSFLGSLLFPMFCLSQF

SEQ ID NO: 3263899 - protein, 27 aa, Plasmodium falciparum
KCKNECNTKCDCFLKWITQKKTEWDKI

SEQ ID NO: 3263900 - protein, 33 aa, Plasmodium falciparum
KCKNEFPCSIFELHISQYLYFFVKLNELNIKDA

SEQ ID NO: 3263901 - protein, 19 aa, Plasmodium falciparum
KCKQEKELSNNFIYNNKNN

SEQ ID NO: 3263902 - protein, 19 aa, Plasmodium falciparum
KCKYKRCKYKIYKYKICKR

SEQ ID NO: 3263903 - protein, 18 aa, Plasmodium falciparum
KCKYPKQIHLIRGNHEDV

SEQ ID NO: 3263904 - protein, 20 aa, Plasmodium falciparum
KCLEHLYNYLYFVYLKKKEE

SEQ ID NO: 3263905 - protein, 26 aa, Plasmodium falciparum
KCLEVCIYIIILLKHFKNFFQLNDII

SEQ ID NO: 3263906 - protein, 19 aa, Plasmodium falciparum
KCLFLKKSIIQLLNKPIYS

SEQ ID NO: 3263907 - protein, 20 aa, Plasmodium falciparum
KCLHAFYIALSLLRNKKNRT

SEQ ID NO: 3263908 - protein, 19 aa, Plasmodium falciparum
KCLHEKREIDDVSTNYGPF

SEQ ID NO: 3263909 - protein, 18 aa, Plasmodium falciparum
KCLLINKYMESIPYLSKL

SEQ ID NO: 3263910 - protein, 34 aa, Plasmodium falciparum
KCLNIKLDALEFSYKLAKRLYLKSDLFKKFCKKT

SEQ ID NO: 3263911 - protein, 25 aa, Plasmodium falciparum
KCLVFSYYILLLWVLKYYMLTCQAI

SEQ ID NO: 3263912 - protein, 19 aa, Plasmodium falciparum
KCMIDIQMATLMNSESVKK

SEQ ID NO: 3263913 - protein, 19 aa, Plasmodium falciparum
KCMKMNENFDVSKKKKKYK

SEQ ID NO: 3263914 - protein, 17 aa, Plasmodium falciparum
KCMRKKRKTLLILLFKI

SEQ ID NO: 3263915 - protein, 19 aa, Plasmodium falciparum
KCNFNIIFHHISFRTNKGE

SEQ ID NO: 3263916 - protein, 24 aa, Plasmodium falciparum
KCNGKCDCYKRWVEQKKEKEWTQI

SEQ ID NO: 3263917 - protein, 20 aa, Plasmodium falciparum
KCNIINCLEDIYLNNKSEKL

SEQ ID NO: 3263918 - protein, 18 aa, Plasmodium falciparum
KCNISLDIHNIFPNDEYD

SEQ ID NO: 3263919 - protein, 21 aa, Plasmodium falciparum
KCNLFLLCNGLIFITWRISEV

SEQ ID NO: 3263920 - protein, 27 aa, Plasmodium falciparum
KCNMYKMVIHYSKFYLLMLLINKILKK

SEQ ID NO: 3263921 - protein, 17 aa, Plasmodium falciparum
KCNVCKCTEQEKKNLGK

SEQ ID NO: 3263922 - protein, 32 aa, Plasmodium falciparum
KCPFCKEHNEYIFICLNNFYTHFTYENLLNTL

SEQ ID NO: 3263923 - protein, 23 aa, Plasmodium falciparum
KCPKILSINFIKCDEKLFEKIYN

SEQ ID NO: 3263924 - protein, 22 aa, Plasmodium falciparum
KCPTEEICKDFSNLPQCRKNVH

SEQ ID NO: 3263925 - protein, 18 aa, Plasmodium falciparum
KCQKICIKHFLIFNKILL

SEQ ID NO: 3263926 - protein, 28 aa, Plasmodium falciparum
KCRNECKDDCGCFKEWIGKKKEEWENIK

SEQ ID NO: 3263927 - protein, 17 aa, Plasmodium falciparum
KCSDGFELISDDNIYNN

SEQ ID NO: 3263928 - protein, 17 aa, Plasmodium falciparum
KCSHFIKCIKRTYKILF

SEQ ID NO: 3263929 - protein, 24 aa, Plasmodium falciparum
KCSQDILLCLLPILFNKINLKNIL

SEQ ID NO: 3263930 - protein, 17 aa, Plasmodium falciparum
KCSRKSRSLSELVLANY

SEQ ID NO: 3263931 - protein, 19 aa, Plasmodium falciparum
KCSRRKRYNIKKDINKKNI

SEQ ID NO: 3263932 - protein, 18 aa, Plasmodium falciparum
KCSVACDDFEPWIKNQKQ

SEQ ID NO: 3263933 - protein, 21 aa, Plasmodium falciparum
KCTECTCNLDTQTFVYPYKGY

SEQ ID NO: 3263934 - protein, 18 aa, Plasmodium falciparum
KCVAGFYKDQIGNFKCQG

SEQ ID NO: 3263935 - protein, 26 aa, Plasmodium falciparum
KCVFSVGLFASIGPYLFAPMAGLAVW

SEQ ID NO: 3263936 - protein, 19 aa, Plasmodium falciparum
KCVKSAPYIDDAKYGALIS

SEQ ID NO: 3263937 - protein, 33 aa, Plasmodium falciparum
KCYNLIKISHVFFSKQITYKWFDNYNILCAFLS

SEQ ID NO: 3263938 - protein, 23 aa, Plasmodium falciparum
KDAENYLALHLFLLKDENITLFS

SEQ ID NO: 3263939 - protein, 29 aa, Plasmodium falciparum
KDAFSCARLKLSNVILFSFQIESALNFTI

SEQ ID NO: 3263940 - protein, 23 aa, Plasmodium falciparum
KDAIIKHFKEIIGVLQKNALEEY

SEQ ID NO: 3263941 - protein, 18 aa, Plasmodium falciparum
KDCISKINLTYQIDLHKQ

SEQ ID NO: 3263942 - protein, 17 aa, Plasmodium falciparum
KDCSYFEVLSTCYQFII

SEQ ID NO: 3263943 - protein, 20 aa, Plasmodium falciparum
KDCTCTFLCFNRPTIKMYDF

SEQ ID NO: 3263944 - protein, 24 aa, Plasmodium falciparum
KDDEYKYDFNYILKNRDKIKKWLN

SEQ ID NO: 3263945 - protein, 37 aa, Plasmodium falciparum
KDDKICLLCNFSNYIYKGRLIPFYDIYIHSECLKWSL

SEQ ID NO: 3263946 - protein, 17 aa, Plasmodium falciparum
KDDKISLLILKTQTCPF

SEQ ID NO: 3263947 - protein, 21 aa, Plasmodium falciparum
KDDTYNQFCEKYPCNKQNNTI

SEQ ID NO: 3263948 - protein, 25 aa, Plasmodium falciparum
KDECYNKKLVCTKMSDGINKKCLYR

SEQ ID NO: 3263949 - protein, 34 aa, Plasmodium falciparum
KDEDKKECFEIIKRKWLNENNIKCTYENGFNKNM

SEQ ID NO: 3263950 - protein, 25 aa, Plasmodium falciparum
KDEEKICIIHEKLDIADIIQNKIFK

SEQ ID NO: 3263951 - protein, 19 aa, Plasmodium falciparum
KDEEWFDNIKCEWENEIEE

SEQ ID NO: 3263952 - protein, 21 aa, Plasmodium falciparum
KDEKGWNFIKFLKEEKTNNLI

SEQ ID NO: 3263953 - protein, 29 aa, Plasmodium falciparum
KDEMLKRMYEILKNILLKQNYENIYYFQI

SEQ ID NO: 3263954 - protein, 19 aa, Plasmodium falciparum
KDEQIYRKPYIVVINKCDV

SEQ ID NO: 3263955 - protein, 19 aa, Plasmodium falciparum
KDERAEIITNLGISMSENH

SEQ ID NO: 3263956 - protein, 19 aa, Plasmodium falciparum
KDESLIFYFFYNLMNQENM

SEQ ID NO: 3263957 - protein, 27 aa, Plasmodium falciparum
KDEWECGKVCGVDICNLKKKDNIGKES

SEQ ID NO: 3263958 - protein, 25 aa, Plasmodium falciparum
KDEWELEETNFLLILTKTYMNYINM

SEQ ID NO: 3263959 - protein, 26 aa, Plasmodium falciparum
KDEWKCDKFCGVQICGLKKNNDIDQN

SEQ ID NO: 3263960 - protein, 23 aa, Plasmodium falciparum
KDEYYCSYDLLLVNKILNIFIYK

SEQ ID NO: 3263961 - protein, 20 aa, Plasmodium falciparum
KDFCIIRMSDYMYSRRKRKR

SEQ ID NO: 3263962 - protein, 17 aa, Plasmodium falciparum
KDFEFFENILTSLLLKP

SEQ ID NO: 3263963 - protein, 18 aa, Plasmodium falciparum
KDFFKFLSASERLGLNNN

SEQ ID NO: 3263964 - protein, 22 aa, Plasmodium falciparum
KDFIKKLFTSFDYLPNISTNKN

SEQ ID NO: 3263965 - protein, 19 aa, Plasmodium falciparum
KDFIKLKNIIFLTSCEVTQ

SEQ ID NO: 3263966 - protein, 22 aa, Plasmodium falciparum
KDFLLKRYLLFTNKKNEIVKKQ

SEQ ID NO: 3263967 - protein, 31 aa, Plasmodium falciparum
KDFMQPDYFNWLAFYIVKSRASKEVNLHNVF

SEQ ID NO: 3263968 - protein, 25 aa, Plasmodium falciparum
KDFVKRKCGNYIYMYIFDMKKDGIV

SEQ ID NO: 3263969 - protein, 22 aa, Plasmodium falciparum
KDGEVDTILCFAYKDVILNENN

SEQ ID NO: 3263970 - protein, 27 aa, Plasmodium falciparum
KDGKGIFNWRFVYNIKIPTNATNIKIQ

SEQ ID NO: 3263971 - protein, 24 aa, Plasmodium falciparum
KDGRIIKKKPMIMINFKRTAENKK

SEQ ID NO: 3263972 - protein, 19 aa, Plasmodium falciparum
KDGSVLFTDKIVKLLNKKK

SEQ ID NO: 3263973 - protein, 40 aa, Plasmodium falciparum
KDGVRYKKFFSSFKYGNLLAKKKCIEWRLKNLNPSSHAYS

SEQ ID NO: 3263974 - protein, 17 aa, Plasmodium falciparum
KDGYLCILVSGGSTDVY

SEQ ID NO: 3263975 - protein, 18 aa, Plasmodium falciparum
KDHFNIYVKSLLICLKSK

SEQ ID NO: 3263976 - protein, 21 aa, Plasmodium falciparum
KDHIYFFSNVICDINNINNNV

SEQ ID NO: 3263977 - protein, 17 aa, Plasmodium falciparum
KDHLLNLAIYIYMITFN

SEQ ID NO: 3263978 - protein, 21 aa, Plasmodium falciparum
KDIDFKPFFEFEYGKYEEKCM

SEQ ID NO: 3263979 - protein, 17 aa, Plasmodium falciparum
KDIFEDSYLKLLIENEK

SEQ ID NO: 3263980 - protein, 20 aa, Plasmodium falciparum
KDIFRQWGNTALFLSGGAIL

SEQ ID NO: 3263981 - protein, 25 aa, Plasmodium falciparum
KDIFTKICKQWDIIKKKEKDITLFN

SEQ ID NO: 3263982 - protein, 28 aa, Plasmodium falciparum
KDIHSLFFYSFYENILFYFPYEHSYTYD

SEQ ID NO: 3263983 - protein, 19 aa, Plasmodium falciparum
KDIIEQYGIKELTRLNKLY

SEQ ID NO: 3263984 - protein, 35 aa, Plasmodium falciparum
KDIINKLVWEDLYFLQLCFEECLKNRSYIMHVLIC

SEQ ID NO: 3263985 - protein, 22 aa, Plasmodium falciparum
KDIIVHCINFLKDKNIISYKEA

SEQ ID NO: 3263986 - protein, 22 aa, Plasmodium falciparum
KDIKEIDCCLIQKNDSLKNAKK

SEQ ID NO: 3263987 - protein, 18 aa, Plasmodium falciparum
KDIKEIIIFVQIMVENFI

SEQ ID NO: 3263988 - protein, 21 aa, Plasmodium falciparum
KDIKNNFLIFLYYIIHSLNNN

SEQ ID NO: 3263989 - protein, 20 aa, Plasmodium falciparum
KDIKNYFSLCYQNCINKLDK

SEQ ID NO: 3263990 - protein, 20 aa, Plasmodium falciparum
KDIKTESLFFSKFSFFQCYK

SEQ ID NO: 3263991 - protein, 20 aa, Plasmodium falciparum
KDIKYLFLYIEFDNKSVKHF

SEQ ID NO: 3263992 - protein, 21 aa, Plasmodium falciparum
KDILLKKMKYVFIQYKNFIED

SEQ ID NO: 3263993 - protein, 29 aa, Plasmodium falciparum
KDILVPLNYVVCIYKIYKLIKKYKYNIIN

SEQ ID NO: 3263994 - protein, 18 aa, Plasmodium falciparum
KDIMKILQVFTVHSKNKT

SEQ ID NO: 3263995 - protein, 23 aa, Plasmodium falciparum
KDINCFFKDCLKNDSELLSVNKK

SEQ ID NO: 3263996 - protein, 17 aa, Plasmodium falciparum
KDINDCRPHISKNKNVE

SEQ ID NO: 3263997 - protein, 17 aa, Plasmodium falciparum
KDINLVNDMKLYKLGTI

SEQ ID NO: 3263998 - protein, 20 aa, Plasmodium falciparum
KDIPEFTASNFFSYDNYNIN

SEQ ID NO: 3263999 - protein, 17 aa, Plasmodium falciparum
KDIRVGDIILIKSKQRV

SEQ ID NO: 3264000 - protein, 21 aa, Plasmodium falciparum
KDITCSISLNFLNNEYDNNNN

SEQ ID NO: 3264001 - protein, 18 aa, Plasmodium falciparum
KDIVSKKCGIDVESDIDI

SEQ ID NO: 3264002 - protein, 27 aa, Plasmodium falciparum
KDIYCKKNIYIFLSYFMKEYYIQYIQN

SEQ ID NO: 3264003 - protein, 29 aa, Plasmodium falciparum
KDIYIKCYLFYYPHFHNFVLTYFHKFLTH

SEQ ID NO: 3264004 - protein, 29 aa, Plasmodium falciparum
KDKCTTLYTKNCMEYIKMMRNNIWLNKKK

SEQ ID NO: 3264005 - protein, 19 aa, Plasmodium falciparum
KDKELEKIILYYKLNNPFY

SEQ ID NO: 3264006 - protein, 22 aa, Plasmodium falciparum
KDKGDFLQICFEEFIKRKEFNE

SEQ ID NO: 3264007 - protein, 20 aa, Plasmodium falciparum
KDKIFSIIFKYIEHSKVKND

SEQ ID NO: 3264008 - protein, 22 aa, Plasmodium falciparum
KDKIYYLLCIQYNLILLNKKYK

SEQ ID NO: 3264009 - protein, 17 aa, Plasmodium falciparum
KDKKCSDGFELISDDNI

SEQ ID NO: 3264010 - protein, 20 aa, Plasmodium falciparum
KDKKFLFNMENFDILKRYKY

SEQ ID NO: 3264011 - protein, 19 aa, Plasmodium falciparum
KDKKGCFMSIYVFIQSFVD

SEQ ID NO: 3264012 - protein, 19 aa, Plasmodium falciparum
KDKKYPLFELFNVNEHNKK

SEQ ID NO: 3264013 - protein, 19 aa, Plasmodium falciparum
KDKKYSWWFTNKNDEKKNV

SEQ ID NO: 3264014 - protein, 19 aa, Plasmodium falciparum
KDKLKRLSLNKNKAKPNNE

SEQ ID NO: 3264015 - protein, 26 aa, Plasmodium falciparum
KDKLLFNCIFVFKLLEKKKIYDKDFN

SEQ ID NO: 3264016 - protein, 24 aa, Plasmodium falciparum
KDKLLKIQLSYMIINPSIQKNSGK

SEQ ID NO: 3264017 - protein, 27 aa, Plasmodium falciparum
KDKNCNFQFFFKLLFTDKFHNIEEIIL

SEQ ID NO: 3264018 - protein, 32 aa, Plasmodium falciparum
KDKPLQCLLWFRCIISLSCCHIYDFKYCLDLF

SEQ ID NO: 3264019 - protein, 32 aa, Plasmodium falciparum
KDKQKIISFFSICCIMTLLGKLNNVCIINKTH

SEQ ID NO: 3264020 - protein, 20 aa, Plasmodium falciparum
KDKRCVKCVAGFYKDQIGNF

SEQ ID NO: 3264021 - protein, 19 aa, Plasmodium falciparum
KDKRHYICIKKVPYNSHYK

SEQ ID NO: 3264022 - protein, 20 aa, Plasmodium falciparum
KDKYEVILFYTMSCYNYCNN

SEQ ID NO: 3264023 - protein, 20 aa, Plasmodium falciparum
KDLEVCTRYNTIFLNYVLLS

SEQ ID NO: 3264024 - protein, 25 aa, Plasmodium falciparum
KDLILPNNLALMFLNLHEIINIGTF

SEQ ID NO: 3264025 - protein, 21 aa, Plasmodium falciparum
KDLKIKKCVKVTNILANIYDL

SEQ ID NO: 3264026 - protein, 25 aa, Plasmodium falciparum
KDLLFYNYFALFLLDGSMFLKMTKF

SEQ ID NO: 3264027 - protein, 20 aa, Plasmodium falciparum
KDLLPRITPILKNRHEKVQE

SEQ ID NO: 3264028 - protein, 20 aa, Plasmodium falciparum
KDLMDVRHCVFILGEDGCGK

SEQ ID NO: 3264029 - protein, 28 aa, Plasmodium falciparum
KDLNKALNMAIQFIMQYSSNAWSIFVVY

SEQ ID NO: 3264030 - protein, 18 aa, Plasmodium falciparum
KDLPEIYIDDKSFSYTFL

SEQ ID NO: 3264031 - protein, 23 aa, Plasmodium falciparum
KDLPWKLSKEEIKFCTDFKNDFV

SEQ ID NO: 3264032 - protein, 20 aa, Plasmodium falciparum
KDLQDLLLFIQQIKQYNILT

SEQ ID NO: 3264033 - protein, 19 aa, Plasmodium falciparum
KDLRVCVIEHTSLSGVENC

SEQ ID NO: 3264034 - protein, 22 aa, Plasmodium falciparum
KDLSKAIGIAIFIFNCSNQMNY

SEQ ID NO: 3264035 - protein, 21 aa, Plasmodium falciparum
KDLTFNIVVFIAKGGVFLNIF

SEQ ID NO: 3264036 - protein, 22 aa, Plasmodium falciparum
KDLYKLKLFYIKIIVFIHYVNA

SEQ ID NO: 3264037 - protein, 19 aa, Plasmodium falciparum
KDMFYLFDLFYSSKDDHVE

SEQ ID NO: 3264038 - protein, 21 aa, Plasmodium falciparum
KDMILRYAYMKNENEFLKTQL

SEQ ID NO: 3264039 - protein, 25 aa, Plasmodium falciparum
KDMITKSYFSNMFTKYFGRTSANTC

SEQ ID NO: 3264040 - protein, 21 aa, Plasmodium falciparum
KDMLYIFNFINSFERKKYLIM

SEQ ID NO: 3264041 - protein, 18 aa, Plasmodium falciparum
KDMQLCYDNQQLIRKKFY

SEQ ID NO: 3264042 - protein, 19 aa, Plasmodium falciparum
KDMQLESGFQIHKKNKFYK

SEQ ID NO: 3264043 - protein, 20 aa, Plasmodium falciparum
KDMYSNIFLFCKKYIENYEI

SEQ ID NO: 3264044 - protein, 27 aa, Plasmodium falciparum
KDNAYYRIFYAGGITAVLLLCSSTAFF

SEQ ID NO: 3264045 - protein, 21 aa, Plasmodium falciparum
KDNDFCIAGLDVIYVNKRDDT

SEQ ID NO: 3264046 - protein, 23 aa, Plasmodium falciparum
KDNDFERVLLLGGSSGKGKTTLA

SEQ ID NO: 3264047 - protein, 23 aa, Plasmodium falciparum
KDNICSPSNCELYFVNKNIFKNY

SEQ ID NO: 3264048 - protein, 24 aa, Plasmodium falciparum
KDNIYWNIELCNIKYYYEKGKKCN

SEQ ID NO: 3264049 - protein, 20 aa, Plasmodium falciparum
KDNLHFINLLILILKYNKTN

SEQ ID NO: 3264050 - protein, 25 aa, Plasmodium falciparum
KDNLHPIAECCISITSLATHFLTLF

SEQ ID NO: 3264051 - protein, 41 aa, Plasmodium falciparum
KDNNKFSVILTMYGIFYKIFCYIFAHYVLFMGLYILSIYYN

SEQ ID NO: 3264052 - protein, 18 aa, Plasmodium falciparum
KDNNPYCFSTVDMNDERI

SEQ ID NO: 3264053 - protein, 23 aa, Plasmodium falciparum
KDPEGNVVFCFAKQNMRGGAGKF

SEQ ID NO: 3264054 - protein, 17 aa, Plasmodium falciparum
KDPELLTAEILFVALTL

SEQ ID NO: 3264055 - protein, 22 aa, Plasmodium falciparum
KDPFLSSLLFFNFELSIYNITD

SEQ ID NO: 3264056 - protein, 23 aa, Plasmodium falciparum
KDPKRVSGIRAIRVKLKKNLKSE

SEQ ID NO: 3264057 - protein, 20 aa, Plasmodium falciparum
KDPNKICTYYNFYNMKKKKK

SEQ ID NO: 3264058 - protein, 17 aa, Plasmodium falciparum
KDPRNVQNYNIYYKKES

SEQ ID NO: 3264059 - protein, 18 aa, Plasmodium falciparum
KDPSPGEVIPEKKVPEPK

SEQ ID NO: 3264060 - protein, 23 aa, Plasmodium falciparum
KDQDLRVQLLQDYENIFEQIQNM

SEQ ID NO: 3264061 - protein, 20 aa, Plasmodium falciparum
KDQEAICRAVRYSFADIGDI

SEQ ID NO: 3264062 - protein, 19 aa, Plasmodium falciparum
KDQFLSILLNMKKENMNVN

SEQ ID NO: 3264063 - protein, 24 aa, Plasmodium falciparum
KDQGLCGSCWAFASVGNIESVFAK

SEQ ID NO: 3264064 - protein, 23 aa, Plasmodium falciparum
KDQIKEITKTVVVYPPVQNEKDI

SEQ ID NO: 3264065 - protein, 18 aa, Plasmodium falciparum
KDQIKLLCNNIDENNLFD

SEQ ID NO: 3264066 - protein, 20 aa, Plasmodium falciparum
KDQKESYLYFAVKDNTLLLN

SEQ ID NO: 3264067 - protein, 24 aa, Plasmodium falciparum
KDQKNCGSCWAFSSIGSVESQYAI

SEQ ID NO: 3264068 - protein, 25 aa, Plasmodium falciparum
KDQKNCGSCWAFSSIGSVESQYAIR

SEQ ID NO: 3264069 - protein, 27 aa, Plasmodium falciparum
KDQLIKYSYRIFKKISNIFPMRNKIQT

SEQ ID NO: 3264070 - protein, 24 aa, Plasmodium falciparum
KDRIFKVATKFFVSEIIMLLNVPL

SEQ ID NO: 3264071 - protein, 34 aa, Plasmodium falciparum
KDRKEWLRWKERVTREKLEWKHWVEMKENMNIYN

SEQ ID NO: 3264072 - protein, 25 aa, Plasmodium falciparum
KDSFFYKNEEFLLFLYHNNQHMYEH

SEQ ID NO: 3264073 - protein, 29 aa, Plasmodium falciparum
KDSFIYLNLKLKNMFTFFNPIKNNKFLFS

SEQ ID NO: 3264074 - protein, 20 aa, Plasmodium falciparum
KDSFYKLALKYHPDKNENNI

SEQ ID NO: 3264075 - protein, 26 aa, Plasmodium falciparum
KDSIDWRKEYKNCINNGDKSTCKNVC

SEQ ID NO: 3264076 - protein, 19 aa, Plasmodium falciparum
KDSIHWRTKKIKGCLKNGK

SEQ ID NO: 3264077 - protein, 17 aa, Plasmodium falciparum
KDSIHWRTKKLDKCINN

SEQ ID NO: 3264078 - protein, 20 aa, Plasmodium falciparum
KDSIKFVAINSFNDLNRNVC

SEQ ID NO: 3264079 - protein, 23 aa, Plasmodium falciparum
KDSISWNSYDLFILFFKSLILFD

SEQ ID NO: 3264080 - protein, 19 aa, Plasmodium falciparum
KDSKMKFEYIRSHEKSERI

SEQ ID NO: 3264081 - protein, 20 aa, Plasmodium falciparum
KDSLCHYSYCNIIKVKNLDK

SEQ ID NO: 3264082 - protein, 23 aa, Plasmodium falciparum
KDSLFCSKFIQILLELHTPLFNL

SEQ ID NO: 3264083 - protein, 19 aa, Plasmodium falciparum
KDSRCEGIKTYNRLGIALY

SEQ ID NO: 3264084 - protein, 21 aa, Plasmodium falciparum
KDSYIKYCIIKEKYDPLRSVY

SEQ ID NO: 3264085 - protein, 26 aa, Plasmodium falciparum
KDSYLKIPIINILRYIVISNDIPNEF

SEQ ID NO: 3264086 - protein, 21 aa, Plasmodium falciparum
KDTEIICKYIRKFNWNDSFFL

SEQ ID NO: 3264087 - protein, 32 aa, Plasmodium falciparum
KDTEKILFYKISFHMLNIFIPIIDYILNNIDK

SEQ ID NO: 3264088 - protein, 17 aa, Plasmodium falciparum
KDTLLLKSSEIIELNNV

SEQ ID NO: 3264089 - protein, 25 aa, Plasmodium falciparum
KDTQKFLDLRSDWWEANRHQVWRAM

SEQ ID NO: 3264090 - protein, 17 aa, Plasmodium falciparum
KDTYPCCPLCRNPIENV

SEQ ID NO: 3264091 - protein, 19 aa, Plasmodium falciparum
KDVEIYKDLSFTLKEGKTY

SEQ ID NO: 3264092 - protein, 27 aa, Plasmodium falciparum
KDVILPSLISFNRCDIMKLSDHVNSIE

SEQ ID NO: 3264093 - protein, 21 aa, Plasmodium falciparum
KDVILYFAFVFFSFFINYNNS

SEQ ID NO: 3264094 - protein, 23 aa, Plasmodium falciparum
KDVKFVLRFERLFYSNNYKDVEK

SEQ ID NO: 3264095 - protein, 20 aa, Plasmodium falciparum
KDVKNGGGLCILKKEEEEKK

SEQ ID NO: 3264096 - protein, 26 aa, Plasmodium falciparum
KDVKVINSYISKFFVEVDKLKNKFEM

SEQ ID NO: 3264097 - protein, 18 aa, Plasmodium falciparum
KDVLEHFEKFELNYDIPR

SEQ ID NO: 3264098 - protein, 29 aa, Plasmodium falciparum
KDVLLDIEIIKRFLLSISCVIKTYIYNES

SEQ ID NO: 3264099 - protein, 20 aa, Plasmodium falciparum
KDVRTYFLVGFNLYVKTYSC

SEQ ID NO: 3264100 - protein, 19 aa, Plasmodium falciparum
KDWWTKYGPSIWEGMVCAL

SEQ ID NO: 3264101 - protein, 28 aa, Plasmodium falciparum
KDYFNLQLQKLWSLFYIDTMNLLIYTIL

SEQ ID NO: 3264102 - protein, 23 aa, Plasmodium falciparum
KDYFYKIVRIYNNMAFENYIKED

SEQ ID NO: 3264103 - protein, 33 aa, Plasmodium falciparum
KDYIKFKTIIRVFRIIYEFQDFSPILREDIFFN

SEQ ID NO: 3264104 - protein, 20 aa, Plasmodium falciparum
KDYKCIELINLLKYIFETIC

SEQ ID NO: 3264105 - protein, 28 aa, Plasmodium falciparum
KDYTCNISKPLIRRSITFMNTGKNIHLN

SEQ ID NO: 3264106 - protein, 20 aa, Plasmodium falciparum
KDYYNCFFMNSYMWVINNLI

SEQ ID NO: 3264107 - protein, 17 aa, Plasmodium falciparum
KEAISIDSLEEIYEKKK

SEQ ID NO: 3264108 - protein, 20 aa, Plasmodium falciparum
KEAKFPLLAKIPQRHNTLSN

SEQ ID NO: 3264109 - protein, 24 aa, Plasmodium falciparum
KEAKLIIEGSIIFNKLILKLGNIK

SEQ ID NO: 3264110 - protein, 32 aa, Plasmodium falciparum
KEAKVMKALLFLEAVKKYNVVIATCVGSGHEI

SEQ ID NO: 3264111 - protein, 19 aa, Plasmodium falciparum
KEALLKAFVESAAVETFFL

SEQ ID NO: 3264112 - protein, 24 aa, Plasmodium falciparum
KEASEGIFYFYTKKVGIYTLTLKN

SEQ ID NO: 3264113 - protein, 23 aa, Plasmodium falciparum
KEATSIIIWLSIKYICSMITSIV

SEQ ID NO: 3264114 - protein, 24 aa, Plasmodium falciparum
KEAVTDRFVRLMSILIFIVVSVLI

SEQ ID NO: 3264115 - protein, 18 aa, Plasmodium falciparum
KECGCFEKWVKQKKEKEW

SEQ ID NO: 3264116 - protein, 22 aa, Plasmodium falciparum
KECLKYKFLYFKYNVAIEAPLL

SEQ ID NO: 3264117 - protein, 26 aa, Plasmodium falciparum
KECSRKEMFEKAYIIKYISNNVQLFH

SEQ ID NO: 3264118 - protein, 19 aa, Plasmodium falciparum
KEDCVKLICSFNMDNKTWD

SEQ ID NO: 3264119 - protein, 18 aa, Plasmodium falciparum
KEDCYRNGGREGPIKFDD

SEQ ID NO: 3264120 - protein, 27 aa, Plasmodium falciparum
KEDDSPCFFFHFFIYYFLNDSNVLVKK

SEQ ID NO: 3264121 - protein, 27 aa, Plasmodium falciparum
KEDFDVFKMKFSFYQSVSKNKIIIDRI

SEQ ID NO: 3264122 - protein, 20 aa, Plasmodium falciparum
KEDFMRIIGSYQFKNPIGYQ

SEQ ID NO: 3264123 - protein, 17 aa, Plasmodium falciparum
KEDFYKYLFINKNNPIF

SEQ ID NO: 3264124 - protein, 17 aa, Plasmodium falciparum
KEDIIYINHLFDHKFST

SEQ ID NO: 3264125 - protein, 33 aa, Plasmodium falciparum
KEDIKNLLKHVIKLANFSGIIVMSDTNTEITPE

SEQ ID NO: 3264126 - protein, 29 aa, Plasmodium falciparum
KEDINAPNLINCFSEFINWCDNNLIQIKL

SEQ ID NO: 3264127 - protein, 19 aa, Plasmodium falciparum
KEDKLFLDTIFKFDNSSFF

SEQ ID NO: 3264128 - protein, 25 aa, Plasmodium falciparum
KEDMLYKLNEVWNMERKEYLLDIQP

SEQ ID NO: 3264129 - protein, 25 aa, Plasmodium falciparum
KEDMLYKSNEVWNMERKEYLLDIQP

SEQ ID NO: 3264130 - protein, 19 aa, Plasmodium falciparum
KEDSDGLALSRSLESSDIK

SEQ ID NO: 3264131 - protein, 22 aa, Plasmodium falciparum
KEDSYCNLLQFISIIEQEFQEK

SEQ ID NO: 3264132 - protein, 23 aa, Plasmodium falciparum
KEDTKEILGMFIVGNYASVLIHE

SEQ ID NO: 3264133 - protein, 23 aa, Plasmodium falciparum
KEECRSGTGGHEYCSGDGHDCTD

SEQ ID NO: 3264134 - protein, 27 aa, Plasmodium falciparum
KEEDLIEAFFPFILKKLDNESLSLDNK

SEQ ID NO: 3264135 - protein, 18 aa, Plasmodium falciparum
KEEEEISKTIALSLQEYH

SEQ ID NO: 3264136 - protein, 20 aa, Plasmodium falciparum
KEEENIFLLTCKKFVNFTIQ

SEQ ID NO: 3264137 - protein, 30 aa, Plasmodium falciparum
KEEGGYLFLLEIYKSYIYCGINYEMDNMEK

SEQ ID NO: 3264138 - protein, 17 aa, Plasmodium falciparum
KEEHGIFLLVGKGANMY

SEQ ID NO: 3264139 - protein, 26 aa, Plasmodium falciparum
KEEIKILNMCLIRFLNNYIQIYDSFK

SEQ ID NO: 3264140 - protein, 22 aa, Plasmodium falciparum
KEEIKRCLFDCAIYEKKCIYYL

SEQ ID NO: 3264141 - protein, 18 aa, Plasmodium falciparum
KEEIKSVRTLEDLKISVI

SEQ ID NO: 3264142 - protein, 24 aa, Plasmodium falciparum
KEEIMFLYQYFFVRTCLFNELKKQ

SEQ ID NO: 3264143 - protein, 29 aa, Plasmodium falciparum
KEEIMKIVKKLFCRKKLDEILEIIEEKGN

SEQ ID NO: 3264144 - protein, 19 aa, Plasmodium falciparum
KEEINYCKTFLTKNSILKD

SEQ ID NO: 3264145 - protein, 18 aa, Plasmodium falciparum
KEEISGVLSNKLRNTFKD

SEQ ID NO: 3264146 - protein, 23 aa, Plasmodium falciparum
KEEKEYLTRIGVNDANDYKLLTK

SEQ ID NO: 3264147 - protein, 23 aa, Plasmodium falciparum
KEEKICLNNSYILDYYIHGKYDV

SEQ ID NO: 3264148 - protein, 20 aa, Plasmodium falciparum
KEELCQLFFFNEFIEKKDDN

SEQ ID NO: 3264149 - protein, 20 aa, Plasmodium falciparum
KEELEECYPLITFSEGKKKK

SEQ ID NO: 3264150 - protein, 20 aa, Plasmodium falciparum
KEELEIIRNNFHILKEKKNE

SEQ ID NO: 3264151 - protein, 24 aa, Plasmodium falciparum
KEELRECIPCPINTYKDVISNAEC

SEQ ID NO: 3264152 - protein, 25 aa, Plasmodium falciparum
KEELYKMNIILTIVFLLQNTNMKLS

SEQ ID NO: 3264153 - protein, 20 aa, Plasmodium falciparum
KEEMKKHMKADVTGEDDSLL

SEQ ID NO: 3264154 - protein, 29 aa, Plasmodium falciparum
KEENIEILRCPKCYSYLHATILEDISKSV

SEQ ID NO: 3264155 - protein, 28 aa, Plasmodium falciparum
KEENIGIFILLNCQWLSDSFVNNVNQIE

SEQ ID NO: 3264156 - protein, 19 aa, Plasmodium falciparum
KEENNLFVRYIRNVQEKIK

SEQ ID NO: 3264157 - protein, 21 aa, Plasmodium falciparum
KEENYNCKIIYNHQKLINELK

SEQ ID NO: 3264158 - protein, 21 aa, Plasmodium falciparum
KEEPYCLLNKCTSSIKSINNN

SEQ ID NO: 3264159 - protein, 18 aa, Plasmodium falciparum
KEERRKSEKYERKYNEEK

SEQ ID NO: 3264160 - protein, 17 aa, Plasmodium falciparum
KEESCYVFSIISENFIK

SEQ ID NO: 3264161 - protein, 24 aa, Plasmodium falciparum
KEETELFCGSDLQITSINILKKRR

SEQ ID NO: 3264162 - protein, 24 aa, Plasmodium falciparum
KEETIRVAFTYSILKFIYILFEIQ

SEQ ID NO: 3264163 - protein, 21 aa, Plasmodium falciparum
KEEYIRILLKLIMYPYNENNE

SEQ ID NO: 3264164 - protein, 19 aa, Plasmodium falciparum
KEFHKKYNGEMVKKLPNNE

SEQ ID NO: 3264165 - protein, 22 aa, Plasmodium falciparum
KEFHKYCILPPLIKTNIKDGES

SEQ ID NO: 3264166 - protein, 21 aa, Plasmodium falciparum
KEFICKYIFKKMIKRKEKSKY

SEQ ID NO: 3264167 - protein, 36 aa, Plasmodium falciparum
KEFKEGKNVMSYNAFFWKWVHDMLIDSMQWRNEHGN

SEQ ID NO: 3264168 - protein, 23 aa, Plasmodium falciparum
KEFLYINRIQFFFTTENPILYIE

SEQ ID NO: 3264169 - protein, 20 aa, Plasmodium falciparum
KEFNILFNILNKMNYSFAYR

SEQ ID NO: 3264170 - protein, 24 aa, Plasmodium falciparum
KEFVPKRAEEILCDQNENIIGKII

SEQ ID NO: 3264171 - protein, 25 aa, Plasmodium falciparum
KEFYEIIKDAYSFIRRNENFINPKS

SEQ ID NO: 3264172 - protein, 19 aa, Plasmodium falciparum
KEFYKTCVYSGTNASDRIC

SEQ ID NO: 3264173 - protein, 18 aa, Plasmodium falciparum
KEGCKYYFEELNMFIYNG

SEQ ID NO: 3264174 - protein, 23 aa, Plasmodium falciparum
KEGEVPSLCIFIHEYSSKTSISY

SEQ ID NO: 3264175 - protein, 24 aa, Plasmodium falciparum
KEGGEIFWRQLLIKSSTVPSNIQE

SEQ ID NO: 3264176 - protein, 19 aa, Plasmodium falciparum
KEGGILYVRGYDFNILPYI

SEQ ID NO: 3264177 - protein, 26 aa, Plasmodium falciparum
KEGKFVEIIFLYIRLGYFEEAIEICS

SEQ ID NO: 3264178 - protein, 18 aa, Plasmodium falciparum
KEGLEWLLYYNLPFYNNE

SEQ ID NO: 3264179 - protein, 22 aa, Plasmodium falciparum
KEGLNSEGIWIFSIAEKNNSSS

SEQ ID NO: 3264180 - protein, 17 aa, Plasmodium falciparum
KEGLPFNRDGYYTKKKE

SEQ ID NO: 3264181 - protein, 20 aa, Plasmodium falciparum
KEGPASGMIVIFGGRSAENK

SEQ ID NO: 3264182 - protein, 21 aa, Plasmodium falciparum
KEGSFAFKCYNCEGDPTCAIC

SEQ ID NO: 3264183 - protein, 20 aa, Plasmodium falciparum
KEGSKCVIIGSSFIACELSS

SEQ ID NO: 3264184 - protein, 33 aa, Plasmodium falciparum
KEHIYICNKEIIIQCLYIYFNSEINNLFIAHKQ

SEQ ID NO: 3264185 - protein, 17 aa, Plasmodium falciparum
KEHIYILTFLKKYISSR

SEQ ID NO: 3264186 - protein, 25 aa, Plasmodium falciparum
KEHKWKCRNVCGYVVCKPENGNTET

SEQ ID NO: 3264187 - protein, 19 aa, Plasmodium falciparum
KEHTFCYSTYISKENALSQ

SEQ ID NO: 3264188 - protein, 27 aa, Plasmodium falciparum
KEHVKKFGIEYFLTYADNFAIGYFRKQ

SEQ ID NO: 3264189 - protein, 17 aa, Plasmodium falciparum
KEIAVNTYLAMTFNCHS

SEQ ID NO: 3264190 - protein, 23 aa, Plasmodium falciparum
KEICVPNTFLIMIYKKIMKNLNL

SEQ ID NO: 3264191 - protein, 17 aa, Plasmodium falciparum
KEIFEGDSIIKTMENKP

SEQ ID NO: 3264192 - protein, 17 aa, Plasmodium falciparum
KEIFIKKIKNLYNFDFE

SEQ ID NO: 3264193 - protein, 19 aa, Plasmodium falciparum
KEIFNKYIILQNCSSNIIL

SEQ ID NO: 3264194 - protein, 20 aa, Plasmodium falciparum
KEIFNRLFFNINIRYSNYVI

SEQ ID NO: 3264195 - protein, 22 aa, Plasmodium falciparum
KEIFQHILCHLVEYIHFDILKK

SEQ ID NO: 3264196 - protein, 20 aa, Plasmodium falciparum
KEIFYHLYYIYIYYRDILFL

SEQ ID NO: 3264197 - protein, 17 aa, Plasmodium falciparum
KEIFYNLYEPFHVNNIQ

SEQ ID NO: 3264198 - protein, 19 aa, Plasmodium falciparum
KEIFYSFFEEFFLIQKKEK

SEQ ID NO: 3264199 - protein, 19 aa, Plasmodium falciparum
KEIICFINKSKIHFNNYKK

SEQ ID NO: 3264200 - protein, 19 aa, Plasmodium falciparum
KEIIYRSADECNFNNEELN

SEQ ID NO: 3264201 - protein, 17 aa, Plasmodium falciparum
KEIKVEPVVPRAIGEPM

SEQ ID NO: 3264202 - protein, 38 aa, Plasmodium falciparum
KEILISLHVDNMIYFWSIDEGRCFKVLKNFDFLIYNLR

SEQ ID NO: 3264203 - protein, 23 aa, Plasmodium falciparum
KEILITCILKAYISLKLLSNQLH

SEQ ID NO: 3264204 - protein, 21 aa, Plasmodium falciparum
KEINNLINIFFFFYYHQIKNK

SEQ ID NO: 3264205 - protein, 20 aa, Plasmodium falciparum
KEIPLKFKGNLKCSQLYNFN

SEQ ID NO: 3264206 - protein, 20 aa, Plasmodium falciparum
KEIQNKILIHLNKFNINELV

SEQ ID NO: 3264207 - protein, 25 aa, Plasmodium falciparum
KEISEMKEILYVHNVILNKNFHLNN

SEQ ID NO: 3264208 - protein, 22 aa, Plasmodium falciparum
KEISKTYVRFIFKTIQNYNKIK

SEQ ID NO: 3264209 - protein, 20 aa, Plasmodium falciparum
KEITFKLILYFISLLISLRY

SEQ ID NO: 3264210 - protein, 18 aa, Plasmodium falciparum
KEIVIKFSSYDNISELIF

SEQ ID NO: 3264211 - protein, 21 aa, Plasmodium falciparum
KEIVLSVLFIIRIYPNVINNV

SEQ ID NO: 3264212 - protein, 20 aa, Plasmodium falciparum
KEKASAFFYERTRLGHVHWG

SEQ ID NO: 3264213 - protein, 19 aa, Plasmodium falciparum
KEKCSFFLNLFTKHVSNKI

SEQ ID NO: 3264214 - protein, 24 aa, Plasmodium falciparum
KEKDEIFQKCLLRSKSDSLLDFLK

SEQ ID NO: 3264215 - protein, 21 aa, Plasmodium falciparum
KEKDKILLCHNYNCLSSSIKL

SEQ ID NO: 3264216 - protein, 18 aa, Plasmodium falciparum
KEKEFIKQHLKDYEERKE

SEQ ID NO: 3264217 - protein, 22 aa, Plasmodium falciparum
KEKEKRKILEYKYMTYRNLLEV

SEQ ID NO: 3264218 - protein, 17 aa, Plasmodium falciparum
KEKFALYLRLMSLFINI

SEQ ID NO: 3264219 - protein, 18 aa, Plasmodium falciparum
KEKIFNLYIKCSEQQNII

SEQ ID NO: 3264220 - protein, 18 aa, Plasmodium falciparum
KEKIHPLLFSAYKLILFI

SEQ ID NO: 3264221 - protein, 21 aa, Plasmodium falciparum
KEKILKIALLMNIFMAILDTS

SEQ ID NO: 3264222 - protein, 17 aa, Plasmodium falciparum
KEKIMSMAKKMMNIEKN

SEQ ID NO: 3264223 - protein, 27 aa, Plasmodium falciparum
KEKIYIFRYSIYYIILSRCSNNIKINY

SEQ ID NO: 3264224 - protein, 24 aa, Plasmodium falciparum
KEKIYIYNILKGVLYEMCSNILLG

SEQ ID NO: 3264225 - protein, 26 aa, Plasmodium falciparum
KEKKAGICRRCFRGLFKSIKGPSITH

SEQ ID NO: 3264226 - protein, 25 aa, Plasmodium falciparum
KEKKFLIEIERVLKLYKIINYEITI

SEQ ID NO: 3264227 - protein, 29 aa, Plasmodium falciparum
KEKKIDQDKLFLFPLPYGNYTHYSNFVVN

SEQ ID NO: 3264228 - protein, 33 aa, Plasmodium falciparum
KEKKKICFKNIFLRVCVINLSIFSFTLYNYLKK

SEQ ID NO: 3264229 - protein, 18 aa, Plasmodium falciparum
KEKKKIRNIYLFIKFISS

SEQ ID NO: 3264230 - protein, 23 aa, Plasmodium falciparum
KEKKKKFIGKKMKDWEEWFPTIY

SEQ ID NO: 3264231 - protein, 20 aa, Plasmodium falciparum
KEKKKNCSYDFQKIDGDKNI

SEQ ID NO: 3264232 - protein, 23 aa, Plasmodium falciparum
KEKKYVMCKDILNKYLSTLKIAI

SEQ ID NO: 3264233 - protein, 24 aa, Plasmodium falciparum
KEKLKKFLFRICSYYNDIPYHTSL

SEQ ID NO: 3264234 - protein, 23 aa, Plasmodium falciparum
KEKLKRSISLPLNLKRTVVKIIN

SEQ ID NO: 3264235 - protein, 24 aa, Plasmodium falciparum
KEKNELKPIIIMGTSMGGCIALRT

SEQ ID NO: 3264236 - protein, 34 aa, Plasmodium falciparum
KEKNEYLPNVLILWCKRVKYAINIYNNNNNIKIK

SEQ ID NO: 3264237 - protein, 25 aa, Plasmodium falciparum
KEKNFLKQGIVNYIFEEKERKSKEN

SEQ ID NO: 3264238 - protein, 23 aa, Plasmodium falciparum
KEKNFRWSMILSIGSKKKDLELG

SEQ ID NO: 3264239 - protein, 25 aa, Plasmodium falciparum
KEKNMLSSYGFIFVFLYFGLNNLVL

SEQ ID NO: 3264240 - protein, 20 aa, Plasmodium falciparum
KEKQAGVKKEKVPETKKEKA

SEQ ID NO: 3264241 - protein, 20 aa, Plasmodium falciparum
KEKRKIFFILLKYKNIKKKK

SEQ ID NO: 3264242 - protein, 17 aa, Plasmodium falciparum
KEKRKKKIMINQTINKN

SEQ ID NO: 3264243 - protein, 19 aa, Plasmodium falciparum
KEKSFKEGILISAASEAKM

SEQ ID NO: 3264244 - protein, 21 aa, Plasmodium falciparum
KEKSSIYFKSFSFENNLYHSG

SEQ ID NO: 3264245 - protein, 26 aa, Plasmodium falciparum
KEKSYYCSSFFIALIFFYKNPYENTF

SEQ ID NO: 3264246 - protein, 18 aa, Plasmodium falciparum
KEKYCSGNGYDCRKTIYK

SEQ ID NO: 3264247 - protein, 21 aa, Plasmodium falciparum
KEKYFKVAIKATKTLEEFKKY

SEQ ID NO: 3264248 - protein, 19 aa, Plasmodium falciparum
KEKYKYKKSIILYLHEITK

SEQ ID NO: 3264249 - protein, 21 aa, Plasmodium falciparum
KEKYYIYIPFIIFESQTLMLN

SEQ ID NO: 3264250 - protein, 17 aa, Plasmodium falciparum
KELCLKSKIPNNYDEIL

SEQ ID NO: 3264251 - protein, 22 aa, Plasmodium falciparum
KELDIIYLYAAFLPLESDLFHL

SEQ ID NO: 3264252 - protein, 20 aa, Plasmodium falciparum
KELEELGLLNIKSLLYEDFK

SEQ ID NO: 3264253 - protein, 17 aa, Plasmodium falciparum
KELEGKVSFDFDKTSPF

SEQ ID NO: 3264254 - protein, 20 aa, Plasmodium falciparum
KELEVLFSKVFSFKYSSNYI

SEQ ID NO: 3264255 - protein, 17 aa, Plasmodium falciparum
KELFFKEFSNLFDKEFI

SEQ ID NO: 3264256 - protein, 20 aa, Plasmodium falciparum
KELFKKSSVITFLMDHYFRH

SEQ ID NO: 3264257 - protein, 26 aa, Plasmodium falciparum
KELFLKKQSDILFVPFYFNKNTKDNI

SEQ ID NO: 3264258 - protein, 20 aa, Plasmodium falciparum
KELFSFVYNLPFFKNLNEDI

SEQ ID NO: 3264259 - protein, 21 aa, Plasmodium falciparum
KELIENIYLSKNHILLVIKNS

SEQ ID NO: 3264260 - protein, 26 aa, Plasmodium falciparum
KELIIKSSCFKLIKYLLTEYYYYPDI

SEQ ID NO: 3264261 - protein, 24 aa, Plasmodium falciparum
KELIKRWLEYFFQDYNRIQKKLKP

SEQ ID NO: 3264262 - protein, 21 aa, Plasmodium falciparum
KELIRLEGFILNTLDNLFAKR

SEQ ID NO: 3264263 - protein, 20 aa, Plasmodium falciparum
KELKGKLSFASILGESAGTD

SEQ ID NO: 3264264 - protein, 24 aa, Plasmodium falciparum
KELKGRTPFEYGYYKNVLNNYNKY

SEQ ID NO: 3264265 - protein, 17 aa, Plasmodium falciparum
KELKIAIDNTNEEKDKK

SEQ ID NO: 3264266 - protein, 17 aa, Plasmodium falciparum
KELKKLFEQYVLNIRII

SEQ ID NO: 3264267 - protein, 17 aa, Plasmodium falciparum
KELKKSNIINYIIKKKK

SEQ ID NO: 3264268 - protein, 21 aa, Plasmodium falciparum
KELKNRYGSVETFLVLLNNEK

SEQ ID NO: 3264269 - protein, 20 aa, Plasmodium falciparum
KELKWSDDNIYEYIESVDKD

SEQ ID NO: 3264270 - protein, 20 aa, Plasmodium falciparum
KELLETLQIVAEREAYYLWK

SEQ ID NO: 3264271 - protein, 18 aa, Plasmodium falciparum
KELLFILLNNYRPSLKQR

SEQ ID NO: 3264272 - protein, 19 aa, Plasmodium falciparum
KELLVSCVINNVMYGKKDI

SEQ ID NO: 3264273 - protein, 26 aa, Plasmodium falciparum
KELLYKCLRLLVRLHSAGLSHLDLTA

SEQ ID NO: 3264274 - protein, 17 aa, Plasmodium falciparum
KELMELYMTGIKKDNTY

SEQ ID NO: 3264275 - protein, 20 aa, Plasmodium falciparum
KELMNALILKRGYHTIMKRR

SEQ ID NO: 3264276 - protein, 23 aa, Plasmodium falciparum
KELNCKRYFLNYNKDFKKEIYYY

SEQ ID NO: 3264277 - protein, 21 aa, Plasmodium falciparum
KELNCLIFLSLVVKKKKYHHI

SEQ ID NO: 3264278 - protein, 24 aa, Plasmodium falciparum
KELNYKHFLLFNSFVNPLKNFDIY

SEQ ID NO: 3264279 - protein, 24 aa, Plasmodium falciparum
KELRIRKGCCLLLGSVIKAHGMDF

SEQ ID NO: 3264280 - protein, 25 aa, Plasmodium falciparum
KELRKIRMKKNEFYESVKLYQSILE

SEQ ID NO: 3264281 - protein, 17 aa, Plasmodium falciparum
KELRKISKVVIVENINI

SEQ ID NO: 3264282 - protein, 23 aa, Plasmodium falciparum
KELRNKGSEGLKENAELKNKELQ

SEQ ID NO: 3264283 - protein, 23 aa, Plasmodium falciparum
KELRNKGSEGLKENVYTNNDLKN

SEQ ID NO: 3264284 - protein, 19 aa, Plasmodium falciparum
KELSKAFRSRFIEFQINDF

SEQ ID NO: 3264285 - protein, 32 aa, Plasmodium falciparum
KELSYYKNLCKEFKIELELLKNGHKGGSTTKM

SEQ ID NO: 3264286 - protein, 24 aa, Plasmodium falciparum
KELTTICLKSIFKEIYDHKNINYE

SEQ ID NO: 3264287 - protein, 19 aa, Plasmodium falciparum
KELVEIINDLIFFLFEDNF

SEQ ID NO: 3264288 - protein, 26 aa, Plasmodium falciparum
KELYFLKKISTFYIKDLYDKCIDFIN

SEQ ID NO: 3264289 - protein, 20 aa, Plasmodium falciparum
KELYRYGSRTVVITKRKEKT

SEQ ID NO: 3264290 - protein, 18 aa, Plasmodium falciparum
KELYWARKKRIYNKKLKK

SEQ ID NO: 3264291 - protein, 21 aa, Plasmodium falciparum
KEMFDDWLVHGHIKLDEFKIV

SEQ ID NO: 3264292 - protein, 17 aa, Plasmodium falciparum
KEMFLLGDFKKHLFQTG

SEQ ID NO: 3264293 - protein, 17 aa, Plasmodium falciparum
KEMKIIKYLKERKTSSS

SEQ ID NO: 3264294 - protein, 18 aa, Plasmodium falciparum
KEMKKYVFKNECDQNNNI

SEQ ID NO: 3264295 - protein, 27 aa, Plasmodium falciparum
KEMLDISVLPKKIFNYNISAFIQYMSK

SEQ ID NO: 3264296 - protein, 24 aa, Plasmodium falciparum
KEMNHKTIVPKCCFENEKTKLDHV

SEQ ID NO: 3264297 - protein, 19 aa, Plasmodium falciparum
KEMNRFSTINFFSDKSNIY

SEQ ID NO: 3264298 - protein, 18 aa, Plasmodium falciparum
KENEHGKCNSNCVSRKCY

SEQ ID NO: 3264299 - protein, 17 aa, Plasmodium falciparum
KENELFGTYHTKYTTFN

SEQ ID NO: 3264300 - protein, 22 aa, Plasmodium falciparum
KENFKYFFEKILQNVEKNFHTY

SEQ ID NO: 3264301 - protein, 24 aa, Plasmodium falciparum
KENIKNLLIYLFLKKMNLLNDEKL

SEQ ID NO: 3264302 - protein, 34 aa, Plasmodium falciparum
KENIKNLLLFHTHFFFYYYFCILQQNNYDIIHEQ

SEQ ID NO: 3264303 - protein, 18 aa, Plasmodium falciparum
KENIKQFIILTIKNNNTS

SEQ ID NO: 3264304 - protein, 25 aa, Plasmodium falciparum
KENILALFACIIIKHIDSFEDEDIQ

SEQ ID NO: 3264305 - protein, 26 aa, Plasmodium falciparum
KENITNCVLYKSIIYNNCNKEIQKKK

SEQ ID NO: 3264306 - protein, 22 aa, Plasmodium falciparum
KENKILLSLKEIYKLMVDIQNK

SEQ ID NO: 3264307 - protein, 26 aa, Plasmodium falciparum
KENKKHSSLCLFLYCIGKMKHRDNKL

SEQ ID NO: 3264308 - protein, 25 aa, Plasmodium falciparum
KENKLKCLHIYIINIFKNIYHPNMK

SEQ ID NO: 3264309 - protein, 24 aa, Plasmodium falciparum
KENKNLWVFFEFNLFDSLLSSIEE

SEQ ID NO: 3264310 - protein, 28 aa, Plasmodium falciparum
KENKQNCCSKFTSYIPIHVSRNYTCTNT

SEQ ID NO: 3264311 - protein, 24 aa, Plasmodium falciparum
KENKWECRNVCGYVVCKPKEGNRE

SEQ ID NO: 3264312 - protein, 25 aa, Plasmodium falciparum
KENKWKCGNVCGYVVCKPENGNGKI

SEQ ID NO: 3264313 - protein, 20 aa, Plasmodium falciparum
KENLISIDFMNFIGKKNLNK

SEQ ID NO: 3264314 - protein, 30 aa, Plasmodium falciparum
KENLKENKRNVCLSIIFSININHKEKKNEH

SEQ ID NO: 3264315 - protein, 17 aa, Plasmodium falciparum
KENLNICTDNKYIFLEL

SEQ ID NO: 3264316 - protein, 17 aa, Plasmodium falciparum
KENMEILSQLLNYLMMC

SEQ ID NO: 3264317 - protein, 23 aa, Plasmodium falciparum
KENPCYGRQGVRFSDTKGAKCYS

SEQ ID NO: 3264318 - protein, 17 aa, Plasmodium falciparum
KENTCLNKSLLKVKDSI

SEQ ID NO: 3264319 - protein, 19 aa, Plasmodium falciparum
KENTLYCILNLNNRKVNVI

SEQ ID NO: 3264320 - protein, 22 aa, Plasmodium falciparum
KENYAMSLIWSFFNTEIVINGT

SEQ ID NO: 3264321 - protein, 18 aa, Plasmodium falciparum
KENYEIILDLELLQMQNN

SEQ ID NO: 3264322 - protein, 47 aa, Plasmodium falciparum
KENYFKLNRFLSCVFFSVHFSLSILCVACPCAVGLASPLSIAISTYI

SEQ ID NO: 3264323 - protein, 18 aa, Plasmodium falciparum
KEPIFRFNMPSVNKRLNN

SEQ ID NO: 3264324 - protein, 25 aa, Plasmodium falciparum
KEPKMNSLMHFLKPFTLKLETTKIL

SEQ ID NO: 3264325 - protein, 18 aa, Plasmodium falciparum
KEPTICVNIKNSTNENNN

SEQ ID NO: 3264326 - protein, 21 aa, Plasmodium falciparum
KEPYIYEMLDLTSQYSSEGIG

SEQ ID NO: 3264327 - protein, 18 aa, Plasmodium falciparum
KEQCDLKSLFSYFTESLK

SEQ ID NO: 3264328 - protein, 24 aa, Plasmodium falciparum
KEQFLKTLILDFFIYVHNIYKQKL

SEQ ID NO: 3264329 - protein, 20 aa, Plasmodium falciparum
KEQHPCLRFLNDLQGLNYIY

SEQ ID NO: 3264330 - protein, 19 aa, Plasmodium falciparum
KEQIITILFTKDLYKLKLF

SEQ ID NO: 3264331 - protein, 23 aa, Plasmodium falciparum
KEQLKETILYPLEYKHLYNKFNS

SEQ ID NO: 3264332 - protein, 28 aa, Plasmodium falciparum
KEQLNWGLIVEEVFKKKVEPYLPHEPIH

SEQ ID NO: 3264333 - protein, 32 aa, Plasmodium falciparum
KEQLQFSHFFLYPLMDIYNLFLFLNDIKLCNS

SEQ ID NO: 3264334 - protein, 18 aa, Plasmodium falciparum
KEQMDSYLMHLRMQNDIK

SEQ ID NO: 3264335 - protein, 20 aa, Plasmodium falciparum
KEQMLLYFLYENKSFYVESF

SEQ ID NO: 3264336 - protein, 21 aa, Plasmodium falciparum
KEQSSGNLISNCFSRDFLHTI

SEQ ID NO: 3264337 - protein, 18 aa, Plasmodium falciparum
KEQWKCRNVCGYIVCGLK

SEQ ID NO: 3264338 - protein, 29 aa, Plasmodium falciparum
KEQWKCRNVCGYVVCKLEKVNEKHIIQIR

SEQ ID NO: 3264339 - protein, 24 aa, Plasmodium falciparum
KEQWKCRNVCGYVVCKPENGTADT

SEQ ID NO: 3264340 - protein, 19 aa, Plasmodium falciparum
KEQYFFAELSKLFYYFTQK

SEQ ID NO: 3264341 - protein, 20 aa, Plasmodium falciparum
KEQYNHLGYVFSTYILYYWS

SEQ ID NO: 3264342 - protein, 18 aa, Plasmodium falciparum
KERCTYINNLWRTYKMCI

SEQ ID NO: 3264343 - protein, 23 aa, Plasmodium falciparum
KERDMNILFILLQFISYNMIFID

SEQ ID NO: 3264344 - protein, 24 aa, Plasmodium falciparum
KEREWKWKTIIEIHMEVLEDCKNE

SEQ ID NO: 3264345 - protein, 17 aa, Plasmodium falciparum
KERGAECDKNKISGSND

SEQ ID NO: 3264346 - protein, 17 aa, Plasmodium falciparum
KERGVGLLCPKLLESIG

SEQ ID NO: 3264347 - protein, 25 aa, Plasmodium falciparum
KERKFLFHKKCHGLSKYEYIDEKTN

SEQ ID NO: 3264348 - protein, 24 aa, Plasmodium falciparum
KERKRYRRINDLGENVSNDYLYFS

SEQ ID NO: 3264349 - protein, 18 aa, Plasmodium falciparum
KERLHEYEIEIRKLNELR

SEQ ID NO: 3264350 - protein, 23 aa, Plasmodium falciparum
KERMKHLKIHTDDIVKELFDMDI

SEQ ID NO: 3264351 - protein, 20 aa, Plasmodium falciparum
KERRASFKFQDFVVKEDSVV

SEQ ID NO: 3264352 - protein, 18 aa, Plasmodium falciparum
KERTRRTSLMNEYYIPKK

SEQ ID NO: 3264353 - protein, 18 aa, Plasmodium falciparum
KERVGCYNILNVLDLYYT

SEQ ID NO: 3264354 - protein, 19 aa, Plasmodium falciparum
KERYDMLEYVYTNIYKNEE

SEQ ID NO: 3264355 - protein, 24 aa, Plasmodium falciparum
KESKEKIFLLLYIISGKYNGLIQS

SEQ ID NO: 3264356 - protein, 20 aa, Plasmodium falciparum
KESKFIPWYIEEVKQSNKVN

SEQ ID NO: 3264357 - protein, 26 aa, Plasmodium falciparum
KESKLYQRKGIRNKCVLYKYTDLLLF

SEQ ID NO: 3264358 - protein, 34 aa, Plasmodium falciparum
KESKYAHGYLRKILKNIICTSGTDIAYCNCMEGT

SEQ ID NO: 3264359 - protein, 20 aa, Plasmodium falciparum
KESLKKIILLKDEAQLDITL

SEQ ID NO: 3264360 - protein, 23 aa, Plasmodium falciparum
KESSGIIGRYLYIQFVLFHKNKI

SEQ ID NO: 3264361 - protein, 17 aa, Plasmodium falciparum
KESYMNKGINFLLTNIS

SEQ ID NO: 3264362 - protein, 18 aa, Plasmodium falciparum
KESYPEWQCDKSKFKNGE

SEQ ID NO: 3264363 - protein, 23 aa, Plasmodium falciparum
KESYRFSFFISILYAFSLGNIHA

SEQ ID NO: 3264364 - protein, 41 aa, Plasmodium falciparum
KESYVYITNVFIKWNKKIYKYSCKYIKLLHYYQMNAKSFFF

SEQ ID NO: 3264365 - protein, 21 aa, Plasmodium falciparum
KETHSQLSLCIDQKEDPIFHF

SEQ ID NO: 3264366 - protein, 23 aa, Plasmodium falciparum
KETKLFYKGVMIIDIKNFIYDNK

SEQ ID NO: 3264367 - protein, 20 aa, Plasmodium falciparum
KETLIPFIESVVCINSVTSK

SEQ ID NO: 3264368 - protein, 34 aa, Plasmodium falciparum
KETNIRINLFIDICWIYFRYMKFLTYIKRERNME

SEQ ID NO: 3264369 - protein, 25 aa, Plasmodium falciparum
KETSFNCVWISYKHELRSYDDENEP

SEQ ID NO: 3264370 - protein, 28 aa, Plasmodium falciparum
KETVLDYYIDDIIKRIVEDTSHVNNIKE

SEQ ID NO: 3264371 - protein, 34 aa, Plasmodium falciparum
KEVEFCKNMKLPILFFLLIKRLLIMEVSNSNLNM

SEQ ID NO: 3264372 - protein, 18 aa, Plasmodium falciparum
KEVHEFYSSVDFYKIENL

SEQ ID NO: 3264373 - protein, 23 aa, Plasmodium falciparum
KEVKDQKNGICKNEISHSHAENK

SEQ ID NO: 3264374 - protein, 24 aa, Plasmodium falciparum
KEVKKNICGSLYELIFNEIMNDYI

SEQ ID NO: 3264375 - protein, 19 aa, Plasmodium falciparum
KEVLSCIELFTTNYNNFSD

SEQ ID NO: 3264376 - protein, 23 aa, Plasmodium falciparum
KEVNINWQFVKDIILNVYSSKVE

SEQ ID NO: 3264377 - protein, 27 aa, Plasmodium falciparum
KEVSDICFRFSRLIIGKNFIKNLEKYQ

SEQ ID NO: 3264378 - protein, 32 aa, Plasmodium falciparum
KEVYNHGLVVLGWRSPIPVRRDVISCSVKKSE

SEQ ID NO: 3264379 - protein, 26 aa, Plasmodium falciparum
KEYCRKVWIELFPQLFYFFNKEEIKI

SEQ ID NO: 3264380 - protein, 29 aa, Plasmodium falciparum
KEYDMWFNNIRCIFCNETQTINKYFIGII

SEQ ID NO: 3264381 - protein, 17 aa, Plasmodium falciparum
KEYEKALLLYNLINKDL

SEQ ID NO: 3264382 - protein, 32 aa, Plasmodium falciparum
KEYEYKYLKLIFNLYCFEHFSNVYDTYVNKLS

SEQ ID NO: 3264383 - protein, 27 aa, Plasmodium falciparum
KEYFFKHLKRRIQGFNKAFIELFENIE

SEQ ID NO: 3264384 - protein, 18 aa, Plasmodium falciparum
KEYIKLFHWSHVIDGKGN

SEQ ID NO: 3264385 - protein, 25 aa, Plasmodium falciparum
KEYIKNIQILYECRVIIFEYFSLYS

SEQ ID NO: 3264386 - protein, 17 aa, Plasmodium falciparum
KEYIYFLYDPELVGIRY

SEQ ID NO: 3264387 - protein, 18 aa, Plasmodium falciparum
KEYKEKKLLENKYEYSYL

SEQ ID NO: 3264388 - protein, 23 aa, Plasmodium falciparum
KEYKENIFYIFSIISKNKQNLSL

SEQ ID NO: 3264389 - protein, 21 aa, Plasmodium falciparum
KEYKIENIFFPISVEIKKKII

SEQ ID NO: 3264390 - protein, 21 aa, Plasmodium falciparum
KEYKIIVKLYPQYFFTYQEYI

SEQ ID NO: 3264391 - protein, 21 aa, Plasmodium falciparum
KEYKITYSIINKCLKILINNI

SEQ ID NO: 3264392 - protein, 21 aa, Plasmodium falciparum
KEYKNLCPLCRSNMGDKKNIN

SEQ ID NO: 3264393 - protein, 20 aa, Plasmodium falciparum
KEYKSYELFLKRKNDEKKKE

SEQ ID NO: 3264394 - protein, 36 aa, Plasmodium falciparum
KEYLKIDIFFLKNILCMLHVFFTRGIYLDIDLINND

SEQ ID NO: 3264395 - protein, 23 aa, Plasmodium falciparum
KEYLKKCIMEILLYYNNINMDTL

SEQ ID NO: 3264396 - protein, 24 aa, Plasmodium falciparum
KEYLRSSISFIYNYYQQIHIKSNK

SEQ ID NO: 3264397 - protein, 33 aa, Plasmodium falciparum
KEYLYYNLLSCVYFYFYRIIKNFQIYIQDIVLY

SEQ ID NO: 3264398 - protein, 17 aa, Plasmodium falciparum
KEYMDSYLMHLRMQNDI

SEQ ID NO: 3264399 - protein, 19 aa, Plasmodium falciparum
KEYNKRYMIGHVEEEKVGK

SEQ ID NO: 3264400 - protein, 27 aa, Plasmodium falciparum
KEYNLMLSVECFHSWAKNLLIDTIRWE

SEQ ID NO: 3264401 - protein, 20 aa, Plasmodium falciparum
KEYRMFATEIYKELFDIFLK

SEQ ID NO: 3264402 - protein, 24 aa, Plasmodium falciparum
KEYTNIIFKYMKFITIDVSRKYEN

SEQ ID NO: 3264403 - protein, 23 aa, Plasmodium falciparum
KEYYLTNYITWYITNMIFLLLNR

SEQ ID NO: 3264404 - protein, 18 aa, Plasmodium falciparum
KEYYTNIYKFKWRPYDFL

SEQ ID NO: 3264405 - protein, 18 aa, Plasmodium falciparum
KFAIISQTFCQKIMSNNS

SEQ ID NO: 3264406 - protein, 18 aa, Plasmodium falciparum
KFAIKILNIHSCNIYKLK

SEQ ID NO: 3264407 - protein, 25 aa, Plasmodium falciparum
KFASRPPFFRWLEEWADEFCRKRTH

SEQ ID NO: 3264408 - protein, 19 aa, Plasmodium falciparum
KFDMEGRHYLFSSIANHLR

SEQ ID NO: 3264409 - protein, 33 aa, Plasmodium falciparum
KFDYPLYIKFHMHLALIYKYIGSFRKFTFTIYL

SEQ ID NO: 3264410 - protein, 22 aa, Plasmodium falciparum
KFEASCPIHLLTKLRLLSDERI

SEQ ID NO: 3264411 - protein, 18 aa, Plasmodium falciparum
KFEGKKRIREELKEYYYL

SEQ ID NO: 3264412 - protein, 25 aa, Plasmodium falciparum
KFEKYYRTYMCKRLINDSSFNIILD

SEQ ID NO: 3264413 - protein, 20 aa, Plasmodium falciparum
KFEYDMCIEEVYNLIKLQMI

SEQ ID NO: 3264414 - protein, 18 aa, Plasmodium falciparum
KFEYKNKLIISVFNKKID

SEQ ID NO: 3264415 - protein, 22 aa, Plasmodium falciparum
KFFEWIFNYPLFNEFRNSSVSN

SEQ ID NO: 3264416 - protein, 17 aa, Plasmodium falciparum
KFFFNWKSDAPIYLYFY

SEQ ID NO: 3264417 - protein, 25 aa, Plasmodium falciparum
KFFHGLNKCRFAGIFEGIRKDEWKC

SEQ ID NO: 3264418 - protein, 24 aa, Plasmodium falciparum
KFFIELIKRPLIYSLHILCVNYLI

SEQ ID NO: 3264419 - protein, 23 aa, Plasmodium falciparum
KFFIMINLACHTRQLKMKTSPNY

SEQ ID NO: 3264420 - protein, 27 aa, Plasmodium falciparum
KFFISCASLPMKLFSNFSSWMENKKKS

SEQ ID NO: 3264421 - protein, 24 aa, Plasmodium falciparum
KFFKNCRNQIKIILKERNINEIIN

SEQ ID NO: 3264422 - protein, 18 aa, Plasmodium falciparum
KFFKSIMPLFNLLNDNFN

SEQ ID NO: 3264423 - protein, 27 aa, Plasmodium falciparum
KFFRKFINFNFSFFFIIYDYITNSKSY

SEQ ID NO: 3264424 - protein, 19 aa, Plasmodium falciparum
KFFTVEFFFSNSTKSKHVR

SEQ ID NO: 3264425 - protein, 17 aa, Plasmodium falciparum
KFHKILLNLMIDKYSYL

SEQ ID NO: 3264426 - protein, 25 aa, Plasmodium falciparum
KFICENMLMSFGFIKANKLSYKFVE

SEQ ID NO: 3264427 - protein, 25 aa, Plasmodium falciparum
KFIDSHTFFGLTLPCVVYQIKYKLF

SEQ ID NO: 3264428 - protein, 25 aa, Plasmodium falciparum
KFIENVYFLISFIFELFVEDSICTK

SEQ ID NO: 3264429 - protein, 19 aa, Plasmodium falciparum
KFIFLCGHLGLYTYIYAEK

SEQ ID NO: 3264430 - protein, 18 aa, Plasmodium falciparum
KFIFSAGELCAFSNKYRI

SEQ ID NO: 3264431 - protein, 17 aa, Plasmodium falciparum
KFIHFSIYMIDACSSIE

SEQ ID NO: 3264432 - protein, 26 aa, Plasmodium falciparum
KFIKQNLCFYIFISALHLFFSYKEIQ

SEQ ID NO: 3264433 - protein, 19 aa, Plasmodium falciparum
KFINDPVHYLRIDSTHKFI

SEQ ID NO: 3264434 - protein, 18 aa, Plasmodium falciparum
KFISIFEIILLKNLENIL

SEQ ID NO: 3264435 - protein, 18 aa, Plasmodium falciparum
KFISTFIETFSYVNRVSW

SEQ ID NO: 3264436 - protein, 26 aa, Plasmodium falciparum
KFIYGDCLLLSSFITYLGVFSSSFRI

SEQ ID NO: 3264437 - protein, 21 aa, Plasmodium falciparum
KFKDFCKYINWGISERTTDSF

SEQ ID NO: 3264438 - protein, 17 aa, Plasmodium falciparum
KFKFAHFEMQGYALKQE

SEQ ID NO: 3264439 - protein, 26 aa, Plasmodium falciparum
KFKLFHFIHLLSLSFSITWDLHILIQ

SEQ ID NO: 3264440 - protein, 26 aa, Plasmodium falciparum
KFKNSSWFFCIDIFRQHTNRIFNQRG

SEQ ID NO: 3264441 - protein, 21 aa, Plasmodium falciparum
KFLELNINLGNLIKVEKEKLQ

SEQ ID NO: 3264442 - protein, 20 aa, Plasmodium falciparum
KFLHNYYKPSLYIKEDIYSD

SEQ ID NO: 3264443 - protein, 24 aa, Plasmodium falciparum
KFLIKKDYVMNYLIYVINNIREKI

SEQ ID NO: 3264444 - protein, 25 aa, Plasmodium falciparum
KFLKEFYYDDEFFFLQISFYLFKIL

SEQ ID NO: 3264445 - protein, 19 aa, Plasmodium falciparum
KFLLTSFFLMIEFHTSFHV

SEQ ID NO: 3264446 - protein, 19 aa, Plasmodium falciparum
KFLNCTKNGQSKCINGCNN

SEQ ID NO: 3264447 - protein, 19 aa, Plasmodium falciparum
KFLNIEPLILFAKKLNSKR

SEQ ID NO: 3264448 - protein, 17 aa, Plasmodium falciparum
KFLNKKTLIKFIKKYSL

SEQ ID NO: 3264449 - protein, 18 aa, Plasmodium falciparum
KFLQMLKFIQGYKLKNTR

SEQ ID NO: 3264450 - protein, 20 aa, Plasmodium falciparum
KFMECIKDIVFFENSIYLIE

SEQ ID NO: 3264451 - protein, 19 aa, Plasmodium falciparum
KFMIIVCVLLNMLSLGIYV

SEQ ID NO: 3264452 - protein, 18 aa, Plasmodium falciparum
KFNELYYIQMINVYNEPF

SEQ ID NO: 3264453 - protein, 20 aa, Plasmodium falciparum
KFNIINSRINYINKLSLIIL

SEQ ID NO: 3264454 - protein, 20 aa, Plasmodium falciparum
KFNILSSPLFNNFYKRNNED

SEQ ID NO: 3264455 - protein, 34 aa, Plasmodium falciparum
KFNIMRPSDCNTLFLSTRKRERPNIIFKENDKYD

SEQ ID NO: 3264456 - protein, 22 aa, Plasmodium falciparum
KFNLNSEVLAFLFFNLIGISQS

SEQ ID NO: 3264457 - protein, 22 aa, Plasmodium falciparum
KFNNENCYLIFQGVDQNIYTIL

SEQ ID NO: 3264458 - protein, 19 aa, Plasmodium falciparum
KFPRINILKNNKFYNFYIH

SEQ ID NO: 3264459 - protein, 20 aa, Plasmodium falciparum
KFPSFKPERLHIVDVNTENN

SEQ ID NO: 3264460 - protein, 26 aa, Plasmodium falciparum
KFQARELPRTFILSIYAYDKLTNKEV

SEQ ID NO: 3264461 - protein, 25 aa, Plasmodium falciparum
KFQPIVCFFEKRFLQDINEHLNNLY

SEQ ID NO: 3264462 - protein, 20 aa, Plasmodium falciparum
KFRLILFCFIFFPYCLIVQL

SEQ ID NO: 3264463 - protein, 38 aa, Plasmodium falciparum
KFRYNEILFILKIFCKRKYKNLLLLQCFSEYFYWLCKL

SEQ ID NO: 3264464 - protein, 18 aa, Plasmodium falciparum
KFSDNFSTGLIITKNMPL

SEQ ID NO: 3264465 - protein, 25 aa, Plasmodium falciparum
KFSFIKLCLCLNYFVNLNIKNEPSF

SEQ ID NO: 3264466 - protein, 24 aa, Plasmodium falciparum
KFSFNIRMFILIKQIVEYLLKEKY

SEQ ID NO: 3264467 - protein, 45 aa, Plasmodium falciparum
KFSFPCKHPSIYTCGHFIHTKCLHNTRILKYRKLFSVKNEPTLYE

SEQ ID NO: 3264468 - protein, 18 aa, Plasmodium falciparum
KFSHLYFFFFFNIKSSFN

SEQ ID NO: 3264469 - protein, 19 aa, Plasmodium falciparum
KFSITNALFLSGYIGMNVI

SEQ ID NO: 3264470 - protein, 28 aa, Plasmodium falciparum
KFSKNFQGLCKFIHLIKSVIFIIPYVYK

SEQ ID NO: 3264471 - protein, 18 aa, Plasmodium falciparum
KFSPFNIVLFLNSTTTYR

SEQ ID NO: 3264472 - protein, 19 aa, Plasmodium falciparum
KFSPNLLFHPLIYTIDCAY

SEQ ID NO: 3264473 - protein, 18 aa, Plasmodium falciparum
KFSSYIIESVGWVYENVA

SEQ ID NO: 3264474 - protein, 18 aa, Plasmodium falciparum
KFTDIVITKINFLYSKLK

SEQ ID NO: 3264475 - protein, 18 aa, Plasmodium falciparum
KFTNFLFLRNLYYFVKFY

SEQ ID NO: 3264476 - protein, 19 aa, Plasmodium falciparum
KFTSFSMSLYYSMIYMLKV

SEQ ID NO: 3264477 - protein, 23 aa, Plasmodium falciparum
KFTSRGGKRFARIINKEYITLYD

SEQ ID NO: 3264478 - protein, 24 aa, Plasmodium falciparum
KFTTRLICGILFSYVTLILEVIIF

SEQ ID NO: 3264479 - protein, 17 aa, Plasmodium falciparum
KFVHSIFMKLIKIKEKK

SEQ ID NO: 3264480 - protein, 29 aa, Plasmodium falciparum
KFWKEFKKDIKFLKKTGCIEKLNTTKMRK

SEQ ID NO: 3264481 - protein, 17 aa, Plasmodium falciparum
KFYANLFSYIIILTSLL

SEQ ID NO: 3264482 - protein, 32 aa, Plasmodium falciparum
KFYANLHSLFSCIPFNYRIYKYILKKTSKENK

SEQ ID NO: 3264483 - protein, 26 aa, Plasmodium falciparum
KFYDFFRFWVTHMLDDSMEWKEKLKG

SEQ ID NO: 3264484 - protein, 21 aa, Plasmodium falciparum
KFYIKENLLFLNEAFFNGFIK

SEQ ID NO: 3264485 - protein, 33 aa, Plasmodium falciparum
KFYKDLELRKKNCLYYYRNALFYNGSSMIPCEE

SEQ ID NO: 3264486 - protein, 24 aa, Plasmodium falciparum
KFYKFSYNFFYLLYEMERDFNRIQ

SEQ ID NO: 3264487 - protein, 17 aa, Plasmodium falciparum
KFYKLFKNILSINVKRY

SEQ ID NO: 3264488 - protein, 28 aa, Plasmodium falciparum
KFYKNIYLWYLNCIHIINLQIYVMCHFY

SEQ ID NO: 3264489 - protein, 23 aa, Plasmodium falciparum
KFYQFIEKIHCYFNEKKNNHILY

SEQ ID NO: 3264490 - protein, 28 aa, Plasmodium falciparum
KFYTFHILEFLRLKILEIKEDVDKYIHY

SEQ ID NO: 3264491 - protein, 17 aa, Plasmodium falciparum
KFYYINECIPIQKIGTL

SEQ ID NO: 3264492 - protein, 24 aa, Plasmodium falciparum
KGACMPPRRQSLCIHNLKESNETG

SEQ ID NO: 3264493 - protein, 25 aa, Plasmodium falciparum
KGAQELAELVKIILLKEENDEKKHI

SEQ ID NO: 3264494 - protein, 18 aa, Plasmodium falciparum
KGASVYKKIFKVIKKKKR

SEQ ID NO: 3264495 - protein, 22 aa, Plasmodium falciparum
KGCLRCAGVLGGGVMPGMGLID

SEQ ID NO: 3264496 - protein, 28 aa, Plasmodium falciparum
KGDFFQLREDWWALNREDVWKALTCSAD

SEQ ID NO: 3264497 - protein, 30 aa, Plasmodium falciparum
KGDFFQLREDWWALNREKVWSAITCNAQGN

SEQ ID NO: 3264498 - protein, 20 aa, Plasmodium falciparum
KGDIKKAKFKNGASPSSLED

SEQ ID NO: 3264499 - protein, 18 aa, Plasmodium falciparum
KGDLIKRDVNDNINRNEK

SEQ ID NO: 3264500 - protein, 24 aa, Plasmodium falciparum
KGDRFKIGTDWQGDSFVNPQYRGI

SEQ ID NO: 3264501 - protein, 24 aa, Plasmodium falciparum
KGEEKFLKEEKMPKKEENMQDKIE

SEQ ID NO: 3264502 - protein, 19 aa, Plasmodium falciparum
KGEFTRRAFENNKMSLLQI

SEQ ID NO: 3264503 - protein, 20 aa, Plasmodium falciparum
KGEIKRNSYLGEFIKKDIMI

SEQ ID NO: 3264504 - protein, 30 aa, Plasmodium falciparum
KGEIVCLILSFAIGLRWIFYKDFITHNVLA

SEQ ID NO: 3264505 - protein, 22 aa, Plasmodium falciparum
KGEKLAFSIFFYVDNISNPYNI

SEQ ID NO: 3264506 - protein, 30 aa, Plasmodium falciparum
KGEPRTLFYYEIYKKLFVYYECAINENERK

SEQ ID NO: 3264507 - protein, 20 aa, Plasmodium falciparum
KGESLNLYVAFNYNINLCHE

SEQ ID NO: 3264508 - protein, 20 aa, Plasmodium falciparum
KGEWKKLFYNFIKNKKGKNY

SEQ ID NO: 3264509 - protein, 19 aa, Plasmodium falciparum
KGEYFAVKESNIFKWNKLK

SEQ ID NO: 3264510 - protein, 29 aa, Plasmodium falciparum
KGEYIYPHKDFRLFATITLCNRDHKNNNK

SEQ ID NO: 3264511 - protein, 22 aa, Plasmodium falciparum
KGFDRNGWMNMSIVQPKLNSIN

SEQ ID NO: 3264512 - protein, 24 aa, Plasmodium falciparum
KGFGRGSKYLNLPTANIFHPNFIS

SEQ ID NO: 3264513 - protein, 17 aa, Plasmodium falciparum
KGFNYKKEEILKNLTSA

SEQ ID NO: 3264514 - protein, 17 aa, Plasmodium falciparum
KGFPGLRKLIKVSQIQS

SEQ ID NO: 3264515 - protein, 22 aa, Plasmodium falciparum
KGGNGGSIYICYTNGKDNIKKK

SEQ ID NO: 3264516 - protein, 25 aa, Plasmodium falciparum
KGGRRKNECIYHFSYRNVRKNLYNI

SEQ ID NO: 3264517 - protein, 23 aa, Plasmodium falciparum
KGILKNIYYFWSLNYDEPYIRQC

SEQ ID NO: 3264518 - protein, 35 aa, Plasmodium falciparum
KGILSLWLKKIKVVSSVIILCVDWQHIYSQQNTQS

SEQ ID NO: 3264519 - protein, 25 aa, Plasmodium falciparum
KGINKRPLIGLLTDFEAFKYCEVGN

SEQ ID NO: 3264520 - protein, 17 aa, Plasmodium falciparum
KGIRFVSRIYKKMFLNK

SEQ ID NO: 3264521 - protein, 18 aa, Plasmodium falciparum
KGISKLRGIFKRKKAMKK

SEQ ID NO: 3264522 - protein, 21 aa, Plasmodium falciparum
KGIYPHIYKSNHMVNVETNNF

SEQ ID NO: 3264523 - protein, 17 aa, Plasmodium falciparum
KGKCKMLEIVLDLKDKH

SEQ ID NO: 3264524 - protein, 23 aa, Plasmodium falciparum
KGKEKKKKKLFSFFRRKNKKNKS

SEQ ID NO: 3264525 - protein, 24 aa, Plasmodium falciparum
KGKEKSIEFLFLEFLERYKNIYTF

SEQ ID NO: 3264526 - protein, 22 aa, Plasmodium falciparum
KGKFLCIDDEFNFENNVQNEMD

SEQ ID NO: 3264527 - protein, 20 aa, Plasmodium falciparum
KGKFSVKEVLDFVHQDHENR

SEQ ID NO: 3264528 - protein, 37 aa, Plasmodium falciparum
KGKIKRCTYAYKILLCTIFIWICQCFYNKSYYVYKKD

SEQ ID NO: 3264529 - protein, 24 aa, Plasmodium falciparum
KGKKRLATDIKYFNYFVTYFMISL

SEQ ID NO: 3264530 - protein, 18 aa, Plasmodium falciparum
KGKLGLVKIILRNQYNNI

SEQ ID NO: 3264531 - protein, 24 aa, Plasmodium falciparum
KGKLNFLYEYGMELLHINKVPMNR

SEQ ID NO: 3264532 - protein, 26 aa, Plasmodium falciparum
KGKMIFSCLCKKCISDWNYFPELTPH

SEQ ID NO: 3264533 - protein, 18 aa, Plasmodium falciparum
KGKMVLCDCIYNLKRKSK

SEQ ID NO: 3264534 - protein, 22 aa, Plasmodium falciparum
KGKRYMKINNLDVIKNRELFIY

SEQ ID NO: 3264535 - protein, 23 aa, Plasmodium falciparum
KGKSCEWNIFLVIDNEKEECFFV

SEQ ID NO: 3264536 - protein, 19 aa, Plasmodium falciparum
KGKVKRMIKRKKKIKKLYV

SEQ ID NO: 3264537 - protein, 17 aa, Plasmodium falciparum
KGKWKKILLSIFDEKNF

SEQ ID NO: 3264538 - protein, 21 aa, Plasmodium falciparum
KGKYGTFFFCKSCNKNVSKKY

SEQ ID NO: 3264539 - protein, 23 aa, Plasmodium falciparum
KGLEFFSNNFFHIKKFIEKKENE

SEQ ID NO: 3264540 - protein, 26 aa, Plasmodium falciparum
KGLEIIVKCLFTYLREIKLDKKSYVY

SEQ ID NO: 3264541 - protein, 18 aa, Plasmodium falciparum
KGLIKFLYPFIPHICEIL

SEQ ID NO: 3264542 - protein, 17 aa, Plasmodium falciparum
KGLIQRFIHGRKVNKND

SEQ ID NO: 3264543 - protein, 17 aa, Plasmodium falciparum
KGLKKPLVINSPDENSE

SEQ ID NO: 3264544 - protein, 29 aa, Plasmodium falciparum
KGLNCGPAGRNALIRWIEYNYKMKNDEEN

SEQ ID NO: 3264545 - protein, 25 aa, Plasmodium falciparum
KGLRGKRILVDSIYNFLIFLDSTLY

SEQ ID NO: 3264546 - protein, 17 aa, Plasmodium falciparum
KGLRILGYMYESQNINI

SEQ ID NO: 3264547 - protein, 24 aa, Plasmodium falciparum
KGLSGGIISVHFPKNALFINECQK

SEQ ID NO: 3264548 - protein, 19 aa, Plasmodium falciparum
KGLTLRKSNINSIPDHESI

SEQ ID NO: 3264549 - protein, 17 aa, Plasmodium falciparum
KGMLCALTNGLSESEKK

SEQ ID NO: 3264550 - protein, 17 aa, Plasmodium falciparum
KGMLGFGNLRGVDIPAM

SEQ ID NO: 3264551 - protein, 21 aa, Plasmodium falciparum
KGNELNEEFYIFVQKFNNKHK

SEQ ID NO: 3264552 - protein, 24 aa, Plasmodium falciparum
KGNENRITIIIAHRLSTIRYANTI

SEQ ID NO: 3264553 - protein, 17 aa, Plasmodium falciparum
KGNFFINIFNLYSSDEN

SEQ ID NO: 3264554 - protein, 20 aa, Plasmodium falciparum
KGNGGGKGRLNVMNNNIQKC

SEQ ID NO: 3264555 - protein, 24 aa, Plasmodium falciparum
KGNLYNLIKRKTIYEHNWEENQYN

SEQ ID NO: 3264556 - protein, 28 aa, Plasmodium falciparum
KGNMLCNNFLHKCFMYFDNNIIIDLFLK

SEQ ID NO: 3264557 - protein, 31 aa, Plasmodium falciparum
KGQEVMVYHPFFWKWVTEMLDDSIKWRKELD

SEQ ID NO: 3264558 - protein, 26 aa, Plasmodium falciparum
KGQKARICLARALYHHYIHMKHMNLY

SEQ ID NO: 3264559 - protein, 26 aa, Plasmodium falciparum
KGQKVRICLARALYEHYIHMHKLCTD

SEQ ID NO: 3264560 - protein, 21 aa, Plasmodium falciparum
KGQRKRLKLYFSKPASSYILK

SEQ ID NO: 3264561 - protein, 20 aa, Plasmodium falciparum
KGRCGRTCHGICIRMISKNF

SEQ ID NO: 3264562 - protein, 19 aa, Plasmodium falciparum
KGRCTRGIYISSLATVILT

SEQ ID NO: 3264563 - protein, 23 aa, Plasmodium falciparum
KGREKFPNWKCIPSGDNSTTREG

SEQ ID NO: 3264564 - protein, 22 aa, Plasmodium falciparum
KGREKIMLERQISPDISSFFTF

SEQ ID NO: 3264565 - protein, 19 aa, Plasmodium falciparum
KGRTFSRFTPGGVRSSTVL

SEQ ID NO: 3264566 - protein, 17 aa, Plasmodium falciparum
KGSELISTYSNDITNYN

SEQ ID NO: 3264567 - protein, 21 aa, Plasmodium falciparum
KGSEVMRMYLTILGEEYYKKG

SEQ ID NO: 3264568 - protein, 18 aa, Plasmodium falciparum
KGSFYICINNTKISMKQV

SEQ ID NO: 3264569 - protein, 19 aa, Plasmodium falciparum
KGSIKRKSSIINNLYDKVH

SEQ ID NO: 3264570 - protein, 25 aa, Plasmodium falciparum
KGSKLRFIKCKDIESKKYIVRRFDK

SEQ ID NO: 3264571 - protein, 28 aa, Plasmodium falciparum
KGSPAFKISVWFSGITVGLVWILFSEYN

SEQ ID NO: 3264572 - protein, 20 aa, Plasmodium falciparum
KGSPRNSIKREDSNMYADQS

SEQ ID NO: 3264573 - protein, 19 aa, Plasmodium falciparum
KGSSCSRENKCTGCSNKCV

SEQ ID NO: 3264574 - protein, 30 aa, Plasmodium falciparum
KGSVSVKFRLGYNSFCFNNIHLASGQTNIF

SEQ ID NO: 3264575 - protein, 26 aa, Plasmodium falciparum
KGTFKEYPMHFLIYYYSGIHFEPGVH

SEQ ID NO: 3264576 - protein, 29 aa, Plasmodium falciparum
KGTLLDFFNKAYIKWLRFLNLKEKTDELI

SEQ ID NO: 3264577 - protein, 17 aa, Plasmodium falciparum
KGTMCGPLNVHINTHNS

SEQ ID NO: 3264578 - protein, 21 aa, Plasmodium falciparum
KGVDIYKAIVIDAGSTGTRIH

SEQ ID NO: 3264579 - protein, 17 aa, Plasmodium falciparum
KGVIVWALLYALFSAIF

SEQ ID NO: 3264580 - protein, 26 aa, Plasmodium falciparum
KGVRFLNILRYTRFFEIMEYAESINE

SEQ ID NO: 3264581 - protein, 26 aa, Plasmodium falciparum
KGVRYLIGTPTCFRSYLLNLDKENLK

SEQ ID NO: 3264582 - protein, 17 aa, Plasmodium falciparum
KGYASIIAFCIRGSDNA

SEQ ID NO: 3264583 - protein, 18 aa, Plasmodium falciparum
KGYINMDISHNMFNSKWN

SEQ ID NO: 3264584 - protein, 19 aa, Plasmodium falciparum
KGYKIDIFLNFSYMNNEYN

SEQ ID NO: 3264585 - protein, 24 aa, Plasmodium falciparum
KGYKNKEFIGLFLTGFFIAIGSIS

SEQ ID NO: 3264586 - protein, 20 aa, Plasmodium falciparum
KGYLLLREKSDWLISSILSL

SEQ ID NO: 3264587 - protein, 28 aa, Plasmodium falciparum
KGYVNRRLNPFSIFYIYEIKKYTCLNLK

SEQ ID NO: 3264588 - protein, 18 aa, Plasmodium falciparum
KHALYYYLNELFEQKKKN

SEQ ID NO: 3264589 - protein, 24 aa, Plasmodium falciparum
KHAYKELNNTLCFLNQKKNDNLNM

SEQ ID NO: 3264590 - protein, 20 aa, Plasmodium falciparum
KHDFHKCIFDVLSSNYYIDL

SEQ ID NO: 3264591 - protein, 28 aa, Plasmodium falciparum
KHDFNMRIGLHYGSCVGGIIGSVRIRYD

SEQ ID NO: 3264592 - protein, 20 aa, Plasmodium falciparum
KHDLLLDVCMAANYEAESLI

SEQ ID NO: 3264593 - protein, 22 aa, Plasmodium falciparum
KHDLLVDVCLAAKYEGDSLKHY

SEQ ID NO: 3264594 - protein, 19 aa, Plasmodium falciparum
KHDLLVDVCMAAKYEGESL

SEQ ID NO: 3264595 - protein, 22 aa, Plasmodium falciparum
KHFDLAFKNARISIQPEDVLKY

SEQ ID NO: 3264596 - protein, 23 aa, Plasmodium falciparum
KHFFNASGCYRKIVVKPYNFKSI

SEQ ID NO: 3264597 - protein, 20 aa, Plasmodium falciparum
KHFIKHVLAFFAASDGIVLE

SEQ ID NO: 3264598 - protein, 19 aa, Plasmodium falciparum
KHFKEPYLDLSYNVDSYYN

SEQ ID NO: 3264599 - protein, 17 aa, Plasmodium falciparum
KHFKINHFLSSLFYINK

SEQ ID NO: 3264600 - protein, 29 aa, Plasmodium falciparum
KHFNQRPYFRLLHCLLIDINEQCIYSNDL

SEQ ID NO: 3264601 - protein, 23 aa, Plasmodium falciparum
KHFQRLYEKYGYPITVVNLLSKK

SEQ ID NO: 3264602 - protein, 19 aa, Plasmodium falciparum
KHFTRRPTLKMSENNYSSK

SEQ ID NO: 3264603 - protein, 20 aa, Plasmodium falciparum
KHFYNYFPILKITNNQTNNL

SEQ ID NO: 3264604 - protein, 23 aa, Plasmodium falciparum
KHGCTYMLYIIAMYLLFQMNIIY

SEQ ID NO: 3264605 - protein, 28 aa, Plasmodium falciparum
KHGGYSCVSRNAKWLKIAKEFNLINKEK

SEQ ID NO: 3264606 - protein, 24 aa, Plasmodium falciparum
KHHEEIMSYLLLDVYHNNIVYKNN

SEQ ID NO: 3264607 - protein, 17 aa, Plasmodium falciparum
KHIEKGKEYIKRITQAN

SEQ ID NO: 3264608 - protein, 18 aa, Plasmodium falciparum
KHIEKGKEYIKRITQANN

SEQ ID NO: 3264609 - protein, 17 aa, Plasmodium falciparum
KHIFKNNIYTFIKMNVN

SEQ ID NO: 3264610 - protein, 20 aa, Plasmodium falciparum
KHIHAPSYLQGIRLNYYKII

SEQ ID NO: 3264611 - protein, 22 aa, Plasmodium falciparum
KHIIQLFLKVYLKFPCYIYNLI

SEQ ID NO: 3264612 - protein, 17 aa, Plasmodium falciparum
KHIKCINDEITIMKKIN

SEQ ID NO: 3264613 - protein, 20 aa, Plasmodium falciparum
KHIKETYILNEISQMDDVNS

SEQ ID NO: 3264614 - protein, 23 aa, Plasmodium falciparum
KHIKLEHIFELFTEGCYLFLLPN

SEQ ID NO: 3264615 - protein, 33 aa, Plasmodium falciparum
KHIKYILKKAFKTDFLSFIGFICSVIMMLLTAI

SEQ ID NO: 3264616 - protein, 27 aa, Plasmodium falciparum
KHILCIIRCITKCMMNVPLVSKPIQEN

SEQ ID NO: 3264617 - protein, 22 aa, Plasmodium falciparum
KHILFTCCKDIFKKINDKNIIQ

SEQ ID NO: 3264618 - protein, 21 aa, Plasmodium falciparum
KHILSYCRKDVLNLFEQKFYY

SEQ ID NO: 3264619 - protein, 18 aa, Plasmodium falciparum
KHINEIILFTETFITPKF

SEQ ID NO: 3264620 - protein, 31 aa, Plasmodium falciparum
KHIYKEYINYFLPRYKSLLIDYENYKFCYNF

SEQ ID NO: 3264621 - protein, 44 aa, Plasmodium falciparum
KHKFIKRKLYLVKRILYMFIRIVYPFLQTCHKIYLHGKCNMIQQ

SEQ ID NO: 3264622 - protein, 31 aa, Plasmodium falciparum
KHKNINGDYFIKFFFEKAFYIKNEDMHSMVT

SEQ ID NO: 3264623 - protein, 17 aa, Plasmodium falciparum
KHKNVWSNFLYIIILKL

SEQ ID NO: 3264624 - protein, 25 aa, Plasmodium falciparum
KHKSERKIKCAKDFLSNNNGLCSNK

SEQ ID NO: 3264625 - protein, 24 aa, Plasmodium falciparum
KHKTYSFFRFKFSALQEQYDKQKK

SEQ ID NO: 3264626 - protein, 20 aa, Plasmodium falciparum
KHKYSLLIGLFITFLIFCGF

SEQ ID NO: 3264627 - protein, 24 aa, Plasmodium falciparum
KHLDMCIIYGKILIIQYFNFQNLY

SEQ ID NO: 3264628 - protein, 22 aa, Plasmodium falciparum
KHLDSYLLFYLIKNYFFQHFNS

SEQ ID NO: 3264629 - protein, 25 aa, Plasmodium falciparum
KHLEWTLKINEEFYLQGLLEKSLNI

SEQ ID NO: 3264630 - protein, 19 aa, Plasmodium falciparum
KHLIGYPSFELVDGDTTEN

SEQ ID NO: 3264631 - protein, 17 aa, Plasmodium falciparum
KHLKGRCTRGIYFCSLG

SEQ ID NO: 3264632 - protein, 17 aa, Plasmodium falciparum
KHLKGRCTRGIYFCSVG

SEQ ID NO: 3264633 - protein, 17 aa, Plasmodium falciparum
KHLKGRCTRGIYISSLA

SEQ ID NO: 3264634 - protein, 18 aa, Plasmodium falciparum
KHLKKCPLYIKNLYLHYT

SEQ ID NO: 3264635 - protein, 25 aa, Plasmodium falciparum
KHLKKIFFRYLHIIQRKMNDQGIDE

SEQ ID NO: 3264636 - protein, 21 aa, Plasmodium falciparum
KHLKNRIPLLKTNILRTNETN

SEQ ID NO: 3264637 - protein, 33 aa, Plasmodium falciparum
KHLKVRCSRGIYSCSVLSAFLTTLGLIFAKKAA

SEQ ID NO: 3264638 - protein, 30 aa, Plasmodium falciparum
KHLLHTANKCLVKFLLIKRDHFLQNKDMYK

SEQ ID NO: 3264639 - protein, 30 aa, Plasmodium falciparum
KHLMIKIFFFFCKKNFLLSSFFHSEENIIN

SEQ ID NO: 3264640 - protein, 18 aa, Plasmodium falciparum
KHLNDIFISLNINLSEHD

SEQ ID NO: 3264641 - protein, 26 aa, Plasmodium falciparum
KHLPTEINKILLLIIKIVFKNYMEYI

SEQ ID NO: 3264642 - protein, 34 aa, Plasmodium falciparum
KHLTKLCKFLFLKMIKPFLHFLFTYVYMGINKDY

SEQ ID NO: 3264643 - protein, 18 aa, Plasmodium falciparum
KHMCMLPMEKRRLKKRRR

SEQ ID NO: 3264644 - protein, 18 aa, Plasmodium falciparum
KHMFDRIGEEVYKEVKNG

SEQ ID NO: 3264645 - protein, 28 aa, Plasmodium falciparum
KHNKKVHLLICPFSFFFSVYKEKKNKKY

SEQ ID NO: 3264646 - protein, 19 aa, Plasmodium falciparum
KHNLLVDVCMAAKYEGDSI

SEQ ID NO: 3264647 - protein, 19 aa, Plasmodium falciparum
KHNLLVDVCMAANYEAQSL

SEQ ID NO: 3264648 - protein, 23 aa, Plasmodium falciparum
KHPYFTNRFLKYYIYTDYAGVRI

SEQ ID NO: 3264649 - protein, 19 aa, Plasmodium falciparum
KHRCIGGICSCSVGSAFLT

SEQ ID NO: 3264650 - protein, 19 aa, Plasmodium falciparum
KHRCIGGICSCSVGSFLLT

SEQ ID NO: 3264651 - protein, 19 aa, Plasmodium falciparum
KHRCIGGICSCTVGSAILT

SEQ ID NO: 3264652 - protein, 30 aa, Plasmodium falciparum
KHRMTRKLFKRIKRKFLKTTKKRINKMKKK

SEQ ID NO: 3264653 - protein, 18 aa, Plasmodium falciparum
KHSCMGILTKCFELNKST

SEQ ID NO: 3264654 - protein, 31 aa, Plasmodium falciparum
KHSPHYICLFINSWVKLNCRRKKNYVTNYRN

SEQ ID NO: 3264655 - protein, 22 aa, Plasmodium falciparum
KHTEFFLNILTRFPNLKNVMRL

SEQ ID NO: 3264656 - protein, 17 aa, Plasmodium falciparum
KHTKYKFNNEVECNVLS

SEQ ID NO: 3264657 - protein, 25 aa, Plasmodium falciparum
KHVDLRKAYKIGIKYTQYILKMLYN

SEQ ID NO: 3264658 - protein, 26 aa, Plasmodium falciparum
KHVKITQMLLGITIMLLFIAILYDFI

SEQ ID NO: 3264659 - protein, 19 aa, Plasmodium falciparum
KHVLHREGITMKQNENIVG

SEQ ID NO: 3264660 - protein, 17 aa, Plasmodium falciparum
KHVLKRDYNHIVSNNIQ

SEQ ID NO: 3264661 - protein, 26 aa, Plasmodium falciparum
KHVTIRYMCCAYSLKNLAGVVKKGIF

SEQ ID NO: 3264662 - protein, 23 aa, Plasmodium falciparum
KHYHNILCSLSFENNSFEILNTN

SEQ ID NO: 3264663 - protein, 21 aa, Plasmodium falciparum
KIACIDCCNILYYLKKLNYVN

SEQ ID NO: 3264664 - protein, 25 aa, Plasmodium falciparum
KIAEKLRTLVHFFFGKEYVKNKTYI

SEQ ID NO: 3264665 - protein, 25 aa, Plasmodium falciparum
KIAKKCKRVLFKIFIKYKKDQELID

SEQ ID NO: 3264666 - protein, 24 aa, Plasmodium falciparum
KIAKRAINDWFFFCERVDNDSGEN

SEQ ID NO: 3264667 - protein, 19 aa, Plasmodium falciparum
KICDLCKYFDMFKILKKIH

SEQ ID NO: 3264668 - protein, 30 aa, Plasmodium falciparum
KICDPFKPLCCYSLTPKLFIDKMFKNKPSI

SEQ ID NO: 3264669 - protein, 22 aa, Plasmodium falciparum
KICISTCLLCMELLDNDIFLLL

SEQ ID NO: 3264670 - protein, 26 aa, Plasmodium falciparum
KICMKCKIKTKFMCITCKDMENICSK

SEQ ID NO: 3264671 - protein, 17 aa, Plasmodium falciparum
KICPDFFNKNAINDYSF

SEQ ID NO: 3264672 - protein, 27 aa, Plasmodium falciparum
KICVDLLKKRTFYYINIWEKNKAFYDE

SEQ ID NO: 3264673 - protein, 18 aa, Plasmodium falciparum
KIDFLVNFHYCFYVGVQK

SEQ ID NO: 3264674 - protein, 24 aa, Plasmodium falciparum
KIDIFHFISPIIFFLLGIIIDVLL

SEQ ID NO: 3264675 - protein, 20 aa, Plasmodium falciparum
KIDILNCLLGYQGNIFMSGR

SEQ ID NO: 3264676 - protein, 23 aa, Plasmodium falciparum
KIDKCIFVKKIKRRINIHEIDMY

SEQ ID NO: 3264677 - protein, 18 aa, Plasmodium falciparum
KIDLSFLEYTILYAVAFQ

SEQ ID NO: 3264678 - protein, 31 aa, Plasmodium falciparum
KIDNVYNIFEIRLKRSLAQVLGNTRLSSRGV

SEQ ID NO: 3264679 - protein, 26 aa, Plasmodium falciparum
KIDPTCPFFKNIAIEINGPFHYKTKS

SEQ ID NO: 3264680 - protein, 18 aa, Plasmodium falciparum
KIDRYIYFYPKLKTDIIL

SEQ ID NO: 3264681 - protein, 25 aa, Plasmodium falciparum
KIDSFCCIFNSFKLQWKDNSHEEWK

SEQ ID NO: 3264682 - protein, 18 aa, Plasmodium falciparum
KIDYEFIGFSVEEIKMTF

SEQ ID NO: 3264683 - protein, 26 aa, Plasmodium falciparum
KIEERLRYTLIIIYIFFCLTLHVFIC

SEQ ID NO: 3264684 - protein, 24 aa, Plasmodium falciparum
KIEFRRNSVLELKKNLELTQENKL

SEQ ID NO: 3264685 - protein, 17 aa, Plasmodium falciparum
KIEFSGVHFCNNILNEK

SEQ ID NO: 3264686 - protein, 20 aa, Plasmodium falciparum
KIEKCRRYSILTNRENRTYL

SEQ ID NO: 3264687 - protein, 26 aa, Plasmodium falciparum
KIEKGCLMCACGLGSVAGSVGLLGGF

SEQ ID NO: 3264688 - protein, 26 aa, Plasmodium falciparum
KIEKGCLMCGCGLGGVAGSIGLFGGV

SEQ ID NO: 3264689 - protein, 26 aa, Plasmodium falciparum
KIEKGCLMCGCGLGSVAGSIGLFGAV

SEQ ID NO: 3264690 - protein, 26 aa, Plasmodium falciparum
KIEKGCLMCGCGLGSVAGSIGLFGEV

SEQ ID NO: 3264691 - protein, 19 aa, Plasmodium falciparum
KIELNIFIEHILKSQIIKD

SEQ ID NO: 3264692 - protein, 30 aa, Plasmodium falciparum
KIENCKHCLYDIYPSIKYSYIELEKLKKKS

SEQ ID NO: 3264693 - protein, 17 aa, Plasmodium falciparum
KIENCLDMNIDYSYKIS

SEQ ID NO: 3264694 - protein, 24 aa, Plasmodium falciparum
KIENYKIGLTYDITKQEQIHNYVT

SEQ ID NO: 3264695 - protein, 31 aa, Plasmodium falciparum
KIETLKLFLYYIHMLTFLSLRKYIQIRNIVH

SEQ ID NO: 3264696 - protein, 24 aa, Plasmodium falciparum
KIFFKLNNFFSSYFFLKEFIIYIS

SEQ ID NO: 3264697 - protein, 17 aa, Plasmodium falciparum
KIFFSIKDYLRCTNLIE

SEQ ID NO: 3264698 - protein, 25 aa, Plasmodium falciparum
KIFIFSESISSVFAVKYKNLSNIFT

SEQ ID NO: 3264699 - protein, 18 aa, Plasmodium falciparum
KIFIVYYYYILIYLNKDK

SEQ ID NO: 3264700 - protein, 20 aa, Plasmodium falciparum
KIFKICKALLKYMYDKNYIF

SEQ ID NO: 3264701 - protein, 27 aa, Plasmodium falciparum
KIFKKGEIWRLFTPYLYIGNLYLQYIL

SEQ ID NO: 3264702 - protein, 21 aa, Plasmodium falciparum
KIFKLNGYLNFLKKKKKKKKK

SEQ ID NO: 3264703 - protein, 21 aa, Plasmodium falciparum
KIFLCSCFTYIWILLTVLCNI

SEQ ID NO: 3264704 - protein, 20 aa, Plasmodium falciparum
KIFLHECINNVINILNIFKV

SEQ ID NO: 3264705 - protein, 23 aa, Plasmodium falciparum
KIFLKNLYYMISKIEGIKTYCMG

SEQ ID NO: 3264706 - protein, 20 aa, Plasmodium falciparum
KIFLKNVKKFLLFNYKESFS

SEQ ID NO: 3264707 - protein, 26 aa, Plasmodium falciparum
KIFLKRLKRKSSSYMKDINNMNSVNT

SEQ ID NO: 3264708 - protein, 23 aa, Plasmodium falciparum
KIFLNFLKNFFKIIIDDFDTFFF

SEQ ID NO: 3264709 - protein, 19 aa, Plasmodium falciparum
KIFNFMLQMFITVYGAKYK

SEQ ID NO: 3264710 - protein, 26 aa, Plasmodium falciparum
KIFQEFFVFLWSMSKLKINNIYIDLL

SEQ ID NO: 3264711 - protein, 18 aa, Plasmodium falciparum
KIFRKNGLNRIIRRNGGT

SEQ ID NO: 3264712 - protein, 21 aa, Plasmodium falciparum
KIFSAKCKNVILSLTLLNYSS

SEQ ID NO: 3264713 - protein, 24 aa, Plasmodium falciparum
KIFTCAHFLCLWIYGPLNAIYNTF

SEQ ID NO: 3264714 - protein, 18 aa, Plasmodium falciparum
KIGIEKKELETFVQDVSD

SEQ ID NO: 3264715 - protein, 19 aa, Plasmodium falciparum
KIHFEPIINYLLNIYNKYN

SEQ ID NO: 3264716 - protein, 31 aa, Plasmodium falciparum
KIHKFNIPVSVIWFLYGMCTYVIAKNFNMFE

SEQ ID NO: 3264717 - protein, 26 aa, Plasmodium falciparum
KIHKKQRLEWAIQISCIVHELHAHNP

SEQ ID NO: 3264718 - protein, 21 aa, Plasmodium falciparum
KIHLKKNISLEKVFNIINVAK

SEQ ID NO: 3264719 - protein, 44 aa, Plasmodium falciparum
KIHLTFDVEYLWALCLGTLLFIYSLISFVVIRTFVLSKIDIGKY

SEQ ID NO: 3264720 - protein, 20 aa, Plasmodium falciparum
KIHNSCFFYDMSNNYEQYKD

SEQ ID NO: 3264721 - protein, 20 aa, Plasmodium falciparum
KIHTLIHLLQKILVLQTEAM

SEQ ID NO: 3264722 - protein, 19 aa, Plasmodium falciparum
KIHTLKCIIDSSVYSKNRN

SEQ ID NO: 3264723 - protein, 24 aa, Plasmodium falciparum
KIIDMPLFLVEHIYIRKKKELIKL

SEQ ID NO: 3264724 - protein, 20 aa, Plasmodium falciparum
KIIEGKKKFCVIYKNKIYML

SEQ ID NO: 3264725 - protein, 19 aa, Plasmodium falciparum
KIIEHLKNIILHILKGLLF

SEQ ID NO: 3264726 - protein, 19 aa, Plasmodium falciparum
KIIEKICLFFNIKYNIAII

SEQ ID NO: 3264727 - protein, 24 aa, Plasmodium falciparum
KIIEYCSYDKITLSIITTICEYLN

SEQ ID NO: 3264728 - protein, 24 aa, Plasmodium falciparum
KIIFICKTKFYPNNINVISSILYN

SEQ ID NO: 3264729 - protein, 23 aa, Plasmodium falciparum
KIIFKELLINITIDNIKELYKLY

SEQ ID NO: 3264730 - protein, 21 aa, Plasmodium falciparum
KIIIAEGLLSLCLQNYTDTMK

SEQ ID NO: 3264731 - protein, 20 aa, Plasmodium falciparum
KIIIGHNCFYDILHIYQTFY

SEQ ID NO: 3264732 - protein, 22 aa, Plasmodium falciparum
KIIKCIRRNLHFYINNQNKHKA

SEQ ID NO: 3264733 - protein, 19 aa, Plasmodium falciparum
KIIKFILITIYRLIKYIIV

SEQ ID NO: 3264734 - protein, 18 aa, Plasmodium falciparum
KIIKHKKKSTMLINKELQ

SEQ ID NO: 3264735 - protein, 23 aa, Plasmodium falciparum
KIIKIIWFQYFYKIYRKYYEKYS

SEQ ID NO: 3264736 - protein, 21 aa, Plasmodium falciparum
KIIKILFIFIHIFHITIESFV

SEQ ID NO: 3264737 - protein, 21 aa, Plasmodium falciparum
KIIKNPCAIPLVDVINISIFN

SEQ ID NO: 3264738 - protein, 17 aa, Plasmodium falciparum
KIIKSIYVQKDIFSDII

SEQ ID NO: 3264739 - protein, 24 aa, Plasmodium falciparum
KIIKSWIYSLFCTFFDLQNIYLLL

SEQ ID NO: 3264740 - protein, 17 aa, Plasmodium falciparum
KIILYYKLNNPFYLNEK

SEQ ID NO: 3264741 - protein, 25 aa, Plasmodium falciparum
KIIMSKSRYFLAVPYIGKDTPSSMS

SEQ ID NO: 3264742 - protein, 20 aa, Plasmodium falciparum
KIINCVKPLFNHTNKDISFH

SEQ ID NO: 3264743 - protein, 23 aa, Plasmodium falciparum
KIINLRILSIIKEKEIYIKRKEK

SEQ ID NO: 3264744 - protein, 19 aa, Plasmodium falciparum
KIINLSAGDIICFLHPRYG

SEQ ID NO: 3264745 - protein, 25 aa, Plasmodium falciparum
KIINVKCLYTYLNVPLCILNYNGFL

SEQ ID NO: 3264746 - protein, 29 aa, Plasmodium falciparum
KIINYFKYRIPANINFTFEYNDGDIILLD

SEQ ID NO: 3264747 - protein, 24 aa, Plasmodium falciparum
KIIPIKLLLHMKCSKNRRFYENLF

SEQ ID NO: 3264748 - protein, 25 aa, Plasmodium falciparum
KIIPLNFFECILLILKKKGKFNVLY

SEQ ID NO: 3264749 - protein, 25 aa, Plasmodium falciparum
KIIQCTTYMFLLFFIFSTDFLFDEC

SEQ ID NO: 3264750 - protein, 22 aa, Plasmodium falciparum
KIIQIHLNFLLNFFPVHLPIYH

SEQ ID NO: 3264751 - protein, 25 aa, Plasmodium falciparum
KIIVKLKEPFFYFHQNVVLYFNNDK

SEQ ID NO: 3264752 - protein, 28 aa, Plasmodium falciparum
KIIVSNPFKGMFPKFCLILKKHNIVSIH

SEQ ID NO: 3264753 - protein, 23 aa, Plasmodium falciparum
KIIYEVIICIFTYFNKYHPTDNV

SEQ ID NO: 3264754 - protein, 28 aa, Plasmodium falciparum
KIKDLPAFLKLYGCNCADNSQNSTQNDV

SEQ ID NO: 3264755 - protein, 23 aa, Plasmodium falciparum
KIKDPCKCQKDYLYNIDILLLIL

SEQ ID NO: 3264756 - protein, 19 aa, Plasmodium falciparum
KIKDYDMGSTLEMISVKNN

SEQ ID NO: 3264757 - protein, 21 aa, Plasmodium falciparum
KIKECNCCDDVICDKAELIKL

SEQ ID NO: 3264758 - protein, 25 aa, Plasmodium falciparum
KIKEFFRNEIFIDNIIFHKHNINNN

SEQ ID NO: 3264759 - protein, 22 aa, Plasmodium falciparum
KIKESLFYKYINKIRREFNSNY

SEQ ID NO: 3264760 - protein, 23 aa, Plasmodium falciparum
KIKFKELYFVESINTIMQPFYFK

SEQ ID NO: 3264761 - protein, 20 aa, Plasmodium falciparum
KIKFYASVILSYIPNINEMI

SEQ ID NO: 3264762 - protein, 26 aa, Plasmodium falciparum
KIKGIKRSLSLFSFKSLPIRRRKFGK

SEQ ID NO: 3264763 - protein, 24 aa, Plasmodium falciparum
KIKHFREEIKLALPEQEDEHVKEA

SEQ ID NO: 3264764 - protein, 22 aa, Plasmodium falciparum
KIKIFLDYILSSAYKNVTKELT

SEQ ID NO: 3264765 - protein, 37 aa, Plasmodium falciparum
KIKIKKFICPSTYCILYKTPLYIFLHFIKKYRNKKLQ

SEQ ID NO: 3264766 - protein, 25 aa, Plasmodium falciparum
KIKIKSKFLYKKIYRCFKNIKKNMS

SEQ ID NO: 3264767 - protein, 24 aa, Plasmodium falciparum
KIKIMVIKCFYKIINNSMNNRPNM

SEQ ID NO: 3264768 - protein, 19 aa, Plasmodium falciparum
KIKINFIQILIIFLVYVNL

SEQ ID NO: 3264769 - protein, 20 aa, Plasmodium falciparum
KIKISFTYLLFLKIKKYILI

SEQ ID NO: 3264770 - protein, 25 aa, Plasmodium falciparum
KIKKEFFNIWFLFVMKRKKERNTFL

SEQ ID NO: 3264771 - protein, 25 aa, Plasmodium falciparum
KIKKEVYEKPLLKIKVEYDDVNIIN

SEQ ID NO: 3264772 - protein, 23 aa, Plasmodium falciparum
KIKKICMNEGMISLIDKKHNLYI

SEQ ID NO: 3264773 - protein, 27 aa, Plasmodium falciparum
KIKKIKEIYFLLCLVWIFHNIKREGVS

SEQ ID NO: 3264774 - protein, 20 aa, Plasmodium falciparum
KIKKIYCDHLLLYESDVSLN

SEQ ID NO: 3264775 - protein, 23 aa, Plasmodium falciparum
KIKKKNYKLIAWIQIHMMILERL

SEQ ID NO: 3264776 - protein, 24 aa, Plasmodium falciparum
KIKKKYFALKKMYIHMRMAKEEKS

SEQ ID NO: 3264777 - protein, 30 aa, Plasmodium falciparum
KIKKSIIPYFFKLMVIIYCIIKHIKETYIL

SEQ ID NO: 3264778 - protein, 24 aa, Plasmodium falciparum
KIKKSLKIFCRCNSVKLIKTGIIQ

SEQ ID NO: 3264779 - protein, 32 aa, Plasmodium falciparum
KIKKSLLYLRNCKDHILLIKAILKFVKNQDQN

SEQ ID NO: 3264780 - protein, 18 aa, Plasmodium falciparum
KIKKSSEYNSIFEKLNKN

SEQ ID NO: 3264781 - protein, 21 aa, Plasmodium falciparum
KIKKTSPFFSEPKHFTRREKD

SEQ ID NO: 3264782 - protein, 22 aa, Plasmodium falciparum
KIKKYRTIRYIKSIIQRIKYEI

SEQ ID NO: 3264783 - protein, 20 aa, Plasmodium falciparum
KIKLKLKRGYMNEIYEREKK

SEQ ID NO: 3264784 - protein, 22 aa, Plasmodium falciparum
KIKNIEAFMEYVLIFLQYLGYF

SEQ ID NO: 3264785 - protein, 22 aa, Plasmodium falciparum
KIKNIWLSSKYFRKEDIIIAFF

SEQ ID NO: 3264786 - protein, 23 aa, Plasmodium falciparum
KIKNRVDLMISKGLLDEAIKLKQ

SEQ ID NO: 3264787 - protein, 19 aa, Plasmodium falciparum
KIKNYKNLLGIIFYLCGYI

SEQ ID NO: 3264788 - protein, 29 aa, Plasmodium falciparum
KIKRKEKKRRCFIKLKCFNKIKNLYRFFI

SEQ ID NO: 3264789 - protein, 20 aa, Plasmodium falciparum
KIKTGSCLTQPSGEKQAECE

SEQ ID NO: 3264790 - protein, 26 aa, Plasmodium falciparum
KIKTGSSIPSNFVWKNSDDSKKKMKS

SEQ ID NO: 3264791 - protein, 20 aa, Plasmodium falciparum
KIKVIASILLLFYKLLHSFG

SEQ ID NO: 3264792 - protein, 20 aa, Plasmodium falciparum
KIKVLLKYLSKINIQLKTFI

SEQ ID NO: 3264793 - protein, 24 aa, Plasmodium falciparum
KIKYICNNLHKKKYIISEIPSIVL

SEQ ID NO: 3264794 - protein, 21 aa, Plasmodium falciparum
KIKYIPIWIHQNIQSIFHSSN

SEQ ID NO: 3264795 - protein, 22 aa, Plasmodium falciparum
KIKYRHLCEAEILLHTKNETLF

SEQ ID NO: 3264796 - protein, 17 aa, Plasmodium falciparum
KILCNLNQIIIFLYKNN

SEQ ID NO: 3264797 - protein, 19 aa, Plasmodium falciparum
KILDDFIQCINFLKYKNIS

SEQ ID NO: 3264798 - protein, 18 aa, Plasmodium falciparum
KILDTFKNVDAYGFVVFL

SEQ ID NO: 3264799 - protein, 18 aa, Plasmodium falciparum
KILEEYFLENLIEKLSKS

SEQ ID NO: 3264800 - protein, 17 aa, Plasmodium falciparum
KILERRLILMKKEGILM

SEQ ID NO: 3264801 - protein, 22 aa, Plasmodium falciparum
KILESIKRIRAILSPSILNDDK

SEQ ID NO: 3264802 - protein, 26 aa, Plasmodium falciparum
KILFNYKKFYNFFLIQNFKYLDFTET

SEQ ID NO: 3264803 - protein, 19 aa, Plasmodium falciparum
KILHIKKNIPLNVQNHDKV

SEQ ID NO: 3264804 - protein, 24 aa, Plasmodium falciparum
KILIEPQKLLAAIQNFKNHKKSLE

SEQ ID NO: 3264805 - protein, 19 aa, Plasmodium falciparum
KILIFIYYLFNGFIGYYHR

SEQ ID NO: 3264806 - protein, 18 aa, Plasmodium falciparum
KILISKPMDDIWFKNIIH

SEQ ID NO: 3264807 - protein, 18 aa, Plasmodium falciparum
KILKDCCFFFDTFKMDRN

SEQ ID NO: 3264808 - protein, 19 aa, Plasmodium falciparum
KILKEFILTNAYNIITLEK

SEQ ID NO: 3264809 - protein, 17 aa, Plasmodium falciparum
KILKEYLYYNLLSCVYF

SEQ ID NO: 3264810 - protein, 24 aa, Plasmodium falciparum
KILKHEILEYFYFISNKEIKEYIM

SEQ ID NO: 3264811 - protein, 17 aa, Plasmodium falciparum
KILKIIKIYSFQSAHPF

SEQ ID NO: 3264812 - protein, 18 aa, Plasmodium falciparum
KILKKPREGGDIYSDVYV

SEQ ID NO: 3264813 - protein, 17 aa, Plasmodium falciparum
KILKNIDNVECNNNDAY

SEQ ID NO: 3264814 - protein, 21 aa, Plasmodium falciparum
KILKPNIKYGNKTKYDHKDFI

SEQ ID NO: 3264815 - protein, 25 aa, Plasmodium falciparum
KILKRKKNSISYLIAGACIFLAWKL

SEQ ID NO: 3264816 - protein, 34 aa, Plasmodium falciparum
KILLKCEILTHFNFFNVINCDRYIYQNNLYNNLV

SEQ ID NO: 3264817 - protein, 19 aa, Plasmodium falciparum
KILLLFILVWIFQYSNEEF

SEQ ID NO: 3264818 - protein, 22 aa, Plasmodium falciparum
KILLNKLCSLYIRKCYNNNYIM

SEQ ID NO: 3264819 - protein, 18 aa, Plasmodium falciparum
KILMKHKIYVETIILDRL

SEQ ID NO: 3264820 - protein, 25 aa, Plasmodium falciparum
KILNLDISNSLGFSIHKLMSIPLIN

SEQ ID NO: 3264821 - protein, 21 aa, Plasmodium falciparum
KILNLELCHKFFFTKISYCNK

SEQ ID NO: 3264822 - protein, 17 aa, Plasmodium falciparum
KILNLIYYYLYKYKNNV

SEQ ID NO: 3264823 - protein, 24 aa, Plasmodium falciparum
KILNLRLITILPHLFLQKDDDNNT

SEQ ID NO: 3264824 - protein, 19 aa, Plasmodium falciparum
KILNSCKLYLYLYSYFYYE

SEQ ID NO: 3264825 - protein, 18 aa, Plasmodium falciparum
KILNSKNYKAEWNKNKKN

SEQ ID NO: 3264826 - protein, 26 aa, Plasmodium falciparum
KILQLKINFNLALSFLSASLNIFDKR

SEQ ID NO: 3264827 - protein, 20 aa, Plasmodium falciparum
KILSYFSYFYIFFLSCLQPV

SEQ ID NO: 3264828 - protein, 20 aa, Plasmodium falciparum
KILTACIKLVYYQRNKNYLD

SEQ ID NO: 3264829 - protein, 27 aa, Plasmodium falciparum
KILTGRKLLFLSLRNKKGISGFLNIFE

SEQ ID NO: 3264830 - protein, 34 aa, Plasmodium falciparum
KILTSKLKGVNFIKYKKAWCFTYVDVDDKKKKKI

SEQ ID NO: 3264831 - protein, 28 aa, Plasmodium falciparum
KILWKIRYMPIIKAFAFLYYYGTNKYTV

SEQ ID NO: 3264832 - protein, 18 aa, Plasmodium falciparum
KILYKLKHINEFNNSESN

SEQ ID NO: 3264833 - protein, 17 aa, Plasmodium falciparum
KIMDILLEFFKDIKNIF

SEQ ID NO: 3264834 - protein, 20 aa, Plasmodium falciparum
KIMDINENFLFSNQNEEMNI

SEQ ID NO: 3264835 - protein, 21 aa, Plasmodium falciparum
KIMHHIRCINGFLKTLTKIVI

SEQ ID NO: 3264836 - protein, 23 aa, Plasmodium falciparum
KIMKYNISSIWLNKSQIYLQYIQ

SEQ ID NO: 3264837 - protein, 21 aa, Plasmodium falciparum
KIMLHCINLIRYSNISNDKIN

SEQ ID NO: 3264838 - protein, 20 aa, Plasmodium falciparum
KINDFYITFMKKLKCDINTF

SEQ ID NO: 3264839 - protein, 18 aa, Plasmodium falciparum
KINFCEYGEDFFHKIKKY

SEQ ID NO: 3264840 - protein, 25 aa, Plasmodium falciparum
KINIIFCFFAYVPIFYLITIIPCRI

SEQ ID NO: 3264841 - protein, 24 aa, Plasmodium falciparum
KINIYEHLLTYFLKNINKMIFKYI

SEQ ID NO: 3264842 - protein, 24 aa, Plasmodium falciparum
KINKELAHRTALFNKLADNISLLL

SEQ ID NO: 3264843 - protein, 18 aa, Plasmodium falciparum
KINKFIHSIFPKKSILII

SEQ ID NO: 3264844 - protein, 18 aa, Plasmodium falciparum
KINKLCPLLIKANFCRKG

SEQ ID NO: 3264845 - protein, 20 aa, Plasmodium falciparum
KINKLIFIPYEIIFYCSKHF

SEQ ID NO: 3264846 - protein, 25 aa, Plasmodium falciparum
KINKYKPCSIFSFFKKKDKNDKNDK

SEQ ID NO: 3264847 - protein, 28 aa, Plasmodium falciparum
KINLEKIVPLNLLYKFFQLFNFNINNVQ

SEQ ID NO: 3264848 - protein, 18 aa, Plasmodium falciparum
KINLENNFLFNISIDNEK

SEQ ID NO: 3264849 - protein, 26 aa, Plasmodium falciparum
KINNCCCGNLKEQCCNENNQCCSSQF

SEQ ID NO: 3264850 - protein, 25 aa, Plasmodium falciparum
KINNFTLHIIKKWYEDIQYYYHKLK

SEQ ID NO: 3264851 - protein, 24 aa, Plasmodium falciparum
KINNNLFDLYSLRKVSTNTKQVTK

SEQ ID NO: 3264852 - protein, 21 aa, Plasmodium falciparum
KINSELCFLVFSLMDQTNKSP

SEQ ID NO: 3264853 - protein, 21 aa, Plasmodium falciparum
KINSWLPVDLYVGGSEHAVLH

SEQ ID NO: 3264854 - protein, 20 aa, Plasmodium falciparum
KINTSILYIFNFVAVAPKVI

SEQ ID NO: 3264855 - protein, 20 aa, Plasmodium falciparum
KINVHLFIVSLFIVFIISNI

SEQ ID NO: 3264856 - protein, 27 aa, Plasmodium falciparum
KINVLFKNIFLVSAKTGYNVKKLIYTV

SEQ ID NO: 3264857 - protein, 23 aa, Plasmodium falciparum
KIPDGFLRQMFYTLADYKDILFS

SEQ ID NO: 3264858 - protein, 21 aa, Plasmodium falciparum
KIPIEPCTKFNIFLISKIKNM

SEQ ID NO: 3264859 - protein, 20 aa, Plasmodium falciparum
KIPNTYLFQHIIKYNSEYIN

SEQ ID NO: 3264860 - protein, 27 aa, Plasmodium falciparum
KIPPLEYYKVYDLCKLYPHLKFTLNGG

SEQ ID NO: 3264861 - protein, 23 aa, Plasmodium falciparum
KIPQEFLNHVHLFCYCNVDKDSV

SEQ ID NO: 3264862 - protein, 29 aa, Plasmodium falciparum
KIQILLKLKESLIPQIDGNFIGQWEMEAL

SEQ ID NO: 3264863 - protein, 23 aa, Plasmodium falciparum
KIQKIYICPKETFFNPFFNNFIT

SEQ ID NO: 3264864 - protein, 20 aa, Plasmodium falciparum
KIQLSMTVINLEYWKPEKLK

SEQ ID NO: 3264865 - protein, 19 aa, Plasmodium falciparum
KIQNVFILIIYIKLFYIYY

SEQ ID NO: 3264866 - protein, 17 aa, Plasmodium falciparum
KIQSLGILYLVIGIISL

SEQ ID NO: 3264867 - protein, 27 aa, Plasmodium falciparum
KIQYCKMFIKYIYLMFNILFNICSSLY

SEQ ID NO: 3264868 - protein, 37 aa, Plasmodium falciparum
KIRKFKEYILYYYEFHSVQDFFDLLILFDEEYKNLEM

SEQ ID NO: 3264869 - protein, 20 aa, Plasmodium falciparum
KIRPFPKFYFYKKEKSYYCS

SEQ ID NO: 3264870 - protein, 23 aa, Plasmodium falciparum
KIRREFNSNYVLYRNEKNVMLKN

SEQ ID NO: 3264871 - protein, 21 aa, Plasmodium falciparum
KISDYIIYGIGLFDLDLGYCK

SEQ ID NO: 3264872 - protein, 18 aa, Plasmodium falciparum
KISFPSFNLNTPILNDSW

SEQ ID NO: 3264873 - protein, 17 aa, Plasmodium falciparum
KISHCMRKGEKTICIND

SEQ ID NO: 3264874 - protein, 20 aa, Plasmodium falciparum
KISIEHILFFLIITHVSIDF

SEQ ID NO: 3264875 - protein, 20 aa, Plasmodium falciparum
KISIEIINFLKNCLENNKKY

SEQ ID NO: 3264876 - protein, 24 aa, Plasmodium falciparum
KISKALRNRCFEIFFDNNNVEYVV

SEQ ID NO: 3264877 - protein, 20 aa, Plasmodium falciparum
KISKDITAFMSFLHNKGIMH

SEQ ID NO: 3264878 - protein, 18 aa, Plasmodium falciparum
KISNFLLNFSDSYDITQV

SEQ ID NO: 3264879 - protein, 34 aa, Plasmodium falciparum
KISNSLKWPLHFYRNLCYKNNYKVASENWVSYFY

SEQ ID NO: 3264880 - protein, 23 aa, Plasmodium falciparum
KISSLRLLASRLDFNLYYVRLSK

SEQ ID NO: 3264881 - protein, 19 aa, Plasmodium falciparum
KISTGLDHYACVAYYKNKP

SEQ ID NO: 3264882 - protein, 19 aa, Plasmodium falciparum
KISVIKEVIFYCLSFRFNI

SEQ ID NO: 3264883 - protein, 22 aa, Plasmodium falciparum
KITEHYIFKYVNSIIIDSLFFF

SEQ ID NO: 3264884 - protein, 19 aa, Plasmodium falciparum
KITELYHILLFDLYFCEQV

SEQ ID NO: 3264885 - protein, 22 aa, Plasmodium falciparum
KITLEALEKGKANLFEELVQVS

SEQ ID NO: 3264886 - protein, 29 aa, Plasmodium falciparum
KITNKAFLYCFIKLFVLIVLSLFTIYYIK

SEQ ID NO: 3264887 - protein, 18 aa, Plasmodium falciparum
KITNWDIIHNNIINYIIN

SEQ ID NO: 3264888 - protein, 25 aa, Plasmodium falciparum
KITNYINIILLKFIKLYSSIYSYST

SEQ ID NO: 3264889 - protein, 24 aa, Plasmodium falciparum
KITYEDIPIFLGLINDLFPNVNCN

SEQ ID NO: 3264890 - protein, 37 aa, Plasmodium falciparum
KIVEKQKLPLCKFIHSCVSCALNLKNQNSFLKYILPY

SEQ ID NO: 3264891 - protein, 23 aa, Plasmodium falciparum
KIVELKKKIRIKKFVQLTLLLLL

SEQ ID NO: 3264892 - protein, 19 aa, Plasmodium falciparum
KIVGCVGIVPFKGDNTIAQ

SEQ ID NO: 3264893 - protein, 20 aa, Plasmodium falciparum
KIVISLLLQKCSNFILSLNI

SEQ ID NO: 3264894 - protein, 23 aa, Plasmodium falciparum
KIVKDSFFRILILNTEKLEKNIL

SEQ ID NO: 3264895 - protein, 28 aa, Plasmodium falciparum
KIVKGLSLRLFFIFVLSSFVYIYYGFSF

SEQ ID NO: 3264896 - protein, 19 aa, Plasmodium falciparum
KIVLFCLFINVLFINKYNQ

SEQ ID NO: 3264897 - protein, 20 aa, Plasmodium falciparum
KIVLYILCLIDNKELINKFD

SEQ ID NO: 3264898 - protein, 17 aa, Plasmodium falciparum
KIVQNGICDILTIDKSL

SEQ ID NO: 3264899 - protein, 20 aa, Plasmodium falciparum
KIVRKSLRYIDDIPDKLVSM

SEQ ID NO: 3264900 - protein, 24 aa, Plasmodium falciparum
KIVTFRFIQDLFLKIENNGRMIDR

SEQ ID NO: 3264901 - protein, 17 aa, Plasmodium falciparum
KIWKEWISKIINNIGEW

SEQ ID NO: 3264902 - protein, 17 aa, Plasmodium falciparum
KIWKEWISKIINSVEEW

SEQ ID NO: 3264903 - protein, 17 aa, Plasmodium falciparum
KIWKKAYNDVHGFYLNK

SEQ ID NO: 3264904 - protein, 19 aa, Plasmodium falciparum
KIWNYDILNCLCINNNENG

SEQ ID NO: 3264905 - protein, 19 aa, Plasmodium falciparum
KIYDALDFIEFIKHKRESW

SEQ ID NO: 3264906 - protein, 31 aa, Plasmodium falciparum
KIYFKSILTVFIELFIKMWMLVIIEKGFSNY

SEQ ID NO: 3264907 - protein, 19 aa, Plasmodium falciparum
KIYFSTSINRCKNLFYHFE

SEQ ID NO: 3264908 - protein, 24 aa, Plasmodium falciparum
KIYHIKFETLLIYIIIPKTTTKSL

SEQ ID NO: 3264909 - protein, 22 aa, Plasmodium falciparum
KIYKNFIDICIYKNLKNKKKNN

SEQ ID NO: 3264910 - protein, 18 aa, Plasmodium falciparum
KIYLFIQYILKFKNRCLY

SEQ ID NO: 3264911 - protein, 17 aa, Plasmodium falciparum
KIYLRALLFPKKMYSDV

SEQ ID NO: 3264912 - protein, 17 aa, Plasmodium falciparum
KIYLYIIYLYYYIINHL

SEQ ID NO: 3264913 - protein, 19 aa, Plasmodium falciparum
KIYNCLLNNFVNLNDQEKR

SEQ ID NO: 3264914 - protein, 22 aa, Plasmodium falciparum
KIYPLIINICYDRNISNIFFNI

SEQ ID NO: 3264915 - protein, 24 aa, Plasmodium falciparum
KIYRRLEIYPDFIFNNNNVGFINR

SEQ ID NO: 3264916 - protein, 18 aa, Plasmodium falciparum
KIYSAVIFYLEKYFHVIR

SEQ ID NO: 3264917 - protein, 17 aa, Plasmodium falciparum
KIYSCKRNFEIENINYF

SEQ ID NO: 3264918 - protein, 19 aa, Plasmodium falciparum
KIYSFKILNPFLCCMNSRC

SEQ ID NO: 3264919 - protein, 27 aa, Plasmodium falciparum
KIYSLYKLCLIKIPYYSSLYKILPTMY

SEQ ID NO: 3264920 - protein, 22 aa, Plasmodium falciparum
KIYTEYELKNNIYLIFEILNNI

SEQ ID NO: 3264921 - protein, 18 aa, Plasmodium falciparum
KIYTHPDLIYGMKYRKLG

SEQ ID NO: 3264922 - protein, 38 aa, Plasmodium falciparum
KIYTKINCLQWIELKHLEIMEGINFERLKIAQQELLRI

SEQ ID NO: 3264923 - protein, 18 aa, Plasmodium falciparum
KKACCAIRGSFYDLEDII

SEQ ID NO: 3264924 - protein, 25 aa, Plasmodium falciparum
KKAHFLKKRIIEYSENNIRSLLNNK

SEQ ID NO: 3264925 - protein, 18 aa, Plasmodium falciparum
KKAIGPCPNLGQFEDSIH

SEQ ID NO: 3264926 - protein, 18 aa, Plasmodium falciparum
KKAIHFIKPQVIYKGINY

SEQ ID NO: 3264927 - protein, 23 aa, Plasmodium falciparum
KKAKWKSLIELHLTILEEYKMEE

SEQ ID NO: 3264928 - protein, 25 aa, Plasmodium falciparum
KKAQVDCEIAFFCLYLQKLSCPGYN

SEQ ID NO: 3264929 - protein, 24 aa, Plasmodium falciparum
KKCEECIKILQKIFINRNKNSGVN

SEQ ID NO: 3264930 - protein, 23 aa, Plasmodium falciparum
KKCEEYKKFIEIWKKQFETQNEA

SEQ ID NO: 3264931 - protein, 19 aa, Plasmodium falciparum
KKCKHIYKDIKECREKSMQ

SEQ ID NO: 3264932 - protein, 24 aa, Plasmodium falciparum
KKCLIEMMPMFFLSYIKNSPHIFP

SEQ ID NO: 3264933 - protein, 24 aa, Plasmodium falciparum
KKCNEAFLFDCGENTFIALQKANI

SEQ ID NO: 3264934 - protein, 23 aa, Plasmodium falciparum
KKCRELHMLKSWELLKNTYRYKM

SEQ ID NO: 3264935 - protein, 30 aa, Plasmodium falciparum
KKCTIFRKNCFTYIIPLFFYYIKSMNLKKC

SEQ ID NO: 3264936 - protein, 24 aa, Plasmodium falciparum
KKCTNEGFHFYIHFYSSSLNMDPY

SEQ ID NO: 3264937 - protein, 18 aa, Plasmodium falciparum
KKCYFNFSNTYMLIIYKS

SEQ ID NO: 3264938 - protein, 21 aa, Plasmodium falciparum
KKDCLKNIFITNGNDKDLFFE

SEQ ID NO: 3264939 - protein, 19 aa, Plasmodium falciparum
KKDECCNFDMMSTLDYQRF

SEQ ID NO: 3264940 - protein, 18 aa, Plasmodium falciparum
KKDECIHIKNLLLDNYID

SEQ ID NO: 3264941 - protein, 33 aa, Plasmodium falciparum
KKDEKIILLILYNSWFLYHYIYIIYLNTIKLKN

SEQ ID NO: 3264942 - protein, 19 aa, Plasmodium falciparum
KKDFCFLLYNVNKLNVKNY

SEQ ID NO: 3264943 - protein, 19 aa, Plasmodium falciparum
KKDFVGNLFKNDFVFLNGK

SEQ ID NO: 3264944 - protein, 17 aa, Plasmodium falciparum
KKDGKGEEVPRFSDKQG

SEQ ID NO: 3264945 - protein, 20 aa, Plasmodium falciparum
KKDICNILLYNLIFINKMNK

SEQ ID NO: 3264946 - protein, 18 aa, Plasmodium falciparum
KKDIKLFNYIAIYNNIFE

SEQ ID NO: 3264947 - protein, 24 aa, Plasmodium falciparum
KKDKLKVPFFFKEKGIYNFFNKTV

SEQ ID NO: 3264948 - protein, 19 aa, Plasmodium falciparum
KKDKPCCFIDSLLSHFCIK

SEQ ID NO: 3264949 - protein, 24 aa, Plasmodium falciparum
KKDLLKEFIQHLIKYMNERYQNMQ

SEQ ID NO: 3264950 - protein, 17 aa, Plasmodium falciparum
KKDMEIFNFEVTCFCPV

SEQ ID NO: 3264951 - protein, 20 aa, Plasmodium falciparum
KKDNRRMRIGSRLLTQLENF

SEQ ID NO: 3264952 - protein, 22 aa, Plasmodium falciparum
KKDPKGEYILDVKMASQNVKMA

SEQ ID NO: 3264953 - protein, 23 aa, Plasmodium falciparum
KKDRKKLSFFILLHKFYLDNYNI

SEQ ID NO: 3264954 - protein, 34 aa, Plasmodium falciparum
KKDSSVLNPTAWWRRYGTRLWKTMIQPYAHLGCR

SEQ ID NO: 3264955 - protein, 23 aa, Plasmodium falciparum
KKDVKELGIYLGEDMPKNGNLEN

SEQ ID NO: 3264956 - protein, 22 aa, Plasmodium falciparum
KKDVVYNVCRYSKSHIAPVASF

SEQ ID NO: 3264957 - protein, 24 aa, Plasmodium falciparum
KKDYYCGGGTKILGALKYSLENYT

SEQ ID NO: 3264958 - protein, 17 aa, Plasmodium falciparum
KKEAILFSEEYYNEIKN

SEQ ID NO: 3264959 - protein, 22 aa, Plasmodium falciparum
KKEANIKFTSFLKHDINKYNNF

SEQ ID NO: 3264960 - protein, 26 aa, Plasmodium falciparum
KKECNRRIKCIINEYLKVFKGENNIN

SEQ ID NO: 3264961 - protein, 23 aa, Plasmodium falciparum
KKECNVNKYMLYEKCNPLKKYNK

SEQ ID NO: 3264962 - protein, 20 aa, Plasmodium falciparum
KKEDYSYFIWKEKNKRKNKN

SEQ ID NO: 3264963 - protein, 18 aa, Plasmodium falciparum
KKEECYRNKQTFVDTYIN

SEQ ID NO: 3264964 - protein, 34 aa, Plasmodium falciparum
KKEEKSMHYHPFFWKWVTEMLIDSMYWRKELKSC

SEQ ID NO: 3264965 - protein, 27 aa, Plasmodium falciparum
KKEIDIFLNFYRFMDKFNIYHSTKYQK

SEQ ID NO: 3264966 - protein, 24 aa, Plasmodium falciparum
KKEIIKTFLCEFISTFLITLLLLS

SEQ ID NO: 3264967 - protein, 22 aa, Plasmodium falciparum
KKEIPFKCSSYIFFLDNILSKN

SEQ ID NO: 3264968 - protein, 29 aa, Plasmodium falciparum
KKEISAWTFDFGYWYGFNTSILALILTFS

SEQ ID NO: 3264969 - protein, 18 aa, Plasmodium falciparum
KKEITTYIEYELNIYIKD

SEQ ID NO: 3264970 - protein, 19 aa, Plasmodium falciparum
KKEIYCFNEKTTINDDDQI

SEQ ID NO: 3264971 - protein, 27 aa, Plasmodium falciparum
KKEKCIKRKKQKCKFRISDIYSSLESE

SEQ ID NO: 3264972 - protein, 24 aa, Plasmodium falciparum
KKEKICSLQKLYWISNEGKYMPFQ

SEQ ID NO: 3264973 - protein, 21 aa, Plasmodium falciparum
KKEKINIMYNKGLVINKNLET

SEQ ID NO: 3264974 - protein, 19 aa, Plasmodium falciparum
KKEKIRLFYILNKISLINL

SEQ ID NO: 3264975 - protein, 17 aa, Plasmodium falciparum
KKEKPAVPKKEKVPETK

SEQ ID NO: 3264976 - protein, 24 aa, Plasmodium falciparum
KKEKRKKFLDERNKQIRKKLVDEE

SEQ ID NO: 3264977 - protein, 24 aa, Plasmodium falciparum
KKEKRRKEKDNKKMNELKLKREYK

SEQ ID NO: 3264978 - protein, 23 aa, Plasmodium falciparum
KKEKWMWKTILEIEMKVVEKCKK

SEQ ID NO: 3264979 - protein, 19 aa, Plasmodium falciparum
KKELCRRFDWSRWYTTAIL

SEQ ID NO: 3264980 - protein, 18 aa, Plasmodium falciparum
KKELDFIFQMVMCDCSNV

SEQ ID NO: 3264981 - protein, 28 aa, Plasmodium falciparum
KKELNKYLILCADKCNIYLLKFKFTKIT

SEQ ID NO: 3264982 - protein, 29 aa, Plasmodium falciparum
KKENIFLKIFRYVKNWFPIKSSNNLKKTN

SEQ ID NO: 3264983 - protein, 23 aa, Plasmodium falciparum
KKENKKLSCFVLSLLYILMCLLL

SEQ ID NO: 3264984 - protein, 17 aa, Plasmodium falciparum
KKEQIMLNDLFKINNIV

SEQ ID NO: 3264985 - protein, 20 aa, Plasmodium falciparum
KKEQKRCICTIQVINGEHDS

SEQ ID NO: 3264986 - protein, 18 aa, Plasmodium falciparum
KKERILIKEVSFKMNSLQ

SEQ ID NO: 3264987 - protein, 25 aa, Plasmodium falciparum
KKERILINFELFRQCIIHKDKLYDY

SEQ ID NO: 3264988 - protein, 18 aa, Plasmodium falciparum
KKERVKFLYNYSNKRNEN

SEQ ID NO: 3264989 - protein, 18 aa, Plasmodium falciparum
KKESIPFVVNKEFGTFFA

SEQ ID NO: 3264990 - protein, 21 aa, Plasmodium falciparum
KKESKRLLKRNKLFNDNISLY

SEQ ID NO: 3264991 - protein, 23 aa, Plasmodium falciparum
KKETIKIKIGLISNSYFYLNVDI

SEQ ID NO: 3264992 - protein, 17 aa, Plasmodium falciparum
KKEWALQKLAELQRNGD

SEQ ID NO: 3264993 - protein, 18 aa, Plasmodium falciparum
KKEWELRQKEAEQGQSGL

SEQ ID NO: 3264994 - protein, 22 aa, Plasmodium falciparum
KKEYDFILFFLSKLNVIKILSF

SEQ ID NO: 3264995 - protein, 23 aa, Plasmodium falciparum
KKEYFKLHIGFDYSNFSMDTNYK

SEQ ID NO: 3264996 - protein, 24 aa, Plasmodium falciparum
KKEYINCYEFLKCLKNKSEDINYL

SEQ ID NO: 3264997 - protein, 19 aa, Plasmodium falciparum
KKEYLEPILSFKNILDTTS

SEQ ID NO: 3264998 - protein, 17 aa, Plasmodium falciparum
KKFDIIRSLILSGTLFL

SEQ ID NO: 3264999 - protein, 21 aa, Plasmodium falciparum
KKFESSLSFYPLKEDTYLIFL

SEQ ID NO: 3265000 - protein, 23 aa, Plasmodium falciparum
KKFEYMKILNLYYRQIIHHLLFL

SEQ ID NO: 3265001 - protein, 20 aa, Plasmodium falciparum
KKFFIYESFCSFNTNNTLLI

SEQ ID NO: 3265002 - protein, 24 aa, Plasmodium falciparum
KKFFKIRTKIIFYKLKKVNQIKNA

SEQ ID NO: 3265003 - protein, 18 aa, Plasmodium falciparum
KKFIKKFLFINTCDEQHN

SEQ ID NO: 3265004 - protein, 32 aa, Plasmodium falciparum
KKFIKSLFLRGCLFYVQKMCEFYFLLFPYENK

SEQ ID NO: 3265005 - protein, 21 aa, Plasmodium falciparum
KKFILHKNCSCYHEIYDQFYL

SEQ ID NO: 3265006 - protein, 21 aa, Plasmodium falciparum
KKFKFNLKFYKKNVRKENNSS

SEQ ID NO: 3265007 - protein, 18 aa, Plasmodium falciparum
KKFKILNFISRFQFVDVF

SEQ ID NO: 3265008 - protein, 18 aa, Plasmodium falciparum
KKFKKNYVKANFIKCKEK

SEQ ID NO: 3265009 - protein, 24 aa, Plasmodium falciparum
KKFKSCSFILYNIKIYGYKSLYRG

SEQ ID NO: 3265010 - protein, 17 aa, Plasmodium falciparum
KKFLSFVPFIYNILNER

SEQ ID NO: 3265011 - protein, 21 aa, Plasmodium falciparum
KKFLSGLSYALIKGCNIQMEH

SEQ ID NO: 3265012 - protein, 17 aa, Plasmodium falciparum
KKFLSSYTYEEIVNILC

SEQ ID NO: 3265013 - protein, 21 aa, Plasmodium falciparum
KKFLYLSSFAWYIISLLEKKL

SEQ ID NO: 3265014 - protein, 22 aa, Plasmodium falciparum
KKFNENFLIFSKNIIKIDFIKI

SEQ ID NO: 3265015 - protein, 21 aa, Plasmodium falciparum
KKFNNFLLNLRIIYGETEEKL

SEQ ID NO: 3265016 - protein, 21 aa, Plasmodium falciparum
KKFNYPIPFNKLNNIDKNSKF

SEQ ID NO: 3265017 - protein, 22 aa, Plasmodium falciparum
KKFRNYSMVFLINVVLQKNTGK

SEQ ID NO: 3265018 - protein, 21 aa, Plasmodium falciparum
KKFSKKIFSFEMKRKYGKDYG

SEQ ID NO: 3265019 - protein, 27 aa, Plasmodium falciparum
KKFTDFYCSVVILSNLCFHIDTYYKEK

SEQ ID NO: 3265020 - protein, 17 aa, Plasmodium falciparum
KKFYDLYNRGFKLTEKD

SEQ ID NO: 3265021 - protein, 26 aa, Plasmodium falciparum
KKFYENIELYLLSIFVFEKNKNICDI

SEQ ID NO: 3265022 - protein, 19 aa, Plasmodium falciparum
KKFYKCANYSIGSGVLNAS

SEQ ID NO: 3265023 - protein, 19 aa, Plasmodium falciparum
KKGEYLIDILNFLKILCNN

SEQ ID NO: 3265024 - protein, 18 aa, Plasmodium falciparum
KKGFFVFNKNMQIISLID

SEQ ID NO: 3265025 - protein, 21 aa, Plasmodium falciparum
KKGILDKIHVLWFYEKKNEVH

SEQ ID NO: 3265026 - protein, 20 aa, Plasmodium falciparum
KKGKCDCEILCLKKREQNDY

SEQ ID NO: 3265027 - protein, 19 aa, Plasmodium falciparum
KKGKEQFSKFIGKHNSMGF

SEQ ID NO: 3265028 - protein, 18 aa, Plasmodium falciparum
KKGKLVIGSECTKCSVWC

SEQ ID NO: 3265029 - protein, 24 aa, Plasmodium falciparum
KKGKRKSLPNCRIMIHQPLGNAFG

SEQ ID NO: 3265030 - protein, 25 aa, Plasmodium falciparum
KKGLPITCISCIIYALNYASHSIYL

SEQ ID NO: 3265031 - protein, 26 aa, Plasmodium falciparum
KKGSILKKEDTLKCSKMINVQEKEKS

SEQ ID NO: 3265032 - protein, 18 aa, Plasmodium falciparum
KKGVSCKINNLFYSESGL

SEQ ID NO: 3265033 - protein, 17 aa, Plasmodium falciparum
KKGYLFFFHNMFNNINL

SEQ ID NO: 3265034 - protein, 18 aa, Plasmodium falciparum
KKGYVVMVCEFFGEDIFD

SEQ ID NO: 3265035 - protein, 27 aa, Plasmodium falciparum
KKHAIKSLLYREKRYIFFKIIDILRMF

SEQ ID NO: 3265036 - protein, 22 aa, Plasmodium falciparum
KKHFEKKCIEFTKLFYDYFDTQ

SEQ ID NO: 3265037 - protein, 28 aa, Plasmodium falciparum
KKHFFFFRGILFLTFIWVILGGLRNMIY

SEQ ID NO: 3265038 - protein, 17 aa, Plasmodium falciparum
KKHFPFLHSNYFNSDLL

SEQ ID NO: 3265039 - protein, 25 aa, Plasmodium falciparum
KKHHPCLYEQCLFVVFDNKIDLCLH

SEQ ID NO: 3265040 - protein, 17 aa, Plasmodium falciparum
KKHIMCMSMKKYKAFKR

SEQ ID NO: 3265041 - protein, 18 aa, Plasmodium falciparum
KKHISMMLQLLTLYHTCI

SEQ ID NO: 3265042 - protein, 20 aa, Plasmodium falciparum
KKHNFHLINIFKIITTCKRK

SEQ ID NO: 3265043 - protein, 20 aa, Plasmodium falciparum
KKHRRMLLKNLHIDEKSKGN

SEQ ID NO: 3265044 - protein, 19 aa, Plasmodium falciparum
KKHSLHFSTILKTQEVHSV

SEQ ID NO: 3265045 - protein, 26 aa, Plasmodium falciparum
KKHTKEICILINFSYNNMFDIFNYPD

SEQ ID NO: 3265046 - protein, 25 aa, Plasmodium falciparum
KKHVKNVISSFQWIVVYKKIKRDMS

SEQ ID NO: 3265047 - protein, 27 aa, Plasmodium falciparum
KKHWGYPRRWKVILWDLHIQNYMNNDF

SEQ ID NO: 3265048 - protein, 20 aa, Plasmodium falciparum
KKIAMKNIFFYIRKKNVTIN

SEQ ID NO: 3265049 - protein, 18 aa, Plasmodium falciparum
KKICKKSKNNKNISKIYK

SEQ ID NO: 3265050 - protein, 17 aa, Plasmodium falciparum
KKICKNLLIFSNDYKNK

SEQ ID NO: 3265051 - protein, 18 aa, Plasmodium falciparum
KKICLLLNNFNNGVIEQR

SEQ ID NO: 3265052 - protein, 17 aa, Plasmodium falciparum
KKICTLFHKNMYSLYLL

SEQ ID NO: 3265053 - protein, 26 aa, Plasmodium falciparum
KKIFFLFRFGCIVLWDFNIKEKEILF

SEQ ID NO: 3265054 - protein, 23 aa, Plasmodium falciparum
KKIFKCDYCDHIFDDIKEASIHE

SEQ ID NO: 3265055 - protein, 17 aa, Plasmodium falciparum
KKIFKMEKYIIKNIPFN

SEQ ID NO: 3265056 - protein, 21 aa, Plasmodium falciparum
KKIFMIFYNYLRKCHFIDKKN

SEQ ID NO: 3265057 - protein, 23 aa, Plasmodium falciparum
KKIFPCGLVSAAIFNDKIALSKN

SEQ ID NO: 3265058 - protein, 26 aa, Plasmodium falciparum
KKIFPQELIRFIIKISSTIFHGYAYV

SEQ ID NO: 3265059 - protein, 17 aa, Plasmodium falciparum
KKIFRSNINKIKQIKKN

SEQ ID NO: 3265060 - protein, 29 aa, Plasmodium falciparum
KKIFYEYFYIFSLCTLLTSYSCLVSPCID

SEQ ID NO: 3265061 - protein, 25 aa, Plasmodium falciparum
KKIGDKWNFVFLIFYIFHKFNELNK

SEQ ID NO: 3265062 - protein, 17 aa, Plasmodium falciparum
KKIHYLINIVSREEENQ

SEQ ID NO: 3265063 - protein, 18 aa, Plasmodium falciparum
KKIIASTSDVCFDIHYTA

SEQ ID NO: 3265064 - protein, 20 aa, Plasmodium falciparum
KKIIHEWIKLVSRLHDTGLS

SEQ ID NO: 3265065 - protein, 25 aa, Plasmodium falciparum
KKIILSLFILCMFIYMYPNDNHLWN

SEQ ID NO: 3265066 - protein, 19 aa, Plasmodium falciparum
KKIINFLKDKKLILEGNSF

SEQ ID NO: 3265067 - protein, 19 aa, Plasmodium falciparum
KKIIRHEWYYNLLNNSPHD

SEQ ID NO: 3265068 - protein, 18 aa, Plasmodium falciparum
KKIIYHILYMLGSALTTY

SEQ ID NO: 3265069 - protein, 19 aa, Plasmodium falciparum
KKIKDCILICKTNNDSDIN

SEQ ID NO: 3265070 - protein, 18 aa, Plasmodium falciparum
KKIKDKDYINILPFSKRA

SEQ ID NO: 3265071 - protein, 18 aa, Plasmodium falciparum
KKIKDKETVLDYYIDDII

SEQ ID NO: 3265072 - protein, 34 aa, Plasmodium falciparum
KKIKDYIVGIGILKILFCVCIILLSIFIAKRKNK

SEQ ID NO: 3265073 - protein, 18 aa, Plasmodium falciparum
KKIKEEKFQGHKNVSKGT

SEQ ID NO: 3265074 - protein, 22 aa, Plasmodium falciparum
KKIKEGHLILNIYKKKTNYDIL

SEQ ID NO: 3265075 - protein, 23 aa, Plasmodium falciparum
KKIKEILNKEIVHKMVHNHIKKN

SEQ ID NO: 3265076 - protein, 24 aa, Plasmodium falciparum
KKIKEWLKLLNLLIFLNIKDVYIF

SEQ ID NO: 3265077 - protein, 26 aa, Plasmodium falciparum
KKIKFIKTFLEKKCSYNFNYINKTKE

SEQ ID NO: 3265078 - protein, 18 aa, Plasmodium falciparum
KKIKFVLIDNKWKHILGL

SEQ ID NO: 3265079 - protein, 23 aa, Plasmodium falciparum
KKIKHKISHCMKNGNGSKCTNDC

SEQ ID NO: 3265080 - protein, 17 aa, Plasmodium falciparum
KKIKISRYLSLVDDVIK

SEQ ID NO: 3265081 - protein, 18 aa, Plasmodium falciparum
KKIKKRKELDLIFIHGLR

SEQ ID NO: 3265082 - protein, 23 aa, Plasmodium falciparum
KKIKLNFYYFLLIIQYFKNTYTQ

SEQ ID NO: 3265083 - protein, 24 aa, Plasmodium falciparum
KKIKLTKLRSNSCMTQKIENTKNS

SEQ ID NO: 3265084 - protein, 21 aa, Plasmodium falciparum
KKIKREIFEKLKLQEINNFAK

SEQ ID NO: 3265085 - protein, 24 aa, Plasmodium falciparum
KKIKSFCKLRRKFVYIRRTGYNSY

SEQ ID NO: 3265086 - protein, 24 aa, Plasmodium falciparum
KKIKSLFTCNSFYLYNIVDLLLLL

SEQ ID NO: 3265087 - protein, 17 aa, Plasmodium falciparum
KKILDEFFFDIYNDYNM

SEQ ID NO: 3265088 - protein, 20 aa, Plasmodium falciparum
KKILHYFPLLKLINNPSDLK

SEQ ID NO: 3265089 - protein, 31 aa, Plasmodium falciparum
KKILKFRLFILKGILKRFLFCCSYFNDKEIL

SEQ ID NO: 3265090 - protein, 27 aa, Plasmodium falciparum
KKILLDILLYIFFHFDIINFKDINCFF

SEQ ID NO: 3265091 - protein, 17 aa, Plasmodium falciparum
KKILLKSKMLNEVKNTI

SEQ ID NO: 3265092 - protein, 18 aa, Plasmodium falciparum
KKILLLKKNFLIINKYKQ

SEQ ID NO: 3265093 - protein, 24 aa, Plasmodium falciparum
KKILNFLKIYLLILNKINYPTPPR

SEQ ID NO: 3265094 - protein, 27 aa, Plasmodium falciparum
KKILPFLKYLICSIFLRQSYYCNETEA

SEQ ID NO: 3265095 - protein, 19 aa, Plasmodium falciparum
KKILQRCIKPVNEILKHWI

SEQ ID NO: 3265096 - protein, 24 aa, Plasmodium falciparum
KKILSLLLNYTFLEYFYIYYKEVS

SEQ ID NO: 3265097 - protein, 20 aa, Plasmodium falciparum
KKILSSILFYYIKYSEDDLY

SEQ ID NO: 3265098 - protein, 24 aa, Plasmodium falciparum
KKILTCVIYFTYAMLSNQKVHKIN

SEQ ID NO: 3265099 - protein, 24 aa, Plasmodium falciparum
KKILTFNSAKKWLTTQFNHKNILN

SEQ ID NO: 3265100 - protein, 20 aa, Plasmodium falciparum
KKIMFTLFCNLTCSYQKTKV

SEQ ID NO: 3265101 - protein, 26 aa, Plasmodium falciparum
KKIMKECLKLLIKLHNAGLAHLDISP

SEQ ID NO: 3265102 - protein, 29 aa, Plasmodium falciparum
KKINIKEIISLFEFCMLSIKEYIKYIMTY

SEQ ID NO: 3265103 - protein, 29 aa, Plasmodium falciparum
KKINIKIVHLLKSFLFDITLNIYNNELLY

SEQ ID NO: 3265104 - protein, 26 aa, Plasmodium falciparum
KKINLYRLVFYLTQYFLGNLNIFKYN

SEQ ID NO: 3265105 - protein, 20 aa, Plasmodium falciparum
KKIPIEVWIRQYNLMNDNDG

SEQ ID NO: 3265106 - protein, 21 aa, Plasmodium falciparum
KKIPKCYSNIFINKKKNNKRN

SEQ ID NO: 3265107 - protein, 25 aa, Plasmodium falciparum
KKIPPFKLIYLISLLSYNNIMLLPI

SEQ ID NO: 3265108 - protein, 20 aa, Plasmodium falciparum
KKIRNIYLFIKFISSKCILK

SEQ ID NO: 3265109 - protein, 23 aa, Plasmodium falciparum
KKIRPHKNFQIFLTLSSQEHYKI

SEQ ID NO: 3265110 - protein, 23 aa, Plasmodium falciparum
KKISDSTSFDWQAQLKYYWVYDK

SEQ ID NO: 3265111 - protein, 22 aa, Plasmodium falciparum
KKISLNIICNIYLNNIPKIKKA

SEQ ID NO: 3265112 - protein, 21 aa, Plasmodium falciparum
KKISNCFRDFIKARHNNNFSF

SEQ ID NO: 3265113 - protein, 20 aa, Plasmodium falciparum
KKISNIFPMRNKIQTHQNYG

SEQ ID NO: 3265114 - protein, 25 aa, Plasmodium falciparum
KKITDIFLNLIFQKNVDEFTYESFI

SEQ ID NO: 3265115 - protein, 20 aa, Plasmodium falciparum
KKITHEYIWNRIRNMIFKFN

SEQ ID NO: 3265116 - protein, 18 aa, Plasmodium falciparum
KKITHFYFYEHGFTQICR

SEQ ID NO: 3265117 - protein, 25 aa, Plasmodium falciparum
KKITKCLFCSCKEKTQQIVKDKNLF

SEQ ID NO: 3265118 - protein, 20 aa, Plasmodium falciparum
KKITKSQCLFSDGEIVNNDS

SEQ ID NO: 3265119 - protein, 42 aa, Plasmodium falciparum
KKIWTNKFIWKGCLMCISMLWPDFKHSLFYIFFMLPSDECST

SEQ ID NO: 3265120 - protein, 19 aa, Plasmodium falciparum
KKIYEGFLDKGAREHYKEV

SEQ ID NO: 3265121 - protein, 19 aa, Plasmodium falciparum
KKIYFEYICGLNTQNNKKN

SEQ ID NO: 3265122 - protein, 17 aa, Plasmodium falciparum
KKIYFYNYISIFFYLLK

SEQ ID NO: 3265123 - protein, 26 aa, Plasmodium falciparum
KKIYHHKYFFLSHIYCFFFYDNEIIK

SEQ ID NO: 3265124 - protein, 19 aa, Plasmodium falciparum
KKIYIYRHMYGHIYGHMYG

SEQ ID NO: 3265125 - protein, 23 aa, Plasmodium falciparum
KKIYRIFYFINIFYNLNIEITKY

SEQ ID NO: 3265126 - protein, 25 aa, Plasmodium falciparum
KKKAFPRFYFLSNIALLDILSNGKN

SEQ ID NO: 3265127 - protein, 18 aa, Plasmodium falciparum
KKKAYKNMHDIWLIQEHV

SEQ ID NO: 3265128 - protein, 31 aa, Plasmodium falciparum
KKKCGKKICNGDCDCFKRWVEQKRKEWDPIK

SEQ ID NO: 3265129 - protein, 18 aa, Plasmodium falciparum
KKKCIQQMYFNNSIFNKL

SEQ ID NO: 3265130 - protein, 18 aa, Plasmodium falciparum
KKKCISCTTKYCEGFNHN

SEQ ID NO: 3265131 - protein, 19 aa, Plasmodium falciparum
KKKCQEILEILIKIVDISK

SEQ ID NO: 3265132 - protein, 22 aa, Plasmodium falciparum
KKKCSQEIIYLYNKMDKINKNK

SEQ ID NO: 3265133 - protein, 19 aa, Plasmodium falciparum
KKKEFDNVLEIPIKGHNIL

SEQ ID NO: 3265134 - protein, 19 aa, Plasmodium falciparum
KKKEGLLFNNIMNLQNNNI

SEQ ID NO: 3265135 - protein, 20 aa, Plasmodium falciparum
KKKEICMSVLKDIMSIDMLK

SEQ ID NO: 3265136 - protein, 22 aa, Plasmodium falciparum
KKKEIIKNLTIEIASLNLTLDY

SEQ ID NO: 3265137 - protein, 26 aa, Plasmodium falciparum
KKKELNEYVQFVFLNSYINSIFLIEQ

SEQ ID NO: 3265138 - protein, 18 aa, Plasmodium falciparum
KKKEWGKIIEHFYKQEGI

SEQ ID NO: 3265139 - protein, 17 aa, Plasmodium falciparum
KKKEYFFKHLKRRIQGF

SEQ ID NO: 3265140 - protein, 18 aa, Plasmodium falciparum
KKKFEEFSIDYKNKNEEI

SEQ ID NO: 3265141 - protein, 27 aa, Plasmodium falciparum
KKKFLLVSIPIWISVFFMSLIGSYFPC

SEQ ID NO: 3265142 - protein, 18 aa, Plasmodium falciparum
KKKFNIILYDISYLYYIY

SEQ ID NO: 3265143 - protein, 18 aa, Plasmodium falciparum
KKKGFFHNLFSTFSGKKS

SEQ ID NO: 3265144 - protein, 28 aa, Plasmodium falciparum
KKKGKDEWYHVCCLYYNNITRNNCIYHI

SEQ ID NO: 3265145 - protein, 17 aa, Plasmodium falciparum
KKKGLDIFDDFINDRYN

SEQ ID NO: 3265146 - protein, 20 aa, Plasmodium falciparum
KKKGLRPLINLSTLNVPEIV

SEQ ID NO: 3265147 - protein, 24 aa, Plasmodium falciparum
KKKHLRLDVLLFFVYLIFLNLILQ

SEQ ID NO: 3265148 - protein, 18 aa, Plasmodium falciparum
KKKIFGMCFFNHKTGVLA

SEQ ID NO: 3265149 - protein, 21 aa, Plasmodium falciparum
KKKIFYIILLIENLSFKKNIF

SEQ ID NO: 3265150 - protein, 18 aa, Plasmodium falciparum
KKKIIGFVSLKKYIDINI

SEQ ID NO: 3265151 - protein, 20 aa, Plasmodium falciparum
KKKIIIKKIRKRFQCKNLIT

SEQ ID NO: 3265152 - protein, 18 aa, Plasmodium falciparum
KKKIKEIFLKVLKDKKKK

SEQ ID NO: 3265153 - protein, 21 aa, Plasmodium falciparum
KKKIKELYLKSIWKKTQRKKI

SEQ ID NO: 3265154 - protein, 18 aa, Plasmodium falciparum
KKKIKIYYYYTALNKYKI

SEQ ID NO: 3265155 - protein, 24 aa, Plasmodium falciparum
KKKIKRKLSDFIFTKIKKNQKKFK

SEQ ID NO: 3265156 - protein, 25 aa, Plasmodium falciparum
KKKIMRKNEDFIWSRERNMTNLSGH

SEQ ID NO: 3265157 - protein, 22 aa, Plasmodium falciparum
KKKINKLFLCLKEESEKKNNVY

SEQ ID NO: 3265158 - protein, 20 aa, Plasmodium falciparum
KKKITPRHVEKINLNISINN

SEQ ID NO: 3265159 - protein, 19 aa, Plasmodium falciparum
KKKIYRKVRNYDIDKNFSF

SEQ ID NO: 3265160 - protein, 19 aa, Plasmodium falciparum
KKKKCCPRKICTNIMNNIQ

SEQ ID NO: 3265161 - protein, 19 aa, Plasmodium falciparum
KKKKEILSFLYENIDELKH

SEQ ID NO: 3265162 - protein, 20 aa, Plasmodium falciparum
KKKKEKCTLLNKIINKDKIN

SEQ ID NO: 3265163 - protein, 26 aa, Plasmodium falciparum
KKKKELFDTLLYMCIYNINDLTVKNT

SEQ ID NO: 3265164 - protein, 25 aa, Plasmodium falciparum
KKKKFKINPIKGYLLLHNKNFYVSP

SEQ ID NO: 3265165 - protein, 21 aa, Plasmodium falciparum
KKKKFKSSVHVNTFLINLKKG

SEQ ID NO: 3265166 - protein, 17 aa, Plasmodium falciparum
KKKKFYMENKFNPFNIE

SEQ ID NO: 3265167 - protein, 17 aa, Plasmodium falciparum
KKKKGFINKSIQTHEYN

SEQ ID NO: 3265168 - protein, 20 aa, Plasmodium falciparum
KKKKHSLFLCKKNMRDTKSN

SEQ ID NO: 3265169 - protein, 17 aa, Plasmodium falciparum
KKKKIKFILNMSRKKKK

SEQ ID NO: 3265170 - protein, 29 aa, Plasmodium falciparum
KKKKILFNILYFKLFRLIFDKIETYHIYK

SEQ ID NO: 3265171 - protein, 18 aa, Plasmodium falciparum
KKKKILSFHNSFNEFPII

SEQ ID NO: 3265172 - protein, 19 aa, Plasmodium falciparum
KKKKKFFTYLKNIRSNKII

SEQ ID NO: 3265173 - protein, 23 aa, Plasmodium falciparum
KKKKKFLFCTNIPETTNNTFNDT

SEQ ID NO: 3265174 - protein, 24 aa, Plasmodium falciparum
KKKKKKCSFEKLYNETKRWYINKE

SEQ ID NO: 3265175 - protein, 25 aa, Plasmodium falciparum
KKKKKKELICPINLLNNKNEIQPKD

SEQ ID NO: 3265176 - protein, 28 aa, Plasmodium falciparum
KKKKKKKNFMCTTRWIYQQNECKRERKE

SEQ ID NO: 3265177 - protein, 30 aa, Plasmodium falciparum
KKKKKKRVYDLFCIYAIILKYFPYSFKLWY

SEQ ID NO: 3265178 - protein, 18 aa, Plasmodium falciparum
KKKKKLLKNICYSNDVEK

SEQ ID NO: 3265179 - protein, 21 aa, Plasmodium falciparum
KKKKKVCKISRNYKQAPLKYI

SEQ ID NO: 3265180 - protein, 21 aa, Plasmodium falciparum
KKKKLVCAKFFSSNEKDTSIN

SEQ ID NO: 3265181 - protein, 18 aa, Plasmodium falciparum
KKKKLVIDINQLNCEVDN

SEQ ID NO: 3265182 - protein, 17 aa, Plasmodium falciparum
KKKKLYTSPLFFNAVSY

SEQ ID NO: 3265183 - protein, 21 aa, Plasmodium falciparum
KKKKMYLIFLILVKNSFTCIY

SEQ ID NO: 3265184 - protein, 34 aa, Plasmodium falciparum
KKKKNCKLKSYLKNESKIHFLFSYKENIKSSHTF

SEQ ID NO: 3265185 - protein, 24 aa, Plasmodium falciparum
KKKKNFWNIFELIKNDTYNNDNNN

SEQ ID NO: 3265186 - protein, 22 aa, Plasmodium falciparum
KKKKNNMFQFIFLNKISDNTIT

SEQ ID NO: 3265187 - protein, 18 aa, Plasmodium falciparum
KKKKNVCTFENKINIYDK

SEQ ID NO: 3265188 - protein, 23 aa, Plasmodium falciparum
KKKKQKKNICCINKDDYIYNNII

SEQ ID NO: 3265189 - protein, 17 aa, Plasmodium falciparum
KKKKRKLSVKVKVNVNV

SEQ ID NO: 3265190 - protein, 19 aa, Plasmodium falciparum
KKKKRRRFTFSRTRLTLKS

SEQ ID NO: 3265191 - protein, 20 aa, Plasmodium falciparum
KKKKSVILHPSLVCVISNLS

SEQ ID NO: 3265192 - protein, 31 aa, Plasmodium falciparum
KKKKSYDSLVFFKRFFNCLNGYIYFLNKCEK

SEQ ID NO: 3265193 - protein, 20 aa, Plasmodium falciparum
KKKLEKCLKNGTKTRCKNNK

SEQ ID NO: 3265194 - protein, 21 aa, Plasmodium falciparum
KKKLEYNREFKLFLVSDTNDR

SEQ ID NO: 3265195 - protein, 18 aa, Plasmodium falciparum
KKKLFFMSSFNLKKNIRK

SEQ ID NO: 3265196 - protein, 18 aa, Plasmodium falciparum
KKKLFNFLSDNNILSLPR

SEQ ID NO: 3265197 - protein, 26 aa, Plasmodium falciparum
KKKLHFLSKWYTSFIINVKFKEVEKI

SEQ ID NO: 3265198 - protein, 22 aa, Plasmodium falciparum
KKKLKNLKCLYKIRSKEDEENK

SEQ ID NO: 3265199 - protein, 20 aa, Plasmodium falciparum
KKKLPHLLCFHSKDCEYCNS

SEQ ID NO: 3265200 - protein, 26 aa, Plasmodium falciparum
KKKLPSKSSQLWKRINMSLDDFIEEI

SEQ ID NO: 3265201 - protein, 17 aa, Plasmodium falciparum
KKKLRKWDSVNISKEKK

SEQ ID NO: 3265202 - protein, 20 aa, Plasmodium falciparum
KKKLSRHKKFVCERKKGVIL

SEQ ID NO: 3265203 - protein, 22 aa, Plasmodium falciparum
KKKLTCKCFDNIYLPNNKYILI

SEQ ID NO: 3265204 - protein, 27 aa, Plasmodium falciparum
KKKLYRYLYELNEIILFYKNFTKNTSI

SEQ ID NO: 3265205 - protein, 17 aa, Plasmodium falciparum
KKKMLKIFLRRLVCATI

SEQ ID NO: 3265206 - protein, 20 aa, Plasmodium falciparum
KKKMMPTICETVVPTEPEEP

SEQ ID NO: 3265207 - protein, 22 aa, Plasmodium falciparum
KKKMPYWVVWHVSSSSENKRNL

SEQ ID NO: 3265208 - protein, 21 aa, Plasmodium falciparum
KKKNDILLFSMAKHFFNHLLS

SEQ ID NO: 3265209 - protein, 24 aa, Plasmodium falciparum
KKKNFKNIFLMRINEHTYRDVTVD

SEQ ID NO: 3265210 - protein, 39 aa, Plasmodium falciparum
KKKNIFFIMKFCQFLIEIFKLIYRDEMKNELKCDKKFQD

SEQ ID NO: 3265211 - protein, 18 aa, Plasmodium falciparum
KKKNLFVNNEFLICNFQY

SEQ ID NO: 3265212 - protein, 23 aa, Plasmodium falciparum
KKKNMRKCIKGLHHTIKNKLNLY

SEQ ID NO: 3265213 - protein, 27 aa, Plasmodium falciparum
KKKNRGEFSYIFFKKEIAKLYEKEKII

SEQ ID NO: 3265214 - protein, 22 aa, Plasmodium falciparum
KKKNRMFFLFVIIFFSLFILYY

SEQ ID NO: 3265215 - protein, 22 aa, Plasmodium falciparum
KKKNSYLGTNWSCVHKKKKKKK

SEQ ID NO: 3265216 - protein, 21 aa, Plasmodium falciparum
KKKNYMCHYNYYNNFECIKHF

SEQ ID NO: 3265217 - protein, 20 aa, Plasmodium falciparum
KKKPNCQILRKTTDSKDWTY

SEQ ID NO: 3265218 - protein, 20 aa, Plasmodium falciparum
KKKQLNACCTFNIPSNSNST

SEQ ID NO: 3265219 - protein, 19 aa, Plasmodium falciparum
KKKRGISFVSLNLNKILEL

SEQ ID NO: 3265220 - protein, 24 aa, Plasmodium falciparum
KKKRKEIISYINIILIYDHLNNTR

SEQ ID NO: 3265221 - protein, 28 aa, Plasmodium falciparum
KKKRMFCNICGYILKQNFLNDFFFFKIF

SEQ ID NO: 3265222 - protein, 32 aa, Plasmodium falciparum
KKKRTFSLKIFWRAYHNFKMKFNKEQFINEEE

SEQ ID NO: 3265223 - protein, 36 aa, Plasmodium falciparum
KKKRVPKRFWLYIQKLFLYKCYLINKTVNYKCENNI

SEQ ID NO: 3265224 - protein, 30 aa, Plasmodium falciparum
KKKSCKICPIGAICNRGFNIYIYLKLLNDR

SEQ ID NO: 3265225 - protein, 23 aa, Plasmodium falciparum
KKKSECIYISKDIICINSELAIW

SEQ ID NO: 3265226 - protein, 22 aa, Plasmodium falciparum
KKKSFKFIYLHLLKKYGHTNHY

SEQ ID NO: 3265227 - protein, 18 aa, Plasmodium falciparum
KKKSIFWSLFKNKIHSDH

SEQ ID NO: 3265228 - protein, 20 aa, Plasmodium falciparum
KKKSISIRYFVDYKNLLLQP

SEQ ID NO: 3265229 - protein, 19 aa, Plasmodium falciparum
KKKSKPRVDLFSVMEIPQN

SEQ ID NO: 3265230 - protein, 20 aa, Plasmodium falciparum
KKKTFPRICESYDIKKNIDI

SEQ ID NO: 3265231 - protein, 20 aa, Plasmodium falciparum
KKKTIIIYKPFVAFGSLIMT

SEQ ID NO: 3265232 - protein, 19 aa, Plasmodium falciparum
KKKTYGIDFFLYQIEELLN

SEQ ID NO: 3265233 - protein, 25 aa, Plasmodium falciparum
KKKTYKGCPYYLSKETCEENIIKLN

SEQ ID NO: 3265234 - protein, 21 aa, Plasmodium falciparum
KKKVLEFFENLVLNKKKKENI

SEQ ID NO: 3265235 - protein, 17 aa, Plasmodium falciparum
KKKVLKGKRGISKEEIH

SEQ ID NO: 3265236 - protein, 25 aa, Plasmodium falciparum
KKKVLRSRLPYVFHLQEKIAHILDI

SEQ ID NO: 3265237 - protein, 23 aa, Plasmodium falciparum
KKKYFFQVLKLIYFIMYYHPYFI

SEQ ID NO: 3265238 - protein, 31 aa, Plasmodium falciparum
KKKYLQFFLHLSLGIFIYIYIYKYIKQNYKS

SEQ ID NO: 3265239 - protein, 21 aa, Plasmodium falciparum
KKKYVPHLIFIIKNHDNKKTN

SEQ ID NO: 3265240 - protein, 25 aa, Plasmodium falciparum
KKKYVWRYSLFFSIFYILLLFGLCY

SEQ ID NO: 3265241 - protein, 19 aa, Plasmodium falciparum
KKKYYSFIKFKTLRRLINK

SEQ ID NO: 3265242 - protein, 17 aa, Plasmodium falciparum
KKLCENLKYKIVTNCTS

SEQ ID NO: 3265243 - protein, 17 aa, Plasmodium falciparum
KKLCRKINYHFSNVAKL

SEQ ID NO: 3265244 - protein, 18 aa, Plasmodium falciparum
KKLDCGIHPEKRLSIIDC

SEQ ID NO: 3265245 - protein, 26 aa, Plasmodium falciparum
KKLEKSCIFEDFYPLYMLETLCVINI

SEQ ID NO: 3265246 - protein, 24 aa, Plasmodium falciparum
KKLEQKLKVIFGHIYEELKKHKKL

SEQ ID NO: 3265247 - protein, 22 aa, Plasmodium falciparum
KKLERLNLFPVHKKHKTFSLIN

SEQ ID NO: 3265248 - protein, 20 aa, Plasmodium falciparum
KKLEVILWIKIYMSVLEEQK

SEQ ID NO: 3265249 - protein, 17 aa, Plasmodium falciparum
KKLEYFYIISKFIYNNI

SEQ ID NO: 3265250 - protein, 20 aa, Plasmodium falciparum
KKLFCRSPLGLVSYYRCTEG

SEQ ID NO: 3265251 - protein, 17 aa, Plasmodium falciparum
KKLFLQNYIFFKLYKDI

SEQ ID NO: 3265252 - protein, 19 aa, Plasmodium falciparum
KKLFNEFLIALATGNLDES

SEQ ID NO: 3265253 - protein, 23 aa, Plasmodium falciparum
KKLFNQFNCVLAGKYHEFSKITN

SEQ ID NO: 3265254 - protein, 23 aa, Plasmodium falciparum
KKLFYFYDPWLYGYDSFLSFIQL

SEQ ID NO: 3265255 - protein, 18 aa, Plasmodium falciparum
KKLGNILEVSHDNVSNEL

SEQ ID NO: 3265256 - protein, 21 aa, Plasmodium falciparum
KKLHGDVAYRVFVKDEMYPGL

SEQ ID NO: 3265257 - protein, 23 aa, Plasmodium falciparum
KKLHKCKIIKYDGDQEHHVDHNN

SEQ ID NO: 3265258 - protein, 17 aa, Plasmodium falciparum
KKLICLCGSSTCLGRMN

SEQ ID NO: 3265259 - protein, 21 aa, Plasmodium falciparum
KKLIFASALGIYGQVNVYNLN

SEQ ID NO: 3265260 - protein, 25 aa, Plasmodium falciparum
KKLIIKNKMKALYLKTKYNVSLINA

SEQ ID NO: 3265261 - protein, 25 aa, Plasmodium falciparum
KKLIQRWKHKISRSFKHKKENSENY

SEQ ID NO: 3265262 - protein, 18 aa, Plasmodium falciparum
KKLKECELSIDVYKEKII

SEQ ID NO: 3265263 - protein, 25 aa, Plasmodium falciparum
KKLKEYVNMFVCIKDILLEIFMGDN

SEQ ID NO: 3265264 - protein, 25 aa, Plasmodium falciparum
KKLKKLCYIMKSFHPHILDEFWFNL

SEQ ID NO: 3265265 - protein, 23 aa, Plasmodium falciparum
KKLKLDIYNFFTFNDFHNNMITN

SEQ ID NO: 3265266 - protein, 31 aa, Plasmodium falciparum
KKLKLFLLQILDIFASLICYMNIYKYICSFL

SEQ ID NO: 3265267 - protein, 27 aa, Plasmodium falciparum
KKLKLISWNLIQTILWGILVSGENVQM

SEQ ID NO: 3265268 - protein, 20 aa, Plasmodium falciparum
KKLKNKNCMLPNRRHKNDLL

SEQ ID NO: 3265269 - protein, 20 aa, Plasmodium falciparum
KKLKNVLVVIECVYNNTKGY

SEQ ID NO: 3265270 - protein, 23 aa, Plasmodium falciparum
KKLKRGGYIWPIENHKYKKNVSV

SEQ ID NO: 3265271 - protein, 29 aa, Plasmodium falciparum
KKLKSANIHFDYLFIIRFLKEKRKEMFIP

SEQ ID NO: 3265272 - protein, 19 aa, Plasmodium falciparum
KKLKSSLKKLLIQYNIPKL

SEQ ID NO: 3265273 - protein, 20 aa, Plasmodium falciparum
KKLKVEIIEPSIILNKNMHI

SEQ ID NO: 3265274 - protein, 17 aa, Plasmodium falciparum
KKLKYNWNDEVNRKLHG

SEQ ID NO: 3265275 - protein, 28 aa, Plasmodium falciparum
KKLLKHDTCLKLWKECLKYITSSSSEKS

SEQ ID NO: 3265276 - protein, 20 aa, Plasmodium falciparum
KKLLLRLEVDYPLMSNNLTK

SEQ ID NO: 3265277 - protein, 20 aa, Plasmodium falciparum
KKLLNSFLNIFSYCSENTNV

SEQ ID NO: 3265278 - protein, 18 aa, Plasmodium falciparum
KKLLSKILVENQFYKYII

SEQ ID NO: 3265279 - protein, 27 aa, Plasmodium falciparum
KKLNILNLIYFRFLKEEDIEDVHDLHK

SEQ ID NO: 3265280 - protein, 21 aa, Plasmodium falciparum
KKLNTLLQMYVLFKPELGYVQ

SEQ ID NO: 3265281 - protein, 29 aa, Plasmodium falciparum
KKLNYKIFFFFVCNYLCTLSLDAMSSVRR

SEQ ID NO: 3265282 - protein, 29 aa, Plasmodium falciparum
KKLPEIFYIRWYWFFLTIMTLGIPWVIPK

SEQ ID NO: 3265283 - protein, 19 aa, Plasmodium falciparum
KKLPIFLSIYTKYIENKAI

SEQ ID NO: 3265284 - protein, 18 aa, Plasmodium falciparum
KKLQGNNFLFMIKKLKSF

SEQ ID NO: 3265285 - protein, 23 aa, Plasmodium falciparum
KKLRKKGWNRIGNLIVPNDNYCK

SEQ ID NO: 3265286 - protein, 18 aa, Plasmodium falciparum
KKLSCKESNILLNEEEII

SEQ ID NO: 3265287 - protein, 23 aa, Plasmodium falciparum
KKLSKRIESLRMLANAIRKYILR

SEQ ID NO: 3265288 - protein, 19 aa, Plasmodium falciparum
KKLSMKKKVGFYCNNKNMY

SEQ ID NO: 3265289 - protein, 19 aa, Plasmodium falciparum
KKLSNVIGIGGGITSTLIS

SEQ ID NO: 3265290 - protein, 17 aa, Plasmodium falciparum
KKLSVDVNLFYRTSYSF

SEQ ID NO: 3265291 - protein, 23 aa, Plasmodium falciparum
KKLVIQFLPPINKGTHILHNKTN

SEQ ID NO: 3265292 - protein, 19 aa, Plasmodium falciparum
KKLVKCLKNGNTIKCGMNC

SEQ ID NO: 3265293 - protein, 24 aa, Plasmodium falciparum
KKLYFNKYFLMYKMTHVSKHVTKL

SEQ ID NO: 3265294 - protein, 26 aa, Plasmodium falciparum
KKLYHLLIRLGITFLTIFIVSIFIKH

SEQ ID NO: 3265295 - protein, 21 aa, Plasmodium falciparum
KKLYILCKYNYLKNVKSKKKK

SEQ ID NO: 3265296 - protein, 17 aa, Plasmodium falciparum
KKLYISIINKINKSCDD

SEQ ID NO: 3265297 - protein, 30 aa, Plasmodium falciparum
KKLYLKNRIDCLKYLMYNIFSLKNHGFFFF

SEQ ID NO: 3265298 - protein, 17 aa, Plasmodium falciparum
KKLYLLLQESYKILRVL

SEQ ID NO: 3265299 - protein, 25 aa, Plasmodium falciparum
KKLYRISQLLKRRKKKWEFYNPSKL

SEQ ID NO: 3265300 - protein, 25 aa, Plasmodium falciparum
KKLYSDPIYLFLFIKNYFELTIDRK

SEQ ID NO: 3265301 - protein, 32 aa, Plasmodium falciparum
KKLYYSNTVLWRGNFFQIKEGFLNSNSLYIKM

SEQ ID NO: 3265302 - protein, 22 aa, Plasmodium falciparum
KKMEIKNFLNLAISDDFFTLHV

SEQ ID NO: 3265303 - protein, 27 aa, Plasmodium falciparum
KKMEYSQKFPFFLNFTNNITSNKDNKE

SEQ ID NO: 3265304 - protein, 29 aa, Plasmodium falciparum
KKMHWLYLSCPLRFLNFLRIEDLFGKNNN

SEQ ID NO: 3265305 - protein, 22 aa, Plasmodium falciparum
KKMKDYIISFINKMWINKFNVF

SEQ ID NO: 3265306 - protein, 20 aa, Plasmodium falciparum
KKMKRKSLVLYIIDITNIEN

SEQ ID NO: 3265307 - protein, 26 aa, Plasmodium falciparum
KKMKRQFYKRICDLQISILKKLQKNK

SEQ ID NO: 3265308 - protein, 32 aa, Plasmodium falciparum
KKMKSKKIICSSCLFLIFLSVIFCSEPDTNSF

SEQ ID NO: 3265309 - protein, 23 aa, Plasmodium falciparum
KKMLEKYMLKSFLSNRYIITDLD

SEQ ID NO: 3265310 - protein, 17 aa, Plasmodium falciparum
KKMLKMLNKNSNAYKSC

SEQ ID NO: 3265311 - protein, 39 aa, Plasmodium falciparum
KKMLTYDNVCYRKSMSISFVSHIMLSFLYSLLNCSDDIY

SEQ ID NO: 3265312 - protein, 21 aa, Plasmodium falciparum
KKMMIKNNMLKNKKIQVTPTN

SEQ ID NO: 3265313 - protein, 19 aa, Plasmodium falciparum
KKMMPKICEGVIPKEEVKD

SEQ ID NO: 3265314 - protein, 17 aa, Plasmodium falciparum
KKMNILSIMKFNYIHDD

SEQ ID NO: 3265315 - protein, 23 aa, Plasmodium falciparum
KKMNLFFERCIILVCKKFKKHFS

SEQ ID NO: 3265316 - protein, 25 aa, Plasmodium falciparum
KKMQLLDIMLLYSLHKNVYMLDNSL

SEQ ID NO: 3265317 - protein, 24 aa, Plasmodium falciparum
KKMSMPIHLIEWFTNMGMNRIDEK

SEQ ID NO: 3265318 - protein, 18 aa, Plasmodium falciparum
KKMVHFIILNFTKTFLKF

SEQ ID NO: 3265319 - protein, 17 aa, Plasmodium falciparum
KKMVVSFIISEWKNEMN

SEQ ID NO: 3265320 - protein, 21 aa, Plasmodium falciparum
KKMYERMGKKVLKSKQPSIIN

SEQ ID NO: 3265321 - protein, 31 aa, Plasmodium falciparum
KKMYIFLLTCFVLSLACSFSSKRTRSEAYIK

SEQ ID NO: 3265322 - protein, 24 aa, Plasmodium falciparum
KKMYRYLYIYKVFVLKQFYRIVYY

SEQ ID NO: 3265323 - protein, 21 aa, Plasmodium falciparum
KKNALKFLGIFNKKKNEKLHI

SEQ ID NO: 3265324 - protein, 18 aa, Plasmodium falciparum
KKNAYIFYELHNFYQNHK

SEQ ID NO: 3265325 - protein, 27 aa, Plasmodium falciparum
KKNCLSYLCSCASRLVDKSLYKGINMN

SEQ ID NO: 3265326 - protein, 35 aa, Plasmodium falciparum
KKNDCLKLLYICNLCTIKYDYVLKIITYKENNKCW

SEQ ID NO: 3265327 - protein, 18 aa, Plasmodium falciparum
KKNDIGIKHVKYIVKAQN

SEQ ID NO: 3265328 - protein, 19 aa, Plasmodium falciparum
KKNDLELNKKCIKYKSTVR

SEQ ID NO: 3265329 - protein, 22 aa, Plasmodium falciparum
KKNDLPLFFSLNNKSFENSNNK

SEQ ID NO: 3265330 - protein, 17 aa, Plasmodium falciparum
KKNFCIMCNEKYDEDDS

SEQ ID NO: 3265331 - protein, 25 aa, Plasmodium falciparum
KKNFEIKELLTIFIHDKELAEKNHY

SEQ ID NO: 3265332 - protein, 24 aa, Plasmodium falciparum
KKNFFKDFFLFFMVKKNSLLLLSN

SEQ ID NO: 3265333 - protein, 19 aa, Plasmodium falciparum
KKNFILHPLINSKYIGFKI

SEQ ID NO: 3265334 - protein, 23 aa, Plasmodium falciparum
KKNFKFYFFYFYYNIFKNKQTSN

SEQ ID NO: 3265335 - protein, 18 aa, Plasmodium falciparum
KKNFLLLARTWRRNIYVH

SEQ ID NO: 3265336 - protein, 19 aa, Plasmodium falciparum
KKNFPSNDWDIRHFDFIFT

SEQ ID NO: 3265337 - protein, 18 aa, Plasmodium falciparum
KKNFVINYMFEFIQIIYH

SEQ ID NO: 3265338 - protein, 23 aa, Plasmodium falciparum
KKNHCFYISIIIIFQTKQINGLR

SEQ ID NO: 3265339 - protein, 20 aa, Plasmodium falciparum
KKNHSCFPLFVSKENLKDNT

SEQ ID NO: 3265340 - protein, 20 aa, Plasmodium falciparum
KKNICKNICGDYFNRNEYCN

SEQ ID NO: 3265341 - protein, 21 aa, Plasmodium falciparum
KKNICLPPRRQYMCLRKIERM

SEQ ID NO: 3265342 - protein, 20 aa, Plasmodium falciparum
KKNIFFKQLENVIYKKIISI

SEQ ID NO: 3265343 - protein, 24 aa, Plasmodium falciparum
KKNILCVYKKMYLLNIQRIEMYIN

SEQ ID NO: 3265344 - protein, 19 aa, Plasmodium falciparum
KKNILLLLKIYKYINKIKI

SEQ ID NO: 3265345 - protein, 18 aa, Plasmodium falciparum
KKNIVGCIVTNIYNISNK

SEQ ID NO: 3265346 - protein, 29 aa, Plasmodium falciparum
KKNKESCIMCIYFLYPLYMNLEDIDFKTF

SEQ ID NO: 3265347 - protein, 17 aa, Plasmodium falciparum
KKNKIIIQRNIIQTKIF

SEQ ID NO: 3265348 - protein, 36 aa, Plasmodium falciparum
KKNKRKRIIYMLSILRMNKLLNMFKIIIKGKKEKKI

SEQ ID NO: 3265349 - protein, 22 aa, Plasmodium falciparum
KKNKRSYFTYLLNQNHSANLHS

SEQ ID NO: 3265350 - protein, 37 aa, Plasmodium falciparum
KKNKSTLFSFSFRNIYMLICIISVMYVSFMNVHMNDE

SEQ ID NO: 3265351 - protein, 18 aa, Plasmodium falciparum
KKNLHVILFPLHKNNKTN

SEQ ID NO: 3265352 - protein, 20 aa, Plasmodium falciparum
KKNLIPYFIFNNWYNDENYN

SEQ ID NO: 3265353 - protein, 19 aa, Plasmodium falciparum
KKNLKLYKPICSLNEDEYY

SEQ ID NO: 3265354 - protein, 18 aa, Plasmodium falciparum
KKNLKNLYLVHSGFLSKT

SEQ ID NO: 3265355 - protein, 21 aa, Plasmodium falciparum
KKNLLNRGCVMLNTQDKNEND

SEQ ID NO: 3265356 - protein, 17 aa, Plasmodium falciparum
KKNLLQKIFPFFKKKRT

SEQ ID NO: 3265357 - protein, 24 aa, Plasmodium falciparum
KKNLLTSFIIFYSYLLKHKNMEET

SEQ ID NO: 3265358 - protein, 20 aa, Plasmodium falciparum
KKNLMKLLVFFLILYMIFIS

SEQ ID NO: 3265359 - protein, 27 aa, Plasmodium falciparum
KKNLYTYSSFRLSSRMYFFNMLHNQNK

SEQ ID NO: 3265360 - protein, 19 aa, Plasmodium falciparum
KKNMLNFFLSGNYEVLKNN

SEQ ID NO: 3265361 - protein, 25 aa, Plasmodium falciparum
KKNMVFKKNILVNYWYAFYTLIFHN

SEQ ID NO: 3265362 - protein, 24 aa, Plasmodium falciparum
KKNNHGFALFNIEKTFNVTKVVDL

SEQ ID NO: 3265363 - protein, 19 aa, Plasmodium falciparum
KKNRKGIDLPDDMKKNVYE

SEQ ID NO: 3265364 - protein, 26 aa, Plasmodium falciparum
KKNRMEIIDLIKLIYSFFILLNQKVQ

SEQ ID NO: 3265365 - protein, 23 aa, Plasmodium falciparum
KKNRMLTCVRKKLISDIMKRTNK

SEQ ID NO: 3265366 - protein, 19 aa, Plasmodium falciparum
KKNSDVLFIYGRDDDVTPC

SEQ ID NO: 3265367 - protein, 21 aa, Plasmodium falciparum
KKNSIDFSYARILTVVGHEYF

SEQ ID NO: 3265368 - protein, 18 aa, Plasmodium falciparum
KKNVFNYICYRIPILLLH

SEQ ID NO: 3265369 - protein, 21 aa, Plasmodium falciparum
KKNVHFIVISFMLMDQGVYDM

SEQ ID NO: 3265370 - protein, 24 aa, Plasmodium falciparum
KKNYFWKWITIIEIHLLIIEDIRK

SEQ ID NO: 3265371 - protein, 31 aa, Plasmodium falciparum
KKNYKSNFLFKSKRFFNTWKEKGKWYTKNIK

SEQ ID NO: 3265372 - protein, 20 aa, Plasmodium falciparum
KKNYVSIMSEEMWKNNEYEN

SEQ ID NO: 3265373 - protein, 37 aa, Plasmodium falciparum
KKPFPLKILKLFPCLINLSSFFMLPCFFSKRKFKKKG

SEQ ID NO: 3265374 - protein, 18 aa, Plasmodium falciparum
KKPGMLFARTISQKTAKV

SEQ ID NO: 3265375 - protein, 23 aa, Plasmodium falciparum
KKPTEIKVLLLGRKGEVRNNDEE

SEQ ID NO: 3265376 - protein, 17 aa, Plasmodium falciparum
KKQEHPIAVRIKSVNFK

SEQ ID NO: 3265377 - protein, 24 aa, Plasmodium falciparum
KKQFKNLYCWSERYIDYKKWLNEM

SEQ ID NO: 3265378 - protein, 19 aa, Plasmodium falciparum
KKQIICIFMLQIFLNNLDK

SEQ ID NO: 3265379 - protein, 24 aa, Plasmodium falciparum
KKQKEYLGCLFNKFEKYSNEKFLH

SEQ ID NO: 3265380 - protein, 18 aa, Plasmodium falciparum
KKQKILFCNTTNEKIIDD

SEQ ID NO: 3265381 - protein, 23 aa, Plasmodium falciparum
KKQKLRYRVYHFFSKSSKDIGDE

SEQ ID NO: 3265382 - protein, 19 aa, Plasmodium falciparum
KKQLLKVIIKTCVVVTNNL

SEQ ID NO: 3265383 - protein, 27 aa, Plasmodium falciparum
KKQVDIKYVYDIFKREYIFYDKILIMI

SEQ ID NO: 3265384 - protein, 28 aa, Plasmodium falciparum
KKRDFPILGKFSMFKKFPLIKRSNTYNV

SEQ ID NO: 3265385 - protein, 19 aa, Plasmodium falciparum
KKREMLGIARLDRSLKKHY

SEQ ID NO: 3265386 - protein, 27 aa, Plasmodium falciparum
KKREVFFRYVPDYKKAINIYATSIQVY

SEQ ID NO: 3265387 - protein, 23 aa, Plasmodium falciparum
KKRISIGGLVPIFLTSQNRNEKK

SEQ ID NO: 3265388 - protein, 26 aa, Plasmodium falciparum
KKRKEKRYKLEYVMKKYGIEKHFTKN

SEQ ID NO: 3265389 - protein, 19 aa, Plasmodium falciparum
KKRKIIANNIIYINKVTLN

SEQ ID NO: 3265390 - protein, 17 aa, Plasmodium falciparum
KKRKSFVVYDIPRDIYG

SEQ ID NO: 3265391 - protein, 29 aa, Plasmodium falciparum
KKRKTCVLCYCVRRYYMNFLNKLEKKLTH

SEQ ID NO: 3265392 - protein, 22 aa, Plasmodium falciparum
KKRKYLDHWLATYKQSKNNVIK

SEQ ID NO: 3265393 - protein, 26 aa, Plasmodium falciparum
KKRLIYLNCIHFVYKDIEFLFKQIDQ

SEQ ID NO: 3265394 - protein, 19 aa, Plasmodium falciparum
KKRMDKYKFDLNIIDPNNN

SEQ ID NO: 3265395 - protein, 21 aa, Plasmodium falciparum
KKRMSRICPFINYMNDKIMNS

SEQ ID NO: 3265396 - protein, 19 aa, Plasmodium falciparum
KKRNYLFLSKHNFKKNNDN

SEQ ID NO: 3265397 - protein, 20 aa, Plasmodium falciparum
KKRRILYRMVRYNLLDYIYN

SEQ ID NO: 3265398 - protein, 22 aa, Plasmodium falciparum
KKRSHMLIEEMMILTNFLVANV

SEQ ID NO: 3265399 - protein, 20 aa, Plasmodium falciparum
KKRSINMIIILLYLTYISFG

SEQ ID NO: 3265400 - protein, 22 aa, Plasmodium falciparum
KKRTFYYLFFFFTFLVYVLYFD

SEQ ID NO: 3265401 - protein, 27 aa, Plasmodium falciparum
KKRTLFKILLSVFIKTLFESFLQPLLP

SEQ ID NO: 3265402 - protein, 30 aa, Plasmodium falciparum
KKRTMFYRLSELFPIVPRKDNELAVSGDCM

SEQ ID NO: 3265403 - protein, 20 aa, Plasmodium falciparum
KKRYFYKQHEVLSYYDDLIN

SEQ ID NO: 3265404 - protein, 32 aa, Plasmodium falciparum
KKRYMVFTLFCFYIISCVGIFFNWISLSDFFF

SEQ ID NO: 3265405 - protein, 23 aa, Plasmodium falciparum
KKSCIKYTILYSSPFYYIPEELL

SEQ ID NO: 3265406 - protein, 22 aa, Plasmodium falciparum
KKSDWKLIFLGTGSMYPSTSRG

SEQ ID NO: 3265407 - protein, 23 aa, Plasmodium falciparum
KKSEKLICFFYIFMGLLIFCSLF

SEQ ID NO: 3265408 - protein, 26 aa, Plasmodium falciparum
KKSFFKRALLLLKIFDNIFIQKTIDS

SEQ ID NO: 3265409 - protein, 28 aa, Plasmodium falciparum
KKSFFYSYMCIYIFLKNGHIYLIRRNLM

SEQ ID NO: 3265410 - protein, 20 aa, Plasmodium falciparum
KKSFKNFREFSKYKNLTKQG

SEQ ID NO: 3265411 - protein, 23 aa, Plasmodium falciparum
KKSFYETITYLFIHLMDKNRRVS

SEQ ID NO: 3265412 - protein, 21 aa, Plasmodium falciparum
KKSFYYICYLYYNSYIFNKSI

SEQ ID NO: 3265413 - protein, 24 aa, Plasmodium falciparum
KKSIHPWIRLNRVIRDIPNPSIIA

SEQ ID NO: 3265414 - protein, 25 aa, Plasmodium falciparum
KKSILECLKHIYLYILPNEYLLNIE

SEQ ID NO: 3265415 - protein, 27 aa, Plasmodium falciparum
KKSKDIECTIEFLIYCENFNKKENSYQ

SEQ ID NO: 3265416 - protein, 21 aa, Plasmodium falciparum
KKSKILGGLVLLQLFLIYARL

SEQ ID NO: 3265417 - protein, 18 aa, Plasmodium falciparum
KKSKMIMMRGMESDNINE

SEQ ID NO: 3265418 - protein, 23 aa, Plasmodium falciparum
KKSKRRGWLCCGGGDNETVEPQQ

SEQ ID NO: 3265419 - protein, 17 aa, Plasmodium falciparum
KKSLDFVSQDIKEINIL

SEQ ID NO: 3265420 - protein, 25 aa, Plasmodium falciparum
KKSQNLFLYLSRIFILTDISKQLIN

SEQ ID NO: 3265421 - protein, 23 aa, Plasmodium falciparum
KKSSELIKHLNFKFDEECNDIMI

SEQ ID NO: 3265422 - protein, 18 aa, Plasmodium falciparum
KKSYEFIFEITKYKTPDI

SEQ ID NO: 3265423 - protein, 25 aa, Plasmodium falciparum
KKTCNEFYPDLHFNNIKYPFLNINS

SEQ ID NO: 3265424 - protein, 18 aa, Plasmodium falciparum
KKTFFNLGFHDNLKNKIN

SEQ ID NO: 3265425 - protein, 23 aa, Plasmodium falciparum
KKTGLKLYVYINFESLKIKTAFD

SEQ ID NO: 3265426 - protein, 18 aa, Plasmodium falciparum
KKTHAPLDLFSVIDIPKS

SEQ ID NO: 3265427 - protein, 22 aa, Plasmodium falciparum
KKTIDHYFFLLLLFNILSNLPY

SEQ ID NO: 3265428 - protein, 19 aa, Plasmodium falciparum
KKTIEYMMCFIKNEENING

SEQ ID NO: 3265429 - protein, 19 aa, Plasmodium falciparum
KKTILSIYMNTLFNCRNDV

SEQ ID NO: 3265430 - protein, 18 aa, Plasmodium falciparum
KKTINYCFFLLLDNLYHI

SEQ ID NO: 3265431 - protein, 20 aa, Plasmodium falciparum
KKTISNWSIQIFNVNNEKIY

SEQ ID NO: 3265432 - protein, 17 aa, Plasmodium falciparum
KKTKCKIKNNDSIINKD

SEQ ID NO: 3265433 - protein, 23 aa, Plasmodium falciparum
KKTKHPVDLFSVINIPKSDYDIP

SEQ ID NO: 3265434 - protein, 27 aa, Plasmodium falciparum
KKTKKENKLICFNRSFINNESCYLYNI

SEQ ID NO: 3265435 - protein, 23 aa, Plasmodium falciparum
KKTKRLVDLFSVINIPKSDYDIP

SEQ ID NO: 3265436 - protein, 18 aa, Plasmodium falciparum
KKTLEGINKKFILTNDNT

SEQ ID NO: 3265437 - protein, 21 aa, Plasmodium falciparum
KKTLIKFIKKYSLYSSSPSSS

SEQ ID NO: 3265438 - protein, 28 aa, Plasmodium falciparum
KKTLKKVKCAYAYLLYIIYYYELTKYEK

SEQ ID NO: 3265439 - protein, 18 aa, Plasmodium falciparum
KKTLVPFEHVDNNIQNDA

SEQ ID NO: 3265440 - protein, 27 aa, Plasmodium falciparum
KKTMQIKYRFKAIIGKINSIFEFQNFL

SEQ ID NO: 3265441 - protein, 24 aa, Plasmodium falciparum
KKTSKWMFYLTVTIIILILIIFFP

SEQ ID NO: 3265442 - protein, 30 aa, Plasmodium falciparum
KKTYIKCGTTIFKHWLLQKSGWSIINVTSF

SEQ ID NO: 3265443 - protein, 28 aa, Plasmodium falciparum
KKVCNKWLCLRNNFFYIFNEYIEESFKN

SEQ ID NO: 3265444 - protein, 19 aa, Plasmodium falciparum
KKVDELYNEFILDYNEIDW

SEQ ID NO: 3265445 - protein, 21 aa, Plasmodium falciparum
KKVENMYLFFYYEKYVKWKKK

SEQ ID NO: 3265446 - protein, 24 aa, Plasmodium falciparum
KKVGFICPYGWNVADYLMDILSNK

SEQ ID NO: 3265447 - protein, 17 aa, Plasmodium falciparum
KKVIDMYNYVGLSSSLV

SEQ ID NO: 3265448 - protein, 20 aa, Plasmodium falciparum
KKVIMCKIKIHSTYENCYLS

SEQ ID NO: 3265449 - protein, 34 aa, Plasmodium falciparum
KKVIYKSIICVIAMAIKLHKPHLIPSSEMLNIKK

SEQ ID NO: 3265450 - protein, 21 aa, Plasmodium falciparum
KKVKPIPIFCCETQNHKLSDV

SEQ ID NO: 3265451 - protein, 17 aa, Plasmodium falciparum
KKVKRRKRNIINNPDEK

SEQ ID NO: 3265452 - protein, 21 aa, Plasmodium falciparum
KKVKWKTIIEIYMEVMNEYKK

SEQ ID NO: 3265453 - protein, 18 aa, Plasmodium falciparum
KKVLYDWDIIHKNFQSKE

SEQ ID NO: 3265454 - protein, 19 aa, Plasmodium falciparum
KKVNDCNNFNWLIQLKYFY

SEQ ID NO: 3265455 - protein, 18 aa, Plasmodium falciparum
KKVNIFMIFSIILIFIYN

SEQ ID NO: 3265456 - protein, 20 aa, Plasmodium falciparum
KKVNILQIFNDIKIYYNESS

SEQ ID NO: 3265457 - protein, 21 aa, Plasmodium falciparum
KKVNYKVCPTFDKHKKNHCFY

SEQ ID NO: 3265458 - protein, 17 aa, Plasmodium falciparum
KKVQKFCIHSNEIKKNE

SEQ ID NO: 3265459 - protein, 21 aa, Plasmodium falciparum
KKVRKQRFIGILSENNNCILL

SEQ ID NO: 3265460 - protein, 30 aa, Plasmodium falciparum
KKVRKYKFILAMCLNHICGMNIPFYLFCEL

SEQ ID NO: 3265461 - protein, 17 aa, Plasmodium falciparum
KKVTINIFAPIKIKYAY

SEQ ID NO: 3265462 - protein, 23 aa, Plasmodium falciparum
KKVTLRLLINIADICSGYFYQFK

SEQ ID NO: 3265463 - protein, 18 aa, Plasmodium falciparum
KKVTNFFYLLLKNVIKEI

SEQ ID NO: 3265464 - protein, 19 aa, Plasmodium falciparum
KKWLWKTIIEIHKLILEEQ

SEQ ID NO: 3265465 - protein, 28 aa, Plasmodium falciparum
KKYAQFWEMFFHILLNFCNIYELNHIRY

SEQ ID NO: 3265466 - protein, 18 aa, Plasmodium falciparum
KKYCRGVYNDVPRYCSRN

SEQ ID NO: 3265467 - protein, 20 aa, Plasmodium falciparum
KKYDVNCCKNIEDIKDEKDL

SEQ ID NO: 3265468 - protein, 29 aa, Plasmodium falciparum
KKYDYEELDLFSLGLLLYELWHTPFKSKE

SEQ ID NO: 3265469 - protein, 21 aa, Plasmodium falciparum
KKYEKDCHKFLIFSNRPCFIS

SEQ ID NO: 3265470 - protein, 21 aa, Plasmodium falciparum
KKYFCYPEMLLYKENKTINEI

SEQ ID NO: 3265471 - protein, 20 aa, Plasmodium falciparum
KKYFFISLLFNIDYYNVRGM

SEQ ID NO: 3265472 - protein, 18 aa, Plasmodium falciparum
KKYFKYSYEKDMDNNKNK

SEQ ID NO: 3265473 - protein, 17 aa, Plasmodium falciparum
KKYFLNYLINAFNFYIL

SEQ ID NO: 3265474 - protein, 20 aa, Plasmodium falciparum
KKYFLSDKMEYISKYLFYKN

SEQ ID NO: 3265475 - protein, 25 aa, Plasmodium falciparum
KKYGECIEFLNFLCSCYINYKVRRM

SEQ ID NO: 3265476 - protein, 17 aa, Plasmodium falciparum
KKYGIKFENVYVSYKKK

SEQ ID NO: 3265477 - protein, 20 aa, Plasmodium falciparum
KKYHNFYLFLLNIFEYHLVK

SEQ ID NO: 3265478 - protein, 18 aa, Plasmodium falciparum
KKYIEKSKKVLHFYRNYM

SEQ ID NO: 3265479 - protein, 18 aa, Plasmodium falciparum
KKYIESINIKDINNIYNK

SEQ ID NO: 3265480 - protein, 20 aa, Plasmodium falciparum
KKYIFSVFVFLCCFLMSFNI

SEQ ID NO: 3265481 - protein, 18 aa, Plasmodium falciparum
KKYIKQYYIYKNVLKNIR

SEQ ID NO: 3265482 - protein, 20 aa, Plasmodium falciparum
KKYILDILSNINIKKLIFGK

SEQ ID NO: 3265483 - protein, 19 aa, Plasmodium falciparum
KKYILYAITIYTYVYSIYY

SEQ ID NO: 3265484 - protein, 18 aa, Plasmodium falciparum
KKYILYDFFFEYDRKLIL

SEQ ID NO: 3265485 - protein, 18 aa, Plasmodium falciparum
KKYINLLNIMTFFVEFIK

SEQ ID NO: 3265486 - protein, 19 aa, Plasmodium falciparum
KKYIYYLYREDIIYLENNI

SEQ ID NO: 3265487 - protein, 18 aa, Plasmodium falciparum
KKYKEYEKALLLYNLINK

SEQ ID NO: 3265488 - protein, 19 aa, Plasmodium falciparum
KKYKLIWNYFKINKEIYID

SEQ ID NO: 3265489 - protein, 19 aa, Plasmodium falciparum
KKYKNFLLSTVKIKDIDSD

SEQ ID NO: 3265490 - protein, 19 aa, Plasmodium falciparum
KKYKRKGKRYSSDSYKDDS

SEQ ID NO: 3265491 - protein, 36 aa, Plasmodium falciparum
KKYLCNPTSFKLLSVISIHFSHMLFNYPYLSKFLTF

SEQ ID NO: 3265492 - protein, 18 aa, Plasmodium falciparum
KKYLEDINMDTLRLSFTF

SEQ ID NO: 3265493 - protein, 22 aa, Plasmodium falciparum
KKYLEMNNIFAVLLHEKLQISL

SEQ ID NO: 3265494 - protein, 19 aa, Plasmodium falciparum
KKYLESLPFYNDSYITSMY

SEQ ID NO: 3265495 - protein, 23 aa, Plasmodium falciparum
KKYLFCAFLLLEFFTHPKDDFIL

SEQ ID NO: 3265496 - protein, 31 aa, Plasmodium falciparum
KKYLKIFLCISLCILFFLIGYAFIMYNGSVD

SEQ ID NO: 3265497 - protein, 23 aa, Plasmodium falciparum
KKYLLSIICVLFFNITNNEISTK

SEQ ID NO: 3265498 - protein, 17 aa, Plasmodium falciparum
KKYMFIRTVEKDVINLF

SEQ ID NO: 3265499 - protein, 24 aa, Plasmodium falciparum
KKYMKILFLKFTKNVFLRNYEICN

SEQ ID NO: 3265500 - protein, 26 aa, Plasmodium falciparum
KKYMNTSLCSFKYFNNFFFNYSLYFP

SEQ ID NO: 3265501 - protein, 20 aa, Plasmodium falciparum
KKYMYEIIEESCFDIKSFNN

SEQ ID NO: 3265502 - protein, 21 aa, Plasmodium falciparum
KKYMYRLNMPLFINKLKLLND

SEQ ID NO: 3265503 - protein, 19 aa, Plasmodium falciparum
KKYNFYLIDNAYCSICKEI

SEQ ID NO: 3265504 - protein, 17 aa, Plasmodium falciparum
KKYNKYISPNFFSNSTN

SEQ ID NO: 3265505 - protein, 20 aa, Plasmodium falciparum
KKYPAIKIYYIFLEHFGFLY

SEQ ID NO: 3265506 - protein, 19 aa, Plasmodium falciparum
KKYPNMEKYYALRNNENKN

SEQ ID NO: 3265507 - protein, 24 aa, Plasmodium falciparum
KKYRMKELMSLYFEDMDYFHQSDI

SEQ ID NO: 3265508 - protein, 21 aa, Plasmodium falciparum
KKYRPNIYIILFIKNNFHDDI

SEQ ID NO: 3265509 - protein, 30 aa, Plasmodium falciparum
KKYSIWQFYLSIEILHLIFSNIKYVPFNSI

SEQ ID NO: 3265510 - protein, 18 aa, Plasmodium falciparum
KKYSSFCILHTGKKVLQK

SEQ ID NO: 3265511 - protein, 19 aa, Plasmodium falciparum
KKYSTLFGLESFNLRFRYK

SEQ ID NO: 3265512 - protein, 23 aa, Plasmodium falciparum
KKYTHWNLSSSLIQYNKILEENK

SEQ ID NO: 3265513 - protein, 20 aa, Plasmodium falciparum
KKYVEFEIIYNLLKKNFLKT

SEQ ID NO: 3265514 - protein, 26 aa, Plasmodium falciparum
KKYVKGNILWNVIINFQKYDLFNMTE

SEQ ID NO: 3265515 - protein, 24 aa, Plasmodium falciparum
KKYVKKKISSIYILTVGVNEYFRG

SEQ ID NO: 3265516 - protein, 26 aa, Plasmodium falciparum
KKYYFSTLLLCLCKLIISLLDIYIAI

SEQ ID NO: 3265517 - protein, 28 aa, Plasmodium falciparum
KKYYFYKLFHKFRMSYNHFIKYTQNEIF

SEQ ID NO: 3265518 - protein, 20 aa, Plasmodium falciparum
KKYYIVKLILEYCEGGNLFE

SEQ ID NO: 3265519 - protein, 30 aa, Plasmodium falciparum
KKYYIYHILFLYIFFLRITYTYAEITISQF

SEQ ID NO: 3265520 - protein, 23 aa, Plasmodium falciparum
KKYYKMLDKYISYIKRSINNELE

SEQ ID NO: 3265521 - protein, 25 aa, Plasmodium falciparum
KKYYYKDRCIIHFSKYIKNRKENFD

SEQ ID NO: 3265522 - protein, 17 aa, Plasmodium falciparum
KLAEKIEKGCLMCACGL

SEQ ID NO: 3265523 - protein, 22 aa, Plasmodium falciparum
KLALCVFSYFLIKKDRNKWLHF

SEQ ID NO: 3265524 - protein, 24 aa, Plasmodium falciparum
KLANKKFILLLAFSILAITLDVRY

SEQ ID NO: 3265525 - protein, 20 aa, Plasmodium falciparum
KLANVIFPILIKVVDIYDVL

SEQ ID NO: 3265526 - protein, 23 aa, Plasmodium falciparum
KLCSSRFNIILNYLCTSINQYIM

SEQ ID NO: 3265527 - protein, 19 aa, Plasmodium falciparum
KLCYCLSSKLNMVRSEAKK

SEQ ID NO: 3265528 - protein, 19 aa, Plasmodium falciparum
KLDLCIKSSSLFTENSNII

SEQ ID NO: 3265529 - protein, 30 aa, Plasmodium falciparum
KLDLKTILTELFKWIKLFENYPNKRFFRIL

SEQ ID NO: 3265530 - protein, 22 aa, Plasmodium falciparum
KLDNDISWIACITLFADSLENS

SEQ ID NO: 3265531 - protein, 24 aa, Plasmodium falciparum
KLDRIAYDWRLHGGVTPVKDQALC

SEQ ID NO: 3265532 - protein, 17 aa, Plasmodium falciparum
KLDSLFIKNEEILNNLF

SEQ ID NO: 3265533 - protein, 20 aa, Plasmodium falciparum
KLDVKNCIYFSGVYIPDINI

SEQ ID NO: 3265534 - protein, 19 aa, Plasmodium falciparum
KLDVQLAILIKKKRRKKKK

SEQ ID NO: 3265535 - protein, 26 aa, Plasmodium falciparum
KLEEKYHLTFLWVLGYIFYFIPSLAK

SEQ ID NO: 3265536 - protein, 19 aa, Plasmodium falciparum
KLEENLKTIFGHIYDELKN

SEQ ID NO: 3265537 - protein, 25 aa, Plasmodium falciparum
KLEFFKIVLDYILTYLVNFINIKNV

SEQ ID NO: 3265538 - protein, 18 aa, Plasmodium falciparum
KLEKCVMIKYPHKKRQPF

SEQ ID NO: 3265539 - protein, 19 aa, Plasmodium falciparum
KLEKLNLLLNERNMKILKI

SEQ ID NO: 3265540 - protein, 21 aa, Plasmodium falciparum
KLELLEVVDFIKNREKYHEMG

SEQ ID NO: 3265541 - protein, 27 aa, Plasmodium falciparum
KLENIRLDILFFTLLSLRDSILNKKGK

SEQ ID NO: 3265542 - protein, 20 aa, Plasmodium falciparum
KLESHFSLPILDSMAHIFIN

SEQ ID NO: 3265543 - protein, 17 aa, Plasmodium falciparum
KLFEIKDPFYFHDNKNY

SEQ ID NO: 3265544 - protein, 29 aa, Plasmodium falciparum
KLFELYYIYIYIILHIINFYNDSFVDLKY

SEQ ID NO: 3265545 - protein, 29 aa, Plasmodium falciparum
KLFEYAFPFLIKYNEHFFFHFLKKKNILI

SEQ ID NO: 3265546 - protein, 24 aa, Plasmodium falciparum
KLFFDCTWMSSIIMTTLFMRIIIL

SEQ ID NO: 3265547 - protein, 19 aa, Plasmodium falciparum
KLFFEFDYNFLKTHPDSTT

SEQ ID NO: 3265548 - protein, 17 aa, Plasmodium falciparum
KLFFFTCSEDSMCNVYS

SEQ ID NO: 3265549 - protein, 20 aa, Plasmodium falciparum
KLFHYNHMVILFQFFSEQFI

SEQ ID NO: 3265550 - protein, 29 aa, Plasmodium falciparum
KLFIKSSILYFNFHFNPILLFPIIYKGAS

SEQ ID NO: 3265551 - protein, 17 aa, Plasmodium falciparum
KLFKDFIYSSAISEVER

SEQ ID NO: 3265552 - protein, 18 aa, Plasmodium falciparum
KLFKFYKHYHVVNQRVSS

SEQ ID NO: 3265553 - protein, 23 aa, Plasmodium falciparum
KLFKKRIWDLYEVHINYMLHFLC

SEQ ID NO: 3265554 - protein, 18 aa, Plasmodium falciparum
KLFKLAYEHKNCIITLSY

SEQ ID NO: 3265555 - protein, 22 aa, Plasmodium falciparum
KLFKYSFLNLSLYRYMKNLENQ

SEQ ID NO: 3265556 - protein, 43 aa, Plasmodium falciparum
KLFNYIKVYYSFLILLTILGFFSKLLVLIRIFITHNINKIFRL

SEQ ID NO: 3265557 - protein, 23 aa, Plasmodium falciparum
KLFPEIFNPFVAKNIYTEITNLA

SEQ ID NO: 3265558 - protein, 17 aa, Plasmodium falciparum
KLFSEVMSFHYPSSFVF

SEQ ID NO: 3265559 - protein, 21 aa, Plasmodium falciparum
KLFVNISPPAALAIIGTAVAI

SEQ ID NO: 3265560 - protein, 32 aa, Plasmodium falciparum
KLFYNMIICLILYHHSFCYITMNIFGGKYFQN

SEQ ID NO: 3265561 - protein, 23 aa, Plasmodium falciparum
KLGCPDYGKTFLMGFEDNKYSEE

SEQ ID NO: 3265562 - protein, 19 aa, Plasmodium falciparum
KLGELYNSLNFLLKSINEY

SEQ ID NO: 3265563 - protein, 18 aa, Plasmodium falciparum
KLGENYLEQSFIQINDYI

SEQ ID NO: 3265564 - protein, 33 aa, Plasmodium falciparum
KLGKCRKGCKNPCECYKRWVEKKKDEWDKIKEF

SEQ ID NO: 3265565 - protein, 25 aa, Plasmodium falciparum
KLGLDKSLLERFVMAKIAPVHLLNT

SEQ ID NO: 3265566 - protein, 19 aa, Plasmodium falciparum
KLGPLILVLTLTFSLSTVV

SEQ ID NO: 3265567 - protein, 20 aa, Plasmodium falciparum
KLGSILLLTSEIVFSHVTVF

SEQ ID NO: 3265568 - protein, 26 aa, Plasmodium falciparum
KLHFLLKHLFIFKNEMKNVEYFKNER

SEQ ID NO: 3265569 - protein, 18 aa, Plasmodium falciparum
KLHNCFVDIQVMYEHCVK

SEQ ID NO: 3265570 - protein, 19 aa, Plasmodium falciparum
KLHNCMRKDLFSINFNNNT

SEQ ID NO: 3265571 - protein, 18 aa, Plasmodium falciparum
KLHNYCLSYLFYNVSSLS

SEQ ID NO: 3265572 - protein, 30 aa, Plasmodium falciparum
KLHPELLVHIPINIIISMVVFKLMHKSLRN

SEQ ID NO: 3265573 - protein, 22 aa, Plasmodium falciparum
KLHPFDLYIAYMVNKNTDKLKN

SEQ ID NO: 3265574 - protein, 23 aa, Plasmodium falciparum
KLHPPDCFENIIVNQNVYKKNII

SEQ ID NO: 3265575 - protein, 20 aa, Plasmodium falciparum
KLHQVGICHLDFSIDNILIS

SEQ ID NO: 3265576 - protein, 17 aa, Plasmodium falciparum
KLIFIIFLCMNLKIVPC

SEQ ID NO: 3265577 - protein, 23 aa, Plasmodium falciparum
KLIFPINIFVNLLIPLFLPYDDV

SEQ ID NO: 3265578 - protein, 19 aa, Plasmodium falciparum
KLIICKIFIDILKKFKRQK

SEQ ID NO: 3265579 - protein, 18 aa, Plasmodium falciparum
KLIIKHPFFLKNYKNDSS

SEQ ID NO: 3265580 - protein, 20 aa, Plasmodium falciparum
KLIIVEFFRQLKINSEIIYH

SEQ ID NO: 3265581 - protein, 21 aa, Plasmodium falciparum
KLIIYKIFRFDILKLNMNNYI

SEQ ID NO: 3265582 - protein, 20 aa, Plasmodium falciparum
KLIIYLPHWFNDYDLLKQVN

SEQ ID NO: 3265583 - protein, 17 aa, Plasmodium falciparum
KLILTHFSQRYIGDNKL

SEQ ID NO: 3265584 - protein, 23 aa, Plasmodium falciparum
KLININIPYLFPNVLAYKKLILT

SEQ ID NO: 3265585 - protein, 20 aa, Plasmodium falciparum
KLINKILCLYKQNVYNAVHN

SEQ ID NO: 3265586 - protein, 19 aa, Plasmodium falciparum
KLINKIWIQIHMMLLEEYK

SEQ ID NO: 3265587 - protein, 27 aa, Plasmodium falciparum
KLINRILYSICRYVKKYFELYEMDVLY

SEQ ID NO: 3265588 - protein, 32 aa, Plasmodium falciparum
KLIPIEKILSYKPSLDFSYIIQGIKHNNFIKT

SEQ ID NO: 3265589 - protein, 17 aa, Plasmodium falciparum
KLIRLEILYNIIRKYVK

SEQ ID NO: 3265590 - protein, 17 aa, Plasmodium falciparum
KLISSIFSYWIKLSDGC

SEQ ID NO: 3265591 - protein, 18 aa, Plasmodium falciparum
KLITKLFIEIHMMVIENS

SEQ ID NO: 3265592 - protein, 37 aa, Plasmodium falciparum
KLIVLAFQCNFSLYSPRVLYPLLFEYVVNIKNSYKII

SEQ ID NO: 3265593 - protein, 17 aa, Plasmodium falciparum
KLIYKYKNVVQCQSNDY

SEQ ID NO: 3265594 - protein, 19 aa, Plasmodium falciparum
KLIYLRIVFQNQLSLDRKT

SEQ ID NO: 3265595 - protein, 27 aa, Plasmodium falciparum
KLIYPHLLKFYLDHFFLSSYSIVKKEI

SEQ ID NO: 3265596 - protein, 20 aa, Plasmodium falciparum
KLKEKFIQGQKIYELVKNET

SEQ ID NO: 3265597 - protein, 25 aa, Plasmodium falciparum
KLKELWNKLTTRYSIKFHTNKETEN

SEQ ID NO: 3265598 - protein, 22 aa, Plasmodium falciparum
KLKERRLVKDDVDLKIDDIYVY

SEQ ID NO: 3265599 - protein, 21 aa, Plasmodium falciparum
KLKHCKNELVDVWNMKGYDSN

SEQ ID NO: 3265600 - protein, 30 aa, Plasmodium falciparum
KLKHLPKELFEFLTSYSLFSCDKKDMINNF

SEQ ID NO: 3265601 - protein, 19 aa, Plasmodium falciparum
KLKICKTIYAFYFWFFAIL

SEQ ID NO: 3265602 - protein, 18 aa, Plasmodium falciparum
KLKIFPLLLDYQKNCIYV

SEQ ID NO: 3265603 - protein, 17 aa, Plasmodium falciparum
KLKIHKLMDNEVIKIFC

SEQ ID NO: 3265604 - protein, 26 aa, Plasmodium falciparum
KLKIKKGYIYPFFVMLPFIFPVIISM

SEQ ID NO: 3265605 - protein, 23 aa, Plasmodium falciparum
KLKIKKYCLISAAGLAKPRHRFL

SEQ ID NO: 3265606 - protein, 19 aa, Plasmodium falciparum
KLKILDAKFLYTEPHSKRL

SEQ ID NO: 3265607 - protein, 25 aa, Plasmodium falciparum
KLKIQLCIYSTFLQRAYDQIIHDLN

SEQ ID NO: 3265608 - protein, 18 aa, Plasmodium falciparum
KLKKFIQIGNGYKSINMC

SEQ ID NO: 3265609 - protein, 21 aa, Plasmodium falciparum
KLKKKSNDLFTYYEQSKNYFY

SEQ ID NO: 3265610 - protein, 22 aa, Plasmodium falciparum
KLKKQYLPLLAHELKIFLFFIV

SEQ ID NO: 3265611 - protein, 20 aa, Plasmodium falciparum
KLKKTIFIFYVLSFSLFLFL

SEQ ID NO: 3265612 - protein, 24 aa, Plasmodium falciparum
KLKKWLHYLKNWFYKKKRMKKYIK

SEQ ID NO: 3265613 - protein, 20 aa, Plasmodium falciparum
KLKLLFKINENVCKYYSIRN

SEQ ID NO: 3265614 - protein, 19 aa, Plasmodium falciparum
KLKNCKMNYNIPYEHFLEN

SEQ ID NO: 3265615 - protein, 19 aa, Plasmodium falciparum
KLKNVEYFLVPIIKEKTIR

SEQ ID NO: 3265616 - protein, 17 aa, Plasmodium falciparum
KLKQCAMKAFYNTEINE

SEQ ID NO: 3265617 - protein, 31 aa, Plasmodium falciparum
KLKSLCSNMFYRLKIKIVKKINEYLKNVVRN

SEQ ID NO: 3265618 - protein, 24 aa, Plasmodium falciparum
KLKTDCLCSPGYEYSDKSSKCEKC

SEQ ID NO: 3265619 - protein, 22 aa, Plasmodium falciparum
KLKTFYRPRLNDNSTLINSFHW

SEQ ID NO: 3265620 - protein, 19 aa, Plasmodium falciparum
KLKTIPLLPNEVGSYVLNE

SEQ ID NO: 3265621 - protein, 20 aa, Plasmodium falciparum
KLKTKLIYMYLSLNPRDVPN

SEQ ID NO: 3265622 - protein, 21 aa, Plasmodium falciparum
KLKTLCDLASKLILFAHNDLI

SEQ ID NO: 3265623 - protein, 19 aa, Plasmodium falciparum
KLKTNIYNTDWFIVECPIK

SEQ ID NO: 3265624 - protein, 17 aa, Plasmodium falciparum
KLKTPFINREDFYVNNN

SEQ ID NO: 3265625 - protein, 20 aa, Plasmodium falciparum
KLKTSLKCNCHGRSKKENDK

SEQ ID NO: 3265626 - protein, 23 aa, Plasmodium falciparum
KLKVEHLRELKAFVNPPSVVVMV

SEQ ID NO: 3265627 - protein, 23 aa, Plasmodium falciparum
KLKYHFDFVYVISLFISLILLKF

SEQ ID NO: 3265628 - protein, 19 aa, Plasmodium falciparum
KLKYLPADDIKKMRSFIKI

SEQ ID NO: 3265629 - protein, 20 aa, Plasmodium falciparum
KLKYNYDLSCEFPDEIINNY

SEQ ID NO: 3265630 - protein, 23 aa, Plasmodium falciparum
KLLAEFIYFFMIIAFWILVTHLI

SEQ ID NO: 3265631 - protein, 17 aa, Plasmodium falciparum
KLLEHYDEISFYLHKKN

SEQ ID NO: 3265632 - protein, 22 aa, Plasmodium falciparum
KLLEILNTLSISTCLHILLNIS

SEQ ID NO: 3265633 - protein, 21 aa, Plasmodium falciparum
KLLEKGGMIERLIKIHENLTK

SEQ ID NO: 3265634 - protein, 24 aa, Plasmodium falciparum
KLLERRKKDILNIFTRKIHYELSR

SEQ ID NO: 3265635 - protein, 18 aa, Plasmodium falciparum
KLLFCLFFECLDNIRRSK

SEQ ID NO: 3265636 - protein, 19 aa, Plasmodium falciparum
KLLFFFFETQMRDIIQNYK

SEQ ID NO: 3265637 - protein, 19 aa, Plasmodium falciparum
KLLFSNKIYNHFNYPGFDF

SEQ ID NO: 3265638 - protein, 19 aa, Plasmodium falciparum
KLLFSYFSVVLLGIIYEIP

SEQ ID NO: 3265639 - protein, 21 aa, Plasmodium falciparum
KLLGESCTKCVLEMNDENQYK

SEQ ID NO: 3265640 - protein, 20 aa, Plasmodium falciparum
KLLHKERINNFALYHNKQPL

SEQ ID NO: 3265641 - protein, 23 aa, Plasmodium falciparum
KLLKDLIKYLHIVKFENNEPTTN

SEQ ID NO: 3265642 - protein, 32 aa, Plasmodium falciparum
KLLKEIITLVNMLCNLFIYDSLIFYNYLNNLK

SEQ ID NO: 3265643 - protein, 20 aa, Plasmodium falciparum
KLLKKSKILFYIWSNNLQKI

SEQ ID NO: 3265644 - protein, 18 aa, Plasmodium falciparum
KLLKSCNIKEDMSSNTSV

SEQ ID NO: 3265645 - protein, 20 aa, Plasmodium falciparum
KLLLFPIVVMRLCFLSLTLI

SEQ ID NO: 3265646 - protein, 25 aa, Plasmodium falciparum
KLLNTQILLYFTRFYQLTKKIFSNI

SEQ ID NO: 3265647 - protein, 25 aa, Plasmodium falciparum
KLLSFSLDHFPFFFFILKNDKKENS

SEQ ID NO: 3265648 - protein, 26 aa, Plasmodium falciparum
KLLTCCIITTLFFYFTLKKVPEGYVC

SEQ ID NO: 3265649 - protein, 20 aa, Plasmodium falciparum
KLLTHSFLYIPFRRYTATPF

SEQ ID NO: 3265650 - protein, 18 aa, Plasmodium falciparum
KLLTLSFTCLSRIHSYNA

SEQ ID NO: 3265651 - protein, 23 aa, Plasmodium falciparum
KLLTYLEFFKFNFGSSTKNIKQA

SEQ ID NO: 3265652 - protein, 19 aa, Plasmodium falciparum
KLLWSLYINCIIKVDILLI

SEQ ID NO: 3265653 - protein, 20 aa, Plasmodium falciparum
KLLYEFLLSCVDNYIHTKKT

SEQ ID NO: 3265654 - protein, 25 aa, Plasmodium falciparum
KLLYFVKINFCLNNKDFNIFCNLYH

SEQ ID NO: 3265655 - protein, 18 aa, Plasmodium falciparum
KLLYIYPAFQNIFNSNFM

SEQ ID NO: 3265656 - protein, 22 aa, Plasmodium falciparum
KLMECQWMKIFFVSLLDVVNQV

SEQ ID NO: 3265657 - protein, 26 aa, Plasmodium falciparum
KLMQIKRYYLATAFFILSGDIKDAID

SEQ ID NO: 3265658 - protein, 22 aa, Plasmodium falciparum
KLMSIPLINIITKWNIMDDKSM

SEQ ID NO: 3265659 - protein, 19 aa, Plasmodium falciparum
KLNEFKFWLYSTRAICISI

SEQ ID NO: 3265660 - protein, 20 aa, Plasmodium falciparum
KLNELIYVSFLIRKYYNHYY

SEQ ID NO: 3265661 - protein, 22 aa, Plasmodium falciparum
KLNESLNVLSFIHTVNKIDINI

SEQ ID NO: 3265662 - protein, 32 aa, Plasmodium falciparum
KLNFISFKFLCLCLYMIGFLYIFLNISLENKS

SEQ ID NO: 3265663 - protein, 19 aa, Plasmodium falciparum
KLNFSLCFFHALIQERTKF

SEQ ID NO: 3265664 - protein, 25 aa, Plasmodium falciparum
KLNHGCSQLAHLVSFSKLPAYIQPF

SEQ ID NO: 3265665 - protein, 21 aa, Plasmodium falciparum
KLNIIPCNNFDMIRNTFNEIN

SEQ ID NO: 3265666 - protein, 20 aa, Plasmodium falciparum
KLNIKNVCIIEGGIDSYHKH

SEQ ID NO: 3265667 - protein, 26 aa, Plasmodium falciparum
KLNIYKLNLFISIVIMTLYQIMENLG

SEQ ID NO: 3265668 - protein, 24 aa, Plasmodium falciparum
KLNKECNQLIFSRHLDKQHYLYRQ

SEQ ID NO: 3265669 - protein, 23 aa, Plasmodium falciparum
KLNKHILSAFPMLKNVIEALKND

SEQ ID NO: 3265670 - protein, 27 aa, Plasmodium falciparum
KLNKNVCVGCGAIFQSKDMNKFGFLKN

SEQ ID NO: 3265671 - protein, 25 aa, Plasmodium falciparum
KLNKRKGSIVCCYVPVFYKNISLTY

SEQ ID NO: 3265672 - protein, 21 aa, Plasmodium falciparum
KLNLACSFISGFISSPLDIIR

SEQ ID NO: 3265673 - protein, 26 aa, Plasmodium falciparum
KLNLINELLYIFPLDSTKIHFLPCKY

SEQ ID NO: 3265674 - protein, 24 aa, Plasmodium falciparum
KLNLIPIQIFYKLHFKIKKNIKNI

SEQ ID NO: 3265675 - protein, 18 aa, Plasmodium falciparum
KLNLITLFLFIILTLFSI

SEQ ID NO: 3265676 - protein, 31 aa, Plasmodium falciparum
KLNLPKFDCFSIFLIVRFKYYLEEFKENSNI

SEQ ID NO: 3265677 - protein, 37 aa, Plasmodium falciparum
KLNLQDFFFLKLRKYNNCFILFFTILLMYITKLFEIK

SEQ ID NO: 3265678 - protein, 26 aa, Plasmodium falciparum
KLNMTESLCSPICVHNFLFKNININS

SEQ ID NO: 3265679 - protein, 30 aa, Plasmodium falciparum
KLNNLKVLDLRWNNFTYKSLLTLSFSLTNI

SEQ ID NO: 3265680 - protein, 25 aa, Plasmodium falciparum
KLNTKSLCAILWSLAKCSYFNFKIY

SEQ ID NO: 3265681 - protein, 21 aa, Plasmodium falciparum
KLPDGFEGYLICEKKNSQALL

SEQ ID NO: 3265682 - protein, 24 aa, Plasmodium falciparum
KLPFKEKLLWTAVSLFVFLICCQI

SEQ ID NO: 3265683 - protein, 23 aa, Plasmodium falciparum
KLPHVIPLSLLFYNFNEKYFMEK

SEQ ID NO: 3265684 - protein, 26 aa, Plasmodium falciparum
KLPRSWKKLLLNLSIRFQTIPIGGSI

SEQ ID NO: 3265685 - protein, 29 aa, Plasmodium falciparum
KLPSLNLSFSFFLELFLKNMKNNQNIKNY

SEQ ID NO: 3265686 - protein, 22 aa, Plasmodium falciparum
KLPYHFRLYLIKSWNKNFEKNM

SEQ ID NO: 3265687 - protein, 17 aa, Plasmodium falciparum
KLQEFRLNNGIRNNFSR

SEQ ID NO: 3265688 - protein, 22 aa, Plasmodium falciparum
KLQEYFYKWIYIYEKKQIYIHF

SEQ ID NO: 3265689 - protein, 28 aa, Plasmodium falciparum
KLQKSGEIPPDFLRQMFYTLGDYRDILY

SEQ ID NO: 3265690 - protein, 32 aa, Plasmodium falciparum
KLQLYNIAFCLLLEIYILLLTINYEYIENFKN

SEQ ID NO: 3265691 - protein, 20 aa, Plasmodium falciparum
KLQTLLGYSLSEHSLIKRII

SEQ ID NO: 3265692 - protein, 21 aa, Plasmodium falciparum
KLREDWWTANRETVWEALTCD

SEQ ID NO: 3265693 - protein, 21 aa, Plasmodium falciparum
KLREHKIIIVTSSGKIYDDDN

SEQ ID NO: 3265694 - protein, 18 aa, Plasmodium falciparum
KLRFDEFKIDTLTIPQKP

SEQ ID NO: 3265695 - protein, 21 aa, Plasmodium falciparum
KLRFSVYFCVFLFLYMFSLCI

SEQ ID NO: 3265696 - protein, 23 aa, Plasmodium falciparum
KLRLMGFRILVERDIGTNILMQN

SEQ ID NO: 3265697 - protein, 18 aa, Plasmodium falciparum
KLRNNICFVIPNIIIIKL

SEQ ID NO: 3265698 - protein, 45 aa, Plasmodium falciparum
KLRVFKLKCIMLKIMKILITFLKFDILIILKCSRIFLKEDNLIIN

SEQ ID NO: 3265699 - protein, 22 aa, Plasmodium falciparum
KLSCGSFYLKNYIYKYMPILYV

SEQ ID NO: 3265700 - protein, 23 aa, Plasmodium falciparum
KLSDHIAVKCTFIKNYNRINYNN

SEQ ID NO: 3265701 - protein, 29 aa, Plasmodium falciparum
KLSEASCDEALENMYIQLCNIMQSKGLEE

SEQ ID NO: 3265702 - protein, 17 aa, Plasmodium falciparum
KLSEQKYILLMLASMRK

SEQ ID NO: 3265703 - protein, 17 aa, Plasmodium falciparum
KLSESICEFNELKCFNV

SEQ ID NO: 3265704 - protein, 21 aa, Plasmodium falciparum
KLSFLHKAYKKKNCTFQNYSL

SEQ ID NO: 3265705 - protein, 18 aa, Plasmodium falciparum
KLSFSLTLLTEFDDVILI

SEQ ID NO: 3265706 - protein, 25 aa, Plasmodium falciparum
KLSKFGNSCGCSFSAHSTNGKDDAI

SEQ ID NO: 3265707 - protein, 25 aa, Plasmodium falciparum
KLSKFLNIKFDLNFDNAYYNTYENY

SEQ ID NO: 3265708 - protein, 26 aa, Plasmodium falciparum
KLSKNFKPPNPWTTAILCLLTEIHEL

SEQ ID NO: 3265709 - protein, 25 aa, Plasmodium falciparum
KLSKVVCIIFIFWTFIWVPIQFNDL

SEQ ID NO: 3265710 - protein, 18 aa, Plasmodium falciparum
KLSLGLLIFFISVIVLIC

SEQ ID NO: 3265711 - protein, 27 aa, Plasmodium falciparum
KLSLHDLILCFNKIFSFFNYIPKSKLN

SEQ ID NO: 3265712 - protein, 20 aa, Plasmodium falciparum
KLSLLCSILTILTGVIMSIT

SEQ ID NO: 3265713 - protein, 27 aa, Plasmodium falciparum
KLSLNSRLEGVYVFMKDSPACYLEDDD

SEQ ID NO: 3265714 - protein, 18 aa, Plasmodium falciparum
KLSLPLEICRLEKLTKNS

SEQ ID NO: 3265715 - protein, 26 aa, Plasmodium falciparum
KLSLYNKLRMCFNYFGPGWIVAIAYL

SEQ ID NO: 3265716 - protein, 22 aa, Plasmodium falciparum
KLSMKRKFLWNCIDQNTNVSEL

SEQ ID NO: 3265717 - protein, 22 aa, Plasmodium falciparum
KLSRKIIPLIFQKIKEIMENLK

SEQ ID NO: 3265718 - protein, 20 aa, Plasmodium falciparum
KLSRWDFIIFFVFFVLITLL

SEQ ID NO: 3265719 - protein, 33 aa, Plasmodium falciparum
KLTEFVEIPPFFRWLHEWGSDFCDKRARMLKNV

SEQ ID NO: 3265720 - protein, 30 aa, Plasmodium falciparum
KLTFYKNNLAHLFTLIKIVIPNIYYIYEET

SEQ ID NO: 3265721 - protein, 22 aa, Plasmodium falciparum
KLTSFKYSIPYIKNKYSNVLIN

SEQ ID NO: 3265722 - protein, 23 aa, Plasmodium falciparum
KLVDSCYSFWMGSIFFLIYEIYI

SEQ ID NO: 3265723 - protein, 21 aa, Plasmodium falciparum
KLVFYHPILLLNYIKMGLFSH

SEQ ID NO: 3265724 - protein, 31 aa, Plasmodium falciparum
KLVKYEYRIYKKFLPIIIHIYFTNKAKSVIF

SEQ ID NO: 3265725 - protein, 31 aa, Plasmodium falciparum
KLVYMPFYLTESFLNLIPHYNLNKSFMNSFC

SEQ ID NO: 3265726 - protein, 28 aa, Plasmodium falciparum
KLWAGTWNLCGGDLEELHDISSWLNEVD

SEQ ID NO: 3265727 - protein, 19 aa, Plasmodium falciparum
KLWESIRIDVWKAMICGYK

SEQ ID NO: 3265728 - protein, 17 aa, Plasmodium falciparum
KLWYEFFFLSSSQKKKT

SEQ ID NO: 3265729 - protein, 20 aa, Plasmodium falciparum
KLYASEIYFKNMIKEKYKIK

SEQ ID NO: 3265730 - protein, 24 aa, Plasmodium falciparum
KLYAVALGLLFLCSREKCEATLSA

SEQ ID NO: 3265731 - protein, 19 aa, Plasmodium falciparum
KLYEDWKCYNDVEKDGQDG

SEQ ID NO: 3265732 - protein, 19 aa, Plasmodium falciparum
KLYEEWKCYKHDEVQKVQG

SEQ ID NO: 3265733 - protein, 17 aa, Plasmodium falciparum
KLYETYSSYIIKEKNTD

SEQ ID NO: 3265734 - protein, 21 aa, Plasmodium falciparum
KLYFILLRYSYIKTYKTYLIL

SEQ ID NO: 3265735 - protein, 22 aa, Plasmodium falciparum
KLYFYNLCFHINIYLYTYFQKC

SEQ ID NO: 3265736 - protein, 18 aa, Plasmodium falciparum
KLYHIIEKIILLFFNNLK

SEQ ID NO: 3265737 - protein, 20 aa, Plasmodium falciparum
KLYIFIIYYIEGLRKKENIL

SEQ ID NO: 3265738 - protein, 19 aa, Plasmodium falciparum
KLYIFNIIYGYVRIYITNN

SEQ ID NO: 3265739 - protein, 21 aa, Plasmodium falciparum
KLYILRYIKYLQINDDINKYR

SEQ ID NO: 3265740 - protein, 20 aa, Plasmodium falciparum
KLYIRRYYLKKSIKYNNHLY

SEQ ID NO: 3265741 - protein, 24 aa, Plasmodium falciparum
KLYKMIFKRNKFWRVISKIITVLG

SEQ ID NO: 3265742 - protein, 22 aa, Plasmodium falciparum
KLYLNLVDMFLFYSYKYYFYYY

SEQ ID NO: 3265743 - protein, 24 aa, Plasmodium falciparum
KLYMTCPHVKFLNNHIINNIKNIL

SEQ ID NO: 3265744 - protein, 20 aa, Plasmodium falciparum
KLYNGLHFLIMFLNNYLDNT

SEQ ID NO: 3265745 - protein, 25 aa, Plasmodium falciparum
KLYNHKYLYDILCDIFKNDKKFQAR

SEQ ID NO: 3265746 - protein, 32 aa, Plasmodium falciparum
KLYPYYFYRKPVCHSIIFKILAYNFLHYEQIN

SEQ ID NO: 3265747 - protein, 23 aa, Plasmodium falciparum
KLYRRIYWPLLLGIYKAENLEDL

SEQ ID NO: 3265748 - protein, 23 aa, Plasmodium falciparum
KLYSFKIRCFLFIKKNEEEKNDK

SEQ ID NO: 3265749 - protein, 18 aa, Plasmodium falciparum
KLYSLYCQCSDNGVISFW

SEQ ID NO: 3265750 - protein, 23 aa, Plasmodium falciparum
KLYTCMIYCCYILIKNKYYLDFF

SEQ ID NO: 3265751 - protein, 20 aa, Plasmodium falciparum
KLYVELNKIFFVCRENKIYD

SEQ ID NO: 3265752 - protein, 18 aa, Plasmodium falciparum
KLYYYGIHSNIFQNNKNT

SEQ ID NO: 3265753 - protein, 19 aa, Plasmodium falciparum
KMCAEKFIFVRSLSEEVKE

SEQ ID NO: 3265754 - protein, 17 aa, Plasmodium falciparum
KMCNIEKGLEIIVKCLF

SEQ ID NO: 3265755 - protein, 18 aa, Plasmodium falciparum
KMDKCISFNEAYDLNNDE

SEQ ID NO: 3265756 - protein, 24 aa, Plasmodium falciparum
KMDKGCLHFPFPSSDSLIKNDDNK

SEQ ID NO: 3265757 - protein, 18 aa, Plasmodium falciparum
KMDKNMCKNMNKNTNKTH

SEQ ID NO: 3265758 - protein, 18 aa, Plasmodium falciparum
KMDYIITLFILFKNGSRL

SEQ ID NO: 3265759 - protein, 21 aa, Plasmodium falciparum
KMEEWDIHKGDFLEICVQEFN

SEQ ID NO: 3265760 - protein, 17 aa, Plasmodium falciparum
KMEICSFNKMDNTYTLR

SEQ ID NO: 3265761 - protein, 25 aa, Plasmodium falciparum
KMEKDCLRCTYGLGTLAPTVGLIGS

SEQ ID NO: 3265762 - protein, 26 aa, Plasmodium falciparum
KMENIKFLTSRAAMWYQVEKNDDPDY

SEQ ID NO: 3265763 - protein, 21 aa, Plasmodium falciparum
KMESIPPFYLYENTVSEYQEY

SEQ ID NO: 3265764 - protein, 17 aa, Plasmodium falciparum
KMFAYSVDGTRLFVPEP

SEQ ID NO: 3265765 - protein, 19 aa, Plasmodium falciparum
KMFKIKKKYIYGSSVNNNE

SEQ ID NO: 3265766 - protein, 21 aa, Plasmodium falciparum
KMFLEKCLNLYYLLLSNIKLK

SEQ ID NO: 3265767 - protein, 17 aa, Plasmodium falciparum
KMFLEKFGLNYLTTSEG

SEQ ID NO: 3265768 - protein, 24 aa, Plasmodium falciparum
KMFLSQIYLYISLYNIMHADKELS

SEQ ID NO: 3265769 - protein, 20 aa, Plasmodium falciparum
KMFQDFVCRDCYKQCRKYKK

SEQ ID NO: 3265770 - protein, 19 aa, Plasmodium falciparum
KMGEDFSINMIIIGSRKHL

SEQ ID NO: 3265771 - protein, 19 aa, Plasmodium falciparum
KMIDVFKNICIHLDNTKIA

SEQ ID NO: 3265772 - protein, 25 aa, Plasmodium falciparum
KMIIFKLLFKQSVILVDRFSVCKYP

SEQ ID NO: 3265773 - protein, 17 aa, Plasmodium falciparum
KMIKYKVFYYLYDMSMS

SEQ ID NO: 3265774 - protein, 18 aa, Plasmodium falciparum
KMIRAEYHTYKYIKDNNM

SEQ ID NO: 3265775 - protein, 23 aa, Plasmodium falciparum
KMKEIKWDPKFVNNFKTLQVQKY

SEQ ID NO: 3265776 - protein, 26 aa, Plasmodium falciparum
KMKGKICSSYVKYICLTICVIGMLCI

SEQ ID NO: 3265777 - protein, 25 aa, Plasmodium falciparum
KMKHFRLFFFSSIIIFKYYDKKIIH

SEQ ID NO: 3265778 - protein, 25 aa, Plasmodium falciparum
KMKIFRKEELCLLKQYDKKKFTPID

SEQ ID NO: 3265779 - protein, 28 aa, Plasmodium falciparum
KMKKEGFKYIPTNNICFLLHIRDHIKIS

SEQ ID NO: 3265780 - protein, 23 aa, Plasmodium falciparum
KMKKKIFGLLLFIKVLRIIPPYW

SEQ ID NO: 3265781 - protein, 25 aa, Plasmodium falciparum
KMKKNYFKRSLVYEQLKQCGSNEMI

SEQ ID NO: 3265782 - protein, 35 aa, Plasmodium falciparum
KMKNFFIFILYNLMKLCLDERIEVRNCSIKTIMSI

SEQ ID NO: 3265783 - protein, 19 aa, Plasmodium falciparum
KMKNMACEYIYKIYLIYKT

SEQ ID NO: 3265784 - protein, 22 aa, Plasmodium falciparum
KMKRILSDLSCVYIIILYIYFP

SEQ ID NO: 3265785 - protein, 17 aa, Plasmodium falciparum
KMKRNKYIYIFCNIIEN

SEQ ID NO: 3265786 - protein, 21 aa, Plasmodium falciparum
KMKSRMFKGKYMGKEVAIKIL

SEQ ID NO: 3265787 - protein, 43 aa, Plasmodium falciparum
KMLEITNKLIGKKYRGICYDPTRNGWSTFVYKDGVRYKKFFSS

SEQ ID NO: 3265788 - protein, 19 aa, Plasmodium falciparum
KMLLCGMENNLPAETNITI

SEQ ID NO: 3265789 - protein, 25 aa, Plasmodium falciparum
KMLTLIPWIIFQLFFIKNHMKKIIQ

SEQ ID NO: 3265790 - protein, 19 aa, Plasmodium falciparum
KMNASLLVHYFACAAYYIK

SEQ ID NO: 3265791 - protein, 24 aa, Plasmodium falciparum
KMNDCLYHTYHIIGIKKISSIGYI

SEQ ID NO: 3265792 - protein, 21 aa, Plasmodium falciparum
KMNIREIIIHIKLSTKKRKAH

SEQ ID NO: 3265793 - protein, 23 aa, Plasmodium falciparum
KMNKYARCFLIIQNLLEEQTCAV

SEQ ID NO: 3265794 - protein, 24 aa, Plasmodium falciparum
KMNNEIFLFFVWQRMNNEHVEEKE

SEQ ID NO: 3265795 - protein, 28 aa, Plasmodium falciparum
KMNYLYGEGECVIFFYKNISTVCCIKGQ

SEQ ID NO: 3265796 - protein, 28 aa, Plasmodium falciparum
KMQLNRWKYKNIKGIIVILPEIFYNYIN

SEQ ID NO: 3265797 - protein, 21 aa, Plasmodium falciparum
KMRLFRMAMNKSFYLFRAISE

SEQ ID NO: 3265798 - protein, 24 aa, Plasmodium falciparum
KMTNLRYGNTFNFICNKYDEVIQH

SEQ ID NO: 3265799 - protein, 20 aa, Plasmodium falciparum
KMTSFCFFIKDNIETNNKDS

SEQ ID NO: 3265800 - protein, 23 aa, Plasmodium falciparum
KMVHLILRLIFYATHKSLNTMER

SEQ ID NO: 3265801 - protein, 22 aa, Plasmodium falciparum
KMVKSFLRKTIQKMKDNENSEE

SEQ ID NO: 3265802 - protein, 21 aa, Plasmodium falciparum
KMWSAHEIFKDVGLHEIQVLF

SEQ ID NO: 3265803 - protein, 18 aa, Plasmodium falciparum
KMWYLYKRGEIIKRKICI

SEQ ID NO: 3265804 - protein, 22 aa, Plasmodium falciparum
KMYPCKNFGGLFNLINPSYLIT

SEQ ID NO: 3265805 - protein, 18 aa, Plasmodium falciparum
KNACIKNAIHIFLNPNYI

SEQ ID NO: 3265806 - protein, 20 aa, Plasmodium falciparum
KNADYRLTLNESLYDQNNIL

SEQ ID NO: 3265807 - protein, 25 aa, Plasmodium falciparum
KNAFFYNLINYFLLVLNYVERNNFD

SEQ ID NO: 3265808 - protein, 20 aa, Plasmodium falciparum
KNAFKKISDYIGFKKCLENR

SEQ ID NO: 3265809 - protein, 27 aa, Plasmodium falciparum
KNAIALIKYLNYCVTTISVIFHIFVSA

SEQ ID NO: 3265810 - protein, 19 aa, Plasmodium falciparum
KNAIKPCGTLQQFESFCGL

SEQ ID NO: 3265811 - protein, 26 aa, Plasmodium falciparum
KNALLNFRNFIMKKKHIDYVKKSFNY

SEQ ID NO: 3265812 - protein, 23 aa, Plasmodium falciparum
KNAQICINYAFAHFISSGDKTTN

SEQ ID NO: 3265813 - protein, 20 aa, Plasmodium falciparum
KNAQNYFSHIFKYMKKGDLF

SEQ ID NO: 3265814 - protein, 18 aa, Plasmodium falciparum
KNASVIVFNIYKYENDDE

SEQ ID NO: 3265815 - protein, 20 aa, Plasmodium falciparum
KNCALRFVMENKKLEMTHYN

SEQ ID NO: 3265816 - protein, 25 aa, Plasmodium falciparum
KNCEILKYEACGIFYKNYLQKKRKI

SEQ ID NO: 3265817 - protein, 17 aa, Plasmodium falciparum
KNCEYYSTLQFLFNNFL

SEQ ID NO: 3265818 - protein, 17 aa, Plasmodium falciparum
KNCGIKFNMETLPNNEQ

SEQ ID NO: 3265819 - protein, 25 aa, Plasmodium falciparum
KNCGKKWSVKKNIFFSNSLKKDHIF

SEQ ID NO: 3265820 - protein, 28 aa, Plasmodium falciparum
KNCIFVEIFNYLRICSKYINIFVDKNLC

SEQ ID NO: 3265821 - protein, 19 aa, Plasmodium falciparum
KNCIIWDVIYIYKTDEVIC

SEQ ID NO: 3265822 - protein, 22 aa, Plasmodium falciparum
KNCIQVCKELYPFLINFPSIPF

SEQ ID NO: 3265823 - protein, 21 aa, Plasmodium falciparum
KNCKEKCKCYSLWIEKINDQW

SEQ ID NO: 3265824 - protein, 24 aa, Plasmodium falciparum
KNCKNKIMLCELIYQSLDYITLNE

SEQ ID NO: 3265825 - protein, 22 aa, Plasmodium falciparum
KNCLACGGMLSGGIAPTVGLIG

SEQ ID NO: 3265826 - protein, 18 aa, Plasmodium falciparum
KNCLLREDLSNIIRKGPV

SEQ ID NO: 3265827 - protein, 25 aa, Plasmodium falciparum
KNCLSHKYILFKWIDEDVFFYQGNN

SEQ ID NO: 3265828 - protein, 19 aa, Plasmodium falciparum
KNCNSPCYSFYDNYSEGRD

SEQ ID NO: 3265829 - protein, 19 aa, Plasmodium falciparum
KNDFLKNDIKCFCNNSKNK

SEQ ID NO: 3265830 - protein, 17 aa, Plasmodium falciparum
KNDICIENIPIIHFENY

SEQ ID NO: 3265831 - protein, 23 aa, Plasmodium falciparum
KNDIFKKLTSSFMLKENEEKDNF

SEQ ID NO: 3265832 - protein, 20 aa, Plasmodium falciparum
KNDIHLLLFLYTQRIQNCCD

SEQ ID NO: 3265833 - protein, 26 aa, Plasmodium falciparum
KNDIICKHYCKIYHRGDYILKQINDN

SEQ ID NO: 3265834 - protein, 20 aa, Plasmodium falciparum
KNDILDEINIKLVHVPHEKK

SEQ ID NO: 3265835 - protein, 24 aa, Plasmodium falciparum
KNDIRLHLFASVIIEDNYIHRNKY

SEQ ID NO: 3265836 - protein, 21 aa, Plasmodium falciparum
KNDKEGICRAIRYSFADIGDI

SEQ ID NO: 3265837 - protein, 30 aa, Plasmodium falciparum
KNDKFWLCPSCSNIDISKHVQRGCYNQNEI

SEQ ID NO: 3265838 - protein, 23 aa, Plasmodium falciparum
KNDKKSIPLCFSDDEEAKEINDK

SEQ ID NO: 3265839 - protein, 25 aa, Plasmodium falciparum
KNDKRFKIGTEWSYGEHEKKRTHPE

SEQ ID NO: 3265840 - protein, 24 aa, Plasmodium falciparum
KNDKRYKNFFFFKTATICDTIKNE

SEQ ID NO: 3265841 - protein, 25 aa, Plasmodium falciparum
KNDKYLLCISKRYIHIYKINKYPIK

SEQ ID NO: 3265842 - protein, 18 aa, Plasmodium falciparum
KNDLIEWNNSGVKNKEND

SEQ ID NO: 3265843 - protein, 25 aa, Plasmodium falciparum
KNDMKLKILIIWWLEKCGIENPEEL

SEQ ID NO: 3265844 - protein, 20 aa, Plasmodium falciparum
KNDNTFFIVVYWKEEDDEDE

SEQ ID NO: 3265845 - protein, 26 aa, Plasmodium falciparum
KNDSLYMRLQNIISFSSGHNNTKIKV

SEQ ID NO: 3265846 - protein, 19 aa, Plasmodium falciparum
KNDTVWCPSNIPQPRNHLF

SEQ ID NO: 3265847 - protein, 26 aa, Plasmodium falciparum
KNDYSIFFLHLYKITSLNYKYICTKN

SEQ ID NO: 3265848 - protein, 18 aa, Plasmodium falciparum
KNEACYDFYNKVIPNSLL

SEQ ID NO: 3265849 - protein, 24 aa, Plasmodium falciparum
KNECLKKGIIMFLSFAVFGIIPLS

SEQ ID NO: 3265850 - protein, 20 aa, Plasmodium falciparum
KNEDAIDCMLDKLGKKAEKC

SEQ ID NO: 3265851 - protein, 21 aa, Plasmodium falciparum
KNEDPKCLLALRQQIIELILA

SEQ ID NO: 3265852 - protein, 19 aa, Plasmodium falciparum
KNEEFKFNIFIFYYNNIDS

SEQ ID NO: 3265853 - protein, 18 aa, Plasmodium falciparum
KNEEIWKLNKFIENLNKE

SEQ ID NO: 3265854 - protein, 20 aa, Plasmodium falciparum
KNEEPVICKDGNINIKSALL

SEQ ID NO: 3265855 - protein, 20 aa, Plasmodium falciparum
KNEEQCLVGGKTDFDNLLIV

SEQ ID NO: 3265856 - protein, 24 aa, Plasmodium falciparum
KNEFEIIDLIKLNVPYYDRYNMNN

SEQ ID NO: 3265857 - protein, 19 aa, Plasmodium falciparum
KNEFFTSTDSILFYIEKNE

SEQ ID NO: 3265858 - protein, 18 aa, Plasmodium falciparum
KNEFIPIIEECLKNNLNI

SEQ ID NO: 3265859 - protein, 18 aa, Plasmodium falciparum
KNEIKMKIKRKIEDSKVT

SEQ ID NO: 3265860 - protein, 23 aa, Plasmodium falciparum
KNEIKQFLNRLFVNKKKKKKKSI

SEQ ID NO: 3265861 - protein, 26 aa, Plasmodium falciparum
KNEKDVIILLLWKSFLNSFVLLEKMN

SEQ ID NO: 3265862 - protein, 25 aa, Plasmodium falciparum
KNEKGLEEWNVYNIFQLYMKYILNE

SEQ ID NO: 3265863 - protein, 24 aa, Plasmodium falciparum
KNEKKVIICFYQLTIKNLNSVVQL

SEQ ID NO: 3265864 - protein, 25 aa, Plasmodium falciparum
KNEKLFPNFHIMKFNLVCNIVSSFF

SEQ ID NO: 3265865 - protein, 18 aa, Plasmodium falciparum
KNELCILYKGYFYVNFIF

SEQ ID NO: 3265866 - protein, 17 aa, Plasmodium falciparum
KNELFKHLVDIGRSNIK

SEQ ID NO: 3265867 - protein, 21 aa, Plasmodium falciparum
KNELRYFFHIIKNMMKKNIHN

SEQ ID NO: 3265868 - protein, 24 aa, Plasmodium falciparum
KNEMFPIYIPMYIFNNFYQTHFFL

SEQ ID NO: 3265869 - protein, 20 aa, Plasmodium falciparum
KNENCLLSLGPNDGITNDTI

SEQ ID NO: 3265870 - protein, 17 aa, Plasmodium falciparum
KNENFDVQKKYSLTSKN

SEQ ID NO: 3265871 - protein, 24 aa, Plasmodium falciparum
KNENRFFFDIIIDILKYMKYEKCL

SEQ ID NO: 3265872 - protein, 20 aa, Plasmodium falciparum
KNEPCYIFRIDMPNLNVEPD

SEQ ID NO: 3265873 - protein, 23 aa, Plasmodium falciparum
KNERRIPAYILNKLTIKAKHFQH

SEQ ID NO: 3265874 - protein, 17 aa, Plasmodium falciparum
KNEVCIKHLPYVIIGIM

SEQ ID NO: 3265875 - protein, 20 aa, Plasmodium falciparum
KNEVEYSAYFISRQWSEEYI

SEQ ID NO: 3265876 - protein, 26 aa, Plasmodium falciparum
KNEYISRCNFIYINVLLLSLFEYNLF

SEQ ID NO: 3265877 - protein, 23 aa, Plasmodium falciparum
KNEYKFGKILGCGSFGVVRECIN

SEQ ID NO: 3265878 - protein, 24 aa, Plasmodium falciparum
KNFANKLCFYFSYKKIRKENKYIY

SEQ ID NO: 3265879 - protein, 22 aa, Plasmodium falciparum
KNFDILKNIIFLGLNKVLEKKE

SEQ ID NO: 3265880 - protein, 17 aa, Plasmodium falciparum
KNFERRKSFVLNDSAES

SEQ ID NO: 3265881 - protein, 25 aa, Plasmodium falciparum
KNFEYFFDKDICKYIKNVCLLAIYI

SEQ ID NO: 3265882 - protein, 22 aa, Plasmodium falciparum
KNFFFIIDIVNLFKNIQTLSYL

SEQ ID NO: 3265883 - protein, 17 aa, Plasmodium falciparum
KNFFIKILNIIKIKEKV

SEQ ID NO: 3265884 - protein, 28 aa, Plasmodium falciparum
KNFHYLYKWKIAVSILLILSITFFLIGS

SEQ ID NO: 3265885 - protein, 18 aa, Plasmodium falciparum
KNFIKIITIISILCNITI

SEQ ID NO: 3265886 - protein, 24 aa, Plasmodium falciparum
KNFIKNNYKIMCFQPTKISYKDFL

SEQ ID NO: 3265887 - protein, 17 aa, Plasmodium falciparum
KNFIYLVHIFNEWKNYT

SEQ ID NO: 3265888 - protein, 17 aa, Plasmodium falciparum
KNFKELYNFILSHNYDN

SEQ ID NO: 3265889 - protein, 18 aa, Plasmodium falciparum
KNFKSHISLDNFLTLIYK

SEQ ID NO: 3265890 - protein, 26 aa, Plasmodium falciparum
KNFKSICIYCGKKYYFFEQYIQKKFY

SEQ ID NO: 3265891 - protein, 17 aa, Plasmodium falciparum
KNFLENFNFPLDELVLQ

SEQ ID NO: 3265892 - protein, 18 aa, Plasmodium falciparum
KNFLKGFFSDEEINNIEN

SEQ ID NO: 3265893 - protein, 17 aa, Plasmodium falciparum
KNFLLEYSVESSRRKQR

SEQ ID NO: 3265894 - protein, 25 aa, Plasmodium falciparum
KNFLPSFNLLKLIILCDKKKEKIEN

SEQ ID NO: 3265895 - protein, 19 aa, Plasmodium falciparum
KNFMKWYNYWVKTVLFNYY

SEQ ID NO: 3265896 - protein, 21 aa, Plasmodium falciparum
KNFQLQLLIKYIMNFIYTDLA

SEQ ID NO: 3265897 - protein, 28 aa, Plasmodium falciparum
KNFSLTEICLAFFLLLSFLYTCLTVLYV

SEQ ID NO: 3265898 - protein, 23 aa, Plasmodium falciparum
KNFVKKFVYPFICGCLSSTITTF

SEQ ID NO: 3265899 - protein, 19 aa, Plasmodium falciparum
KNFVPVVLYILLIIYINLN

SEQ ID NO: 3265900 - protein, 17 aa, Plasmodium falciparum
KNFYDIAIYLGYKDEKG

SEQ ID NO: 3265901 - protein, 18 aa, Plasmodium falciparum
KNFYHLLIYNKYYNNNNK

SEQ ID NO: 3265902 - protein, 31 aa, Plasmodium falciparum
KNFYLEKQKIIWKRWIARYVKHIDDYIIEIW

SEQ ID NO: 3265903 - protein, 25 aa, Plasmodium falciparum
KNGCNKKCECYERWVDKKKGEWKNI

SEQ ID NO: 3265904 - protein, 25 aa, Plasmodium falciparum
KNGCNKNCKCYESWVEEKKKEWGEI

SEQ ID NO: 3265905 - protein, 19 aa, Plasmodium falciparum
KNGEGSTCIKGCEIKCNCV

SEQ ID NO: 3265906 - protein, 25 aa, Plasmodium falciparum
KNGELSFIFNRGCKSITNLLNVMVF

SEQ ID NO: 3265907 - protein, 19 aa, Plasmodium falciparum
KNGFYVIALAFKIISNMKH

SEQ ID NO: 3265908 - protein, 20 aa, Plasmodium falciparum
KNGKCKSSLNRKCQGNITVD

SEQ ID NO: 3265909 - protein, 27 aa, Plasmodium falciparum
KNGKFCFPIVINTFGWIKNIGLFLLNL

SEQ ID NO: 3265910 - protein, 18 aa, Plasmodium falciparum
KNGKFRVHREKAINEKEK

SEQ ID NO: 3265911 - protein, 20 aa, Plasmodium falciparum
KNGLPSLEFIIDYIVEKKII

SEQ ID NO: 3265912 - protein, 26 aa, Plasmodium falciparum
KNGMLYLLCDDIYISSIYLYNNTSQI

SEQ ID NO: 3265913 - protein, 17 aa, Plasmodium falciparum
KNGNYIKLREDWWTANR

SEQ ID NO: 3265914 - protein, 18 aa, Plasmodium falciparum
KNGNYIKLREDWWTANRD

SEQ ID NO: 3265915 - protein, 20 aa, Plasmodium falciparum
KNGPDWKCGDLTLVDDTKVC

SEQ ID NO: 3265916 - protein, 19 aa, Plasmodium falciparum
KNHCLKEINFLINKLKSSL

SEQ ID NO: 3265917 - protein, 17 aa, Plasmodium falciparum
KNHEFYINFLIEAILIP

SEQ ID NO: 3265918 - protein, 18 aa, Plasmodium falciparum
KNHIEFRDISVQWSDKQS

SEQ ID NO: 3265919 - protein, 17 aa, Plasmodium falciparum
KNHILLFKWLRCYEPIY

SEQ ID NO: 3265920 - protein, 20 aa, Plasmodium falciparum
KNHKLSCLQSIDILCIYEKL

SEQ ID NO: 3265921 - protein, 21 aa, Plasmodium falciparum
KNHLIKLLLVLSQCINNQDIS

SEQ ID NO: 3265922 - protein, 18 aa, Plasmodium falciparum
KNHLKNDFLNSFRKNLQI

SEQ ID NO: 3265923 - protein, 17 aa, Plasmodium falciparum
KNICALTNASLLKSSDN

SEQ ID NO: 3265924 - protein, 35 aa, Plasmodium falciparum
KNICDKCKFIKIKNFCALLFFNILFIMKRIFYNYY

SEQ ID NO: 3265925 - protein, 17 aa, Plasmodium falciparum
KNICGKKHLGLKSEYGQ

SEQ ID NO: 3265926 - protein, 24 aa, Plasmodium falciparum
KNICSYKKKQKCVKKINTNERYKQ

SEQ ID NO: 3265927 - protein, 21 aa, Plasmodium falciparum
KNIFFFLKIYIDNDINIYILI

SEQ ID NO: 3265928 - protein, 22 aa, Plasmodium falciparum
KNIFLDNMFNFLIYKFLYLLCK

SEQ ID NO: 3265929 - protein, 27 aa, Plasmodium falciparum
KNIHLFNFPVVFIFSSDSKNFNFNHFD

SEQ ID NO: 3265930 - protein, 18 aa, Plasmodium falciparum
KNIHNFSSDIFLYKILER

SEQ ID NO: 3265931 - protein, 18 aa, Plasmodium falciparum
KNIICMYDNIVLPKKESF

SEQ ID NO: 3265932 - protein, 26 aa, Plasmodium falciparum
KNIILLWSCKNIGYIFLNTDNSLHIN

SEQ ID NO: 3265933 - protein, 22 aa, Plasmodium falciparum
KNIITTCVFIFFHIKQFNDIIE

SEQ ID NO: 3265934 - protein, 18 aa, Plasmodium falciparum
KNIIYIEYSNLWKMKCKI

SEQ ID NO: 3265935 - protein, 17 aa, Plasmodium falciparum
KNIKCFDLLFQGFLTEQ

SEQ ID NO: 3265936 - protein, 23 aa, Plasmodium falciparum
KNIKFLPLLGLCTLRVHFKNFKE

SEQ ID NO: 3265937 - protein, 17 aa, Plasmodium falciparum
KNIKIKLNKNITINDTP

SEQ ID NO: 3265938 - protein, 17 aa, Plasmodium falciparum
KNIKLIYENKCPIWNEE

SEQ ID NO: 3265939 - protein, 24 aa, Plasmodium falciparum
KNIKLVCGYISLLLNYSLNKKTNN

SEQ ID NO: 3265940 - protein, 18 aa, Plasmodium falciparum
KNIKRKNSLIFMNNTNDT

SEQ ID NO: 3265941 - protein, 22 aa, Plasmodium falciparum
KNIKTLYNIFSYVEKENTQEND

SEQ ID NO: 3265942 - protein, 30 aa, Plasmodium falciparum
KNIKYLGYRFHTIYKILLLLSQLKSIYYFN

SEQ ID NO: 3265943 - protein, 20 aa, Plasmodium falciparum
KNIKYPGFITLILNLFTAYN

SEQ ID NO: 3265944 - protein, 17 aa, Plasmodium falciparum
KNILAFKKIKEELYKMN

SEQ ID NO: 3265945 - protein, 34 aa, Plasmodium falciparum
KNILFRTIFDILFLFFINKIRVEVLIHFLSMIYT

SEQ ID NO: 3265946 - protein, 18 aa, Plasmodium falciparum
KNILHSFEILNIAFDKCY

SEQ ID NO: 3265947 - protein, 22 aa, Plasmodium falciparum
KNILKKFGKSYWFNIKELQIQK

SEQ ID NO: 3265948 - protein, 38 aa, Plasmodium falciparum
KNILKKKYYLKFSYLFSIYFSLHMKFFLQYKLGEQQNR

SEQ ID NO: 3265949 - protein, 18 aa, Plasmodium falciparum
KNILLFYNIMEHIYKFIL

SEQ ID NO: 3265950 - protein, 18 aa, Plasmodium falciparum
KNILLSKWLTNYIYFLIF

SEQ ID NO: 3265951 - protein, 21 aa, Plasmodium falciparum
KNILRINKFFDIHYSINNTAL

SEQ ID NO: 3265952 - protein, 21 aa, Plasmodium falciparum
KNILSILLIHIEKPVTRKSNR

SEQ ID NO: 3265953 - protein, 18 aa, Plasmodium falciparum
KNILTYLFDMFDIDKDKK

SEQ ID NO: 3265954 - protein, 19 aa, Plasmodium falciparum
KNILYRFIDKIIYVLEKIS

SEQ ID NO: 3265955 - protein, 17 aa, Plasmodium falciparum
KNIMLEYDILLHIPFSS

SEQ ID NO: 3265956 - protein, 19 aa, Plasmodium falciparum
KNIMNSFVLFFKDYIYYMN

SEQ ID NO: 3265957 - protein, 22 aa, Plasmodium falciparum
KNIMYDLWFKVMNNEKMKYYSL

SEQ ID NO: 3265958 - protein, 17 aa, Plasmodium falciparum
KNINHLFEMLIFNINNK

SEQ ID NO: 3265959 - protein, 22 aa, Plasmodium falciparum
KNINILLALSLYFLNFNINNNC

SEQ ID NO: 3265960 - protein, 17 aa, Plasmodium falciparum
KNINLLLGELIKQKYPL

SEQ ID NO: 3265961 - protein, 17 aa, Plasmodium falciparum
KNIPCLVPQGIDQDPYF

SEQ ID NO: 3265962 - protein, 20 aa, Plasmodium falciparum
KNIPEPVLINYWRNNGARYW

SEQ ID NO: 3265963 - protein, 25 aa, Plasmodium falciparum
KNIPIKFIKCFKYIFEHTRNENIFD

SEQ ID NO: 3265964 - protein, 30 aa, Plasmodium falciparum
KNIPLFAILNCDILYLKGKIQSYLYDKLGR

SEQ ID NO: 3265965 - protein, 21 aa, Plasmodium falciparum
KNIPSFLKFNTFHMEPNSYNN

SEQ ID NO: 3265966 - protein, 17 aa, Plasmodium falciparum
KNIRCYYNHTMGIDEHN

SEQ ID NO: 3265967 - protein, 17 aa, Plasmodium falciparum
KNIRGLENLKECSSDTC

SEQ ID NO: 3265968 - protein, 22 aa, Plasmodium falciparum
KNIRYFYIKNLKLIEKNFNIND

SEQ ID NO: 3265969 - protein, 22 aa, Plasmodium falciparum
KNISDLDCRDCYKQCRKYRKWI

SEQ ID NO: 3265970 - protein, 18 aa, Plasmodium falciparum
KNISFKFLIDDILVELNK

SEQ ID NO: 3265971 - protein, 26 aa, Plasmodium falciparum
KNISLKYVFFPICFFGYEKKLKVVVH

SEQ ID NO: 3265972 - protein, 17 aa, Plasmodium falciparum
KNISNILSHVFFYIFSC

SEQ ID NO: 3265973 - protein, 21 aa, Plasmodium falciparum
KNISYSLYFLIFINLLTQLWE

SEQ ID NO: 3265974 - protein, 22 aa, Plasmodium falciparum
KNITGRFLVRMIWWIDSGEDYS

SEQ ID NO: 3265975 - protein, 31 aa, Plasmodium falciparum
KNITSLELFCFLNFTLATSILLIIDTDIILE

SEQ ID NO: 3265976 - protein, 22 aa, Plasmodium falciparum
KNITSLGIILSFINIFNETISQ

SEQ ID NO: 3265977 - protein, 26 aa, Plasmodium falciparum
KNIVKRSGPFEIWRKKFIEEVSKKIS

SEQ ID NO: 3265978 - protein, 17 aa, Plasmodium falciparum
KNIWAWHNTCMVLYLGN

SEQ ID NO: 3265979 - protein, 22 aa, Plasmodium falciparum
KNIYDISKFVIFYGNCMLKKSK

SEQ ID NO: 3265980 - protein, 27 aa, Plasmodium falciparum
KNIYFKDELKYVLNYFVEPSLITIVTR

SEQ ID NO: 3265981 - protein, 25 aa, Plasmodium falciparum
KNIYIPLPVLIIAYISVILKVVDKK

SEQ ID NO: 3265982 - protein, 25 aa, Plasmodium falciparum
KNIYLKIFNFFELLLLPSKLIRLEI

SEQ ID NO: 3265983 - protein, 22 aa, Plasmodium falciparum
KNIYLSPHFYFFRNIFISHKFQ

SEQ ID NO: 3265984 - protein, 17 aa, Plasmodium falciparum
KNIYRICTKEVIKNILL

SEQ ID NO: 3265985 - protein, 24 aa, Plasmodium falciparum
KNIYSKLIRRIWSLYMLIISDDYV

SEQ ID NO: 3265986 - protein, 20 aa, Plasmodium falciparum
KNIYSYAVSLEICSKQKAYF

SEQ ID NO: 3265987 - protein, 26 aa, Plasmodium falciparum
KNIYTKRFYCIPIYIKKNNILIRPNF

SEQ ID NO: 3265988 - protein, 19 aa, Plasmodium falciparum
KNIYYKKYLLVLYFFLMIS

SEQ ID NO: 3265989 - protein, 23 aa, Plasmodium falciparum
KNIYYKNLHFVISLHNSSIIDFK

SEQ ID NO: 3265990 - protein, 25 aa, Plasmodium falciparum
KNKCDLYPLQICDIYIKIYNKIVSI

SEQ ID NO: 3265991 - protein, 21 aa, Plasmodium falciparum
KNKDLNIIWLVNKVDCLPKST

SEQ ID NO: 3265992 - protein, 29 aa, Plasmodium falciparum
KNKEIVYIFAVNFFFLFVLVMDIFPFLNY

SEQ ID NO: 3265993 - protein, 20 aa, Plasmodium falciparum
KNKEKIWYVMMCYYTGEHKT

SEQ ID NO: 3265994 - protein, 28 aa, Plasmodium falciparum
KNKEKKKKKCVIRKIKKRNKVNPKRNNN

SEQ ID NO: 3265995 - protein, 19 aa, Plasmodium falciparum
KNKELKENTVYRIKKKDSF

SEQ ID NO: 3265996 - protein, 20 aa, Plasmodium falciparum
KNKFDLIFYFNMEKNNFPYE

SEQ ID NO: 3265997 - protein, 19 aa, Plasmodium falciparum
KNKFFCNNYIFQVYIHTFK

SEQ ID NO: 3265998 - protein, 19 aa, Plasmodium falciparum
KNKFFSIIRKNGCEKSIKI

SEQ ID NO: 3265999 - protein, 25 aa, Plasmodium falciparum
KNKFIFICLIAVGGFSCVYKIKKKE

SEQ ID NO: 3266000 - protein, 24 aa, Plasmodium falciparum
KNKFYTFMYHIFYKYKPKNQGGNI

SEQ ID NO: 3266001 - protein, 21 aa, Plasmodium falciparum
KNKGIMFYSDMNDFPFLANNQ

SEQ ID NO: 3266002 - protein, 18 aa, Plasmodium falciparum
KNKGRLYISNNGLCNDKL

SEQ ID NO: 3266003 - protein, 25 aa, Plasmodium falciparum
KNKHFRKCLEIELINTEKKNIENEM

SEQ ID NO: 3266004 - protein, 18 aa, Plasmodium falciparum
KNKIDDIIYVESKRSISS

SEQ ID NO: 3266005 - protein, 25 aa, Plasmodium falciparum
KNKIDILNMQYNHFFVHRCKNEGKC

SEQ ID NO: 3266006 - protein, 24 aa, Plasmodium falciparum
KNKIFCKRCMKKISRSIDMFKTNF

SEQ ID NO: 3266007 - protein, 19 aa, Plasmodium falciparum
KNKIFRYSKRRLFHENVYK

SEQ ID NO: 3266008 - protein, 19 aa, Plasmodium falciparum
KNKIINIVNYFLFNSFMKN

SEQ ID NO: 3266009 - protein, 19 aa, Plasmodium falciparum
KNKIIPYLFLNSSFLLNTL

SEQ ID NO: 3266010 - protein, 18 aa, Plasmodium falciparum
KNKIIYHYCFYLLCIQKD

SEQ ID NO: 3266011 - protein, 20 aa, Plasmodium falciparum
KNKIKDIFIDIRIITLEYFY

SEQ ID NO: 3266012 - protein, 17 aa, Plasmodium falciparum
KNKILGFINFYKHITHK

SEQ ID NO: 3266013 - protein, 19 aa, Plasmodium falciparum
KNKILKKLITSYILSSPSN

SEQ ID NO: 3266014 - protein, 19 aa, Plasmodium falciparum
KNKILLFNKYIIKLRNDLK

SEQ ID NO: 3266015 - protein, 25 aa, Plasmodium falciparum
KNKINNICSINFCRNQLRYILLLYV

SEQ ID NO: 3266016 - protein, 27 aa, Plasmodium falciparum
KNKIRKILLCLYFELLFLKICNNKNLF

SEQ ID NO: 3266017 - protein, 26 aa, Plasmodium falciparum
KNKIRYCTKCFLWLHIFPCNNKLFNY

SEQ ID NO: 3266018 - protein, 20 aa, Plasmodium falciparum
KNKIYDIGRNILLKLKDEKL

SEQ ID NO: 3266019 - protein, 24 aa, Plasmodium falciparum
KNKKFKHNFIYLKNLFKENICINT

SEQ ID NO: 3266020 - protein, 29 aa, Plasmodium falciparum
KNKKIMLLKVCLSNIISINKLLYFITRPE

SEQ ID NO: 3266021 - protein, 18 aa, Plasmodium falciparum
KNKKISFFMWIINNKKLS

SEQ ID NO: 3266022 - protein, 23 aa, Plasmodium falciparum
KNKKLKFVKLFLIQTAIEAFRYA

SEQ ID NO: 3266023 - protein, 19 aa, Plasmodium falciparum
KNKKNFLLHTSMYKQFSRT

SEQ ID NO: 3266024 - protein, 24 aa, Plasmodium falciparum
KNKKRYILFYIYFLIYKFMKLKGL

SEQ ID NO: 3266025 - protein, 18 aa, Plasmodium falciparum
KNKKSVCDINNNKSNDNN

SEQ ID NO: 3266026 - protein, 26 aa, Plasmodium falciparum
KNKKYRRCINYIPSVEHSDITYKKFI

SEQ ID NO: 3266027 - protein, 17 aa, Plasmodium falciparum
KNKLCNIYINLDHNNLK

SEQ ID NO: 3266028 - protein, 19 aa, Plasmodium falciparum
KNKLDLFFYIAILRLTPIF

SEQ ID NO: 3266029 - protein, 18 aa, Plasmodium falciparum
KNKLRSVYNSYKYVESTN

SEQ ID NO: 3266030 - protein, 20 aa, Plasmodium falciparum
KNKLRYILDNIIIISIILSF

SEQ ID NO: 3266031 - protein, 38 aa, Plasmodium falciparum
KNKLSFLLLVTIHFKNKICLFIALSILFYVGDMLNESK

SEQ ID NO: 3266032 - protein, 24 aa, Plasmodium falciparum
KNKMIELFHVMFLNNKKYILISTK

SEQ ID NO: 3266033 - protein, 27 aa, Plasmodium falciparum
KNKMKLINKVECAISFASNISGTILYL

SEQ ID NO: 3266034 - protein, 19 aa, Plasmodium falciparum
KNKMKNCIYYNEFKSNHNN

SEQ ID NO: 3266035 - protein, 23 aa, Plasmodium falciparum
KNKMMDMNFLFDKRKQTQNGNNN

SEQ ID NO: 3266036 - protein, 18 aa, Plasmodium falciparum
KNKMVFIFFINEILLKRL

SEQ ID NO: 3266037 - protein, 25 aa, Plasmodium falciparum
KNKNCLKILDFLTIYLPEISNSPLK

SEQ ID NO: 3266038 - protein, 17 aa, Plasmodium falciparum
KNKNICDIYSFKENYKH

SEQ ID NO: 3266039 - protein, 23 aa, Plasmodium falciparum
KNKNILIPFSFLFHNINCSYFIK

SEQ ID NO: 3266040 - protein, 24 aa, Plasmodium falciparum
KNKNISFFVSLLIIATSVVLFIFT

SEQ ID NO: 3266041 - protein, 21 aa, Plasmodium falciparum
KNKNMCLIPIIDVCNHSSLSN

SEQ ID NO: 3266042 - protein, 26 aa, Plasmodium falciparum
KNKPCQLRIFLLKSYIENNTFNISQF

SEQ ID NO: 3266043 - protein, 22 aa, Plasmodium falciparum
KNKPNIKSICGRRLHRSLYEYQ

SEQ ID NO: 3266044 - protein, 18 aa, Plasmodium falciparum
KNKPSEFVKNICQHLTTL

SEQ ID NO: 3266045 - protein, 17 aa, Plasmodium falciparum
KNKRKRKYIKYNTKGNT

SEQ ID NO: 3266046 - protein, 17 aa, Plasmodium falciparum
KNKRMFHIPPYIKHDNM

SEQ ID NO: 3266047 - protein, 26 aa, Plasmodium falciparum
KNKSEKRINRKKCDKKDCLKDDENIS

SEQ ID NO: 3266048 - protein, 17 aa, Plasmodium falciparum
KNKSNSNYSMWEKGTKK

SEQ ID NO: 3266049 - protein, 24 aa, Plasmodium falciparum
KNKTCKHKNRYILSYFKNDKIDKM

SEQ ID NO: 3266050 - protein, 20 aa, Plasmodium falciparum
KNKYKYFLNKKMLKIPVSKH

SEQ ID NO: 3266051 - protein, 19 aa, Plasmodium falciparum
KNKYVSLIYKHLLNDRDNE

SEQ ID NO: 3266052 - protein, 31 aa, Plasmodium falciparum
KNKYYYYDFMLIFLKTFYDYINVNRDMREIM

SEQ ID NO: 3266053 - protein, 21 aa, Plasmodium falciparum
KNLEERKLYMGKLYDKNNDII

SEQ ID NO: 3266054 - protein, 30 aa, Plasmodium falciparum
KNLEILRMSLKCLECYHNIESKIIQDKKKN

SEQ ID NO: 3266055 - protein, 19 aa, Plasmodium falciparum
KNLESFIKFLQQLMTLEKN

SEQ ID NO: 3266056 - protein, 28 aa, Plasmodium falciparum
KNLFKNVNFYLSSFVTYSFLNTYNEDNN

SEQ ID NO: 3266057 - protein, 17 aa, Plasmodium falciparum
KNLFKSNTFFINNLYYH

SEQ ID NO: 3266058 - protein, 22 aa, Plasmodium falciparum
KNLFYGILCKYHYMYEGRRKEI

SEQ ID NO: 3266059 - protein, 17 aa, Plasmodium falciparum
KNLHIYGNMKKYKSLND

SEQ ID NO: 3266060 - protein, 22 aa, Plasmodium falciparum
KNLIKSFRIVLLLKSLIKENRW

SEQ ID NO: 3266061 - protein, 18 aa, Plasmodium falciparum
KNLIKYNTLMDIPVELLK

SEQ ID NO: 3266062 - protein, 31 aa, Plasmodium falciparum
KNLIYFLDDIGCFDIKFILDKRIFNNTYEDI

SEQ ID NO: 3266063 - protein, 17 aa, Plasmodium falciparum
KNLKEKNKIILFIEKQM

SEQ ID NO: 3266064 - protein, 20 aa, Plasmodium falciparum
KNLKKIFGIIYEGLTKANGK

SEQ ID NO: 3266065 - protein, 17 aa, Plasmodium falciparum
KNLKKKRPHIIITTPGY

SEQ ID NO: 3266066 - protein, 21 aa, Plasmodium falciparum
KNLKKRLSILRTTKCIKKINS

SEQ ID NO: 3266067 - protein, 26 aa, Plasmodium falciparum
KNLKRELLDGIYMFQLFISYKNFFWK

SEQ ID NO: 3266068 - protein, 17 aa, Plasmodium falciparum
KNLLELLNVKEEDFINE

SEQ ID NO: 3266069 - protein, 31 aa, Plasmodium falciparum
KNLLFLFSSIMKIKFLYNLIIIKQKNIKNVS

SEQ ID NO: 3266070 - protein, 18 aa, Plasmodium falciparum
KNLLKESYKWFKDTDYFV

SEQ ID NO: 3266071 - protein, 27 aa, Plasmodium falciparum
KNLLMIKEHILAIAIYESRILKRKYKN

SEQ ID NO: 3266072 - protein, 24 aa, Plasmodium falciparum
KNLLTKIWFQIHMMILEEYKKDEC

SEQ ID NO: 3266073 - protein, 18 aa, Plasmodium falciparum
KNLNIEPQVGHKIREKNI

SEQ ID NO: 3266074 - protein, 17 aa, Plasmodium falciparum
KNLNLHELCAHPWWFSK

SEQ ID NO: 3266075 - protein, 25 aa, Plasmodium falciparum
KNLPDSHLFFSKLLLTLSQNDDKDK

SEQ ID NO: 3266076 - protein, 18 aa, Plasmodium falciparum
KNLPRVKLKIKRNEEYER

SEQ ID NO: 3266077 - protein, 21 aa, Plasmodium falciparum
KNLRISSCGIISRLLKSNSNY

SEQ ID NO: 3266078 - protein, 17 aa, Plasmodium falciparum
KNLRLNYNLRNNHILLI

SEQ ID NO: 3266079 - protein, 17 aa, Plasmodium falciparum
KNLSNIFTLDIIAKPNI

SEQ ID NO: 3266080 - protein, 31 aa, Plasmodium falciparum
KNLSVHLIFYLKDLTDMLGIDIYYIRKSIFE

SEQ ID NO: 3266081 - protein, 26 aa, Plasmodium falciparum
KNLTYLRHIVNFIQLIFDIHNANYDI

SEQ ID NO: 3266082 - protein, 20 aa, Plasmodium falciparum
KNLYCKKLQSFNWSLIKIIC

SEQ ID NO: 3266083 - protein, 17 aa, Plasmodium falciparum
KNLYKQINLILLIIFII

SEQ ID NO: 3266084 - protein, 17 aa, Plasmodium falciparum
KNLYNKYIINGMGKKIH

SEQ ID NO: 3266085 - protein, 21 aa, Plasmodium falciparum
KNLYVLRRILFFDSNINIYHL

SEQ ID NO: 3266086 - protein, 19 aa, Plasmodium falciparum
KNMALHIFFYKIIDETEHV

SEQ ID NO: 3266087 - protein, 19 aa, Plasmodium falciparum
KNMCQISVCLYDLNKPMPL

SEQ ID NO: 3266088 - protein, 17 aa, Plasmodium falciparum
KNMDLFIFNCIISVAHE

SEQ ID NO: 3266089 - protein, 23 aa, Plasmodium falciparum
KNMFEGAIYFYTLIYKKRKHTYF

SEQ ID NO: 3266090 - protein, 29 aa, Plasmodium falciparum
KNMFHERICQLKFKWPINKDENITEYDFY

SEQ ID NO: 3266091 - protein, 23 aa, Plasmodium falciparum
KNMKCNYILFLLNFVSHIKVRPF

SEQ ID NO: 3266092 - protein, 21 aa, Plasmodium falciparum
KNMKILECLMNEWRREEDEKW

SEQ ID NO: 3266093 - protein, 23 aa, Plasmodium falciparum
KNMKRHLYSTVPFFNLKNKGNKN

SEQ ID NO: 3266094 - protein, 18 aa, Plasmodium falciparum
KNMMPTICKDVVPQEPKA

SEQ ID NO: 3266095 - protein, 18 aa, Plasmodium falciparum
KNMVHYFVHNKKYMCING

SEQ ID NO: 3266096 - protein, 25 aa, Plasmodium falciparum
KNMYPYRYISLISYVLHCIDDYQTR

SEQ ID NO: 3266097 - protein, 20 aa, Plasmodium falciparum
KNNALLCSLYIVILYIICLT

SEQ ID NO: 3266098 - protein, 20 aa, Plasmodium falciparum
KNNCISAFVLLNIKNYKKEL

SEQ ID NO: 3266099 - protein, 24 aa, Plasmodium falciparum
KNNDVYKCMLLVLFNECKFFPKYP

SEQ ID NO: 3266100 - protein, 23 aa, Plasmodium falciparum
KNNEGVIKFIFQNILKNHQVNQY

SEQ ID NO: 3266101 - protein, 19 aa, Plasmodium falciparum
KNNEICLAFVLQKYFKKEK

SEQ ID NO: 3266102 - protein, 25 aa, Plasmodium falciparum
KNNEIFHLKNRVVLLETQLEIKNED

SEQ ID NO: 3266103 - protein, 25 aa, Plasmodium falciparum
KNNESIHTIPYCLLTNLDDLSCDIK

SEQ ID NO: 3266104 - protein, 23 aa, Plasmodium falciparum
KNNETYGCLFIFLNNISYHVKYL

SEQ ID NO: 3266105 - protein, 24 aa, Plasmodium falciparum
KNNEYKRKKMCTVSEAKIIKDTND

SEQ ID NO: 3266106 - protein, 21 aa, Plasmodium falciparum
KNNFKKFYSFQIKLKGIRDSK

SEQ ID NO: 3266107 - protein, 19 aa, Plasmodium falciparum
KNNFLNILFHIWSKNEACY

SEQ ID NO: 3266108 - protein, 30 aa, Plasmodium falciparum
KNNFPFLFKRIQLYISKFFLYIQNDFLSIS

SEQ ID NO: 3266109 - protein, 23 aa, Plasmodium falciparum
KNNFYMNCSDFLFNKKMDKQKIK

SEQ ID NO: 3266110 - protein, 27 aa, Plasmodium falciparum
KNNGSYSIKCGKNFQKNKMNYIHLDKI

SEQ ID NO: 3266111 - protein, 19 aa, Plasmodium falciparum
KNNICFCINNLNGNNSENF

SEQ ID NO: 3266112 - protein, 20 aa, Plasmodium falciparum
KNNICLEIFLKYDNIIDKDV

SEQ ID NO: 3266113 - protein, 31 aa, Plasmodium falciparum
KNNIKKCIHPIFLINLLKWYSIITNSSLSYG

SEQ ID NO: 3266114 - protein, 18 aa, Plasmodium falciparum
KNNIKRLKNYMCKNKNCY

SEQ ID NO: 3266115 - protein, 24 aa, Plasmodium falciparum
KNNILENFLVYTIYFRLYKFKEIK

SEQ ID NO: 3266116 - protein, 28 aa, Plasmodium falciparum
KNNINDIFLFLKILKKFLLFYDTILITR

SEQ ID NO: 3266117 - protein, 20 aa, Plasmodium falciparum
KNNINIIKIIKSWIYSLFCT

SEQ ID NO: 3266118 - protein, 34 aa, Plasmodium falciparum
KNNIRAILEYSFSFSIMNFVGWLYEYFSKLYMGY

SEQ ID NO: 3266119 - protein, 25 aa, Plasmodium falciparum
KNNIYKLFLYFLFFYKNDFNHLILF

SEQ ID NO: 3266120 - protein, 17 aa, Plasmodium falciparum
KNNKKCNSRTISKKEQS

SEQ ID NO: 3266121 - protein, 19 aa, Plasmodium falciparum
KNNKKIFYCSQECFEQNYK

SEQ ID NO: 3266122 - protein, 24 aa, Plasmodium falciparum
KNNKKIYAYICIGDFSNCYEHINH

SEQ ID NO: 3266123 - protein, 20 aa, Plasmodium falciparum
KNNKSLCSFQKNFYDIISIN

SEQ ID NO: 3266124 - protein, 22 aa, Plasmodium falciparum
KNNLGQYTWYIIDRFINSLKNI

SEQ ID NO: 3266125 - protein, 19 aa, Plasmodium falciparum
KNNLLCIESYLDINMKKLF

SEQ ID NO: 3266126 - protein, 32 aa, Plasmodium falciparum
KNNLSSCLLFFFRFYINCLMLLNINIDIDYEY

SEQ ID NO: 3266127 - protein, 20 aa, Plasmodium falciparum
KNNLSYTLFLFLSKELDMEG

SEQ ID NO: 3266128 - protein, 25 aa, Plasmodium falciparum
KNNMKYKIHLSKEMLNLYNPNERKI

SEQ ID NO: 3266129 - protein, 28 aa, Plasmodium falciparum
KNNNIFKIYIKWLYYTLYAHKYLIISLC

SEQ ID NO: 3266130 - protein, 19 aa, Plasmodium falciparum
KNNNIRMGIPKMKNNSNYN

SEQ ID NO: 3266131 - protein, 20 aa, Plasmodium falciparum
KNNNKFYFVKDIYNNMNEGI

SEQ ID NO: 3266132 - protein, 25 aa, Plasmodium falciparum
KNNNRLKHDLSYHMDNNLQRCKNEN

SEQ ID NO: 3266133 - protein, 27 aa, Plasmodium falciparum
KNNPFAFCLGSTWFLLINGGILFSYKY

SEQ ID NO: 3266134 - protein, 34 aa, Plasmodium falciparum
KNNPVFKFRLSKLFILKYIDLYTIVKNKEFTTDC

SEQ ID NO: 3266135 - protein, 30 aa, Plasmodium falciparum
KNNSIKIFFSKECFKHIFVPEPCDHPYERN

SEQ ID NO: 3266136 - protein, 19 aa, Plasmodium falciparum
KNNSLLCMVQLIEKFHKIF

SEQ ID NO: 3266137 - protein, 24 aa, Plasmodium falciparum
KNNSYRMLLSFVIYSWDYLLMLIV

SEQ ID NO: 3266138 - protein, 18 aa, Plasmodium falciparum
KNNVPDFLFLKRNKNIYY

SEQ ID NO: 3266139 - protein, 18 aa, Plasmodium falciparum
KNNYCIYINILKHIFIDV

SEQ ID NO: 3266140 - protein, 27 aa, Plasmodium falciparum
KNNYSICNSVIKECYMQIISNDYFLHL

SEQ ID NO: 3266141 - protein, 24 aa, Plasmodium falciparum
KNPCNYNICFPNIMTNNILSEDAY

SEQ ID NO: 3266142 - protein, 24 aa, Plasmodium falciparum
KNPFKTSRLFKGIRKEQWECKVTN

SEQ ID NO: 3266143 - protein, 22 aa, Plasmodium falciparum
KNPKFSEFLFLKNYILQSTDYS

SEQ ID NO: 3266144 - protein, 18 aa, Plasmodium falciparum
KNPLNCFVYMDVPIGTVM

SEQ ID NO: 3266145 - protein, 19 aa, Plasmodium falciparum
KNPYDFEAIKKLINDDTKK

SEQ ID NO: 3266146 - protein, 21 aa, Plasmodium falciparum
KNPYMNYDIFSIVLNLYSCLC

SEQ ID NO: 3266147 - protein, 17 aa, Plasmodium falciparum
KNQAVIMTNEFCGIFTP

SEQ ID NO: 3266148 - protein, 18 aa, Plasmodium falciparum
KNQIEKIFFCFPDPHFKR

SEQ ID NO: 3266149 - protein, 29 aa, Plasmodium falciparum
KNQIVKILFFLCKILLSIHLEEVKISILW

SEQ ID NO: 3266150 - protein, 25 aa, Plasmodium falciparum
KNQLLKMNYFRSFFKYMKYNREKNF

SEQ ID NO: 3266151 - protein, 26 aa, Plasmodium falciparum
KNQLNRFGSAGVMLFNTKFRNIKLTS

SEQ ID NO: 3266152 - protein, 20 aa, Plasmodium falciparum
KNQLYFLILQMFNYILYLYY

SEQ ID NO: 3266153 - protein, 19 aa, Plasmodium falciparum
KNRICCKQLNNSYINVYCP

SEQ ID NO: 3266154 - protein, 17 aa, Plasmodium falciparum
KNRITHISINNKCIHLV

SEQ ID NO: 3266155 - protein, 20 aa, Plasmodium falciparum
KNRKFLKKKKKSIESLKKLQ

SEQ ID NO: 3266156 - protein, 20 aa, Plasmodium falciparum
KNRLDAKLLYDTKSYRNFFT

SEQ ID NO: 3266157 - protein, 18 aa, Plasmodium falciparum
KNRNVICLNYYNINNLLF

SEQ ID NO: 3266158 - protein, 27 aa, Plasmodium falciparum
KNSCKRPCECFKRWVDQKKKNEWEAIK

SEQ ID NO: 3266159 - protein, 23 aa, Plasmodium falciparum
KNSDIFINTGFLPYSLNKKKNNK

SEQ ID NO: 3266160 - protein, 19 aa, Plasmodium falciparum
KNSDLWGKLLGKYYLYETQ

SEQ ID NO: 3266161 - protein, 20 aa, Plasmodium falciparum
KNSDVTIMFTLRVKESHNVN

SEQ ID NO: 3266162 - protein, 20 aa, Plasmodium falciparum
KNSEQIFIFFNKKFLIKKDY

SEQ ID NO: 3266163 - protein, 19 aa, Plasmodium falciparum
KNSFKKYCTSFFDIYDDRM

SEQ ID NO: 3266164 - protein, 25 aa, Plasmodium falciparum
KNSGKSCPYHHNYSFHNITSDEQNN

SEQ ID NO: 3266165 - protein, 21 aa, Plasmodium falciparum
KNSIFGIPFPNFFDYTDFNLS

SEQ ID NO: 3266166 - protein, 21 aa, Plasmodium falciparum
KNSIFLNLFMQLHEEIRHSLK

SEQ ID NO: 3266167 - protein, 18 aa, Plasmodium falciparum
KNSIRLLYYVGRRLSNYL

SEQ ID NO: 3266168 - protein, 17 aa, Plasmodium falciparum
KNSKFLFLSALIQLNAW

SEQ ID NO: 3266169 - protein, 28 aa, Plasmodium falciparum
KNSKIFRPPNPWTVSILNLLGELHEAQS

SEQ ID NO: 3266170 - protein, 17 aa, Plasmodium falciparum
KNSKRNIKMVSRNKENK

SEQ ID NO: 3266171 - protein, 25 aa, Plasmodium falciparum
KNSLCSSKNKIACLFDIGNDDNRNT

SEQ ID NO: 3266172 - protein, 25 aa, Plasmodium falciparum
KNSLRYCLLNQIYLLLESKNHIFEL

SEQ ID NO: 3266173 - protein, 30 aa, Plasmodium falciparum
KNSNSLFLLYYWKWITHMIHKCSDYVNTVF

SEQ ID NO: 3266174 - protein, 30 aa, Plasmodium falciparum
KNSPYIRGKLKLVYVKSFYEECQKELYEAK

SEQ ID NO: 3266175 - protein, 20 aa, Plasmodium falciparum
KNSRLSERFETYIGQMEIAN

SEQ ID NO: 3266176 - protein, 17 aa, Plasmodium falciparum
KNSSFILSISEIILNSF

SEQ ID NO: 3266177 - protein, 56 aa, Plasmodium falciparum
KNSSLIPMEVTMGSLLCSFLWLTYGFTLKDGFIIIPNLCGFILSLLQVLLIILYSN

SEQ ID NO: 3266178 - protein, 24 aa, Plasmodium falciparum
KNSSNVLCSFIFDLYADFRNERVR

SEQ ID NO: 3266179 - protein, 24 aa, Plasmodium falciparum
KNSSSRNNLNFNYSFEQNQNKNMS

SEQ ID NO: 3266180 - protein, 29 aa, Plasmodium falciparum
KNSYHPKSRHGLYIFLIHLIIVIKKHIQD

SEQ ID NO: 3266181 - protein, 22 aa, Plasmodium falciparum
KNTCLTFSMFLNIDNIMEKYKV

SEQ ID NO: 3266182 - protein, 22 aa, Plasmodium falciparum
KNTDLYIFISILIKNVTLSYHK

SEQ ID NO: 3266183 - protein, 40 aa, Plasmodium falciparum
KNTEKDRAICCIIRYIAFICKNINFFLFNSINTLPSTFMI

SEQ ID NO: 3266184 - protein, 17 aa, Plasmodium falciparum
KNTEMQEIFSISSSSGD

SEQ ID NO: 3266185 - protein, 20 aa, Plasmodium falciparum
KNTFKSIGLLLKYLDIDVYN

SEQ ID NO: 3266186 - protein, 25 aa, Plasmodium falciparum
KNTIVPFKLTLNVYRCLNENMKHFK

SEQ ID NO: 3266187 - protein, 20 aa, Plasmodium falciparum
KNTLFPYLFKMLSISKPLSI

SEQ ID NO: 3266188 - protein, 27 aa, Plasmodium falciparum
KNTLHCIKNIYYREGIRNFYHGLFPSM

SEQ ID NO: 3266189 - protein, 25 aa, Plasmodium falciparum
KNTLKICSVRQIFLNLLSIVGIVLV

SEQ ID NO: 3266190 - protein, 18 aa, Plasmodium falciparum
KNTMCIEIDGSFNKWTII

SEQ ID NO: 3266191 - protein, 19 aa, Plasmodium falciparum
KNTNIFFLILFFNIFLPYT

SEQ ID NO: 3266192 - protein, 24 aa, Plasmodium falciparum
KNTPLLLCLLIERGYIFCTYIIIT

SEQ ID NO: 3266193 - protein, 32 aa, Plasmodium falciparum
KNTQQFFLALKILFSISAFLFMRFDSYVVTNI

SEQ ID NO: 3266194 - protein, 20 aa, Plasmodium falciparum
KNTRGHALLTLVDKIKTIET

SEQ ID NO: 3266195 - protein, 20 aa, Plasmodium falciparum
KNTRLDNFLFFSHIKEITFK

SEQ ID NO: 3266196 - protein, 24 aa, Plasmodium falciparum
KNVDICEYYGVFNLVYSNIINNDN

SEQ ID NO: 3266197 - protein, 18 aa, Plasmodium falciparum
KNVEELSKFDCLLINMGI

SEQ ID NO: 3266198 - protein, 24 aa, Plasmodium falciparum
KNVEVKKFWNIINVQYLTNFDYKY

SEQ ID NO: 3266199 - protein, 19 aa, Plasmodium falciparum
KNVFHMNIMHIHMKCYSNQ

SEQ ID NO: 3266200 - protein, 24 aa, Plasmodium falciparum
KNVFSIILSMLFYFFSNDTTSEVN

SEQ ID NO: 3266201 - protein, 20 aa, Plasmodium falciparum
KNVHIHISSIFVLTPNKIYP

SEQ ID NO: 3266202 - protein, 25 aa, Plasmodium falciparum
KNVHLKHLLSIVIFLCYKYEEKGKH

SEQ ID NO: 3266203 - protein, 21 aa, Plasmodium falciparum
KNVIFNFLKKILINVIKSEIN

SEQ ID NO: 3266204 - protein, 21 aa, Plasmodium falciparum
KNVIKTPCPDKCINNDNNIIK

SEQ ID NO: 3266205 - protein, 27 aa, Plasmodium falciparum
KNVIMLNCLKDEILFKEEELRKAEIIE

SEQ ID NO: 3266206 - protein, 19 aa, Plasmodium falciparum
KNVKEMTCDDSSYHMIMEK

SEQ ID NO: 3266207 - protein, 25 aa, Plasmodium falciparum
KNVKICLFCCFIGCSINYEEQSKIK

SEQ ID NO: 3266208 - protein, 18 aa, Plasmodium falciparum
KNVKIRHELLVNKKTPHI

SEQ ID NO: 3266209 - protein, 25 aa, Plasmodium falciparum
KNVKMKKVMFDLFIFIDILKNKNIQ

SEQ ID NO: 3266210 - protein, 17 aa, Plasmodium falciparum
KNVKVKTIYFIRHSESV

SEQ ID NO: 3266211 - protein, 26 aa, Plasmodium falciparum
KNVLKLAKIFLHLAYIHFEHGYIEKC

SEQ ID NO: 3266212 - protein, 20 aa, Plasmodium falciparum
KNVLKRFNVSVEDFYEELKN

SEQ ID NO: 3266213 - protein, 19 aa, Plasmodium falciparum
KNVLRAVCNNIKVYKTTKL

SEQ ID NO: 3266214 - protein, 24 aa, Plasmodium falciparum
KNVNECLHIWKPILSSSAHFSNNI

SEQ ID NO: 3266215 - protein, 29 aa, Plasmodium falciparum
KNVRRYVYRRSCFIFNIWNSSKVIKDIYK

SEQ ID NO: 3266216 - protein, 21 aa, Plasmodium falciparum
KNVSYRKLEKIKHNNNNNNND

SEQ ID NO: 3266217 - protein, 25 aa, Plasmodium falciparum
KNVTIKNFWKFYLYAHTLIDINNSK

SEQ ID NO: 3266218 - protein, 18 aa, Plasmodium falciparum
KNVVFAIDGICPFSKLKL

SEQ ID NO: 3266219 - protein, 18 aa, Plasmodium falciparum
KNVYCPKLLNKNNNIIYD

SEQ ID NO: 3266220 - protein, 20 aa, Plasmodium falciparum
KNVYKFIPYINIKDIIIILK

SEQ ID NO: 3266221 - protein, 24 aa, Plasmodium falciparum
KNVYNKPLHFFNYFNNSNINTDDN

SEQ ID NO: 3266222 - protein, 17 aa, Plasmodium falciparum
KNWKYSDLFSEYKNEIN

SEQ ID NO: 3266223 - protein, 31 aa, Plasmodium falciparum
KNYCYKKKYWKVRDGICVDYGIIKKEKKKFK

SEQ ID NO: 3266224 - protein, 21 aa, Plasmodium falciparum
KNYDYINCYYISKYITKERKQ

SEQ ID NO: 3266225 - protein, 29 aa, Plasmodium falciparum
KNYFEKIFEIYKTLYIIIVEKTFLSIFVN

SEQ ID NO: 3266226 - protein, 20 aa, Plasmodium falciparum
KNYFILKNTFSLITLDESLN

SEQ ID NO: 3266227 - protein, 31 aa, Plasmodium falciparum
KNYFYCINKYYGCVKRTFYSYKNIKFYKKNN

SEQ ID NO: 3266228 - protein, 17 aa, Plasmodium falciparum
KNYGNSCTSIFIEKKEW

SEQ ID NO: 3266229 - protein, 26 aa, Plasmodium falciparum
KNYGRITLFEICLFINEYLNKIFNND

SEQ ID NO: 3266230 - protein, 22 aa, Plasmodium falciparum
KNYHLSYEYVFISQLFNIYDNF

SEQ ID NO: 3266231 - protein, 25 aa, Plasmodium falciparum
KNYILFLRKKINSLEKQLNILKESK

SEQ ID NO: 3266232 - protein, 29 aa, Plasmodium falciparum
KNYKKFIFFKCLKLKPHNITPYLIYSSVV

SEQ ID NO: 3266233 - protein, 19 aa, Plasmodium falciparum
KNYKRNKILIVINNINTNH

SEQ ID NO: 3266234 - protein, 27 aa, Plasmodium falciparum
KNYLASCARKEKFPFFKNRNYNNENII

SEQ ID NO: 3266235 - protein, 19 aa, Plasmodium falciparum
KNYLKCVKSAPYIDDAKYG

SEQ ID NO: 3266236 - protein, 17 aa, Plasmodium falciparum
KNYLNTMLINMSLFILK

SEQ ID NO: 3266237 - protein, 37 aa, Plasmodium falciparum
KNYLTNSVGIIWGIYRWLWKSNGKFICPLRLPLCVSE

SEQ ID NO: 3266238 - protein, 20 aa, Plasmodium falciparum
KNYSDYRIDIFYETFNIFDT

SEQ ID NO: 3266239 - protein, 19 aa, Plasmodium falciparum
KNYSFIGNDIFLFGKDKTK

SEQ ID NO: 3266240 - protein, 17 aa, Plasmodium falciparum
KNYSGASSIIFLLYQFL

SEQ ID NO: 3266241 - protein, 25 aa, Plasmodium falciparum
KNYVIKIYLVRHMEALHNTEVIKNS

SEQ ID NO: 3266242 - protein, 18 aa, Plasmodium falciparum
KNYYSVWFYVDMILCCYC

SEQ ID NO: 3266243 - protein, 22 aa, Plasmodium falciparum
KPAEIIFLINFIQSSKYTNRVI

SEQ ID NO: 3266244 - protein, 19 aa, Plasmodium falciparum
KPAIGRLRMGKGCTDCFFA

SEQ ID NO: 3266245 - protein, 19 aa, Plasmodium falciparum
KPDKILFNNHILDFLKTNY

SEQ ID NO: 3266246 - protein, 19 aa, Plasmodium falciparum
KPEDFLIFLTFGYISNLLF

SEQ ID NO: 3266247 - protein, 19 aa, Plasmodium falciparum
KPELGLCKLMIYDHFLILY

SEQ ID NO: 3266248 - protein, 20 aa, Plasmodium falciparum
KPEPYYLIVLKKEVDKLKEF

SEQ ID NO: 3266249 - protein, 46 aa, Plasmodium falciparum
KPESIKYFFEVITEILIVIRLGLIYRYTNFLIPFKNFLISKTLENV

SEQ ID NO: 3266250 - protein, 23 aa, Plasmodium falciparum
KPFEVDFYLPFYVKNRKDNNILN

SEQ ID NO: 3266251 - protein, 20 aa, Plasmodium falciparum
KPFHIFKKISLLLLLILSFL

SEQ ID NO: 3266252 - protein, 18 aa, Plasmodium falciparum
KPFIMSIHDRNLYTGEEI

SEQ ID NO: 3266253 - protein, 17 aa, Plasmodium falciparum
KPFLNKYLNYFLERIKI

SEQ ID NO: 3266254 - protein, 18 aa, Plasmodium falciparum
KPGALKVAITAALNANSV

SEQ ID NO: 3266255 - protein, 19 aa, Plasmodium falciparum
KPIDDIFIFSDESDNYKDD

SEQ ID NO: 3266256 - protein, 17 aa, Plasmodium falciparum
KPIKIHRSLCECDLYTS

SEQ ID NO: 3266257 - protein, 24 aa, Plasmodium falciparum
KPIYCSLCDPIYFHEDIYKNIFLL

SEQ ID NO: 3266258 - protein, 20 aa, Plasmodium falciparum
KPKHLFLVKWMFLNTDNYKI

SEQ ID NO: 3266259 - protein, 19 aa, Plasmodium falciparum
KPKIQDIIRVWKFKNKSFK

SEQ ID NO: 3266260 - protein, 20 aa, Plasmodium falciparum
KPKLSIQIVISFSHILNYYK

SEQ ID NO: 3266261 - protein, 19 aa, Plasmodium falciparum
KPKNSLKYNKIRNSNNNNN

SEQ ID NO: 3266262 - protein, 19 aa, Plasmodium falciparum
KPKYLGIVGTYQWTAPEVL

SEQ ID NO: 3266263 - protein, 18 aa, Plasmodium falciparum
KPLLLVCGWPDNIHMFFK

SEQ ID NO: 3266264 - protein, 26 aa, Plasmodium falciparum
KPLNLRIPFINLRNSESLFVNSLYIS

SEQ ID NO: 3266265 - protein, 18 aa, Plasmodium falciparum
KPLYSLFFVTYFFLSFFF

SEQ ID NO: 3266266 - protein, 18 aa, Plasmodium falciparum
KPNFNIIVQYIWAFTEFL

SEQ ID NO: 3266267 - protein, 20 aa, Plasmodium falciparum
KPNKIYKLQIIFKDKSLNNI

SEQ ID NO: 3266268 - protein, 19 aa, Plasmodium falciparum
KPNLYCINNSISSILAKYN

SEQ ID NO: 3266269 - protein, 24 aa, Plasmodium falciparum
KPNYIKMNLTFKIGLRTYDNMYNI

SEQ ID NO: 3266270 - protein, 25 aa, Plasmodium falciparum
KPQFFRWFIEWSDEFCRERKKKEEE

SEQ ID NO: 3266271 - protein, 25 aa, Plasmodium falciparum
KPQFLRWMIEWGEEFCAERGKLEQN

SEQ ID NO: 3266272 - protein, 20 aa, Plasmodium falciparum
KPRKIVCTQFTQICNSDNNI

SEQ ID NO: 3266273 - protein, 21 aa, Plasmodium falciparum
KPSARRTNLYESLKEYYEKYI

SEQ ID NO: 3266274 - protein, 26 aa, Plasmodium falciparum
KPSLEHFPCIKLAYQAGIKGNFYPTV

SEQ ID NO: 3266275 - protein, 25 aa, Plasmodium falciparum
KPSLRFCKLFRRYYIRKFLKNKIKE

SEQ ID NO: 3266276 - protein, 20 aa, Plasmodium falciparum
KPSNMYFYLLHAECSEIRIC

SEQ ID NO: 3266277 - protein, 19 aa, Plasmodium falciparum
KPTLYEIYMRRSVLYNLHL

SEQ ID NO: 3266278 - protein, 23 aa, Plasmodium falciparum
KPTNFPGDCFSFKGNHGKITIHL

SEQ ID NO: 3266279 - protein, 19 aa, Plasmodium falciparum
KPYNKKNMNFILNNIQDLD

SEQ ID NO: 3266280 - protein, 21 aa, Plasmodium falciparum
KPYVECICINYGYILNQDKKK

SEQ ID NO: 3266281 - protein, 24 aa, Plasmodium falciparum
KQACKEYRIRKSAFEQFCHCSTAG

SEQ ID NO: 3266282 - protein, 17 aa, Plasmodium falciparum
KQCCKLLDKTFEDEKKK

SEQ ID NO: 3266283 - protein, 20 aa, Plasmodium falciparum
KQCRKYKKWIDIKFDEYQNQ

SEQ ID NO: 3266284 - protein, 17 aa, Plasmodium falciparum
KQDNLFCNNILKDLSIL

SEQ ID NO: 3266285 - protein, 22 aa, Plasmodium falciparum
KQEGKLLWKKHGTILDNQNACK

SEQ ID NO: 3266286 - protein, 18 aa, Plasmodium falciparum
KQEMFALVPPHHYWSLPI

SEQ ID NO: 3266287 - protein, 22 aa, Plasmodium falciparum
KQENIRTLFGYELYQDERIMKQ

SEQ ID NO: 3266288 - protein, 30 aa, Plasmodium falciparum
KQESFNFLLKHIFKKNFIYYINYIYTILGD

SEQ ID NO: 3266289 - protein, 27 aa, Plasmodium falciparum
KQFFLFLICFYINQALYYWSNDGDAIG

SEQ ID NO: 3266290 - protein, 17 aa, Plasmodium falciparum
KQFYIKEIINIYNKQEE

SEQ ID NO: 3266291 - protein, 18 aa, Plasmodium falciparum
KQHLLKFDDSIKCLLNNI

SEQ ID NO: 3266292 - protein, 19 aa, Plasmodium falciparum
KQHRTSHEHGHYSSNTIKK

SEQ ID NO: 3266293 - protein, 25 aa, Plasmodium falciparum
KQHYKIIFKNVIPFTKYDDFYNTHK

SEQ ID NO: 3266294 - protein, 25 aa, Plasmodium falciparum
KQIDAINVYGIFDLRTIHKITTKHK

SEQ ID NO: 3266295 - protein, 28 aa, Plasmodium falciparum
KQIEILKILCIFINYTPVSFILMKKINI

SEQ ID NO: 3266296 - protein, 31 aa, Plasmodium falciparum
KQIFAFPIKKLKFYCLRSFYHSGCLILVDSN

SEQ ID NO: 3266297 - protein, 20 aa, Plasmodium falciparum
KQIIFESFINLAIKMSILLH

SEQ ID NO: 3266298 - protein, 21 aa, Plasmodium falciparum
KQIMFIKILFFLYKHNNLLII

SEQ ID NO: 3266299 - protein, 18 aa, Plasmodium falciparum
KQINKFCEIIYSFFIKNG

SEQ ID NO: 3266300 - protein, 25 aa, Plasmodium falciparum
KQINKRVEMIYKFLNPSKIILLVKL

SEQ ID NO: 3266301 - protein, 18 aa, Plasmodium falciparum
KQINLILLIIFIISYYDI

SEQ ID NO: 3266302 - protein, 18 aa, Plasmodium falciparum
KQIRFQALYRFKDNVKKK

SEQ ID NO: 3266303 - protein, 21 aa, Plasmodium falciparum
KQKEFCYYKNGLTSRSSDAKE

SEQ ID NO: 3266304 - protein, 35 aa, Plasmodium falciparum
KQKFHMTHNFFKVAKKVYTLQAWVCNNSSDDLFID

SEQ ID NO: 3266305 - protein, 20 aa, Plasmodium falciparum
KQKFNNCFIISNRTIKMKNI

SEQ ID NO: 3266306 - protein, 23 aa, Plasmodium falciparum
KQKGIPFGCYFTTLEGVLQLEFL

SEQ ID NO: 3266307 - protein, 26 aa, Plasmodium falciparum
KQKIFIKYILRLCKDEEYSIIHMKNF

SEQ ID NO: 3266308 - protein, 17 aa, Plasmodium falciparum
KQKIIWRQWISKHLYYI

SEQ ID NO: 3266309 - protein, 24 aa, Plasmodium falciparum
KQKIKDDFLFYINIEKRKECYQKI

SEQ ID NO: 3266310 - protein, 25 aa, Plasmodium falciparum
KQKILKKDKSLLCLDNRKLVAKICS

SEQ ID NO: 3266311 - protein, 20 aa, Plasmodium falciparum
KQKKKGVCKSLLEENNNENF

SEQ ID NO: 3266312 - protein, 38 aa, Plasmodium falciparum
KQKKMKCNLNFRSVLGFLSMCPFNFDTKRNIYDNQTAD

SEQ ID NO: 3266313 - protein, 34 aa, Plasmodium falciparum
KQKLYKFIFGCIFLLPIIWFTFYKISMLTLKNNK

SEQ ID NO: 3266314 - protein, 33 aa, Plasmodium falciparum
KQKSIMAFFPFFYIMLMKNCNYVISHLTVVDIK

SEQ ID NO: 3266315 - protein, 26 aa, Plasmodium falciparum
KQKYGPKAPTGWKCVPSGDSTTTGEA

SEQ ID NO: 3266316 - protein, 17 aa, Plasmodium falciparum
KQLDLCVRIFDILNKSI

SEQ ID NO: 3266317 - protein, 19 aa, Plasmodium falciparum
KQLLPLFFLYSKELITDVI

SEQ ID NO: 3266318 - protein, 17 aa, Plasmodium falciparum
KQLNILMRKNHRKCNVY

SEQ ID NO: 3266319 - protein, 25 aa, Plasmodium falciparum
KQMKEIFLQQDVCYKKFCEMKKEKK

SEQ ID NO: 3266320 - protein, 25 aa, Plasmodium falciparum
KQNCFLKKNFSSLFLKKRNKKHNRH

SEQ ID NO: 3266321 - protein, 22 aa, Plasmodium falciparum
KQNIEKIILCFYDTLEYLNLYT

SEQ ID NO: 3266322 - protein, 18 aa, Plasmodium falciparum
KQNLCSYNKSRINCKRVL

SEQ ID NO: 3266323 - protein, 23 aa, Plasmodium falciparum
KQNWGCIKRDIISLELNLIYHNN

SEQ ID NO: 3266324 - protein, 18 aa, Plasmodium falciparum
KQNYFGLLGSYRKVRDTT

SEQ ID NO: 3266325 - protein, 24 aa, Plasmodium falciparum
KQPNLIHIGDFYFDRKKRIATYPT

SEQ ID NO: 3266326 - protein, 20 aa, Plasmodium falciparum
KQPRTEANPALTVHENEMCS

SEQ ID NO: 3266327 - protein, 25 aa, Plasmodium falciparum
KQRDEYTRRALLILSNEQSLKKFIR

SEQ ID NO: 3266328 - protein, 22 aa, Plasmodium falciparum
KQRSHSSYHTSFPMQNNNTPLY

SEQ ID NO: 3266329 - protein, 28 aa, Plasmodium falciparum
KQSKRIFLYLRLSNGMYLTCVYEKKIPT

SEQ ID NO: 3266330 - protein, 25 aa, Plasmodium falciparum
KQSLESIASLLLPRGVGQNINENIY

SEQ ID NO: 3266331 - protein, 23 aa, Plasmodium falciparum
KQTCNLPKVSVCTEPVDGQHEKE

SEQ ID NO: 3266332 - protein, 24 aa, Plasmodium falciparum
KQTKICNKSKCNYDQSYADSYDFY

SEQ ID NO: 3266333 - protein, 22 aa, Plasmodium falciparum
KQTPLFWAICSNNILMIYILNK

SEQ ID NO: 3266334 - protein, 24 aa, Plasmodium falciparum
KQVKENICKYIISQILQAVYYLHY

SEQ ID NO: 3266335 - protein, 26 aa, Plasmodium falciparum
KQVKFKDMLILLISILLQCFTDNYVI

SEQ ID NO: 3266336 - protein, 17 aa, Plasmodium falciparum
KQYCYQIIMGGGKTTVL

SEQ ID NO: 3266337 - protein, 20 aa, Plasmodium falciparum
KQYKYKCRFNQHTLMVFDHF

SEQ ID NO: 3266338 - protein, 21 aa, Plasmodium falciparum
KRAIGKLRYGKGCTDCFFACY

SEQ ID NO: 3266339 - protein, 20 aa, Plasmodium falciparum
KRAIGKLRYGKGCTECFFAC

SEQ ID NO: 3266340 - protein, 19 aa, Plasmodium falciparum
KRAIGKLRYGKQCISCLYA

SEQ ID NO: 3266341 - protein, 19 aa, Plasmodium falciparum
KRAIGKLRYGKQCISCLYG

SEQ ID NO: 3266342 - protein, 26 aa, Plasmodium falciparum
KRAPVAYNINCPFRKSPLSSKRRRQK

SEQ ID NO: 3266343 - protein, 18 aa, Plasmodium falciparum
KRARINLIVIKKKYLNDD

SEQ ID NO: 3266344 - protein, 18 aa, Plasmodium falciparum
KRCKDYLFNELIDADYVR

SEQ ID NO: 3266345 - protein, 22 aa, Plasmodium falciparum
KRCKNCNETYCTPNDCNNNDHV

SEQ ID NO: 3266346 - protein, 18 aa, Plasmodium falciparum
KRCLFCDKDNKILEQLSY

SEQ ID NO: 3266347 - protein, 21 aa, Plasmodium falciparum
KRDFLKIALAEYIKMQFDKQK

SEQ ID NO: 3266348 - protein, 20 aa, Plasmodium falciparum
KRDIFLKCVLPYILFLDDIL

SEQ ID NO: 3266349 - protein, 18 aa, Plasmodium falciparum
KRDIIDILLEHELDEAQE

SEQ ID NO: 3266350 - protein, 20 aa, Plasmodium falciparum
KRDKSKNMFFSWTSKKKKKK

SEQ ID NO: 3266351 - protein, 24 aa, Plasmodium falciparum
KRDNKEIKENINVADTMSSSDMNN

SEQ ID NO: 3266352 - protein, 17 aa, Plasmodium falciparum
KRDYNLIFQNLRNSPSI

SEQ ID NO: 3266353 - protein, 19 aa, Plasmodium falciparum
KRDYWPLIFSKIAYTNAEQ

SEQ ID NO: 3266354 - protein, 19 aa, Plasmodium falciparum
KREEEIFEYISNLVYNKTG

SEQ ID NO: 3266355 - protein, 25 aa, Plasmodium falciparum
KREFIKSLRVLQDMYKTNRRNKIKG

SEQ ID NO: 3266356 - protein, 22 aa, Plasmodium falciparum
KREGYLLQKRNLIFFKNDKNDI

SEQ ID NO: 3266357 - protein, 23 aa, Plasmodium falciparum
KREIKSMLFFVLYSKMFNEPFSC

SEQ ID NO: 3266358 - protein, 21 aa, Plasmodium falciparum
KRERKGPYTLKGEEYMGEKYG

SEQ ID NO: 3266359 - protein, 20 aa, Plasmodium falciparum
KRETNLYLFFLVYIQILNVI

SEQ ID NO: 3266360 - protein, 19 aa, Plasmodium falciparum
KREYRDVDKFLDLLSKETA

SEQ ID NO: 3266361 - protein, 21 aa, Plasmodium falciparum
KRFCLDTFKIISMFKYYLYEK

SEQ ID NO: 3266362 - protein, 17 aa, Plasmodium falciparum
KRFDKSKHRSYKKVSVH

SEQ ID NO: 3266363 - protein, 17 aa, Plasmodium falciparum
KRFDSNASFKLSDEYSS

SEQ ID NO: 3266364 - protein, 18 aa, Plasmodium falciparum
KRFFKLINIDIILIILWF

SEQ ID NO: 3266365 - protein, 17 aa, Plasmodium falciparum
KRFIFKFTTQYFYFILF

SEQ ID NO: 3266366 - protein, 20 aa, Plasmodium falciparum
KRFINEINKFVNIMKYGYQA

SEQ ID NO: 3266367 - protein, 19 aa, Plasmodium falciparum
KRFIYFKNIYNILFSNNII

SEQ ID NO: 3266368 - protein, 24 aa, Plasmodium falciparum
KRFNPSTCLLRNCIYYVNCKINDK

SEQ ID NO: 3266369 - protein, 20 aa, Plasmodium falciparum
KRFQCKNLITQILLADYILD

SEQ ID NO: 3266370 - protein, 19 aa, Plasmodium falciparum
KRGILLIKYYKNNKETYKK

SEQ ID NO: 3266371 - protein, 21 aa, Plasmodium falciparum
KRGKWKKMFKFLNLFVFIFLF

SEQ ID NO: 3266372 - protein, 19 aa, Plasmodium falciparum
KRGRIDYDMKLKMDEKKNE

SEQ ID NO: 3266373 - protein, 20 aa, Plasmodium falciparum
KRGRKRMSILHEFNIKERDK

SEQ ID NO: 3266374 - protein, 46 aa, Plasmodium falciparum
KRHDKKFSVKTFGFLQARKLAIEYRERWIQLKAFHRLNNLKKKTEK

SEQ ID NO: 3266375 - protein, 18 aa, Plasmodium falciparum
KRHDLLLRGKNDFEIFKF

SEQ ID NO: 3266376 - protein, 31 aa, Plasmodium falciparum
KRHIYKCIWCNKYFHLRCLIKNSYKKKKIIK

SEQ ID NO: 3266377 - protein, 21 aa, Plasmodium falciparum
KRHLLKVIFLYGKLHSLQGLN

SEQ ID NO: 3266378 - protein, 19 aa, Plasmodium falciparum
KRHRSLCECDLYMPNYDND

SEQ ID NO: 3266379 - protein, 22 aa, Plasmodium falciparum
KRHTIECMFEELFIDKNTKEKE

SEQ ID NO: 3266380 - protein, 29 aa, Plasmodium falciparum
KRIAFLSCNIYGLCGYIFVDFNKEFICYD

SEQ ID NO: 3266381 - protein, 21 aa, Plasmodium falciparum
KRIFCDLKILFPKSKVQYTYV

SEQ ID NO: 3266382 - protein, 18 aa, Plasmodium falciparum
KRIFKLKLPLYKIHHYED

SEQ ID NO: 3266383 - protein, 19 aa, Plasmodium falciparum
KRIGRRKSWIIPLQLFCSF

SEQ ID NO: 3266384 - protein, 17 aa, Plasmodium falciparum
KRIHSFLNNSCAFYSFQ

SEQ ID NO: 3266385 - protein, 19 aa, Plasmodium falciparum
KRIIELKHIVLFILGISRF

SEQ ID NO: 3266386 - protein, 19 aa, Plasmodium falciparum
KRIIMKRISLCGKIFKIHK

SEQ ID NO: 3266387 - protein, 22 aa, Plasmodium falciparum
KRIINFYLNKWIEYIKECKQLN

SEQ ID NO: 3266388 - protein, 20 aa, Plasmodium falciparum
KRIIWNIIFDALRKKFISDV

SEQ ID NO: 3266389 - protein, 18 aa, Plasmodium falciparum
KRIKGCTREVVYNDNVLC

SEQ ID NO: 3266390 - protein, 17 aa, Plasmodium falciparum
KRIKKGKIRNEIYQKLK

SEQ ID NO: 3266391 - protein, 19 aa, Plasmodium falciparum
KRIKNKKYHNFYLFLLNIF

SEQ ID NO: 3266392 - protein, 18 aa, Plasmodium falciparum
KRILGSLKKNKFIKKKYE

SEQ ID NO: 3266393 - protein, 22 aa, Plasmodium falciparum
KRILKFNLIETFLKKDDIPFEE

SEQ ID NO: 3266394 - protein, 26 aa, Plasmodium falciparum
KRILYTLKFLFSFDLFPNVLPYNRMS

SEQ ID NO: 3266395 - protein, 23 aa, Plasmodium falciparum
KRIMKRKFNKNGLYNTIGDNKNK

SEQ ID NO: 3266396 - protein, 21 aa, Plasmodium falciparum
KRINDSFFFLMSSYKYFYKSS

SEQ ID NO: 3266397 - protein, 30 aa, Plasmodium falciparum
KRISLCGKIFKIHKKKAVIRNMFYNPKDIN

SEQ ID NO: 3266398 - protein, 17 aa, Plasmodium falciparum
KRISSILNKDNKNELRA

SEQ ID NO: 3266399 - protein, 22 aa, Plasmodium falciparum
KRIYFYTLYIWLIFSFFQFPII

SEQ ID NO: 3266400 - protein, 18 aa, Plasmodium falciparum
KRIYINYNDSFFIDLIFS

SEQ ID NO: 3266401 - protein, 24 aa, Plasmodium falciparum
KRIYLREYYDLFCSTNCMNYNLGL

SEQ ID NO: 3266402 - protein, 18 aa, Plasmodium falciparum
KRIYPFYQRVQRIRRKML

SEQ ID NO: 3266403 - protein, 27 aa, Plasmodium falciparum
KRIYYYCNLLKCDILTFIKKDIENLRK

SEQ ID NO: 3266404 - protein, 17 aa, Plasmodium falciparum
KRKEGCFGNNLEEKKKI

SEQ ID NO: 3266405 - protein, 21 aa, Plasmodium falciparum
KRKEKKFSYSKILQNISKILN

SEQ ID NO: 3266406 - protein, 21 aa, Plasmodium falciparum
KRKELDLIFIHGLRGNALRTW

SEQ ID NO: 3266407 - protein, 17 aa, Plasmodium falciparum
KRKELLVSCVINNVMYG

SEQ ID NO: 3266408 - protein, 21 aa, Plasmodium falciparum
KRKENLGNLFSFNDPSIKERI

SEQ ID NO: 3266409 - protein, 19 aa, Plasmodium falciparum
KRKHFLSNIDIKFHLNSHD

SEQ ID NO: 3266410 - protein, 25 aa, Plasmodium falciparum
KRKIFLKKHIHMIFVSWHKLIQVNN

SEQ ID NO: 3266411 - protein, 20 aa, Plasmodium falciparum
KRKIKKAKFEGVEDLKHKNK

SEQ ID NO: 3266412 - protein, 26 aa, Plasmodium falciparum
KRKINIETFIKFSMLIFKKQKDCINN

SEQ ID NO: 3266413 - protein, 17 aa, Plasmodium falciparum
KRKISLSLDKYALNIIK

SEQ ID NO: 3266414 - protein, 20 aa, Plasmodium falciparum
KRKKEFTDVLLTKKRTPKRK

SEQ ID NO: 3266415 - protein, 24 aa, Plasmodium falciparum
KRKKGELFFMYYVSRRRYIFFLLY

SEQ ID NO: 3266416 - protein, 29 aa, Plasmodium falciparum
KRKKIKIDFFCVNWFLTLFSQDLSFENTL

SEQ ID NO: 3266417 - protein, 20 aa, Plasmodium falciparum
KRKKKFVILFLYIILSSVIQ

SEQ ID NO: 3266418 - protein, 23 aa, Plasmodium falciparum
KRKKKYLNFFVILLSLFLKKYLY

SEQ ID NO: 3266419 - protein, 23 aa, Plasmodium falciparum
KRKKLKDIHFFKGGKHDDKEKKS

SEQ ID NO: 3266420 - protein, 17 aa, Plasmodium falciparum
KRKLDCDNKIKFNDIEK

SEQ ID NO: 3266421 - protein, 24 aa, Plasmodium falciparum
KRKLDLKSFFIIVWISIFQGTVVM

SEQ ID NO: 3266422 - protein, 32 aa, Plasmodium falciparum
KRKLFLRNIFISEILYRYKIIKKTEIIFNMNN

SEQ ID NO: 3266423 - protein, 22 aa, Plasmodium falciparum
KRKLSCDVYFKNIKNINVYQFL

SEQ ID NO: 3266424 - protein, 18 aa, Plasmodium falciparum
KRKLSVKVKVNVNVKVEL

SEQ ID NO: 3266425 - protein, 20 aa, Plasmodium falciparum
KRKLYVYNHIIPKELNEDGF

SEQ ID NO: 3266426 - protein, 17 aa, Plasmodium falciparum
KRKNHIYNIDMKYIKRK

SEQ ID NO: 3266427 - protein, 19 aa, Plasmodium falciparum
KRKNIKLFLNIINSNEYIN

SEQ ID NO: 3266428 - protein, 19 aa, Plasmodium falciparum
KRKNMWMYLFRKYYMSYIY

SEQ ID NO: 3266429 - protein, 22 aa, Plasmodium falciparum
KRKNVLCIRCPPMTYKGTISND

SEQ ID NO: 3266430 - protein, 25 aa, Plasmodium falciparum
KRKQYFYSVCDIKSLRQSIILLDGI

SEQ ID NO: 3266431 - protein, 19 aa, Plasmodium falciparum
KRKSKSKRRTNTYMYVPSY

SEQ ID NO: 3266432 - protein, 20 aa, Plasmodium falciparum
KRKSNKIKRKRIKNDAYINV

SEQ ID NO: 3266433 - protein, 25 aa, Plasmodium falciparum
KRKTREILELDEYILYLKIKYKEKY

SEQ ID NO: 3266434 - protein, 25 aa, Plasmodium falciparum
KRKYDYRKINGIGYYSEYDMRRVIR

SEQ ID NO: 3266435 - protein, 24 aa, Plasmodium falciparum
KRKYKTRGKKYFKYDSDINYEDDI

SEQ ID NO: 3266436 - protein, 18 aa, Plasmodium falciparum
KRKYVYIVNLCFSDILLK

SEQ ID NO: 3266437 - protein, 21 aa, Plasmodium falciparum
KRKYYNFLFLYILINKLHFYI

SEQ ID NO: 3266438 - protein, 17 aa, Plasmodium falciparum
KRLEANNLFNLIKYYNV

SEQ ID NO: 3266439 - protein, 29 aa, Plasmodium falciparum
KRLENIKRGLTFLKCYPMIKNEINELFLT

SEQ ID NO: 3266440 - protein, 26 aa, Plasmodium falciparum
KRLIKSRWLFIIKEYNNIFLYIYMLS

SEQ ID NO: 3266441 - protein, 25 aa, Plasmodium falciparum
KRLKKLRAKLFLKVANHFIQQNIIK

SEQ ID NO: 3266442 - protein, 22 aa, Plasmodium falciparum
KRLKNIPLLPLFIMHGKNDRDI

SEQ ID NO: 3266443 - protein, 20 aa, Plasmodium falciparum
KRLKQIKVECKVDQDNDKNG

SEQ ID NO: 3266444 - protein, 40 aa, Plasmodium falciparum
KRLLNELCFNLSYKLNVCPKYMVTSGFLNYIYFKIMTPLH

SEQ ID NO: 3266445 - protein, 20 aa, Plasmodium falciparum
KRLLRSGFSRIPVINRNKAE

SEQ ID NO: 3266446 - protein, 25 aa, Plasmodium falciparum
KRLSFSKSYIKGMYLKSEESIEKEN

SEQ ID NO: 3266447 - protein, 20 aa, Plasmodium falciparum
KRLYFKKNYYVISACEDKLY

SEQ ID NO: 3266448 - protein, 20 aa, Plasmodium falciparum
KRMEELYKNYLIFYDISILS

SEQ ID NO: 3266449 - protein, 18 aa, Plasmodium falciparum
KRMKYFINNDIIQFINKG

SEQ ID NO: 3266450 - protein, 20 aa, Plasmodium falciparum
KRMLDLLPFCSLNLDEIFYR

SEQ ID NO: 3266451 - protein, 23 aa, Plasmodium falciparum
KRNDSSYKFDVYKDTSFLKNREY

SEQ ID NO: 3266452 - protein, 41 aa, Plasmodium falciparum
KRNFKTTSDYYICCSLFLKLPFGILPGIYITCLTNMRDKNI

SEQ ID NO: 3266453 - protein, 19 aa, Plasmodium falciparum
KRNGTFFSLYFFILNILMN

SEQ ID NO: 3266454 - protein, 17 aa, Plasmodium falciparum
KRNIPIYPYGVIQKLNI

SEQ ID NO: 3266455 - protein, 27 aa, Plasmodium falciparum
KRNKGKIGIIYCFKRNTCDEISKYLRE

SEQ ID NO: 3266456 - protein, 21 aa, Plasmodium falciparum
KRNKYIYIFCNIIENLLQNCI

SEQ ID NO: 3266457 - protein, 17 aa, Plasmodium falciparum
KRNLLFYSLFTSYTEIY

SEQ ID NO: 3266458 - protein, 22 aa, Plasmodium falciparum
KRNMNFHLLLFYSLSYSSSLYL

SEQ ID NO: 3266459 - protein, 19 aa, Plasmodium falciparum
KRNMSILIMNTHNNVITLN

SEQ ID NO: 3266460 - protein, 36 aa, Plasmodium falciparum
KRNNKRSGCTKMFRFFKKIGLNIIYIFSKTKRICIG

SEQ ID NO: 3266461 - protein, 20 aa, Plasmodium falciparum
KRNNLNDVLICRKEEYEIRE

SEQ ID NO: 3266462 - protein, 28 aa, Plasmodium falciparum
KRNYFIVYYKRYIKRGYANSGNNKQKMF

SEQ ID NO: 3266463 - protein, 26 aa, Plasmodium falciparum
KRNYLLFKILISFLCYHIRQYHDMLK

SEQ ID NO: 3266464 - protein, 27 aa, Plasmodium falciparum
KRPKRLEYKLSRYFFRALIYEGLHFPA

SEQ ID NO: 3266465 - protein, 31 aa, Plasmodium falciparum
KRPSDYMFEKFCIINIFLSVFEFLIGNFHIF

SEQ ID NO: 3266466 - protein, 36 aa, Plasmodium falciparum
KRQSFYLSYGCLFKVLKYRFEPYIMKNFNLLLECYN

SEQ ID NO: 3266467 - protein, 22 aa, Plasmodium falciparum
KRRDIFPIPYFIIYKNKNKNVF

SEQ ID NO: 3266468 - protein, 17 aa, Plasmodium falciparum
KRRETFNSVEGTPTPTS

SEQ ID NO: 3266469 - protein, 21 aa, Plasmodium falciparum
KRRFIKKKISICIQNKKKKKM

SEQ ID NO: 3266470 - protein, 18 aa, Plasmodium falciparum
KRRICTSKFYSINENSHY

SEQ ID NO: 3266471 - protein, 18 aa, Plasmodium falciparum
KRRIEKKSDIDKTQIKLI

SEQ ID NO: 3266472 - protein, 18 aa, Plasmodium falciparum
KRRIIVNAALWGFSQSAQ

SEQ ID NO: 3266473 - protein, 21 aa, Plasmodium falciparum
KRRNIRRMKIAAAALGGGALI

SEQ ID NO: 3266474 - protein, 29 aa, Plasmodium falciparum
KRRNKPKRFPFFIPLKIMKCRKEMHLIKS

SEQ ID NO: 3266475 - protein, 18 aa, Plasmodium falciparum
KRRNLPIYLRQRNLNNNL

SEQ ID NO: 3266476 - protein, 25 aa, Plasmodium falciparum
KRRRMSFFLICTFFNLIFLVSLLVL

SEQ ID NO: 3266477 - protein, 27 aa, Plasmodium falciparum
KRRSMWDLLMECTEEIFTEMNINEENF

SEQ ID NO: 3266478 - protein, 43 aa, Plasmodium falciparum
KRRTFFSAIICFFKSIFIFLYFCLCPWKLLKLKKKKSNDNKKK

SEQ ID NO: 3266479 - protein, 19 aa, Plasmodium falciparum
KRRTVYESYNIINIANKKR

SEQ ID NO: 3266480 - protein, 22 aa, Plasmodium falciparum
KRSCVPVDVSVRFTVADTDLTF

SEQ ID NO: 3266481 - protein, 34 aa, Plasmodium falciparum
KRSDVFLDYLKIYNFKQICIIFNLINKKKERKDN

SEQ ID NO: 3266482 - protein, 31 aa, Plasmodium falciparum
KRSIFIVLTVSICFMFALMLFYFTRNENNKT

SEQ ID NO: 3266483 - protein, 33 aa, Plasmodium falciparum
KRSKIMFLLLFCKVKHILNFKKIILDMLDKDVI

SEQ ID NO: 3266484 - protein, 20 aa, Plasmodium falciparum
KRSSISYYFDDYFDEHFEDY

SEQ ID NO: 3266485 - protein, 18 aa, Plasmodium falciparum
KRSYEYFLGLLIFILHVF

SEQ ID NO: 3266486 - protein, 17 aa, Plasmodium falciparum
KRSYVLCSNQLDMSIQN

SEQ ID NO: 3266487 - protein, 17 aa, Plasmodium falciparum
KRTCYNPLMSRNSTWCN

SEQ ID NO: 3266488 - protein, 18 aa, Plasmodium falciparum
KRTFCYLCEKNVYVSNLK

SEQ ID NO: 3266489 - protein, 20 aa, Plasmodium falciparum
KRTFVLSIYAFITFIIFCIG

SEQ ID NO: 3266490 - protein, 20 aa, Plasmodium falciparum
KRTNDGIGYVGLYNDINDYV

SEQ ID NO: 3266491 - protein, 19 aa, Plasmodium falciparum
KRTNKRMNVETFDICAEQN

SEQ ID NO: 3266492 - protein, 20 aa, Plasmodium falciparum
KRTNNMIGINKNHFNIIIST

SEQ ID NO: 3266493 - protein, 23 aa, Plasmodium falciparum
KRTYEYFKSFILFSYGQMFLVCI

SEQ ID NO: 3266494 - protein, 21 aa, Plasmodium falciparum
KRTYVVAILLAFLVLHALLYM

SEQ ID NO: 3266495 - protein, 29 aa, Plasmodium falciparum
KRVLRAFEFYRIYTSALFYGDISLYVLTN

SEQ ID NO: 3266496 - protein, 37 aa, Plasmodium falciparum
KRVRIKDLFNLFNLDEFRCSFILYEVLNALNTYLNEK

SEQ ID NO: 3266497 - protein, 20 aa, Plasmodium falciparum
KRWIYILKHFLTKKLNIPIL

SEQ ID NO: 3266498 - protein, 35 aa, Plasmodium falciparum
KRWKDIKAGDIILCRRSEFFCADILLLCTSHKNGI

SEQ ID NO: 3266499 - protein, 20 aa, Plasmodium falciparum
KRWMLMFWFIPFSKKKENKT

SEQ ID NO: 3266500 - protein, 20 aa, Plasmodium falciparum
KRYDLLFLYNKKFINFIESI

SEQ ID NO: 3266501 - protein, 20 aa, Plasmodium falciparum
KRYIFFKIIDILRMFNLSIF

SEQ ID NO: 3266502 - protein, 22 aa, Plasmodium falciparum
KRYIRYSTLLICIANFLKPRNE

SEQ ID NO: 3266503 - protein, 20 aa, Plasmodium falciparum
KRYLLKKMKYKNLVVDFSFG

SEQ ID NO: 3266504 - protein, 24 aa, Plasmodium falciparum
KRYNRSVWCTLLYGRNNILIVLIL

SEQ ID NO: 3266505 - protein, 25 aa, Plasmodium falciparum
KRYREHIDNGHMCHMNLNDEETNFY

SEQ ID NO: 3266506 - protein, 19 aa, Plasmodium falciparum
KRYRIISCVAAFLSTVSLA

SEQ ID NO: 3266507 - protein, 23 aa, Plasmodium falciparum
KRYTRFPLLFKEILKNPNECFLP

SEQ ID NO: 3266508 - protein, 17 aa, Plasmodium falciparum
KSADIGIAMGINGTEVA

SEQ ID NO: 3266509 - protein, 27 aa, Plasmodium falciparum
KSAGHPFKYQPTKGLKEYEESHVAKDY

SEQ ID NO: 3266510 - protein, 19 aa, Plasmodium falciparum
KSAIFFEWLIFFVGIIIRI

SEQ ID NO: 3266511 - protein, 19 aa, Plasmodium falciparum
KSAKKLKIFQGHKKYIDCI

SEQ ID NO: 3266512 - protein, 19 aa, Plasmodium falciparum
KSAKTYLDIMKRVLEELQT

SEQ ID NO: 3266513 - protein, 26 aa, Plasmodium falciparum
KSCFPMKRIIFEFTENYGASYTCVYR

SEQ ID NO: 3266514 - protein, 22 aa, Plasmodium falciparum
KSCNFLNSIWIYYYYNNIKTLT

SEQ ID NO: 3266515 - protein, 26 aa, Plasmodium falciparum
KSCSSKAEWCILPFNKILIINNQQKD

SEQ ID NO: 3266516 - protein, 21 aa, Plasmodium falciparum
KSCVKPKTFAAEEKIRKTKMA

SEQ ID NO: 3266517 - protein, 24 aa, Plasmodium falciparum
KSDFFLYNEMNFFINIINNTFDKF

SEQ ID NO: 3266518 - protein, 21 aa, Plasmodium falciparum
KSDIIPIKIIIMSATINDNNL

SEQ ID NO: 3266519 - protein, 25 aa, Plasmodium falciparum
KSDILNIKYIYKLIDNYSKIDSYIK

SEQ ID NO: 3266520 - protein, 17 aa, Plasmodium falciparum
KSDIYGMQNMLNSKLNV

SEQ ID NO: 3266521 - protein, 17 aa, Plasmodium falciparum
KSDLIDVCINRRSYNKC

SEQ ID NO: 3266522 - protein, 18 aa, Plasmodium falciparum
KSDWCIRKYKKIYNYNKI

SEQ ID NO: 3266523 - protein, 19 aa, Plasmodium falciparum
KSEFCYRNCLPKICIPMNM

SEQ ID NO: 3266524 - protein, 21 aa, Plasmodium falciparum
KSEILKLINYIPTLSNEEEFF

SEQ ID NO: 3266525 - protein, 21 aa, Plasmodium falciparum
KSEKFPILVILASFLSLILYN

SEQ ID NO: 3266526 - protein, 22 aa, Plasmodium falciparum
KSELYLYSINLFDAGLYNLSFV

SEQ ID NO: 3266527 - protein, 20 aa, Plasmodium falciparum
KSEPHYRIVYKNNKSSNTTN

SEQ ID NO: 3266528 - protein, 18 aa, Plasmodium falciparum
KSEVFLRNYNHFNLCIKI

SEQ ID NO: 3266529 - protein, 19 aa, Plasmodium falciparum
KSEVKYFYYIQRKNNLGVY

SEQ ID NO: 3266530 - protein, 17 aa, Plasmodium falciparum
KSFDFGCNIIIKIIEYC

SEQ ID NO: 3266531 - protein, 21 aa, Plasmodium falciparum
KSFDLKKKFLFLYEKKNKEQV

SEQ ID NO: 3266532 - protein, 25 aa, Plasmodium falciparum
KSFELAKTFSNFKISTEILDMLNIL

SEQ ID NO: 3266533 - protein, 20 aa, Plasmodium falciparum
KSFHILNLVYIFYKYVKSEK

SEQ ID NO: 3266534 - protein, 21 aa, Plasmodium falciparum
KSFHKIKICILINIHKYLIPS

SEQ ID NO: 3266535 - protein, 19 aa, Plasmodium falciparum
KSFHQYMLYLNKKCQDRIA

SEQ ID NO: 3266536 - protein, 17 aa, Plasmodium falciparum
KSFHYLLNTSYYHYKMK

SEQ ID NO: 3266537 - protein, 25 aa, Plasmodium falciparum
KSFLVYVSGLIKWLNIIEDKHVTIR

SEQ ID NO: 3266538 - protein, 19 aa, Plasmodium falciparum
KSFLYSLMIDNVVKQNNQF

SEQ ID NO: 3266539 - protein, 21 aa, Plasmodium falciparum
KSFNFFYLFSYIFKIFPFIGK

SEQ ID NO: 3266540 - protein, 18 aa, Plasmodium falciparum
KSFYMCNHQLLIIGSGAD

SEQ ID NO: 3266541 - protein, 26 aa, Plasmodium falciparum
KSGDIPPPFLRQMFYTIADYKDILYS

SEQ ID NO: 3266542 - protein, 25 aa, Plasmodium falciparum
KSGEIPNDFLRQMFYTLGDYRDILV

SEQ ID NO: 3266543 - protein, 25 aa, Plasmodium falciparum
KSGEIPTDFLRQMFYTLGDYRDICI

SEQ ID NO: 3266544 - protein, 22 aa, Plasmodium falciparum
KSGKKLPILVDYIITKWQDDNF

SEQ ID NO: 3266545 - protein, 25 aa, Plasmodium falciparum
KSGLYKRKGRSCLEQRNLIIQECFN

SEQ ID NO: 3266546 - protein, 25 aa, Plasmodium falciparum
KSGRFSVYNNICFNNKMKINKRGTI

SEQ ID NO: 3266547 - protein, 19 aa, Plasmodium falciparum
KSGVSEFLLPSASQYGREN

SEQ ID NO: 3266548 - protein, 21 aa, Plasmodium falciparum
KSGWSIINVTSFEWNKINKDE

SEQ ID NO: 3266549 - protein, 22 aa, Plasmodium falciparum
KSHKLIKQKCEHVKDINDQMFM

SEQ ID NO: 3266550 - protein, 20 aa, Plasmodium falciparum
KSHLRNGFLQRYENNTDINY

SEQ ID NO: 3266551 - protein, 24 aa, Plasmodium falciparum
KSHVIKINVPLLNFLKKITNLSNI

SEQ ID NO: 3266552 - protein, 22 aa, Plasmodium falciparum
KSICSICRYNNYCLGLDHSSII

SEQ ID NO: 3266553 - protein, 18 aa, Plasmodium falciparum
KSIDFWITLKENIKNIDI

SEQ ID NO: 3266554 - protein, 19 aa, Plasmodium falciparum
KSIFYEYFILNRFRKNKLK

SEQ ID NO: 3266555 - protein, 17 aa, Plasmodium falciparum
KSIHFLRDIYKKNYINY

SEQ ID NO: 3266556 - protein, 17 aa, Plasmodium falciparum
KSIHPFKLSNHNGNVLC

SEQ ID NO: 3266557 - protein, 17 aa, Plasmodium falciparum
KSIIHSLFFYNKLIYLR

SEQ ID NO: 3266558 - protein, 25 aa, Plasmodium falciparum
KSIIQRIKYEIIFNNPQNCKRQNKI

SEQ ID NO: 3266559 - protein, 17 aa, Plasmodium falciparum
KSILKKYINYIIYLFCE

SEQ ID NO: 3266560 - protein, 19 aa, Plasmodium falciparum
KSILYDIIEAVYNKEPILL

SEQ ID NO: 3266561 - protein, 31 aa, Plasmodium falciparum
KSINEFLLELKFKVFNRLLKLNSYEFSDGKN

SEQ ID NO: 3266562 - protein, 24 aa, Plasmodium falciparum
KSINRIITIYIFLQKKINKFFSFF

SEQ ID NO: 3266563 - protein, 19 aa, Plasmodium falciparum
KSINTFLDFFISLINIGKF

SEQ ID NO: 3266564 - protein, 17 aa, Plasmodium falciparum
KSIPMLYKEFKILSKSI

SEQ ID NO: 3266565 - protein, 23 aa, Plasmodium falciparum
KSIRFPIWENLGEIYFRGTLRDL

SEQ ID NO: 3266566 - protein, 30 aa, Plasmodium falciparum
KSIRKDVWKCVNICGVDVCGLKKGDNNGEL

SEQ ID NO: 3266567 - protein, 19 aa, Plasmodium falciparum
KSISCCIIRYFFLRTTKKD

SEQ ID NO: 3266568 - protein, 22 aa, Plasmodium falciparum
KSISDVQLEICAHKKYDSNVRS

SEQ ID NO: 3266569 - protein, 18 aa, Plasmodium falciparum
KSISYIIYFTETYIKKKT

SEQ ID NO: 3266570 - protein, 21 aa, Plasmodium falciparum
KSIYLSPLFFFLNKYHNKKNG

SEQ ID NO: 3266571 - protein, 22 aa, Plasmodium falciparum
KSIYNLLKLICLTYEFHHNFYI

SEQ ID NO: 3266572 - protein, 24 aa, Plasmodium falciparum
KSIYYCSLIFYLLQKYNLHYTYLY

SEQ ID NO: 3266573 - protein, 21 aa, Plasmodium falciparum
KSKEELFDFYTILQQYKNSII

SEQ ID NO: 3266574 - protein, 25 aa, Plasmodium falciparum
KSKEVYKLDLVLLINRKRKYENYNV

SEQ ID NO: 3266575 - protein, 24 aa, Plasmodium falciparum
KSKEYDFIITFAITFFLVSLDFYL

SEQ ID NO: 3266576 - protein, 21 aa, Plasmodium falciparum
KSKIFIPERNPLGIFKNPKIE

SEQ ID NO: 3266577 - protein, 21 aa, Plasmodium falciparum
KSKIINYNIVFPFVIQMKNRN

SEQ ID NO: 3266578 - protein, 26 aa, Plasmodium falciparum
KSKINYVKLIKIWDTYLFFKEKKQLE

SEQ ID NO: 3266579 - protein, 19 aa, Plasmodium falciparum
KSKIVTFVNSYIFINRLPF

SEQ ID NO: 3266580 - protein, 19 aa, Plasmodium falciparum
KSKIYRYGINQLKINRKCS

SEQ ID NO: 3266581 - protein, 28 aa, Plasmodium falciparum
KSKKKKKSFFQMLGCNFLCNKNIETDDE

SEQ ID NO: 3266582 - protein, 19 aa, Plasmodium falciparum
KSKKLMNVLNFMIDNKLDV

SEQ ID NO: 3266583 - protein, 23 aa, Plasmodium falciparum
KSKKMQLEFSHILNLENPITSKH

SEQ ID NO: 3266584 - protein, 23 aa, Plasmodium falciparum
KSKLEGFYFCVNKIDLLSNYKEF

SEQ ID NO: 3266585 - protein, 23 aa, Plasmodium falciparum
KSKLELFSSYYFPLLHALPTSIQ

SEQ ID NO: 3266586 - protein, 28 aa, Plasmodium falciparum
KSKLHPRGPVKLCASKSIAFNKLNNSKG

SEQ ID NO: 3266587 - protein, 18 aa, Plasmodium falciparum
KSKLRKRVILQIDGQLKT

SEQ ID NO: 3266588 - protein, 18 aa, Plasmodium falciparum
KSKNIIIIVKKFTSDDLS

SEQ ID NO: 3266589 - protein, 23 aa, Plasmodium falciparum
KSKNKRKLLFFVLTKKHFYIFKF

SEQ ID NO: 3266590 - protein, 18 aa, Plasmodium falciparum
KSKNLHIISVALKCIEDI

SEQ ID NO: 3266591 - protein, 21 aa, Plasmodium falciparum
KSKNLKGDMFVEYLEEKKKNM

SEQ ID NO: 3266592 - protein, 20 aa, Plasmodium falciparum
KSKRENFLIISYMNEEIYFL

SEQ ID NO: 3266593 - protein, 18 aa, Plasmodium falciparum
KSKRMISIHLSDVLMYLF

SEQ ID NO: 3266594 - protein, 27 aa, Plasmodium falciparum
KSKRYFKSFDIFYFTGFNSDDLIKIYD

SEQ ID NO: 3266595 - protein, 19 aa, Plasmodium falciparum
KSKSAICIGDTKINKTSHN

SEQ ID NO: 3266596 - protein, 20 aa, Plasmodium falciparum
KSKYNFFFFKNEKIIKMSVN

SEQ ID NO: 3266597 - protein, 25 aa, Plasmodium falciparum
KSLCSKRLVLPILGILYIILNGNFG

SEQ ID NO: 3266598 - protein, 17 aa, Plasmodium falciparum
KSLDISKNFIFSEEVRS

SEQ ID NO: 3266599 - protein, 28 aa, Plasmodium falciparum
KSLDSCSFPLLFCILFLNTLGKFGKSVL

SEQ ID NO: 3266600 - protein, 27 aa, Plasmodium falciparum
KSLFNYKIFWFYFKYAVACISNDLNFF

SEQ ID NO: 3266601 - protein, 25 aa, Plasmodium falciparum
KSLFPKSKIEVFGSYTSGLSLPSSD

SEQ ID NO: 3266602 - protein, 17 aa, Plasmodium falciparum
KSLFRQNFICEFPSNYK

SEQ ID NO: 3266603 - protein, 19 aa, Plasmodium falciparum
KSLFYKKKLSLYVKKSYFD

SEQ ID NO: 3266604 - protein, 17 aa, Plasmodium falciparum
KSLGCNCAGRAENSKED

SEQ ID NO: 3266605 - protein, 26 aa, Plasmodium falciparum
KSLIRLASKMTPMFQVREIQPLFSVL

SEQ ID NO: 3266606 - protein, 23 aa, Plasmodium falciparum
KSLIRLFIMKTLTYCAPPYDLMF

SEQ ID NO: 3266607 - protein, 18 aa, Plasmodium falciparum
KSLKEKVNGEALKEKENK

SEQ ID NO: 3266608 - protein, 39 aa, Plasmodium falciparum
KSLKYIFKLDVENICILLFKYGYKFIKYYPQLTIYLLKK

SEQ ID NO: 3266609 - protein, 22 aa, Plasmodium falciparum
KSLLKNNFICLSYEEEENLLSE

SEQ ID NO: 3266610 - protein, 18 aa, Plasmodium falciparum
KSLLKYVNYYIYTRNDKL

SEQ ID NO: 3266611 - protein, 18 aa, Plasmodium falciparum
KSLLLDRYHYLLNEAKGN

SEQ ID NO: 3266612 - protein, 30 aa, Plasmodium falciparum
KSLLQYLSVYEGIPLYNIITTKIKIIEIDD

SEQ ID NO: 3266613 - protein, 21 aa, Plasmodium falciparum
KSLLTHFFKAYVIQGKTFENV

SEQ ID NO: 3266614 - protein, 24 aa, Plasmodium falciparum
KSLNSRDLFSYPLTIKMPSYVKIN

SEQ ID NO: 3266615 - protein, 29 aa, Plasmodium falciparum
KSLNVWKYGLKVSLEIIEYVSNEMFALAK

SEQ ID NO: 3266616 - protein, 19 aa, Plasmodium falciparum
KSLPEAFHLAKGDSKKDEM

SEQ ID NO: 3266617 - protein, 21 aa, Plasmodium falciparum
KSLQILAGHFIWVFCSYLTFR

SEQ ID NO: 3266618 - protein, 25 aa, Plasmodium falciparum
KSLSIMCNEHFFSFYMNKINVKNMY

SEQ ID NO: 3266619 - protein, 19 aa, Plasmodium falciparum
KSLSLALNYVCMIISLDHL

SEQ ID NO: 3266620 - protein, 18 aa, Plasmodium falciparum
KSLSTYGIVVLKNVLPKE

SEQ ID NO: 3266621 - protein, 21 aa, Plasmodium falciparum
KSLTPAIIWRSNIEEDESNDE

SEQ ID NO: 3266622 - protein, 25 aa, Plasmodium falciparum
KSLVLKRIGNRKVYNKKRKSITSRV

SEQ ID NO: 3266623 - protein, 18 aa, Plasmodium falciparum
KSLVTFYFKSDVNYKINE

SEQ ID NO: 3266624 - protein, 18 aa, Plasmodium falciparum
KSLYCFSFILNSMNEKIE

SEQ ID NO: 3266625 - protein, 20 aa, Plasmodium falciparum
KSLYIFNLIFFLTFLLLLDV

SEQ ID NO: 3266626 - protein, 22 aa, Plasmodium falciparum
KSMDFDGIYPPVKYLLNTLKFY

SEQ ID NO: 3266627 - protein, 20 aa, Plasmodium falciparum
KSMFFLLFVFFLKRKYDRKE

SEQ ID NO: 3266628 - protein, 30 aa, Plasmodium falciparum
KSMKCKDFICSTCLCIFSSNNHFVKLYNCF

SEQ ID NO: 3266629 - protein, 18 aa, Plasmodium falciparum
KSMQWPVILDLLVPSFSR

SEQ ID NO: 3266630 - protein, 17 aa, Plasmodium falciparum
KSMTIIFNLNEQVLYKE

SEQ ID NO: 3266631 - protein, 20 aa, Plasmodium falciparum
KSNCPYGLKCVGNKCEYLQS

SEQ ID NO: 3266632 - protein, 18 aa, Plasmodium falciparum
KSNESFDTFLTNDHNENG

SEQ ID NO: 3266633 - protein, 23 aa, Plasmodium falciparum
KSNFKHLLLCNDISYIKKSTNNH

SEQ ID NO: 3266634 - protein, 24 aa, Plasmodium falciparum
KSNFLKIYGCDFVGEFSTHFLFSK

SEQ ID NO: 3266635 - protein, 21 aa, Plasmodium falciparum
KSNIFCKSFLLSMEEKDNIKN

SEQ ID NO: 3266636 - protein, 17 aa, Plasmodium falciparum
KSNIIGYTYNRGTIGSC

SEQ ID NO: 3266637 - protein, 19 aa, Plasmodium falciparum
KSNIMSLFFGEKKKKKYLE

SEQ ID NO: 3266638 - protein, 21 aa, Plasmodium falciparum
KSNKINALFNIPKRLSSLIYP

SEQ ID NO: 3266639 - protein, 20 aa, Plasmodium falciparum
KSNKMKSLTYFKSIKNEFKK

SEQ ID NO: 3266640 - protein, 22 aa, Plasmodium falciparum
KSNLTLRIDRGMAATAKHIAHT

SEQ ID NO: 3266641 - protein, 17 aa, Plasmodium falciparum
KSNRPNFKLTRSLSFNI

SEQ ID NO: 3266642 - protein, 41 aa, Plasmodium falciparum
KSNSFYVSESFIIKEILMILSLNCPIKFKNNFYMNCSDFLF

SEQ ID NO: 3266643 - protein, 30 aa, Plasmodium falciparum
KSNYLIKNCKFVFNFLSKVLINSCNQNLNT

SEQ ID NO: 3266644 - protein, 24 aa, Plasmodium falciparum
KSPEVFEYLEFAYLNCLELFKKVY

SEQ ID NO: 3266645 - protein, 25 aa, Plasmodium falciparum
KSPFSKFILEAVGWTYENVGNIYME

SEQ ID NO: 3266646 - protein, 24 aa, Plasmodium falciparum
KSPFYFSRKFKLFISVGAKNSANI

SEQ ID NO: 3266647 - protein, 25 aa, Plasmodium falciparum
KSPIERRKQIISQRMAELKKIENPY

SEQ ID NO: 3266648 - protein, 20 aa, Plasmodium falciparum
KSPLFPNMVFIGSRESTIIN

SEQ ID NO: 3266649 - protein, 19 aa, Plasmodium falciparum
KSPNICFYSSLDTYENLYE

SEQ ID NO: 3266650 - protein, 25 aa, Plasmodium falciparum
KSQKIRIANKIFTFNGQKLYSHKIL

SEQ ID NO: 3266651 - protein, 26 aa, Plasmodium falciparum
KSRKNFKRKCMKKRDIRHLYQIDKLQ

SEQ ID NO: 3266652 - protein, 20 aa, Plasmodium falciparum
KSRLSSEIVKIFSAKCKNVI

SEQ ID NO: 3266653 - protein, 19 aa, Plasmodium falciparum
KSRQKWSRLEFVYGNHVIV

SEQ ID NO: 3266654 - protein, 21 aa, Plasmodium falciparum
KSRSLSIFYFNAFPVFIQFLN

SEQ ID NO: 3266655 - protein, 18 aa, Plasmodium falciparum
KSRVVEYEVVPKIVTTKD

SEQ ID NO: 3266656 - protein, 23 aa, Plasmodium falciparum
KSRYKEVGEFLGLLNNETTCTKK

SEQ ID NO: 3266657 - protein, 23 aa, Plasmodium falciparum
KSSEHILTLTLSLMICISILCNY

SEQ ID NO: 3266658 - protein, 25 aa, Plasmodium falciparum
KSSELELFKSMIIPFNATVEQYNKD

SEQ ID NO: 3266659 - protein, 18 aa, Plasmodium falciparum
KSSFIYKLKNTKIITKLF

SEQ ID NO: 3266660 - protein, 18 aa, Plasmodium falciparum
KSSGITYAVLKTFKYYLS

SEQ ID NO: 3266661 - protein, 17 aa, Plasmodium falciparum
KSSILFYTKCIVILLVL

SEQ ID NO: 3266662 - protein, 20 aa, Plasmodium falciparum
KSSILLFQFKCLDPCRTNNE

SEQ ID NO: 3266663 - protein, 20 aa, Plasmodium falciparum
KSSINFFPLLVFDFQSLYPS

SEQ ID NO: 3266664 - protein, 19 aa, Plasmodium falciparum
KSSKGMVLLKGLKNVDKLN

SEQ ID NO: 3266665 - protein, 25 aa, Plasmodium falciparum
KSSKRIIALNSEWIFLKFSDKNLEA

SEQ ID NO: 3266666 - protein, 29 aa, Plasmodium falciparum
KSSKVYIWMYLYVNFVFDFFYVNIKKNYR

SEQ ID NO: 3266667 - protein, 21 aa, Plasmodium falciparum
KSSLAQSNFFLGLKQDDDAQK

SEQ ID NO: 3266668 - protein, 19 aa, Plasmodium falciparum
KSSLSLIKLFVIFEIKEML

SEQ ID NO: 3266669 - protein, 17 aa, Plasmodium falciparum
KSSNFVMSTNDNVNFDM

SEQ ID NO: 3266670 - protein, 23 aa, Plasmodium falciparum
KSSNVNGIYFYNSVFKLIQNGTF

SEQ ID NO: 3266671 - protein, 21 aa, Plasmodium falciparum
KSSRCNNRIFQLINDVNKNTF

SEQ ID NO: 3266672 - protein, 20 aa, Plasmodium falciparum
KSSVITFLMDHYFRHELYIL

SEQ ID NO: 3266673 - protein, 20 aa, Plasmodium falciparum
KSSYLYEIILGTLFFAYILY

SEQ ID NO: 3266674 - protein, 19 aa, Plasmodium falciparum
KSTAIKWSLSIEVGGSDID

SEQ ID NO: 3266675 - protein, 24 aa, Plasmodium falciparum
KSTCESCPIGTFWNSEKLLCENCQ

SEQ ID NO: 3266676 - protein, 21 aa, Plasmodium falciparum
KSTCVPKFLLEENIRENKKIN

SEQ ID NO: 3266677 - protein, 21 aa, Plasmodium falciparum
KSTFLRNFIRYLLKINENKDI

SEQ ID NO: 3266678 - protein, 18 aa, Plasmodium falciparum
KSTGKRCLLTNGQEVNEN

SEQ ID NO: 3266679 - protein, 18 aa, Plasmodium falciparum
KSTGVCFVSFIDTKSVHD

SEQ ID NO: 3266680 - protein, 24 aa, Plasmodium falciparum
KSTLWKLLTCNFSYEGNIFIDNLN

SEQ ID NO: 3266681 - protein, 23 aa, Plasmodium falciparum
KSTMPINLYSFLHLKKNTIFKYL

SEQ ID NO: 3266682 - protein, 18 aa, Plasmodium falciparum
KSVCDLYTLIKINIIDDF

SEQ ID NO: 3266683 - protein, 26 aa, Plasmodium falciparum
KSVFKKLIKKIECDMNIKKRCYKLYD

SEQ ID NO: 3266684 - protein, 19 aa, Plasmodium falciparum
KSVGNFICIKGCPINEKSI

SEQ ID NO: 3266685 - protein, 21 aa, Plasmodium falciparum
KSVHARIYYYDNIMNPNNKRN

SEQ ID NO: 3266686 - protein, 21 aa, Plasmodium falciparum
KSVIENVHLSLSYSLNSIDKI

SEQ ID NO: 3266687 - protein, 20 aa, Plasmodium falciparum
KSVKGLHLIGSPRLLNNVDH

SEQ ID NO: 3266688 - protein, 19 aa, Plasmodium falciparum
KSVKRLNSFTKNKTMNIDF

SEQ ID NO: 3266689 - protein, 21 aa, Plasmodium falciparum
KSVLLLLFVCFHFIIFHYFFY

SEQ ID NO: 3266690 - protein, 31 aa, Plasmodium falciparum
KSVRTHLVLSIRDAVKWISFMNTYINNKKIT

SEQ ID NO: 3266691 - protein, 20 aa, Plasmodium falciparum
KSVSALDCLCIKGYGRIIIN

SEQ ID NO: 3266692 - protein, 19 aa, Plasmodium falciparum
KSVTKEIVDEVSRTEEIVE

SEQ ID NO: 3266693 - protein, 30 aa, Plasmodium falciparum
KSWNAYPYLKTVYESSGFPKAKIQVESAHF

SEQ ID NO: 3266694 - protein, 31 aa, Plasmodium falciparum
KSYAEGCKWKYGKMPLGLGWLCNDKEGEKGK

SEQ ID NO: 3266695 - protein, 40 aa, Plasmodium falciparum
KSYDCKKELFSFIQYNSFFWYILYKQYNMFLTYYDMTNHC

SEQ ID NO: 3266696 - protein, 23 aa, Plasmodium falciparum
KSYEVKRISSIILNSKKSKPFNI

SEQ ID NO: 3266697 - protein, 35 aa, Plasmodium falciparum
KSYFYKIKKIFSLFYFDFFVCIINENISLEQGMDF

SEQ ID NO: 3266698 - protein, 19 aa, Plasmodium falciparum
KSYILNYINYFFSFGKYGI

SEQ ID NO: 3266699 - protein, 20 aa, Plasmodium falciparum
KSYIYRNMFDFVKVISKKYM

SEQ ID NO: 3266700 - protein, 25 aa, Plasmodium falciparum
KSYKFPYKCHQIICCENKLIIDSIV

SEQ ID NO: 3266701 - protein, 19 aa, Plasmodium falciparum
KSYLFDIYTSLSLFFFILS

SEQ ID NO: 3266702 - protein, 19 aa, Plasmodium falciparum
KSYLRYMYDTSKNFLENYM

SEQ ID NO: 3266703 - protein, 19 aa, Plasmodium falciparum
KSYPYGINLIIGIFLTFLG

SEQ ID NO: 3266704 - protein, 21 aa, Plasmodium falciparum
KSYRNIFSYIFQKIKRKRKQN

SEQ ID NO: 3266705 - protein, 20 aa, Plasmodium falciparum
KSYSTFCGCGYNLQNELNKN

SEQ ID NO: 3266706 - protein, 18 aa, Plasmodium falciparum
KSYTCTNNDLSLVNNTIC

SEQ ID NO: 3266707 - protein, 27 aa, Plasmodium falciparum
KTALMSSTILWMVGIGFAALTYFLLKK

SEQ ID NO: 3266708 - protein, 19 aa, Plasmodium falciparum
KTCECFQKWVVQKGKEWDE

SEQ ID NO: 3266709 - protein, 22 aa, Plasmodium falciparum
KTCELKEICYLLNYINKDHFIN

SEQ ID NO: 3266710 - protein, 24 aa, Plasmodium falciparum
KTCLKCGGILGGGIAPGWSLVSGL

SEQ ID NO: 3266711 - protein, 22 aa, Plasmodium falciparum
KTCLKCGGILGGGVEPTVGLLG

SEQ ID NO: 3266712 - protein, 23 aa, Plasmodium falciparum
KTCLRCGGVFGGGVMPGFGAIGG

SEQ ID NO: 3266713 - protein, 30 aa, Plasmodium falciparum
KTCLRCGSVFGGGITPGWGLISGLGYVGWT

SEQ ID NO: 3266714 - protein, 18 aa, Plasmodium falciparum
KTCNQCLNLSQFKDINDE

SEQ ID NO: 3266715 - protein, 20 aa, Plasmodium falciparum
KTCYYHIKYIQEINKCIIFT

SEQ ID NO: 3266716 - protein, 19 aa, Plasmodium falciparum
KTDETFGSLQSHKIKKYNK

SEQ ID NO: 3266717 - protein, 28 aa, Plasmodium falciparum
KTDLSYIYLKICDCFIKQTNKNFMTKSR

SEQ ID NO: 3266718 - protein, 17 aa, Plasmodium falciparum
KTEEIYNILTIYQDNHI

SEQ ID NO: 3266719 - protein, 25 aa, Plasmodium falciparum
KTEKFCLNCGFGLGSGVLQSLGLFG

SEQ ID NO: 3266720 - protein, 21 aa, Plasmodium falciparum
KTELKLNDFFIYKMPMKSMKI

SEQ ID NO: 3266721 - protein, 23 aa, Plasmodium falciparum
KTELYKIFNVWYYKKALYMNEYR

SEQ ID NO: 3266722 - protein, 47 aa, Plasmodium falciparum
KTETFNKWSKQHWNKLDNWKEEKWFKLFKRDLKIDMRNTYESDQNDE

SEQ ID NO: 3266723 - protein, 17 aa, Plasmodium falciparum
KTFCSFCTYIISLLHYE

SEQ ID NO: 3266724 - protein, 17 aa, Plasmodium falciparum
KTFDFYPTKGFEPCGGL

SEQ ID NO: 3266725 - protein, 17 aa, Plasmodium falciparum
KTFEFLNNLLLSIDVGN

SEQ ID NO: 3266726 - protein, 19 aa, Plasmodium falciparum
KTFEVYIYYFLIFFNSTII

SEQ ID NO: 3266727 - protein, 18 aa, Plasmodium falciparum
KTFFKIAPFNFFREETQE

SEQ ID NO: 3266728 - protein, 21 aa, Plasmodium falciparum
KTFFYFMFYNKIYLFEIGNID

SEQ ID NO: 3266729 - protein, 33 aa, Plasmodium falciparum
KTFHDFFYFWIRRFLNDSMYWRGKVNSCINKSK

SEQ ID NO: 3266730 - protein, 26 aa, Plasmodium falciparum
KTFHDFFYYWVAHMLKDSIHWKKKLQ

SEQ ID NO: 3266731 - protein, 28 aa, Plasmodium falciparum
KTFHDFFYYWVAHMLKDSIHWRTKKLDK

SEQ ID NO: 3266732 - protein, 18 aa, Plasmodium falciparum
KTFMSLTCTEGNTIAFGF

SEQ ID NO: 3266733 - protein, 33 aa, Plasmodium falciparum
KTFNDFFYFWIRRFLNDSMYWRGKVERCLKNKS

SEQ ID NO: 3266734 - protein, 27 aa, Plasmodium falciparum
KTFNEFFYFWIGRFLNDSMYWRGKVGG

SEQ ID NO: 3266735 - protein, 27 aa, Plasmodium falciparum
KTFNPFFYYWVAHMLKDSIHWKKKLEK

SEQ ID NO: 3266736 - protein, 28 aa, Plasmodium falciparum
KTFNPFFYYWVVHMLKDSIHWRTKKLDK

SEQ ID NO: 3266737 - protein, 36 aa, Plasmodium falciparum
KTFTPWYRFIFLLLGVFFLYVWKLESSLSQLWNMPS

SEQ ID NO: 3266738 - protein, 23 aa, Plasmodium falciparum
KTFWREIYKNYKNIYIIIRDYMI

SEQ ID NO: 3266739 - protein, 28 aa, Plasmodium falciparum
KTFYDFFTYWVAHMLKDSIHWRTEKLDK

SEQ ID NO: 3266740 - protein, 28 aa, Plasmodium falciparum
KTFYDFFYYWVAHMLKDSIHWRTRRLRK

SEQ ID NO: 3266741 - protein, 27 aa, Plasmodium falciparum
KTFYDFFYYWVAHMLKDSIYWRTKKLD

SEQ ID NO: 3266742 - protein, 25 aa, Plasmodium falciparum
KTFYTYRIVMLLLFIHVLALLLNDF

SEQ ID NO: 3266743 - protein, 22 aa, Plasmodium falciparum
KTFYYNREQLIMFRHSLCNLLN

SEQ ID NO: 3266744 - protein, 17 aa, Plasmodium falciparum
KTHFLNIMDPSMLFDIQ

SEQ ID NO: 3266745 - protein, 20 aa, Plasmodium falciparum
KTHRSLCECELYAPSDYDND

SEQ ID NO: 3266746 - protein, 20 aa, Plasmodium falciparum
KTHRTLCECELYAPSKYEND

SEQ ID NO: 3266747 - protein, 26 aa, Plasmodium falciparum
KTICSKRNNISFIYLYDYLLIMTLNE

SEQ ID NO: 3266748 - protein, 24 aa, Plasmodium falciparum
KTIFERRYMNILSYLCPPNKRSFE

SEQ ID NO: 3266749 - protein, 26 aa, Plasmodium falciparum
KTIFKCTHCIFSFKRNIIYPTLFSTK

SEQ ID NO: 3266750 - protein, 18 aa, Plasmodium falciparum
KTIFSFSSITYFYHFFIN

SEQ ID NO: 3266751 - protein, 18 aa, Plasmodium falciparum
KTIKMMKLYIRNLFMKYI

SEQ ID NO: 3266752 - protein, 17 aa, Plasmodium falciparum
KTILAAPILDKNDEVVG

SEQ ID NO: 3266753 - protein, 30 aa, Plasmodium falciparum
KTINELRRIISFFLIYSIVFSIVYEVKNNV

SEQ ID NO: 3266754 - protein, 25 aa, Plasmodium falciparum
KTIREVLSIICVLGLNINGEPKENK

SEQ ID NO: 3266755 - protein, 18 aa, Plasmodium falciparum
KTIREWDDKINLLNDDIK

SEQ ID NO: 3266756 - protein, 19 aa, Plasmodium falciparum
KTIVKRKISYIIDEDKHVQ

SEQ ID NO: 3266757 - protein, 21 aa, Plasmodium falciparum
KTIYFFNLFLNYACSHFQFKY

SEQ ID NO: 3266758 - protein, 27 aa, Plasmodium falciparum
KTIYIIDMILCLKEQIPYLSRIYIYEN

SEQ ID NO: 3266759 - protein, 20 aa, Plasmodium falciparum
KTIYVHGWGNVNIKEAIDKL

SEQ ID NO: 3266760 - protein, 18 aa, Plasmodium falciparum
KTKCLHIYNSFDILNNYL

SEQ ID NO: 3266761 - protein, 23 aa, Plasmodium falciparum
KTKDEILHLFDLYVDILKVIPHN

SEQ ID NO: 3266762 - protein, 18 aa, Plasmodium falciparum
KTKELFILSNYIRDHMIQ

SEQ ID NO: 3266763 - protein, 27 aa, Plasmodium falciparum
KTKERIMNINILFILHLFIMIVYCSEI

SEQ ID NO: 3266764 - protein, 24 aa, Plasmodium falciparum
KTKIKYIILKGCKQMENVRIIHPL

SEQ ID NO: 3266765 - protein, 23 aa, Plasmodium falciparum
KTKIKYLFCYYIYPLFISNYCHF

SEQ ID NO: 3266766 - protein, 26 aa, Plasmodium falciparum
KTKILRQTYRLVFSKINFFDENIVNL

SEQ ID NO: 3266767 - protein, 22 aa, Plasmodium falciparum
KTKISVPLFFSPFFTKGVNKNE

SEQ ID NO: 3266768 - protein, 18 aa, Plasmodium falciparum
KTKKIWNYILDTYIEERV

SEQ ID NO: 3266769 - protein, 22 aa, Plasmodium falciparum
KTKKRPFLSITFNEKQNRPVNR

SEQ ID NO: 3266770 - protein, 19 aa, Plasmodium falciparum
KTKMIITYCYKSCIFLNLL

SEQ ID NO: 3266771 - protein, 24 aa, Plasmodium falciparum
KTKMVCNFFLYKYPIIYHLYSNKL

SEQ ID NO: 3266772 - protein, 27 aa, Plasmodium falciparum
KTKNKCKIDDNWFCSIIQGYISYTSIE

SEQ ID NO: 3266773 - protein, 19 aa, Plasmodium falciparum
KTKRGRNMYRWDHKCTGCF

SEQ ID NO: 3266774 - protein, 25 aa, Plasmodium falciparum
KTKSINCKKCFFKPILFPFNEELLN

SEQ ID NO: 3266775 - protein, 26 aa, Plasmodium falciparum
KTKSSACAYLALWLVNIVKYNEVYKK

SEQ ID NO: 3266776 - protein, 22 aa, Plasmodium falciparum
KTLCNNYFHLCFPILECKILTK

SEQ ID NO: 3266777 - protein, 27 aa, Plasmodium falciparum
KTLFFFFIKRMNNVILEIKTKFKRKDF

SEQ ID NO: 3266778 - protein, 23 aa, Plasmodium falciparum
KTLLKYCNIFLYEINWEDKNNSY

SEQ ID NO: 3266779 - protein, 18 aa, Plasmodium falciparum
KTLLLWGCVGVLVAYLPT

SEQ ID NO: 3266780 - protein, 19 aa, Plasmodium falciparum
KTLLNEMIHMYHLKGSYQS

SEQ ID NO: 3266781 - protein, 18 aa, Plasmodium falciparum
KTLMIYVISKMVLKNVNN

SEQ ID NO: 3266782 - protein, 32 aa, Plasmodium falciparum
KTLTFLLSHLSLIFPSLFNFYPNTFVLPENKN

SEQ ID NO: 3266783 - protein, 18 aa, Plasmodium falciparum
KTLYCKKKGKNKKGNTNK

SEQ ID NO: 3266784 - protein, 21 aa, Plasmodium falciparum
KTLYYLYNVNYCFNDQNNNNN

SEQ ID NO: 3266785 - protein, 19 aa, Plasmodium falciparum
KTMKRRLFENILYQEMSFF

SEQ ID NO: 3266786 - protein, 24 aa, Plasmodium falciparum
KTNCIKDKYILKSFFEEYIEKIYT

SEQ ID NO: 3266787 - protein, 19 aa, Plasmodium falciparum
KTNGEHIWNAMVCALTYNE

SEQ ID NO: 3266788 - protein, 21 aa, Plasmodium falciparum
KTNIFDVFLFLKNIGYKNVQK

SEQ ID NO: 3266789 - protein, 27 aa, Plasmodium falciparum
KTNKYKLLRIIILEAFDSLNEYYRKNF

SEQ ID NO: 3266790 - protein, 23 aa, Plasmodium falciparum
KTNMIRPLINLVYRKINRKQKVR

SEQ ID NO: 3266791 - protein, 19 aa, Plasmodium falciparum
KTNNCLHVPFLNTENYKEN

SEQ ID NO: 3266792 - protein, 29 aa, Plasmodium falciparum
KTNQIVFSWNEGQSWFDFELGQFSIDVDN

SEQ ID NO: 3266793 - protein, 20 aa, Plasmodium falciparum
KTNSISLIICMCYIMYIKKY

SEQ ID NO: 3266794 - protein, 18 aa, Plasmodium falciparum
KTNTKWQFSQSIMIKENL

SEQ ID NO: 3266795 - protein, 25 aa, Plasmodium falciparum
KTNVKCTFYYIYIYFFFMNKNKSGG

SEQ ID NO: 3266796 - protein, 21 aa, Plasmodium falciparum
KTPKLIVFARLLLKNEKILNL

SEQ ID NO: 3266797 - protein, 29 aa, Plasmodium falciparum
KTPTQGKCRCIDFSVPTYFDYVPQYLRWF

SEQ ID NO: 3266798 - protein, 19 aa, Plasmodium falciparum
KTQTCPFSNLLQYKIICDK

SEQ ID NO: 3266799 - protein, 25 aa, Plasmodium falciparum
KTRKICITKENFKHIFILENVDIIA

SEQ ID NO: 3266800 - protein, 29 aa, Plasmodium falciparum
KTRTYDVCFILSFILQMIYPFIIKYFYDK

SEQ ID NO: 3266801 - protein, 17 aa, Plasmodium falciparum
KTSCSALYKKVKKGKNK

SEQ ID NO: 3266802 - protein, 20 aa, Plasmodium falciparum
KTSEDMLIYMNFLNKIKMEK

SEQ ID NO: 3266803 - protein, 17 aa, Plasmodium falciparum
KTSICLLLKRLTLTYFY

SEQ ID NO: 3266804 - protein, 20 aa, Plasmodium falciparum
KTSKIEKVWLLPKKKNIEHV

SEQ ID NO: 3266805 - protein, 21 aa, Plasmodium falciparum
KTSKKFIPRDLSDFWKSIIQT

SEQ ID NO: 3266806 - protein, 24 aa, Plasmodium falciparum
KTSKNVYYPISYYSFFYGSIIDML

SEQ ID NO: 3266807 - protein, 26 aa, Plasmodium falciparum
KTSNILRNYSTFFFYKNYEHYIQYIV

SEQ ID NO: 3266808 - protein, 18 aa, Plasmodium falciparum
KTSPKFYDITSFFKPSSK

SEQ ID NO: 3266809 - protein, 41 aa, Plasmodium falciparum
KTSPYNIFLFLKLCTEYKYLEKLKIFTLDTFIKKINKHMIN

SEQ ID NO: 3266810 - protein, 20 aa, Plasmodium falciparum
KTSRHEILYCYEHQYMHGTY

SEQ ID NO: 3266811 - protein, 19 aa, Plasmodium falciparum
KTSSLYLEIELLYNEHVFL

SEQ ID NO: 3266812 - protein, 19 aa, Plasmodium falciparum
KTSTWGRETYIIILFHTLM

SEQ ID NO: 3266813 - protein, 17 aa, Plasmodium falciparum
KTTALKVAIEAAKEAGA

SEQ ID NO: 3266814 - protein, 35 aa, Plasmodium falciparum
KTTGIKTKCMFPSCSTYFHIYCYYNKYMQHVRKKK

SEQ ID NO: 3266815 - protein, 24 aa, Plasmodium falciparum
KTTHRVHVWFLMFDDCYDNFIRNL

SEQ ID NO: 3266816 - protein, 21 aa, Plasmodium falciparum
KTTICEFFISYMIRKKNIFFF

SEQ ID NO: 3266817 - protein, 25 aa, Plasmodium falciparum
KTTTKSLCYKDFFDDLIEIKKYINI

SEQ ID NO: 3266818 - protein, 20 aa, Plasmodium falciparum
KTVQYCLINIYEIIKNKIFY

SEQ ID NO: 3266819 - protein, 22 aa, Plasmodium falciparum
KTWDIVPLKIFIIFVKLLYPFC

SEQ ID NO: 3266820 - protein, 19 aa, Plasmodium falciparum
KTYELILIQIFFTYFEIKY

SEQ ID NO: 3266821 - protein, 23 aa, Plasmodium falciparum
KTYELYQKYLIILLYIFKLIEYS

SEQ ID NO: 3266822 - protein, 20 aa, Plasmodium falciparum
KTYFKYNIMLSILALFKTIF

SEQ ID NO: 3266823 - protein, 24 aa, Plasmodium falciparum
KTYFSCLFLFLVLSFLYVIFRIYM

SEQ ID NO: 3266824 - protein, 21 aa, Plasmodium falciparum
KTYGICLLILFGLLPILMTKF

SEQ ID NO: 3266825 - protein, 22 aa, Plasmodium falciparum
KTYGSDCLRLHILFLGPVDQNK

SEQ ID NO: 3266826 - protein, 19 aa, Plasmodium falciparum
KTYKDMHIILHFLNFQIFI

SEQ ID NO: 3266827 - protein, 17 aa, Plasmodium falciparum
KTYKEYINFDGSEYIYI

SEQ ID NO: 3266828 - protein, 20 aa, Plasmodium falciparum
KTYLGYLKFFVIDNKRPFHE

SEQ ID NO: 3266829 - protein, 20 aa, Plasmodium falciparum
KTYLTNIMKLQIEQIKNETI

SEQ ID NO: 3266830 - protein, 33 aa, Plasmodium falciparum
KTYLVPTAFRKKYWWRVHYMLTEEVVKRERTDN

SEQ ID NO: 3266831 - protein, 19 aa, Plasmodium falciparum
KTYSICILQDFSYITPNIL

SEQ ID NO: 3266832 - protein, 20 aa, Plasmodium falciparum
KTYVHKFLHFCLNEIKNAFF

SEQ ID NO: 3266833 - protein, 21 aa, Plasmodium falciparum
KTYYLIAILIWFILISVVLSR

SEQ ID NO: 3266834 - protein, 18 aa, Plasmodium falciparum
KVADSCISYFLKNATNEK

SEQ ID NO: 3266835 - protein, 25 aa, Plasmodium falciparum
KVAELLKDRLDLYIDNEDEWKKLME

SEQ ID NO: 3266836 - protein, 17 aa, Plasmodium falciparum
KVAIFYTLFEAIIYSFL

SEQ ID NO: 3266837 - protein, 22 aa, Plasmodium falciparum
KVCLRCGSILGAAMPEVGSIGG

SEQ ID NO: 3266838 - protein, 22 aa, Plasmodium falciparum
KVCMLSFGCFNSLALNVKGDVY

SEQ ID NO: 3266839 - protein, 25 aa, Plasmodium falciparum
KVDALKYSPKWLRLLSDVCFQNQHD

SEQ ID NO: 3266840 - protein, 19 aa, Plasmodium falciparum
KVDDQSCWIIAKSDDDAKN

SEQ ID NO: 3266841 - protein, 23 aa, Plasmodium falciparum
KVDKEYMKVFLFVNNSQKYCEKD

SEQ ID NO: 3266842 - protein, 27 aa, Plasmodium falciparum
KVDLVSFFYLFLSNYFSAYVKDENINK

SEQ ID NO: 3266843 - protein, 19 aa, Plasmodium falciparum
KVDSLIFLTYLMKNIFSLI

SEQ ID NO: 3266844 - protein, 24 aa, Plasmodium falciparum
KVEFLRIIGNIYFQIEKYKYSAIT

SEQ ID NO: 3266845 - protein, 26 aa, Plasmodium falciparum
KVEKGCLICGCGLGSVAGSVGIFGTV

SEQ ID NO: 3266846 - protein, 33 aa, Plasmodium falciparum
KVEKVCLICACGLGGGVAPVWGLVSGLWYVKWS

SEQ ID NO: 3266847 - protein, 23 aa, Plasmodium falciparum
KVELCYNAGVVFIKCFLQYNDIN

SEQ ID NO: 3266848 - protein, 19 aa, Plasmodium falciparum
KVELLKAFVESAAVETFFL

SEQ ID NO: 3266849 - protein, 26 aa, Plasmodium falciparum
KVETGCLKYGCGLGGVAGSVGIFGTV

SEQ ID NO: 3266850 - protein, 26 aa, Plasmodium falciparum
KVETGCLKYGCGLGGVAGSVGLFGGF

SEQ ID NO: 3266851 - protein, 52 aa, Plasmodium falciparum
KVFEHAFLSTVLYSTFPLLVMELFVSIAYTCLKKKKKGYIEKQLKELKIAID

SEQ ID NO: 3266852 - protein, 18 aa, Plasmodium falciparum
KVFFFKISLILKLIWFLY

SEQ ID NO: 3266853 - protein, 30 aa, Plasmodium falciparum
KVFIFLYKRIYPIWFPLSWGGEQDLGPDNQ

SEQ ID NO: 3266854 - protein, 20 aa, Plasmodium falciparum
KVFILLKCLLSFSMYLILVM

SEQ ID NO: 3266855 - protein, 26 aa, Plasmodium falciparum
KVGKIPPDFLRLMFYTLGDYRDILFS

SEQ ID NO: 3266856 - protein, 19 aa, Plasmodium falciparum
KVGSILCMKFFYNSEKKKI

SEQ ID NO: 3266857 - protein, 17 aa, Plasmodium falciparum
KVHKCLKTNFYHLKDQC

SEQ ID NO: 3266858 - protein, 18 aa, Plasmodium falciparum
KVIIGRSGLVGEDGATHQ

SEQ ID NO: 3266859 - protein, 18 aa, Plasmodium falciparum
KVIKELCVSNNLKRNFNE

SEQ ID NO: 3266860 - protein, 30 aa, Plasmodium falciparum
KVIKIHIIHFVFKIWIYQYASIMLLSNENI

SEQ ID NO: 3266861 - protein, 17 aa, Plasmodium falciparum
KVINRWLNNDIYNVYYP

SEQ ID NO: 3266862 - protein, 30 aa, Plasmodium falciparum
KVIPGKWEGNGLLGIHISYEFLNALNEGVR

SEQ ID NO: 3266863 - protein, 24 aa, Plasmodium falciparum
KVIQRKLRIYHWVKKYVQNDLIQK

SEQ ID NO: 3266864 - protein, 24 aa, Plasmodium falciparum
KVIYDIIKMFFLHNKLYIISLYYT

SEQ ID NO: 3266865 - protein, 17 aa, Plasmodium falciparum
KVIYMDKLTKCFYNNNN

SEQ ID NO: 3266866 - protein, 17 aa, Plasmodium falciparum
KVKCFVMAILNNLTNNL

SEQ ID NO: 3266867 - protein, 23 aa, Plasmodium falciparum
KVKELFIHFKNFILLNFGTHINF

SEQ ID NO: 3266868 - protein, 18 aa, Plasmodium falciparum
KVKKCSRYFFNKNKYIYI

SEQ ID NO: 3266869 - protein, 19 aa, Plasmodium falciparum
KVKKKGVTFMDELEEDKKF

SEQ ID NO: 3266870 - protein, 23 aa, Plasmodium falciparum
KVKNRITPKIKYLYDEYGNIIEH

SEQ ID NO: 3266871 - protein, 22 aa, Plasmodium falciparum
KVKQEFLYHLPWDEGDQKYLSR

SEQ ID NO: 3266872 - protein, 27 aa, Plasmodium falciparum
KVLDELGSKCKICFQLTNDNMNDENST

SEQ ID NO: 3266873 - protein, 18 aa, Plasmodium falciparum
KVLFNLIFEFTKTPIKKR

SEQ ID NO: 3266874 - protein, 25 aa, Plasmodium falciparum
KVLHLYFKLLKEILLKEQTNIYNIE

SEQ ID NO: 3266875 - protein, 22 aa, Plasmodium falciparum
KVLIKFFQCFEQKLIYISNNIN

SEQ ID NO: 3266876 - protein, 17 aa, Plasmodium falciparum
KVLKGKRGISKEEIHDE

SEQ ID NO: 3266877 - protein, 24 aa, Plasmodium falciparum
KVLKKRYSDFVTFYDLLKNELLTK

SEQ ID NO: 3266878 - protein, 17 aa, Plasmodium falciparum
KVLKKVYIFFNFYERRI

SEQ ID NO: 3266879 - protein, 20 aa, Plasmodium falciparum
KVLLLFSLPLNILVTLHHVD

SEQ ID NO: 3266880 - protein, 17 aa, Plasmodium falciparum
KVLNCFLYRTFSNSCSY

SEQ ID NO: 3266881 - protein, 19 aa, Plasmodium falciparum
KVLNEFFVYLNYLISNKQN

SEQ ID NO: 3266882 - protein, 25 aa, Plasmodium falciparum
KVLNLKVFHIYNIFSKIIELYYERK

SEQ ID NO: 3266883 - protein, 25 aa, Plasmodium falciparum
KVLNPVLYMFKYFKPSYFNVKKIQC

SEQ ID NO: 3266884 - protein, 29 aa, Plasmodium falciparum
KVLNTLVFYYSFFYFFYIFFFNKKLYMNN

SEQ ID NO: 3266885 - protein, 28 aa, Plasmodium falciparum
KVLSKRKRALLKLKKISAAYNINTHHNW

SEQ ID NO: 3266886 - protein, 19 aa, Plasmodium falciparum
KVLVCCKGAFGVTALPPSI

SEQ ID NO: 3266887 - protein, 19 aa, Plasmodium falciparum
KVLVICLLLSLVNKSNDNT

SEQ ID NO: 3266888 - protein, 30 aa, Plasmodium falciparum
KVMKKHSQVTWCCRITLVIIFLMLVVLTSN

SEQ ID NO: 3266889 - protein, 24 aa, Plasmodium falciparum
KVNDCLKSSLDIVKYSFDIEKKKR

SEQ ID NO: 3266890 - protein, 19 aa, Plasmodium falciparum
KVNERTCVSFLKRRVEKKR

SEQ ID NO: 3266891 - protein, 17 aa, Plasmodium falciparum
KVNGYIMFVTAFISTLA

SEQ ID NO: 3266892 - protein, 18 aa, Plasmodium falciparum
KVNKCLHEKREIDDVSTN

SEQ ID NO: 3266893 - protein, 19 aa, Plasmodium falciparum
KVPIAFRLFHYIFLFILSS

SEQ ID NO: 3266894 - protein, 20 aa, Plasmodium falciparum
KVPLSFLIEMFYGYGKKEIL

SEQ ID NO: 3266895 - protein, 20 aa, Plasmodium falciparum
KVPRNIYFVNNFLKTDTGKI

SEQ ID NO: 3266896 - protein, 20 aa, Plasmodium falciparum
KVPYPNGIVYPLPLTDIHNS

SEQ ID NO: 3266897 - protein, 22 aa, Plasmodium falciparum
KVQHWLYRIWVKLRNPDLPLDD

SEQ ID NO: 3266898 - protein, 21 aa, Plasmodium falciparum
KVQLLGCNFIFDMKRRKEGLE

SEQ ID NO: 3266899 - protein, 21 aa, Plasmodium falciparum
KVREHEISFEIPKEAYILKIF

SEQ ID NO: 3266900 - protein, 29 aa, Plasmodium falciparum
KVREYTLYIFYNFCKHFFDIENLIIYQKE

SEQ ID NO: 3266901 - protein, 25 aa, Plasmodium falciparum
KVRHIAVSNESVWGIYQWCNLAKKK

SEQ ID NO: 3266902 - protein, 25 aa, Plasmodium falciparum
KVRKRKNDIGGRVRFRRYGKDSRNP

SEQ ID NO: 3266903 - protein, 19 aa, Plasmodium falciparum
KVRNYDIDKNFSFNTALSD

SEQ ID NO: 3266904 - protein, 20 aa, Plasmodium falciparum
KVRRLMKIKNNFQFIFNNHL

SEQ ID NO: 3266905 - protein, 19 aa, Plasmodium falciparum
KVRYCFNKEQVGYKEDDTL

SEQ ID NO: 3266906 - protein, 24 aa, Plasmodium falciparum
KVSHPIIMWSNNFVFSFSLFNKCI

SEQ ID NO: 3266907 - protein, 25 aa, Plasmodium falciparum
KVSLFFLLIFKYSYKNIVKKGRQDN

SEQ ID NO: 3266908 - protein, 17 aa, Plasmodium falciparum
KVTELIKYHYNYICMSE

SEQ ID NO: 3266909 - protein, 23 aa, Plasmodium falciparum
KVTENCFRYSFLSDLNNKYHTTI

SEQ ID NO: 3266910 - protein, 19 aa, Plasmodium falciparum
KVTYCKKNNLLLFQYYDGQ

SEQ ID NO: 3266911 - protein, 26 aa, Plasmodium falciparum
KVVDKKGLYLFNTISKWILKNINIFI

SEQ ID NO: 3266912 - protein, 18 aa, Plasmodium falciparum
KVVDLPIFDFFNEKVMDI

SEQ ID NO: 3266913 - protein, 27 aa, Plasmodium falciparum
KVVIKYKYILNHSIYFFKSCDNNIIII

SEQ ID NO: 3266914 - protein, 27 aa, Plasmodium falciparum
KVVIQLLCDYIYYLIFCKHDILCYKCM

SEQ ID NO: 3266915 - protein, 26 aa, Plasmodium falciparum
KVVKFLEDFKKDFLNNMLQSLNNLYD

SEQ ID NO: 3266916 - protein, 25 aa, Plasmodium falciparum
KVYCKHLAKIIYLICNKLEIKNFIT

SEQ ID NO: 3266917 - protein, 22 aa, Plasmodium falciparum
KVYDYCIVTVPIGVLKDSVRFF

SEQ ID NO: 3266918 - protein, 24 aa, Plasmodium falciparum
KVYFEILKKSFLKAEFFEKNKKKD

SEQ ID NO: 3266919 - protein, 17 aa, Plasmodium falciparum
KVYFLTCYHDFLRSNKF

SEQ ID NO: 3266920 - protein, 19 aa, Plasmodium falciparum
KVYIFFNFYERRIITLENE

SEQ ID NO: 3266921 - protein, 23 aa, Plasmodium falciparum
KVYIKEMFNNVNIMKNIEKKNKI

SEQ ID NO: 3266922 - protein, 22 aa, Plasmodium falciparum
KVYKAIYKYAFSHVISEFHKYQ

SEQ ID NO: 3266923 - protein, 18 aa, Plasmodium falciparum
KVYRACLILHVILAILQL

SEQ ID NO: 3266924 - protein, 26 aa, Plasmodium falciparum
KWCLKILNIFLYRSIHFDEMNDTWKI

SEQ ID NO: 3266925 - protein, 20 aa, Plasmodium falciparum
KWDFIRNKENGWGILENQKE

SEQ ID NO: 3266926 - protein, 17 aa, Plasmodium falciparum
KWEKEKCLYICNYNMYD

SEQ ID NO: 3266927 - protein, 18 aa, Plasmodium falciparum
KWGENGFMRLSRNKNGDN

SEQ ID NO: 3266928 - protein, 19 aa, Plasmodium falciparum
KWIDHYSIHMDNIIRPVTN

SEQ ID NO: 3266929 - protein, 23 aa, Plasmodium falciparum
KWIMPNYWYHYFTHFTVSSGPSI

SEQ ID NO: 3266930 - protein, 18 aa, Plasmodium falciparum
KWITTWVDVGSIFMTDVH

SEQ ID NO: 3266931 - protein, 19 aa, Plasmodium falciparum
KWLHHLNISYSLRNIKSAS

SEQ ID NO: 3266932 - protein, 18 aa, Plasmodium falciparum
KWLTFKIIRNIFVAHMMN

SEQ ID NO: 3266933 - protein, 17 aa, Plasmodium falciparum
KWLTNYIYFLIFLHMYK

SEQ ID NO: 3266934 - protein, 17 aa, Plasmodium falciparum
KWNDVIKEPCIDKKVKS

SEQ ID NO: 3266935 - protein, 20 aa, Plasmodium falciparum
KWRLHCRTTLEKFIEEKNLK

SEQ ID NO: 3266936 - protein, 26 aa, Plasmodium falciparum
KWRPKELYCNLFLLIFVILTIGCTYV

SEQ ID NO: 3266937 - protein, 18 aa, Plasmodium falciparum
KWRVNEMRLNTLIDELKY

SEQ ID NO: 3266938 - protein, 25 aa, Plasmodium falciparum
KWSNSGIHGKGKFKYEIEERDVLSE

SEQ ID NO: 3266939 - protein, 28 aa, Plasmodium falciparum
KWVQCDVCKFWIHLSCDKNESRNIETLS

SEQ ID NO: 3266940 - protein, 20 aa, Plasmodium falciparum
KWYDIKNVINIKCCEKKKFC

SEQ ID NO: 3266941 - protein, 20 aa, Plasmodium falciparum
KWYWFDLGYPTLMCLYEILK

SEQ ID NO: 3266942 - protein, 26 aa, Plasmodium falciparum
KYACRHMLKKYLLFRPNNYKEKNYNT

SEQ ID NO: 3266943 - protein, 21 aa, Plasmodium falciparum
KYAENILTHYTHYFDISVNED

SEQ ID NO: 3266944 - protein, 25 aa, Plasmodium falciparum
KYAKLKRGLQLSIFYEIYRMYNNIY

SEQ ID NO: 3266945 - protein, 21 aa, Plasmodium falciparum
KYALFCIKYFDKFCNIPDRPL

SEQ ID NO: 3266946 - protein, 28 aa, Plasmodium falciparum
KYCGTYYLAGFIYGLGLLQFFQNIKIYL

SEQ ID NO: 3266947 - protein, 25 aa, Plasmodium falciparum
KYCILKKKIKSIVFLGHHQNDNNET

SEQ ID NO: 3266948 - protein, 22 aa, Plasmodium falciparum
KYCQPCPLCGVERKGGSGWEEK

SEQ ID NO: 3266949 - protein, 22 aa, Plasmodium falciparum
KYCSRLSKYVFENRFSYKEKEF

SEQ ID NO: 3266950 - protein, 31 aa, Plasmodium falciparum
KYDELKYAKKRFLNRSIDKFIKEKKIKDKET

SEQ ID NO: 3266951 - protein, 20 aa, Plasmodium falciparum
KYDFISDIFISILLFGCLIE

SEQ ID NO: 3266952 - protein, 20 aa, Plasmodium falciparum
KYDFQFKLANFSINVYDDCK

SEQ ID NO: 3266953 - protein, 26 aa, Plasmodium falciparum
KYDGINPYPSWKCDKSLVDEDGVCMP

SEQ ID NO: 3266954 - protein, 39 aa, Plasmodium falciparum
KYDIFCEYNKACAYYFFKNLNFSISFIFFQKVNINIFFL

SEQ ID NO: 3266955 - protein, 18 aa, Plasmodium falciparum
KYDKAFPVDSYVRRFTTA

SEQ ID NO: 3266956 - protein, 18 aa, Plasmodium falciparum
KYDKDCRDFNYFIDDVKD

SEQ ID NO: 3266957 - protein, 24 aa, Plasmodium falciparum
KYDLKIILTHIEYPVTLYFIYLFN

SEQ ID NO: 3266958 - protein, 29 aa, Plasmodium falciparum
KYDLYTCSFHLFYYLKFLLKKNEKEKIIK

SEQ ID NO: 3266959 - protein, 21 aa, Plasmodium falciparum
KYDNLKTLFKYIYLIECSTNS

SEQ ID NO: 3266960 - protein, 17 aa, Plasmodium falciparum
KYDNLRMYAEHAKDFLS

SEQ ID NO: 3266961 - protein, 19 aa, Plasmodium falciparum
KYDPLRSVYLYSLNLDDLE

SEQ ID NO: 3266962 - protein, 21 aa, Plasmodium falciparum
KYDPSSCFFDFSGARETFCTW

SEQ ID NO: 3266963 - protein, 25 aa, Plasmodium falciparum
KYDTILDFLYDFMLIIHNAKMVHMP

SEQ ID NO: 3266964 - protein, 24 aa, Plasmodium falciparum
KYDYKRFNLIELFQYIYKKLHCIN

SEQ ID NO: 3266965 - protein, 19 aa, Plasmodium falciparum
KYEEEILESASFIDKILQN

SEQ ID NO: 3266966 - protein, 20 aa, Plasmodium falciparum
KYEEKCMCQSYIDLKIQFKN

SEQ ID NO: 3266967 - protein, 24 aa, Plasmodium falciparum
KYEEYQKQLSIWAIFNDFYETGKN

SEQ ID NO: 3266968 - protein, 28 aa, Plasmodium falciparum
KYEFSRLSKRILYIYMVLIKTLFVICIF

SEQ ID NO: 3266969 - protein, 17 aa, Plasmodium falciparum
KYEKGREKFPNWKCIPS

SEQ ID NO: 3266970 - protein, 19 aa, Plasmodium falciparum
KYEKILFIDAEWKCAVFRE

SEQ ID NO: 3266971 - protein, 17 aa, Plasmodium falciparum
KYEKLIHKFTFKKLCNS

SEQ ID NO: 3266972 - protein, 25 aa, Plasmodium falciparum
KYEMNKLRFCFLVNHMNCMDETGKN

SEQ ID NO: 3266973 - protein, 24 aa, Plasmodium falciparum
KYENINKLGKFVFATVHEPRNLIT

SEQ ID NO: 3266974 - protein, 23 aa, Plasmodium falciparum
KYERMIKMFKEFMSYKKMVDTKN

SEQ ID NO: 3266975 - protein, 22 aa, Plasmodium falciparum
KYESLNLLFLHSHIFEHAHRSI

SEQ ID NO: 3266976 - protein, 20 aa, Plasmodium falciparum
KYEYIIEMPHYIYDNDEIDV

SEQ ID NO: 3266977 - protein, 22 aa, Plasmodium falciparum
KYFELIDTLFLILKKKEITFLH

SEQ ID NO: 3266978 - protein, 26 aa, Plasmodium falciparum
KYFHLSSFFLLKSMDSSIHKDVEKER

SEQ ID NO: 3266979 - protein, 20 aa, Plasmodium falciparum
KYFIMIQEFLNWDFFNLDNI

SEQ ID NO: 3266980 - protein, 18 aa, Plasmodium falciparum
KYFLILSIVLNIFLLLFL

SEQ ID NO: 3266981 - protein, 18 aa, Plasmodium falciparum
KYFLKKLLFEDIEYKDTE

SEQ ID NO: 3266982 - protein, 18 aa, Plasmodium falciparum
KYFLKNLEDYNIFKNDSI

SEQ ID NO: 3266983 - protein, 36 aa, Plasmodium falciparum
KYFLNLRKFKYVKLKSVSMIGLFIIIFIDEALVDHI

SEQ ID NO: 3266984 - protein, 19 aa, Plasmodium falciparum
KYFMCFCSCAYSCLCSCIC

SEQ ID NO: 3266985 - protein, 23 aa, Plasmodium falciparum
KYFNNFFFNYSLYFPTNDSINFY

SEQ ID NO: 3266986 - protein, 27 aa, Plasmodium falciparum
KYFNSICAYKCGFVLEQINTIFNLLDT

SEQ ID NO: 3266987 - protein, 18 aa, Plasmodium falciparum
KYFPLTTYYLSLRIRASY

SEQ ID NO: 3266988 - protein, 25 aa, Plasmodium falciparum
KYFPYILKSSFFIFNILKKKRLIHI

SEQ ID NO: 3266989 - protein, 19 aa, Plasmodium falciparum
KYFRFNCFINNIKLDETSP

SEQ ID NO: 3266990 - protein, 18 aa, Plasmodium falciparum
KYFSCVKNSGFIILCDDP

SEQ ID NO: 3266991 - protein, 19 aa, Plasmodium falciparum
KYFTSGYLLNEIILMKGQN

SEQ ID NO: 3266992 - protein, 19 aa, Plasmodium falciparum
KYFYESHQTISIVKNMQNE

SEQ ID NO: 3266993 - protein, 22 aa, Plasmodium falciparum
KYFYKFENLIIFNYDFTLISKI

SEQ ID NO: 3266994 - protein, 27 aa, Plasmodium falciparum
KYFYVICPLFLKNGNCILVNRGLVSND

SEQ ID NO: 3266995 - protein, 19 aa, Plasmodium falciparum
KYGHSPLSFSECKYKIENI

SEQ ID NO: 3266996 - protein, 20 aa, Plasmodium falciparum
KYGLPQRHWGWKCIPSGSGS

SEQ ID NO: 3266997 - protein, 25 aa, Plasmodium falciparum
KYGPKAPTSWKCVPSGVSTATSGEG

SEQ ID NO: 3266998 - protein, 24 aa, Plasmodium falciparum
KYGPKAPTSWKCVPTTSGGSGVTT

SEQ ID NO: 3266999 - protein, 24 aa, Plasmodium falciparum
KYGREKFPNWKCIPSGDKTAPSSD

SEQ ID NO: 3267000 - protein, 21 aa, Plasmodium falciparum
KYGYPQRHWGWKCIPSGDNTT

SEQ ID NO: 3267001 - protein, 24 aa, Plasmodium falciparum
KYHECGLELFNILINLICIHNNDN

SEQ ID NO: 3267002 - protein, 24 aa, Plasmodium falciparum
KYHENRKRKALSLVSKEKKKKKKK

SEQ ID NO: 3267003 - protein, 17 aa, Plasmodium falciparum
KYHFDFGKGKKINLKAL

SEQ ID NO: 3267004 - protein, 22 aa, Plasmodium falciparum
KYHKCYHIFHILTLNQRLKEKM

SEQ ID NO: 3267005 - protein, 29 aa, Plasmodium falciparum
KYIDIFKLFRICYWFSILYIFMLTPVMFI

SEQ ID NO: 3267006 - protein, 24 aa, Plasmodium falciparum
KYIDMLLILLFYCKNYVIQKNIYE

SEQ ID NO: 3267007 - protein, 17 aa, Plasmodium falciparum
KYIEAFSINDKCSLATL

SEQ ID NO: 3267008 - protein, 17 aa, Plasmodium falciparum
KYIECLTKRSSNNNNND

SEQ ID NO: 3267009 - protein, 24 aa, Plasmodium falciparum
KYIFKEIFKYLSKPIHDVKKSIND

SEQ ID NO: 3267010 - protein, 18 aa, Plasmodium falciparum
KYIFKKKTLVPFEHVDNN

SEQ ID NO: 3267011 - protein, 22 aa, Plasmodium falciparum
KYIICKKCTNLTILKKGKYGTF

SEQ ID NO: 3267012 - protein, 23 aa, Plasmodium falciparum
KYIIDFYSALLLLYTYSEINILD

SEQ ID NO: 3267013 - protein, 24 aa, Plasmodium falciparum
KYIIRLPLNILKYIFKEIFKYLSK

SEQ ID NO: 3267014 - protein, 25 aa, Plasmodium falciparum
KYIIYYYCRKKLKRKNFHYFNYQDL

SEQ ID NO: 3267015 - protein, 22 aa, Plasmodium falciparum
KYIKNVCLLAIYISKLESDLFL

SEQ ID NO: 3267016 - protein, 18 aa, Plasmodium falciparum
KYIKTFYEYFSFYHIKKN

SEQ ID NO: 3267017 - protein, 17 aa, Plasmodium falciparum
KYIKVFINSNVYKYFYN

SEQ ID NO: 3267018 - protein, 17 aa, Plasmodium falciparum
KYILAPFVFTFKILYDI

SEQ ID NO: 3267019 - protein, 19 aa, Plasmodium falciparum
KYILKMSINNACIDEYIEE

SEQ ID NO: 3267020 - protein, 25 aa, Plasmodium falciparum
KYILKRMCIESCRYSIKEICDICFV

SEQ ID NO: 3267021 - protein, 24 aa, Plasmodium falciparum
KYILLFLEKCIEFFIDLLSQLYSR

SEQ ID NO: 3267022 - protein, 24 aa, Plasmodium falciparum
KYILNVHIPPRFILYVEGDKLNIE

SEQ ID NO: 3267023 - protein, 24 aa, Plasmodium falciparum
KYINEIIMEILFFTNIWKHYLSLE

SEQ ID NO: 3267024 - protein, 20 aa, Plasmodium falciparum
KYINELKEVSAFRTVLKNLG

SEQ ID NO: 3267025 - protein, 20 aa, Plasmodium falciparum
KYINHPYCTPIKTNITTNKL

SEQ ID NO: 3267026 - protein, 25 aa, Plasmodium falciparum
KYINIKYWYDYDIILYFFLNLLKNC

SEQ ID NO: 3267027 - protein, 29 aa, Plasmodium falciparum
KYINVVICLCRIFFKYVDNILLCKKNMLK

SEQ ID NO: 3267028 - protein, 17 aa, Plasmodium falciparum
KYINYIIYLFCELLCKY

SEQ ID NO: 3267029 - protein, 21 aa, Plasmodium falciparum
KYIPFFWVIFFKYINSSMLIV

SEQ ID NO: 3267030 - protein, 18 aa, Plasmodium falciparum
KYIRNSIIISIKHNYIRL

SEQ ID NO: 3267031 - protein, 17 aa, Plasmodium falciparum
KYISILTCHDISNIYYS

SEQ ID NO: 3267032 - protein, 26 aa, Plasmodium falciparum
KYIYEWLNRNICLFQFPDNYVDKNKD

SEQ ID NO: 3267033 - protein, 25 aa, Plasmodium falciparum
KYIYFKKILFFISFFNYLYTNEQNI

SEQ ID NO: 3267034 - protein, 17 aa, Plasmodium falciparum
KYIYKIKYCNPYKNKNN

SEQ ID NO: 3267035 - protein, 17 aa, Plasmodium falciparum
KYIYKSEMKEEMYNKSN

SEQ ID NO: 3267036 - protein, 22 aa, Plasmodium falciparum
KYKCLCIIMFYIIYYNPFLDFI

SEQ ID NO: 3267037 - protein, 46 aa, Plasmodium falciparum
KYKDILSIIMKIFFFYLLKYVIYFNHGDVFYSCIHKMLHNKRKKKI

SEQ ID NO: 3267038 - protein, 24 aa, Plasmodium falciparum
KYKEFFFKYFNSFLSTVFSKNMIL

SEQ ID NO: 3267039 - protein, 19 aa, Plasmodium falciparum
KYKELYIKASTNITKQNSS

SEQ ID NO: 3267040 - protein, 20 aa, Plasmodium falciparum
KYKENFWLQFNILINEQVED

SEQ ID NO: 3267041 - protein, 19 aa, Plasmodium falciparum
KYKIFFLSLIVLSYGIFSG

SEQ ID NO: 3267042 - protein, 28 aa, Plasmodium falciparum
KYKIIKAIKLRKGYKHNHINYVIGIKQK

SEQ ID NO: 3267043 - protein, 20 aa, Plasmodium falciparum
KYKKKAFMSLFMYSKNVMYF

SEQ ID NO: 3267044 - protein, 21 aa, Plasmodium falciparum
KYKKKSLEYFSLFKQTTLHLD

SEQ ID NO: 3267045 - protein, 20 aa, Plasmodium falciparum
KYKKNFKLSGLFKKSKKRTK

SEQ ID NO: 3267046 - protein, 27 aa, Plasmodium falciparum
KYKKNIKIGRLLKCIGYQNEYVYRKKK

SEQ ID NO: 3267047 - protein, 29 aa, Plasmodium falciparum
KYKKRRICGDLKYSNSLDHWFGTNTLIPP

SEQ ID NO: 3267048 - protein, 18 aa, Plasmodium falciparum
KYKKWIEKKLEEFQKQKD

SEQ ID NO: 3267049 - protein, 19 aa, Plasmodium falciparum
KYKKWIEKKLEEFQKQKDK

SEQ ID NO: 3267050 - protein, 19 aa, Plasmodium falciparum
KYKLLTFIFHWMKALIEAI

SEQ ID NO: 3267051 - protein, 24 aa, Plasmodium falciparum
KYKLYSEVFFVLFLIIFIILIILG

SEQ ID NO: 3267052 - protein, 36 aa, Plasmodium falciparum
KYKLYSFLPLIVFFQFLRLGNLYFLSISMLQLIPEI

SEQ ID NO: 3267053 - protein, 31 aa, Plasmodium falciparum
KYKNCIKINYEIIKSIHLFHLLLKHFYNYFP

SEQ ID NO: 3267054 - protein, 25 aa, Plasmodium falciparum
KYKNIVICICYDYIYIINMMSYKKV

SEQ ID NO: 3267055 - protein, 21 aa, Plasmodium falciparum
KYKRRIMNSSFGFENEGKKYA

SEQ ID NO: 3267056 - protein, 22 aa, Plasmodium falciparum
KYKTLYKNISFVFSYFSFDEIF

SEQ ID NO: 3267057 - protein, 21 aa, Plasmodium falciparum
KYKYAFMINVHHIIKTMIFLF

SEQ ID NO: 3267058 - protein, 23 aa, Plasmodium falciparum
KYKYKYRFFYIIIKKNYSNKIKR

SEQ ID NO: 3267059 - protein, 18 aa, Plasmodium falciparum
KYKYRKVEITGVLDTTNE

SEQ ID NO: 3267060 - protein, 23 aa, Plasmodium falciparum
KYLCDKLNIRQCYYENEPMDYIN

SEQ ID NO: 3267061 - protein, 23 aa, Plasmodium falciparum
KYLELQMKYSIYIMNKKAFLNYL

SEQ ID NO: 3267062 - protein, 32 aa, Plasmodium falciparum
KYLFLDIRLNSHFKSFHLYNSINMELVKNYLD

SEQ ID NO: 3267063 - protein, 18 aa, Plasmodium falciparum
KYLIEIDPLFFLFFQNFK

SEQ ID NO: 3267064 - protein, 18 aa, Plasmodium falciparum
KYLIWNIFRQVLESLSYL

SEQ ID NO: 3267065 - protein, 36 aa, Plasmodium falciparum
KYLKHLKWRCTRAICFCSVGSLFLTFIGLAAARATD

SEQ ID NO: 3267066 - protein, 22 aa, Plasmodium falciparum
KYLKKKHYLPISISIKKHILNI

SEQ ID NO: 3267067 - protein, 18 aa, Plasmodium falciparum
KYLKKLKHRCIGGICSCS

SEQ ID NO: 3267068 - protein, 17 aa, Plasmodium falciparum
KYLKLALPLLSHRNNII

SEQ ID NO: 3267069 - protein, 23 aa, Plasmodium falciparum
KYLKRLKERFIRTIYLSSVGSLF

SEQ ID NO: 3267070 - protein, 17 aa, Plasmodium falciparum
KYLKYLFIPIILLYYNN

SEQ ID NO: 3267071 - protein, 18 aa, Plasmodium falciparum
KYLLNVFVANILWEEENN

SEQ ID NO: 3267072 - protein, 20 aa, Plasmodium falciparum
KYLLTEYYYYPDIFNEKCHE

SEQ ID NO: 3267073 - protein, 17 aa, Plasmodium falciparum
KYLNILYTYIFQIITVH

SEQ ID NO: 3267074 - protein, 22 aa, Plasmodium falciparum
KYLPRLKYRIQNMIQKGTLLLL

SEQ ID NO: 3267075 - protein, 19 aa, Plasmodium falciparum
KYLQDKCMRLGKNNNGRTD

SEQ ID NO: 3267076 - protein, 26 aa, Plasmodium falciparum
KYLQLSFCTICIALYYMNKYNQKILK

SEQ ID NO: 3267077 - protein, 17 aa, Plasmodium falciparum
KYLQNFLYDEFERKYLF

SEQ ID NO: 3267078 - protein, 22 aa, Plasmodium falciparum
KYLSDNFIFFLFKAPSTSKLEQ

SEQ ID NO: 3267079 - protein, 25 aa, Plasmodium falciparum
KYLSVKRKFTFAMNYLIRNLKKKIF

SEQ ID NO: 3267080 - protein, 25 aa, Plasmodium falciparum
KYLSWLCSGMSLIDVVINFIINVRL

SEQ ID NO: 3267081 - protein, 20 aa, Plasmodium falciparum
KYLTKLLFILFEYCKENNTK

SEQ ID NO: 3267082 - protein, 19 aa, Plasmodium falciparum
KYLTPLMLACRIGCEECVQ

SEQ ID NO: 3267083 - protein, 19 aa, Plasmodium falciparum
KYLYIYGKVVKGFGRGSKY

SEQ ID NO: 3267084 - protein, 22 aa, Plasmodium falciparum
KYLYNYIIILSFVNLRHIYNIY

SEQ ID NO: 3267085 - protein, 22 aa, Plasmodium falciparum
KYMEMLLLLLYNNMRLYDKDKI

SEQ ID NO: 3267086 - protein, 28 aa, Plasmodium falciparum
KYMIPYDHLELIKIRLKKYYRIKQFLID

SEQ ID NO: 3267087 - protein, 25 aa, Plasmodium falciparum
KYMKSLKMFIKVIPFFHKNKDLVIF

SEQ ID NO: 3267088 - protein, 25 aa, Plasmodium falciparum
KYMNIKGCISLSGMIMLEKLSSVNS

SEQ ID NO: 3267089 - protein, 24 aa, Plasmodium falciparum
KYMQSLICGLYLLTLIRKKKNNDH

SEQ ID NO: 3267090 - protein, 17 aa, Plasmodium falciparum
KYMSYNFSYYMNMKLFI

SEQ ID NO: 3267091 - protein, 20 aa, Plasmodium falciparum
KYMYLYFLFIKFMGVLKKKK

SEQ ID NO: 3267092 - protein, 17 aa, Plasmodium falciparum
KYNCFIFGNEGSYNYVK

SEQ ID NO: 3267093 - protein, 25 aa, Plasmodium falciparum
KYNEEFCLNLKWSYGDYGDIIKGTD

SEQ ID NO: 3267094 - protein, 21 aa, Plasmodium falciparum
KYNEEFWFKKLFEDYEKEVEN

SEQ ID NO: 3267095 - protein, 24 aa, Plasmodium falciparum
KYNHYRFLVLLSLFFCITGMFLRI

SEQ ID NO: 3267096 - protein, 18 aa, Plasmodium falciparum
KYNIAIIYAPYISLIYIS

SEQ ID NO: 3267097 - protein, 28 aa, Plasmodium falciparum
KYNIPSFHFSFYKAFDTFFFNNILYESL

SEQ ID NO: 3267098 - protein, 20 aa, Plasmodium falciparum
KYNKKLKMSSLFSKKIMHKE

SEQ ID NO: 3267099 - protein, 23 aa, Plasmodium falciparum
KYNNINCIFYHYYNSFLHSLFYS

SEQ ID NO: 3267100 - protein, 20 aa, Plasmodium falciparum
KYNPNLIIAYMLKIYNNWSI

SEQ ID NO: 3267101 - protein, 26 aa, Plasmodium falciparum
KYNRLNGCLHPSRVIGDYDIKKRYNR

SEQ ID NO: 3267102 - protein, 19 aa, Plasmodium falciparum
KYNSEDSITCEDDKHILKN

SEQ ID NO: 3267103 - protein, 29 aa, Plasmodium falciparum
KYNTVVIVVPWGYEFHSLYASPEGNEELS

SEQ ID NO: 3267104 - protein, 41 aa, Plasmodium falciparum
KYNVKVEGLRLVSRMKRGKILKGCFPKDGILHNHYISTLFI

SEQ ID NO: 3267105 - protein, 24 aa, Plasmodium falciparum
KYNWSKHYFHVFFNDPFLYNYFNE

SEQ ID NO: 3267106 - protein, 19 aa, Plasmodium falciparum
KYPDWKLKPIPTIGYSKKS

SEQ ID NO: 3267107 - protein, 21 aa, Plasmodium falciparum
KYPLFLLQYIYFFLKYSPIIS

SEQ ID NO: 3267108 - protein, 35 aa, Plasmodium falciparum
KYPREFFYINLIFKLFPLFVVPFLFLFVVYKQYIL

SEQ ID NO: 3267109 - protein, 26 aa, Plasmodium falciparum
KYPSFLKDKIKAFIHIYNMFSIYPYI

SEQ ID NO: 3267110 - protein, 18 aa, Plasmodium falciparum
KYPYCVVFTYLPCASTFI

SEQ ID NO: 3267111 - protein, 21 aa, Plasmodium falciparum
KYQEWSRKRSIQWEAISEGYK

SEQ ID NO: 3267112 - protein, 19 aa, Plasmodium falciparum
KYQFAYFACCILLNLYVLI

SEQ ID NO: 3267113 - protein, 18 aa, Plasmodium falciparum
KYQFELVPYINHLYYLYN

SEQ ID NO: 3267114 - protein, 19 aa, Plasmodium falciparum
KYREILLIRIINLIIDIFL

SEQ ID NO: 3267115 - protein, 19 aa, Plasmodium falciparum
KYREYNLIYNKEMKAKNNL

SEQ ID NO: 3267116 - protein, 25 aa, Plasmodium falciparum
KYRHITKYITPYCNIFINFFHYHYI

SEQ ID NO: 3267117 - protein, 17 aa, Plasmodium falciparum
KYRKWIEKKFEEFHNQK

SEQ ID NO: 3267118 - protein, 33 aa, Plasmodium falciparum
KYRMLGKIYFLKAYEPIICFIGTPCVIKSFTVK

SEQ ID NO: 3267119 - protein, 20 aa, Plasmodium falciparum
KYRNCWVCIESVYSMDGDIP

SEQ ID NO: 3267120 - protein, 19 aa, Plasmodium falciparum
KYRSRNYIGYRCLIVSLLI

SEQ ID NO: 3267121 - protein, 18 aa, Plasmodium falciparum
KYSFIFKGLYEQFLRLPN

SEQ ID NO: 3267122 - protein, 31 aa, Plasmodium falciparum
KYSFYSFIEYFPKYFYTYIEMLYINIILIFM

SEQ ID NO: 3267123 - protein, 29 aa, Plasmodium falciparum
KYSIADPICSIIFCCIVFSTTISVIKEIL

SEQ ID NO: 3267124 - protein, 19 aa, Plasmodium falciparum
KYSIFEFYYLLYGLNKINE

SEQ ID NO: 3267125 - protein, 19 aa, Plasmodium falciparum
KYSISCLIYMNIYTEESII

SEQ ID NO: 3267126 - protein, 22 aa, Plasmodium falciparum
KYSKYFFLKSFLNRVNSELYDY

SEQ ID NO: 3267127 - protein, 19 aa, Plasmodium falciparum
KYSLIEFINKSGVFSDIIK

SEQ ID NO: 3267128 - protein, 18 aa, Plasmodium falciparum
KYSNIRIFLSLVLIVIGT

SEQ ID NO: 3267129 - protein, 24 aa, Plasmodium falciparum
KYSNYRMMKNINGLHKLMILKNKN

SEQ ID NO: 3267130 - protein, 24 aa, Plasmodium falciparum
KYSPFNCALAYRIPDTNLNISTQY

SEQ ID NO: 3267131 - protein, 19 aa, Plasmodium falciparum
KYSSLPFEKKCYKENIKCM

SEQ ID NO: 3267132 - protein, 27 aa, Plasmodium falciparum
KYSTYSIEITRYFSIFDKFKIQLQTMK

SEQ ID NO: 3267133 - protein, 22 aa, Plasmodium falciparum
KYTCIYIYIAFIYTYISIYAQT

SEQ ID NO: 3267134 - protein, 18 aa, Plasmodium falciparum
KYTEIELYKENLYNLYNQ

SEQ ID NO: 3267135 - protein, 29 aa, Plasmodium falciparum
KYTHPLISYRIALIIKIWTKCYKTSFPFI

SEQ ID NO: 3267136 - protein, 22 aa, Plasmodium falciparum
KYTIKHFIIYNVYYILTTILCL

SEQ ID NO: 3267137 - protein, 17 aa, Plasmodium falciparum
KYTNILFHFLIILQTNP

SEQ ID NO: 3267138 - protein, 21 aa, Plasmodium falciparum
KYTNYLFCYYDNFIHCDKHVV

SEQ ID NO: 3267139 - protein, 19 aa, Plasmodium falciparum
KYTPVFVINITKKFDSSKF

SEQ ID NO: 3267140 - protein, 28 aa, Plasmodium falciparum
KYTTFKVFLLYWLEDFLYGYYISKKRKI

SEQ ID NO: 3267141 - protein, 26 aa, Plasmodium falciparum
KYTYLFYRLPLFLFGDKYINDIDDVK

SEQ ID NO: 3267142 - protein, 18 aa, Plasmodium falciparum
KYVDCIKNVSVFLGVLIF

SEQ ID NO: 3267143 - protein, 19 aa, Plasmodium falciparum
KYVHLNILTNIMLNILAYE

SEQ ID NO: 3267144 - protein, 19 aa, Plasmodium falciparum
KYVIYYKNFEKFMKIMDSF

SEQ ID NO: 3267145 - protein, 23 aa, Plasmodium falciparum
KYVKGKAVFAFVLLNEEKEKNLY

SEQ ID NO: 3267146 - protein, 27 aa, Plasmodium falciparum
KYVMNKFCKKWKKRKKYLILKCTHISQ

SEQ ID NO: 3267147 - protein, 22 aa, Plasmodium falciparum
KYVNINICFLFDVYVYDNNIIG

SEQ ID NO: 3267148 - protein, 18 aa, Plasmodium falciparum
KYVNVGFHKNFIHFKKLN

SEQ ID NO: 3267149 - protein, 20 aa, Plasmodium falciparum
KYVYNYKSYYIFKHILLSKY

SEQ ID NO: 3267150 - protein, 18 aa, Plasmodium falciparum
KYWSEIDYINVLINLTIF

SEQ ID NO: 3267151 - protein, 26 aa, Plasmodium falciparum
KYYDFSFKKIKTFRDLFYFLSKKNII

SEQ ID NO: 3267152 - protein, 20 aa, Plasmodium falciparum
KYYEKYSFLFTFDLSFIYKR

SEQ ID NO: 3267153 - protein, 32 aa, Plasmodium falciparum
KYYERIKLLYLLNCIPLIYLDPHMNVILINES

SEQ ID NO: 3267154 - protein, 19 aa, Plasmodium falciparum
KYYFDLFLDSFNFFHNAFL

SEQ ID NO: 3267155 - protein, 23 aa, Plasmodium falciparum
KYYGYCVIYFLKLSKCIEEKISV

SEQ ID NO: 3267156 - protein, 20 aa, Plasmodium falciparum
KYYHHCSILRKELYDRYIMI

SEQ ID NO: 3267157 - protein, 26 aa, Plasmodium falciparum
KYYLDFFCLYLLLKSYFFIDTIIINK

SEQ ID NO: 3267158 - protein, 25 aa, Plasmodium falciparum
KYYNNLKHLIIIKITYFLDLLERCT

SEQ ID NO: 3267159 - protein, 24 aa, Plasmodium falciparum
KYYSENFYAYNLEKIVYKFLLNNK

SEQ ID NO: 3267160 - protein, 25 aa, Plasmodium falciparum
KYYSPKYKQFFIHHLENYKLYQTSD

SEQ ID NO: 3267161 - protein, 39 aa, Plasmodium falciparum
KYYTYNCICEIASSYVPFYFTHKNIKTFSYYSNYSGKQN

SEQ ID NO: 3267162 - protein, 18 aa, Plasmodium falciparum
LACAYFYKDEHTYPQCFR

SEQ ID NO: 3267163 - protein, 18 aa, Plasmodium falciparum
LADWWKEHGHEIWEGMLC

SEQ ID NO: 3267164 - protein, 18 aa, Plasmodium falciparum
LAECIILPYLRTEIKENI

SEQ ID NO: 3267165 - protein, 17 aa, Plasmodium falciparum
LAEEYGIGLIKIKKNKE

SEQ ID NO: 3267166 - protein, 18 aa, Plasmodium falciparum
LAFFVRNCYRMHCFDKSF

SEQ ID NO: 3267167 - protein, 25 aa, Plasmodium falciparum
LAFWKKKKIFSRIQVSNIFYENKIY

SEQ ID NO: 3267168 - protein, 20 aa, Plasmodium falciparum
LAGGFSYYIFENFVFQKNRK

SEQ ID NO: 3267169 - protein, 21 aa, Plasmodium falciparum
LAGKELSCRNISAWNNILENN

SEQ ID NO: 3267170 - protein, 27 aa, Plasmodium falciparum
LAGTCSAIAFTVLRMLILRKKNSFEII

SEQ ID NO: 3267171 - protein, 24 aa, Plasmodium falciparum
LAHELKIFLFFIVNITGGHFSSVL

SEQ ID NO: 3267172 - protein, 22 aa, Plasmodium falciparum
LAHKWAECLIVYKNVVNKIENP

SEQ ID NO: 3267173 - protein, 23 aa, Plasmodium falciparum
LAHNSLLYAQWVSLHSCDIDQVD

SEQ ID NO: 3267174 - protein, 29 aa, Plasmodium falciparum
LAHYIPLFIGVDVFVGFVGYRLEYNQRKN

SEQ ID NO: 3267175 - protein, 26 aa, Plasmodium falciparum
LAICTGGVLYSWGYNNFGCIGNGTNQ

SEQ ID NO: 3267176 - protein, 24 aa, Plasmodium falciparum
LAIDEYKKMISLFSEDNKKMLNKE

SEQ ID NO: 3267177 - protein, 23 aa, Plasmodium falciparum
LAIGSCINCLFLDEMNLLSIYGY

SEQ ID NO: 3267178 - protein, 23 aa, Plasmodium falciparum
LAIRKNSKIFICSVEGDYYNYIY

SEQ ID NO: 3267179 - protein, 23 aa, Plasmodium falciparum
LAKKEIYFSYLLKVRKSNKINKY

SEQ ID NO: 3267180 - protein, 27 aa, Plasmodium falciparum
LAKNRYICLCPYPYVRILNNCLHPLKG

SEQ ID NO: 3267181 - protein, 39 aa, Plasmodium falciparum
LAKPRHRFLHFLLKHNIRLCLRVAKRYSHLFVNEETFKN

SEQ ID NO: 3267182 - protein, 24 aa, Plasmodium falciparum
LALIKRYFMSLIFIMLSYIMIEII

SEQ ID NO: 3267183 - protein, 17 aa, Plasmodium falciparum
LALILNSYAKINFVNVK

SEQ ID NO: 3267184 - protein, 19 aa, Plasmodium falciparum
LALKNELKKFFQINQNKLL

SEQ ID NO: 3267185 - protein, 18 aa, Plasmodium falciparum
LALLWIKEKLSLFNKYNL

SEQ ID NO: 3267186 - protein, 19 aa, Plasmodium falciparum
LALNVRFIYMGKILDDKKK

SEQ ID NO: 3267187 - protein, 18 aa, Plasmodium falciparum
LALSPKWMNNEDFKIVLK

SEQ ID NO: 3267188 - protein, 28 aa, Plasmodium falciparum
LALTTFLPKCLRYFDAVRRCRNIKNKKK

SEQ ID NO: 3267189 - protein, 37 aa, Plasmodium falciparum
LANIKSFRFSLFFDIFFELKVNFNHFFNSHICVQNGL

SEQ ID NO: 3267190 - protein, 25 aa, Plasmodium falciparum
LANMIIKFIMSFYMFYYKMGSAAVL

SEQ ID NO: 3267191 - protein, 26 aa, Plasmodium falciparum
LANYLLRYVPFTLPFDDRLLIFYHFR

SEQ ID NO: 3267192 - protein, 19 aa, Plasmodium falciparum
LAQEVIKFTGKYMPIYQLL

SEQ ID NO: 3267193 - protein, 26 aa, Plasmodium falciparum
LAQNLELLKGFALNFQTLSLFFLVFV

SEQ ID NO: 3267194 - protein, 17 aa, Plasmodium falciparum
LARSFADIGDIIRGKDL

SEQ ID NO: 3267195 - protein, 17 aa, Plasmodium falciparum
LASIIGMMLLRNIGSLL

SEQ ID NO: 3267196 - protein, 18 aa, Plasmodium falciparum
LASPLSIAISTYICSSIG

SEQ ID NO: 3267197 - protein, 28 aa, Plasmodium falciparum
LASVIFSRLSNFFYVFYDNFYYQNFTNS

SEQ ID NO: 3267198 - protein, 25 aa, Plasmodium falciparum
LATITMCYLCYFVSEYYLNLSGPLS

SEQ ID NO: 3267199 - protein, 21 aa, Plasmodium falciparum
LATTIPFGIAFALGSIAFLFL

SEQ ID NO: 3267200 - protein, 24 aa, Plasmodium falciparum
LAVVDTKKGHFCELERNIETQDLN

SEQ ID NO: 3267201 - protein, 17 aa, Plasmodium falciparum
LAYKNVSHKIYFDLSEK

SEQ ID NO: 3267202 - protein, 20 aa, Plasmodium falciparum
LAYLNLLYVISEYVIKNQQD

SEQ ID NO: 3267203 - protein, 20 aa, Plasmodium falciparum
LCAKAEGINGFFKGMFFGLL

SEQ ID NO: 3267204 - protein, 19 aa, Plasmodium falciparum
LCANTCINYNHILNCNIIK

SEQ ID NO: 3267205 - protein, 26 aa, Plasmodium falciparum
LCCHITCSMIIYILCIIYIIMEITYL

SEQ ID NO: 3267206 - protein, 21 aa, Plasmodium falciparum
LCDFKTKYLYEYIGNSGKLVI

SEQ ID NO: 3267207 - protein, 24 aa, Plasmodium falciparum
LCEELKMILEPTIRNKYEGDYKSG

SEQ ID NO: 3267208 - protein, 25 aa, Plasmodium falciparum
LCEENKFAAFILMGSYMINYVFHKD

SEQ ID NO: 3267209 - protein, 18 aa, Plasmodium falciparum
LCEHLDIRIDTLIIRLIN

SEQ ID NO: 3267210 - protein, 17 aa, Plasmodium falciparum
LCEKINIILKIEREDSF

SEQ ID NO: 3267211 - protein, 22 aa, Plasmodium falciparum
LCELIKILCYFKKCYHLNMCMY

SEQ ID NO: 3267212 - protein, 19 aa, Plasmodium falciparum
LCFCKEKNIYFSFKNINNK

SEQ ID NO: 3267213 - protein, 19 aa, Plasmodium falciparum
LCFLNKNMNTFFGIVQKRK

SEQ ID NO: 3267214 - protein, 23 aa, Plasmodium falciparum
LCGCVFPLCTYQLIVRYFIYKLF

SEQ ID NO: 3267215 - protein, 17 aa, Plasmodium falciparum
LCGLFVFTGDIINKYII

SEQ ID NO: 3267216 - protein, 24 aa, Plasmodium falciparum
LCGNGSDLALRMLVNSVKDNVVEN

SEQ ID NO: 3267217 - protein, 17 aa, Plasmodium falciparum
LCHGRIKKKKGFINKSI

SEQ ID NO: 3267218 - protein, 17 aa, Plasmodium falciparum
LCIHIIRLKSVNTILNH

SEQ ID NO: 3267219 - protein, 17 aa, Plasmodium falciparum
LCIHSPIEICKYMFNNI

SEQ ID NO: 3267220 - protein, 31 aa, Plasmodium falciparum
LCILNPIRVPAFVFAWLELISHKLFLPEILK

SEQ ID NO: 3267221 - protein, 24 aa, Plasmodium falciparum
LCIPPRRRKLYVTPLTKWATTAVS

SEQ ID NO: 3267222 - protein, 24 aa, Plasmodium falciparum
LCKAIPKVHIKLPLENLIEEKKRI

SEQ ID NO: 3267223 - protein, 25 aa, Plasmodium falciparum
LCKEKALKCKGQIKGIHHKCDERID

SEQ ID NO: 3267224 - protein, 20 aa, Plasmodium falciparum
LCKHKYRILYYDLLKKISHI

SEQ ID NO: 3267225 - protein, 24 aa, Plasmodium falciparum
LCKHPSVNFYPLVISIFKRIFSEL

SEQ ID NO: 3267226 - protein, 27 aa, Plasmodium falciparum
LCKIFLNIKFPDMFKIIIKELFKYFII

SEQ ID NO: 3267227 - protein, 20 aa, Plasmodium falciparum
LCKILSIINMYDFKLESSFF

SEQ ID NO: 3267228 - protein, 22 aa, Plasmodium falciparum
LCKVSRKYIFHNIEDIFDCLYR

SEQ ID NO: 3267229 - protein, 20 aa, Plasmodium falciparum
LCLCCGATSFSCFYGEYFKN

SEQ ID NO: 3267230 - protein, 21 aa, Plasmodium falciparum
LCLFHKSRIILTYLYLLSPYP

SEQ ID NO: 3267231 - protein, 23 aa, Plasmodium falciparum
LCLFQSCCPTVGKPKYEPPECVD

SEQ ID NO: 3267232 - protein, 17 aa, Plasmodium falciparum
LCLHCLENITSNIVTFD

SEQ ID NO: 3267233 - protein, 18 aa, Plasmodium falciparum
LCLIDLLKSFAISTHDIS

SEQ ID NO: 3267234 - protein, 19 aa, Plasmodium falciparum
LCLLFPIFKKGINNIRLEI

SEQ ID NO: 3267235 - protein, 19 aa, Plasmodium falciparum
LCLLYIKLNLYKKSYILYS

SEQ ID NO: 3267236 - protein, 27 aa, Plasmodium falciparum
LCLPALSFFLSVLFMMMFLCLNILLIN

SEQ ID NO: 3267237 - protein, 17 aa, Plasmodium falciparum
LCLWSNMSSESSMNYNY

SEQ ID NO: 3267238 - protein, 17 aa, Plasmodium falciparum
LCLYFKPLQNYFCSMYY

SEQ ID NO: 3267239 - protein, 20 aa, Plasmodium falciparum
LCLYIIKAKVNSIYYYDEDV

SEQ ID NO: 3267240 - protein, 18 aa, Plasmodium falciparum
LCNARHRILPDLLIKNHP

SEQ ID NO: 3267241 - protein, 20 aa, Plasmodium falciparum
LCNAYHYIDLLLICIKMENG

SEQ ID NO: 3267242 - protein, 20 aa, Plasmodium falciparum
LCNEIKLILLDIDNIHMESF

SEQ ID NO: 3267243 - protein, 21 aa, Plasmodium falciparum
LCNLLIVICEYMFPFYSFILF

SEQ ID NO: 3267244 - protein, 20 aa, Plasmodium falciparum
LCNMPINYFYVILKNIKNNP

SEQ ID NO: 3267245 - protein, 26 aa, Plasmodium falciparum
LCNNYPRLVNKYVCILKNIINRYHSR

SEQ ID NO: 3267246 - protein, 22 aa, Plasmodium falciparum
LCNSKAAFNNTLLKSFIEEDEE

SEQ ID NO: 3267247 - protein, 17 aa, Plasmodium falciparum
LCNWKLIYDKNMISSAS

SEQ ID NO: 3267248 - protein, 21 aa, Plasmodium falciparum
LCPLLIKANFCRKGQGKTTKE

SEQ ID NO: 3267249 - protein, 24 aa, Plasmodium falciparum
LCQAIPVVYLPVWVDEFSPDEKAT

SEQ ID NO: 3267250 - protein, 19 aa, Plasmodium falciparum
LCQRNPLHIILGLIVILAA

SEQ ID NO: 3267251 - protein, 22 aa, Plasmodium falciparum
LCSANSFVILLSYINEYNYYNN

SEQ ID NO: 3267252 - protein, 18 aa, Plasmodium falciparum
LCSDKITIKCIININLSN

SEQ ID NO: 3267253 - protein, 24 aa, Plasmodium falciparum
LCSEGSFKSLSFAVLHGNIAQSTR

SEQ ID NO: 3267254 - protein, 22 aa, Plasmodium falciparum
LCSLSAIFFKSRLNNENVMSSL

SEQ ID NO: 3267255 - protein, 40 aa, Plasmodium falciparum
LCSNDEIYMYFFLFKKFIFSCYIYFNLVSIQIYSNFSNIE

SEQ ID NO: 3267256 - protein, 22 aa, Plasmodium falciparum
LCSNILKYNLKITFETLEGRII

SEQ ID NO: 3267257 - protein, 17 aa, Plasmodium falciparum
LCTICNISSCGKYIYIE

SEQ ID NO: 3267258 - protein, 20 aa, Plasmodium falciparum
LCTKTKLLLSTCKINCVFYI

SEQ ID NO: 3267259 - protein, 20 aa, Plasmodium falciparum
LCTLQILLYIFKMNGNKTLF

SEQ ID NO: 3267260 - protein, 21 aa, Plasmodium falciparum
LCTVLARSFADIGDIIRGKDL

SEQ ID NO: 3267261 - protein, 21 aa, Plasmodium falciparum
LCTVLARSFADIGDIIRGRDL

SEQ ID NO: 3267262 - protein, 20 aa, Plasmodium falciparum
LCTVLARSFADIGDIVRGKD

SEQ ID NO: 3267263 - protein, 21 aa, Plasmodium falciparum
LCTVLARSFADIGDIVRGKDL

SEQ ID NO: 3267264 - protein, 20 aa, Plasmodium falciparum
LCTVLARSFADIGDIVRGRD

SEQ ID NO: 3267265 - protein, 21 aa, Plasmodium falciparum
LCVPCKRGTWKTKLSNSPCIF

SEQ ID NO: 3267266 - protein, 26 aa, Plasmodium falciparum
LDALIKYGCSDKMLMYTIWCTVMKNE

SEQ ID NO: 3267267 - protein, 31 aa, Plasmodium falciparum
LDALIKYGCSDKMLMYTNWCRVMKNEEDKYY

SEQ ID NO: 3267268 - protein, 24 aa, Plasmodium falciparum
LDASRSINGHRILIDKVLQTSDIL

SEQ ID NO: 3267269 - protein, 20 aa, Plasmodium falciparum
LDCLISYLKKMLRIYGNPEI

SEQ ID NO: 3267270 - protein, 18 aa, Plasmodium falciparum
LDDFRLYKSYKINVNEIN

SEQ ID NO: 3267271 - protein, 23 aa, Plasmodium falciparum
LDDKSIYLIFLFLGNIFTVLYNS

SEQ ID NO: 3267272 - protein, 29 aa, Plasmodium falciparum
LDDLCNIYLCLCSSLYFLNRAEEKSNEIK

SEQ ID NO: 3267273 - protein, 17 aa, Plasmodium falciparum
LDDLKHKYCPVDDNNND

SEQ ID NO: 3267274 - protein, 31 aa, Plasmodium falciparum
LDDSIFKKNFMKISVLYNVLFKIVVYDQRNL

SEQ ID NO: 3267275 - protein, 26 aa, Plasmodium falciparum
LDDVYWYKYLYLRRVYEKKRIYKNRK

SEQ ID NO: 3267276 - protein, 18 aa, Plasmodium falciparum
LDEDILYERNFLKDFELL

SEQ ID NO: 3267277 - protein, 24 aa, Plasmodium falciparum
LDEDKLKMSTHMVNNIFEGTKEYI

SEQ ID NO: 3267278 - protein, 24 aa, Plasmodium falciparum
LDEEEKPLFSFCSGSSRKKKHMDD

SEQ ID NO: 3267279 - protein, 21 aa, Plasmodium falciparum
LDEIILFFYLLRNINNLRHFV

SEQ ID NO: 3267280 - protein, 21 aa, Plasmodium falciparum
LDEMKELVIIFLKKISDTYTE

SEQ ID NO: 3267281 - protein, 24 aa, Plasmodium falciparum
LDERMKICTFQGVMNMNINYYYNK

SEQ ID NO: 3267282 - protein, 17 aa, Plasmodium falciparum
LDESGGLLIKGKVEITF

SEQ ID NO: 3267283 - protein, 22 aa, Plasmodium falciparum
LDETQCPHLLLNDYVLDISDFI

SEQ ID NO: 3267284 - protein, 21 aa, Plasmodium falciparum
LDFFYKYYNFFDMNNIGLFCK

SEQ ID NO: 3267285 - protein, 21 aa, Plasmodium falciparum
LDFLIKNRLIFNVSTIVFFSS

SEQ ID NO: 3267286 - protein, 21 aa, Plasmodium falciparum
LDFPVPTFILGDPFMRKYFTV

SEQ ID NO: 3267287 - protein, 20 aa, Plasmodium falciparum
LDFSLAIKVIHVLSQLKDIC

SEQ ID NO: 3267288 - protein, 19 aa, Plasmodium falciparum
LDHPAVIPALMSSTIMWSI

SEQ ID NO: 3267289 - protein, 20 aa, Plasmodium falciparum
LDICPYVRTYCCTATATKFV

SEQ ID NO: 3267290 - protein, 19 aa, Plasmodium falciparum
LDIDMCPKYGSNNYILKNI

SEQ ID NO: 3267291 - protein, 20 aa, Plasmodium falciparum
LDIEAVPFNILYKLLNKYAL

SEQ ID NO: 3267292 - protein, 25 aa, Plasmodium falciparum
LDIFKELYLFFYLYLYKFACNINDF

SEQ ID NO: 3267293 - protein, 20 aa, Plasmodium falciparum
LDIFLFLHFLLYNEKIMIHN

SEQ ID NO: 3267294 - protein, 24 aa, Plasmodium falciparum
LDIGCGYGGLLFSLSKIFNDKLIL

SEQ ID NO: 3267295 - protein, 17 aa, Plasmodium falciparum
LDIIRKGNTEFKENKIV

SEQ ID NO: 3267296 - protein, 17 aa, Plasmodium falciparum
LDILKNKLFAHIKANNI

SEQ ID NO: 3267297 - protein, 20 aa, Plasmodium falciparum
LDILKVCSLYFERIGYCQGM

SEQ ID NO: 3267298 - protein, 18 aa, Plasmodium falciparum
LDILLCLCSYKREDMKLE

SEQ ID NO: 3267299 - protein, 32 aa, Plasmodium falciparum
LDILYYLLLTNCVNFLLIFTITYLYMNKIYYI

SEQ ID NO: 3267300 - protein, 21 aa, Plasmodium falciparum
LDINSFFFLSKIIKYIHDLCI

SEQ ID NO: 3267301 - protein, 17 aa, Plasmodium falciparum
LDIRAIVTLCKKNIVGC

SEQ ID NO: 3267302 - protein, 17 aa, Plasmodium falciparum
LDISKNFIFSEEVRSTN

SEQ ID NO: 3267303 - protein, 30 aa, Plasmodium falciparum
LDISLNLIFLLCRNNFYVMLNKICMLQSKY

SEQ ID NO: 3267304 - protein, 26 aa, Plasmodium falciparum
LDIYDPFLFSNNMCYNFGVHNKEKNK

SEQ ID NO: 3267305 - protein, 17 aa, Plasmodium falciparum
LDIYKRFKKAAEISKIV

SEQ ID NO: 3267306 - protein, 19 aa, Plasmodium falciparum
LDIYLHFFLNIYTLNQENT

SEQ ID NO: 3267307 - protein, 21 aa, Plasmodium falciparum
LDKCHLSELIKIMKKLEKVHM

SEQ ID NO: 3267308 - protein, 20 aa, Plasmodium falciparum
LDKCNICKIKNELNINKNIN

SEQ ID NO: 3267309 - protein, 17 aa, Plasmodium falciparum
LDKFLLNKCLDPKKVDT

SEQ ID NO: 3267310 - protein, 24 aa, Plasmodium falciparum
LDKIWKNKVFRLLGENSHYFKEYN

SEQ ID NO: 3267311 - protein, 26 aa, Plasmodium falciparum
LDKKGRPHGFGYWRGINLEGEVLIGY

SEQ ID NO: 3267312 - protein, 41 aa, Plasmodium falciparum
LDKKLFFPLKSVLKILALRKLSFHFLSWINYFFHEIQKYFS

SEQ ID NO: 3267313 - protein, 18 aa, Plasmodium falciparum
LDKKSVFEENRKIPIKFI

SEQ ID NO: 3267314 - protein, 23 aa, Plasmodium falciparum
LDKRLTFYLILSCISSIFVTFSS

SEQ ID NO: 3267315 - protein, 17 aa, Plasmodium falciparum
LDKVQLLGCNFIFDMKR

SEQ ID NO: 3267316 - protein, 40 aa, Plasmodium falciparum
LDKYKNFTFHVPINYSIYWRIVKIPMNLYIMKKKIWEKKY

SEQ ID NO: 3267317 - protein, 22 aa, Plasmodium falciparum
LDLDGSLWLLRRNVFQILLDAD

SEQ ID NO: 3267318 - protein, 26 aa, Plasmodium falciparum
LDLDSDAFCYYDFNEFLNYMYKDENI

SEQ ID NO: 3267319 - protein, 21 aa, Plasmodium falciparum
LDLEAEWLFNSFLEIKKLDEK

SEQ ID NO: 3267320 - protein, 17 aa, Plasmodium falciparum
LDLFIYFLDLNKIVTPF

SEQ ID NO: 3267321 - protein, 21 aa, Plasmodium falciparum
LDLGYCKHVHNIPEYYLSGFS

SEQ ID NO: 3267322 - protein, 23 aa, Plasmodium falciparum
LDLLSIRMALGVNEKYLTNNNPI

SEQ ID NO: 3267323 - protein, 17 aa, Plasmodium falciparum
LDLPKYILVPYEYKNIN

SEQ ID NO: 3267324 - protein, 29 aa, Plasmodium falciparum
LDLPLLRTKFDYILTCVIIFCSYIFIGLP

SEQ ID NO: 3267325 - protein, 21 aa, Plasmodium falciparum
LDLPQLPAIFFVNVRNNFKIF

SEQ ID NO: 3267326 - protein, 18 aa, Plasmodium falciparum
LDLSIPCVNQDITIFIDD

SEQ ID NO: 3267327 - protein, 26 aa, Plasmodium falciparum
LDLSNHLYIYCLLFISISLIEINEHI

SEQ ID NO: 3267328 - protein, 23 aa, Plasmodium falciparum
LDLYKGMIKEIIYNIEKINEYGL

SEQ ID NO: 3267329 - protein, 21 aa, Plasmodium falciparum
LDNESSMFLYNFLNTYNNDYN

SEQ ID NO: 3267330 - protein, 24 aa, Plasmodium falciparum
LDNIDFLFMFIVKFLDKNVNINKI

SEQ ID NO: 3267331 - protein, 19 aa, Plasmodium falciparum
LDNIFKTYVKLFIYSWITI

SEQ ID NO: 3267332 - protein, 24 aa, Plasmodium falciparum
LDNIYYDKSLYCDIDLRHGKDDTE

SEQ ID NO: 3267333 - protein, 17 aa, Plasmodium falciparum
LDNLAFALLDKETLSGE

SEQ ID NO: 3267334 - protein, 23 aa, Plasmodium falciparum
LDNLKTIQIYYIIRSFYEHFYLK

SEQ ID NO: 3267335 - protein, 22 aa, Plasmodium falciparum
LDNNLFKGLFIKDDIKLSKRTI

SEQ ID NO: 3267336 - protein, 18 aa, Plasmodium falciparum
LDNTFLITIILFLKKSIY

SEQ ID NO: 3267337 - protein, 18 aa, Plasmodium falciparum
LDPEASFWGEEKRASHTT

SEQ ID NO: 3267338 - protein, 19 aa, Plasmodium falciparum
LDPSIFGRKKIQITPPIIG

SEQ ID NO: 3267339 - protein, 24 aa, Plasmodium falciparum
LDPYFNFFFCFIIPGIYSYFMYNN

SEQ ID NO: 3267340 - protein, 25 aa, Plasmodium falciparum
LDQCFRNLYKYKIMKKYFHNILNEN

SEQ ID NO: 3267341 - protein, 23 aa, Plasmodium falciparum
LDRSRTGTYFDRISKNEDQNYII

SEQ ID NO: 3267342 - protein, 21 aa, Plasmodium falciparum
LDSFFSLEFLERITKIFNNRQ

SEQ ID NO: 3267343 - protein, 20 aa, Plasmodium falciparum
LDSFLFYKTQRTIIKVYDEF

SEQ ID NO: 3267344 - protein, 18 aa, Plasmodium falciparum
LDSITILLYDIYKKHNYF

SEQ ID NO: 3267345 - protein, 23 aa, Plasmodium falciparum
LDSKRININFLRKSNNMCLALGC

SEQ ID NO: 3267346 - protein, 19 aa, Plasmodium falciparum
LDSLILYLLSFNIKNVENF

SEQ ID NO: 3267347 - protein, 17 aa, Plasmodium falciparum
LDSPLYIKGEKIKEEEE

SEQ ID NO: 3267348 - protein, 17 aa, Plasmodium falciparum
LDSTLSFNNLIKIIIMF

SEQ ID NO: 3267349 - protein, 18 aa, Plasmodium falciparum
LDSYESFLKPLFVLLFTF

SEQ ID NO: 3267350 - protein, 23 aa, Plasmodium falciparum
LDSYFPYDEHTFVNPFFPKNKID

SEQ ID NO: 3267351 - protein, 21 aa, Plasmodium falciparum
LDSYITLPLAHMVQTIMNEIF

SEQ ID NO: 3267352 - protein, 22 aa, Plasmodium falciparum
LDTIPKYIKLFYVLNNDNYIFN

SEQ ID NO: 3267353 - protein, 21 aa, Plasmodium falciparum
LDTYPFLPLHLLYYYMNLCSN

SEQ ID NO: 3267354 - protein, 17 aa, Plasmodium falciparum
LDVFLRFIQYKQHNNNT

SEQ ID NO: 3267355 - protein, 25 aa, Plasmodium falciparum
LDVFRNDERICMYLHIYKNDNESDT

SEQ ID NO: 3267356 - protein, 19 aa, Plasmodium falciparum
LDVHHKVVHHFLLGTIQNN

SEQ ID NO: 3267357 - protein, 23 aa, Plasmodium falciparum
LDVIKVPFLPFYVTLCNNSKLPT

SEQ ID NO: 3267358 - protein, 23 aa, Plasmodium falciparum
LDVKRKRYISLYMYNKKKGKDTN

SEQ ID NO: 3267359 - protein, 18 aa, Plasmodium falciparum
LDVLSYFFNKFVCSHKKN

SEQ ID NO: 3267360 - protein, 22 aa, Plasmodium falciparum
LDVPFRYLQWLSYQTYSASVLA

SEQ ID NO: 3267361 - protein, 20 aa, Plasmodium falciparum
LDVYEKWRNLTIDKDENKHW

SEQ ID NO: 3267362 - protein, 17 aa, Plasmodium falciparum
LDYAEFFSHINEHIGNN

SEQ ID NO: 3267363 - protein, 17 aa, Plasmodium falciparum
LDYDLSLLEKSFQGMSF

SEQ ID NO: 3267364 - protein, 19 aa, Plasmodium falciparum
LDYIIPINIHLDVILQNSL

SEQ ID NO: 3267365 - protein, 17 aa, Plasmodium falciparum
LDYLEKQQSAWPFLKPV

SEQ ID NO: 3267366 - protein, 26 aa, Plasmodium falciparum
LDYSSGSCPLGFYLTYFTYLEIETEN

SEQ ID NO: 3267367 - protein, 18 aa, Plasmodium falciparum
LEAAEKCFSENKWKIKDY

SEQ ID NO: 3267368 - protein, 23 aa, Plasmodium falciparum
LEALCSSISKQLCTYLENEKTEL

SEQ ID NO: 3267369 - protein, 18 aa, Plasmodium falciparum
LEALFFSLMVTIGCICLT

SEQ ID NO: 3267370 - protein, 25 aa, Plasmodium falciparum
LEANFNIYVCKNILINFLKCCLLNI

SEQ ID NO: 3267371 - protein, 19 aa, Plasmodium falciparum
LEANNLFNLIKYYNVHKKE

SEQ ID NO: 3267372 - protein, 19 aa, Plasmodium falciparum
LEAPSWLVKEAKYEGWENK

SEQ ID NO: 3267373 - protein, 23 aa, Plasmodium falciparum
LECFLKNHLNYFLEKICKSNMLH

SEQ ID NO: 3267374 - protein, 24 aa, Plasmodium falciparum
LEDIKFTYMLIYLLNYKKKQDKKC

SEQ ID NO: 3267375 - protein, 20 aa, Plasmodium falciparum
LEDPNCPRCYEQCRKYRKWI

SEQ ID NO: 3267376 - protein, 20 aa, Plasmodium falciparum
LEDTYKIFFYNKLIYYLNSN

SEQ ID NO: 3267377 - protein, 23 aa, Plasmodium falciparum
LEDVTAKLGERVESLKDVLSSAL

SEQ ID NO: 3267378 - protein, 17 aa, Plasmodium falciparum
LEEEYAFNVEKKRKNKH

SEQ ID NO: 3267379 - protein, 17 aa, Plasmodium falciparum
LEEIIKMNVYISERINS

SEQ ID NO: 3267380 - protein, 29 aa, Plasmodium falciparum
LEEILRNILKIILCDVETTVRRSAQKVLQ

SEQ ID NO: 3267381 - protein, 23 aa, Plasmodium falciparum
LEEILYFSMEYILIIYKQMIDRD

SEQ ID NO: 3267382 - protein, 19 aa, Plasmodium falciparum
LEELSEFVIHKMKKIKKEF

SEQ ID NO: 3267383 - protein, 26 aa, Plasmodium falciparum
LEEQTCAVDLSWSEKYDQLVIGASNG

SEQ ID NO: 3267384 - protein, 18 aa, Plasmodium falciparum
LEESIKLFYLLSKLDMSK

SEQ ID NO: 3267385 - protein, 22 aa, Plasmodium falciparum
LEEVFMKWLAAFSYDKIYMDIF

SEQ ID NO: 3267386 - protein, 17 aa, Plasmodium falciparum
LEEVTCMHGSNLSIVNI

SEQ ID NO: 3267387 - protein, 18 aa, Plasmodium falciparum
LEEWGETFCRERKKRLEK

SEQ ID NO: 3267388 - protein, 24 aa, Plasmodium falciparum
LEEYKSIDLFLGKLKAGPCSKTNN

SEQ ID NO: 3267389 - protein, 19 aa, Plasmodium falciparum
LEFLERYKNIYTFGYIRDD

SEQ ID NO: 3267390 - protein, 19 aa, Plasmodium falciparum
LEFLIKILNIINVYINDKD

SEQ ID NO: 3267391 - protein, 21 aa, Plasmodium falciparum
LEFLNSSILSQGYKLNNIEKI

SEQ ID NO: 3267392 - protein, 23 aa, Plasmodium falciparum
LEFLRQLLTYKLIYDRDNLDEKK

SEQ ID NO: 3267393 - protein, 19 aa, Plasmodium falciparum
LEFNICDDYDYLLFYIIIL

SEQ ID NO: 3267394 - protein, 17 aa, Plasmodium falciparum
LEFYIHLNVTYVHYKNK

SEQ ID NO: 3267395 - protein, 29 aa, Plasmodium falciparum
LEGEHFDLCFLFMKLYFYYYFYINNEKEE

SEQ ID NO: 3267396 - protein, 20 aa, Plasmodium falciparum
LEGIRYAVQNVKCDKTKIAI

SEQ ID NO: 3267397 - protein, 17 aa, Plasmodium falciparum
LEGKLSFASILGETGGF

SEQ ID NO: 3267398 - protein, 20 aa, Plasmodium falciparum
LEGKLSLAPILGVESGSTNE

SEQ ID NO: 3267399 - protein, 24 aa, Plasmodium falciparum
LEGTEKRLAVNLMKIYEETKDVES

SEQ ID NO: 3267400 - protein, 17 aa, Plasmodium falciparum
LEHIKIVGGKKFICESH

SEQ ID NO: 3267401 - protein, 25 aa, Plasmodium falciparum
LEHVCEVFAFFGIDYISAEILRRGK

SEQ ID NO: 3267402 - protein, 22 aa, Plasmodium falciparum
LEICKKKKCMLHRNVEKDEWNY

SEQ ID NO: 3267403 - protein, 18 aa, Plasmodium falciparum
LEIEICILKKLNYDLSIP

SEQ ID NO: 3267404 - protein, 24 aa, Plasmodium falciparum
LEIFKRIDKPIAIVSVLGDMHTGK

SEQ ID NO: 3267405 - protein, 27 aa, Plasmodium falciparum
LEIIEKIKMILCCNIFDYLYKNKRTYG

SEQ ID NO: 3267406 - protein, 33 aa, Plasmodium falciparum
LEILCQRFGKKYLHFKHIPSILIDFLTHLKKPE

SEQ ID NO: 3267407 - protein, 17 aa, Plasmodium falciparum
LEILKFIDANYKSINEN

SEQ ID NO: 3267408 - protein, 20 aa, Plasmodium falciparum
LEILNKMRYSFFELFYNTTI

SEQ ID NO: 3267409 - protein, 22 aa, Plasmodium falciparum
LEISSLFFSFDYLKAYTEENNI

SEQ ID NO: 3267410 - protein, 25 aa, Plasmodium falciparum
LEIVNYCGIPNNFLEYFDISTPTIK

SEQ ID NO: 3267411 - protein, 31 aa, Plasmodium falciparum
LEIVSFNSLFWRWVTEMLKDSIDWRKEYKNC

SEQ ID NO: 3267412 - protein, 25 aa, Plasmodium falciparum
LEKCCLKSGCGLGAVAASVGIFRAL

SEQ ID NO: 3267413 - protein, 36 aa, Plasmodium falciparum
LEKECIIYIKYVFIYLLKYIFLFKIYKYDYKKKTNI

SEQ ID NO: 3267414 - protein, 25 aa, Plasmodium falciparum
LEKECLKCAQNLGGIVAPSSGVLVG

SEQ ID NO: 3267415 - protein, 20 aa, Plasmodium falciparum
LEKFGELWLNARSTKNYVYH

SEQ ID NO: 3267416 - protein, 24 aa, Plasmodium falciparum
LEKGCLRCGFGLGGVAASVGIIGP

SEQ ID NO: 3267417 - protein, 26 aa, Plasmodium falciparum
LEKHIVHILFTFKVLKDIEMKDIDKL

SEQ ID NO: 3267418 - protein, 33 aa, Plasmodium falciparum
LEKHWIKNCPMLCACPNCFLIVELVVIHDHFIS

SEQ ID NO: 3267419 - protein, 17 aa, Plasmodium falciparum
LEKISVLPSKKIFGRFN

SEQ ID NO: 3267420 - protein, 18 aa, Plasmodium falciparum
LEKLCLLTILDIYKTPLC

SEQ ID NO: 3267421 - protein, 30 aa, Plasmodium falciparum
LEKLKKAGSFHLILLYAILVFLFISISLLL

SEQ ID NO: 3267422 - protein, 23 aa, Plasmodium falciparum
LEKLNNILNCFPIDNYKEFILLF

SEQ ID NO: 3267423 - protein, 18 aa, Plasmodium falciparum
LEKMKSEDSSVIYATNNN

SEQ ID NO: 3267424 - protein, 21 aa, Plasmodium falciparum
LEKNPFFYFYFSLALLILHRN

SEQ ID NO: 3267425 - protein, 25 aa, Plasmodium falciparum
LEKQKIIWRRWVARYVQHIDDDIIE

SEQ ID NO: 3267426 - protein, 17 aa, Plasmodium falciparum
LEKSVCDLHQTIIELSA

SEQ ID NO: 3267427 - protein, 24 aa, Plasmodium falciparum
LEKTCLKCTYGLGSNVPLLGLING

SEQ ID NO: 3267428 - protein, 21 aa, Plasmodium falciparum
LEKTIPFGIALALGSIAFLFI

SEQ ID NO: 3267429 - protein, 21 aa, Plasmodium falciparum
LEKTIPFGVALALGSIAFLFL

SEQ ID NO: 3267430 - protein, 26 aa, Plasmodium falciparum
LEKVYRSTIYLIFPFLQHIFVHIFYY

SEQ ID NO: 3267431 - protein, 24 aa, Plasmodium falciparum
LEKWKKEKWFIVLKENWKNEEHKY

SEQ ID NO: 3267432 - protein, 21 aa, Plasmodium falciparum
LEKYIYQSVVMFFMTLLPWWV

SEQ ID NO: 3267433 - protein, 27 aa, Plasmodium falciparum
LEKYQKFYISYCIPITYEILSSNSTDC

SEQ ID NO: 3267434 - protein, 19 aa, Plasmodium falciparum
LELENDCFLNCLIKEIVIK

SEQ ID NO: 3267435 - protein, 57 aa, Plasmodium falciparum
LELGFFVGSFFFIWYITGEKIFKRKKKIVKENILLILRNLCYEIYTVLCETSKTTKH

SEQ ID NO: 3267436 - protein, 18 aa, Plasmodium falciparum
LELGLKIYGIIITVVGTI

SEQ ID NO: 3267437 - protein, 49 aa, Plasmodium falciparum
LELISHKLFLPEILKSSKGWYIYNKLLIYLLEFLYIFLKNNYLTDSIKI

SEQ ID NO: 3267438 - protein, 19 aa, Plasmodium falciparum
LELIVLILRKDYFTIFLLV

SEQ ID NO: 3267439 - protein, 20 aa, Plasmodium falciparum
LELLHKIFLNYIRKEKEHIY

SEQ ID NO: 3267440 - protein, 27 aa, Plasmodium falciparum
LELLLISRRSSILGGTRFNKRGINDDG

SEQ ID NO: 3267441 - protein, 20 aa, Plasmodium falciparum
LELQKLILSICDMNKESFGL

SEQ ID NO: 3267442 - protein, 24 aa, Plasmodium falciparum
LELSKIPFGIIVNPFARLNEGECV

SEQ ID NO: 3267443 - protein, 26 aa, Plasmodium falciparum
LELYYNIGKDIIYLVHVMKPTLYEIY

SEQ ID NO: 3267444 - protein, 18 aa, Plasmodium falciparum
LEMFRNELDFNIITYIMK

SEQ ID NO: 3267445 - protein, 19 aa, Plasmodium falciparum
LEMIYVLTYIYGFLPLVII

SEQ ID NO: 3267446 - protein, 25 aa, Plasmodium falciparum
LEMNEIKTYIDLFFGKNTYEKVFVK

SEQ ID NO: 3267447 - protein, 17 aa, Plasmodium falciparum
LENGSVCRRFKFVKTDT

SEQ ID NO: 3267448 - protein, 17 aa, Plasmodium falciparum
LENIEIDILVLKKILTC

SEQ ID NO: 3267449 - protein, 24 aa, Plasmodium falciparum
LENIFSALCMLNIVPIDLEKNTFV

SEQ ID NO: 3267450 - protein, 25 aa, Plasmodium falciparum
LENIIERYKIIYGMNKEVDYNMLEE

SEQ ID NO: 3267451 - protein, 27 aa, Plasmodium falciparum
LENKIKCFEKLKGECVVKEEFNKANEL

SEQ ID NO: 3267452 - protein, 27 aa, Plasmodium falciparum
LENKILHTCFLLCALCDTTYINEFVFK

SEQ ID NO: 3267453 - protein, 26 aa, Plasmodium falciparum
LENKLLKSEICFVKISQNIKYDQKLQ

SEQ ID NO: 3267454 - protein, 17 aa, Plasmodium falciparum
LENKYFLDLPFKNFKST

SEQ ID NO: 3267455 - protein, 25 aa, Plasmodium falciparum
LENLIPRCIINYCNNFKCVIDTKHD

SEQ ID NO: 3267456 - protein, 35 aa, Plasmodium falciparum
LENMPQFFRWFSQWAHFFCKEKEYWELKLNDKCTG

SEQ ID NO: 3267457 - protein, 24 aa, Plasmodium falciparum
LENVEMVCVTFLSIHKFGREKYPD

SEQ ID NO: 3267458 - protein, 21 aa, Plasmodium falciparum
LENVHKFNLLKNVMNVIYLFN

SEQ ID NO: 3267459 - protein, 20 aa, Plasmodium falciparum
LENYVMLFLLNYNTKKKRKI

SEQ ID NO: 3267460 - protein, 20 aa, Plasmodium falciparum
LENYYLYNVCTHDIKDEGEN

SEQ ID NO: 3267461 - protein, 19 aa, Plasmodium falciparum
LEPEYYLQQIFDFGISLCM

SEQ ID NO: 3267462 - protein, 26 aa, Plasmodium falciparum
LEPFLFLKTLHYISGNIHKKVSSINK

SEQ ID NO: 3267463 - protein, 17 aa, Plasmodium falciparum
LEPLLPIYIKNITDHVI

SEQ ID NO: 3267464 - protein, 26 aa, Plasmodium falciparum
LEPRQARMCTLYIKPQKKGLLFISGV

SEQ ID NO: 3267465 - protein, 21 aa, Plasmodium falciparum
LEPSFYFQYTRCINKKKFIYY

SEQ ID NO: 3267466 - protein, 44 aa, Plasmodium falciparum
LEQEVLKAIIIKALIIEEVIKYIKCILYKIELIKYNNNNNNNNN

SEQ ID NO: 3267467 - protein, 26 aa, Plasmodium falciparum
LEQKWLKHLQNILSLKIDSLLNKNDE

SEQ ID NO: 3267468 - protein, 23 aa, Plasmodium falciparum
LEQLKDFRLLITIDTLNNNENPR

SEQ ID NO: 3267469 - protein, 20 aa, Plasmodium falciparum
LEQLKLGKFEGLRKHEIKKL

SEQ ID NO: 3267470 - protein, 19 aa, Plasmodium falciparum
LEQYMLWNNYMVIPHMKQY

SEQ ID NO: 3267471 - protein, 21 aa, Plasmodium falciparum
LERDLVKIFGKIKEGITDETT

SEQ ID NO: 3267472 - protein, 18 aa, Plasmodium falciparum
LEREMKRYNRSVWCTLLY

SEQ ID NO: 3267473 - protein, 30 aa, Plasmodium falciparum
LERILAHRPHPWGLLITFIELIKNTKFNFW

SEQ ID NO: 3267474 - protein, 17 aa, Plasmodium falciparum
LERIVVKLKNELKEERR

SEQ ID NO: 3267475 - protein, 18 aa, Plasmodium falciparum
LERKGCIIQPEDKMNKDL

SEQ ID NO: 3267476 - protein, 21 aa, Plasmodium falciparum
LERLRHYSCNVQRNTENEDEV

SEQ ID NO: 3267477 - protein, 24 aa, Plasmodium falciparum
LERQKIIWLQWINRNKYMLEKWNK

SEQ ID NO: 3267478 - protein, 24 aa, Plasmodium falciparum
LERQKIRWLQWINRNKYMLEKWNK

SEQ ID NO: 3267479 - protein, 17 aa, Plasmodium falciparum
LERYEMYAIDFSDEIYS

SEQ ID NO: 3267480 - protein, 23 aa, Plasmodium falciparum
LESDLSNILLFNFVENVKVSVHL

SEQ ID NO: 3267481 - protein, 17 aa, Plasmodium falciparum
LESIFCVLINMKEEIIK

SEQ ID NO: 3267482 - protein, 19 aa, Plasmodium falciparum
LESLTFWNNILIPDCIKKY

SEQ ID NO: 3267483 - protein, 18 aa, Plasmodium falciparum
LESMGIKKTLSFLKNNCI

SEQ ID NO: 3267484 - protein, 23 aa, Plasmodium falciparum
LESSFALAFIPFFFLNKNVFSNY

SEQ ID NO: 3267485 - protein, 17 aa, Plasmodium falciparum
LESSLSQLWNMPSDAST

SEQ ID NO: 3267486 - protein, 26 aa, Plasmodium falciparum
LETPKLSFSFFIYLIIWLHNIQVHVD

SEQ ID NO: 3267487 - protein, 17 aa, Plasmodium falciparum
LETRYIIRNNIMEGNII

SEQ ID NO: 3267488 - protein, 19 aa, Plasmodium falciparum
LEVGVDWCKHSYLLKYNKL

SEQ ID NO: 3267489 - protein, 22 aa, Plasmodium falciparum
LEYASTMFLLYIFKNINIYETF

SEQ ID NO: 3267490 - protein, 20 aa, Plasmodium falciparum
LEYFGICNLNGYFYLFNIYK

SEQ ID NO: 3267491 - protein, 19 aa, Plasmodium falciparum
LEYIYKCIQYILDNINIIY

SEQ ID NO: 3267492 - protein, 24 aa, Plasmodium falciparum
LEYNPSFFYLSFKILNTLLYNHIT

SEQ ID NO: 3267493 - protein, 18 aa, Plasmodium falciparum
LFAFPLNILVTLYHEYNQ

SEQ ID NO: 3267494 - protein, 21 aa, Plasmodium falciparum
LFAIVLLCIHSPIEICKYMFN

SEQ ID NO: 3267495 - protein, 24 aa, Plasmodium falciparum
LFANVKFKIIVHKFIQPLISNIMY

SEQ ID NO: 3267496 - protein, 17 aa, Plasmodium falciparum
LFCLIPLNNEKRITFYF

SEQ ID NO: 3267497 - protein, 17 aa, Plasmodium falciparum
LFCSFTMIYFSNHVSIW

SEQ ID NO: 3267498 - protein, 19 aa, Plasmodium falciparum
LFCSYTITKWFCLNTIFSL

SEQ ID NO: 3267499 - protein, 18 aa, Plasmodium falciparum
LFDDSTLYEIMKYSQVKN

SEQ ID NO: 3267500 - protein, 30 aa, Plasmodium falciparum
LFDLSNFTFRSCLFPFIYEKKYITDIHNMD

SEQ ID NO: 3267501 - protein, 26 aa, Plasmodium falciparum
LFDLYHKCTFNILKYLEIKDIKEIKD

SEQ ID NO: 3267502 - protein, 24 aa, Plasmodium falciparum
LFDMRGNVFKDCMIMLRNIESRYK

SEQ ID NO: 3267503 - protein, 17 aa, Plasmodium falciparum
LFDRKNIILNIITRVAF

SEQ ID NO: 3267504 - protein, 22 aa, Plasmodium falciparum
LFDSSFCTYLGFSTMAAAGLGN

SEQ ID NO: 3267505 - protein, 18 aa, Plasmodium falciparum
LFDVPKVNGYIMFVTAFI

SEQ ID NO: 3267506 - protein, 18 aa, Plasmodium falciparum
LFEDLIIEALNFFNKQKM

SEQ ID NO: 3267507 - protein, 21 aa, Plasmodium falciparum
LFEEIEKRNGFDLNDDTTNSN

SEQ ID NO: 3267508 - protein, 36 aa, Plasmodium falciparum
LFEISRKTLLVIKFNFLFSFFINIFFILLASGAFYS

SEQ ID NO: 3267509 - protein, 24 aa, Plasmodium falciparum
LFEKLKLALLFLTWYTLNVLYNVD

SEQ ID NO: 3267510 - protein, 19 aa, Plasmodium falciparum
LFEKYCNFQYFPQLDFLNK

SEQ ID NO: 3267511 - protein, 17 aa, Plasmodium falciparum
LFEKYNLSYLGRIAYLR

SEQ ID NO: 3267512 - protein, 26 aa, Plasmodium falciparum
LFERGKYAINSTFSVTIILAIIYYFL

SEQ ID NO: 3267513 - protein, 18 aa, Plasmodium falciparum
LFETVLLFERDDIIKYDK

SEQ ID NO: 3267514 - protein, 19 aa, Plasmodium falciparum
LFETYKWKNIIKIIKKTLK

SEQ ID NO: 3267515 - protein, 28 aa, Plasmodium falciparum
LFEYNIFYKRYIKVHIEYGEKIGDQKYQ

SEQ ID NO: 3267516 - protein, 21 aa, Plasmodium falciparum
LFFAICIFYAIFFKYENSTSV

SEQ ID NO: 3267517 - protein, 18 aa, Plasmodium falciparum
LFFCITGMFLRIMGIINC

SEQ ID NO: 3267518 - protein, 19 aa, Plasmodium falciparum
LFFCLPLNILEISSYEINK

SEQ ID NO: 3267519 - protein, 20 aa, Plasmodium falciparum
LFFDECEVLRNISYNHKTQN

SEQ ID NO: 3267520 - protein, 26 aa, Plasmodium falciparum
LFFERIIKMYMELLGEYKKADWDKNK

SEQ ID NO: 3267521 - protein, 21 aa, Plasmodium falciparum
LFFFDELYYYYSVNHTYIACF

SEQ ID NO: 3267522 - protein, 22 aa, Plasmodium falciparum
LFFFNMTKWIGIDGNLNISNDK

SEQ ID NO: 3267523 - protein, 26 aa, Plasmodium falciparum
LFFFSSSFFPNVCRELFFNDDDLIKM

SEQ ID NO: 3267524 - protein, 20 aa, Plasmodium falciparum
LFFFVIRIKKSWNINYKFKN

SEQ ID NO: 3267525 - protein, 18 aa, Plasmodium falciparum
LFFFYSILYVVLCTYVLG

SEQ ID NO: 3267526 - protein, 18 aa, Plasmodium falciparum
LFFHNLLFISCTNNSIYI

SEQ ID NO: 3267527 - protein, 17 aa, Plasmodium falciparum
LFFKINCMICNKVCVTN

SEQ ID NO: 3267528 - protein, 17 aa, Plasmodium falciparum
LFFLVCFYYIISQILKL

SEQ ID NO: 3267529 - protein, 17 aa, Plasmodium falciparum
LFFNIKYNIAIIYAPYI

SEQ ID NO: 3267530 - protein, 25 aa, Plasmodium falciparum
LFFNIPKYKLNIHNILLNFSNVDNS

SEQ ID NO: 3267531 - protein, 23 aa, Plasmodium falciparum
LFFPEPWILFVTQFLWQFPHFYS

SEQ ID NO: 3267532 - protein, 18 aa, Plasmodium falciparum
LFFTLCFNFIFYRYLYYF

SEQ ID NO: 3267533 - protein, 17 aa, Plasmodium falciparum
LFGRRDSSFQFFRRAAS

SEQ ID NO: 3267534 - protein, 38 aa, Plasmodium falciparum
LFGSIDVFRLILIKLNIPLDVLSIWFTLLLKNLNYITE

SEQ ID NO: 3267535 - protein, 21 aa, Plasmodium falciparum
LFGVIKRNELITDFLSGNIFD

SEQ ID NO: 3267536 - protein, 23 aa, Plasmodium falciparum
LFHEFGHAYHLLLLSYKYKLYNF

SEQ ID NO: 3267537 - protein, 27 aa, Plasmodium falciparum
LFHFYFIKRFLSLIFNKHANEDDNNKT

SEQ ID NO: 3267538 - protein, 38 aa, Plasmodium falciparum
LFHKYGIQYKDLIPMNMFPTAYLNLGRERRSSKYENSS

SEQ ID NO: 3267539 - protein, 17 aa, Plasmodium falciparum
LFHLITCDCLKIKDIHN

SEQ ID NO: 3267540 - protein, 17 aa, Plasmodium falciparum
LFHVHGLIGVLLPIIYC

SEQ ID NO: 3267541 - protein, 26 aa, Plasmodium falciparum
LFHYFKTNLVHYFFLLSNEHLSRCII

SEQ ID NO: 3267542 - protein, 29 aa, Plasmodium falciparum
LFIASLPIKSVIVIWDYLFSTSIKKIIII

SEQ ID NO: 3267543 - protein, 24 aa, Plasmodium falciparum
LFIDCLFKKCWNESFFNNNNNNNI

SEQ ID NO: 3267544 - protein, 34 aa, Plasmodium falciparum
LFIHRKNPLINFCLRKNIYCDNINKHLYRQYIYY

SEQ ID NO: 3267545 - protein, 19 aa, Plasmodium falciparum
LFIIISFIWFFLNRTKHLN

SEQ ID NO: 3267546 - protein, 23 aa, Plasmodium falciparum
LFIIKRCFTKFFTQYEENKKKNK

SEQ ID NO: 3267547 - protein, 24 aa, Plasmodium falciparum
LFIILRYITYFWFYLSEDNKLILI

SEQ ID NO: 3267548 - protein, 32 aa, Plasmodium falciparum
LFIIWSILLNHVYKYEIMCFSNIQSSNQRDIK

SEQ ID NO: 3267549 - protein, 19 aa, Plasmodium falciparum
LFIKECSDFNFNEYEQKEK

SEQ ID NO: 3267550 - protein, 25 aa, Plasmodium falciparum
LFIKRIPVEWWIKQFNLMEKYDGEY

SEQ ID NO: 3267551 - protein, 36 aa, Plasmodium falciparum
LFILIPYIYIRKALCESRTYYVYTHFKRKMESSEKN

SEQ ID NO: 3267552 - protein, 19 aa, Plasmodium falciparum
LFINYNILCNISMKNLMKK

SEQ ID NO: 3267553 - protein, 17 aa, Plasmodium falciparum
LFIQSIYVFEILIQRKT

SEQ ID NO: 3267554 - protein, 20 aa, Plasmodium falciparum
LFIQYILKFKNRCLYICSIL

SEQ ID NO: 3267555 - protein, 18 aa, Plasmodium falciparum
LFIRCAAIETFFLWKKYE

SEQ ID NO: 3267556 - protein, 21 aa, Plasmodium falciparum
LFIRLMTKCKMNESSKGIRHL

SEQ ID NO: 3267557 - protein, 17 aa, Plasmodium falciparum
LFISINILYFWYSEYLD

SEQ ID NO: 3267558 - protein, 29 aa, Plasmodium falciparum
LFISLIVDECVDLCFKLLYSTIETDQKSA

SEQ ID NO: 3267559 - protein, 26 aa, Plasmodium falciparum
LFISMNFLICYSIFIVSIHFVTRTIL

SEQ ID NO: 3267560 - protein, 25 aa, Plasmodium falciparum
LFITFLIFCGFFRYMTELYHTHFYN

SEQ ID NO: 3267561 - protein, 17 aa, Plasmodium falciparum
LFIVNDFFRNMFVILSF

SEQ ID NO: 3267562 - protein, 28 aa, Plasmodium falciparum
LFKDIYIYRIYECFLKPYNIVNMNRLFE

SEQ ID NO: 3267563 - protein, 33 aa, Plasmodium falciparum
LFKILDLCKLYNIYCINCSFPYVHDIVYKNKRP

SEQ ID NO: 3267564 - protein, 18 aa, Plasmodium falciparum
LFKKECIKKEYLKNDDIL

SEQ ID NO: 3267565 - protein, 17 aa, Plasmodium falciparum
LFKKERKNSHLFYLNKS

SEQ ID NO: 3267566 - protein, 17 aa, Plasmodium falciparum
LFKKFCKKTLSLMYKND

SEQ ID NO: 3267567 - protein, 23 aa, Plasmodium falciparum
LFKKVMLNLLKRGVVYDDQKNVL

SEQ ID NO: 3267568 - protein, 18 aa, Plasmodium falciparum
LFKMRRKAKRQVDMIRIL

SEQ ID NO: 3267569 - protein, 30 aa, Plasmodium falciparum
LFKNDEKYLFGLELICCLCGHTYRNKVQNG

SEQ ID NO: 3267570 - protein, 18 aa, Plasmodium falciparum
LFKNDFVFLNGKLVAWRF

SEQ ID NO: 3267571 - protein, 34 aa, Plasmodium falciparum
LFKNILIDFHIYRYNDFQNIFSLINKFKTEGKKK

SEQ ID NO: 3267572 - protein, 17 aa, Plasmodium falciparum
LFKQMLINSDFDKVYEI

SEQ ID NO: 3267573 - protein, 18 aa, Plasmodium falciparum
LFKRCPYNKKHYSMIKNE

SEQ ID NO: 3267574 - protein, 25 aa, Plasmodium falciparum
LFKRIPLERNYEGFILEQKNIKDED

SEQ ID NO: 3267575 - protein, 18 aa, Plasmodium falciparum
LFKRLSKHFYIAEVSAYF

SEQ ID NO: 3267576 - protein, 22 aa, Plasmodium falciparum
LFKSACIINGVYEWILSTYSSD

SEQ ID NO: 3267577 - protein, 19 aa, Plasmodium falciparum
LFLCYRNKHIYKYIKKRQA

SEQ ID NO: 3267578 - protein, 34 aa, Plasmodium falciparum
LFLEIYSKTISLCFDFIYFYTIQTYDVISLYCVY

SEQ ID NO: 3267579 - protein, 18 aa, Plasmodium falciparum
LFLERNIAPENIVSFLEE

SEQ ID NO: 3267580 - protein, 18 aa, Plasmodium falciparum
LFLGRKLFLNKFKRSFCI

SEQ ID NO: 3267581 - protein, 26 aa, Plasmodium falciparum
LFLHLINFYINFSCSVYFHYLTHYEK

SEQ ID NO: 3267582 - protein, 24 aa, Plasmodium falciparum
LFLHNCAYSIFNINGEIANSFVND

SEQ ID NO: 3267583 - protein, 20 aa, Plasmodium falciparum
LFLIPLLIGFIFLKDDDIIS

SEQ ID NO: 3267584 - protein, 22 aa, Plasmodium falciparum
LFLKASCFEFFYLGNEYQNSSK

SEQ ID NO: 3267585 - protein, 26 aa, Plasmodium falciparum
LFLKICNNKNLFLYMFINITFFFSLK

SEQ ID NO: 3267586 - protein, 23 aa, Plasmodium falciparum
LFLKKSIYFKSIFNCGNINEKEE

SEQ ID NO: 3267587 - protein, 26 aa, Plasmodium falciparum
LFLKSIEIYKNIYVYNSLFFMIAEKM

SEQ ID NO: 3267588 - protein, 20 aa, Plasmodium falciparum
LFLLFKKYYISICGNQTTKI

SEQ ID NO: 3267589 - protein, 18 aa, Plasmodium falciparum
LFLLIFFLYLKKNVICSI

SEQ ID NO: 3267590 - protein, 20 aa, Plasmodium falciparum
LFLNEVQKLVHFTNIYNNNN

SEQ ID NO: 3267591 - protein, 24 aa, Plasmodium falciparum
LFLNFLRFLGIQLYYKNDYMFLLC

SEQ ID NO: 3267592 - protein, 23 aa, Plasmodium falciparum
LFLNIYMFMKFIKLIKLIKKNDL

SEQ ID NO: 3267593 - protein, 20 aa, Plasmodium falciparum
LFLNYACSHFQFKYKQGLNE

SEQ ID NO: 3267594 - protein, 19 aa, Plasmodium falciparum
LFLPKFSTFLFFTIPIFVM

SEQ ID NO: 3267595 - protein, 17 aa, Plasmodium falciparum
LFLPPMKIFIILFLINR

SEQ ID NO: 3267596 - protein, 22 aa, Plasmodium falciparum
LFLSCLYNVLTLSIHFNIKDVV

SEQ ID NO: 3267597 - protein, 18 aa, Plasmodium falciparum
LFLSFIIIIIHGKDISST

SEQ ID NO: 3267598 - protein, 35 aa, Plasmodium falciparum
LFLSSFQLSFSFIFSMYCEFYYLSIINMGLFVTSI

SEQ ID NO: 3267599 - protein, 24 aa, Plasmodium falciparum
LFMDMYICSAPILYDTHLSKKKIM

SEQ ID NO: 3267600 - protein, 18 aa, Plasmodium falciparum
LFMKGHDHYSCSLSSAIY

SEQ ID NO: 3267601 - protein, 18 aa, Plasmodium falciparum
LFMMMFLCLNILLINMIK

SEQ ID NO: 3267602 - protein, 17 aa, Plasmodium falciparum
LFMSFVNLIFVILTSFF

SEQ ID NO: 3267603 - protein, 28 aa, Plasmodium falciparum
LFMTGVSFGICLFKFINFLSYHKSSICR

SEQ ID NO: 3267604 - protein, 27 aa, Plasmodium falciparum
LFNALFKRWLEYFLEDYKKIKHKISHC

SEQ ID NO: 3267605 - protein, 27 aa, Plasmodium falciparum
LFNEEKCFYCYPSNLNFNMNTSFLTYY

SEQ ID NO: 3267606 - protein, 23 aa, Plasmodium falciparum
LFNELLFICFKFINYPLKHVQLC

SEQ ID NO: 3267607 - protein, 18 aa, Plasmodium falciparum
LFNIDYYNVRGMNIGNKV

SEQ ID NO: 3267608 - protein, 24 aa, Plasmodium falciparum
LFNIPKRLSSLIYPKIKKNFIAKI

SEQ ID NO: 3267609 - protein, 21 aa, Plasmodium falciparum
LFNISSYVFILLFLETAIIKF

SEQ ID NO: 3267610 - protein, 18 aa, Plasmodium falciparum
LFNKELYKLITKLKTKNM

SEQ ID NO: 3267611 - protein, 18 aa, Plasmodium falciparum
LFNKFLVFLLYSNVYEFK

SEQ ID NO: 3267612 - protein, 30 aa, Plasmodium falciparum
LFNKQRDWPRITFTFLVFVLGIKTVLCILL

SEQ ID NO: 3267613 - protein, 20 aa, Plasmodium falciparum
LFNKYKIIFLQTTTEIPIDG

SEQ ID NO: 3267614 - protein, 20 aa, Plasmodium falciparum
LFNLKSKWMKQNILFGDIES

SEQ ID NO: 3267615 - protein, 19 aa, Plasmodium falciparum
LFNLLRSRVLAVCINYSDF

SEQ ID NO: 3267616 - protein, 25 aa, Plasmodium falciparum
LFNMKNCIRMFILFRDLYVKEENGY

SEQ ID NO: 3267617 - protein, 18 aa, Plasmodium falciparum
LFNNTAIMFLHYITNNLE

SEQ ID NO: 3267618 - protein, 18 aa, Plasmodium falciparum
LFNQICLLYVNYNPIKCM

SEQ ID NO: 3267619 - protein, 27 aa, Plasmodium falciparum
LFNVLCFYPSLLYMIIKFCKMNILEEC

SEQ ID NO: 3267620 - protein, 25 aa, Plasmodium falciparum
LFNWPSGKNLLEFFIAKDNSQNKKV

SEQ ID NO: 3267621 - protein, 18 aa, Plasmodium falciparum
LFNYNSSIFSYIFLNKNM

SEQ ID NO: 3267622 - protein, 46 aa, Plasmodium falciparum
LFPIKFHHLVILKLLHWYYKGYLRRYYKNVILYSILENIKNIKKNL

SEQ ID NO: 3267623 - protein, 25 aa, Plasmodium falciparum
LFPLKDIFKNYVFLMNKEKYFFDIS

SEQ ID NO: 3267624 - protein, 24 aa, Plasmodium falciparum
LFQEKKMLCNISFNSKRKELRDKI

SEQ ID NO: 3267625 - protein, 19 aa, Plasmodium falciparum
LFQFFFYLTIGYKANTSQY

SEQ ID NO: 3267626 - protein, 18 aa, Plasmodium falciparum
LFQHIIKYNSEYINLKDY

SEQ ID NO: 3267627 - protein, 30 aa, Plasmodium falciparum
LFQHRIHYLKEWNPKILIIKKFYPEDIIIK

SEQ ID NO: 3267628 - protein, 25 aa, Plasmodium falciparum
LFRGFGATCSYEWIECDENVEVKIR

SEQ ID NO: 3267629 - protein, 21 aa, Plasmodium falciparum
LFRHIPLNYAKYLLLTNKIIN

SEQ ID NO: 3267630 - protein, 26 aa, Plasmodium falciparum
LFSHYKKYSCLDFLKNDFERYRNNGC

SEQ ID NO: 3267631 - protein, 23 aa, Plasmodium falciparum
LFSIDLDVLKTFHLFLKEKNEDL

SEQ ID NO: 3267632 - protein, 18 aa, Plasmodium falciparum
LFSIICLFEGGEIENVTR

SEQ ID NO: 3267633 - protein, 24 aa, Plasmodium falciparum
LFSKKKKKRCSFNIYKDKKEKKEY

SEQ ID NO: 3267634 - protein, 24 aa, Plasmodium falciparum
LFSKKKSSDDFVLYINEEFTEDSS

SEQ ID NO: 3267635 - protein, 24 aa, Plasmodium falciparum
LFSKLRSFLELARIIVDQMKKRED

SEQ ID NO: 3267636 - protein, 19 aa, Plasmodium falciparum
LFSLNRMNFLFVIKYVSTF

SEQ ID NO: 3267637 - protein, 18 aa, Plasmodium falciparum
LFSSICFILCLTGLNAHR

SEQ ID NO: 3267638 - protein, 33 aa, Plasmodium falciparum
LFSTSIKKIIIISVALLKILKSYLMKHKFEKIL

SEQ ID NO: 3267639 - protein, 26 aa, Plasmodium falciparum
LFSYLKVCYHNDLWLHKKNQNGDSDS

SEQ ID NO: 3267640 - protein, 18 aa, Plasmodium falciparum
LFTERKVYYYNIYPYYEK

SEQ ID NO: 3267641 - protein, 18 aa, Plasmodium falciparum
LFTHFKILFDKNIYKEKD

SEQ ID NO: 3267642 - protein, 17 aa, Plasmodium falciparum
LFTHTYIIYTFIQRLNN

SEQ ID NO: 3267643 - protein, 17 aa, Plasmodium falciparum
LFTKCLYNGMKIPLPPK

SEQ ID NO: 3267644 - protein, 19 aa, Plasmodium falciparum
LFTKKNCLCIVLKEREESY

SEQ ID NO: 3267645 - protein, 23 aa, Plasmodium falciparum
LFVCFLLFFLILSFRYSCEKKKL

SEQ ID NO: 3267646 - protein, 18 aa, Plasmodium falciparum
LFVFYILYILLSFNNERK

SEQ ID NO: 3267647 - protein, 33 aa, Plasmodium falciparum
LFVHPYFKQRFAFKLAKHYKLVVRVADDRIYND

SEQ ID NO: 3267648 - protein, 30 aa, Plasmodium falciparum
LFVLHSICIFLLWCSWLFILFNDVKDYLPI

SEQ ID NO: 3267649 - protein, 26 aa, Plasmodium falciparum
LFVLISFACVILLFCNVYEAPFINND

SEQ ID NO: 3267650 - protein, 17 aa, Plasmodium falciparum
LFYEPKINILDNQKQIN

SEQ ID NO: 3267651 - protein, 26 aa, Plasmodium falciparum
LFYEQPCFLSSCSFNGIYQPNLENNK

SEQ ID NO: 3267652 - protein, 19 aa, Plasmodium falciparum
LFYHICVINKYKIDDTSFV

SEQ ID NO: 3267653 - protein, 25 aa, Plasmodium falciparum
LFYHPDMYASYIFFKTLTYSGLPTY

SEQ ID NO: 3267654 - protein, 18 aa, Plasmodium falciparum
LFYIKLRILLSEKKFITF

SEQ ID NO: 3267655 - protein, 26 aa, Plasmodium falciparum
LFYILGEFQFAFILFHLGYNYQSFIQ

SEQ ID NO: 3267656 - protein, 20 aa, Plasmodium falciparum
LFYIQKCFMSPYYYDNIKTE

SEQ ID NO: 3267657 - protein, 23 aa, Plasmodium falciparum
LFYKVLCNFIKCKVQTLNAKNLF

SEQ ID NO: 3267658 - protein, 21 aa, Plasmodium falciparum
LFYLYKYMRKADVKRTYKLLR

SEQ ID NO: 3267659 - protein, 20 aa, Plasmodium falciparum
LFYMIVFVCLYRMYYYNHKE

SEQ ID NO: 3267660 - protein, 18 aa, Plasmodium falciparum
LFYNFPHIIISTPGRLKH

SEQ ID NO: 3267661 - protein, 18 aa, Plasmodium falciparum
LFYPSNFLLLPLKEAFFF

SEQ ID NO: 3267662 - protein, 18 aa, Plasmodium falciparum
LFYSFQFLFIPTYILQNI

SEQ ID NO: 3267663 - protein, 23 aa, Plasmodium falciparum
LFYTIRIYFKIPLIFLNLLCIVI

SEQ ID NO: 3267664 - protein, 24 aa, Plasmodium falciparum
LFYTKCIVILLVLCSIFIFIYNFS

SEQ ID NO: 3267665 - protein, 24 aa, Plasmodium falciparum
LFYTKYYICFFFFVNNTKWCWHKL

SEQ ID NO: 3267666 - protein, 19 aa, Plasmodium falciparum
LFYWLHIYLNFTLSKRIYL

SEQ ID NO: 3267667 - protein, 21 aa, Plasmodium falciparum
LFYYINICLYIDPSRKSKNMC

SEQ ID NO: 3267668 - protein, 24 aa, Plasmodium falciparum
LGALETFLKLGYNGKLIICSKDAY

SEQ ID NO: 3267669 - protein, 17 aa, Plasmodium falciparum
LGAVAASVGIFRALALN

SEQ ID NO: 3267670 - protein, 17 aa, Plasmodium falciparum
LGDDGVEEREKISTEEV

SEQ ID NO: 3267671 - protein, 22 aa, Plasmodium falciparum
LGDIICDALRLMLWDIESTVKD

SEQ ID NO: 3267672 - protein, 27 aa, Plasmodium falciparum
LGDIKDCSISEYMSRYMKNNGNDKDHK

SEQ ID NO: 3267673 - protein, 23 aa, Plasmodium falciparum
LGDPFMRKYFTVFDYDNQSVGIA

SEQ ID NO: 3267674 - protein, 24 aa, Plasmodium falciparum
LGEACRQKYEYGREKFPNWKCISG

SEQ ID NO: 3267675 - protein, 25 aa, Plasmodium falciparum
LGEFRLKKFPKFAVFLIIIAIIISN

SEQ ID NO: 3267676 - protein, 23 aa, Plasmodium falciparum
LGEIIKAYIFCKSVKIKETCNLC

SEQ ID NO: 3267677 - protein, 25 aa, Plasmodium falciparum
LGESNLCVSELCIGTNMYENDNFIS

SEQ ID NO: 3267678 - protein, 18 aa, Plasmodium falciparum
LGFFSDIYGRKICLNISF

SEQ ID NO: 3267679 - protein, 25 aa, Plasmodium falciparum
LGFQELYPKFCIYRVPDHTRLPTAS

SEQ ID NO: 3267680 - protein, 17 aa, Plasmodium falciparum
LGGCVGYLLAVALPLMK

SEQ ID NO: 3267681 - protein, 17 aa, Plasmodium falciparum
LGGIRLRNGVDNKRTHD

SEQ ID NO: 3267682 - protein, 29 aa, Plasmodium falciparum
LGGSEKEFLRLIFSGVVIQKVQCQKCLFI

SEQ ID NO: 3267683 - protein, 26 aa, Plasmodium falciparum
LGIDIYSVSIQYIFYNISFLDIYKNI

SEQ ID NO: 3267684 - protein, 25 aa, Plasmodium falciparum
LGILKGMPGHRIFRNKLDTYIRNYT

SEQ ID NO: 3267685 - protein, 23 aa, Plasmodium falciparum
LGIPRTARMGLWENVMENKLKDI

SEQ ID NO: 3267686 - protein, 18 aa, Plasmodium falciparum
LGISHTWLCDPSRFLSIE

SEQ ID NO: 3267687 - protein, 17 aa, Plasmodium falciparum
LGIVTFILLGGYRPFYP

SEQ ID NO: 3267688 - protein, 23 aa, Plasmodium falciparum
LGKEIRIPRIFSYAKLCNTSFVP

SEQ ID NO: 3267689 - protein, 21 aa, Plasmodium falciparum
LGKHRPIYPGLTIQLSAIKFL

SEQ ID NO: 3267690 - protein, 24 aa, Plasmodium falciparum
LGKIELISTFGIFFGISICACASF

SEQ ID NO: 3267691 - protein, 20 aa, Plasmodium falciparum
LGKKYCKELYMASDKNFEDM

SEQ ID NO: 3267692 - protein, 22 aa, Plasmodium falciparum
LGLDAWKAAALVTAKELAEKAG

SEQ ID NO: 3267693 - protein, 18 aa, Plasmodium falciparum
LGLDVWKAAAIKAATEYA

SEQ ID NO: 3267694 - protein, 48 aa, Plasmodium falciparum
LGLIEKQKIIWKSWIVKNVNNIENWFDEMWFKNVVNELKEKNDVSNVL

SEQ ID NO: 3267695 - protein, 18 aa, Plasmodium falciparum
LGLLCGYGAYELVKAAIV

SEQ ID NO: 3267696 - protein, 25 aa, Plasmodium falciparum
LGLLKEIWGYSSFLQGISLLYSNRL

SEQ ID NO: 3267697 - protein, 18 aa, Plasmodium falciparum
LGLNAWKTTEITAAIAAA

SEQ ID NO: 3267698 - protein, 17 aa, Plasmodium falciparum
LGLTGTIIWSLGIPLFS

SEQ ID NO: 3267699 - protein, 25 aa, Plasmodium falciparum
LGLYWLLCAFICFVVTFYIFVLDKS

SEQ ID NO: 3267700 - protein, 19 aa, Plasmodium falciparum
LGMGIKWKGFIEKLIKVKE

SEQ ID NO: 3267701 - protein, 25 aa, Plasmodium falciparum
LGNFIPRLKLQNFYFFVIHKKKNIP

SEQ ID NO: 3267702 - protein, 17 aa, Plasmodium falciparum
LGNFRIVSILLKGFSST

SEQ ID NO: 3267703 - protein, 22 aa, Plasmodium falciparum
LGNHFKGVSFLTSKRILNNNSN

SEQ ID NO: 3267704 - protein, 23 aa, Plasmodium falciparum
LGNIKSYPFYKGYSNFVQTPYIE

SEQ ID NO: 3267705 - protein, 19 aa, Plasmodium falciparum
LGNTCYLNSLLQALYSTVS

SEQ ID NO: 3267706 - protein, 23 aa, Plasmodium falciparum
LGNTIISFFSFIFLSSFFEVVLS

SEQ ID NO: 3267707 - protein, 24 aa, Plasmodium falciparum
LGQRVCLYIHDLMYVYLIVYFILF

SEQ ID NO: 3267708 - protein, 25 aa, Plasmodium falciparum
LGSAMAYEILHNVKVRISESNLKYN

SEQ ID NO: 3267709 - protein, 17 aa, Plasmodium falciparum
LGSHYMDHLSCHNKEGK

SEQ ID NO: 3267710 - protein, 17 aa, Plasmodium falciparum
LGSSIAVGGTFVYSLVK

SEQ ID NO: 3267711 - protein, 24 aa, Plasmodium falciparum
LGSSSFYWYKFIVPLFLLSFGLLI

SEQ ID NO: 3267712 - protein, 23 aa, Plasmodium falciparum
LGTLKILYNFYVNLFDKLKEDVE

SEQ ID NO: 3267713 - protein, 17 aa, Plasmodium falciparum
LGTYGWKIAAITTATEL

SEQ ID NO: 3267714 - protein, 17 aa, Plasmodium falciparum
LGTYGWKVAATATAIEF

SEQ ID NO: 3267715 - protein, 19 aa, Plasmodium falciparum
LGVCYGHQLICYFYGNKIE

SEQ ID NO: 3267716 - protein, 17 aa, Plasmodium falciparum
LGVFTFIGNLGFVSYTL

SEQ ID NO: 3267717 - protein, 21 aa, Plasmodium falciparum
LGVGEYEIYITFLSNNHYKNV

SEQ ID NO: 3267718 - protein, 23 aa, Plasmodium falciparum
LGYDKRISKNFILEETGSDQEYI

SEQ ID NO: 3267719 - protein, 24 aa, Plasmodium falciparum
LGYLKYNYCLILKSLNKIELVSLN

SEQ ID NO: 3267720 - protein, 22 aa, Plasmodium falciparum
LGYPTLMCLYEILKSEKNNQTN

SEQ ID NO: 3267721 - protein, 17 aa, Plasmodium falciparum
LHAECSEIRICVKEYLL

SEQ ID NO: 3267722 - protein, 37 aa, Plasmodium falciparum
LHAYGKIGCILVHCFPPWSCTYGYIKKEHYIINECLY

SEQ ID NO: 3267723 - protein, 21 aa, Plasmodium falciparum
LHAYGKLLIKDEEFILYLLIN

SEQ ID NO: 3267724 - protein, 20 aa, Plasmodium falciparum
LHCNQFRLNDIIKILYSHPQ

SEQ ID NO: 3267725 - protein, 40 aa, Plasmodium falciparum
LHCTINLKTIYFKNIKSILRLKENVYIFAYALLLSLFNVV

SEQ ID NO: 3267726 - protein, 18 aa, Plasmodium falciparum
LHDIPFEKIIELKKMYIF

SEQ ID NO: 3267727 - protein, 27 aa, Plasmodium falciparum
LHEYESLKLLELFSLQYPMFLKIQNKP

SEQ ID NO: 3267728 - protein, 31 aa, Plasmodium falciparum
LHFFYGFFCSSLIYLKYYFKIEFKLIKIEHM

SEQ ID NO: 3267729 - protein, 35 aa, Plasmodium falciparum
LHFLKNEIYRNVIFLKYKYLKSYKTAIHNLKQEKK

SEQ ID NO: 3267730 - protein, 23 aa, Plasmodium falciparum
LHFLYEHHFYPSFFNQEKGEHIS

SEQ ID NO: 3267731 - protein, 25 aa, Plasmodium falciparum
LHFNIKNVFIVGGVGCNNFLYQSLK

SEQ ID NO: 3267732 - protein, 18 aa, Plasmodium falciparum
LHFREIDKSIQIYKYIVD

SEQ ID NO: 3267733 - protein, 19 aa, Plasmodium falciparum
LHFTNLIFDLYISRFNSKD

SEQ ID NO: 3267734 - protein, 19 aa, Plasmodium falciparum
LHGNNFLPSLVLKSKEDNS

SEQ ID NO: 3267735 - protein, 25 aa, Plasmodium falciparum
LHGQFKKVITYLGFKKYVDLNQMKI

SEQ ID NO: 3267736 - protein, 17 aa, Plasmodium falciparum
LHHLSYYNECMKLYLTV

SEQ ID NO: 3267737 - protein, 30 aa, Plasmodium falciparum
LHIFLRIKKKLKFTFSHLQKFFLKNFAYIS

SEQ ID NO: 3267738 - protein, 30 aa, Plasmodium falciparum
LHIKCLIPVWLYKQYKIYISLIILNLIFLL

SEQ ID NO: 3267739 - protein, 17 aa, Plasmodium falciparum
LHIKPITSFFLETHKDL

SEQ ID NO: 3267740 - protein, 19 aa, Plasmodium falciparum
LHILKCLDLLLEIYYNRSG

SEQ ID NO: 3267741 - protein, 18 aa, Plasmodium falciparum
LHILKIYLNKEIKINISY

SEQ ID NO: 3267742 - protein, 17 aa, Plasmodium falciparum
LHILYKINPQEIKTFNH

SEQ ID NO: 3267743 - protein, 21 aa, Plasmodium falciparum
LHINKLKGLFISPSKLDEDQS

SEQ ID NO: 3267744 - protein, 20 aa, Plasmodium falciparum
LHIQPFFNYFEQYRINQVTK

SEQ ID NO: 3267745 - protein, 28 aa, Plasmodium falciparum
LHISFRNFFLIFKYIYMYSSYKTTELFS

SEQ ID NO: 3267746 - protein, 24 aa, Plasmodium falciparum
LHKCLHEYKYYNIIDIFDFYTVFE

SEQ ID NO: 3267747 - protein, 24 aa, Plasmodium falciparum
LHKENRLSHRLPIGKLELLKRYGE

SEQ ID NO: 3267748 - protein, 20 aa, Plasmodium falciparum
LHKHFSLLYLLAESGLYIKE

SEQ ID NO: 3267749 - protein, 17 aa, Plasmodium falciparum
LHKKFTYDSHLDKIVSQ

SEQ ID NO: 3267750 - protein, 19 aa, Plasmodium falciparum
LHLALLKIAEVFSENTSGK

SEQ ID NO: 3267751 - protein, 18 aa, Plasmodium falciparum
LHLCCEISDYCLKFFNPK

SEQ ID NO: 3267752 - protein, 19 aa, Plasmodium falciparum
LHLFRCAYAKYLKDMNIKR

SEQ ID NO: 3267753 - protein, 17 aa, Plasmodium falciparum
LHLLYISAFPFEVEQIY

SEQ ID NO: 3267754 - protein, 21 aa, Plasmodium falciparum
LHLLYSRFFHKFLYDLKLTKH

SEQ ID NO: 3267755 - protein, 17 aa, Plasmodium falciparum
LHLLYYYMNLCSNVNYF

SEQ ID NO: 3267756 - protein, 19 aa, Plasmodium falciparum
LHLNYSLVHPYNYNYFYYI

SEQ ID NO: 3267757 - protein, 32 aa, Plasmodium falciparum
LHLPLLILVFKEYFFRFFSHIFYFICTYPYYI

SEQ ID NO: 3267758 - protein, 21 aa, Plasmodium falciparum
LHLYYRYVNVTNILFLEDYNK

SEQ ID NO: 3267759 - protein, 17 aa, Plasmodium falciparum
LHMKIIGSKMMKHEIEM

SEQ ID NO: 3267760 - protein, 20 aa, Plasmodium falciparum
LHMKLYLFFNYNIFDKLQEC

SEQ ID NO: 3267761 - protein, 17 aa, Plasmodium falciparum
LHMRNGLKNNRFFDNNM

SEQ ID NO: 3267762 - protein, 18 aa, Plasmodium falciparum
LHNILDIHIVHMKQSDII

SEQ ID NO: 3267763 - protein, 20 aa, Plasmodium falciparum
LHNMIYYILNMVSISINILA

SEQ ID NO: 3267764 - protein, 22 aa, Plasmodium falciparum
LHNRKLFRRYFNGMYKSELYLE

SEQ ID NO: 3267765 - protein, 26 aa, Plasmodium falciparum
LHNVFLEFIDKLSYPLFIDTIISMTY

SEQ ID NO: 3267766 - protein, 18 aa, Plasmodium falciparum
LHNVMCTFIDNIRNSIVP

SEQ ID NO: 3267767 - protein, 20 aa, Plasmodium falciparum
LHNWNYFFIERFFNPTSKYC

SEQ ID NO: 3267768 - protein, 26 aa, Plasmodium falciparum
LHPCMHGGFCEACIRCMIFNSLKLKD

SEQ ID NO: 3267769 - protein, 18 aa, Plasmodium falciparum
LHPIINVEATKKCSNNLS

SEQ ID NO: 3267770 - protein, 36 aa, Plasmodium falciparum
LHPKRLYLKHFKLISVSNYDDVEWYIQQGRQMTFQK

SEQ ID NO: 3267771 - protein, 19 aa, Plasmodium falciparum
LHRTFGRAIGLFFLSGASF

SEQ ID NO: 3267772 - protein, 18 aa, Plasmodium falciparum
LHSIKKYGVVNIYDQIIT

SEQ ID NO: 3267773 - protein, 27 aa, Plasmodium falciparum
LHSYFLLFDILERLIIIPGGSNQKFNV

SEQ ID NO: 3267774 - protein, 18 aa, Plasmodium falciparum
LHTKMFLEKCLNLYYLLL

SEQ ID NO: 3267775 - protein, 21 aa, Plasmodium falciparum
LHTMLPNFLVEYLLISDPKND

SEQ ID NO: 3267776 - protein, 19 aa, Plasmodium falciparum
LHWENCYFLYNVLYDLKEK

SEQ ID NO: 3267777 - protein, 27 aa, Plasmodium falciparum
LHWFREWKNDFCIDKLKWNDVIKEPCI

SEQ ID NO: 3267778 - protein, 24 aa, Plasmodium falciparum
LHYFREFIFYLSLMLILALSNDLT

SEQ ID NO: 3267779 - protein, 17 aa, Plasmodium falciparum
LHYGFVIYWYVLLKENF

SEQ ID NO: 3267780 - protein, 29 aa, Plasmodium falciparum
LHYISFKFLCLCLYMIGFYYVFLNNSSEN

SEQ ID NO: 3267781 - protein, 19 aa, Plasmodium falciparum
LIAFYRVITILFNAPTLID

SEQ ID NO: 3267782 - protein, 30 aa, Plasmodium falciparum
LIAHILKIDVSNLFFDVLKNISINNLTLKK

SEQ ID NO: 3267783 - protein, 18 aa, Plasmodium falciparum
LIANIPRQVKFIVAEKSM

SEQ ID NO: 3267784 - protein, 29 aa, Plasmodium falciparum
LIASFFYYFSIYKISPWAIIKNVDFQITY

SEQ ID NO: 3267785 - protein, 25 aa, Plasmodium falciparum
LICCLLLTCGFYFKEHEKDIYKLYS

SEQ ID NO: 3267786 - protein, 26 aa, Plasmodium falciparum
LICENLELIPPLLVTNFIFTIGTCKY

SEQ ID NO: 3267787 - protein, 18 aa, Plasmodium falciparum
LICSYNILNQDKIFMMEK

SEQ ID NO: 3267788 - protein, 18 aa, Plasmodium falciparum
LIDCIKNGHWILLDEINL

SEQ ID NO: 3267789 - protein, 26 aa, Plasmodium falciparum
LIDGIKINKGISCVDESMISGEKNAI

SEQ ID NO: 3267790 - protein, 21 aa, Plasmodium falciparum
LIDISRTFPELLIFDKYAQQQ

SEQ ID NO: 3267791 - protein, 27 aa, Plasmodium falciparum
LIDIYKIVWCLCVLKKNEIFIDLLRIL

SEQ ID NO: 3267792 - protein, 24 aa, Plasmodium falciparum
LIDKCLKIFSNIPMRSVSLILNSM

SEQ ID NO: 3267793 - protein, 20 aa, Plasmodium falciparum
LIDKLSIFGNFIFSFLSLYL

SEQ ID NO: 3267794 - protein, 25 aa, Plasmodium falciparum
LIDMLKSLISYTWNIYQILFLYYQL

SEQ ID NO: 3267795 - protein, 33 aa, Plasmodium falciparum
LIDNAYCSICKEILSVPMIHFLCKHSYHSYCLK

SEQ ID NO: 3267796 - protein, 24 aa, Plasmodium falciparum
LIDNKWKHILGLGKIEDPNVQHLY

SEQ ID NO: 3267797 - protein, 17 aa, Plasmodium falciparum
LIDSHHIIQKCLLTMKK

SEQ ID NO: 3267798 - protein, 29 aa, Plasmodium falciparum
LIDYMCYWVYEFFDKILYFIKFSKSQKSK

SEQ ID NO: 3267799 - protein, 25 aa, Plasmodium falciparum
LIEFIPKLPEWKINSIKRLGVTKNN

SEQ ID NO: 3267800 - protein, 18 aa, Plasmodium falciparum
LIEGCTLTYIIQKLKGTD

SEQ ID NO: 3267801 - protein, 53 aa, Plasmodium falciparum
LIEGKLIFVKFLYICIDKEKFWDESFLCRRDIRTVIHVKALDVLFISKNKLKK

SEQ ID NO: 3267802 - protein, 21 aa, Plasmodium falciparum
LIEHAFALFLHKPHKYVDILI

SEQ ID NO: 3267803 - protein, 19 aa, Plasmodium falciparum
LIEKKCLYLYLIPIPPTNV

SEQ ID NO: 3267804 - protein, 19 aa, Plasmodium falciparum
LIEKTKCPIICICNDRQNN

SEQ ID NO: 3267805 - protein, 23 aa, Plasmodium falciparum
LIEMLKKKCKIEVAKNKNYSLLL

SEQ ID NO: 3267806 - protein, 19 aa, Plasmodium falciparum
LIENLCVFNNVTNCVMHKN

SEQ ID NO: 3267807 - protein, 25 aa, Plasmodium falciparum
LIEQPCRGEYELYDYVFSGMQTVTT

SEQ ID NO: 3267808 - protein, 24 aa, Plasmodium falciparum
LIEYLKFYSTNPFHMYVLISVISL

SEQ ID NO: 3267809 - protein, 18 aa, Plasmodium falciparum
LIFAFSMYAFSYIKSNWA

SEQ ID NO: 3267810 - protein, 19 aa, Plasmodium falciparum
LIFEKACLHKILQINKFSC

SEQ ID NO: 3267811 - protein, 24 aa, Plasmodium falciparum
LIFERNFGYKVGRNKLFKTIKELK

SEQ ID NO: 3267812 - protein, 19 aa, Plasmodium falciparum
LIFIIFCLLVFLMTKHIFL

SEQ ID NO: 3267813 - protein, 55 aa, Plasmodium falciparum
LIFILESLSLIIIRSLFYFNHFINIFLLYKINLAVCFFLNLLNIFILNKYCDKLS

SEQ ID NO: 3267814 - protein, 19 aa, Plasmodium falciparum
LIFKEIKDNIFIYILSIIY

SEQ ID NO: 3267815 - protein, 22 aa, Plasmodium falciparum
LIFKFHDGILIDCIKNGHWILL

SEQ ID NO: 3267816 - protein, 32 aa, Plasmodium falciparum
LIFKIYDPVIWRSLMCPNWKIRFNATCIFQLI

SEQ ID NO: 3267817 - protein, 26 aa, Plasmodium falciparum
LIFKKYDIKYIYGLYGIPINKIIYSF

SEQ ID NO: 3267818 - protein, 20 aa, Plasmodium falciparum
LIFKNERIHLSNEFLNKLLT

SEQ ID NO: 3267819 - protein, 28 aa, Plasmodium falciparum
LIFKNLEMYYMHFTKFSFNLKNMSDYRR

SEQ ID NO: 3267820 - protein, 17 aa, Plasmodium falciparum
LIFLYNVIRINESIIGR

SEQ ID NO: 3267821 - protein, 31 aa, Plasmodium falciparum
LIFNHRLYFSLYRKKYCPYKNTCLSKKKKKK

SEQ ID NO: 3267822 - protein, 25 aa, Plasmodium falciparum
LIFQQKCPFFFLPFSKNYNKYFKHY

SEQ ID NO: 3267823 - protein, 27 aa, Plasmodium falciparum
LIFSCVICIISCIFIILFIPQINSCID

SEQ ID NO: 3267824 - protein, 26 aa, Plasmodium falciparum
LIFSEDDIEFFIKCKLIYNVKLDIRF

SEQ ID NO: 3267825 - protein, 27 aa, Plasmodium falciparum
LIFSYACNFITPSIIYLIACKNIPFSE

SEQ ID NO: 3267826 - protein, 20 aa, Plasmodium falciparum
LIFVAVCIEKYVLLIKGGSN

SEQ ID NO: 3267827 - protein, 20 aa, Plasmodium falciparum
LIFVIPILVFYSFLILLFTK

SEQ ID NO: 3267828 - protein, 21 aa, Plasmodium falciparum
LIFWTGYSAIDAWNPWTKQII

SEQ ID NO: 3267829 - protein, 18 aa, Plasmodium falciparum
LIFYLGYKTWYMVYINHK

SEQ ID NO: 3267830 - protein, 21 aa, Plasmodium falciparum
LIGCSIFEIFLAWKNLTRKAK

SEQ ID NO: 3267831 - protein, 26 aa, Plasmodium falciparum
LIGKFKYNICMFIQKNLFHYFKTNLV

SEQ ID NO: 3267832 - protein, 28 aa, Plasmodium falciparum
LIGTKSIMCCCIILRTLLEMNSDGYYEP

SEQ ID NO: 3267833 - protein, 30 aa, Plasmodium falciparum
LIGTLIFHLFHMTFSFSFIKNYKTTDLWNS

SEQ ID NO: 3267834 - protein, 19 aa, Plasmodium falciparum
LIHFIKCYHIILRNFMNYK

SEQ ID NO: 3267835 - protein, 18 aa, Plasmodium falciparum
LIHKACLVGNLNIIYILL

SEQ ID NO: 3267836 - protein, 23 aa, Plasmodium falciparum
LIHRSLLLRIMDYFFYLINKNIH

SEQ ID NO: 3267837 - protein, 17 aa, Plasmodium falciparum
LIHVIIYEHELRLKNIY

SEQ ID NO: 3267838 - protein, 25 aa, Plasmodium falciparum
LIICILRLLSFKILFNSAVRKLVYD

SEQ ID NO: 3267839 - protein, 17 aa, Plasmodium falciparum
LIIDIFLGFLIFLLLYF

SEQ ID NO: 3267840 - protein, 22 aa, Plasmodium falciparum
LIIDIYICICLVHINNASDCYN

SEQ ID NO: 3267841 - protein, 19 aa, Plasmodium falciparum
LIIEKKINEILIYNIDIFV

SEQ ID NO: 3267842 - protein, 17 aa, Plasmodium falciparum
LIIELYLSLHIQKKHIP

SEQ ID NO: 3267843 - protein, 17 aa, Plasmodium falciparum
LIIENYQTWSLREVIQW

SEQ ID NO: 3267844 - protein, 19 aa, Plasmodium falciparum
LIIFIIFYIIYYWKDKNWS

SEQ ID NO: 3267845 - protein, 34 aa, Plasmodium falciparum
LIIFLIDLCIFGFMCLCGITMNIISMVILVLSVG

SEQ ID NO: 3267846 - protein, 17 aa, Plasmodium falciparum
LIIGKNFIKNLEKYQKF

SEQ ID NO: 3267847 - protein, 18 aa, Plasmodium falciparum
LIIGYPMTYRKIAPERST

SEQ ID NO: 3267848 - protein, 20 aa, Plasmodium falciparum
LIIHYVFSKFYRLHTIKFKK

SEQ ID NO: 3267849 - protein, 19 aa, Plasmodium falciparum
LIIIKIFLIMCDMTTFENF

SEQ ID NO: 3267850 - protein, 19 aa, Plasmodium falciparum
LIIILLLEVGVDWCKHSYL

SEQ ID NO: 3267851 - protein, 24 aa, Plasmodium falciparum
LIIIPYIIELIIYLMNVRKEIVHH

SEQ ID NO: 3267852 - protein, 23 aa, Plasmodium falciparum
LIIKDLKLEIHILLKDKEITNNL

SEQ ID NO: 3267853 - protein, 18 aa, Plasmodium falciparum
LIIKRITYIYIYIYIYNQ

SEQ ID NO: 3267854 - protein, 17 aa, Plasmodium falciparum
LIIKRRLSETLMYNKRS

SEQ ID NO: 3267855 - protein, 17 aa, Plasmodium falciparum
LIILYIWLYKRRKRSWK

SEQ ID NO: 3267856 - protein, 17 aa, Plasmodium falciparum
LIIMCANISFSKELTII

SEQ ID NO: 3267857 - protein, 17 aa, Plasmodium falciparum
LIIMSATMQSNLFYSYF

SEQ ID NO: 3267858 - protein, 22 aa, Plasmodium falciparum
LIINACIKLVYNLSIYTNFIFK

SEQ ID NO: 3267859 - protein, 22 aa, Plasmodium falciparum
LIINFYILFSVFYYNNTIPLAS

SEQ ID NO: 3267860 - protein, 27 aa, Plasmodium falciparum
LIIPFKELFYLYFFMKKLKYSVDPLTY

SEQ ID NO: 3267861 - protein, 29 aa, Plasmodium falciparum
LIISCALFFLFKRSEGIFQTKGLEGTEKR

SEQ ID NO: 3267862 - protein, 29 aa, Plasmodium falciparum
LIISHLFLYFCFSFLYNFKYNEFIIDIYK

SEQ ID NO: 3267863 - protein, 18 aa, Plasmodium falciparum
LIIVLAIYFLFFYFIVME

SEQ ID NO: 3267864 - protein, 26 aa, Plasmodium falciparum
LIKCIKKRLEEIMNFYYIKSNKHEDD

SEQ ID NO: 3267865 - protein, 23 aa, Plasmodium falciparum
LIKCKLYGIKYNEKNVCNSTFIR

SEQ ID NO: 3267866 - protein, 18 aa, Plasmodium falciparum
LIKFFKSFSYHVTTFLTY

SEQ ID NO: 3267867 - protein, 25 aa, Plasmodium falciparum
LIKFYERFSDLILYVYTNKNLHHLN

SEQ ID NO: 3267868 - protein, 24 aa, Plasmodium falciparum
LIKGPSILFYLYIDILERSLPVQK

SEQ ID NO: 3267869 - protein, 25 aa, Plasmodium falciparum
LIKGSKILLCMSLFLNIIVTFNDFN

SEQ ID NO: 3267870 - protein, 21 aa, Plasmodium falciparum
LIKKEKVGILFDEHKIYNVKN

SEQ ID NO: 3267871 - protein, 19 aa, Plasmodium falciparum
LIKKKGNICMYDIFEDNIN

SEQ ID NO: 3267872 - protein, 18 aa, Plasmodium falciparum
LIKKKLKINDVIKLDLFH

SEQ ID NO: 3267873 - protein, 26 aa, Plasmodium falciparum
LIKKNLIYFKGRWNISDILFSKHFQN

SEQ ID NO: 3267874 - protein, 21 aa, Plasmodium falciparum
LIKKQECIYIKKATSHHNNNI

SEQ ID NO: 3267875 - protein, 25 aa, Plasmodium falciparum
LIKKYKVSGNFAFNEWTEVNSNIRL

SEQ ID NO: 3267876 - protein, 41 aa, Plasmodium falciparum
LIKLKKIQCELSNMWYLFTHLFKIINIIYYNSLFNFCNIIR

SEQ ID NO: 3267877 - protein, 29 aa, Plasmodium falciparum
LIKLYEELKLFLLYFFHKLLYNLLTEQDN

SEQ ID NO: 3267878 - protein, 27 aa, Plasmodium falciparum
LIKNDIPEFIKRVNFNSMQKNNNDKDD

SEQ ID NO: 3267879 - protein, 19 aa, Plasmodium falciparum
LIKNIIIYLCSLMKKKIPK

SEQ ID NO: 3267880 - protein, 24 aa, Plasmodium falciparum
LIKQNLKIIYGFKGDMSSGVEIPL

SEQ ID NO: 3267881 - protein, 24 aa, Plasmodium falciparum
LIKSEYYKILSLFYLAIKNITELY

SEQ ID NO: 3267882 - protein, 26 aa, Plasmodium falciparum
LIKTLFVICIFMKNKIIPYLFLNSSF

SEQ ID NO: 3267883 - protein, 25 aa, Plasmodium falciparum
LIKYSSKFLYSLCFKEKSDSKKKKK

SEQ ID NO: 3267884 - protein, 30 aa, Plasmodium falciparum
LILDKRKIKCFLFYMWLNIFIPLEYAKKIM

SEQ ID NO: 3267885 - protein, 19 aa, Plasmodium falciparum
LILENCFSNLISENKPKVM

SEQ ID NO: 3267886 - protein, 18 aa, Plasmodium falciparum
LILFIIYQIIVSVLQLHF

SEQ ID NO: 3267887 - protein, 19 aa, Plasmodium falciparum
LILFKKVKIDLSFLEYTIL

SEQ ID NO: 3267888 - protein, 19 aa, Plasmodium falciparum
LILGLYVLFMFLFVNIKQC

SEQ ID NO: 3267889 - protein, 24 aa, Plasmodium falciparum
LILLKIYICNILYYVINYLNFLFL

SEQ ID NO: 3267890 - protein, 18 aa, Plasmodium falciparum
LILLKKFSVIKCKDYYLF

SEQ ID NO: 3267891 - protein, 33 aa, Plasmodium falciparum
LILLQILFCIIIEIRGLFVTKIKNFLNKRIAYL

SEQ ID NO: 3267892 - protein, 20 aa, Plasmodium falciparum
LILNLLKKCISFFYLHKDNI

SEQ ID NO: 3267893 - protein, 17 aa, Plasmodium falciparum
LILNVCLTKESSSSLIQ

SEQ ID NO: 3267894 - protein, 18 aa, Plasmodium falciparum
LILQLKYIYNFIMNNDKN

SEQ ID NO: 3267895 - protein, 17 aa, Plasmodium falciparum
LILRYLRKSKMKKKLHY

SEQ ID NO: 3267896 - protein, 18 aa, Plasmodium falciparum
LILYCFLYLILKHINKMY

SEQ ID NO: 3267897 - protein, 17 aa, Plasmodium falciparum
LILYCKNYILLNILFNW

SEQ ID NO: 3267898 - protein, 20 aa, Plasmodium falciparum
LILYFYEIITRKYLFLNNSN

SEQ ID NO: 3267899 - protein, 17 aa, Plasmodium falciparum
LINCGLVSFLNCTILFQ

SEQ ID NO: 3267900 - protein, 18 aa, Plasmodium falciparum
LINELIKKMVHFIILNFT

SEQ ID NO: 3267901 - protein, 18 aa, Plasmodium falciparum
LINEVLRNIKFIYDYKMK

SEQ ID NO: 3267902 - protein, 23 aa, Plasmodium falciparum
LINFLKCCLLNISLSSYLCVKLN

SEQ ID NO: 3267903 - protein, 30 aa, Plasmodium falciparum
LINHHIFVLHVYRMMHILSYNIMDLKDDKY

SEQ ID NO: 3267904 - protein, 19 aa, Plasmodium falciparum
LINIFCYELFYSPNKKLKN

SEQ ID NO: 3267905 - protein, 19 aa, Plasmodium falciparum
LINIGRLEPFLFLKTLHYI

SEQ ID NO: 3267906 - protein, 25 aa, Plasmodium falciparum
LINIISACKFFFISLLDETQCPHLL

SEQ ID NO: 3267907 - protein, 17 aa, Plasmodium falciparum
LINITYKNEYALKLKYH

SEQ ID NO: 3267908 - protein, 18 aa, Plasmodium falciparum
LINKCLYNNNAHKIDHKI

SEQ ID NO: 3267909 - protein, 23 aa, Plasmodium falciparum
LINKKCVFTKCLENYENRYFVLK

SEQ ID NO: 3267910 - protein, 17 aa, Plasmodium falciparum
LINKKNCMLELWRKEKW

SEQ ID NO: 3267911 - protein, 19 aa, Plasmodium falciparum
LINLILIKCKLYGIKYNEK

SEQ ID NO: 3267912 - protein, 27 aa, Plasmodium falciparum
LINLSHVLVCIFRIFDSFALSHVLNIR

SEQ ID NO: 3267913 - protein, 21 aa, Plasmodium falciparum
LINMGKSFISGFFSNIKEKIK

SEQ ID NO: 3267914 - protein, 18 aa, Plasmodium falciparum
LINMPRPHVRMHMVKNTL

SEQ ID NO: 3267915 - protein, 37 aa, Plasmodium falciparum
LINQLIIQWFFKIFSVFLEKHFHYFREEYEHIKKVNS

SEQ ID NO: 3267916 - protein, 21 aa, Plasmodium falciparum
LINRIKMKYFNESCRNIKNSI

SEQ ID NO: 3267917 - protein, 22 aa, Plasmodium falciparum
LINTIISFFSIVGFNNELIQIS

SEQ ID NO: 3267918 - protein, 22 aa, Plasmodium falciparum
LIPCLLTAAFLLPLKPFKALDY

SEQ ID NO: 3267919 - protein, 19 aa, Plasmodium falciparum
LIPDHYEFFSTFLNLFKSR

SEQ ID NO: 3267920 - protein, 22 aa, Plasmodium falciparum
LIPKSIILMAFFQTPLFFIFYF

SEQ ID NO: 3267921 - protein, 24 aa, Plasmodium falciparum
LIPLRLMFLNILKFIHVTVKSEDR

SEQ ID NO: 3267922 - protein, 24 aa, Plasmodium falciparum
LIPPRRRQLCFSRIVRGPANLRNL

SEQ ID NO: 3267923 - protein, 25 aa, Plasmodium falciparum
LIPYKKEILPFGVSNSELEDKLTEE

SEQ ID NO: 3267924 - protein, 27 aa, Plasmodium falciparum
LIQHAACVYIQSWFRKIIQQRKYKAMK

SEQ ID NO: 3267925 - protein, 21 aa, Plasmodium falciparum
LIRICKNVTDLLSWNYMLENM

SEQ ID NO: 3267926 - protein, 26 aa, Plasmodium falciparum
LIRKGDRCFKRESFFFEIYKYKNYII

SEQ ID NO: 3267927 - protein, 20 aa, Plasmodium falciparum
LIRKNVAYGKMFVKRKNEDN

SEQ ID NO: 3267928 - protein, 23 aa, Plasmodium falciparum
LIRPNFFHIKWIVYTLQSFIFYN

SEQ ID NO: 3267929 - protein, 26 aa, Plasmodium falciparum
LIRTLFKRWLEYFFEDYNRIQKKLKP

SEQ ID NO: 3267930 - protein, 27 aa, Plasmodium falciparum
LIRTLFKRWLEYFLQDYIKINAKFSHC

SEQ ID NO: 3267931 - protein, 27 aa, Plasmodium falciparum
LISCSSCSNLFYFKNRIFMLTLKEKYQ

SEQ ID NO: 3267932 - protein, 22 aa, Plasmodium falciparum
LISHCIIFFILNDMQIFNSHLI

SEQ ID NO: 3267933 - protein, 21 aa, Plasmodium falciparum
LISKLEGAIIHTLISIDNELV

SEQ ID NO: 3267934 - protein, 27 aa, Plasmodium falciparum
LISLCYYSDSLIFLSYNIVHWDNQSED

SEQ ID NO: 3267935 - protein, 18 aa, Plasmodium falciparum
LISLRYKYINSLFILTLF

SEQ ID NO: 3267936 - protein, 18 aa, Plasmodium falciparum
LISLYSIFVYDFFFNRFF

SEQ ID NO: 3267937 - protein, 18 aa, Plasmodium falciparum
LISPLVILLLEYFEYPRL

SEQ ID NO: 3267938 - protein, 30 aa, Plasmodium falciparum
LISYDEIQICLQKIFPLYLIQTALIYMVHI

SEQ ID NO: 3267939 - protein, 17 aa, Plasmodium falciparum
LITAILCGKNYDRNNIK

SEQ ID NO: 3267940 - protein, 22 aa, Plasmodium falciparum
LITAIRMLSGFVIEQKKEKLEK

SEQ ID NO: 3267941 - protein, 18 aa, Plasmodium falciparum
LITHEDIIIISLQNVADQ

SEQ ID NO: 3267942 - protein, 41 aa, Plasmodium falciparum
LITIIPCRICYSFTFDLLFFILRIAIFSVYYLITVKNYILI

SEQ ID NO: 3267943 - protein, 33 aa, Plasmodium falciparum
LITILRIFLIFTYKISDFYVMVLLMIDNIIKLI

SEQ ID NO: 3267944 - protein, 24 aa, Plasmodium falciparum
LITKELKSILFLKLSENCNVQSIY

SEQ ID NO: 3267945 - protein, 26 aa, Plasmodium falciparum
LITKYFDSIFCISVKVNDRKHLAVYR

SEQ ID NO: 3267946 - protein, 22 aa, Plasmodium falciparum
LITNTRFSYMGNLDGILGDIIE

SEQ ID NO: 3267947 - protein, 17 aa, Plasmodium falciparum
LITQMAFIPTDIRCSLW

SEQ ID NO: 3267948 - protein, 17 aa, Plasmodium falciparum
LITYFLQRYKFFICPQK

SEQ ID NO: 3267949 - protein, 18 aa, Plasmodium falciparum
LITYIFIFFFDLSKKNYI

SEQ ID NO: 3267950 - protein, 20 aa, Plasmodium falciparum
LITYIYCFFKSYDLNKNVNK

SEQ ID NO: 3267951 - protein, 20 aa, Plasmodium falciparum
LIVDILMYKEYVLLDGKRNF

SEQ ID NO: 3267952 - protein, 28 aa, Plasmodium falciparum
LIVHRPHPWGLLITFIELIRNPIFKFWQ

SEQ ID NO: 3267953 - protein, 21 aa, Plasmodium falciparum
LIVLSLFTIYYIKKLVSNKRV

SEQ ID NO: 3267954 - protein, 18 aa, Plasmodium falciparum
LIVRQICCALQYLHSNNI

SEQ ID NO: 3267955 - protein, 17 aa, Plasmodium falciparum
LIWNNIYNLLLIFQQKC

SEQ ID NO: 3267956 - protein, 25 aa, Plasmodium falciparum
LIYEILKCTVLFNYIDLNNFSKNIL

SEQ ID NO: 3267957 - protein, 22 aa, Plasmodium falciparum
LIYENIRFLYIQLLQKNVVSLI

SEQ ID NO: 3267958 - protein, 21 aa, Plasmodium falciparum
LIYFCYKNHIFLSYLQNEKEY

SEQ ID NO: 3267959 - protein, 22 aa, Plasmodium falciparum
LIYFKASVVYCIIHCLIKKGID

SEQ ID NO: 3267960 - protein, 19 aa, Plasmodium falciparum
LIYGDWYMCDSFMKNEKSN

SEQ ID NO: 3267961 - protein, 18 aa, Plasmodium falciparum
LIYIWLSKNVMTYNRNIK

SEQ ID NO: 3267962 - protein, 28 aa, Plasmodium falciparum
LIYKSKYLFLKIFFKRYIKNGLSKSRYL

SEQ ID NO: 3267963 - protein, 27 aa, Plasmodium falciparum
LIYLMPINIHIKFFLSYTPNFLTIFFK

SEQ ID NO: 3267964 - protein, 27 aa, Plasmodium falciparum
LIYRLLFCIRYKVMLTLIVKNILFLLF

SEQ ID NO: 3267965 - protein, 21 aa, Plasmodium falciparum
LIYVLKFLLYLFAKPTSLLLD

SEQ ID NO: 3267966 - protein, 24 aa, Plasmodium falciparum
LIYVPSLLSLMFIHSIGKSTMKKI

SEQ ID NO: 3267967 - protein, 34 aa, Plasmodium falciparum
LIYVSGSVLTYICFWQLIIGYTLREMEIRDELSD

SEQ ID NO: 3267968 - protein, 20 aa, Plasmodium falciparum
LKACCLSLLVKRFVIIKNNN

SEQ ID NO: 3267969 - protein, 18 aa, Plasmodium falciparum
LKAGPCSKTNNGDDDINF

SEQ ID NO: 3267970 - protein, 18 aa, Plasmodium falciparum
LKAIKPCGDLDKFQNSTD

SEQ ID NO: 3267971 - protein, 20 aa, Plasmodium falciparum
LKALKFTWRSISFFIKLIFF

SEQ ID NO: 3267972 - protein, 17 aa, Plasmodium falciparum
LKAPANMKSTMHKVGVK

SEQ ID NO: 3267973 - protein, 18 aa, Plasmodium falciparum
LKAVCFPKQPRTEANPAL

SEQ ID NO: 3267974 - protein, 27 aa, Plasmodium falciparum
LKCAGVLGGGVTPAWGLISGIVYTGWK

SEQ ID NO: 3267975 - protein, 18 aa, Plasmodium falciparum
LKCASYIIIYSLIVKIIT

SEQ ID NO: 3267976 - protein, 19 aa, Plasmodium falciparum
LKCFVLMFEILNLMDMQSF

SEQ ID NO: 3267977 - protein, 21 aa, Plasmodium falciparum
LKCGKNLGGFIPGLGLIGGTA

SEQ ID NO: 3267978 - protein, 20 aa, Plasmodium falciparum
LKCKASYHSHCLHKWFLTSH

SEQ ID NO: 3267979 - protein, 22 aa, Plasmodium falciparum
LKCKNCNNVDDIWLCLTCSNVG

SEQ ID NO: 3267980 - protein, 25 aa, Plasmodium falciparum
LKCLCIEILCSSFVKNSSSALSVLC

SEQ ID NO: 3267981 - protein, 20 aa, Plasmodium falciparum
LKCTLTGKVFEIYEDEKYEK

SEQ ID NO: 3267982 - protein, 24 aa, Plasmodium falciparum
LKCVLRLEKDFLFILKSKKNKECV

SEQ ID NO: 3267983 - protein, 24 aa, Plasmodium falciparum
LKDCKTSGIFKGFREDVWTCGKVC

SEQ ID NO: 3267984 - protein, 19 aa, Plasmodium falciparum
LKDDIIKEWGEQIDEFDNL

SEQ ID NO: 3267985 - protein, 20 aa, Plasmodium falciparum
LKDEIFLLLQKREFKRNMNK

SEQ ID NO: 3267986 - protein, 22 aa, Plasmodium falciparum
LKDEVFPEYKIKYQDGDITFSC

SEQ ID NO: 3267987 - protein, 22 aa, Plasmodium falciparum
LKDFKVFSGLVVVMIMFFHLFF

SEQ ID NO: 3267988 - protein, 31 aa, Plasmodium falciparum
LKDFVEIPPFFRWLHEWGSDFCGKRARMLKN

SEQ ID NO: 3267989 - protein, 30 aa, Plasmodium falciparum
LKDFVLRPPYFRYLEEWGETFCRQRTRMLE

SEQ ID NO: 3267990 - protein, 30 aa, Plasmodium falciparum
LKDFYKEKFPLLNRFIYLFERIMQNEIPDL

SEQ ID NO: 3267991 - protein, 23 aa, Plasmodium falciparum
LKDGIKNTIKYVAYNNSIFNLFE

SEQ ID NO: 3267992 - protein, 20 aa, Plasmodium falciparum
LKDIHRWKIIVPALVGLWSG

SEQ ID NO: 3267993 - protein, 22 aa, Plasmodium falciparum
LKDIINNICLLFNLRREYQETL

SEQ ID NO: 3267994 - protein, 46 aa, Plasmodium falciparum
LKDIKKCRTCLNYQRLLFHEVINLFVFYVYKFCNWDVLKNYFDILI

SEQ ID NO: 3267995 - protein, 20 aa, Plasmodium falciparum
LKDKCFPGTCDYMEKVKNNS

SEQ ID NO: 3267996 - protein, 18 aa, Plasmodium falciparum
LKDKICIHEHVKRTIRNN

SEQ ID NO: 3267997 - protein, 29 aa, Plasmodium falciparum
LKDLKDCLFDKLDNAVDWENLSSNVKGYL

SEQ ID NO: 3267998 - protein, 25 aa, Plasmodium falciparum
LKDMLKCTKHVIGLVDIGSNKFDNI

SEQ ID NO: 3267999 - protein, 18 aa, Plasmodium falciparum
LKDPSVTVCFGRDVDDTS

SEQ ID NO: 3268000 - protein, 17 aa, Plasmodium falciparum
LKDQILGVLDYLEKQQS

SEQ ID NO: 3268001 - protein, 20 aa, Plasmodium falciparum
LKDSCDLIYHFIAIICLFIS

SEQ ID NO: 3268002 - protein, 21 aa, Plasmodium falciparum
LKDSILWSKELDRCIKKDDKS

SEQ ID NO: 3268003 - protein, 22 aa, Plasmodium falciparum
LKDVFDRFLFQVMFALDQDEKG

SEQ ID NO: 3268004 - protein, 21 aa, Plasmodium falciparum
LKDYYLYEQIINFKFNQKVDG

SEQ ID NO: 3268005 - protein, 20 aa, Plasmodium falciparum
LKEAGTCIICRDDLKEGSKK

SEQ ID NO: 3268006 - protein, 19 aa, Plasmodium falciparum
LKEAMFSPKTVMGIIPKQD

SEQ ID NO: 3268007 - protein, 19 aa, Plasmodium falciparum
LKECPSVSELLNYNYIDSW

SEQ ID NO: 3268008 - protein, 24 aa, Plasmodium falciparum
LKEEIKDKEYLRKVIPKEEKKEPI

SEQ ID NO: 3268009 - protein, 22 aa, Plasmodium falciparum
LKEERKAFINFCKSYIKNKYYN

SEQ ID NO: 3268010 - protein, 26 aa, Plasmodium falciparum
LKEFKCIKCPKGHYCPGGYLKNCFNN

SEQ ID NO: 3268011 - protein, 21 aa, Plasmodium falciparum
LKEFKLIKMFNWESFAFKYIN

SEQ ID NO: 3268012 - protein, 23 aa, Plasmodium falciparum
LKEFKLMKIFNWESIAFDYVNMF

SEQ ID NO: 3268013 - protein, 26 aa, Plasmodium falciparum
LKEGKCISSKIIIDLMLEYMNTIISK

SEQ ID NO: 3268014 - protein, 19 aa, Plasmodium falciparum
LKEHLIKFYSIKNETPKKS

SEQ ID NO: 3268015 - protein, 26 aa, Plasmodium falciparum
LKEIELPFDRAVLLNVIDKKDKTKKI

SEQ ID NO: 3268016 - protein, 33 aa, Plasmodium falciparum
LKEIFFKEYVKRCITKVIFFPVHMKEHDHVMNK

SEQ ID NO: 3268017 - protein, 26 aa, Plasmodium falciparum
LKEIHGNSGICTRQWKEGSFAFKCYN

SEQ ID NO: 3268018 - protein, 25 aa, Plasmodium falciparum
LKEIKSVHPNICFMKRQKMKKKDIK

SEQ ID NO: 3268019 - protein, 18 aa, Plasmodium falciparum
LKEILKFIMNDTDLETVL

SEQ ID NO: 3268020 - protein, 26 aa, Plasmodium falciparum
LKEISSQCNFDFCIKKSVELFHNNFI

SEQ ID NO: 3268021 - protein, 17 aa, Plasmodium falciparum
LKEKCQLYNERNSLEEH

SEQ ID NO: 3268022 - protein, 20 aa, Plasmodium falciparum
LKEKIKLLYDDMVDVCQEFY

SEQ ID NO: 3268023 - protein, 28 aa, Plasmodium falciparum
LKELRFFEKICYELFKLKSKNYSDDEDS

SEQ ID NO: 3268024 - protein, 21 aa, Plasmodium falciparum
LKENCEINCSLNIIYKYIRIW

SEQ ID NO: 3268025 - protein, 18 aa, Plasmodium falciparum
LKEPFERYIDNDKKYEEH

SEQ ID NO: 3268026 - protein, 22 aa, Plasmodium falciparum
LKERISQIIWCFFFCLHLALLK

SEQ ID NO: 3268027 - protein, 21 aa, Plasmodium falciparum
LKERKFMILLLKIKNGTPSIR

SEQ ID NO: 3268028 - protein, 21 aa, Plasmodium falciparum
LKERLFPELELYTNDQNSRNN

SEQ ID NO: 3268029 - protein, 19 aa, Plasmodium falciparum
LKEVSAFRTVLKNLGSWLG

SEQ ID NO: 3268030 - protein, 17 aa, Plasmodium falciparum
LKEYYIIINNLLLLNNS

SEQ ID NO: 3268031 - protein, 17 aa, Plasmodium falciparum
LKEYYSKYLNIFFKSSF

SEQ ID NO: 3268032 - protein, 18 aa, Plasmodium falciparum
LKFFFSCTHFIKKLRYLL

SEQ ID NO: 3268033 - protein, 17 aa, Plasmodium falciparum
LKFKYQYDIINEQYPII

SEQ ID NO: 3268034 - protein, 24 aa, Plasmodium falciparum
LKFLFDIIFFLSFILYPLFLRLKR

SEQ ID NO: 3268035 - protein, 28 aa, Plasmodium falciparum
LKFQNKIDYCFPRIFFYVKCILHSIKKY

SEQ ID NO: 3268036 - protein, 19 aa, Plasmodium falciparum
LKFSKELYEHLSVLDEFSK

SEQ ID NO: 3268037 - protein, 18 aa, Plasmodium falciparum
LKFVSYIVSLIFTSIFIY

SEQ ID NO: 3268038 - protein, 26 aa, Plasmodium falciparum
LKFYFFKYTAIFIGFIISLLRYDLLV

SEQ ID NO: 3268039 - protein, 20 aa, Plasmodium falciparum
LKGDYKFSKQFHKYIHKNLL

SEQ ID NO: 3268040 - protein, 19 aa, Plasmodium falciparum
LKGICKVKKLMGLSKICGN

SEQ ID NO: 3268041 - protein, 21 aa, Plasmodium falciparum
LKGLKVAIIFLFSHIFFCKYD

SEQ ID NO: 3268042 - protein, 27 aa, Plasmodium falciparum
LKGNFYMCYVYMLYIFLSFLTKNRKKN

SEQ ID NO: 3268043 - protein, 20 aa, Plasmodium falciparum
LKGNHFLDDKLKGENFIVDN

SEQ ID NO: 3268044 - protein, 23 aa, Plasmodium falciparum
LKGSILDMLKGDMELGDMDKESL

SEQ ID NO: 3268045 - protein, 17 aa, Plasmodium falciparum
LKGSKGKSVKNIVGNKE

SEQ ID NO: 3268046 - protein, 23 aa, Plasmodium falciparum
LKGYIYYRYIFNIIYPNLSPEHF

SEQ ID NO: 3268047 - protein, 25 aa, Plasmodium falciparum
LKHIHLYSYIFIKRSVLKIVKKNEM

SEQ ID NO: 3268048 - protein, 24 aa, Plasmodium falciparum
LKHIKDICTLLKHKNMYEFIHIPV

SEQ ID NO: 3268049 - protein, 17 aa, Plasmodium falciparum
LKHIRINKVIYETSKEI

SEQ ID NO: 3268050 - protein, 23 aa, Plasmodium falciparum
LKHLKGRCTRGIYISSLATVILT

SEQ ID NO: 3268051 - protein, 24 aa, Plasmodium falciparum
LKHLKGRCTRGIYISSLTTVILTT

SEQ ID NO: 3268052 - protein, 33 aa, Plasmodium falciparum
LKHLKGRCTRGIYSCSVISAFLTMLGLTAAKTA

SEQ ID NO: 3268053 - protein, 17 aa, Plasmodium falciparum
LKHLLSLQDENFTYLIN

SEQ ID NO: 3268054 - protein, 18 aa, Plasmodium falciparum
LKHNLYFKLKNLNVSCNN

SEQ ID NO: 3268055 - protein, 21 aa, Plasmodium falciparum
LKHPKWKMGKKITIDSATMMN

SEQ ID NO: 3268056 - protein, 18 aa, Plasmodium falciparum
LKIDNPFEHLSTITDQEE

SEQ ID NO: 3268057 - protein, 19 aa, Plasmodium falciparum
LKIDSLFGIFLLIISVISS

SEQ ID NO: 3268058 - protein, 19 aa, Plasmodium falciparum
LKIEHLYILLYFSLSILST

SEQ ID NO: 3268059 - protein, 21 aa, Plasmodium falciparum
LKIEKEHFLIISYCDDKIEGL

SEQ ID NO: 3268060 - protein, 18 aa, Plasmodium falciparum
LKIEKNVNKLVYIKHNNN

SEQ ID NO: 3268061 - protein, 21 aa, Plasmodium falciparum
LKIFCKTNILIYNFFNSGKEI

SEQ ID NO: 3268062 - protein, 18 aa, Plasmodium falciparum
LKIFIIFVKLLYPFCPHI

SEQ ID NO: 3268063 - protein, 18 aa, Plasmodium falciparum
LKIFKNLFYLLIYGDDQG

SEQ ID NO: 3268064 - protein, 21 aa, Plasmodium falciparum
LKIFLCGVLHMCPEDFNLLQQ

SEQ ID NO: 3268065 - protein, 19 aa, Plasmodium falciparum
LKIFLRRLVCATIIGIIGI

SEQ ID NO: 3268066 - protein, 18 aa, Plasmodium falciparum
LKIFNYWSYYIFPSTYKY

SEQ ID NO: 3268067 - protein, 23 aa, Plasmodium falciparum
LKIFSLIFCSAMPVHIIDDYEMY

SEQ ID NO: 3268068 - protein, 19 aa, Plasmodium falciparum
LKIFYELIENNFIPLNYYN

SEQ ID NO: 3268069 - protein, 17 aa, Plasmodium falciparum
LKIINFIKTHTSIQTVS

SEQ ID NO: 3268070 - protein, 24 aa, Plasmodium falciparum
LKIIPKSPFVLKFAIYNYSQKTYY

SEQ ID NO: 3268071 - protein, 18 aa, Plasmodium falciparum
LKIIRIYYYFTITLYFIP

SEQ ID NO: 3268072 - protein, 17 aa, Plasmodium falciparum
LKIITCLKTNRNSLHNV

SEQ ID NO: 3268073 - protein, 20 aa, Plasmodium falciparum
LKIIYNYIVNPKIQILCYSS

SEQ ID NO: 3268074 - protein, 18 aa, Plasmodium falciparum
LKIKEWYVYFSTEKIVDF

SEQ ID NO: 3268075 - protein, 29 aa, Plasmodium falciparum
LKIKKNEFVNFSLLCNMFINNSLTIYTFF

SEQ ID NO: 3268076 - protein, 27 aa, Plasmodium falciparum
LKIKYDKMIIHFKTYILEHIKNLQKVN

SEQ ID NO: 3268077 - protein, 20 aa, Plasmodium falciparum
LKILIFQCIKDFFYQIIQTI

SEQ ID NO: 3268078 - protein, 17 aa, Plasmodium falciparum
LKILKYYCKSHISEVVI

SEQ ID NO: 3268079 - protein, 21 aa, Plasmodium falciparum
LKILLFPVVCPEMWTNNVDER

SEQ ID NO: 3268080 - protein, 17 aa, Plasmodium falciparum
LKILLRLNKIDKIKDLI

SEQ ID NO: 3268081 - protein, 23 aa, Plasmodium falciparum
LKILNLFGYLLITFVSFSLILFL

SEQ ID NO: 3268082 - protein, 20 aa, Plasmodium falciparum
LKILYFLYHIHLKRIKKKKK

SEQ ID NO: 3268083 - protein, 21 aa, Plasmodium falciparum
LKINLPYNIISLYKLRYYKNL

SEQ ID NO: 3268084 - protein, 19 aa, Plasmodium falciparum
LKINSPHFFNSITNMSDIC

SEQ ID NO: 3268085 - protein, 25 aa, Plasmodium falciparum
LKIPLKSIFGLFNIFGFMFLLNHYN

SEQ ID NO: 3268086 - protein, 18 aa, Plasmodium falciparum
LKIPSYRYVIILGCLLSG

SEQ ID NO: 3268087 - protein, 18 aa, Plasmodium falciparum
LKISLKYFNHMIVSIINQ

SEQ ID NO: 3268088 - protein, 26 aa, Plasmodium falciparum
LKIYLKGLLCNLSYVLKNKSHILKSN

SEQ ID NO: 3268089 - protein, 19 aa, Plasmodium falciparum
LKIYSKNFIQNHKINFNQF

SEQ ID NO: 3268090 - protein, 19 aa, Plasmodium falciparum
LKKALSYLEDYSLRKGISE

SEQ ID NO: 3268091 - protein, 18 aa, Plasmodium falciparum
LKKAMLSSTIMWSIGIGF

SEQ ID NO: 3268092 - protein, 28 aa, Plasmodium falciparum
LKKDHIYNFLKYNNFIILACQKKKKKYK

SEQ ID NO: 3268093 - protein, 20 aa, Plasmodium falciparum
LKKDICNLLEIYNLKIKAKK

SEQ ID NO: 3268094 - protein, 26 aa, Plasmodium falciparum
LKKDTCIKFSKLNLSDLLLFINKNLL

SEQ ID NO: 3268095 - protein, 25 aa, Plasmodium falciparum
LKKDVKAKHLKGSKVKITEDIQKKM

SEQ ID NO: 3268096 - protein, 18 aa, Plasmodium falciparum
LKKEAYKQINILDIYNSC

SEQ ID NO: 3268097 - protein, 24 aa, Plasmodium falciparum
LKKEKIIWKEWLLKNFKNIEECDN

SEQ ID NO: 3268098 - protein, 26 aa, Plasmodium falciparum
LKKELLELFNNPLFLLSLKYVQNKKL

SEQ ID NO: 3268099 - protein, 17 aa, Plasmodium falciparum
LKKELQDLVTLKESLMK

SEQ ID NO: 3268100 - protein, 22 aa, Plasmodium falciparum
LKKEQLHILNLIGRGGYSNVYR

SEQ ID NO: 3268101 - protein, 23 aa, Plasmodium falciparum
LKKFPYLLLLLHFKIIRKIDNIF

SEQ ID NO: 3268102 - protein, 19 aa, Plasmodium falciparum
LKKFQHVMWYIPEGSSPFF

SEQ ID NO: 3268103 - protein, 31 aa, Plasmodium falciparum
LKKFSVIKCKDYYLFCYFKQILMDNMHVLNF

SEQ ID NO: 3268104 - protein, 24 aa, Plasmodium falciparum
LKKFYKIIFFKAGKMFVSKFSLFN

SEQ ID NO: 3268105 - protein, 17 aa, Plasmodium falciparum
LKKGHIFLMDEISLVES

SEQ ID NO: 3268106 - protein, 25 aa, Plasmodium falciparum
LKKGRSINDLHLIKFYERFSDLILY

SEQ ID NO: 3268107 - protein, 23 aa, Plasmodium falciparum
LKKHCSKCPCGFNDMQEITKYTN

SEQ ID NO: 3268108 - protein, 30 aa, Plasmodium falciparum
LKKHHIKKNIPFLFFIYELMITFFNTAENI

SEQ ID NO: 3268109 - protein, 21 aa, Plasmodium falciparum
LKKHKRKIFKNLIRNIKKNKD

SEQ ID NO: 3268110 - protein, 20 aa, Plasmodium falciparum
LKKHYVVISFAMKKNLRLMH

SEQ ID NO: 3268111 - protein, 19 aa, Plasmodium falciparum
LKKIHPAYFEKILIERYYC

SEQ ID NO: 3268112 - protein, 22 aa, Plasmodium falciparum
LKKISTPLLRWYDNSLKTFSLR

SEQ ID NO: 3268113 - protein, 27 aa, Plasmodium falciparum
LKKIVADEIYCLYLKDCISKINLTYQI

SEQ ID NO: 3268114 - protein, 17 aa, Plasmodium falciparum
LKKIVTHEIDLLQKDIL

SEQ ID NO: 3268115 - protein, 21 aa, Plasmodium falciparum
LKKKCEMKIIIDIFNINELLK

SEQ ID NO: 3268116 - protein, 17 aa, Plasmodium falciparum
LKKKCTLIYNYVMNVHK

SEQ ID NO: 3268117 - protein, 19 aa, Plasmodium falciparum
LKKKFLFRYKQKVNLAKQI

SEQ ID NO: 3268118 - protein, 26 aa, Plasmodium falciparum
LKKKFSISCLCPHKINIAGQINTMVF

SEQ ID NO: 3268119 - protein, 19 aa, Plasmodium falciparum
LKKKFYSFHLPYYEECKNI

SEQ ID NO: 3268120 - protein, 24 aa, Plasmodium falciparum
LKKKKILKFFPLFNYKSDLESIME

SEQ ID NO: 3268121 - protein, 39 aa, Plasmodium falciparum
LKKKKKRKLRILCLDGGGIRGLLSIEILKYINSNLNKNI

SEQ ID NO: 3268122 - protein, 19 aa, Plasmodium falciparum
LKKKLEYIDKQLLLGQIKN

SEQ ID NO: 3268123 - protein, 23 aa, Plasmodium falciparum
LKKKLKNSIILKDLKKLNCNFIN

SEQ ID NO: 3268124 - protein, 17 aa, Plasmodium falciparum
LKKKLKSKIIYNNNNNN

SEQ ID NO: 3268125 - protein, 30 aa, Plasmodium falciparum
LKKKNETMLTYIIYITYYVFLKVMNSYTPT

SEQ ID NO: 3268126 - protein, 28 aa, Plasmodium falciparum
LKKKNIKCPFVYRKVFFGKYGIINYDIK

SEQ ID NO: 3268127 - protein, 20 aa, Plasmodium falciparum
LKKKRPHIIITTPGYLMNFI

SEQ ID NO: 3268128 - protein, 23 aa, Plasmodium falciparum
LKKKSIKYMLMHIDFYNVNIQKK

SEQ ID NO: 3268129 - protein, 25 aa, Plasmodium falciparum
LKKKSKFSVDLLRVLNIPKGDYEMP

SEQ ID NO: 3268130 - protein, 26 aa, Plasmodium falciparum
LKKKSVDRIYFFFLEKINNIKNKNTD

SEQ ID NO: 3268131 - protein, 22 aa, Plasmodium falciparum
LKKLCPDGSCSCMEQRSQQHNE

SEQ ID NO: 3268132 - protein, 21 aa, Plasmodium falciparum
LKKLIYNYLILYAEGNEELTI

SEQ ID NO: 3268133 - protein, 17 aa, Plasmodium falciparum
LKKLLCVLNKFKNILTY

SEQ ID NO: 3268134 - protein, 25 aa, Plasmodium falciparum
LKKLLKTYKRNVCIREPSNQLDTNK

SEQ ID NO: 3268135 - protein, 23 aa, Plasmodium falciparum
LKKLPMYINYFFHNLYVYIEYED

SEQ ID NO: 3268136 - protein, 24 aa, Plasmodium falciparum
LKKLQNFFFCFLRYNNLYKGKNKY

SEQ ID NO: 3268137 - protein, 21 aa, Plasmodium falciparum
LKKLYVYGLFYIFSFPIIFII

SEQ ID NO: 3268138 - protein, 18 aa, Plasmodium falciparum
LKKMRIIKEQEHINNYTF

SEQ ID NO: 3268139 - protein, 25 aa, Plasmodium falciparum
LKKMYFKKFIVFNTCYHKNNYVSIK

SEQ ID NO: 3268140 - protein, 23 aa, Plasmodium falciparum
LKKNCMYNKLIGMPKKVTTVDKY

SEQ ID NO: 3268141 - protein, 35 aa, Plasmodium falciparum
LKKNDICLLYTLCFKKSYLNHMLIFLNMDCLINDN

SEQ ID NO: 3268142 - protein, 17 aa, Plasmodium falciparum
LKKNFLENFNFPLDELV

SEQ ID NO: 3268143 - protein, 20 aa, Plasmodium falciparum
LKKNLPQWAIQALEYADIEL

SEQ ID NO: 3268144 - protein, 33 aa, Plasmodium falciparum
LKKNTVIGGVCFRPYFEQKFAEIAFLAVTSTEQ

SEQ ID NO: 3268145 - protein, 26 aa, Plasmodium falciparum
LKKQLKSRHIFKKGLLNYSSYSITIV

SEQ ID NO: 3268146 - protein, 25 aa, Plasmodium falciparum
LKKRKYKFFFFYNMNFFHKDKNCIL

SEQ ID NO: 3268147 - protein, 25 aa, Plasmodium falciparum
LKKRQLQISLIKWVIKAVDENTLKK

SEQ ID NO: 3268148 - protein, 17 aa, Plasmodium falciparum
LKKSNIINYIIKKKKKY

SEQ ID NO: 3268149 - protein, 30 aa, Plasmodium falciparum
LKKSVITIQVWWRNFYKLRKIFQNFPLNIY

SEQ ID NO: 3268150 - protein, 26 aa, Plasmodium falciparum
LKKTSHYNCFKRELFIMKTINNKHPY

SEQ ID NO: 3268151 - protein, 17 aa, Plasmodium falciparum
LKKYCMEQKLFIHKCKE

SEQ ID NO: 3268152 - protein, 21 aa, Plasmodium falciparum
LKKYELCLKYISYINDDNIDG

SEQ ID NO: 3268153 - protein, 27 aa, Plasmodium falciparum
LKKYLKSANVYLQFIAYIIFSIYDYNS

SEQ ID NO: 3268154 - protein, 24 aa, Plasmodium falciparum
LKKYNFKNLLLIFCYSSYINIHFN

SEQ ID NO: 3268155 - protein, 18 aa, Plasmodium falciparum
LKKYWQDVEISWIDDDNQ

SEQ ID NO: 3268156 - protein, 21 aa, Plasmodium falciparum
LKLEIFKGRFGSPNSTSSMFN

SEQ ID NO: 3268157 - protein, 23 aa, Plasmodium falciparum
LKLESAEFNNIISCSNETKKHLT

SEQ ID NO: 3268158 - protein, 25 aa, Plasmodium falciparum
LKLFKIEDNYLFPISYKINLNNFDF

SEQ ID NO: 3268159 - protein, 20 aa, Plasmodium falciparum
LKLFLNKYHYVYPYENIKGL

SEQ ID NO: 3268160 - protein, 22 aa, Plasmodium falciparum
LKLFQVCHIFNLFFRFQNYLML

SEQ ID NO: 3268161 - protein, 50 aa, Plasmodium falciparum
LKLFSFSILCLREEMYLILLASYPKHFAWFKYFLFFILYSINFQFRDKKV

SEQ ID NO: 3268162 - protein, 19 aa, Plasmodium falciparum
LKLFYNCTFMDISNFVSIV

SEQ ID NO: 3268163 - protein, 17 aa, Plasmodium falciparum
LKLILNVATGYIGANFS

SEQ ID NO: 3268164 - protein, 25 aa, Plasmodium falciparum
LKLKELLKELLVYTELKIDFEEEHI

SEQ ID NO: 3268165 - protein, 20 aa, Plasmodium falciparum
LKLKGIIGCSNRIFDESPNY

SEQ ID NO: 3268166 - protein, 31 aa, Plasmodium falciparum
LKLKGYKVGQLYDFFLSFDINQKDEFLNNGT

SEQ ID NO: 3268167 - protein, 17 aa, Plasmodium falciparum
LKLKIDFGSLDTGTKII

SEQ ID NO: 3268168 - protein, 19 aa, Plasmodium falciparum
LKLKNCLICDDKRTFPDLG

SEQ ID NO: 3268169 - protein, 17 aa, Plasmodium falciparum
LKLKNSYTLKCTEEIRV

SEQ ID NO: 3268170 - protein, 26 aa, Plasmodium falciparum
LKLKREYKESYLLDNKSDMDVIRNDK

SEQ ID NO: 3268171 - protein, 24 aa, Plasmodium falciparum
LKLKSSIFSAFLLYLMHLKEIYLL

SEQ ID NO: 3268172 - protein, 17 aa, Plasmodium falciparum
LKLKYDEVIQRGTKEYI

SEQ ID NO: 3268173 - protein, 18 aa, Plasmodium falciparum
LKLLKKYCTNKWILKTTF

SEQ ID NO: 3268174 - protein, 17 aa, Plasmodium falciparum
LKLLNIIYNSWKEKNFD

SEQ ID NO: 3268175 - protein, 20 aa, Plasmodium falciparum
LKLLSSILVKNMYFIIYNRC

SEQ ID NO: 3268176 - protein, 20 aa, Plasmodium falciparum
LKLNILILSCIIIQIFNSFI

SEQ ID NO: 3268177 - protein, 17 aa, Plasmodium falciparum
LKLPDYLSKEVLYKNLI

SEQ ID NO: 3268178 - protein, 22 aa, Plasmodium falciparum
LKLPIHTFLSMQALHDMDINKT

SEQ ID NO: 3268179 - protein, 21 aa, Plasmodium falciparum
LKLQKAYSYMIGKIFEETLID

SEQ ID NO: 3268180 - protein, 23 aa, Plasmodium falciparum
LKLQSNVHISAWMEKRMNFSFTN

SEQ ID NO: 3268181 - protein, 17 aa, Plasmodium falciparum
LKLSDNMYSNFTSPLEE

SEQ ID NO: 3268182 - protein, 26 aa, Plasmodium falciparum
LKLSGTEFFFCLSWVVTYYSHVLTEF

SEQ ID NO: 3268183 - protein, 18 aa, Plasmodium falciparum
LKLYFSKPASSYILKNKE

SEQ ID NO: 3268184 - protein, 19 aa, Plasmodium falciparum
LKLYKCKVHDNMDDNTIYM

SEQ ID NO: 3268185 - protein, 23 aa, Plasmodium falciparum
LKLYKYYYLFSLFKNHIIKTKSH

SEQ ID NO: 3268186 - protein, 19 aa, Plasmodium falciparum
LKLYNTFKFIMNNIYDLNF

SEQ ID NO: 3268187 - protein, 17 aa, Plasmodium falciparum
LKMDQNLLRCQNYEDVL

SEQ ID NO: 3268188 - protein, 17 aa, Plasmodium falciparum
LKMGFKYIASGPLVRSS

SEQ ID NO: 3268189 - protein, 18 aa, Plasmodium falciparum
LKMIKFIYRKNKYNICIN

SEQ ID NO: 3268190 - protein, 23 aa, Plasmodium falciparum
LKMIKVCLFSKSLCSFNRANHIL

SEQ ID NO: 3268191 - protein, 17 aa, Plasmodium falciparum
LKMLYNFSLHTIGFFYM

SEQ ID NO: 3268192 - protein, 26 aa, Plasmodium falciparum
LKMNYNFICILYLCLIYIYNYIVKFF

SEQ ID NO: 3268193 - protein, 19 aa, Plasmodium falciparum
LKMSNFFFKYYDTNMKKNY

SEQ ID NO: 3268194 - protein, 20 aa, Plasmodium falciparum
LKMYKSCLFLFNKTKIPANW

SEQ ID NO: 3268195 - protein, 21 aa, Plasmodium falciparum
LKMYYESFNFMYLNNKRDNSL

SEQ ID NO: 3268196 - protein, 26 aa, Plasmodium falciparum
LKNAMLFSTILWMVGIGFAAFTYFFL

SEQ ID NO: 3268197 - protein, 17 aa, Plasmodium falciparum
LKNAMLSSTIMWSIGIG

SEQ ID NO: 3268198 - protein, 27 aa, Plasmodium falciparum
LKNCFILSFHILIIFGISTFLNLLPTF

SEQ ID NO: 3268199 - protein, 20 aa, Plasmodium falciparum
LKNDFCLSVIAFNMDTYISN

SEQ ID NO: 3268200 - protein, 20 aa, Plasmodium falciparum
LKNDLMLKFEKLYNAQNDIK

SEQ ID NO: 3268201 - protein, 24 aa, Plasmodium falciparum
LKNEEIKLALQLGLEQAMCTRFPE

SEQ ID NO: 3268202 - protein, 27 aa, Plasmodium falciparum
LKNEIKYLSSKHMRHIEKMKKITNKAF

SEQ ID NO: 3268203 - protein, 20 aa, Plasmodium falciparum
LKNESVIDVVGRIKLHGTLY

SEQ ID NO: 3268204 - protein, 18 aa, Plasmodium falciparum
LKNFLLNNKFEWPLTVNS

SEQ ID NO: 3268205 - protein, 17 aa, Plasmodium falciparum
LKNGIKINGIDTYFMLK

SEQ ID NO: 3268206 - protein, 17 aa, Plasmodium falciparum
LKNGISISSDDDIFISM

SEQ ID NO: 3268207 - protein, 17 aa, Plasmodium falciparum
LKNICQIIKEFLLKEKK

SEQ ID NO: 3268208 - protein, 21 aa, Plasmodium falciparum
LKNIFIELNYIYANISTLRKD

SEQ ID NO: 3268209 - protein, 18 aa, Plasmodium falciparum
LKNILCVYSKQINIYYNN

SEQ ID NO: 3268210 - protein, 25 aa, Plasmodium falciparum
LKNIPNYIIINSFRIILQSCLNKVH

SEQ ID NO: 3268211 - protein, 17 aa, Plasmodium falciparum
LKNIRSMDLCLNTNNYE

SEQ ID NO: 3268212 - protein, 19 aa, Plasmodium falciparum
LKNIYLYDDERIMILMKKL

SEQ ID NO: 3268213 - protein, 25 aa, Plasmodium falciparum
LKNKGKACCYFNFYKRESVHNNVVS

SEQ ID NO: 3268214 - protein, 43 aa, Plasmodium falciparum
LKNKKSGLINIIRFPLLYEINLKKLMKIFCFYEHIKKEEKINT

SEQ ID NO: 3268215 - protein, 21 aa, Plasmodium falciparum
LKNKMINCLEITNNTQIKDIY

SEQ ID NO: 3268216 - protein, 26 aa, Plasmodium falciparum
LKNKRKFSFFINFFLNIFNIINILLF

SEQ ID NO: 3268217 - protein, 24 aa, Plasmodium falciparum
LKNKRYENVDAFLGLLNNEKACQA

SEQ ID NO: 3268218 - protein, 24 aa, Plasmodium falciparum
LKNLFKENICINTLNVSNFISVSK

SEQ ID NO: 3268219 - protein, 19 aa, Plasmodium falciparum
LKNLFNYWIHHKRNMIINN

SEQ ID NO: 3268220 - protein, 25 aa, Plasmodium falciparum
LKNLIKINECYYDLSTFGKSPNTIF

SEQ ID NO: 3268221 - protein, 22 aa, Plasmodium falciparum
LKNLRMDILYPIFNASLVFLFD

SEQ ID NO: 3268222 - protein, 24 aa, Plasmodium falciparum
LKNMKEPFFYFSKENKIKEDKNII

SEQ ID NO: 3268223 - protein, 22 aa, Plasmodium falciparum
LKNNEFIYVKSLPNFSYEIASW

SEQ ID NO: 3268224 - protein, 17 aa, Plasmodium falciparum
LKNNFNISNHNILLMNN

SEQ ID NO: 3268225 - protein, 25 aa, Plasmodium falciparum
LKNNITCKIINSFYIYNYIQLLLNE

SEQ ID NO: 3268226 - protein, 20 aa, Plasmodium falciparum
LKNNIYLIFEILNNIYDVYY

SEQ ID NO: 3268227 - protein, 20 aa, Plasmodium falciparum
LKNNVEIGRYGKIQENNETK

SEQ ID NO: 3268228 - protein, 24 aa, Plasmodium falciparum
LKNPKEVFTKAFLNIHENIERTTN

SEQ ID NO: 3268229 - protein, 19 aa, Plasmodium falciparum
LKNQEWYCCFFNNVKELYD

SEQ ID NO: 3268230 - protein, 20 aa, Plasmodium falciparum
LKNRRFTVSKNNMLKKYMFM

SEQ ID NO: 3268231 - protein, 25 aa, Plasmodium falciparum
LKNRYSKRGNYLWLLEKKEKNDLSS

SEQ ID NO: 3268232 - protein, 18 aa, Plasmodium falciparum
LKNSFKIVKKMWFFDYPF

SEQ ID NO: 3268233 - protein, 20 aa, Plasmodium falciparum
LKNSKLVLFYKCNCIVKGKI

SEQ ID NO: 3268234 - protein, 25 aa, Plasmodium falciparum
LKNSKNIFFSLCIYLYNIAKIMMLK

SEQ ID NO: 3268235 - protein, 19 aa, Plasmodium falciparum
LKNSVTYNLDRKCLELFFC

SEQ ID NO: 3268236 - protein, 19 aa, Plasmodium falciparum
LKNSYTLKCTEEIRVAQRR

SEQ ID NO: 3268237 - protein, 18 aa, Plasmodium falciparum
LKNTILIKRDIDEIYDIC

SEQ ID NO: 3268238 - protein, 18 aa, Plasmodium falciparum
LKNVETFNIDDHFCKLLN

SEQ ID NO: 3268239 - protein, 24 aa, Plasmodium falciparum
LKNVFAVSILFLYGSYECINVLQH

SEQ ID NO: 3268240 - protein, 20 aa, Plasmodium falciparum
LKNYLIKSVYQNFFVCIFNF

SEQ ID NO: 3268241 - protein, 19 aa, Plasmodium falciparum
LKNYLNVCDKFDKNKKVDD

SEQ ID NO: 3268242 - protein, 17 aa, Plasmodium falciparum
LKPIPTIGYSKKSGRVQ

SEQ ID NO: 3268243 - protein, 18 aa, Plasmodium falciparum
LKPIYSICVSEHGGELII

SEQ ID NO: 3268244 - protein, 21 aa, Plasmodium falciparum
LKPRGFIIGIIYILYINVLCI

SEQ ID NO: 3268245 - protein, 21 aa, Plasmodium falciparum
LKPRVSLVCGKDNWESTFYAH

SEQ ID NO: 3268246 - protein, 22 aa, Plasmodium falciparum
LKPTSFFLYKHHVYFNQKYKKD

SEQ ID NO: 3268247 - protein, 17 aa, Plasmodium falciparum
LKPVFFFYINFNKSHMN

SEQ ID NO: 3268248 - protein, 18 aa, Plasmodium falciparum
LKPYFSFLDLVTKNFFQR

SEQ ID NO: 3268249 - protein, 21 aa, Plasmodium falciparum
LKPYISHIIICIQKTLLRKYK

SEQ ID NO: 3268250 - protein, 21 aa, Plasmodium falciparum
LKQIRHFFSTSEFNNMSQLSD

SEQ ID NO: 3268251 - protein, 19 aa, Plasmodium falciparum
LKQKFKYLMEENFFFSKRQ

SEQ ID NO: 3268252 - protein, 17 aa, Plasmodium falciparum
LKQKFLNKLNEIIQNHK

SEQ ID NO: 3268253 - protein, 37 aa, Plasmodium falciparum
LKQKQFKRWSIWKSNKWNGLNGWKKREWNFEGDEMWI

SEQ ID NO: 3268254 - protein, 23 aa, Plasmodium falciparum
LKQNCSKCICSFKDIEQTHKKSK

SEQ ID NO: 3268255 - protein, 20 aa, Plasmodium falciparum
LKQNECYEIFYKRTKDNFIG

SEQ ID NO: 3268256 - protein, 25 aa, Plasmodium falciparum
LKQNFLNDFFFFKIFIVTKRAIFSN

SEQ ID NO: 3268257 - protein, 25 aa, Plasmodium falciparum
LKQQREYLKLCYGDNWEKKIKELQN

SEQ ID NO: 3268258 - protein, 19 aa, Plasmodium falciparum
LKQYFFFPSKDENIRKDFF

SEQ ID NO: 3268259 - protein, 20 aa, Plasmodium falciparum
LKQYKLYLADFIGLDISNND

SEQ ID NO: 3268260 - protein, 17 aa, Plasmodium falciparum
LKRAEGIKIVGNLMNKW

SEQ ID NO: 3268261 - protein, 17 aa, Plasmodium falciparum
LKRDTFPLFLRKKKKKL

SEQ ID NO: 3268262 - protein, 17 aa, Plasmodium falciparum
LKREGMALYELFQLEKE

SEQ ID NO: 3268263 - protein, 22 aa, Plasmodium falciparum
LKREIFNRFYFLSTDDLINLIS

SEQ ID NO: 3268264 - protein, 17 aa, Plasmodium falciparum
LKRFFKKDSSVLNPTAW

SEQ ID NO: 3268265 - protein, 30 aa, Plasmodium falciparum
LKRHRVFQTFLSFLICNNIRTLTKESSNKE

SEQ ID NO: 3268266 - protein, 23 aa, Plasmodium falciparum
LKRIRLDNFFHLILAKKKIDFDI

SEQ ID NO: 3268267 - protein, 27 aa, Plasmodium falciparum
LKRITIYYKEFNAIKDVVKFYLEHFII

SEQ ID NO: 3268268 - protein, 22 aa, Plasmodium falciparum
LKRKAYIKWIFYHKNYKINILT

SEQ ID NO: 3268269 - protein, 18 aa, Plasmodium falciparum
LKRKIKFLNEQKEINNHL

SEQ ID NO: 3268270 - protein, 20 aa, Plasmodium falciparum
LKRKKVCKIILLVILPENTK

SEQ ID NO: 3268271 - protein, 19 aa, Plasmodium falciparum
LKRKLMWMIKEYIHVATFN

SEQ ID NO: 3268272 - protein, 18 aa, Plasmodium falciparum
LKRKNLWNNIGINSITLS

SEQ ID NO: 3268273 - protein, 19 aa, Plasmodium falciparum
LKRKNLWNNIGINSITLSL

SEQ ID NO: 3268274 - protein, 21 aa, Plasmodium falciparum
LKRKPFFFFRKFRSLKTLYIK

SEQ ID NO: 3268275 - protein, 20 aa, Plasmodium falciparum
LKRLFKYPPVENIKILIDLS

SEQ ID NO: 3268276 - protein, 22 aa, Plasmodium falciparum
LKRNFLKNIIWIDIFMGVLNAC

SEQ ID NO: 3268277 - protein, 20 aa, Plasmodium falciparum
LKRRCIGGICSCSVASAFLT

SEQ ID NO: 3268278 - protein, 20 aa, Plasmodium falciparum
LKRSNMLKFTNFLKTNYKDS

SEQ ID NO: 3268279 - protein, 40 aa, Plasmodium falciparum
LKRYEHIKNHFLLIQYRLIFPMYLFISFYFYNQKLIASKN

SEQ ID NO: 3268280 - protein, 24 aa, Plasmodium falciparum
LKRYFLCSYDHNLIERKWLMYYFT

SEQ ID NO: 3268281 - protein, 24 aa, Plasmodium falciparum
LKRYKYYICRKYKNISFQNILNKF

SEQ ID NO: 3268282 - protein, 20 aa, Plasmodium falciparum
LKSAERHNLYLLLKKEKQKI

SEQ ID NO: 3268283 - protein, 17 aa, Plasmodium falciparum
LKSAYSRNELRNDQEKK

SEQ ID NO: 3268284 - protein, 17 aa, Plasmodium falciparum
LKSDLTYKLYKSKMHII

SEQ ID NO: 3268285 - protein, 22 aa, Plasmodium falciparum
LKSELFSFTLINSYDFLLRNSV

SEQ ID NO: 3268286 - protein, 20 aa, Plasmodium falciparum
LKSFCILKYDHANIYKYIYF

SEQ ID NO: 3268287 - protein, 33 aa, Plasmodium falciparum
LKSFKKKSSLIFFCITLLYLFYTYVSLFLFIFN

SEQ ID NO: 3268288 - protein, 33 aa, Plasmodium falciparum
LKSIKYEPKYNVAWKCLGDAYRSFRKFWQAKNF

SEQ ID NO: 3268289 - protein, 17 aa, Plasmodium falciparum
LKSILYFMEPLECVNIY

SEQ ID NO: 3268290 - protein, 25 aa, Plasmodium falciparum
LKSIYFNLFVSLSFVLQYIPLNVQY

SEQ ID NO: 3268291 - protein, 23 aa, Plasmodium falciparum
LKSKGLVFLYAMIDKYGSILNKS

SEQ ID NO: 3268292 - protein, 17 aa, Plasmodium falciparum
LKSKIFLDKSYRKRKKS

SEQ ID NO: 3268293 - protein, 17 aa, Plasmodium falciparum
LKSKVFGTFDQKTGKCK

SEQ ID NO: 3268294 - protein, 20 aa, Plasmodium falciparum
LKSKYFSTSHETLKGVNNIS

SEQ ID NO: 3268295 - protein, 21 aa, Plasmodium falciparum
LKSKYKISTKIVDRNIKMFLK

SEQ ID NO: 3268296 - protein, 26 aa, Plasmodium falciparum
LKSLLSRPSLVAPFVGIIYIVLVNIC

SEQ ID NO: 3268297 - protein, 20 aa, Plasmodium falciparum
LKSNVLRLDKIRNRNIKKPL

SEQ ID NO: 3268298 - protein, 19 aa, Plasmodium falciparum
LKSNWFKIVELINIVSSIK

SEQ ID NO: 3268299 - protein, 19 aa, Plasmodium falciparum
LKSSHDYDKIKTCTSNICG

SEQ ID NO: 3268300 - protein, 28 aa, Plasmodium falciparum
LKSSILKFICCIKTLKKMFNAFTNSTYN

SEQ ID NO: 3268301 - protein, 20 aa, Plasmodium falciparum
LKSSYLSSGYFFSNRSITTN

SEQ ID NO: 3268302 - protein, 17 aa, Plasmodium falciparum
LKSTYAFIQKNYNVRSI

SEQ ID NO: 3268303 - protein, 17 aa, Plasmodium falciparum
LKSVRLFEESLGIRKNK

SEQ ID NO: 3268304 - protein, 24 aa, Plasmodium falciparum
LKSYKILFYYYLLGKKYCKELYMA

SEQ ID NO: 3268305 - protein, 17 aa, Plasmodium falciparum
LKTAIPKMDIQFKNAEN

SEQ ID NO: 3268306 - protein, 19 aa, Plasmodium falciparum
LKTDIILNSFVQINSSNIL

SEQ ID NO: 3268307 - protein, 25 aa, Plasmodium falciparum
LKTEYNCDEIIYKLICYVNNIRKDR

SEQ ID NO: 3268308 - protein, 23 aa, Plasmodium falciparum
LKTIQKLLSVHMYYSYDYDLTQC

SEQ ID NO: 3268309 - protein, 20 aa, Plasmodium falciparum
LKTIYCKKNFFFQLYEYNNG

SEQ ID NO: 3268310 - protein, 17 aa, Plasmodium falciparum
LKTIYIYNNDIHIKHED

SEQ ID NO: 3268311 - protein, 19 aa, Plasmodium falciparum
LKTKISNILSIEDIYFLFN

SEQ ID NO: 3268312 - protein, 17 aa, Plasmodium falciparum
LKTLKIICYDKYSRYLR

SEQ ID NO: 3268313 - protein, 23 aa, Plasmodium falciparum
LKTLKLEYLRSVFYQDGQFHDNN

SEQ ID NO: 3268314 - protein, 20 aa, Plasmodium falciparum
LKTLQTICHLLGLKPYGIHY

SEQ ID NO: 3268315 - protein, 21 aa, Plasmodium falciparum
LKTQDFWYIYKYNPFDTSFAF

SEQ ID NO: 3268316 - protein, 22 aa, Plasmodium falciparum
LKTRIMLKRCMGMYEERVNKKL

SEQ ID NO: 3268317 - protein, 18 aa, Plasmodium falciparum
LKTSDFLYNIYKDRLKQS

SEQ ID NO: 3268318 - protein, 18 aa, Plasmodium falciparum
LKTVNVFENVYLDKPGKV

SEQ ID NO: 3268319 - protein, 24 aa, Plasmodium falciparum
LKTYEPINFILFYSENFVEKLINF

SEQ ID NO: 3268320 - protein, 25 aa, Plasmodium falciparum
LKTYKHLIVYLIKIPASFNQKIIKS

SEQ ID NO: 3268321 - protein, 22 aa, Plasmodium falciparum
LKTYLYEILCHALYELGKHRPI

SEQ ID NO: 3268322 - protein, 17 aa, Plasmodium falciparum
LKVCLSYNTNTFLSLFI

SEQ ID NO: 3268323 - protein, 23 aa, Plasmodium falciparum
LKVFYFLFFYLSFEDIYYHCINI

SEQ ID NO: 3268324 - protein, 18 aa, Plasmodium falciparum
LKVGMWLSTCSLLILGMI

SEQ ID NO: 3268325 - protein, 20 aa, Plasmodium falciparum
LKVLFMVYSMISSIYYYFIQ

SEQ ID NO: 3268326 - protein, 20 aa, Plasmodium falciparum
LKVLLKYFSKYFNFYNYIQQ

SEQ ID NO: 3268327 - protein, 26 aa, Plasmodium falciparum
LKVNNCKDPVFLFNILWSLILKYSKY

SEQ ID NO: 3268328 - protein, 22 aa, Plasmodium falciparum
LKVQNFCLNYRNSINHLIFYIK

SEQ ID NO: 3268329 - protein, 19 aa, Plasmodium falciparum
LKVSMKSFFQSSNSQEYTY

SEQ ID NO: 3268330 - protein, 33 aa, Plasmodium falciparum
LKVSRITAVLIFVTYCLFLLFQLYTHISLFQDK

SEQ ID NO: 3268331 - protein, 19 aa, Plasmodium falciparum
LKVYNLIKLLSMPIISSLL

SEQ ID NO: 3268332 - protein, 26 aa, Plasmodium falciparum
LKYCDIIYLNYIIKKKCLNKYGNDKS

SEQ ID NO: 3268333 - protein, 27 aa, Plasmodium falciparum
LKYDLKRGIIEMGVFHFCLIMYLINYI

SEQ ID NO: 3268334 - protein, 28 aa, Plasmodium falciparum
LKYEYYIKEMKCIFNILNKYYKMYDTEE

SEQ ID NO: 3268335 - protein, 17 aa, Plasmodium falciparum
LKYFLNIDLRKNLENSR

SEQ ID NO: 3268336 - protein, 19 aa, Plasmodium falciparum
LKYFLYVFFNAIRKKKRNK

SEQ ID NO: 3268337 - protein, 18 aa, Plasmodium falciparum
LKYFRVDVFFPKIFNSIG

SEQ ID NO: 3268338 - protein, 26 aa, Plasmodium falciparum
LKYGPKAPTSWKCIPSGSDSSSSGAI

SEQ ID NO: 3268339 - protein, 26 aa, Plasmodium falciparum
LKYGPKAPTSWKCVTPSGKPGEAPSG

SEQ ID NO: 3268340 - protein, 20 aa, Plasmodium falciparum
LKYGTPNRYWGWKCIGDKTA

SEQ ID NO: 3268341 - protein, 18 aa, Plasmodium falciparum
LKYHKGYTTSLYNLYVVN

SEQ ID NO: 3268342 - protein, 18 aa, Plasmodium falciparum
LKYHYIILLITAIVPSLI

SEQ ID NO: 3268343 - protein, 26 aa, Plasmodium falciparum
LKYIFPDIPEGLYFHLKESNYKIINC

SEQ ID NO: 3268344 - protein, 17 aa, Plasmodium falciparum
LKYINNISIIPRNTSFV

SEQ ID NO: 3268345 - protein, 17 aa, Plasmodium falciparum
LKYKFRNYINFKKILSF

SEQ ID NO: 3268346 - protein, 23 aa, Plasmodium falciparum
LKYKTDCKMVFCVRTDIKMTKGK

SEQ ID NO: 3268347 - protein, 17 aa, Plasmodium falciparum
LKYLCKYLQNFLYDEFE

SEQ ID NO: 3268348 - protein, 19 aa, Plasmodium falciparum
LKYLFIPIILLYYNNIYIS

SEQ ID NO: 3268349 - protein, 18 aa, Plasmodium falciparum
LKYLFNIWNKKYKKRKIC

SEQ ID NO: 3268350 - protein, 27 aa, Plasmodium falciparum
LKYLNCRYNFVLIFGIILYIFLLNINI

SEQ ID NO: 3268351 - protein, 17 aa, Plasmodium falciparum
LKYNYYISCDYNNSDHF

SEQ ID NO: 3268352 - protein, 18 aa, Plasmodium falciparum
LKYPVHYMYFKYSSDQSI

SEQ ID NO: 3268353 - protein, 17 aa, Plasmodium falciparum
LKYSCEYDKKGKNKLFD

SEQ ID NO: 3268354 - protein, 17 aa, Plasmodium falciparum
LKYSNVINYELSIEEIK

SEQ ID NO: 3268355 - protein, 21 aa, Plasmodium falciparum
LKYVECKSIMCDNVEHSSPCL

SEQ ID NO: 3268356 - protein, 20 aa, Plasmodium falciparum
LKYYCKSHISEVVINTIRKM

SEQ ID NO: 3268357 - protein, 20 aa, Plasmodium falciparum
LKYYHVCCISTREILRDKRN

SEQ ID NO: 3268358 - protein, 17 aa, Plasmodium falciparum
LLAECLKKNGNVYKAVE

SEQ ID NO: 3268359 - protein, 23 aa, Plasmodium falciparum
LLAENLCKIGFIFFSKDLKFLQM

SEQ ID NO: 3268360 - protein, 20 aa, Plasmodium falciparum
LLAESGLYIKEFVNGDKGRT

SEQ ID NO: 3268361 - protein, 23 aa, Plasmodium falciparum
LLAGEPFKLNSYYYRDVKYENVK

SEQ ID NO: 3268362 - protein, 20 aa, Plasmodium falciparum
LLAHTLITKYFDSIFCISVK

SEQ ID NO: 3268363 - protein, 18 aa, Plasmodium falciparum
LLAINKWFKRIIVECERF

SEQ ID NO: 3268364 - protein, 17 aa, Plasmodium falciparum
LLAIYGFFCPCTEHCRI

SEQ ID NO: 3268365 - protein, 21 aa, Plasmodium falciparum
LLANCIMSYIYFYNISKKGTL

SEQ ID NO: 3268366 - protein, 17 aa, Plasmodium falciparum
LLANLSTHILKRCSKKI

SEQ ID NO: 3268367 - protein, 18 aa, Plasmodium falciparum
LLANNFIYDGRWNKAMDS

SEQ ID NO: 3268368 - protein, 24 aa, Plasmodium falciparum
LLCFLETLKIIILNIRIKKEKGQK

SEQ ID NO: 3268369 - protein, 21 aa, Plasmodium falciparum
LLCHNYNCLSSSIKLIHHMNL

SEQ ID NO: 3268370 - protein, 27 aa, Plasmodium falciparum
LLCIKNGEYRYCFNKLIYILDIYKNMY

SEQ ID NO: 3268371 - protein, 24 aa, Plasmodium falciparum
LLCIQKDMRNCVPYLNFILKSVSL

SEQ ID NO: 3268372 - protein, 30 aa, Plasmodium falciparum
LLCLHPYYYKLCSYLLIIHPYHQTYLIDLL

SEQ ID NO: 3268373 - protein, 19 aa, Plasmodium falciparum
LLCLIIIEIFNLIYDNRQY

SEQ ID NO: 3268374 - protein, 25 aa, Plasmodium falciparum
LLCLLKNICLLGHIIYFYEDLYEQK

SEQ ID NO: 3268375 - protein, 17 aa, Plasmodium falciparum
LLCPFDMCKNYLCYHQM

SEQ ID NO: 3268376 - protein, 17 aa, Plasmodium falciparum
LLCPHIYLNVSSHININ

SEQ ID NO: 3268377 - protein, 27 aa, Plasmodium falciparum
LLCTLLVNFFFLYSIIFYFLPINNLPS

SEQ ID NO: 3268378 - protein, 17 aa, Plasmodium falciparum
LLDILFLFNEEIVKESK

SEQ ID NO: 3268379 - protein, 18 aa, Plasmodium falciparum
LLDILFLYFSKFQATTQI

SEQ ID NO: 3268380 - protein, 20 aa, Plasmodium falciparum
LLDILKVIIILKLKKEKKCS

SEQ ID NO: 3268381 - protein, 17 aa, Plasmodium falciparum
LLDIYILIMLLKHESVF

SEQ ID NO: 3268382 - protein, 21 aa, Plasmodium falciparum
LLDKRQDIFITFKISHENQQE

SEQ ID NO: 3268383 - protein, 17 aa, Plasmodium falciparum
LLECSLVKFNKTRLNCV

SEQ ID NO: 3268384 - protein, 17 aa, Plasmodium falciparum
LLEDRVMILEKKIKEDK

SEQ ID NO: 3268385 - protein, 24 aa, Plasmodium falciparum
LLEEEVFLFFLFLINCSFLSEWDN

SEQ ID NO: 3268386 - protein, 18 aa, Plasmodium falciparum
LLEFKRDTLSMLNNIFNI

SEQ ID NO: 3268387 - protein, 24 aa, Plasmodium falciparum
LLEGEIKFLCLILENKGNMDIEFL

SEQ ID NO: 3268388 - protein, 19 aa, Plasmodium falciparum
LLEIIKLSIHTGVQKFAYY

SEQ ID NO: 3268389 - protein, 41 aa, Plasmodium falciparum
LLEIILGDECIVWWLHDIDPIFSYHFQYFIWIISLFCFATY

SEQ ID NO: 3268390 - protein, 17 aa, Plasmodium falciparum
LLEKNLDTIPGFKYNEK

SEQ ID NO: 3268391 - protein, 22 aa, Plasmodium falciparum
LLEKRIMFVQSLILNMKLQQSI

SEQ ID NO: 3268392 - protein, 19 aa, Plasmodium falciparum
LLEKTFYGSDTFRVFEDFD

SEQ ID NO: 3268393 - protein, 22 aa, Plasmodium falciparum
LLEPNFHYPYMYNMNPMNHVNN

SEQ ID NO: 3268394 - protein, 17 aa, Plasmodium falciparum
LLEYSLKKDIHMTNVFL

SEQ ID NO: 3268395 - protein, 17 aa, Plasmodium falciparum
LLFCLLSIVWSSYNCIL

SEQ ID NO: 3268396 - protein, 20 aa, Plasmodium falciparum
LLFCLPLNILAHSKNKLYMK

SEQ ID NO: 3268397 - protein, 18 aa, Plasmodium falciparum
LLFECSLKLISIKKNIHL

SEQ ID NO: 3268398 - protein, 19 aa, Plasmodium falciparum
LLFFELIYFGNYRGLYNYK

SEQ ID NO: 3268399 - protein, 21 aa, Plasmodium falciparum
LLFFEVLLRHSLFLIFNEETN

SEQ ID NO: 3268400 - protein, 19 aa, Plasmodium falciparum
LLFFFPLPCIYNKMIYKKL

SEQ ID NO: 3268401 - protein, 25 aa, Plasmodium falciparum
LLFFHIQCLHFLYTKRNEDIKKDIV

SEQ ID NO: 3268402 - protein, 20 aa, Plasmodium falciparum
LLFFYSIYFTYAINMNTSLS

SEQ ID NO: 3268403 - protein, 18 aa, Plasmodium falciparum
LLFLCIQEVLTFYENIII

SEQ ID NO: 3268404 - protein, 18 aa, Plasmodium falciparum
LLFLSSGIYLCHLITNSI

SEQ ID NO: 3268405 - protein, 19 aa, Plasmodium falciparum
LLFLYKLYYDIYKGLDFTH

SEQ ID NO: 3268406 - protein, 27 aa, Plasmodium falciparum
LLFNALLKRWVEYFLEDYKKIKHKISH

SEQ ID NO: 3268407 - protein, 17 aa, Plasmodium falciparum
LLFNIYETPNFVQELEA

SEQ ID NO: 3268408 - protein, 22 aa, Plasmodium falciparum
LLFPGWKYYAEDEMKDDQNKRY

SEQ ID NO: 3268409 - protein, 17 aa, Plasmodium falciparum
LLFPLKLNILIYNQRNH

SEQ ID NO: 3268410 - protein, 26 aa, Plasmodium falciparum
LLFPLNIFLSFSFIRYNSISFKNNQS

SEQ ID NO: 3268411 - protein, 18 aa, Plasmodium falciparum
LLFQIIKPFNVFLNIIKI

SEQ ID NO: 3268412 - protein, 18 aa, Plasmodium falciparum
LLFSMAKHFFNHLLSCVN

SEQ ID NO: 3268413 - protein, 17 aa, Plasmodium falciparum
LLGEFRITLFNESNNMF

SEQ ID NO: 3268414 - protein, 19 aa, Plasmodium falciparum
LLGIDAETFLKYFTSGYLL

SEQ ID NO: 3268415 - protein, 24 aa, Plasmodium falciparum
LLGILTNLCLYDFNYKTNTYYLEE

SEQ ID NO: 3268416 - protein, 18 aa, Plasmodium falciparum
LLGKNLLRSYYRNIELAK

SEQ ID NO: 3268417 - protein, 23 aa, Plasmodium falciparum
LLHAINIWLKILISKPMDDIWFK

SEQ ID NO: 3268418 - protein, 28 aa, Plasmodium falciparum
LLHDFPEFLCVYNFSFCNVIPLNCVQLR

SEQ ID NO: 3268419 - protein, 25 aa, Plasmodium falciparum
LLHKRNCPICKQIIKHNNLKKITGK

SEQ ID NO: 3268420 - protein, 26 aa, Plasmodium falciparum
LLHLMYKLSQLFTYFFVKLKLSSTDN

SEQ ID NO: 3268421 - protein, 18 aa, Plasmodium falciparum
LLHMMVFGVCIYKVEGSV

SEQ ID NO: 3268422 - protein, 23 aa, Plasmodium falciparum
LLHPCGIFPWNVFTDSYIFYDKE

SEQ ID NO: 3268423 - protein, 20 aa, Plasmodium falciparum
LLHQCYTYIYSIFIVTKKMK

SEQ ID NO: 3268424 - protein, 23 aa, Plasmodium falciparum
LLHSYYLKMSMFNIDSCIMHMIT

SEQ ID NO: 3268425 - protein, 24 aa, Plasmodium falciparum
LLICILTIKILCFINLKKLRFNII

SEQ ID NO: 3268426 - protein, 18 aa, Plasmodium falciparum
LLICISFICVFECFNKCM

SEQ ID NO: 3268427 - protein, 23 aa, Plasmodium falciparum
LLICLPLNILVLSSYVHNKNKPS

SEQ ID NO: 3268428 - protein, 24 aa, Plasmodium falciparum
LLIDLFGLFIIFFFSYKWYYQRNV

SEQ ID NO: 3268429 - protein, 18 aa, Plasmodium falciparum
LLIELILVPMLYRSNTTI

SEQ ID NO: 3268430 - protein, 24 aa, Plasmodium falciparum
LLIFCYSSYINIHFNNSILQDLCI

SEQ ID NO: 3268431 - protein, 18 aa, Plasmodium falciparum
LLIFEYTNNLIIRRKQVK

SEQ ID NO: 3268432 - protein, 28 aa, Plasmodium falciparum
LLIGDCIIVSSLLNYISHFSYEYRKIIK

SEQ ID NO: 3268433 - protein, 22 aa, Plasmodium falciparum
LLIKDEEFILYLLINKKHVIQY

SEQ ID NO: 3268434 - protein, 23 aa, Plasmodium falciparum
LLIKKHFYLPLNRIHNASEFNEK

SEQ ID NO: 3268435 - protein, 18 aa, Plasmodium falciparum
LLILGHWDILYLPFSIFV

SEQ ID NO: 3268436 - protein, 19 aa, Plasmodium falciparum
LLILICSLLCTFVITLFYK

SEQ ID NO: 3268437 - protein, 18 aa, Plasmodium falciparum
LLILILFDTQLLKISLKY

SEQ ID NO: 3268438 - protein, 29 aa, Plasmodium falciparum
LLILKKGYFYLLATCLFNPMNILNASLSS

SEQ ID NO: 3268439 - protein, 17 aa, Plasmodium falciparum
LLILLHDFPEFLCVYNF

SEQ ID NO: 3268440 - protein, 27 aa, Plasmodium falciparum
LLINCIIYLSIVFYKLLQIIPSKERTD

SEQ ID NO: 3268441 - protein, 26 aa, Plasmodium falciparum
LLIPHSSFCLSLDFIFILIKNNIKID

SEQ ID NO: 3268442 - protein, 18 aa, Plasmodium falciparum
LLIQLCLTDNALPLNLSL

SEQ ID NO: 3268443 - protein, 18 aa, Plasmodium falciparum
LLISCILLLNICKKDTFQ

SEQ ID NO: 3268444 - protein, 17 aa, Plasmodium falciparum
LLISLFLTKYLKINMSR

SEQ ID NO: 3268445 - protein, 17 aa, Plasmodium falciparum
LLITYVFYKIFIKYKTY

SEQ ID NO: 3268446 - protein, 17 aa, Plasmodium falciparum
LLIVAFIILFPVFFNYT

SEQ ID NO: 3268447 - protein, 17 aa, Plasmodium falciparum
LLIYWKMLEDLKNVKTE

SEQ ID NO: 3268448 - protein, 22 aa, Plasmodium falciparum
LLKCRKKKLEVILWIKIYMSVL

SEQ ID NO: 3268449 - protein, 19 aa, Plasmodium falciparum
LLKDYHINKILSYIIYNYR

SEQ ID NO: 3268450 - protein, 23 aa, Plasmodium falciparum
LLKDYKYYISFQLKNIIDLVLFQ

SEQ ID NO: 3268451 - protein, 26 aa, Plasmodium falciparum
LLKEIKNKVCLLGVCVGNKENIRSDI

SEQ ID NO: 3268452 - protein, 17 aa, Plasmodium falciparum
LLKEMFDDWLVHGHIKL

SEQ ID NO: 3268453 - protein, 17 aa, Plasmodium falciparum
LLKFKRKTGQRFCVCCY

SEQ ID NO: 3268454 - protein, 22 aa, Plasmodium falciparum
LLKFLWNCIMALRKIQTTKDEV

SEQ ID NO: 3268455 - protein, 17 aa, Plasmodium falciparum
LLKHFYNYFPILKITNN

SEQ ID NO: 3268456 - protein, 21 aa, Plasmodium falciparum
LLKIIIFKNTLYIFDNVCTSI

SEQ ID NO: 3268457 - protein, 22 aa, Plasmodium falciparum
LLKKEKQKIILIDGKNIGTRYQ

SEQ ID NO: 3268458 - protein, 25 aa, Plasmodium falciparum
LLKKIERSRCSNLFNIEHDIYDYNK

SEQ ID NO: 3268459 - protein, 24 aa, Plasmodium falciparum
LLKKYKFFLNKLIYHDIQNMNQMS

SEQ ID NO: 3268460 - protein, 17 aa, Plasmodium falciparum
LLKLYFYNLCFHINIYL

SEQ ID NO: 3268461 - protein, 49 aa, Plasmodium falciparum
LLKNDILKECCYICGSIEYKNNFIYCCICGISVHYSCANIVHPFLFNLN

SEQ ID NO: 3268462 - protein, 22 aa, Plasmodium falciparum
LLKNEGIIYIAYYEYEPTVYRK

SEQ ID NO: 3268463 - protein, 29 aa, Plasmodium falciparum
LLKNNELKGALKIEFPFSTPINNEKKNFI

SEQ ID NO: 3268464 - protein, 17 aa, Plasmodium falciparum
LLKRGVQTYICKDKEKI

SEQ ID NO: 3268465 - protein, 22 aa, Plasmodium falciparum
LLKTLLIIINILIKRNVSFINF

SEQ ID NO: 3268466 - protein, 26 aa, Plasmodium falciparum
LLKVYKRVNICLNIATLSLNILAHIL

SEQ ID NO: 3268467 - protein, 37 aa, Plasmodium falciparum
LLKYFNECLKYFISFLFPNKEFNIFIQFASYNIPAFY

SEQ ID NO: 3268468 - protein, 20 aa, Plasmodium falciparum
LLKYLFKKLFEQFINQEIFL

SEQ ID NO: 3268469 - protein, 20 aa, Plasmodium falciparum
LLKYNQYLSFNYKDSVDTEL

SEQ ID NO: 3268470 - protein, 22 aa, Plasmodium falciparum
LLKYYLSNDEYMFFQFLTSNLF

SEQ ID NO: 3268471 - protein, 19 aa, Plasmodium falciparum
LLLCCCLKGLEYDAYVCKG

SEQ ID NO: 3268472 - protein, 23 aa, Plasmodium falciparum
LLLCIEYHMGISFTNECKQNYKI

SEQ ID NO: 3268473 - protein, 19 aa, Plasmodium falciparum
LLLCSLRLCYPNVVEELFC

SEQ ID NO: 3268474 - protein, 17 aa, Plasmodium falciparum
LLLDVCLAAKYEGESLK

SEQ ID NO: 3268475 - protein, 22 aa, Plasmodium falciparum
LLLDYFFDLHFIKDELKCQDTN

SEQ ID NO: 3268476 - protein, 19 aa, Plasmodium falciparum
LLLEGNFYLGRICISSYVE

SEQ ID NO: 3268477 - protein, 17 aa, Plasmodium falciparum
LLLFAHPLNILLLSSSH

SEQ ID NO: 3268478 - protein, 19 aa, Plasmodium falciparum
LLLFFYPLIIPFRGAFAFA

SEQ ID NO: 3268479 - protein, 17 aa, Plasmodium falciparum
LLLFLIYMVKVFYRINK

SEQ ID NO: 3268480 - protein, 27 aa, Plasmodium falciparum
LLLIHFILMILLKFLLFTIMEVRYVLI

SEQ ID NO: 3268481 - protein, 19 aa, Plasmodium falciparum
LLLILCLYPNVDKYVYEKK

SEQ ID NO: 3268482 - protein, 19 aa, Plasmodium falciparum
LLLISSIATGLAVLVGGII

SEQ ID NO: 3268483 - protein, 17 aa, Plasmodium falciparum
LLLIYISNCLLYINNKH

SEQ ID NO: 3268484 - protein, 19 aa, Plasmodium falciparum
LLLKRKANKQIYEQKYYNE

SEQ ID NO: 3268485 - protein, 20 aa, Plasmodium falciparum
LLLLKFSLFNIFNLYEKYKI

SEQ ID NO: 3268486 - protein, 22 aa, Plasmodium falciparum
LLLLLEYCIELLLCSWDNIKPS

SEQ ID NO: 3268487 - protein, 22 aa, Plasmodium falciparum
LLLLLFCLIFSIDLNGIPLYFD

SEQ ID NO: 3268488 - protein, 19 aa, Plasmodium falciparum
LLLMKKKGINFLVTNIEIQ

SEQ ID NO: 3268489 - protein, 26 aa, Plasmodium falciparum
LLLNIYANFYFIKEIHDIATNISNQI

SEQ ID NO: 3268490 - protein, 20 aa, Plasmodium falciparum
LLLRIYRFIELIIKKKYNVD

SEQ ID NO: 3268491 - protein, 19 aa, Plasmodium falciparum
LLLSKKIYFFTSIKKKNMS

SEQ ID NO: 3268492 - protein, 21 aa, Plasmodium falciparum
LLLSSFLWLVYGMLLNNSAIV

SEQ ID NO: 3268493 - protein, 25 aa, Plasmodium falciparum
LLLSWNININRIFLLLVDIILLICL

SEQ ID NO: 3268494 - protein, 21 aa, Plasmodium falciparum
LLLTKKRYFGFSFKNENQDNP

SEQ ID NO: 3268495 - protein, 17 aa, Plasmodium falciparum
LLLVEPIDDITDEMKKE

SEQ ID NO: 3268496 - protein, 25 aa, Plasmodium falciparum
LLLVFRKNIDTIRCFISMLKNYNIK

SEQ ID NO: 3268497 - protein, 18 aa, Plasmodium falciparum
LLLWCIMGNNLPSYMTWI

SEQ ID NO: 3268498 - protein, 17 aa, Plasmodium falciparum
LLLYELWHTPFKSKEEK

SEQ ID NO: 3268499 - protein, 21 aa, Plasmodium falciparum
LLMLSELYKDIIIINENIYNN

SEQ ID NO: 3268500 - protein, 24 aa, Plasmodium falciparum
LLNCLKYFCKNIILFNEVDDTNDM

SEQ ID NO: 3268501 - protein, 23 aa, Plasmodium falciparum
LLNENKPKWFSMKNIETNVHEYN

SEQ ID NO: 3268502 - protein, 21 aa, Plasmodium falciparum
LLNFFFNKEMNIFEENCFFLK

SEQ ID NO: 3268503 - protein, 19 aa, Plasmodium falciparum
LLNGYKMDECNNISNNNNN

SEQ ID NO: 3268504 - protein, 24 aa, Plasmodium falciparum
LLNHKCFHDCFDLYINIYDDNINS

SEQ ID NO: 3268505 - protein, 34 aa, Plasmodium falciparum
LLNHSESWVWNLRDILRICKVLKYSKTNDQFFNI

SEQ ID NO: 3268506 - protein, 18 aa, Plasmodium falciparum
LLNICLFFFISLGISLFS

SEQ ID NO: 3268507 - protein, 18 aa, Plasmodium falciparum
LLNIFFNYHIFQNNNEII

SEQ ID NO: 3268508 - protein, 23 aa, Plasmodium falciparum
LLNILKKPYLTNFNLKEISIEKK

SEQ ID NO: 3268509 - protein, 17 aa, Plasmodium falciparum
LLNKKYDSFEIKDVLED

SEQ ID NO: 3268510 - protein, 18 aa, Plasmodium falciparum
LLNKRANECLNRKRVEYF

SEQ ID NO: 3268511 - protein, 24 aa, Plasmodium falciparum
LLNLIFRLTWAITIMPINIFENKE

SEQ ID NO: 3268512 - protein, 18 aa, Plasmodium falciparum
LLNLYKERECVYKDIVKH

SEQ ID NO: 3268513 - protein, 17 aa, Plasmodium falciparum
LLNMFLDNLNFVLIFYY

SEQ ID NO: 3268514 - protein, 18 aa, Plasmodium falciparum
LLNMLKFNVSYVKKKYNF

SEQ ID NO: 3268515 - protein, 17 aa, Plasmodium falciparum
LLNNIISFSYDLYTNIT

SEQ ID NO: 3268516 - protein, 24 aa, Plasmodium falciparum
LLNRYLKNLFPSMNRFNTDNSKTS

SEQ ID NO: 3268517 - protein, 21 aa, Plasmodium falciparum
LLNSIKFKIHYLYTSKMLIHT

SEQ ID NO: 3268518 - protein, 18 aa, Plasmodium falciparum
LLNSKTFIEKDIFQNNNI

SEQ ID NO: 3268519 - protein, 21 aa, Plasmodium falciparum
LLNSLKLLKYHFSYDEQKMVI

SEQ ID NO: 3268520 - protein, 25 aa, Plasmodium falciparum
LLNSMFCIFYNLWSNHMKTITIRKN

SEQ ID NO: 3268521 - protein, 18 aa, Plasmodium falciparum
LLNSSLYLTSKKLMSHLL

SEQ ID NO: 3268522 - protein, 22 aa, Plasmodium falciparum
LLNTLYNLIAWIYKSNMQNTQF

SEQ ID NO: 3268523 - protein, 28 aa, Plasmodium falciparum
LLNVIRIIYTVILFRLHKKLTELNTLGK

SEQ ID NO: 3268524 - protein, 19 aa, Plasmodium falciparum
LLNYYKGVILIDIDVGQPI

SEQ ID NO: 3268525 - protein, 27 aa, Plasmodium falciparum
LLPIIYCKGNILFQLGHSFSASEFWNN

SEQ ID NO: 3268526 - protein, 25 aa, Plasmodium falciparum
LLPYSFKYMESFIVFNLLHNNNYSI

SEQ ID NO: 3268527 - protein, 17 aa, Plasmodium falciparum
LLQCFNNSFSYILKSPY

SEQ ID NO: 3268528 - protein, 18 aa, Plasmodium falciparum
LLQHIPAHMLENITSSIR

SEQ ID NO: 3268529 - protein, 26 aa, Plasmodium falciparum
LLQILSIYICKNVYFISLPILASLLR

SEQ ID NO: 3268530 - protein, 27 aa, Plasmodium falciparum
LLQIVLVLVLCCHRIRCEEVSSISNKA

SEQ ID NO: 3268531 - protein, 19 aa, Plasmodium falciparum
LLQKCSNFILSLNINDLHS

SEQ ID NO: 3268532 - protein, 19 aa, Plasmodium falciparum
LLQNELKYCDIIYLNYIIK

SEQ ID NO: 3268533 - protein, 20 aa, Plasmodium falciparum
LLQYFNYVIFFNCVSIRMIY

SEQ ID NO: 3268534 - protein, 23 aa, Plasmodium falciparum
LLRKNKYFLPTIFTLTPKNEKAK

SEQ ID NO: 3268535 - protein, 22 aa, Plasmodium falciparum
LLRLRHDLNLIVTRKKCHKFIG

SEQ ID NO: 3268536 - protein, 26 aa, Plasmodium falciparum
LLRNYRHLWIFPIHMKNKFKVKNFDK

SEQ ID NO: 3268537 - protein, 23 aa, Plasmodium falciparum
LLRTCNFNELINLKKSIIIKTKM

SEQ ID NO: 3268538 - protein, 20 aa, Plasmodium falciparum
LLRYRYNKKIIRYRKNQPEN

SEQ ID NO: 3268539 - protein, 38 aa, Plasmodium falciparum
LLSCEKLKQILCYNGIFLSWAEIYDFFQPLNKYCVIYH

SEQ ID NO: 3268540 - protein, 18 aa, Plasmodium falciparum
LLSCMKLVSLIIDMEMNY

SEQ ID NO: 3268541 - protein, 18 aa, Plasmodium falciparum
LLSECLPINHLGFCNRQS

SEQ ID NO: 3268542 - protein, 23 aa, Plasmodium falciparum
LLSEKKTDIVIWSIKIEDITEIR

SEQ ID NO: 3268543 - protein, 17 aa, Plasmodium falciparum
LLSGFGIGLVTVSVPMY

SEQ ID NO: 3268544 - protein, 17 aa, Plasmodium falciparum
LLSGIIMDIMHKYTNDN

SEQ ID NO: 3268545 - protein, 24 aa, Plasmodium falciparum
LLSIFSILSICFKKVDVYRPSCCY

SEQ ID NO: 3268546 - protein, 18 aa, Plasmodium falciparum
LLSIFVGMIYMKSRKHSD

SEQ ID NO: 3268547 - protein, 18 aa, Plasmodium falciparum
LLSILPEHIRSMPYIEPS

SEQ ID NO: 3268548 - protein, 26 aa, Plasmodium falciparum
LLSKERIKMLLPYKDHLVLSSIIYCL

SEQ ID NO: 3268549 - protein, 20 aa, Plasmodium falciparum
LLSKKRFNIAYLKKKRKQIK

SEQ ID NO: 3268550 - protein, 18 aa, Plasmodium falciparum
LLSLKYFLITLLHLYLNP

SEQ ID NO: 3268551 - protein, 25 aa, Plasmodium falciparum
LLSLLFYKNMDVIRIASEIAYDLTD

SEQ ID NO: 3268552 - protein, 26 aa, Plasmodium falciparum
LLSLYSCVIYSLFFLWNKNDNMDTNL

SEQ ID NO: 3268553 - protein, 17 aa, Plasmodium falciparum
LLSMFWSVGSINFQNGN

SEQ ID NO: 3268554 - protein, 17 aa, Plasmodium falciparum
LLSNHYNHFDLSKQHVL

SEQ ID NO: 3268555 - protein, 25 aa, Plasmodium falciparum
LLSPPCLLSPSIISPHMLFTEKIQG

SEQ ID NO: 3268556 - protein, 18 aa, Plasmodium falciparum
LLSRFYLYMYCFNDKIKV

SEQ ID NO: 3268557 - protein, 26 aa, Plasmodium falciparum
LLSTCKINCVFYINYIKPEEVIKINY

SEQ ID NO: 3268558 - protein, 31 aa, Plasmodium falciparum
LLSTQMFFHIMCYKINYTYILYNILCKLKLK

SEQ ID NO: 3268559 - protein, 18 aa, Plasmodium falciparum
LLSVLICSLSTYYMALSW

SEQ ID NO: 3268560 - protein, 22 aa, Plasmodium falciparum
LLSVPYFFLFLWNEDIKCQSLL

SEQ ID NO: 3268561 - protein, 18 aa, Plasmodium falciparum
LLSVVLLMFLILRYMMEE

SEQ ID NO: 3268562 - protein, 21 aa, Plasmodium falciparum
LLTELFTLHYILIINNLENEI

SEQ ID NO: 3268563 - protein, 19 aa, Plasmodium falciparum
LLTFCSSYFFVHFKYISLA

SEQ ID NO: 3268564 - protein, 21 aa, Plasmodium falciparum
LLTFFPYHIKLILISYLYNVI

SEQ ID NO: 3268565 - protein, 17 aa, Plasmodium falciparum
LLTFFWFFYERNIYVKT

SEQ ID NO: 3268566 - protein, 19 aa, Plasmodium falciparum
LLTFLSFPFFFSKLKVKPN

SEQ ID NO: 3268567 - protein, 29 aa, Plasmodium falciparum
LLTKILNKFLYCLNLKTCLLKENKINYSA

SEQ ID NO: 3268568 - protein, 20 aa, Plasmodium falciparum
LLTLYCLFNKLKSYIISLQL

SEQ ID NO: 3268569 - protein, 18 aa, Plasmodium falciparum
LLTNCIEELFINPIQKEN

SEQ ID NO: 3268570 - protein, 23 aa, Plasmodium falciparum
LLTNLRILYYIQNMMKNKKCLLY

SEQ ID NO: 3268571 - protein, 17 aa, Plasmodium falciparum
LLTPTSFLHKTYNTNKS

SEQ ID NO: 3268572 - protein, 25 aa, Plasmodium falciparum
LLTSYSCLVSPCIDYWTKIQNRKVE

SEQ ID NO: 3268573 - protein, 17 aa, Plasmodium falciparum
LLVDVCLAAHYEGDSIK

SEQ ID NO: 3268574 - protein, 27 aa, Plasmodium falciparum
LLVEEILRFTYNILDNCLNKTKYNSIE

SEQ ID NO: 3268575 - protein, 19 aa, Plasmodium falciparum
LLVGDYILTKDICVERKSI

SEQ ID NO: 3268576 - protein, 27 aa, Plasmodium falciparum
LLVHYFACAAYYIKRADVYNIMNYYNE

SEQ ID NO: 3268577 - protein, 17 aa, Plasmodium falciparum
LLVQYSCNLNISNPQSK

SEQ ID NO: 3268578 - protein, 24 aa, Plasmodium falciparum
LLVSCLYLESIFSYDYKLKMKYKK

SEQ ID NO: 3268579 - protein, 19 aa, Plasmodium falciparum
LLVSVPSLFAYFLKRHKDN

SEQ ID NO: 3268580 - protein, 19 aa, Plasmodium falciparum
LLVTVCIIIILSIIYLILR

SEQ ID NO: 3268581 - protein, 25 aa, Plasmodium falciparum
LLVYVCLSEKLKYLINNKLINQLII

SEQ ID NO: 3268582 - protein, 17 aa, Plasmodium falciparum
LLYEEIQKWTILPVYVN

SEQ ID NO: 3268583 - protein, 19 aa, Plasmodium falciparum
LLYFFKRVNEKSCHIKWNS

SEQ ID NO: 3268584 - protein, 24 aa, Plasmodium falciparum
LLYFSYLIYCIFVSSYSTSKSKEN

SEQ ID NO: 3268585 - protein, 40 aa, Plasmodium falciparum
LLYGLKFNNFMFLQFEKIILKRFICLPKKEIQKIGKEEIM

SEQ ID NO: 3268586 - protein, 17 aa, Plasmodium falciparum
LLYIFLNNYECFLDNFE

SEQ ID NO: 3268587 - protein, 23 aa, Plasmodium falciparum
LLYIFYYVCINKFCIYLYRDCII

SEQ ID NO: 3268588 - protein, 21 aa, Plasmodium falciparum
LLYISAFPFEVEQIYTHSELY

SEQ ID NO: 3268589 - protein, 22 aa, Plasmodium falciparum
LLYISLCFYYIYLLNDDIYYLQ

SEQ ID NO: 3268590 - protein, 20 aa, Plasmodium falciparum
LLYKDTWDRIVLKFCRTVAI

SEQ ID NO: 3268591 - protein, 23 aa, Plasmodium falciparum
LLYKEIKNDFFLCQEYYDENLYI

SEQ ID NO: 3268592 - protein, 25 aa, Plasmodium falciparum
LLYKSYKIIKIWNKLYFLCFTNFCF

SEQ ID NO: 3268593 - protein, 18 aa, Plasmodium falciparum
LLYLKKWYLKNVYILNSK

SEQ ID NO: 3268594 - protein, 17 aa, Plasmodium falciparum
LLYLLLLHFDVFKNKNM

SEQ ID NO: 3268595 - protein, 26 aa, Plasmodium falciparum
LLYLPSEKLLIILYNFINNLKKIFPQ

SEQ ID NO: 3268596 - protein, 19 aa, Plasmodium falciparum
LLYLYEYLLKISMTDYEKQ

SEQ ID NO: 3268597 - protein, 32 aa, Plasmodium falciparum
LLYNEIKSTILLPETYFKPFIKPLQHSSIINH

SEQ ID NO: 3268598 - protein, 17 aa, Plasmodium falciparum
LLYPLMLLFLYVYLNIT

SEQ ID NO: 3268599 - protein, 18 aa, Plasmodium falciparum
LLYQFIIKKKEEIHWEEI

SEQ ID NO: 3268600 - protein, 26 aa, Plasmodium falciparum
LLYQGECNICLIGKTKNCKTVILNEI

SEQ ID NO: 3268601 - protein, 17 aa, Plasmodium falciparum
LLYSLGVQEFIQKYFYN

SEQ ID NO: 3268602 - protein, 18 aa, Plasmodium falciparum
LLYTCLIVLISKTSPLKN

SEQ ID NO: 3268603 - protein, 28 aa, Plasmodium falciparum
LLYTDIVLCLLKVFFLFYTDDVLSITLF

SEQ ID NO: 3268604 - protein, 18 aa, Plasmodium falciparum
LMAFCVFGELMKLILATM

SEQ ID NO: 3268605 - protein, 18 aa, Plasmodium falciparum
LMAKFNLILENVIDKYAT

SEQ ID NO: 3268606 - protein, 20 aa, Plasmodium falciparum
LMAMHVYWFFLILKMSRLFI

SEQ ID NO: 3268607 - protein, 22 aa, Plasmodium falciparum
LMDDFYKWFEYFFDESENDKQP

SEQ ID NO: 3268608 - protein, 29 aa, Plasmodium falciparum
LMDEVKKKISIFICFLVKRDIYILDEPFI

SEQ ID NO: 3268609 - protein, 19 aa, Plasmodium falciparum
LMEKKRLFLNIKDKCVENK

SEQ ID NO: 3268610 - protein, 34 aa, Plasmodium falciparum
LMERSHMFLLIKIFFVLFLFEVNVKMYFIVSGMF

SEQ ID NO: 3268611 - protein, 17 aa, Plasmodium falciparum
LMFAFEFSSSLFKLKYL

SEQ ID NO: 3268612 - protein, 25 aa, Plasmodium falciparum
LMFEHDFFYKFIVSHNYKKPTIDVI

SEQ ID NO: 3268613 - protein, 19 aa, Plasmodium falciparum
LMFYLSKCNLYFYYESFLC

SEQ ID NO: 3268614 - protein, 18 aa, Plasmodium falciparum
LMGATVWLAVATRAGLPV

SEQ ID NO: 3268615 - protein, 17 aa, Plasmodium falciparum
LMHKFATLHTDIQSDAI

SEQ ID NO: 3268616 - protein, 19 aa, Plasmodium falciparum
LMHLKEIYLLNISVIITNN

SEQ ID NO: 3268617 - protein, 19 aa, Plasmodium falciparum
LMINFYINMLIEKFLEKKK

SEQ ID NO: 3268618 - protein, 28 aa, Plasmodium falciparum
LMITSFLFYKICHFFGILVSMRNICIYI

SEQ ID NO: 3268619 - protein, 21 aa, Plasmodium falciparum
LMKDNCLFVDYTYFNINFSIL

SEQ ID NO: 3268620 - protein, 18 aa, Plasmodium falciparum
LMKKNYLDIFPIFEENKK

SEQ ID NO: 3268621 - protein, 20 aa, Plasmodium falciparum
LMKLQEDIFNLGILILEILL

SEQ ID NO: 3268622 - protein, 22 aa, Plasmodium falciparum
LMLFFSCFREKFIMRLSAFPLR

SEQ ID NO: 3268623 - protein, 24 aa, Plasmodium falciparum
LMLFILFCTEFLFVYNNLLKIKVD

SEQ ID NO: 3268624 - protein, 20 aa, Plasmodium falciparum
LMLICFLWTFFGTIQINKSG

SEQ ID NO: 3268625 - protein, 19 aa, Plasmodium falciparum
LMLKNIILIIFTLLSMIVY

SEQ ID NO: 3268626 - protein, 19 aa, Plasmodium falciparum
LMLSYCKYEKSGIEVLLGI

SEQ ID NO: 3268627 - protein, 17 aa, Plasmodium falciparum
LMLYYLYPLHVCTNNTY

SEQ ID NO: 3268628 - protein, 18 aa, Plasmodium falciparum
LMNCIIAGTLYFIADLTC

SEQ ID NO: 3268629 - protein, 24 aa, Plasmodium falciparum
LMNELKIKRNLFLQKKRRNENKKE

SEQ ID NO: 3268630 - protein, 33 aa, Plasmodium falciparum
LMNFSFKASFLFCCKFIISVWVSYYLNLHIMLY

SEQ ID NO: 3268631 - protein, 17 aa, Plasmodium falciparum
LMNKLNFSLCFFHALIQ

SEQ ID NO: 3268632 - protein, 29 aa, Plasmodium falciparum
LMNRAKIILRTELEYEKKHIIIDTHYLLK

SEQ ID NO: 3268633 - protein, 21 aa, Plasmodium falciparum
LMSCPDFVLKTVLKLEDLFEN

SEQ ID NO: 3268634 - protein, 24 aa, Plasmodium falciparum
LMSSTIMWSIGIGFAAFTYFFLKK

SEQ ID NO: 3268635 - protein, 22 aa, Plasmodium falciparum
LMSSTIMWSIGIGFAAFTYFLL

SEQ ID NO: 3268636 - protein, 23 aa, Plasmodium falciparum
LMSSTIMWSIGIGFATFTYFYLK

SEQ ID NO: 3268637 - protein, 18 aa, Plasmodium falciparum
LMSYPFNKSKIFYLKSSS

SEQ ID NO: 3268638 - protein, 29 aa, Plasmodium falciparum
LMTGITPLPMCLMINYKNTKDILLKKEKK

SEQ ID NO: 3268639 - protein, 23 aa, Plasmodium falciparum
LMWMIKEYIHVATFNDNVIQFFF

SEQ ID NO: 3268640 - protein, 32 aa, Plasmodium falciparum
LNAEKIINILFFKLNKDYFLIIFLTGRPILIY

SEQ ID NO: 3268641 - protein, 21 aa, Plasmodium falciparum
LNAFIYLLIRFFIYFFENTSF

SEQ ID NO: 3268642 - protein, 28 aa, Plasmodium falciparum
LNAHTYISFLGIQYFYLTYKKFNEQQHH

SEQ ID NO: 3268643 - protein, 20 aa, Plasmodium falciparum
LNALLPFIFIAFVYCTITML

SEQ ID NO: 3268644 - protein, 25 aa, Plasmodium falciparum
LNASLSSRCLYLYLNSYEKTELELI

SEQ ID NO: 3268645 - protein, 23 aa, Plasmodium falciparum
LNAYKHYTKHGATSFIQSREVKI

SEQ ID NO: 3268646 - protein, 17 aa, Plasmodium falciparum
LNCEPDKSIQLFKRNVF

SEQ ID NO: 3268647 - protein, 17 aa, Plasmodium falciparum
LNCFLYRTFSNSCSYDK

SEQ ID NO: 3268648 - protein, 19 aa, Plasmodium falciparum
LNCIKKWNNNMMIYFDTLC

SEQ ID NO: 3268649 - protein, 19 aa, Plasmodium falciparum
LNCPCWNRSYKFSITNALF

SEQ ID NO: 3268650 - protein, 25 aa, Plasmodium falciparum
LNCRHKVLYDMCYFNKTKEEKKNDI

SEQ ID NO: 3268651 - protein, 28 aa, Plasmodium falciparum
LNCYDYICILIFWLFFFDLVVLSPFSLI

SEQ ID NO: 3268652 - protein, 17 aa, Plasmodium falciparum
LNDELNRQIAMYFIQLD

SEQ ID NO: 3268653 - protein, 19 aa, Plasmodium falciparum
LNDFCNIWLGRTFLNCSIL

SEQ ID NO: 3268654 - protein, 28 aa, Plasmodium falciparum
LNDFLDIFLSIHFKYKIDNIGLCLLFPI

SEQ ID NO: 3268655 - protein, 17 aa, Plasmodium falciparum
LNDIIKILYSHPQYTLF

SEQ ID NO: 3268656 - protein, 25 aa, Plasmodium falciparum
LNDKLCFNCISLLQQVELDYSIFIS

SEQ ID NO: 3268657 - protein, 24 aa, Plasmodium falciparum
LNDKMRYSGFHSMENDKSPPNDKY

SEQ ID NO: 3268658 - protein, 22 aa, Plasmodium falciparum
LNDLFKGYFFHVMYELNNEEAK

SEQ ID NO: 3268659 - protein, 19 aa, Plasmodium falciparum
LNDLFKINNIVKMPKNLIH

SEQ ID NO: 3268660 - protein, 17 aa, Plasmodium falciparum
LNDLGFSYNVIAVLGSQ

SEQ ID NO: 3268661 - protein, 21 aa, Plasmodium falciparum
LNDLIKLFFFILNEHEYMEKY

SEQ ID NO: 3268662 - protein, 24 aa, Plasmodium falciparum
LNDTLPCYVLIMILSIPYILLELV

SEQ ID NO: 3268663 - protein, 20 aa, Plasmodium falciparum
LNDVCANDYCQIPFNLKIRA

SEQ ID NO: 3268664 - protein, 22 aa, Plasmodium falciparum
LNDVNCPLFIYSTYNIIFEFFS

SEQ ID NO: 3268665 - protein, 18 aa, Plasmodium falciparum
LNDYLKYVLIHLSISKNI

SEQ ID NO: 3268666 - protein, 22 aa, Plasmodium falciparum
LNEALCWLREEFHEILTDIDFE

SEQ ID NO: 3268667 - protein, 18 aa, Plasmodium falciparum
LNEDLFYLLSKFFKNIEL

SEQ ID NO: 3268668 - protein, 19 aa, Plasmodium falciparum
LNEKCLKRRQKSEEEEEEK

SEQ ID NO: 3268669 - protein, 27 aa, Plasmodium falciparum
LNEKDWWLLNNWNYWHLNCDKKNYFFL

SEQ ID NO: 3268670 - protein, 34 aa, Plasmodium falciparum
LNEKSCKSSLLFGWQRIFYQCVVSWDDEKLVDQL

SEQ ID NO: 3268671 - protein, 22 aa, Plasmodium falciparum
LNELKIFLSKFYKYLNEYDDIE

SEQ ID NO: 3268672 - protein, 22 aa, Plasmodium falciparum
LNELKIIFYNYINRKKTSFMDK

SEQ ID NO: 3268673 - protein, 18 aa, Plasmodium falciparum
LNELMKLSKNDLKKLQGT

SEQ ID NO: 3268674 - protein, 20 aa, Plasmodium falciparum
LNEQVLYKEVLKTIIDLIEN

SEQ ID NO: 3268675 - protein, 19 aa, Plasmodium falciparum
LNERCDYCPVIEEVEETQL

SEQ ID NO: 3268676 - protein, 20 aa, Plasmodium falciparum
LNEYPVLMICISKFSTNVNL

SEQ ID NO: 3268677 - protein, 18 aa, Plasmodium falciparum
LNFDFLHVSGSTFIELYI

SEQ ID NO: 3268678 - protein, 24 aa, Plasmodium falciparum
LNFEHLCALFVLYLEEVNGNQNYK

SEQ ID NO: 3268679 - protein, 47 aa, Plasmodium falciparum
LNFFCSNYNILLCFLLYVICFGFVISSLCYDSWKMHEITLKSLNKEK

SEQ ID NO: 3268680 - protein, 23 aa, Plasmodium falciparum
LNFFKIILQKDFMGFSKISTNFL

SEQ ID NO: 3268681 - protein, 27 aa, Plasmodium falciparum
LNFHAILYICLLKSLNLELPQKILCHG

SEQ ID NO: 3268682 - protein, 24 aa, Plasmodium falciparum
LNFLEKSYILQFFINIYSSIDKKF

SEQ ID NO: 3268683 - protein, 23 aa, Plasmodium falciparum
LNFLFKKSYFKNILHKNEKHNNY

SEQ ID NO: 3268684 - protein, 17 aa, Plasmodium falciparum
LNFLKSIYFNLFVSLSF

SEQ ID NO: 3268685 - protein, 22 aa, Plasmodium falciparum
LNFLLNFLYIFKMYKSKNEKLQ

SEQ ID NO: 3268686 - protein, 17 aa, Plasmodium falciparum
LNFNKIINHKRDGFYNN

SEQ ID NO: 3268687 - protein, 25 aa, Plasmodium falciparum
LNFQTLSLFFLVFVGQFYPKHFQKA

SEQ ID NO: 3268688 - protein, 26 aa, Plasmodium falciparum
LNFSKDILKNVLIFYNTFCYFINNCS

SEQ ID NO: 3268689 - protein, 24 aa, Plasmodium falciparum
LNFSNIFYICLLLIIPTFERIFLN

SEQ ID NO: 3268690 - protein, 23 aa, Plasmodium falciparum
LNFSSTYFIYYFILQGLGGIFLG

SEQ ID NO: 3268691 - protein, 17 aa, Plasmodium falciparum
LNFTLDDKIIFKLIFFY

SEQ ID NO: 3268692 - protein, 19 aa, Plasmodium falciparum
LNGNFSFHFLNQFVNINDR

SEQ ID NO: 3268693 - protein, 19 aa, Plasmodium falciparum
LNGYDCKRTISAEKKLFPD

SEQ ID NO: 3268694 - protein, 26 aa, Plasmodium falciparum
LNHIIEFKGLCIYSNSDIKSRTKKKI

SEQ ID NO: 3268695 - protein, 21 aa, Plasmodium falciparum
LNHLPAHFNWKLYGQENKNLF

SEQ ID NO: 3268696 - protein, 19 aa, Plasmodium falciparum
LNHYICILNSITNNYEKSY

SEQ ID NO: 3268697 - protein, 26 aa, Plasmodium falciparum
LNICLRKLYLNKDCAFSVKLDKKNKN

SEQ ID NO: 3268698 - protein, 19 aa, Plasmodium falciparum
LNICNIIKEHTYILQYIKD

SEQ ID NO: 3268699 - protein, 26 aa, Plasmodium falciparum
LNIDFIFKFIKNIFFYNQFIQKKNYI

SEQ ID NO: 3268700 - protein, 18 aa, Plasmodium falciparum
LNIELPHYLNIIKKKIEK

SEQ ID NO: 3268701 - protein, 17 aa, Plasmodium falciparum
LNIGGVLTCFDCTCIEW

SEQ ID NO: 3268702 - protein, 23 aa, Plasmodium falciparum
LNIHDIWSVYLLKLIENNNFFHI

SEQ ID NO: 3268703 - protein, 19 aa, Plasmodium falciparum
LNIIDLMYFFLTNDMLEKN

SEQ ID NO: 3268704 - protein, 22 aa, Plasmodium falciparum
LNIIFIRIYIRDPFSKIIEKIC

SEQ ID NO: 3268705 - protein, 18 aa, Plasmodium falciparum
LNIILPQYHLFDLFDNYV

SEQ ID NO: 3268706 - protein, 25 aa, Plasmodium falciparum
LNIIPIFLFFYFHVYVIKQIILDFA

SEQ ID NO: 3268707 - protein, 20 aa, Plasmodium falciparum
LNIIVGECCTMYSINIHDEQ

SEQ ID NO: 3268708 - protein, 18 aa, Plasmodium falciparum
LNIKCNRLLFQVEKQEPN

SEQ ID NO: 3268709 - protein, 27 aa, Plasmodium falciparum
LNIKQLFFLFHHLQKFNLNYEIILLYN

SEQ ID NO: 3268710 - protein, 32 aa, Plasmodium falciparum
LNILDIFSCIIKSCYTFDFSNELYYLENKILC

SEQ ID NO: 3268711 - protein, 18 aa, Plasmodium falciparum
LNILKYQFELVPYINHLY

SEQ ID NO: 3268712 - protein, 19 aa, Plasmodium falciparum
LNILLCIYNSYSYENENDR

SEQ ID NO: 3268713 - protein, 17 aa, Plasmodium falciparum
LNILLFQYDNFRSAISS

SEQ ID NO: 3268714 - protein, 17 aa, Plasmodium falciparum
LNILLSYLIYKNDDNSN

SEQ ID NO: 3268715 - protein, 17 aa, Plasmodium falciparum
LNILPLRKNFNFKDKNS

SEQ ID NO: 3268716 - protein, 17 aa, Plasmodium falciparum
LNILVTLYHEYNQRNHK

SEQ ID NO: 3268717 - protein, 17 aa, Plasmodium falciparum
LNILYKNIDCVLLRNMY

SEQ ID NO: 3268718 - protein, 18 aa, Plasmodium falciparum
LNINEHFISYSIKGIRYT

SEQ ID NO: 3268719 - protein, 23 aa, Plasmodium falciparum
LNINELYNFIMLRFYEYDKNNGD

SEQ ID NO: 3268720 - protein, 23 aa, Plasmodium falciparum
LNIPIFFFILYIKFVLISDKSII

SEQ ID NO: 3268721 - protein, 25 aa, Plasmodium falciparum
LNIRNENYILILLMVIANERGIINN

SEQ ID NO: 3268722 - protein, 18 aa, Plasmodium falciparum
LNIRSLCLNVKRHMKHID

SEQ ID NO: 3268723 - protein, 25 aa, Plasmodium falciparum
LNITPAFSYCCICFNDDYNTMQINE

SEQ ID NO: 3268724 - protein, 19 aa, Plasmodium falciparum
LNIYEQWEQFMLLEKEKKK

SEQ ID NO: 3268725 - protein, 19 aa, Plasmodium falciparum
LNIYFTYIMDIFIKNVQKN

SEQ ID NO: 3268726 - protein, 21 aa, Plasmodium falciparum
LNIYIKDIILFVNKHENIINT

SEQ ID NO: 3268727 - protein, 17 aa, Plasmodium falciparum
LNIYITLKRSYYLKNLN

SEQ ID NO: 3268728 - protein, 32 aa, Plasmodium falciparum
LNIYKCLKYNIKVCELLGYYKDIIVKYCHEMK

SEQ ID NO: 3268729 - protein, 20 aa, Plasmodium falciparum
LNIYMKISIYIFDILTIAPG

SEQ ID NO: 3268730 - protein, 17 aa, Plasmodium falciparum
LNIYQIFCYDIVQNHFQ

SEQ ID NO: 3268731 - protein, 31 aa, Plasmodium falciparum
LNIYWYESFIFICTPLSVFVINFFNKTKIAQ

SEQ ID NO: 3268732 - protein, 19 aa, Plasmodium falciparum
LNIYYSKYINDWIKKGQIF

SEQ ID NO: 3268733 - protein, 18 aa, Plasmodium falciparum
LNKAIKPCPNLNNFKTSC

SEQ ID NO: 3268734 - protein, 18 aa, Plasmodium falciparum
LNKAVSFLSMKSFTKILQ

SEQ ID NO: 3268735 - protein, 17 aa, Plasmodium falciparum
LNKDMYMCHNIDIYNIN

SEQ ID NO: 3268736 - protein, 22 aa, Plasmodium falciparum
LNKELFPLLISRFNDLKNNNYM

SEQ ID NO: 3268737 - protein, 42 aa, Plasmodium falciparum
LNKFKIYCVLGLKVLRTFLIKYLRSIKLCIPVEVRKRYIYDF

SEQ ID NO: 3268738 - protein, 18 aa, Plasmodium falciparum
LNKFKLATKDLPNKDKNE

SEQ ID NO: 3268739 - protein, 26 aa, Plasmodium falciparum
LNKGLKQGFGKLFYEPKINILDNQKQ

SEQ ID NO: 3268740 - protein, 30 aa, Plasmodium falciparum
LNKIQINCKFYRLITECIKKAPSDADDISI

SEQ ID NO: 3268741 - protein, 27 aa, Plasmodium falciparum
LNKIYKRTPFKFGFVDKSADYIIKQGK

SEQ ID NO: 3268742 - protein, 20 aa, Plasmodium falciparum
LNKKIKILIFKSYAFLNTIL

SEQ ID NO: 3268743 - protein, 27 aa, Plasmodium falciparum
LNKKLSLVILYCFMISSLLSMISSKLK

SEQ ID NO: 3268744 - protein, 23 aa, Plasmodium falciparum
LNKLNMRIYYSHILNLCNNESYI

SEQ ID NO: 3268745 - protein, 24 aa, Plasmodium falciparum
LNKNEFLKRLHILVNSLNKFKLQN

SEQ ID NO: 3268746 - protein, 24 aa, Plasmodium falciparum
LNKNISMFVSYCFLNKDLKKTILE

SEQ ID NO: 3268747 - protein, 18 aa, Plasmodium falciparum
LNKNIYWSSVIYPSENFV

SEQ ID NO: 3268748 - protein, 25 aa, Plasmodium falciparum
LNKNNLVNIPFTWDKTTLDFSKCLP

SEQ ID NO: 3268749 - protein, 21 aa, Plasmodium falciparum
LNKNVICWNSDLIYHHMCNIS

SEQ ID NO: 3268750 - protein, 22 aa, Plasmodium falciparum
LNKRHIESLYNISILSISDKLK

SEQ ID NO: 3268751 - protein, 24 aa, Plasmodium falciparum
LNKRKEFFSFYLLNDENFLNIYLN

SEQ ID NO: 3268752 - protein, 24 aa, Plasmodium falciparum
LNKSIFGTFFLKSIGWIYTNLTQC

SEQ ID NO: 3268753 - protein, 31 aa, Plasmodium falciparum
LNKSILLVNVLWSLCLIEVPCSEFLKDISGY

SEQ ID NO: 3268754 - protein, 24 aa, Plasmodium falciparum
LNKSLNFIVCTWGINILKKKSPAK

SEQ ID NO: 3268755 - protein, 19 aa, Plasmodium falciparum
LNKTCNLYASKIFSQSDIT

SEQ ID NO: 3268756 - protein, 18 aa, Plasmodium falciparum
LNKYERKILEKNASAFFY

SEQ ID NO: 3268757 - protein, 51 aa, Plasmodium falciparum
LNKYFCSGYNFFSFKKKFVFFFIQRLFRLLCFRLMCLFLSTVHLNKFTSEI

SEQ ID NO: 3268758 - protein, 17 aa, Plasmodium falciparum
LNKYKTALSKNVFYIFT

SEQ ID NO: 3268759 - protein, 26 aa, Plasmodium falciparum
LNLAHFKILLPLLIKYKYVNNNVFKL

SEQ ID NO: 3268760 - protein, 17 aa, Plasmodium falciparum
LNLCKPLFSSLMNMFTN

SEQ ID NO: 3268761 - protein, 18 aa, Plasmodium falciparum
LNLCLHRHFNIVAKVEGG

SEQ ID NO: 3268762 - protein, 28 aa, Plasmodium falciparum
LNLEEYRRLTVLNQIAWKALSNQIQYTC

SEQ ID NO: 3268763 - protein, 27 aa, Plasmodium falciparum
LNLEFPKNCIRLLFSNLLAYDLTSFNS

SEQ ID NO: 3268764 - protein, 18 aa, Plasmodium falciparum
LNLERFNIKILKKILSKL

SEQ ID NO: 3268765 - protein, 27 aa, Plasmodium falciparum
LNLEYIKEPYILFISFFKYNIYELFEN

SEQ ID NO: 3268766 - protein, 17 aa, Plasmodium falciparum
LNLFLIDIGRGIDMKNF

SEQ ID NO: 3268767 - protein, 18 aa, Plasmodium falciparum
LNLFSSMFMLDKQVDNME

SEQ ID NO: 3268768 - protein, 29 aa, Plasmodium falciparum
LNLICPHIIRYYCVYAIFYRNRKDHFELI

SEQ ID NO: 3268769 - protein, 19 aa, Plasmodium falciparum
LNLKRTVVKIINLKNKINL

SEQ ID NO: 3268770 - protein, 19 aa, Plasmodium falciparum
LNLLGELHEAQSLKTILIF

SEQ ID NO: 3268771 - protein, 17 aa, Plasmodium falciparum
LNLLLKERVGCYNILNV

SEQ ID NO: 3268772 - protein, 17 aa, Plasmodium falciparum
LNLLPIKCFIKKNIEND

SEQ ID NO: 3268773 - protein, 19 aa, Plasmodium falciparum
LNLLYIIDLYMEFKSNIFN

SEQ ID NO: 3268774 - protein, 17 aa, Plasmodium falciparum
LNLNTCVSYYTKLIKDY

SEQ ID NO: 3268775 - protein, 23 aa, Plasmodium falciparum
LNLNVICSLPYKKRFYEKQKLIK

SEQ ID NO: 3268776 - protein, 18 aa, Plasmodium falciparum
LNLNYVPCNSFINTPNNC

SEQ ID NO: 3268777 - protein, 17 aa, Plasmodium falciparum
LNLSGIQTYDMIKMFIP

SEQ ID NO: 3268778 - protein, 26 aa, Plasmodium falciparum
LNLSGPLSIVCYGLFINAYGHIALDE

SEQ ID NO: 3268779 - protein, 17 aa, Plasmodium falciparum
LNLYVKLMLDKYIQESS

SEQ ID NO: 3268780 - protein, 24 aa, Plasmodium falciparum
LNMEKLHLLYCDEYFYIFKNILYV

SEQ ID NO: 3268781 - protein, 17 aa, Plasmodium falciparum
LNNCVRIIIPQVLINDK

SEQ ID NO: 3268782 - protein, 17 aa, Plasmodium falciparum
LNNDITNILLLFEKVQE

SEQ ID NO: 3268783 - protein, 25 aa, Plasmodium falciparum
LNNFFKLPLSYSFNKELEVLFSKVF

SEQ ID NO: 3268784 - protein, 24 aa, Plasmodium falciparum
LNNFLEKFLNLFNYKNLNLTKIVI

SEQ ID NO: 3268785 - protein, 25 aa, Plasmodium falciparum
LNNGLKFYNIFHGFDPVAFRIEPLI

SEQ ID NO: 3268786 - protein, 17 aa, Plasmodium falciparum
LNNGMIIIYQLDKKLKL

SEQ ID NO: 3268787 - protein, 24 aa, Plasmodium falciparum
LNNICNFSLKCLGNMRHNNNSLFK

SEQ ID NO: 3268788 - protein, 18 aa, Plasmodium falciparum
LNNIHSFLNNKNCKQNNI

SEQ ID NO: 3268789 - protein, 26 aa, Plasmodium falciparum
LNNKKFYAYLCYLLIKENNFTFVNKF

SEQ ID NO: 3268790 - protein, 33 aa, Plasmodium falciparum
LNNLFNFDYFFACGDFNFRINKNLEEVLKLISS

SEQ ID NO: 3268791 - protein, 25 aa, Plasmodium falciparum
LNNLLKNFGCLNISKSAHIKLVNIL

SEQ ID NO: 3268792 - protein, 17 aa, Plasmodium falciparum
LNNLMIIQDNFNSLNHS

SEQ ID NO: 3268793 - protein, 26 aa, Plasmodium falciparum
LNNLRYKKNFFFFLPLLKLKVKCKKN

SEQ ID NO: 3268794 - protein, 24 aa, Plasmodium falciparum
LNNLYKYSISFTFSSKNCIYIRLF

SEQ ID NO: 3268795 - protein, 21 aa, Plasmodium falciparum
LNNMKCFLEKIIMNSSEQKNN

SEQ ID NO: 3268796 - protein, 18 aa, Plasmodium falciparum
LNNMSSYLPCVVNMNIFL

SEQ ID NO: 3268797 - protein, 35 aa, Plasmodium falciparum
LNNPKLSDFVLRPPYFRYLEEWGQNFCKERKKRLE

SEQ ID NO: 3268798 - protein, 36 aa, Plasmodium falciparum
LNNPKLSDFVLRPPYFRYLEEWGQNFCKKRTEMLEK

SEQ ID NO: 3268799 - protein, 24 aa, Plasmodium falciparum
LNNRIVNIITYIIYRIFKLGNTQN

SEQ ID NO: 3268800 - protein, 24 aa, Plasmodium falciparum
LNNRKIHVGYDLNLYTTLTVDKNI

SEQ ID NO: 3268801 - protein, 22 aa, Plasmodium falciparum
LNNSYCTIHILQLDYSSGSCPL

SEQ ID NO: 3268802 - protein, 25 aa, Plasmodium falciparum
LNNTYRKSTSFGYFYNSNCKPYVKE

SEQ ID NO: 3268803 - protein, 17 aa, Plasmodium falciparum
LNNYDIFISQHKLYNDV

SEQ ID NO: 3268804 - protein, 20 aa, Plasmodium falciparum
LNNYIEGFQIFQIAFFNHFI

SEQ ID NO: 3268805 - protein, 19 aa, Plasmodium falciparum
LNPALSLMASRAVDGLLGG

SEQ ID NO: 3268806 - protein, 27 aa, Plasmodium falciparum
LNPLELYLSPLLIKSILSFTFPLLDII

SEQ ID NO: 3268807 - protein, 20 aa, Plasmodium falciparum
LNQDMCIFPDIFIDHLQVHI

SEQ ID NO: 3268808 - protein, 26 aa, Plasmodium falciparum
LNQLRLILKLFINYFMCNLNVQIDNI

SEQ ID NO: 3268809 - protein, 20 aa, Plasmodium falciparum
LNRLFVKEKIHFRKLKEAFS

SEQ ID NO: 3268810 - protein, 26 aa, Plasmodium falciparum
LNRMKRLASHKICFNLNNEESLPSKE

SEQ ID NO: 3268811 - protein, 19 aa, Plasmodium falciparum
LNRNKVWESMRCGIDEVDQ

SEQ ID NO: 3268812 - protein, 19 aa, Plasmodium falciparum
LNRQIAMYFIQLDTDKKSG

SEQ ID NO: 3268813 - protein, 23 aa, Plasmodium falciparum
LNRRIFKYLYLYESNDEKNFKDK

SEQ ID NO: 3268814 - protein, 27 aa, Plasmodium falciparum
LNRRLIKKAFFLRSLKFDDFNDIKSYY

SEQ ID NO: 3268815 - protein, 17 aa, Plasmodium falciparum
LNRTEFLHFKKTLKNKK

SEQ ID NO: 3268816 - protein, 29 aa, Plasmodium falciparum
LNRYIKFLSYHCSNNIYVHILFNDLYITL

SEQ ID NO: 3268817 - protein, 23 aa, Plasmodium falciparum
LNRYPIYLRELIKIIKTSKKREK

SEQ ID NO: 3268818 - protein, 25 aa, Plasmodium falciparum
LNRYYKICSNIIYYKKYLEKELSSK

SEQ ID NO: 3268819 - protein, 26 aa, Plasmodium falciparum
LNSFFKHKVVKCGKKFKNCCTNKEDI

SEQ ID NO: 3268820 - protein, 26 aa, Plasmodium falciparum
LNSFGVSWQNMMEYIISLNEHKNLMK

SEQ ID NO: 3268821 - protein, 24 aa, Plasmodium falciparum
LNSIKRIYKIFSENMLGEKNIEDI

SEQ ID NO: 3268822 - protein, 20 aa, Plasmodium falciparum
LNSILDHRKEIFIPEKNEVV

SEQ ID NO: 3268823 - protein, 26 aa, Plasmodium falciparum
LNSITFLRLYLTIFMLTEKCIQEGYH

SEQ ID NO: 3268824 - protein, 23 aa, Plasmodium falciparum
LNSKRCFYNFDGIYSKLEKCVMI

SEQ ID NO: 3268825 - protein, 23 aa, Plasmodium falciparum
LNSKYLFYVMLFFVLINEQSYLE

SEQ ID NO: 3268826 - protein, 26 aa, Plasmodium falciparum
LNSLIKLEFLLFLNLFISRKKNVSTF

SEQ ID NO: 3268827 - protein, 17 aa, Plasmodium falciparum
LNSLKKNDSLYMRLQNI

SEQ ID NO: 3268828 - protein, 24 aa, Plasmodium falciparum
LNSLNLDLLFLINMYSNNNYKKKF

SEQ ID NO: 3268829 - protein, 24 aa, Plasmodium falciparum
LNSNIKLYSYQSILSLRKLLKQSH

SEQ ID NO: 3268830 - protein, 17 aa, Plasmodium falciparum
LNSNWSLSDYFSCDTHT

SEQ ID NO: 3268831 - protein, 28 aa, Plasmodium falciparum
LNSQSWRGYYIDEFFKCMTLCHAVTPFI

SEQ ID NO: 3268832 - protein, 27 aa, Plasmodium falciparum
LNSRCKLLTLECLLNLSAQLPKELTER

SEQ ID NO: 3268833 - protein, 31 aa, Plasmodium falciparum
LNSSKWYIDKGIPYRRCYLLHGPPGCGKSSL

SEQ ID NO: 3268834 - protein, 20 aa, Plasmodium falciparum
LNSYNMFGKILLYNNKYNYF

SEQ ID NO: 3268835 - protein, 20 aa, Plasmodium falciparum
LNSYTIIGLIFTFICVFISV

SEQ ID NO: 3268836 - protein, 17 aa, Plasmodium falciparum
LNTAVSFFMKFYNEIKT

SEQ ID NO: 3268837 - protein, 17 aa, Plasmodium falciparum
LNTDFGLSPVRIKELES

SEQ ID NO: 3268838 - protein, 20 aa, Plasmodium falciparum
LNTFINFLLLLWGINISFDH

SEQ ID NO: 3268839 - protein, 20 aa, Plasmodium falciparum
LNTLYKKNCIDNIHKVKNKK

SEQ ID NO: 3268840 - protein, 17 aa, Plasmodium falciparum
LNTWKPAAIIAAKEAAL

SEQ ID NO: 3268841 - protein, 19 aa, Plasmodium falciparum
LNVCDHIDSCIIIDRRVDM

SEQ ID NO: 3268842 - protein, 18 aa, Plasmodium falciparum
LNVDPGFRGPVLQINLKE

SEQ ID NO: 3268843 - protein, 19 aa, Plasmodium falciparum
LNVDRIIIMSFRYSSYFMK

SEQ ID NO: 3268844 - protein, 18 aa, Plasmodium falciparum
LNVETVLSSCWFLDRILI

SEQ ID NO: 3268845 - protein, 19 aa, Plasmodium falciparum
LNVIPKFIFKNVNRIFLFS

SEQ ID NO: 3268846 - protein, 26 aa, Plasmodium falciparum
LNVLPHELPHPAKLIMTYNKNMNALY

SEQ ID NO: 3268847 - protein, 19 aa, Plasmodium falciparum
LNVNTTYEFSSLKRIFLDN

SEQ ID NO: 3268848 - protein, 21 aa, Plasmodium falciparum
LNVRISIVIVYYILYMDNNSN

SEQ ID NO: 3268849 - protein, 19 aa, Plasmodium falciparum
LNVRQCILDTTSLIAYHKP

SEQ ID NO: 3268850 - protein, 19 aa, Plasmodium falciparum
LNVTDVKANVTLFFENYYE

SEQ ID NO: 3268851 - protein, 20 aa, Plasmodium falciparum
LNVWTSYEFLNCGTQLSNIR

SEQ ID NO: 3268852 - protein, 27 aa, Plasmodium falciparum
LNYDFGKSVFNAVEFFNVKNHQRSMLY

SEQ ID NO: 3268853 - protein, 32 aa, Plasmodium falciparum
LNYHFKYFLSILLCVIKSIITRIFQGKNNIQD

SEQ ID NO: 3268854 - protein, 24 aa, Plasmodium falciparum
LNYIIKLKKIFNISFSMNLEKEIR

SEQ ID NO: 3268855 - protein, 28 aa, Plasmodium falciparum
LNYISAYCYKHIKKLLDNVIKKIICSIL

SEQ ID NO: 3268856 - protein, 17 aa, Plasmodium falciparum
LNYIYFKIMTPLHKADV

SEQ ID NO: 3268857 - protein, 17 aa, Plasmodium falciparum
LNYIYVDLFNIHKSKYK

SEQ ID NO: 3268858 - protein, 27 aa, Plasmodium falciparum
LNYKNIILIQVCKYEINILYYKNTYVL

SEQ ID NO: 3268859 - protein, 21 aa, Plasmodium falciparum
LNYKYICTKNEILDNELNVNL

SEQ ID NO: 3268860 - protein, 18 aa, Plasmodium falciparum
LNYLSNISLFSFALSIWI

SEQ ID NO: 3268861 - protein, 31 aa, Plasmodium falciparum
LNYNRCYYIYIPKRLLVNFMNKGGIPEDNIF

SEQ ID NO: 3268862 - protein, 17 aa, Plasmodium falciparum
LNYPLDSLILYLLSFNI

SEQ ID NO: 3268863 - protein, 26 aa, Plasmodium falciparum
LNYSNVFLNFFIKYWNTISSEKKDMS

SEQ ID NO: 3268864 - protein, 22 aa, Plasmodium falciparum
LPAETNITIFWLFVQNGYREKR

SEQ ID NO: 3268865 - protein, 21 aa, Plasmodium falciparum
LPAQHRKLLFISFVCAVLSGG

SEQ ID NO: 3268866 - protein, 17 aa, Plasmodium falciparum
LPCKNNGFFPGEIIVQK

SEQ ID NO: 3268867 - protein, 25 aa, Plasmodium falciparum
LPCTIKCAYIKLKFYNPYHNYLNKY

SEQ ID NO: 3268868 - protein, 17 aa, Plasmodium falciparum
LPDIRIKEIKKRMRQQK

SEQ ID NO: 3268869 - protein, 20 aa, Plasmodium falciparum
LPELKNRCTSVSYLEKLDNN

SEQ ID NO: 3268870 - protein, 21 aa, Plasmodium falciparum
LPEYEKGHVSREYQLDNEGPS

SEQ ID NO: 3268871 - protein, 21 aa, Plasmodium falciparum
LPEYEKGHVSREYQLDNEVRD

SEQ ID NO: 3268872 - protein, 18 aa, Plasmodium falciparum
LPEYERELILAKRHEEYM

SEQ ID NO: 3268873 - protein, 19 aa, Plasmodium falciparum
LPFFFNFIMYFFIDTMIQR

SEQ ID NO: 3268874 - protein, 20 aa, Plasmodium falciparum
LPFILFFCGYTSYMYILTSI

SEQ ID NO: 3268875 - protein, 28 aa, Plasmodium falciparum
LPFKIKMKKWWKCCGHVTDELLIKEHDD

SEQ ID NO: 3268876 - protein, 23 aa, Plasmodium falciparum
LPFLSCIYQLLNVVYDHINKQNY

SEQ ID NO: 3268877 - protein, 19 aa, Plasmodium falciparum
LPFNRNNVIISRRNNVSNI

SEQ ID NO: 3268878 - protein, 19 aa, Plasmodium falciparum
LPFYSSEVLYELFYEKSNL

SEQ ID NO: 3268879 - protein, 18 aa, Plasmodium falciparum
LPFYYLINIVESYSSCLI

SEQ ID NO: 3268880 - protein, 19 aa, Plasmodium falciparum
LPGSFFLIGNSELYSGSSN

SEQ ID NO: 3268881 - protein, 30 aa, Plasmodium falciparum
LPIINKCIFLKGGILNVEFLKFSKKDIFFF

SEQ ID NO: 3268882 - protein, 18 aa, Plasmodium falciparum
LPILLSLRTIMFKTKSFF

SEQ ID NO: 3268883 - protein, 19 aa, Plasmodium falciparum
LPIQLSSYLFIKKLLKHDT

SEQ ID NO: 3268884 - protein, 24 aa, Plasmodium falciparum
LPITHIFIKPLMLIIITFFIIILS

SEQ ID NO: 3268885 - protein, 23 aa, Plasmodium falciparum
LPKIFKNFLHSIYFRTPALGGRT

SEQ ID NO: 3268886 - protein, 18 aa, Plasmodium falciparum
LPKYILVPYEYKNINKFK

SEQ ID NO: 3268887 - protein, 17 aa, Plasmodium falciparum
LPLGCLIENDKKRKLKT

SEQ ID NO: 3268888 - protein, 36 aa, Plasmodium falciparum
LPLHSKIFFYLKCMNISIDHVISFDIIKKEMNKDEE

SEQ ID NO: 3268889 - protein, 23 aa, Plasmodium falciparum
LPLIILMTYQFIKKPTMEQIVLE

SEQ ID NO: 3268890 - protein, 22 aa, Plasmodium falciparum
LPLIKKCNDISCDNNYNENKIE

SEQ ID NO: 3268891 - protein, 31 aa, Plasmodium falciparum
LPLLFCFISLHVTIFFSWFIERYVTSWLYTC

SEQ ID NO: 3268892 - protein, 17 aa, Plasmodium falciparum
LPLLKIVEKAFLECKKF

SEQ ID NO: 3268893 - protein, 26 aa, Plasmodium falciparum
LPLLKSLFHEEFFRILKYNNKLFSQG

SEQ ID NO: 3268894 - protein, 17 aa, Plasmodium falciparum
LPLNILEISSYEINKNK

SEQ ID NO: 3268895 - protein, 23 aa, Plasmodium falciparum
LPLNILVKLCRVHYQRNHKSPIP

SEQ ID NO: 3268896 - protein, 19 aa, Plasmodium falciparum
LPLTWKPRKDYIKAGIFPF

SEQ ID NO: 3268897 - protein, 17 aa, Plasmodium falciparum
LPMKRIKNVKGKKKINL

SEQ ID NO: 3268898 - protein, 20 aa, Plasmodium falciparum
LPNDEYRNILNVQHLNSNYN

SEQ ID NO: 3268899 - protein, 26 aa, Plasmodium falciparum
LPNHLYYKIELTNLFQFEKKIIFDLF

SEQ ID NO: 3268900 - protein, 26 aa, Plasmodium falciparum
LPNICLECIKGYRLSRDRTKCSLIYE

SEQ ID NO: 3268901 - protein, 32 aa, Plasmodium falciparum
LPNIKRIDKILSLCSDNPQLVYFSLESLNGYR

SEQ ID NO: 3268902 - protein, 20 aa, Plasmodium falciparum
LPNNICSGGTIMPNVMSKGK

SEQ ID NO: 3268903 - protein, 25 aa, Plasmodium falciparum
LPQSSFVFFHWNIRTFIDPYKDFTD

SEQ ID NO: 3268904 - protein, 26 aa, Plasmodium falciparum
LPSDYKNRINILVLHQNRYIRNAYGN

SEQ ID NO: 3268905 - protein, 17 aa, Plasmodium falciparum
LPSLISDNWKFFCVCSK

SEQ ID NO: 3268906 - protein, 19 aa, Plasmodium falciparum
LPSSILMFLHHCIEIPGQG

SEQ ID NO: 3268907 - protein, 17 aa, Plasmodium falciparum
LPSYFYMFKVYKKLEKN

SEQ ID NO: 3268908 - protein, 18 aa, Plasmodium falciparum
LPTHVNFIYYLYSIYYLR

SEQ ID NO: 3268909 - protein, 20 aa, Plasmodium falciparum
LPTYYTFYEFFLLIQGFMNF

SEQ ID NO: 3268910 - protein, 21 aa, Plasmodium falciparum
LPVEGKFILCWCYNILNDQNN

SEQ ID NO: 3268911 - protein, 19 aa, Plasmodium falciparum
LPVHCLALILYCKNYILLN

SEQ ID NO: 3268912 - protein, 22 aa, Plasmodium falciparum
LPVLELHFSCSYKSMNENDENV

SEQ ID NO: 3268913 - protein, 21 aa, Plasmodium falciparum
LPVNGCIGIVLRSGFSTYQGK

SEQ ID NO: 3268914 - protein, 26 aa, Plasmodium falciparum
LPVNSNDLFFRNSFNEHVSVNINSIN

SEQ ID NO: 3268915 - protein, 17 aa, Plasmodium falciparum
LPWKALIYKSLNTFIDD

SEQ ID NO: 3268916 - protein, 18 aa, Plasmodium falciparum
LPYGNYTHYSNFVVNRKK

SEQ ID NO: 3268917 - protein, 25 aa, Plasmodium falciparum
LPYKEIRSKYILKNGYKSMYQRNAG

SEQ ID NO: 3268918 - protein, 17 aa, Plasmodium falciparum
LPYKKRFYEKQKLIKDI

SEQ ID NO: 3268919 - protein, 17 aa, Plasmodium falciparum
LPYSVLAALMNEYKTQD

SEQ ID NO: 3268920 - protein, 26 aa, Plasmodium falciparum
LPYYDMWSIGIVFLQFILGTKNPLEV

SEQ ID NO: 3268921 - protein, 18 aa, Plasmodium falciparum
LPYYFPRYNFSKNNILSK

SEQ ID NO: 3268922 - protein, 20 aa, Plasmodium falciparum
LQCFSEYFYWLCKLKKSNKT

SEQ ID NO: 3268923 - protein, 18 aa, Plasmodium falciparum
LQDFKRWLEDSEGYLKSW

SEQ ID NO: 3268924 - protein, 17 aa, Plasmodium falciparum
LQFFFLLIFPFSFYFLS

SEQ ID NO: 3268925 - protein, 17 aa, Plasmodium falciparum
LQFLFKSFFSINRFNFI

SEQ ID NO: 3268926 - protein, 20 aa, Plasmodium falciparum
LQGLCKFGFYEIFKDVYSNY

SEQ ID NO: 3268927 - protein, 19 aa, Plasmodium falciparum
LQGLGGIFLGFFSDIYGRK

SEQ ID NO: 3268928 - protein, 42 aa, Plasmodium falciparum
LQHKLCISPMFYFFYYIELIRYVYCLFVWRVRKMSNINNDNG

SEQ ID NO: 3268929 - protein, 28 aa, Plasmodium falciparum
LQHLEELRMSIKYNVSRLIQEKKKDKNM

SEQ ID NO: 3268930 - protein, 24 aa, Plasmodium falciparum
LQHTFKLGDLFKEYQDMNIINYNK

SEQ ID NO: 3268931 - protein, 20 aa, Plasmodium falciparum
LQIARPLSINNIPISYMNKN

SEQ ID NO: 3268932 - protein, 17 aa, Plasmodium falciparum
LQIILSYVDVHQCTLDK

SEQ ID NO: 3268933 - protein, 21 aa, Plasmodium falciparum
LQIIYNIILYFVYLYIYYTKY

SEQ ID NO: 3268934 - protein, 19 aa, Plasmodium falciparum
LQIKISMKVLNSMFHIIMY

SEQ ID NO: 3268935 - protein, 28 aa, Plasmodium falciparum
LQIKKIINILCIVLIIILGYYFVTLKLL

SEQ ID NO: 3268936 - protein, 27 aa, Plasmodium falciparum
LQIKSRKKLLPSFNVFEINGMNVVHPN

SEQ ID NO: 3268937 - protein, 21 aa, Plasmodium falciparum
LQKAKGIGELAAFPDTCKRVE

SEQ ID NO: 3268938 - protein, 26 aa, Plasmodium falciparum
LQKIFLLCNKSIFMLCDKMMKLKKSN

SEQ ID NO: 3268939 - protein, 18 aa, Plasmodium falciparum
LQKILVLQTEAMRNIEEG

SEQ ID NO: 3268940 - protein, 18 aa, Plasmodium falciparum
LQKLWKGRNKNLSLHNNN

SEQ ID NO: 3268941 - protein, 26 aa, Plasmodium falciparum
LQKNEARMSMLLGRNLDDEISKEKKE

SEQ ID NO: 3268942 - protein, 22 aa, Plasmodium falciparum
LQKNIHYDWGLRAVKVVLIQAG

SEQ ID NO: 3268943 - protein, 27 aa, Plasmodium falciparum
LQKSGTIPLDFLRLMFYTLGDYRDILV

SEQ ID NO: 3268944 - protein, 27 aa, Plasmodium falciparum
LQKTLGYSICAWIFLPIEKSISYSSLI

SEQ ID NO: 3268945 - protein, 23 aa, Plasmodium falciparum
LQKVLNLICRVIHKKYESEKKHF

SEQ ID NO: 3268946 - protein, 18 aa, Plasmodium falciparum
LQKYCLKEKINYIDEPLI

SEQ ID NO: 3268947 - protein, 31 aa, Plasmodium falciparum
LQKYLCLVKPFSKLYIVLNFFFYLFDNTSTF

SEQ ID NO: 3268948 - protein, 24 aa, Plasmodium falciparum
LQKYRPSVVSLRRFLCDDENIKIE

SEQ ID NO: 3268949 - protein, 29 aa, Plasmodium falciparum
LQLFNYIIIYILRNCTTFHIYHDEEKKKN

SEQ ID NO: 3268950 - protein, 26 aa, Plasmodium falciparum
LQLIYHPYFYLMYKLYKYLKIDASPV

SEQ ID NO: 3268951 - protein, 22 aa, Plasmodium falciparum
LQLQLVHFIRYILPLYEKNIDK

SEQ ID NO: 3268952 - protein, 28 aa, Plasmodium falciparum
LQLSIPINMFFCFLILRYRYHLYNYLGA

SEQ ID NO: 3268953 - protein, 18 aa, Plasmodium falciparum
LQMIYPFIIKYFYDKTVF

SEQ ID NO: 3268954 - protein, 17 aa, Plasmodium falciparum
LQNFFDVSKKVLFDLKK

SEQ ID NO: 3268955 - protein, 25 aa, Plasmodium falciparum
LQNIFYRYVFLLIMNLLIDYNANSK

SEQ ID NO: 3268956 - protein, 26 aa, Plasmodium falciparum
LQNIIFFKKFFIYKILKEEKHRNYQH

SEQ ID NO: 3268957 - protein, 18 aa, Plasmodium falciparum
LQNIIYINCILKKGYYDL

SEQ ID NO: 3268958 - protein, 17 aa, Plasmodium falciparum
LQNKYGFIKNFKSNIFK

SEQ ID NO: 3268959 - protein, 25 aa, Plasmodium falciparum
LQNNYKQVCVFCKKTTGIKTKCMFP

SEQ ID NO: 3268960 - protein, 25 aa, Plasmodium falciparum
LQNRFKVHIAIPFNLSDILQVLDGL

SEQ ID NO: 3268961 - protein, 21 aa, Plasmodium falciparum
LQNTFKASISYYNNKSKHNNI

SEQ ID NO: 3268962 - protein, 26 aa, Plasmodium falciparum
LQNVDEFRLLYELILIEEINEKIKNQ

SEQ ID NO: 3268963 - protein, 17 aa, Plasmodium falciparum
LQNVPLYGKDNDCKRRK

SEQ ID NO: 3268964 - protein, 22 aa, Plasmodium falciparum
LQNYKKSHCLGIEHKIKKGLFQ

SEQ ID NO: 3268965 - protein, 20 aa, Plasmodium falciparum
LQPFRANFQFELKLPNPEIL

SEQ ID NO: 3268966 - protein, 26 aa, Plasmodium falciparum
LQQPCVLCNMSTYFIIFFFAIFIFVI

SEQ ID NO: 3268967 - protein, 32 aa, Plasmodium falciparum
LQRHLNNMFNEWFKKGFVSIGEFQNIINATRH

SEQ ID NO: 3268968 - protein, 19 aa, Plasmodium falciparum
LQRKSCMSNDEVIYTYKFI

SEQ ID NO: 3268969 - protein, 21 aa, Plasmodium falciparum
LQRYKFFICPQKYITFQPFVS

SEQ ID NO: 3268970 - protein, 38 aa, Plasmodium falciparum
LQSFRQKIYFLFPKIYFYIKLFICSNTDRYSENNFFYV

SEQ ID NO: 3268971 - protein, 31 aa, Plasmodium falciparum
LQSNIIPSLYFKYIPNILHIFQFFDISQSFH

SEQ ID NO: 3268972 - protein, 21 aa, Plasmodium falciparum
LQSQVKVMEWNILKQENLYKG

SEQ ID NO: 3268973 - protein, 21 aa, Plasmodium falciparum
LQTLCNSSFFISKKKIFNNVL

SEQ ID NO: 3268974 - protein, 18 aa, Plasmodium falciparum
LQTMGIVLKYWSKIRNIN

SEQ ID NO: 3268975 - protein, 17 aa, Plasmodium falciparum
LQTSNVLGHFMISKCNF

SEQ ID NO: 3268976 - protein, 25 aa, Plasmodium falciparum
LQTSSLCSFLIHRGFILTYLQFIYS

SEQ ID NO: 3268977 - protein, 17 aa, Plasmodium falciparum
LQVCIKYNIYYIYIYFN

SEQ ID NO: 3268978 - protein, 23 aa, Plasmodium falciparum
LQVFPEIFNLLNGPTLDIIQNPI

SEQ ID NO: 3268979 - protein, 26 aa, Plasmodium falciparum
LQWALECLKKSMAFDEDYFGLEYDLS

SEQ ID NO: 3268980 - protein, 21 aa, Plasmodium falciparum
LQWWIYDTFKSVMGLGTSGSG

SEQ ID NO: 3268981 - protein, 29 aa, Plasmodium falciparum
LQYIKDLLNILSIFVIYDISLKDENDLLN

SEQ ID NO: 3268982 - protein, 19 aa, Plasmodium falciparum
LQYILVFIFLLYKIIRMNI

SEQ ID NO: 3268983 - protein, 22 aa, Plasmodium falciparum
LRALKKKCKLFLFQNTNHSIDN

SEQ ID NO: 3268984 - protein, 19 aa, Plasmodium falciparum
LRAVKVVLIQAGNLKRKYA

SEQ ID NO: 3268985 - protein, 17 aa, Plasmodium falciparum
LRCAENIYMGKLAFNKI

SEQ ID NO: 3268986 - protein, 17 aa, Plasmodium falciparum
LRCAGVLGGGVMPGMGL

SEQ ID NO: 3268987 - protein, 19 aa, Plasmodium falciparum
LRCAQNLGGIVVPSSGVLG

SEQ ID NO: 3268988 - protein, 18 aa, Plasmodium falciparum
LRCTQNLGGIVAPSSGVL

SEQ ID NO: 3268989 - protein, 20 aa, Plasmodium falciparum
LRDIHVIEVELIRHASLLCQ

SEQ ID NO: 3268990 - protein, 26 aa, Plasmodium falciparum
LRDIITIKMCIDLNILSPSVLYPQEY

SEQ ID NO: 3268991 - protein, 24 aa, Plasmodium falciparum
LRDPRIKMKFLKILERHNNIKDIF

SEQ ID NO: 3268992 - protein, 19 aa, Plasmodium falciparum
LRDSLLIKAYHFILVCCFL

SEQ ID NO: 3268993 - protein, 26 aa, Plasmodium falciparum
LREAWWDANRAKVWEAITCDAPDNAK

SEQ ID NO: 3268994 - protein, 22 aa, Plasmodium falciparum
LREAWWTANRDQVWKAITCRAP

SEQ ID NO: 3268995 - protein, 21 aa, Plasmodium falciparum
LREDWWALNRDQVWKAITCKA

SEQ ID NO: 3268996 - protein, 22 aa, Plasmodium falciparum
LREDWWALNRDQVWKAITCNAG

SEQ ID NO: 3268997 - protein, 26 aa, Plasmodium falciparum
LREDWWALNRQDVWKAITCDAHDSRY

SEQ ID NO: 3268998 - protein, 20 aa, Plasmodium falciparum
LREDWWTANRDQVWKAITCN

SEQ ID NO: 3268999 - protein, 21 aa, Plasmodium falciparum
LREDWWTANRDQVWKAMTCVA

SEQ ID NO: 3269000 - protein, 20 aa, Plasmodium falciparum
LREDWWTANRETVWEAITCD

SEQ ID NO: 3269001 - protein, 26 aa, Plasmodium falciparum
LREDWWTANRHTVWKAITCGTHEGDT

SEQ ID NO: 3269002 - protein, 26 aa, Plasmodium falciparum
LREDWWYANRATVWEAITCDVHGSDY

SEQ ID NO: 3269003 - protein, 20 aa, Plasmodium falciparum
LREDWWYANRRQVWKAITCD

SEQ ID NO: 3269004 - protein, 23 aa, Plasmodium falciparum
LREENKLHFLSGITEGRCAPIPI

SEQ ID NO: 3269005 - protein, 17 aa, Plasmodium falciparum
LREGCKASKIFELSWGD

SEQ ID NO: 3269006 - protein, 26 aa, Plasmodium falciparum
LREHQYWRLITCFLYFGSFGIHFFWD

SEQ ID NO: 3269007 - protein, 30 aa, Plasmodium falciparum
LREIIYRKDVDCIFIYNIFFHMNRFIKKLY

SEQ ID NO: 3269008 - protein, 19 aa, Plasmodium falciparum
LRFCFSFYFYVQLFIIYLF

SEQ ID NO: 3269009 - protein, 25 aa, Plasmodium falciparum
LRFSSYNCGITWLVLDDEGSVVLRE

SEQ ID NO: 3269010 - protein, 17 aa, Plasmodium falciparum
LRGFWYHGYPVGPFISQ

SEQ ID NO: 3269011 - protein, 19 aa, Plasmodium falciparum
LRGGIVLVLGLRIEAENKI

SEQ ID NO: 3269012 - protein, 18 aa, Plasmodium falciparum
LRGIERFLFEDTVSDLFT

SEQ ID NO: 3269013 - protein, 21 aa, Plasmodium falciparum
LRGKCFLENFYEYIVIICQGE

SEQ ID NO: 3269014 - protein, 24 aa, Plasmodium falciparum
LRGKLEFYDNLFIDKMLDLRIQKK

SEQ ID NO: 3269015 - protein, 17 aa, Plasmodium falciparum
LRGKVVIITGGYKGIGL

SEQ ID NO: 3269016 - protein, 19 aa, Plasmodium falciparum
LRGNIHYYRINKIHIEYSL

SEQ ID NO: 3269017 - protein, 21 aa, Plasmodium falciparum
LRGNIKYYYFFNRIVSTSLYL

SEQ ID NO: 3269018 - protein, 18 aa, Plasmodium falciparum
LRHKYDIEMIPIDIVGNI

SEQ ID NO: 3269019 - protein, 31 aa, Plasmodium falciparum
LRHMKKRIKLPFLRIFFEKMSKIAEEKDYKD

SEQ ID NO: 3269020 - protein, 24 aa, Plasmodium falciparum
LRHVQETKGLCLFESCVPTVGKSA

SEQ ID NO: 3269021 - protein, 27 aa, Plasmodium falciparum
LRIEKCYADYAFSKLCRMNNNNNNNNN

SEQ ID NO: 3269022 - protein, 24 aa, Plasmodium falciparum
LRIFAENIKIIFFDNHIHTKPFTL

SEQ ID NO: 3269023 - protein, 31 aa, Plasmodium falciparum
LRIKKMYSNIFLRRCNVPLNLFDSNTLQVNS

SEQ ID NO: 3269024 - protein, 25 aa, Plasmodium falciparum
LRILPDRRFLLISGEKKVLVLDIWA

SEQ ID NO: 3269025 - protein, 24 aa, Plasmodium falciparum
LRIQNGCILFCVMNGKLSEGINFY

SEQ ID NO: 3269026 - protein, 17 aa, Plasmodium falciparum
LRKAFIISAAAETFRSW

SEQ ID NO: 3269027 - protein, 23 aa, Plasmodium falciparum
LRKKFVVDVLMFEFFFSFFSANK

SEQ ID NO: 3269028 - protein, 19 aa, Plasmodium falciparum
LRKMLFKKSNFAIMCKQAY

SEQ ID NO: 3269029 - protein, 20 aa, Plasmodium falciparum
LRKNIQLMFIDQGYEKFVTK

SEQ ID NO: 3269030 - protein, 19 aa, Plasmodium falciparum
LRKNNAPNLVFYSDNDGLT

SEQ ID NO: 3269031 - protein, 20 aa, Plasmodium falciparum
LRKNRTIIIIAHKLCTITTA

SEQ ID NO: 3269032 - protein, 18 aa, Plasmodium falciparum
LRKQKWICQKKTGEVHQC

SEQ ID NO: 3269033 - protein, 17 aa, Plasmodium falciparum
LRKRECINDSKYIDNKS

SEQ ID NO: 3269034 - protein, 22 aa, Plasmodium falciparum
LRKYKDIYTVLKLYSYIDKHLS

SEQ ID NO: 3269035 - protein, 26 aa, Plasmodium falciparum
LRLFFFKWKRYEIINIVKEKLANKNK

SEQ ID NO: 3269036 - protein, 18 aa, Plasmodium falciparum
LRLFHLILINEGQDNKSE

SEQ ID NO: 3269037 - protein, 17 aa, Plasmodium falciparum
LRLIPHYKTIRMFHYSS

SEQ ID NO: 3269038 - protein, 24 aa, Plasmodium falciparum
LRLRYYGCTRVQLGIQHIDDVILK

SEQ ID NO: 3269039 - protein, 17 aa, Plasmodium falciparum
LRLTYGIASLIGIIIYR

SEQ ID NO: 3269040 - protein, 23 aa, Plasmodium falciparum
LRLYLKKGVLCLLKNINNIEDSD

SEQ ID NO: 3269041 - protein, 28 aa, Plasmodium falciparum
LRMLILRKKNSFEIIKKMYWFLIFLITL

SEQ ID NO: 3269042 - protein, 19 aa, Plasmodium falciparum
LRNFIIFKNMIKKEHVEHT

SEQ ID NO: 3269043 - protein, 17 aa, Plasmodium falciparum
LRNFLKNAIIRPNLQTF

SEQ ID NO: 3269044 - protein, 33 aa, Plasmodium falciparum
LRNKEEILNIFSIMYLFRICIYYLGRSKDFRKE

SEQ ID NO: 3269045 - protein, 24 aa, Plasmodium falciparum
LRNLKSKRDVFSYIENCLLNNNIE

SEQ ID NO: 3269046 - protein, 20 aa, Plasmodium falciparum
LRNNYLYSFLRNYNKNLKRN

SEQ ID NO: 3269047 - protein, 25 aa, Plasmodium falciparum
LRNQIKDIIGIYINDCFINSTICFF

SEQ ID NO: 3269048 - protein, 18 aa, Plasmodium falciparum
LRNRKCLYDKAIEKDINR

SEQ ID NO: 3269049 - protein, 17 aa, Plasmodium falciparum
LRNSFSDFRNSFIGDDM

SEQ ID NO: 3269050 - protein, 18 aa, Plasmodium falciparum
LRNSLYYKDEEPLKNTGA

SEQ ID NO: 3269051 - protein, 25 aa, Plasmodium falciparum
LRNTFKDKFLDNLEICIKLNSKDIC

SEQ ID NO: 3269052 - protein, 19 aa, Plasmodium falciparum
LRNTGCTFLSYLYSKSQTY

SEQ ID NO: 3269053 - protein, 28 aa, Plasmodium falciparum
LRNVLFLKKYYNIFSIILIAWFHNPLSA

SEQ ID NO: 3269054 - protein, 19 aa, Plasmodium falciparum
LRNVYLYGPMVSLEYLVTK

SEQ ID NO: 3269055 - protein, 19 aa, Plasmodium falciparum
LRNYYCFPNEMKKLKKIGE

SEQ ID NO: 3269056 - protein, 22 aa, Plasmodium falciparum
LRNYYKGIFLYFIIFIGCVHVV

SEQ ID NO: 3269057 - protein, 18 aa, Plasmodium falciparum
LRPYTWDKSVENFSKSVL

SEQ ID NO: 3269058 - protein, 34 aa, Plasmodium falciparum
LRQKNIPIDYCLKGDESLPLGVLPMEYEQNDKHH

SEQ ID NO: 3269059 - protein, 18 aa, Plasmodium falciparum
LRQKVWLLLLGFNINISK

SEQ ID NO: 3269060 - protein, 18 aa, Plasmodium falciparum
LRRCFMKNEFFDHYNDNH

SEQ ID NO: 3269061 - protein, 22 aa, Plasmodium falciparum
LRRDVLSTASIRFIRTLTDDMI

SEQ ID NO: 3269062 - protein, 19 aa, Plasmodium falciparum
LRRGYFCSTIKYGDKTTFP

SEQ ID NO: 3269063 - protein, 23 aa, Plasmodium falciparum
LRRKNIYYKYVLNINEYNNFLDN

SEQ ID NO: 3269064 - protein, 39 aa, Plasmodium falciparum
LRRNSFLVYFCIFRNVSFCLCSMILIFWTGYSAIDAWNP

SEQ ID NO: 3269065 - protein, 33 aa, Plasmodium falciparum
LRRVKRGIPQKYRWKIWFHITNAKNLYNKFQKK

SEQ ID NO: 3269066 - protein, 26 aa, Plasmodium falciparum
LRRYRYPYLCSYTCNIKNISLTCEEK

SEQ ID NO: 3269067 - protein, 17 aa, Plasmodium falciparum
LRSKIRKTQNYILNNNI

SEQ ID NO: 3269068 - protein, 18 aa, Plasmodium falciparum
LRSLHSPLVRFFIMILNF

SEQ ID NO: 3269069 - protein, 20 aa, Plasmodium falciparum
LRSNIEWLSKAINWEKFSAT

SEQ ID NO: 3269070 - protein, 20 aa, Plasmodium falciparum
LRSYNFWSYFIAQKENFKLL

SEQ ID NO: 3269071 - protein, 19 aa, Plasmodium falciparum
LRTIMIYDISKLKNDLIDN

SEQ ID NO: 3269072 - protein, 30 aa, Plasmodium falciparum
LRTKNILFSLCYFHSIIVERAKFGSQGFNI

SEQ ID NO: 3269073 - protein, 22 aa, Plasmodium falciparum
LRTNHFPPYANFNFTIRRKLQT

SEQ ID NO: 3269074 - protein, 17 aa, Plasmodium falciparum
LRTVICTAFLIQPIVLL

SEQ ID NO: 3269075 - protein, 27 aa, Plasmodium falciparum
LRVCEKYCLYHNFILKKEVSKIKEEKY

SEQ ID NO: 3269076 - protein, 26 aa, Plasmodium falciparum
LRVLALPLICLFSSLVGSPHFLDDLY

SEQ ID NO: 3269077 - protein, 17 aa, Plasmodium falciparum
LRVLKCFYICPRNIERK

SEQ ID NO: 3269078 - protein, 19 aa, Plasmodium falciparum
LRVLSSISYHYLYEKNGIY

SEQ ID NO: 3269079 - protein, 30 aa, Plasmodium falciparum
LRYGKGCTDCFFACYPYEKWIDNKKKEFLK

SEQ ID NO: 3269080 - protein, 19 aa, Plasmodium falciparum
LRYGKGCTECFFACNPYVE

SEQ ID NO: 3269081 - protein, 20 aa, Plasmodium falciparum
LRYGNRCTDCLFACHRYEKW

SEQ ID NO: 3269082 - protein, 19 aa, Plasmodium falciparum
LRYGNRCTDCLFACHRYEN

SEQ ID NO: 3269083 - protein, 19 aa, Plasmodium falciparum
LRYHLCPFFSSNNNITKII

SEQ ID NO: 3269084 - protein, 26 aa, Plasmodium falciparum
LRYIILRKIEILYVFKNILISMYNEI

SEQ ID NO: 3269085 - protein, 21 aa, Plasmodium falciparum
LRYIKSLNLYTPYINEKDRNE

SEQ ID NO: 3269086 - protein, 21 aa, Plasmodium falciparum
LRYIKSLQYVTDFSIFNLHPS

SEQ ID NO: 3269087 - protein, 22 aa, Plasmodium falciparum
LRYINIQFIFKTTCDNKEKVKG

SEQ ID NO: 3269088 - protein, 19 aa, Plasmodium falciparum
LRYLHVHELFPVIFDSFVK

SEQ ID NO: 3269089 - protein, 21 aa, Plasmodium falciparum
LRYNDSIVIIWLIRSIYLFII

SEQ ID NO: 3269090 - protein, 20 aa, Plasmodium falciparum
LRYSDNFIQLIIFKIINNIF

SEQ ID NO: 3269091 - protein, 23 aa, Plasmodium falciparum
LRYVHLVYYFIIISFCIHNNISC

SEQ ID NO: 3269092 - protein, 17 aa, Plasmodium falciparum
LRYYSISIISNIINDNY

SEQ ID NO: 3269093 - protein, 17 aa, Plasmodium falciparum
LSAAIPVTAIPIYMYLT

SEQ ID NO: 3269094 - protein, 23 aa, Plasmodium falciparum
LSAALTWPLALIKYASNLDNVYL

SEQ ID NO: 3269095 - protein, 28 aa, Plasmodium falciparum
LSAGDIICFLHPRYGDYIMLNLYNDINK

SEQ ID NO: 3269096 - protein, 20 aa, Plasmodium falciparum
LSAHIYKFDFFFYKTSICLL

SEQ ID NO: 3269097 - protein, 17 aa, Plasmodium falciparum
LSAIPTINYSVRTSRVQ

SEQ ID NO: 3269098 - protein, 25 aa, Plasmodium falciparum
LSASILCKMYENFPRIEKKKKKIKR

SEQ ID NO: 3269099 - protein, 26 aa, Plasmodium falciparum
LSAYDWFLVFLWSFPVIILDEIIKFY

SEQ ID NO: 3269100 - protein, 29 aa, Plasmodium falciparum
LSCKKKFSFFISEIFLKENIKKINIKEII

SEQ ID NO: 3269101 - protein, 19 aa, Plasmodium falciparum
LSCLTNCIIVLTFAEVNLK

SEQ ID NO: 3269102 - protein, 23 aa, Plasmodium falciparum
LSCTLFVYFLYIHFFLLKQNNFC

SEQ ID NO: 3269103 - protein, 17 aa, Plasmodium falciparum
LSCWPNVMFDLCGICCG

SEQ ID NO: 3269104 - protein, 20 aa, Plasmodium falciparum
LSDCVKSFHQYMLYLNKKCQ

SEQ ID NO: 3269105 - protein, 17 aa, Plasmodium falciparum
LSDFSYLKWSAMVTPTT

SEQ ID NO: 3269106 - protein, 32 aa, Plasmodium falciparum
LSDLFKLKIIKTFECLIIFLRDSMIGEFPVRL

SEQ ID NO: 3269107 - protein, 22 aa, Plasmodium falciparum
LSDYLIYCLHSGFISHKYNVTD

SEQ ID NO: 3269108 - protein, 22 aa, Plasmodium falciparum
LSEDSFCLSLFSSENDYKNNIV

SEQ ID NO: 3269109 - protein, 29 aa, Plasmodium falciparum
LSEFEEVYEYILFCYKKCYENYTRTFFYT

SEQ ID NO: 3269110 - protein, 30 aa, Plasmodium falciparum
LSEFITISCCFGCQKIILINKYWKNVKKTK

SEQ ID NO: 3269111 - protein, 28 aa, Plasmodium falciparum
LSEKHQLIFFFYMVCMINIYKKDIDYDD

SEQ ID NO: 3269112 - protein, 20 aa, Plasmodium falciparum
LSERSLIYIYFLSLNNIDEY

SEQ ID NO: 3269113 - protein, 18 aa, Plasmodium falciparum
LSETRLKAYSKYINEHFN

SEQ ID NO: 3269114 - protein, 22 aa, Plasmodium falciparum
LSEYLCLIRNLLKDHPTINYIE

SEQ ID NO: 3269115 - protein, 17 aa, Plasmodium falciparum
LSFDEGNNWKNEVMNLY

SEQ ID NO: 3269116 - protein, 26 aa, Plasmodium falciparum
LSFDFFVFLFFCFFFLYFPSEEIKVE

SEQ ID NO: 3269117 - protein, 27 aa, Plasmodium falciparum
LSFKFYDLIKLFFLYDLEVIGIIGLKN

SEQ ID NO: 3269118 - protein, 24 aa, Plasmodium falciparum
LSFLCGQIYIDFFMRFPLSQKEKK

SEQ ID NO: 3269119 - protein, 19 aa, Plasmodium falciparum
LSFLKNFYCTSKNMNNYIP

SEQ ID NO: 3269120 - protein, 19 aa, Plasmodium falciparum
LSFLNIPLSYFLLQDQNKD

SEQ ID NO: 3269121 - protein, 28 aa, Plasmodium falciparum
LSFMKFIRFLYCCFSVMLLIGFSCITNG

SEQ ID NO: 3269122 - protein, 24 aa, Plasmodium falciparum
LSFMKRNVLHLSKNVNYITCSEFF

SEQ ID NO: 3269123 - protein, 18 aa, Plasmodium falciparum
LSFNKLKSIEIINEGIHQ

SEQ ID NO: 3269124 - protein, 22 aa, Plasmodium falciparum
LSFPFYAEIEIVQFVNDQIDEP

SEQ ID NO: 3269125 - protein, 18 aa, Plasmodium falciparum
LSFSKCIETLFNNIKKQD

SEQ ID NO: 3269126 - protein, 26 aa, Plasmodium falciparum
LSFSYKEKRKFLKLLLKENNRKEEHA

SEQ ID NO: 3269127 - protein, 17 aa, Plasmodium falciparum
LSFTVTKIAGSTAAANA

SEQ ID NO: 3269128 - protein, 25 aa, Plasmodium falciparum
LSFVFPVGAFILFKRMLKLSNNKLL

SEQ ID NO: 3269129 - protein, 27 aa, Plasmodium falciparum
LSGDWYKLCLGWGLAVFFGILVSAKLS

SEQ ID NO: 3269130 - protein, 24 aa, Plasmodium falciparum
LSGFRKGKGIFELIFLLKHILIVL

SEQ ID NO: 3269131 - protein, 19 aa, Plasmodium falciparum
LSGNIILYACNNYIISDDE

SEQ ID NO: 3269132 - protein, 21 aa, Plasmodium falciparum
LSGPCGLISSIQGYIIIILLF

SEQ ID NO: 3269133 - protein, 19 aa, Plasmodium falciparum
LSGPLIIVLSLGFILLLAG

SEQ ID NO: 3269134 - protein, 20 aa, Plasmodium falciparum
LSHLIHFLFILTSISQLFLF

SEQ ID NO: 3269135 - protein, 19 aa, Plasmodium falciparum
LSHLYKEGFIQSSKISPSI

SEQ ID NO: 3269136 - protein, 24 aa, Plasmodium falciparum
LSHTLKSRFTEIYVDSFAPDTDDY

SEQ ID NO: 3269137 - protein, 17 aa, Plasmodium falciparum
LSIANLSLFTYFYKNSL

SEQ ID NO: 3269138 - protein, 22 aa, Plasmodium falciparum
LSIEILVFLLLLLHIDKPKNVN

SEQ ID NO: 3269139 - protein, 35 aa, Plasmodium falciparum
LSIEPQIFLLRWIRLFYCREFPIDDTVILWDNFFA

SEQ ID NO: 3269140 - protein, 26 aa, Plasmodium falciparum
LSIFLLRCINSIFILLFPLLTISYYD

SEQ ID NO: 3269141 - protein, 24 aa, Plasmodium falciparum
LSIGCLFIAFKVYSISLVINFSLI

SEQ ID NO: 3269142 - protein, 18 aa, Plasmodium falciparum
LSIGSSIFMQLIFLPTIF

SEQ ID NO: 3269143 - protein, 35 aa, Plasmodium falciparum
LSIHRRKEKVADFIFCLNLFYSISMMKDIISLKQI

SEQ ID NO: 3269144 - protein, 19 aa, Plasmodium falciparum
LSIHTGVQKFAYYQMIRNK

SEQ ID NO: 3269145 - protein, 20 aa, Plasmodium falciparum
LSIIFLKYYHVCCISTREIL

SEQ ID NO: 3269146 - protein, 32 aa, Plasmodium falciparum
LSIIFPDVSPGLWFFIHFIMNLIVLCVSLSSL

SEQ ID NO: 3269147 - protein, 21 aa, Plasmodium falciparum
LSIKEYIKYIMTYVPLIPTKN

SEQ ID NO: 3269148 - protein, 23 aa, Plasmodium falciparum
LSIKKVSIIKGFVNSRMIYLQKF

SEQ ID NO: 3269149 - protein, 24 aa, Plasmodium falciparum
LSILFCILNSYLSFATLQHASFYT

SEQ ID NO: 3269150 - protein, 17 aa, Plasmodium falciparum
LSILNFFTDIIKFNNDP

SEQ ID NO: 3269151 - protein, 23 aa, Plasmodium falciparum
LSIPKKWITYSFFSNLQIFHYAT

SEQ ID NO: 3269152 - protein, 26 aa, Plasmodium falciparum
LSISSFPLTVGVAFAALSYFLLKKKS

SEQ ID NO: 3269153 - protein, 17 aa, Plasmodium falciparum
LSITHWKFRGIKYPRNE

SEQ ID NO: 3269154 - protein, 17 aa, Plasmodium falciparum
LSIYEYILRTCTVYARM

SEQ ID NO: 3269155 - protein, 32 aa, Plasmodium falciparum
LSKFVLRPPYFRYLEEWGETFCRERTRRLGKI

SEQ ID NO: 3269156 - protein, 20 aa, Plasmodium falciparum
LSKIHSFKAPFNVENLENGW

SEQ ID NO: 3269157 - protein, 18 aa, Plasmodium falciparum
LSKINLRKYVSIFHNLYN

SEQ ID NO: 3269158 - protein, 33 aa, Plasmodium falciparum
LSKIYCSHIRLSFFFPLLFYKTYYINDILSSSL

SEQ ID NO: 3269159 - protein, 27 aa, Plasmodium falciparum
LSKKHTWDKYELHLPGLAHGKYNNERD

SEQ ID NO: 3269160 - protein, 24 aa, Plasmodium falciparum
LSKKISYFVFFHIYRNYEKLSKDR

SEQ ID NO: 3269161 - protein, 26 aa, Plasmodium falciparum
LSKLICNYKTNFLWINNMNNTTNNNN

SEQ ID NO: 3269162 - protein, 23 aa, Plasmodium falciparum
LSKLKYDIDRDIFLQQHNEVLQS

SEQ ID NO: 3269163 - protein, 18 aa, Plasmodium falciparum
LSKLKYNYYISCDYNNSD

SEQ ID NO: 3269164 - protein, 20 aa, Plasmodium falciparum
LSKLLSRYNVSFNFVSCKSL

SEQ ID NO: 3269165 - protein, 17 aa, Plasmodium falciparum
LSKNLRTKCSLIVKAGD

SEQ ID NO: 3269166 - protein, 25 aa, Plasmodium falciparum
LSKQKNANCLYPFCEKTKKFCYLNE

SEQ ID NO: 3269167 - protein, 17 aa, Plasmodium falciparum
LSKQRISNIYNLQQSVQ

SEQ ID NO: 3269168 - protein, 24 aa, Plasmodium falciparum
LSKVYVKLCNPFLSISLKKKKKKN

SEQ ID NO: 3269169 - protein, 20 aa, Plasmodium falciparum
LSKYFFRNGLVLKTVEEEEK

SEQ ID NO: 3269170 - protein, 19 aa, Plasmodium falciparum
LSLCVISLFYISLLNIHEG

SEQ ID NO: 3269171 - protein, 25 aa, Plasmodium falciparum
LSLFEYNLFFVFKFISYYCLINSCA

SEQ ID NO: 3269172 - protein, 24 aa, Plasmodium falciparum
LSLFVLCIPFMFICKPAIRTYHIM

SEQ ID NO: 3269173 - protein, 24 aa, Plasmodium falciparum
LSLHKEFIFHLLSLNMLKKMNSFL

SEQ ID NO: 3269174 - protein, 22 aa, Plasmodium falciparum
LSLIEILRKVSLLYLVVSDENM

SEQ ID NO: 3269175 - protein, 24 aa, Plasmodium falciparum
LSLIIICIAFVFYLASTHVSSQLY

SEQ ID NO: 3269176 - protein, 30 aa, Plasmodium falciparum
LSLITFPFYFRIFLFFILFFNFLCSYSYEK

SEQ ID NO: 3269177 - protein, 28 aa, Plasmodium falciparum
LSLKFLRHLNLFLGMSMIKNLETYDHSY

SEQ ID NO: 3269178 - protein, 22 aa, Plasmodium falciparum
LSLKLLILTVFICILQFSNNNG

SEQ ID NO: 3269179 - protein, 29 aa, Plasmodium falciparum
LSLKRVNEKFPFPKCYYYTAKLGSKKRKN

SEQ ID NO: 3269180 - protein, 17 aa, Plasmodium falciparum
LSLLCTLLVNFFFLYSI

SEQ ID NO: 3269181 - protein, 31 aa, Plasmodium falciparum
LSLLLRIILLIIMILKFSLLYNKKNVVMYFI

SEQ ID NO: 3269182 - protein, 24 aa, Plasmodium falciparum
LSLMICISILCNYDHGAIPVTLEE

SEQ ID NO: 3269183 - protein, 25 aa, Plasmodium falciparum
LSLNCNKKIYFLYKIFEDGNISFKN

SEQ ID NO: 3269184 - protein, 24 aa, Plasmodium falciparum
LSLNELYIELAYVIKKRKNLINNI

SEQ ID NO: 3269185 - protein, 23 aa, Plasmodium falciparum
LSLPDPYYILPILSSLLLLSNNE

SEQ ID NO: 3269186 - protein, 25 aa, Plasmodium falciparum
LSLQYCIKGKIPTFLLVQNKCLLAE

SEQ ID NO: 3269187 - protein, 19 aa, Plasmodium falciparum
LSLSAIMFGLSFAFVPLYQ

SEQ ID NO: 3269188 - protein, 22 aa, Plasmodium falciparum
LSLSCTLPFLSFELKNNYNDCF

SEQ ID NO: 3269189 - protein, 19 aa, Plasmodium falciparum
LSLVMFVSLLWIYRYNYSH

SEQ ID NO: 3269190 - protein, 20 aa, Plasmodium falciparum
LSLYYEWHEKIYLGAAHGYA

SEQ ID NO: 3269191 - protein, 23 aa, Plasmodium falciparum
LSMKYKSVKNIDILDYIHTKYYD

SEQ ID NO: 3269192 - protein, 19 aa, Plasmodium falciparum
LSNDIPYNYPFASHIMAVV

SEQ ID NO: 3269193 - protein, 24 aa, Plasmodium falciparum
LSNEGMVYIFFCNLYISNMFKENN

SEQ ID NO: 3269194 - protein, 19 aa, Plasmodium falciparum
LSNEHLSRCIINYFCTNIY

SEQ ID NO: 3269195 - protein, 30 aa, Plasmodium falciparum
LSNFKRKMEIYKFLQMVYKVLLLLNIYLIF

SEQ ID NO: 3269196 - protein, 28 aa, Plasmodium falciparum
LSNIFCFTLSFLLSWVYFYRTIKIEEKN

SEQ ID NO: 3269197 - protein, 22 aa, Plasmodium falciparum
LSNKLYIVKKMIKLYDKSRNME

SEQ ID NO: 3269198 - protein, 18 aa, Plasmodium falciparum
LSNLCIYWDYTIISVSQD

SEQ ID NO: 3269199 - protein, 25 aa, Plasmodium falciparum
LSNNFKTERWLKALMNNAYKLMQIK

SEQ ID NO: 3269200 - protein, 21 aa, Plasmodium falciparum
LSNNYKMIWKPSSYLYKKESF

SEQ ID NO: 3269201 - protein, 25 aa, Plasmodium falciparum
LSNNYRIVVEFDYIRNHIDLDFPFD

SEQ ID NO: 3269202 - protein, 26 aa, Plasmodium falciparum
LSNTMVILFFFYKIYIILKKLEIRNV

SEQ ID NO: 3269203 - protein, 20 aa, Plasmodium falciparum
LSNVSTWNKPFFVYNKKISV

SEQ ID NO: 3269204 - protein, 30 aa, Plasmodium falciparum
LSPCKKIHMTYFYRHVCKQYFKNEIVKKYT

SEQ ID NO: 3269205 - protein, 17 aa, Plasmodium falciparum
LSPIFLKLAKDLDVEEP

SEQ ID NO: 3269206 - protein, 20 aa, Plasmodium falciparum
LSPIIVGLIFKQLGILQNNQ

SEQ ID NO: 3269207 - protein, 27 aa, Plasmodium falciparum
LSPNILNCLYLHIFIMYIYYYNKLYTK

SEQ ID NO: 3269208 - protein, 21 aa, Plasmodium falciparum
LSPNTCLNRNFLKAQKDESTH

SEQ ID NO: 3269209 - protein, 23 aa, Plasmodium falciparum
LSPSCLLSPPSLLSPPSLLSPPC

SEQ ID NO: 3269210 - protein, 28 aa, Plasmodium falciparum
LSPVCFYDLIKLSLKFSIPNKMGIFKNI

SEQ ID NO: 3269211 - protein, 18 aa, Plasmodium falciparum
LSQGCILNSLSFLKKKIK

SEQ ID NO: 3269212 - protein, 19 aa, Plasmodium falciparum
LSQLSLSYVYSRPFVGSSI

SEQ ID NO: 3269213 - protein, 28 aa, Plasmodium falciparum
LSQLYSRRILFIFLKYFNVFIYCKISKL

SEQ ID NO: 3269214 - protein, 20 aa, Plasmodium falciparum
LSRNHSFSSYLILPNNLTEN

SEQ ID NO: 3269215 - protein, 25 aa, Plasmodium falciparum
LSRVLMFLSCIIKINKDYSYLIISY

SEQ ID NO: 3269216 - protein, 57 aa, Plasmodium falciparum
LSSDYISKLHLFIVKKEKVLFFPILYAEMIIRYNMKFFPLSKLYNIKNTASLMKCKR

SEQ ID NO: 3269217 - protein, 18 aa, Plasmodium falciparum
LSSFVYIYYGFSFVLNGY

SEQ ID NO: 3269218 - protein, 21 aa, Plasmodium falciparum
LSSIFLNCLFIHIDNITHIEC

SEQ ID NO: 3269219 - protein, 28 aa, Plasmodium falciparum
LSSILLTISIVWFFKFYSFHEVCYEARK

SEQ ID NO: 3269220 - protein, 17 aa, Plasmodium falciparum
LSSILSMLATFLSSVNL

SEQ ID NO: 3269221 - protein, 19 aa, Plasmodium falciparum
LSSKIIWNPLLYNIWCNIY

SEQ ID NO: 3269222 - protein, 19 aa, Plasmodium falciparum
LSSLWGIRIHYNHEMNKKE

SEQ ID NO: 3269223 - protein, 17 aa, Plasmodium falciparum
LSSQILLKVAGKNDMIE

SEQ ID NO: 3269224 - protein, 26 aa, Plasmodium falciparum
LSSRFNQMIFVSSIFISFYLINKHWQ

SEQ ID NO: 3269225 - protein, 25 aa, Plasmodium falciparum
LSSRFSGMFSCSSALKSQEPSMGET

SEQ ID NO: 3269226 - protein, 26 aa, Plasmodium falciparum
LSSRKAYRYLIRKFKKVAIECDLYFE

SEQ ID NO: 3269227 - protein, 26 aa, Plasmodium falciparum
LSSSCAKPCRLYKTWIEKKKTEYEKQ

SEQ ID NO: 3269228 - protein, 17 aa, Plasmodium falciparum
LSSSFELLKPVLGILKG

SEQ ID NO: 3269229 - protein, 20 aa, Plasmodium falciparum
LSSSLFIYSKRFKSFKKENT

SEQ ID NO: 3269230 - protein, 19 aa, Plasmodium falciparum
LSSSLLFTSSLSWTKLIYF

SEQ ID NO: 3269231 - protein, 18 aa, Plasmodium falciparum
LSSSMSRSGSINRSTSRS

SEQ ID NO: 3269232 - protein, 25 aa, Plasmodium falciparum
LSSSVYYLGLYVTFFFISKFLKEVC

SEQ ID NO: 3269233 - protein, 24 aa, Plasmodium falciparum
LSSTFFIYLIFKLYIMRIFLLNYF

SEQ ID NO: 3269234 - protein, 21 aa, Plasmodium falciparum
LSSTIMWSIGIGFATFTYFYL

SEQ ID NO: 3269235 - protein, 18 aa, Plasmodium falciparum
LSSVFCYYDNKTLQIFSS

SEQ ID NO: 3269236 - protein, 21 aa, Plasmodium falciparum
LSSWNNYLLYVLKNDIMENSY

SEQ ID NO: 3269237 - protein, 25 aa, Plasmodium falciparum
LSTFVLRPFCFRSFKGKMVNGYDDD

SEQ ID NO: 3269238 - protein, 18 aa, Plasmodium falciparum
LSTISSFLLFSFTSLKIH

SEQ ID NO: 3269239 - protein, 24 aa, Plasmodium falciparum
LSTKYKAFCNCFNISSLYGEKTYE

SEQ ID NO: 3269240 - protein, 24 aa, Plasmodium falciparum
LSTYCKTCPLNGLNCGSKECNEVK

SEQ ID NO: 3269241 - protein, 24 aa, Plasmodium falciparum
LSVDVLKLFMNFFLNQYLYTPSLI

SEQ ID NO: 3269242 - protein, 21 aa, Plasmodium falciparum
LSVGIAFAALSYFLLKKKSKF

SEQ ID NO: 3269243 - protein, 20 aa, Plasmodium falciparum
LSVGIGFAALSYFLLKVNGC

SEQ ID NO: 3269244 - protein, 19 aa, Plasmodium falciparum
LSVIAMGAGAISFVHIVKA

SEQ ID NO: 3269245 - protein, 23 aa, Plasmodium falciparum
LSVIPCALFGILIQKIHILLLIF

SEQ ID NO: 3269246 - protein, 18 aa, Plasmodium falciparum
LSVKEIYNILNMNCDYKP

SEQ ID NO: 3269247 - protein, 18 aa, Plasmodium falciparum
LSVLEHVLSFYYNDISFF

SEQ ID NO: 3269248 - protein, 17 aa, Plasmodium falciparum
LSVPHFLYPFKLYNKNN

SEQ ID NO: 3269249 - protein, 34 aa, Plasmodium falciparum
LSVVFVFFICVCISFYNVRIVKGLIQYKKTKISS

SEQ ID NO: 3269250 - protein, 17 aa, Plasmodium falciparum
LSYIFFFVHLIVINIKC

SEQ ID NO: 3269251 - protein, 17 aa, Plasmodium falciparum
LSYKENCYIYIYMLSLL

SEQ ID NO: 3269252 - protein, 23 aa, Plasmodium falciparum
LSYKNLYLDSGWITGTSISDRIR

SEQ ID NO: 3269253 - protein, 24 aa, Plasmodium falciparum
LSYKNYCFYIVWISNLLLNHKIEY

SEQ ID NO: 3269254 - protein, 17 aa, Plasmodium falciparum
LSYLHMYYLFKRITYED

SEQ ID NO: 3269255 - protein, 28 aa, Plasmodium falciparum
LSYLIWPFYLLYPIKRNANIYVFNYHSP

SEQ ID NO: 3269256 - protein, 35 aa, Plasmodium falciparum
LSYMKTSWIKNFIHFNGLKILMTFTNLPCFPPNYI

SEQ ID NO: 3269257 - protein, 19 aa, Plasmodium falciparum
LSYVLFLYVNYLKNNKNGI

SEQ ID NO: 3269258 - protein, 24 aa, Plasmodium falciparum
LSYYEHLDFWLSKNTDVLCSPFIE

SEQ ID NO: 3269259 - protein, 20 aa, Plasmodium falciparum
LSYYEYVICFFMKKKIKNIL

SEQ ID NO: 3269260 - protein, 17 aa, Plasmodium falciparum
LSYYVSLPLSFIKEIQY

SEQ ID NO: 3269261 - protein, 27 aa, Plasmodium falciparum
LTAWQIFGYTGIYGWANYAALLAHEAG

SEQ ID NO: 3269262 - protein, 17 aa, Plasmodium falciparum
LTAYGIICGILGISEYI

SEQ ID NO: 3269263 - protein, 25 aa, Plasmodium falciparum
LTCFNKLKNKCNMNCKCCKDKNCVD

SEQ ID NO: 3269264 - protein, 24 aa, Plasmodium falciparum
LTCKAEGAYFRPTCSDGNSQSQAT

SEQ ID NO: 3269265 - protein, 18 aa, Plasmodium falciparum
LTCLEIYQYLPQCIEQGN

SEQ ID NO: 3269266 - protein, 25 aa, Plasmodium falciparum
LTCNKKLLLYLSYSFLLTNYVCPMS

SEQ ID NO: 3269267 - protein, 23 aa, Plasmodium falciparum
LTCRAKDPIGTFCEMLYKKDNKR

SEQ ID NO: 3269268 - protein, 23 aa, Plasmodium falciparum
LTDEHFCCSFCYDTKGSRIKIQK

SEQ ID NO: 3269269 - protein, 27 aa, Plasmodium falciparum
LTDSIKILYRGTLRTLLILLHDFPEFL

SEQ ID NO: 3269270 - protein, 25 aa, Plasmodium falciparum
LTEKDYRLIFYIIMKYIHKHKIKYT

SEQ ID NO: 3269271 - protein, 25 aa, Plasmodium falciparum
LTEKIKYPFSFLNTSCVNLRLFRTV

SEQ ID NO: 3269272 - protein, 19 aa, Plasmodium falciparum
LTENLVFYLPRNVCMKELY

SEQ ID NO: 3269273 - protein, 22 aa, Plasmodium falciparum
LTEQFYRFSFPKDIFRGNEDIN

SEQ ID NO: 3269274 - protein, 19 aa, Plasmodium falciparum
LTEQWKCYKEDDIKKHVEN

SEQ ID NO: 3269275 - protein, 22 aa, Plasmodium falciparum
LTFFKKKLKHEFDLRYINIQFI

SEQ ID NO: 3269276 - protein, 17 aa, Plasmodium falciparum
LTFFNGIYDNNNLFISF

SEQ ID NO: 3269277 - protein, 17 aa, Plasmodium falciparum
LTFIPLFLFYQFADFLN

SEQ ID NO: 3269278 - protein, 20 aa, Plasmodium falciparum
LTFMPTCLIGLTEDLKVPKN

SEQ ID NO: 3269279 - protein, 33 aa, Plasmodium falciparum
LTFRFYDDINFMFRVLLIRGLKDMYSNIFLFCK

SEQ ID NO: 3269280 - protein, 22 aa, Plasmodium falciparum
LTGNCKEIFFPFNEHIKNVILF

SEQ ID NO: 3269281 - protein, 17 aa, Plasmodium falciparum
LTGTIIWSLGIPLFSFY

SEQ ID NO: 3269282 - protein, 17 aa, Plasmodium falciparum
LTHDIHIYVPFKNVHLL

SEQ ID NO: 3269283 - protein, 17 aa, Plasmodium falciparum
LTHFIIVIFLKRDKTIL

SEQ ID NO: 3269284 - protein, 17 aa, Plasmodium falciparum
LTHGISLYFENVGEEVD

SEQ ID NO: 3269285 - protein, 19 aa, Plasmodium falciparum
LTHNKCTYMHIYVSYYLIY

SEQ ID NO: 3269286 - protein, 27 aa, Plasmodium falciparum
LTHQFMCVKSLFLFYLYSRCTKKKIYN

SEQ ID NO: 3269287 - protein, 20 aa, Plasmodium falciparum
LTHSYNFFCYHYVYNNLYIH

SEQ ID NO: 3269288 - protein, 22 aa, Plasmodium falciparum
LTIAPGIYVYCIATRYNLINSN

SEQ ID NO: 3269289 - protein, 23 aa, Plasmodium falciparum
LTIFPCVFWIFCDTAIFLFLLIF

SEQ ID NO: 3269290 - protein, 27 aa, Plasmodium falciparum
LTIKMPSYVKINFGYNFTLTSFEIKLL

SEQ ID NO: 3269291 - protein, 27 aa, Plasmodium falciparum
LTIPVRPCMRKRAGKGRRGYRRHDDFM

SEQ ID NO: 3269292 - protein, 28 aa, Plasmodium falciparum
LTIQLSAIKFLALFFYKENKLFSIPLRK

SEQ ID NO: 3269293 - protein, 23 aa, Plasmodium falciparum
LTIRGIHKLDLFPFNRKKKEAEN

SEQ ID NO: 3269294 - protein, 17 aa, Plasmodium falciparum
LTIYLGYTFIHMWNDAV

SEQ ID NO: 3269295 - protein, 22 aa, Plasmodium falciparum
LTKCSLRILPLNDVIDGIIIHL

SEQ ID NO: 3269296 - protein, 23 aa, Plasmodium falciparum
LTKGDLNAACTLKYGTPNRYWGW

SEQ ID NO: 3269297 - protein, 30 aa, Plasmodium falciparum
LTKHKSLLFCLFELCEYIYLFLDKKEKIIE

SEQ ID NO: 3269298 - protein, 25 aa, Plasmodium falciparum
LTKKCITGTIDIIYICYRFFGHHYI

SEQ ID NO: 3269299 - protein, 17 aa, Plasmodium falciparum
LTKKEISAWTFDFGYWY

SEQ ID NO: 3269300 - protein, 24 aa, Plasmodium falciparum
LTKKEKYVNWILFLFILSIIVFIT

SEQ ID NO: 3269301 - protein, 20 aa, Plasmodium falciparum
LTKKELKYILDVVNQGYYFY

SEQ ID NO: 3269302 - protein, 19 aa, Plasmodium falciparum
LTKKMIEMINFIKKDKHYK

SEQ ID NO: 3269303 - protein, 18 aa, Plasmodium falciparum
LTKKMIFFLIKWIPMLVF

SEQ ID NO: 3269304 - protein, 23 aa, Plasmodium falciparum
LTKLCPLNYIFTLYNNFMENNNY

SEQ ID NO: 3269305 - protein, 21 aa, Plasmodium falciparum
LTKNCAHEICSINSYNNNLKI

SEQ ID NO: 3269306 - protein, 17 aa, Plasmodium falciparum
LTKNIFKYIIFARYNPL

SEQ ID NO: 3269307 - protein, 26 aa, Plasmodium falciparum
LTKNKRKWLRRRKRKRLYQIHVIRKY

SEQ ID NO: 3269308 - protein, 29 aa, Plasmodium falciparum
LTLDILSWRMIYIFKKYLYIYGKVVKGFG

SEQ ID NO: 3269309 - protein, 18 aa, Plasmodium falciparum
LTLFCLSNQLIFLNVSLS

SEQ ID NO: 3269310 - protein, 23 aa, Plasmodium falciparum
LTLGRLLYLLFLKMNNLMIKKKL

SEQ ID NO: 3269311 - protein, 29 aa, Plasmodium falciparum
LTLIYKTSCILFYYMVRVFQTFQNHINAQ

SEQ ID NO: 3269312 - protein, 17 aa, Plasmodium falciparum
LTLKKLIYNYLILYAEG

SEQ ID NO: 3269313 - protein, 18 aa, Plasmodium falciparum
LTLLRYIIIGTYVGIATV

SEQ ID NO: 3269314 - protein, 25 aa, Plasmodium falciparum
LTLLSGWVNEADWGTYFMVPFFLFE

SEQ ID NO: 3269315 - protein, 19 aa, Plasmodium falciparum
LTLLTEFDDVILIKIIDDL

SEQ ID NO: 3269316 - protein, 32 aa, Plasmodium falciparum
LTLLTSLIYWLWKHKMNLFFIKENIELKSTEP

SEQ ID NO: 3269317 - protein, 19 aa, Plasmodium falciparum
LTLNLFPPIYIGYDETSNF

SEQ ID NO: 3269318 - protein, 20 aa, Plasmodium falciparum
LTLRSNRIFVLLGENGSGKS

SEQ ID NO: 3269319 - protein, 25 aa, Plasmodium falciparum
LTLWFVVGLLCYHIYTIVTNQTTYE

SEQ ID NO: 3269320 - protein, 19 aa, Plasmodium falciparum
LTMDFTKFQWYILSFKNTM

SEQ ID NO: 3269321 - protein, 23 aa, Plasmodium falciparum
LTMYRKYILLLFILKILKIIKIY

SEQ ID NO: 3269322 - protein, 23 aa, Plasmodium falciparum
LTNDCIRYLSLVRLYLNRHKYKI

SEQ ID NO: 3269323 - protein, 23 aa, Plasmodium falciparum
LTNEIYKTVLLIIGISTFSFFRI

SEQ ID NO: 3269324 - protein, 18 aa, Plasmodium falciparum
LTNFPVLYVERDHVVNDN

SEQ ID NO: 3269325 - protein, 20 aa, Plasmodium falciparum
LTNIIPIFFLYILPNHSQKK

SEQ ID NO: 3269326 - protein, 26 aa, Plasmodium falciparum
LTNIVFKLIVHFCKNKKYYIAAKIFI

SEQ ID NO: 3269327 - protein, 17 aa, Plasmodium falciparum
LTNKCDIIAGESSDFHL

SEQ ID NO: 3269328 - protein, 18 aa, Plasmodium falciparum
LTNLKRSKIMFLLLFCKV

SEQ ID NO: 3269329 - protein, 18 aa, Plasmodium falciparum
LTNSKFAIEIDIPEPKKC

SEQ ID NO: 3269330 - protein, 26 aa, Plasmodium falciparum
LTPCNSDIWWIYSFSDIIHIEKIGLV

SEQ ID NO: 3269331 - protein, 21 aa, Plasmodium falciparum
LTPFPSIFLQTNFPSITNTQS

SEQ ID NO: 3269332 - protein, 18 aa, Plasmodium falciparum
LTPHKLLIRLINLTLNIN

SEQ ID NO: 3269333 - protein, 20 aa, Plasmodium falciparum
LTPLFFLKLSNIHIYDINIQ

SEQ ID NO: 3269334 - protein, 21 aa, Plasmodium falciparum
LTPRPRPGPQPKPPPQVEKNP

SEQ ID NO: 3269335 - protein, 19 aa, Plasmodium falciparum
LTPYPFLSKGRLHKGYLFM

SEQ ID NO: 3269336 - protein, 30 aa, Plasmodium falciparum
LTQFVLRPTYFRYLEEWGQNFCKERKKRLA

SEQ ID NO: 3269337 - protein, 31 aa, Plasmodium falciparum
LTQFVLRPTYFRYLEEWGQNFCKKRTEMLEK

SEQ ID NO: 3269338 - protein, 23 aa, Plasmodium falciparum
LTQHRIITVFLIFIYFINLKDCF

SEQ ID NO: 3269339 - protein, 38 aa, Plasmodium falciparum
LTQKLWSGKMVNVLKKREFLITGILCELRNGNKSPLIS

SEQ ID NO: 3269340 - protein, 23 aa, Plasmodium falciparum
LTQSFVICPHINYKENYLENKKI

SEQ ID NO: 3269341 - protein, 34 aa, Plasmodium falciparum
LTRLNKLYTCNILKFNNKQKFLWTQLKNNFHLLS

SEQ ID NO: 3269342 - protein, 26 aa, Plasmodium falciparum
LTSFAKLWWRLMFLFPSVISLIGILA

SEQ ID NO: 3269343 - protein, 17 aa, Plasmodium falciparum
LTSIFLFIYVKKKPNII

SEQ ID NO: 3269344 - protein, 17 aa, Plasmodium falciparum
LTSILIFDGPLKPLDIY

SEQ ID NO: 3269345 - protein, 24 aa, Plasmodium falciparum
LTSKAGTISGIFSKDLVTIGKLSV

SEQ ID NO: 3269346 - protein, 21 aa, Plasmodium falciparum
LTSLCRYLISRSLKSMLCAGI

SEQ ID NO: 3269347 - protein, 17 aa, Plasmodium falciparum
LTSSFVYDYLKLNLGII

SEQ ID NO: 3269348 - protein, 39 aa, Plasmodium falciparum
LTSTYELICIGIILCSSKLLLQDYILNWFFPKLKERRLV

SEQ ID NO: 3269349 - protein, 18 aa, Plasmodium falciparum
LTTLWAYKNIKCINKLLI

SEQ ID NO: 3269350 - protein, 25 aa, Plasmodium falciparum
LTVGGPNRLTCLFRMNCNDEISKIT

SEQ ID NO: 3269351 - protein, 27 aa, Plasmodium falciparum
LTVLRFSFQLFRTITFFMHYKRTKLPT

SEQ ID NO: 3269352 - protein, 19 aa, Plasmodium falciparum
LTYADNFAIGYFRKQGFSQ

SEQ ID NO: 3269353 - protein, 17 aa, Plasmodium falciparum
LTYEYNDDFNIFINSNK

SEQ ID NO: 3269354 - protein, 17 aa, Plasmodium falciparum
LTYFKINIPIFIFSFFY

SEQ ID NO: 3269355 - protein, 23 aa, Plasmodium falciparum
LTYLCVLFKMNILKVKMQKLQLL

SEQ ID NO: 3269356 - protein, 19 aa, Plasmodium falciparum
LTYMSHIFIVKFLIQLLKE

SEQ ID NO: 3269357 - protein, 17 aa, Plasmodium falciparum
LTYMSVTGMTIVSALSA

SEQ ID NO: 3269358 - protein, 18 aa, Plasmodium falciparum
LTYNFDHLFMLSDKNNHF

SEQ ID NO: 3269359 - protein, 20 aa, Plasmodium falciparum
LVACGYYDNYVHLYDVRINS

SEQ ID NO: 3269360 - protein, 24 aa, Plasmodium falciparum
LVAGGLYPVFALLYARYVSTLFDF

SEQ ID NO: 3269361 - protein, 17 aa, Plasmodium falciparum
LVCEKCIIFKNYLKLDS

SEQ ID NO: 3269362 - protein, 17 aa, Plasmodium falciparum
LVCIYIVIIFLFQDVRC

SEQ ID NO: 3269363 - protein, 26 aa, Plasmodium falciparum
LVCSLSGFIQFCSKLSLGFIFVLEKR

SEQ ID NO: 3269364 - protein, 25 aa, Plasmodium falciparum
LVDIEKISPIFILQKVLNLICRVIH

SEQ ID NO: 3269365 - protein, 18 aa, Plasmodium falciparum
LVEFLYIVIYNDLYYLDI

SEQ ID NO: 3269366 - protein, 31 aa, Plasmodium falciparum
LVFYLPRNVCMKELYYLYGYYKELVKNKKCK

SEQ ID NO: 3269367 - protein, 19 aa, Plasmodium falciparum
LVGCHGFTLFIHEKHETND

SEQ ID NO: 3269368 - protein, 19 aa, Plasmodium falciparum
LVGYGIIFIPGFPVLVGIV

SEQ ID NO: 3269369 - protein, 20 aa, Plasmodium falciparum
LVHFRRFFIYFIIIMYRLFI

SEQ ID NO: 3269370 - protein, 23 aa, Plasmodium falciparum
LVHINIYLCKECKALDNNFRMIS

SEQ ID NO: 3269371 - protein, 18 aa, Plasmodium falciparum
LVHNHIWDSKTTIMQNEL

SEQ ID NO: 3269372 - protein, 18 aa, Plasmodium falciparum
LVIFCIGFLIGNHISSKS

SEQ ID NO: 3269373 - protein, 19 aa, Plasmodium falciparum
LVIILCIFIIPSLPFCTYF

SEQ ID NO: 3269374 - protein, 37 aa, Plasmodium falciparum
LVISIIGQIMIRFNLSINLCRLLLYGVLLDVTFDTII

SEQ ID NO: 3269375 - protein, 17 aa, Plasmodium falciparum
LVITAAMISVKFFDDLY

SEQ ID NO: 3269376 - protein, 18 aa, Plasmodium falciparum
LVIVNGYIVSFKSQRGEE

SEQ ID NO: 3269377 - protein, 23 aa, Plasmodium falciparum
LVKCKYYKLGKTLTYCKLSMNKN

SEQ ID NO: 3269378 - protein, 18 aa, Plasmodium falciparum
LVKEAKIVINNIIRNSFV

SEQ ID NO: 3269379 - protein, 18 aa, Plasmodium falciparum
LVKFNKTRLNCVEKNVAY

SEQ ID NO: 3269380 - protein, 27 aa, Plasmodium falciparum
LVKIIFCCSFVLCLSLLSMILFEITGF

SEQ ID NO: 3269381 - protein, 21 aa, Plasmodium falciparum
LVKIYQCFHLNYKILSKNKYH

SEQ ID NO: 3269382 - protein, 24 aa, Plasmodium falciparum
LVKQCRNCRSGICENGKDDCVKCT

SEQ ID NO: 3269383 - protein, 25 aa, Plasmodium falciparum
LVKYFIKGIHLMYLQVYLKDNNYLE

SEQ ID NO: 3269384 - protein, 18 aa, Plasmodium falciparum
LVLFYKCNCIVKGKIVRA

SEQ ID NO: 3269385 - protein, 20 aa, Plasmodium falciparum
LVLISALIPVCFSNMTREIV

SEQ ID NO: 3269386 - protein, 17 aa, Plasmodium falciparum
LVLKYYNNLKHLIIIKI

SEQ ID NO: 3269387 - protein, 24 aa, Plasmodium falciparum
LVLLGGSITFYFLRKEKTEKVVQE

SEQ ID NO: 3269388 - protein, 24 aa, Plasmodium falciparum
LVLLILSFLCFFYSSLSYDEDYDE

SEQ ID NO: 3269389 - protein, 18 aa, Plasmodium falciparum
LVLLYFCCCVGMPVMFTL

SEQ ID NO: 3269390 - protein, 17 aa, Plasmodium falciparum
LVLRNKNTMCIEIDGSF

SEQ ID NO: 3269391 - protein, 24 aa, Plasmodium falciparum
LVMHFKHLMCIFKCMEQNNNKVDA

SEQ ID NO: 3269392 - protein, 27 aa, Plasmodium falciparum
LVNFSLKCPIKIAARFRDVLSIFHTNK

SEQ ID NO: 3269393 - protein, 24 aa, Plasmodium falciparum
LVNNYSYSYLWNIVKLKNRKILSE

SEQ ID NO: 3269394 - protein, 21 aa, Plasmodium falciparum
LVNSMICFLSFNYYEKNFCLF

SEQ ID NO: 3269395 - protein, 20 aa, Plasmodium falciparum
LVNVLRKCFKYIKIKYLKKK

SEQ ID NO: 3269396 - protein, 19 aa, Plasmodium falciparum
LVPFHFKKRIVKYLINTSS

SEQ ID NO: 3269397 - protein, 23 aa, Plasmodium falciparum
LVPTDVLEWDRTVNKRKAAVNNI

SEQ ID NO: 3269398 - protein, 21 aa, Plasmodium falciparum
LVPYLSHDVLYHIIKKLYKSL

SEQ ID NO: 3269399 - protein, 25 aa, Plasmodium falciparum
LVQYFKRFYSIFCLYDDTYYDLFLF

SEQ ID NO: 3269400 - protein, 24 aa, Plasmodium falciparum
LVRQRAFALLSCIANDVVKTKYMI

SEQ ID NO: 3269401 - protein, 17 aa, Plasmodium falciparum
LVSFLNCTILFQIVYYW

SEQ ID NO: 3269402 - protein, 18 aa, Plasmodium falciparum
LVSFLNCTILFQIVYYWK

SEQ ID NO: 3269403 - protein, 29 aa, Plasmodium falciparum
LVSFPNIRFKFFFFFLMLVDIFLPYLVTN

SEQ ID NO: 3269404 - protein, 28 aa, Plasmodium falciparum
LVSKAINCFLCPSLYLFKFDIINSSNNN

SEQ ID NO: 3269405 - protein, 19 aa, Plasmodium falciparum
LVTNIFFFSFFKNFNKFYT

SEQ ID NO: 3269406 - protein, 19 aa, Plasmodium falciparum
LVVDMTFYNDWNLFKDTDG

SEQ ID NO: 3269407 - protein, 27 aa, Plasmodium falciparum
LVVYFKKFHASFLFLIILALFMVFGYQ

SEQ ID NO: 3269408 - protein, 17 aa, Plasmodium falciparum
LVVYPYIDINKITTNIS

SEQ ID NO: 3269409 - protein, 19 aa, Plasmodium falciparum
LVWIIIFGNFFVVHFFLCF

SEQ ID NO: 3269410 - protein, 21 aa, Plasmodium falciparum
LVYICVNYYFVPMFYKNKIKA

SEQ ID NO: 3269411 - protein, 25 aa, Plasmodium falciparum
LVYIFFKVLCKITIDYIYMFNPPIK

SEQ ID NO: 3269412 - protein, 24 aa, Plasmodium falciparum
LVYNLSIYTNFIFKNIIYDQTNTN

SEQ ID NO: 3269413 - protein, 17 aa, Plasmodium falciparum
LWDRYKKEWALQKLAEL

SEQ ID NO: 3269414 - protein, 18 aa, Plasmodium falciparum
LWFECKILLAEKLIIVEF

SEQ ID NO: 3269415 - protein, 19 aa, Plasmodium falciparum
LWHKNICSNIYNLYEYIQM

SEQ ID NO: 3269416 - protein, 20 aa, Plasmodium falciparum
LWMLDSYWYFGIFSIFILII

SEQ ID NO: 3269417 - protein, 21 aa, Plasmodium falciparum
LWNILKCFSYWDGEYFLRLSL

SEQ ID NO: 3269418 - protein, 21 aa, Plasmodium falciparum
LWNKKIKAFLIKKSMSHNVTL

SEQ ID NO: 3269419 - protein, 25 aa, Plasmodium falciparum
LWNMFYKSHIFDVQFSRHSLNNLVI

SEQ ID NO: 3269420 - protein, 38 aa, Plasmodium falciparum
LWNNESVKIFLLKIGKSLIRFLIFIGNVEYIHKNILTL

SEQ ID NO: 3269421 - protein, 19 aa, Plasmodium falciparum
LWNNHHFQISLSNTMVILF

SEQ ID NO: 3269422 - protein, 26 aa, Plasmodium falciparum
LWNVIKIFMFFLQFEENHSLLLFYFY

SEQ ID NO: 3269423 - protein, 26 aa, Plasmodium falciparum
LWQHIFCGSIAGLMEHVFMYPLDTLK

SEQ ID NO: 3269424 - protein, 29 aa, Plasmodium falciparum
LWSILKTFKFRIILIISFYILETLIVTLG

SEQ ID NO: 3269425 - protein, 19 aa, Plasmodium falciparum
LYAAWKCYKHDEVQKVKRE

SEQ ID NO: 3269426 - protein, 19 aa, Plasmodium falciparum
LYDEWKCYEFKHLDKVEEG

SEQ ID NO: 3269427 - protein, 34 aa, Plasmodium falciparum
LYDIILFIYMKGFRLSIESKKKYLSKYIWSVSTL

SEQ ID NO: 3269428 - protein, 26 aa, Plasmodium falciparum
LYDMCIKLFLFFSSNYILSFWFLLNL

SEQ ID NO: 3269429 - protein, 25 aa, Plasmodium falciparum
LYDMINLIFCKKMFYILKNQNYEIY

SEQ ID NO: 3269430 - protein, 24 aa, Plasmodium falciparum
LYDPELVGIRYILEILKKKKNVDA

SEQ ID NO: 3269431 - protein, 28 aa, Plasmodium falciparum
LYDVKYRLLLLFYKFIIILKHKELLQNE

SEQ ID NO: 3269432 - protein, 17 aa, Plasmodium falciparum
LYEDIFFFRNEEHTKLR

SEQ ID NO: 3269433 - protein, 24 aa, Plasmodium falciparum
LYEELYYRHVFIIKDITLEDRKNS

SEQ ID NO: 3269434 - protein, 20 aa, Plasmodium falciparum
LYEEWKCYEGKDVKKVKNGE

SEQ ID NO: 3269435 - protein, 40 aa, Plasmodium falciparum
LYEFLKRATKFTIKWGSLIIRHIYYFIFFFLTIPVRPCMR

SEQ ID NO: 3269436 - protein, 23 aa, Plasmodium falciparum
LYEFRFIYRKCKFLIFMNKQDSN

SEQ ID NO: 3269437 - protein, 23 aa, Plasmodium falciparum
LYEFSGKIIGKAIYERILIESVF

SEQ ID NO: 3269438 - protein, 17 aa, Plasmodium falciparum
LYEGYNHLYIESFVEGE

SEQ ID NO: 3269439 - protein, 20 aa, Plasmodium falciparum
LYEHFKLYYFLIGQNVLLYK

SEQ ID NO: 3269440 - protein, 31 aa, Plasmodium falciparum
LYEIYLKEFIKFLNNIIVQFHFYLLPFFLNL

SEQ ID NO: 3269441 - protein, 23 aa, Plasmodium falciparum
LYELSSICECFFLVEYINSQDFQ

SEQ ID NO: 3269442 - protein, 26 aa, Plasmodium falciparum
LYEMKKLKCYYSFINMDNSTILKSSD

SEQ ID NO: 3269443 - protein, 18 aa, Plasmodium falciparum
LYERPKYPWIKGDTDIDP

SEQ ID NO: 3269444 - protein, 26 aa, Plasmodium falciparum
LYESMLSPFFIFQFFSIVLWMLDSYW

SEQ ID NO: 3269445 - protein, 19 aa, Plasmodium falciparum
LYESYKCRVMKDIDLLDGK

SEQ ID NO: 3269446 - protein, 25 aa, Plasmodium falciparum
LYESYSSNFRSVFRLINVNNNPLEE

SEQ ID NO: 3269447 - protein, 24 aa, Plasmodium falciparum
LYEVFYRNICLIINKKMKEINMSI

SEQ ID NO: 3269448 - protein, 21 aa, Plasmodium falciparum
LYEYYKNYFLSNSYFVQFLDN

SEQ ID NO: 3269449 - protein, 17 aa, Plasmodium falciparum
LYFAYKFLDPFYVNLLL

SEQ ID NO: 3269450 - protein, 26 aa, Plasmodium falciparum
LYFDSSALLICIMKFGCEIENFLVSF

SEQ ID NO: 3269451 - protein, 20 aa, Plasmodium falciparum
LYFEKCILPSSGSLRFPFAD

SEQ ID NO: 3269452 - protein, 18 aa, Plasmodium falciparum
LYFIDIFFNILLVDYPYK

SEQ ID NO: 3269453 - protein, 24 aa, Plasmodium falciparum
LYFIFKVLSIRIICYEFQKEIFYN

SEQ ID NO: 3269454 - protein, 18 aa, Plasmodium falciparum
LYFILLHNFIPYKNKHIY

SEQ ID NO: 3269455 - protein, 19 aa, Plasmodium falciparum
LYFILNFNVTSCFQLKRNT

SEQ ID NO: 3269456 - protein, 31 aa, Plasmodium falciparum
LYFIYEIYILLILSFRCIQNFEHVLHENNDM

SEQ ID NO: 3269457 - protein, 17 aa, Plasmodium falciparum
LYFKLYEYISRIDKFSL

SEQ ID NO: 3269458 - protein, 17 aa, Plasmodium falciparum
LYFKSDYIYTFFKKKYA

SEQ ID NO: 3269459 - protein, 17 aa, Plasmodium falciparum
LYFLKWPSVAIEENFSG

SEQ ID NO: 3269460 - protein, 18 aa, Plasmodium falciparum
LYFNSFFHMYFKSILKET

SEQ ID NO: 3269461 - protein, 23 aa, Plasmodium falciparum
LYFSDNRLNIIYNDRAEKNYIMN

SEQ ID NO: 3269462 - protein, 24 aa, Plasmodium falciparum
LYFVNELMDFINLLINHILNIYNK

SEQ ID NO: 3269463 - protein, 17 aa, Plasmodium falciparum
LYFWNITGELKFYNIQY

SEQ ID NO: 3269464 - protein, 19 aa, Plasmodium falciparum
LYFYIYFSDWHIMDKDAII

SEQ ID NO: 3269465 - protein, 24 aa, Plasmodium falciparum
LYGDMTFLEAFIKTNLVLNITVTR

SEQ ID NO: 3269466 - protein, 19 aa, Plasmodium falciparum
LYGLLCFSINLYVNQWEEY

SEQ ID NO: 3269467 - protein, 17 aa, Plasmodium falciparum
LYGNPFIGKSTMLRIYN

SEQ ID NO: 3269468 - protein, 18 aa, Plasmodium falciparum
LYHFTFFYLYNTLKCTLT

SEQ ID NO: 3269469 - protein, 24 aa, Plasmodium falciparum
LYHIKRRIDINIIYDDGKHMVKEF

SEQ ID NO: 3269470 - protein, 20 aa, Plasmodium falciparum
LYHILLFDLYFCEQVLDKNS

SEQ ID NO: 3269471 - protein, 25 aa, Plasmodium falciparum
LYHLFLNVYVKYEYKFEESNFYEGE

SEQ ID NO: 3269472 - protein, 34 aa, Plasmodium falciparum
LYHLHTFLHIFLLNRFPYFFQYLYKNHKCKCLYF

SEQ ID NO: 3269473 - protein, 17 aa, Plasmodium falciparum
LYHSYKLSYNYQKNLIT

SEQ ID NO: 3269474 - protein, 23 aa, Plasmodium falciparum
LYHTCIMEPCPILTIAQQNTLKI

SEQ ID NO: 3269475 - protein, 24 aa, Plasmodium falciparum
LYICAYKLVYNFLINLNKNIAFYN

SEQ ID NO: 3269476 - protein, 19 aa, Plasmodium falciparum
LYIFFFLKLYVELNKIFFV

SEQ ID NO: 3269477 - protein, 18 aa, Plasmodium falciparum
LYIFLGSVVHLKVPIENA

SEQ ID NO: 3269478 - protein, 22 aa, Plasmodium falciparum
LYIGNLYLQYILMFNYLNIYMS

SEQ ID NO: 3269479 - protein, 22 aa, Plasmodium falciparum
LYIICLTLLYAYLAFQEDENYS

SEQ ID NO: 3269480 - protein, 17 aa, Plasmodium falciparum
LYIIINIKKSFYEKNFI

SEQ ID NO: 3269481 - protein, 17 aa, Plasmodium falciparum
LYIKKIYSAVIFYLEKY

SEQ ID NO: 3269482 - protein, 23 aa, Plasmodium falciparum
LYIKTRWFTLLGLFITYILRVYY

SEQ ID NO: 3269483 - protein, 17 aa, Plasmodium falciparum
LYIKYQLNYGSMFFPFN

SEQ ID NO: 3269484 - protein, 43 aa, Plasmodium falciparum
LYILCSFQNLFMCISLNIKNEWRKSVFTNIAFIIWMSFLLLMN

SEQ ID NO: 3269485 - protein, 24 aa, Plasmodium falciparum
LYILMKARFNLIIQNLLYIKNVNE

SEQ ID NO: 3269486 - protein, 29 aa, Plasmodium falciparum
LYILSYEQYEVFVGFVAFISSIVNFGAPL

SEQ ID NO: 3269487 - protein, 28 aa, Plasmodium falciparum
LYIMIFNTCRELYKKLYVNGFISGECLL

SEQ ID NO: 3269488 - protein, 20 aa, Plasmodium falciparum
LYIMRIFLLNYFVLFFLSVL

SEQ ID NO: 3269489 - protein, 18 aa, Plasmodium falciparum
LYINIILIFMYIYCFFII

SEQ ID NO: 3269490 - protein, 25 aa, Plasmodium falciparum
LYINIYLCQIFFILLNILRINNTNI

SEQ ID NO: 3269491 - protein, 38 aa, Plasmodium falciparum
LYIPCIKYGKYISWIQKMCYLYFLIQIMKKNKMEQNKK

SEQ ID NO: 3269492 - protein, 30 aa, Plasmodium falciparum
LYIPELKSYVKAHKDFMLFATQNPANNNSY

SEQ ID NO: 3269493 - protein, 27 aa, Plasmodium falciparum
LYISRCYKNFLLILAQMFKIYHENELI

SEQ ID NO: 3269494 - protein, 18 aa, Plasmodium falciparum
LYIVCLIIPSLLYYFQNI

SEQ ID NO: 3269495 - protein, 20 aa, Plasmodium falciparum
LYIYLIDISLSYLFTPNMGI

SEQ ID NO: 3269496 - protein, 17 aa, Plasmodium falciparum
LYKDFNNSCFLNLPILF

SEQ ID NO: 3269497 - protein, 31 aa, Plasmodium falciparum
LYKEKRHVSNMVVCFYILKQLVKIYNFEKED

SEQ ID NO: 3269498 - protein, 18 aa, Plasmodium falciparum
LYKEVLKTIIDLIENIID

SEQ ID NO: 3269499 - protein, 18 aa, Plasmodium falciparum
LYKGFTFSSLTTIPATCL

SEQ ID NO: 3269500 - protein, 23 aa, Plasmodium falciparum
LYKGKRKKSNFLYSMRNSYYTFL

SEQ ID NO: 3269501 - protein, 23 aa, Plasmodium falciparum
LYKIKNKYLFLLYQTYMICISYI

SEQ ID NO: 3269502 - protein, 26 aa, Plasmodium falciparum
LYKILLSRFQYEFFLMSDSFYHLNRK

SEQ ID NO: 3269503 - protein, 26 aa, Plasmodium falciparum
LYKKECDELYMLKSTIFINKNIYHNR

SEQ ID NO: 3269504 - protein, 23 aa, Plasmodium falciparum
LYKKELYHYMNLFNNIENVKNMY

SEQ ID NO: 3269505 - protein, 21 aa, Plasmodium falciparum
LYKKINYVYERNIKEKNINDI

SEQ ID NO: 3269506 - protein, 26 aa, Plasmodium falciparum
LYKLNYLKLDIIFLLFSILINNTINF

SEQ ID NO: 3269507 - protein, 26 aa, Plasmodium falciparum
LYKLSIKLYKSYYYHASILHYHTSQQ

SEQ ID NO: 3269508 - protein, 26 aa, Plasmodium falciparum
LYKNNDVMYFYVIKGKEVGLYEITKF

SEQ ID NO: 3269509 - protein, 18 aa, Plasmodium falciparum
LYKNYLLYIHQNYLGMKK

SEQ ID NO: 3269510 - protein, 27 aa, Plasmodium falciparum
LYKSIKIFVIYLYFNLPKSMCHYFLNI

SEQ ID NO: 3269511 - protein, 30 aa, Plasmodium falciparum
LYKSQDIFEIFYFYLSHFEPIYMSYFEYYS

SEQ ID NO: 3269512 - protein, 25 aa, Plasmodium falciparum
LYKYCKNNINILLYIYVMHIYINKL

SEQ ID NO: 3269513 - protein, 19 aa, Plasmodium falciparum
LYKYFSLYMFLIYYKYRYV

SEQ ID NO: 3269514 - protein, 21 aa, Plasmodium falciparum
LYKYLKIDASPVLLHDFYENW

SEQ ID NO: 3269515 - protein, 25 aa, Plasmodium falciparum
LYKYTRYIFCFIIAKLLYDVVTNLK

SEQ ID NO: 3269516 - protein, 18 aa, Plasmodium falciparum
LYLCCGIETIISKKLFLP

SEQ ID NO: 3269517 - protein, 17 aa, Plasmodium falciparum
LYLFDMIPKSNIYKKMY

SEQ ID NO: 3269518 - protein, 17 aa, Plasmodium falciparum
LYLFIFNQLIRIRVNKI

SEQ ID NO: 3269519 - protein, 28 aa, Plasmodium falciparum
LYLFKIKKCDILYYFTCNYSVIKSNKEN

SEQ ID NO: 3269520 - protein, 17 aa, Plasmodium falciparum
LYLIKSWNKNFEKNMFK

SEQ ID NO: 3269521 - protein, 24 aa, Plasmodium falciparum
LYLIVIFCLQWESVVSISISPQKR

SEQ ID NO: 3269522 - protein, 19 aa, Plasmodium falciparum
LYLKVRNSISFNDNIKIDD

SEQ ID NO: 3269523 - protein, 17 aa, Plasmodium falciparum
LYLLLSVAYYDLGKYHK

SEQ ID NO: 3269524 - protein, 20 aa, Plasmodium falciparum
LYLLSFLIFHIYELLNKKHM

SEQ ID NO: 3269525 - protein, 19 aa, Plasmodium falciparum
LYLNLKRELNEIIKEYEEN

SEQ ID NO: 3269526 - protein, 18 aa, Plasmodium falciparum
LYLPFSIFVYKYINIYIN

SEQ ID NO: 3269527 - protein, 17 aa, Plasmodium falciparum
LYLRLMSLFINIIIGIY

SEQ ID NO: 3269528 - protein, 19 aa, Plasmodium falciparum
LYLSKFGFKEIGLVDGDKV

SEQ ID NO: 3269529 - protein, 23 aa, Plasmodium falciparum
LYLSLPITLLMNIPYQIIMICTN

SEQ ID NO: 3269530 - protein, 28 aa, Plasmodium falciparum
LYLYIICELCLILAIVFCVCNLDLTNKN

SEQ ID NO: 3269531 - protein, 17 aa, Plasmodium falciparum
LYLYLIPIPPTNVVNIV

SEQ ID NO: 3269532 - protein, 19 aa, Plasmodium falciparum
LYMLGSALTTYLFLGALGP

SEQ ID NO: 3269533 - protein, 22 aa, Plasmodium falciparum
LYMMDCYNSIFLDNEVKENVLK

SEQ ID NO: 3269534 - protein, 33 aa, Plasmodium falciparum
LYMRDIFEFLNLFDLKLLKNILFINIQILTFIY

SEQ ID NO: 3269535 - protein, 18 aa, Plasmodium falciparum
LYMRKWIHRYNEKAKFNN

SEQ ID NO: 3269536 - protein, 33 aa, Plasmodium falciparum
LYMSYKLIICICIPKLIFYMLLWMKNLLLHQYK

SEQ ID NO: 3269537 - protein, 19 aa, Plasmodium falciparum
LYNDICVCINNLNNMKVKK

SEQ ID NO: 3269538 - protein, 18 aa, Plasmodium falciparum
LYNEFILDYNEIDWALES

SEQ ID NO: 3269539 - protein, 27 aa, Plasmodium falciparum
LYNEIKELWPLIITFNFTLVFGNICLK

SEQ ID NO: 3269540 - protein, 24 aa, Plasmodium falciparum
LYNELKMDYDILIERTWCCNMDNI

SEQ ID NO: 3269541 - protein, 37 aa, Plasmodium falciparum
LYNIKKKKNFLFKNFILQKLFWVYKINKHNIQIKQNN

SEQ ID NO: 3269542 - protein, 18 aa, Plasmodium falciparum
LYNILPYIVENAIKELEI

SEQ ID NO: 3269543 - protein, 21 aa, Plasmodium falciparum
LYNIPLFYALSRRRYNMNCFK

SEQ ID NO: 3269544 - protein, 20 aa, Plasmodium falciparum
LYNIREAYVSKEIFHIYLEK

SEQ ID NO: 3269545 - protein, 24 aa, Plasmodium falciparum
LYNKEFIMLLSAICIYNNNYSYIP

SEQ ID NO: 3269546 - protein, 25 aa, Plasmodium falciparum
LYNKYKLKLDRLFNKKKELGQDKMQ

SEQ ID NO: 3269547 - protein, 18 aa, Plasmodium falciparum
LYNLEWFNKFNLHHLYNV

SEQ ID NO: 3269548 - protein, 18 aa, Plasmodium falciparum
LYNLKCKHSYRRLMKRIK

SEQ ID NO: 3269549 - protein, 18 aa, Plasmodium falciparum
LYNLRFSLFRDRVNAYTI

SEQ ID NO: 3269550 - protein, 23 aa, Plasmodium falciparum
LYNMPIFLSLFLRCVTIHLHYFK

SEQ ID NO: 3269551 - protein, 18 aa, Plasmodium falciparum
LYNMPIYIFQFFNNLIRR

SEQ ID NO: 3269552 - protein, 32 aa, Plasmodium falciparum
LYNNIKALLKWRICIYGIFNINQWVKLFENVL

SEQ ID NO: 3269553 - protein, 27 aa, Plasmodium falciparum
LYNNILLCVIDKYYLILKMNQDEFDIV

SEQ ID NO: 3269554 - protein, 24 aa, Plasmodium falciparum
LYNRLNSYMPYQLILLLRAFAYCN

SEQ ID NO: 3269555 - protein, 17 aa, Plasmodium falciparum
LYNSLNFLLKSINEYLD

SEQ ID NO: 3269556 - protein, 20 aa, Plasmodium falciparum
LYNSMILFHRLIEFIDRPIF

SEQ ID NO: 3269557 - protein, 23 aa, Plasmodium falciparum
LYNTIFFIYSFNIFIPIIIYLTI

SEQ ID NO: 3269558 - protein, 18 aa, Plasmodium falciparum
LYPHLKFTLNGGIQTIQE

SEQ ID NO: 3269559 - protein, 19 aa, Plasmodium falciparum
LYPKKSFLFLHSYKKYIDI

SEQ ID NO: 3269560 - protein, 24 aa, Plasmodium falciparum
LYPNVFFHKLMLYYFLKKSDYSSN

SEQ ID NO: 3269561 - protein, 21 aa, Plasmodium falciparum
LYPTFCIKRGKNIVDKLSKSK

SEQ ID NO: 3269562 - protein, 17 aa, Plasmodium falciparum
LYPTLYYHRNAFIKSFV

SEQ ID NO: 3269563 - protein, 19 aa, Plasmodium falciparum
LYQDVCLNIIKYTKKTHFS

SEQ ID NO: 3269564 - protein, 23 aa, Plasmodium falciparum
LYQFTYKMPFLYKNYDNDNKIIN

SEQ ID NO: 3269565 - protein, 27 aa, Plasmodium falciparum
LYQKKINLFKCYKKLFYILEEQYDQCD

SEQ ID NO: 3269566 - protein, 30 aa, Plasmodium falciparum
LYRDRLIKFPSFLSNFSFIYFLPWPYEALV

SEQ ID NO: 3269567 - protein, 19 aa, Plasmodium falciparum
LYSAIGYSVLAIFIILLVM

SEQ ID NO: 3269568 - protein, 18 aa, Plasmodium falciparum
LYSAIGYSVLAIFIIVLV

SEQ ID NO: 3269569 - protein, 17 aa, Plasmodium falciparum
LYSAIGYSVLAILIIVL

SEQ ID NO: 3269570 - protein, 19 aa, Plasmodium falciparum
LYSDLFYRIIRNTPFRKNE

SEQ ID NO: 3269571 - protein, 17 aa, Plasmodium falciparum
LYSECKHTPNGCQNEGY

SEQ ID NO: 3269572 - protein, 27 aa, Plasmodium falciparum
LYSHIKRIFKILYKYGNYLLKDEYYIN

SEQ ID NO: 3269573 - protein, 18 aa, Plasmodium falciparum
LYSIVAFIMRIICYHSVY

SEQ ID NO: 3269574 - protein, 19 aa, Plasmodium falciparum
LYSKLPMKDQMELFHNPKE

SEQ ID NO: 3269575 - protein, 27 aa, Plasmodium falciparum
LYSMLYMKKLPCNKIYNFVLNEINYNL

SEQ ID NO: 3269576 - protein, 27 aa, Plasmodium falciparum
LYSNDFLNIIDPILFENYDNINLDEYI

SEQ ID NO: 3269577 - protein, 19 aa, Plasmodium falciparum
LYSNLAILLMCEIMDLYFS

SEQ ID NO: 3269578 - protein, 17 aa, Plasmodium falciparum
LYSTCTVINEFNVLLEL

SEQ ID NO: 3269579 - protein, 19 aa, Plasmodium falciparum
LYSTNIYTSLYIYLIDISL

SEQ ID NO: 3269580 - protein, 19 aa, Plasmodium falciparum
LYTLIKINIIDDFFLYHKY

SEQ ID NO: 3269581 - protein, 20 aa, Plasmodium falciparum
LYTLLCKIFDNFTKYNIYFE

SEQ ID NO: 3269582 - protein, 25 aa, Plasmodium falciparum
LYTSICPTFSHILFLLISILYVENY

SEQ ID NO: 3269583 - protein, 17 aa, Plasmodium falciparum
LYTSLLHFIFYMKQAFS

SEQ ID NO: 3269584 - protein, 26 aa, Plasmodium falciparum
LYTYFQWILTYSWNRFLINLSESKSL

SEQ ID NO: 3269585 - protein, 24 aa, Plasmodium falciparum
LYTYPKFLYIFNIIKIKHFREEIK

SEQ ID NO: 3269586 - protein, 25 aa, Plasmodium falciparum
LYVFNNLALFEWFVFEVKSFLVYVS

SEQ ID NO: 3269587 - protein, 17 aa, Plasmodium falciparum
LYVGTFIASIAFIGSLV

SEQ ID NO: 3269588 - protein, 18 aa, Plasmodium falciparum
LYVKHFVDIIMNKSLEEI

SEQ ID NO: 3269589 - protein, 20 aa, Plasmodium falciparum
LYVMIYMRLLFECSLKLISI

SEQ ID NO: 3269590 - protein, 18 aa, Plasmodium falciparum
LYVNIALCQIKIYQYENA

SEQ ID NO: 3269591 - protein, 21 aa, Plasmodium falciparum
LYWKNCCLNVTDVKANVTLFF

SEQ ID NO: 3269592 - protein, 18 aa, Plasmodium falciparum
LYYCDILFHNKNKQVHSI

SEQ ID NO: 3269593 - protein, 18 aa, Plasmodium falciparum
LYYCPVFKYNSSTQKNDK

SEQ ID NO: 3269594 - protein, 26 aa, Plasmodium falciparum
LYYDINCVYKILFYMYEICLYYLCSS

SEQ ID NO: 3269595 - protein, 18 aa, Plasmodium falciparum
LYYFEYIYIMNKNTLNLL

SEQ ID NO: 3269596 - protein, 25 aa, Plasmodium falciparum
LYYFKYKLKLNVCDFYYICKSDHRK

SEQ ID NO: 3269597 - protein, 23 aa, Plasmodium falciparum
LYYFVHMCIIIKLSSNITLLLFR

SEQ ID NO: 3269598 - protein, 25 aa, Plasmodium falciparum
LYYKEGKYCVYFFNVLQYDYRNMLQ

SEQ ID NO: 3269599 - protein, 23 aa, Plasmodium falciparum
LYYKYNCAREELLYEMKKHENKY

SEQ ID NO: 3269600 - protein, 17 aa, Plasmodium falciparum
LYYLKKIKFRKEWNRYY

SEQ ID NO: 3269601 - protein, 17 aa, Plasmodium falciparum
LYYLNGHYLMDKNEKNE

SEQ ID NO: 3269602 - protein, 25 aa, Plasmodium falciparum
LYYNFLKYLFARCILCSNNRVEENK

SEQ ID NO: 3269603 - protein, 19 aa, Plasmodium falciparum
LYYNICTTLSISNSMESAS

SEQ ID NO: 3269604 - protein, 17 aa, Plasmodium falciparum
LYYNIFFIYNLLPIFIK

SEQ ID NO: 3269605 - protein, 19 aa, Plasmodium falciparum
LYYRQIIHHLLFLYYYFTV

SEQ ID NO: 3269606 - protein, 25 aa, Plasmodium falciparum
LYYSKRCYHILSSRLNDICFDFIYI

SEQ ID NO: 3269607 - protein, 17 aa, Plasmodium falciparum
LYYYAFHYIFLLLYIKK

SEQ ID NO: 3269608 - protein, 20 aa, Plasmodium falciparum
LYYYDCMVSQHIFQNINGQE

SEQ ID NO: 3269609 - protein, 17 aa, Plasmodium falciparum
LYYYFFIETCVNSCYFD

SEQ ID NO: 3269610 - protein, 19 aa, Plasmodium falciparum
LYYYKVVVDKIIKKDMLDI

SEQ ID NO: 3269611 - protein, 19 aa, Plasmodium falciparum
MAAFYPWGIAALVLLILVV

SEQ ID NO: 3269612 - protein, 37 aa, Plasmodium falciparum
MADSCAYNSENDCIYIKGFIKGVGFNYHNPIHITDVG

SEQ ID NO: 3269613 - protein, 20 aa, Plasmodium falciparum
MAGLAVWNILKSEFKVLQRI

SEQ ID NO: 3269614 - protein, 25 aa, Plasmodium falciparum
MALCITPCNLFMCYKIVHCGVEWGS

SEQ ID NO: 3269615 - protein, 19 aa, Plasmodium falciparum
MAMNKSFYLFRAISENSVM

SEQ ID NO: 3269616 - protein, 19 aa, Plasmodium falciparum
MAVCKSCDVSCKIIFIPYV

SEQ ID NO: 3269617 - protein, 21 aa, Plasmodium falciparum
MCDKCISNVYIDFSHFNLAYE

SEQ ID NO: 3269618 - protein, 17 aa, Plasmodium falciparum
MCDRPFYKNILNIYFHY

SEQ ID NO: 3269619 - protein, 20 aa, Plasmodium falciparum
MCIKEQWLYKYHVKKRKHFL

SEQ ID NO: 3269620 - protein, 24 aa, Plasmodium falciparum
MCILKKLKEIFFIYQKKYAYKYDL

SEQ ID NO: 3269621 - protein, 22 aa, Plasmodium falciparum
MCIQIFLRRVLILFKKEKNEES

SEQ ID NO: 3269622 - protein, 22 aa, Plasmodium falciparum
MCKQFDYTFGMRIRLGSPVEYG

SEQ ID NO: 3269623 - protein, 20 aa, Plasmodium falciparum
MCKRCVRTFDHHCPWINNCV

SEQ ID NO: 3269624 - protein, 22 aa, Plasmodium falciparum
MCPHPLIHFTMNSFRSRFSSII

SEQ ID NO: 3269625 - protein, 23 aa, Plasmodium falciparum
MCSIYFLLIFSCIYFLTLLLYTK

SEQ ID NO: 3269626 - protein, 31 aa, Plasmodium falciparum
MCSVKLNNLWYLNFIRFMLLFSSVIPISLSV

SEQ ID NO: 3269627 - protein, 20 aa, Plasmodium falciparum
MCSYTLILHKYFTNINIASY

SEQ ID NO: 3269628 - protein, 18 aa, Plasmodium falciparum
MCVAVKFLKEKCPNKIIS

SEQ ID NO: 3269629 - protein, 22 aa, Plasmodium falciparum
MDDIWFKNIIHSILLEKIILIL

SEQ ID NO: 3269630 - protein, 17 aa, Plasmodium falciparum
MDDRLKYFLNIDLRKNL

SEQ ID NO: 3269631 - protein, 19 aa, Plasmodium falciparum
MDEIIKCSIILNRNAYYVC

SEQ ID NO: 3269632 - protein, 19 aa, Plasmodium falciparum
MDFYKDWREFEALHGNENT

SEQ ID NO: 3269633 - protein, 25 aa, Plasmodium falciparum
MDIDIFLKIFVSIFMVDNSKSIGDY

SEQ ID NO: 3269634 - protein, 23 aa, Plasmodium falciparum
MDIELYPLTLLLIINNLDNKYIK

SEQ ID NO: 3269635 - protein, 18 aa, Plasmodium falciparum
MDIHMKKIILENLYFCKD

SEQ ID NO: 3269636 - protein, 19 aa, Plasmodium falciparum
MDIINEFYFLIEFFNNLPI

SEQ ID NO: 3269637 - protein, 25 aa, Plasmodium falciparum
MDIKYKIKLLINFVKLNLEYIKEPY

SEQ ID NO: 3269638 - protein, 24 aa, Plasmodium falciparum
MDINSIKLAEDWPKGLKNIINKLL

SEQ ID NO: 3269639 - protein, 17 aa, Plasmodium falciparum
MDKGEYASDHFIHNEDE

SEQ ID NO: 3269640 - protein, 19 aa, Plasmodium falciparum
MDLDCPRCEEECRKYDEWI

SEQ ID NO: 3269641 - protein, 17 aa, Plasmodium falciparum
MDLYMKTYIMHIKIIVF

SEQ ID NO: 3269642 - protein, 17 aa, Plasmodium falciparum
MDMKKLLDEIGVDDMYE

SEQ ID NO: 3269643 - protein, 23 aa, Plasmodium falciparum
MDMPYCKSGINKRDIIQPLKDIN

SEQ ID NO: 3269644 - protein, 24 aa, Plasmodium falciparum
MDNEVIKIFCNFFQYIYINEYLIR

SEQ ID NO: 3269645 - protein, 19 aa, Plasmodium falciparum
MDNFFQLDNKLSFEKEQIV

SEQ ID NO: 3269646 - protein, 20 aa, Plasmodium falciparum
MDNLETVNLFYIFLKENNKK

SEQ ID NO: 3269647 - protein, 19 aa, Plasmodium falciparum
MDPYFLSTINFYFLNNLNK

SEQ ID NO: 3269648 - protein, 23 aa, Plasmodium falciparum
MDQFFRWYIEWTEQYCDQKLLKM

SEQ ID NO: 3269649 - protein, 23 aa, Plasmodium falciparum
MDQKQYICKRCFDLKHKNKITNN

SEQ ID NO: 3269650 - protein, 25 aa, Plasmodium falciparum
MDTLECFLHSLRLQWVEFQNKFYKG

SEQ ID NO: 3269651 - protein, 19 aa, Plasmodium falciparum
MDYILLELCKERLNKICND

SEQ ID NO: 3269652 - protein, 23 aa, Plasmodium falciparum
MDYKSPENLFMFDQEYNINEDHK

SEQ ID NO: 3269653 - protein, 17 aa, Plasmodium falciparum
MDYRRLRRRFSGIRKPI

SEQ ID NO: 3269654 - protein, 26 aa, Plasmodium falciparum
MEALKELNTEFSILFIILILMFLTAT

SEQ ID NO: 3269655 - protein, 21 aa, Plasmodium falciparum
MEEWKMLMVTLQSRYGYGSDL

SEQ ID NO: 3269656 - protein, 21 aa, Plasmodium falciparum
MEFFLHIKALVYLKFGYINRA

SEQ ID NO: 3269657 - protein, 27 aa, Plasmodium falciparum
MEFNVFFQRWLRYFVYDYNILKDKIKA

SEQ ID NO: 3269658 - protein, 18 aa, Plasmodium falciparum
MEILFKENMRYILRLMAL

SEQ ID NO: 3269659 - protein, 18 aa, Plasmodium falciparum
MEILHVRLNQYDILSHGC

SEQ ID NO: 3269660 - protein, 24 aa, Plasmodium falciparum
MEKECLRCAQNLGGIVAPSSGVLA

SEQ ID NO: 3269661 - protein, 24 aa, Plasmodium falciparum
MEKGCLRCGSILGAAMPEMGSIGG

SEQ ID NO: 3269662 - protein, 17 aa, Plasmodium falciparum
MEKGICMDMYIMKDNNL

SEQ ID NO: 3269663 - protein, 23 aa, Plasmodium falciparum
MEKQRLPFTTAYILSLLSTLYFT

SEQ ID NO: 3269664 - protein, 23 aa, Plasmodium falciparum
MEKSSDWLYLFLSLSLNIEKYSN

SEQ ID NO: 3269665 - protein, 22 aa, Plasmodium falciparum
MELCLCMLTFFSYEHKLLKSKE

SEQ ID NO: 3269666 - protein, 24 aa, Plasmodium falciparum
MELLYKPSILFFQKIILLNFLSIY

SEQ ID NO: 3269667 - protein, 18 aa, Plasmodium falciparum
MELRLANENIINFVHNKN

SEQ ID NO: 3269668 - protein, 21 aa, Plasmodium falciparum
MENKIPIYYFLKKDIKIDTFT

SEQ ID NO: 3269669 - protein, 17 aa, Plasmodium falciparum
MESVWWVFSELYKNNYI

SEQ ID NO: 3269670 - protein, 23 aa, Plasmodium falciparum
METLLDFTPNFYFTVKDEEELYK

SEQ ID NO: 3269671 - protein, 18 aa, Plasmodium falciparum
METMKFPNKYYPWDNKNV

SEQ ID NO: 3269672 - protein, 25 aa, Plasmodium falciparum
MEYIKKCPFFYQIPSHLYKEKIYIF

SEQ ID NO: 3269673 - protein, 17 aa, Plasmodium falciparum
MFCYDRIKTFKGHKSSI

SEQ ID NO: 3269674 - protein, 20 aa, Plasmodium falciparum
MFDLSKVMFINTHLYSSSIL

SEQ ID NO: 3269675 - protein, 19 aa, Plasmodium falciparum
MFDRSCSIPGLNNMNDDVN

SEQ ID NO: 3269676 - protein, 19 aa, Plasmodium falciparum
MFDSEFLKIDMGKFKKRGN

SEQ ID NO: 3269677 - protein, 18 aa, Plasmodium falciparum
MFEKQCNILENINKDYKL

SEQ ID NO: 3269678 - protein, 24 aa, Plasmodium falciparum
MFELIKRKYIKSFLNNTHISYDKN

SEQ ID NO: 3269679 - protein, 24 aa, Plasmodium falciparum
MFGEAFRSADFVLELALELEQLFQ

SEQ ID NO: 3269680 - protein, 19 aa, Plasmodium falciparum
MFHFYKFFNDYVEEFLHFL

SEQ ID NO: 3269681 - protein, 25 aa, Plasmodium falciparum
MFHRPNMLNLSYDWDSFQKDIMVLV

SEQ ID NO: 3269682 - protein, 23 aa, Plasmodium falciparum
MFIFAECRLEWIMKELKWNVENI

SEQ ID NO: 3269683 - protein, 22 aa, Plasmodium falciparum
MFIINFINSFFFQNNILSKYII

SEQ ID NO: 3269684 - protein, 24 aa, Plasmodium falciparum
MFILYNRGFFDLIINNLNFVSSND

SEQ ID NO: 3269685 - protein, 24 aa, Plasmodium falciparum
MFIPKYFLTMTRWRNFLLEYRKIM

SEQ ID NO: 3269686 - protein, 33 aa, Plasmodium falciparum
MFISFQVCWFLLCVLCFFLSYYNLYNFWKCSKE

SEQ ID NO: 3269687 - protein, 19 aa, Plasmodium falciparum
MFKHNIIRLYSNIEKILPQ

SEQ ID NO: 3269688 - protein, 19 aa, Plasmodium falciparum
MFKKIFYRIKKIIVDKKGT

SEQ ID NO: 3269689 - protein, 19 aa, Plasmodium falciparum
MFKKMARIMIDNFFNYTYD

SEQ ID NO: 3269690 - protein, 37 aa, Plasmodium falciparum
MFKLIPFSFFIIIPFAEFLLPIFLKIYPNLLPSTFKN

SEQ ID NO: 3269691 - protein, 22 aa, Plasmodium falciparum
MFLFIHIIKYVSCEEYKINKEE

SEQ ID NO: 3269692 - protein, 22 aa, Plasmodium falciparum
MFLKILIGLLISWTIQNTPQII

SEQ ID NO: 3269693 - protein, 17 aa, Plasmodium falciparum
MFMASFIPSILNKIINV

SEQ ID NO: 3269694 - protein, 17 aa, Plasmodium falciparum
MFNCSSVATSLQAGGAT

SEQ ID NO: 3269695 - protein, 25 aa, Plasmodium falciparum
MFQVREIQPLFSVLLEKINVIPVKI

SEQ ID NO: 3269696 - protein, 17 aa, Plasmodium falciparum
MFSCIGASLSIYFYLDL

SEQ ID NO: 3269697 - protein, 22 aa, Plasmodium falciparum
MFSNGKWIFTMPLFNPNKRKCE

SEQ ID NO: 3269698 - protein, 36 aa, Plasmodium falciparum
MFSNLDCRPCYKQCRKYRKWIDIKFEEFRKQEKKYE

SEQ ID NO: 3269699 - protein, 25 aa, Plasmodium falciparum
MFTLIKLIVSILFYVSKLCFKIFQL

SEQ ID NO: 3269700 - protein, 22 aa, Plasmodium falciparum
MFTLSFFYRLFFNKISYLDNID

SEQ ID NO: 3269701 - protein, 18 aa, Plasmodium falciparum
MFTYELIFAFSMYAFSYI

SEQ ID NO: 3269702 - protein, 28 aa, Plasmodium falciparum
MFVRIKKLILSFSIYLIICSCVMNNKWF

SEQ ID NO: 3269703 - protein, 24 aa, Plasmodium falciparum
MFVTSCSRSPLLGFQELYPKFCIY

SEQ ID NO: 3269704 - protein, 20 aa, Plasmodium falciparum
MGAGAISFVHIVKASAPLFA

SEQ ID NO: 3269705 - protein, 25 aa, Plasmodium falciparum
MGAITPCWGLVSGLGYYRWEIAATA

SEQ ID NO: 3269706 - protein, 19 aa, Plasmodium falciparum
MGALYPWGIAALVLLILAI

SEQ ID NO: 3269707 - protein, 19 aa, Plasmodium falciparum
MGCIGGYIWHFLKGARNSP

SEQ ID NO: 3269708 - protein, 23 aa, Plasmodium falciparum
MGKAETEEGDWLFIEQLIMSIMN

SEQ ID NO: 3269709 - protein, 18 aa, Plasmodium falciparum
MGKKVLKSKQPSIINDHT

SEQ ID NO: 3269710 - protein, 30 aa, Plasmodium falciparum
MGLFSHVHLSLKLLLHILLNIFYKEKTTYN

SEQ ID NO: 3269711 - protein, 19 aa, Plasmodium falciparum
MGNDYCCNYIYNIYENNWK

SEQ ID NO: 3269712 - protein, 17 aa, Plasmodium falciparum
MGVKMGTMVGGIFGSLT

SEQ ID NO: 3269713 - protein, 19 aa, Plasmodium falciparum
MGYDMAYKPFEFHEKTKKK

SEQ ID NO: 3269714 - protein, 20 aa, Plasmodium falciparum
MGYITFYSFENIEFNLYTLK

SEQ ID NO: 3269715 - protein, 24 aa, Plasmodium falciparum
MHERQCGLSSAYIVYEKEQLEILE

SEQ ID NO: 3269716 - protein, 18 aa, Plasmodium falciparum
MHIYSYVCTHAIKMKSPL

SEQ ID NO: 3269717 - protein, 25 aa, Plasmodium falciparum
MHLIICSIVSFVLLICILNYIIYYK

SEQ ID NO: 3269718 - protein, 25 aa, Plasmodium falciparum
MHNLTPLCSFLNTFVPNDYSITNFF

SEQ ID NO: 3269719 - protein, 21 aa, Plasmodium falciparum
MHPFVKYELIWDVKNDIARNK

SEQ ID NO: 3269720 - protein, 19 aa, Plasmodium falciparum
MHSMKCKKNDIDVYITMGS

SEQ ID NO: 3269721 - protein, 17 aa, Plasmodium falciparum
MHTVFYAEWVWDLFHIY

SEQ ID NO: 3269722 - protein, 18 aa, Plasmodium falciparum
MHVFLKIFYNINMIDLPE

SEQ ID NO: 3269723 - protein, 18 aa, Plasmodium falciparum
MIALACAPHMARKYPSNY

SEQ ID NO: 3269724 - protein, 17 aa, Plasmodium falciparum
MICGYKDAIGGDMNSLP

SEQ ID NO: 3269725 - protein, 22 aa, Plasmodium falciparum
MICILYPLVIYNILRKMNNPTY

SEQ ID NO: 3269726 - protein, 39 aa, Plasmodium falciparum
MICIQFPKLKILWSPFSLFTVKLFWSLKVNASQPDIFKS

SEQ ID NO: 3269727 - protein, 17 aa, Plasmodium falciparum
MIDEKLNLITLFLFIIL

SEQ ID NO: 3269728 - protein, 23 aa, Plasmodium falciparum
MIDHYFKPARGLLINILDHHTYN

SEQ ID NO: 3269729 - protein, 32 aa, Plasmodium falciparum
MIDQKGRIILLFKKHIYSFIISKILLNNNNVT

SEQ ID NO: 3269730 - protein, 17 aa, Plasmodium falciparum
MIDRDLFHINIGWLQID

SEQ ID NO: 3269731 - protein, 26 aa, Plasmodium falciparum
MIDTLLTCYEKSNILIYDKIIPRLIE

SEQ ID NO: 3269732 - protein, 23 aa, Plasmodium falciparum
MIEEAPTMKKCINDELYKIKINV

SEQ ID NO: 3269733 - protein, 20 aa, Plasmodium falciparum
MIFFLIKWIPMLVFSIILSC

SEQ ID NO: 3269734 - protein, 21 aa, Plasmodium falciparum
MIFVFYIFYFRLFKRRYTSNE

SEQ ID NO: 3269735 - protein, 23 aa, Plasmodium falciparum
MIGVNLLLLFSMFLYGINYILMK

SEQ ID NO: 3269736 - protein, 18 aa, Plasmodium falciparum
MIHMYHLKGSYQSNDDIQ

SEQ ID NO: 3269737 - protein, 19 aa, Plasmodium falciparum
MIIKNCHQFLIFIYLFIFI

SEQ ID NO: 3269738 - protein, 24 aa, Plasmodium falciparum
MIILENLFGLPFSSFLTNVEKICF

SEQ ID NO: 3269739 - protein, 25 aa, Plasmodium falciparum
MIIYDLLELHSYLSIKNGTEDIIKK

SEQ ID NO: 3269740 - protein, 18 aa, Plasmodium falciparum
MIKGSTLLNVLNNELHKC

SEQ ID NO: 3269741 - protein, 22 aa, Plasmodium falciparum
MIKNKTTCCINDDLWKTVLNPF

SEQ ID NO: 3269742 - protein, 22 aa, Plasmodium falciparum
MIKNMMSFHFFYLFLTTLLNNS

SEQ ID NO: 3269743 - protein, 21 aa, Plasmodium falciparum
MIKYYMRKYVRLEFVNIDNAL

SEQ ID NO: 3269744 - protein, 18 aa, Plasmodium falciparum
MILDNFFYKNHMIGEKNQ

SEQ ID NO: 3269745 - protein, 22 aa, Plasmodium falciparum
MILKKYCWYNIKNIWNSCISIY

SEQ ID NO: 3269746 - protein, 25 aa, Plasmodium falciparum
MILLFLIYIIFCFIIIIISYLNITS

SEQ ID NO: 3269747 - protein, 33 aa, Plasmodium falciparum
MILMLIPLTSIYVAEFFYLKNIFVQILMAVILI

SEQ ID NO: 3269748 - protein, 19 aa, Plasmodium falciparum
MILSIYLYIIQNWIHFYKL

SEQ ID NO: 3269749 - protein, 18 aa, Plasmodium falciparum
MILYNIINLFSLSKYKKY

SEQ ID NO: 3269750 - protein, 26 aa, Plasmodium falciparum
MINEINEFYSILNFINFSIEYMLIYC

SEQ ID NO: 3269751 - protein, 18 aa, Plasmodium falciparum
MINRESLENLGCDKKLIA

SEQ ID NO: 3269752 - protein, 23 aa, Plasmodium falciparum
MIPSHKYKSCLVGIQKIQRINNK

SEQ ID NO: 3269753 - protein, 17 aa, Plasmodium falciparum
MIQWFIFKKDKIIDNTV

SEQ ID NO: 3269754 - protein, 19 aa, Plasmodium falciparum
MIRSSDILFLVSVKNYTNL

SEQ ID NO: 3269755 - protein, 17 aa, Plasmodium falciparum
MISCPINSTTIIPASED

SEQ ID NO: 3269756 - protein, 24 aa, Plasmodium falciparum
MISFIKILLFMNAHAVMSEYGYLF

SEQ ID NO: 3269757 - protein, 24 aa, Plasmodium falciparum
MISSICSCYIKIYQKRILYCVFYI

SEQ ID NO: 3269758 - protein, 25 aa, Plasmodium falciparum
MITIHNVKFLFLQNLFTFHKKIKND

SEQ ID NO: 3269759 - protein, 17 aa, Plasmodium falciparum
MITVFIHCFKWFSIPIV

SEQ ID NO: 3269760 - protein, 18 aa, Plasmodium falciparum
MITYRCEHNLFLRINKKH

SEQ ID NO: 3269761 - protein, 23 aa, Plasmodium falciparum
MIVADYYLNITFYYIKDNFNNYY

SEQ ID NO: 3269762 - protein, 26 aa, Plasmodium falciparum
MIVKCIYKLLLCDLCILSEEVINEHE

SEQ ID NO: 3269763 - protein, 19 aa, Plasmodium falciparum
MIVTICILITILVYILLFY

SEQ ID NO: 3269764 - protein, 21 aa, Plasmodium falciparum
MIYFICLYKLHLHNEHTGALK

SEQ ID NO: 3269765 - protein, 28 aa, Plasmodium falciparum
MIYILKEIYLLLHFHITHIWITIKEHTE

SEQ ID NO: 3269766 - protein, 23 aa, Plasmodium falciparum
MIYLEKKNVYGFISNKDQAHTNK

SEQ ID NO: 3269767 - protein, 22 aa, Plasmodium falciparum
MIYNYLHFHIKKSLYNIMNVSI

SEQ ID NO: 3269768 - protein, 18 aa, Plasmodium falciparum
MIYSCFDIFFNLISTNNW

SEQ ID NO: 3269769 - protein, 21 aa, Plasmodium falciparum
MKASEIISSVAHNFSKKHFKH

SEQ ID NO: 3269770 - protein, 17 aa, Plasmodium falciparum
MKCKLYSVYGYISRNRA

SEQ ID NO: 3269771 - protein, 17 aa, Plasmodium falciparum
MKCTYKNMMSHIYAHRN

SEQ ID NO: 3269772 - protein, 26 aa, Plasmodium falciparum
MKDEFSEKILPYFFFKEDEQVWDKYI

SEQ ID NO: 3269773 - protein, 19 aa, Plasmodium falciparum
MKDGEGYQCIKDCVEKWIQ

SEQ ID NO: 3269774 - protein, 20 aa, Plasmodium falciparum
MKDILFLASRSFNFEKLSKK

SEQ ID NO: 3269775 - protein, 24 aa, Plasmodium falciparum
MKDKFKEKKIEQMITQTLGEVSQR

SEQ ID NO: 3269776 - protein, 20 aa, Plasmodium falciparum
MKEKRCELVKEKDDLIEMGN

SEQ ID NO: 3269777 - protein, 17 aa, Plasmodium falciparum
MKELELFVDSPTISLHN

SEQ ID NO: 3269778 - protein, 17 aa, Plasmodium falciparum
MKENIAFIFLKNKKKQK

SEQ ID NO: 3269779 - protein, 18 aa, Plasmodium falciparum
MKERFQVFLQNAHKVKMH

SEQ ID NO: 3269780 - protein, 19 aa, Plasmodium falciparum
MKERFQVFLQNAHKVNMHN

SEQ ID NO: 3269781 - protein, 17 aa, Plasmodium falciparum
MKESLFAKCNDVSNKNL

SEQ ID NO: 3269782 - protein, 21 aa, Plasmodium falciparum
MKETFEEVILAQANCKCQSIG

SEQ ID NO: 3269783 - protein, 17 aa, Plasmodium falciparum
MKEVYDIQPAVINKKSK

SEQ ID NO: 3269784 - protein, 18 aa, Plasmodium falciparum
MKEYKKTLQYGIEKDMTY

SEQ ID NO: 3269785 - protein, 20 aa, Plasmodium falciparum
MKFGEFEKSIFYLKESLRKF

SEQ ID NO: 3269786 - protein, 28 aa, Plasmodium falciparum
MKFPLYTESLRLYKFNDIITRTYVKNII

SEQ ID NO: 3269787 - protein, 25 aa, Plasmodium falciparum
MKFVSSLSWYFLVMFGSSGLISIID

SEQ ID NO: 3269788 - protein, 21 aa, Plasmodium falciparum
MKGDLNISDFFLKKLKKNNNK

SEQ ID NO: 3269789 - protein, 23 aa, Plasmodium falciparum
MKGNLIIEFDIIFPKKLSDEQKE

SEQ ID NO: 3269790 - protein, 17 aa, Plasmodium falciparum
MKHFKILCITIRPGEVI

SEQ ID NO: 3269791 - protein, 21 aa, Plasmodium falciparum
MKHIDIFYKYLKYFVYQNKSA

SEQ ID NO: 3269792 - protein, 18 aa, Plasmodium falciparum
MKHLCLLLYLITSNKNNN

SEQ ID NO: 3269793 - protein, 17 aa, Plasmodium falciparum
MKHLYLNILDTFDENIL

SEQ ID NO: 3269794 - protein, 17 aa, Plasmodium falciparum
MKIEPIGYLKSYYSFSY

SEQ ID NO: 3269795 - protein, 20 aa, Plasmodium falciparum
MKIFCLLSLFNVVNNLRNIY

SEQ ID NO: 3269796 - protein, 17 aa, Plasmodium falciparum
MKIFIILFLINRLPFAS

SEQ ID NO: 3269797 - protein, 19 aa, Plasmodium falciparum
MKIHLKKNILYGCDFDHDE

SEQ ID NO: 3269798 - protein, 21 aa, Plasmodium falciparum
MKIKFWCLLFAYVISFVSTTY

SEQ ID NO: 3269799 - protein, 19 aa, Plasmodium falciparum
MKIKNEFMCIELLNDINKN

SEQ ID NO: 3269800 - protein, 17 aa, Plasmodium falciparum
MKILQVFTVHSKNKTVT

SEQ ID NO: 3269801 - protein, 21 aa, Plasmodium falciparum
MKINLLETWFIQDDLFMYNNQ

SEQ ID NO: 3269802 - protein, 22 aa, Plasmodium falciparum
MKIPEYMYSYILEKKYMKSLKM

SEQ ID NO: 3269803 - protein, 26 aa, Plasmodium falciparum
MKIQSFYIFYILKICKKRYNVKYVTD

SEQ ID NO: 3269804 - protein, 27 aa, Plasmodium falciparum
MKISIAQYFLISGFVFFLFFMCFYLFD

SEQ ID NO: 3269805 - protein, 20 aa, Plasmodium falciparum
MKITFYKLKTVNVFENVYLD

SEQ ID NO: 3269806 - protein, 17 aa, Plasmodium falciparum
MKIVKKVTFIDEHEDYI

SEQ ID NO: 3269807 - protein, 17 aa, Plasmodium falciparum
MKIVTVSTLCFLTSPTS

SEQ ID NO: 3269808 - protein, 17 aa, Plasmodium falciparum
MKIYKIVLFCLFINVLF

SEQ ID NO: 3269809 - protein, 21 aa, Plasmodium falciparum
MKIYKKKNIRCEYIKIHKNMN

SEQ ID NO: 3269810 - protein, 24 aa, Plasmodium falciparum
MKIYNNCYILFDFILNKYDNNLKK

SEQ ID NO: 3269811 - protein, 17 aa, Plasmodium falciparum
MKKCGLPLNNEENKHLE

SEQ ID NO: 3269812 - protein, 24 aa, Plasmodium falciparum
MKKCGSCINIKYVFFIMKRIFEDT

SEQ ID NO: 3269813 - protein, 21 aa, Plasmodium falciparum
MKKDDLEVIENPKFANALGVS

SEQ ID NO: 3269814 - protein, 21 aa, Plasmodium falciparum
MKKDIPIKHWNHIYHKWLHEE

SEQ ID NO: 3269815 - protein, 29 aa, Plasmodium falciparum
MKKDVKLFFFKKRIIYLTDEINKKTADEL

SEQ ID NO: 3269816 - protein, 25 aa, Plasmodium falciparum
MKKEFTHYRYLKEIEKIIEHFIYTY

SEQ ID NO: 3269817 - protein, 18 aa, Plasmodium falciparum
MKKGQGFTNDFSDFHREF

SEQ ID NO: 3269818 - protein, 26 aa, Plasmodium falciparum
MKKIFWKIYIFFLFYKNRRFLKRRKE

SEQ ID NO: 3269819 - protein, 27 aa, Plasmodium falciparum
MKKITKLAMRLFYLSSVLFFKSMPSGL

SEQ ID NO: 3269820 - protein, 21 aa, Plasmodium falciparum
MKKIVLKCVKQCIQTEGVDKD

SEQ ID NO: 3269821 - protein, 28 aa, Plasmodium falciparum
MKKLWKKHFNCYYCNDLINLKNDIFCIA

SEQ ID NO: 3269822 - protein, 25 aa, Plasmodium falciparum
MKKNYGGAIDFHFHIEKSWKQIHSI

SEQ ID NO: 3269823 - protein, 22 aa, Plasmodium falciparum
MKKRKKIRIKRNYKSTYKNLHC

SEQ ID NO: 3269824 - protein, 18 aa, Plasmodium falciparum
MKKRYAIYMHNFNIHSLF

SEQ ID NO: 3269825 - protein, 20 aa, Plasmodium falciparum
MKKTELYNDFYIPEEKKNVN

SEQ ID NO: 3269826 - protein, 22 aa, Plasmodium falciparum
MKLEGDIPYRVFIKNKFYPGLA

SEQ ID NO: 3269827 - protein, 17 aa, Plasmodium falciparum
MKLGTLMLLGFGEAGAK

SEQ ID NO: 3269828 - protein, 23 aa, Plasmodium falciparum
MKLIKDYLYGIIINSYYENIYDV

SEQ ID NO: 3269829 - protein, 18 aa, Plasmodium falciparum
MKLIRLYYIILDVILLEM

SEQ ID NO: 3269830 - protein, 25 aa, Plasmodium falciparum
MKLPHFKNHYSFLSTNLFDNINLHD

SEQ ID NO: 3269831 - protein, 17 aa, Plasmodium falciparum
MKLSLLLVEKYNLTIPN

SEQ ID NO: 3269832 - protein, 25 aa, Plasmodium falciparum
MKLYKLSEFIIHNILNKKLIYDEQS

SEQ ID NO: 3269833 - protein, 17 aa, Plasmodium falciparum
MKMCISIINNMIGVVKY

SEQ ID NO: 3269834 - protein, 31 aa, Plasmodium falciparum
MKMLNIEVVELFLSLYIHKYMHNICLDIKKL

SEQ ID NO: 3269835 - protein, 24 aa, Plasmodium falciparum
MKNEYLKYIIPFIRKIENSYISYK

SEQ ID NO: 3269836 - protein, 17 aa, Plasmodium falciparum
MKNICKLNNLLGQPIAV

SEQ ID NO: 3269837 - protein, 17 aa, Plasmodium falciparum
MKNIHLDLYKGMIKEII

SEQ ID NO: 3269838 - protein, 32 aa, Plasmodium falciparum
MKNIKRLIVAFSRARFGLYVLGNYNLYKKAYE

SEQ ID NO: 3269839 - protein, 21 aa, Plasmodium falciparum
MKNILLYDRFDNIGKVRKSKL

SEQ ID NO: 3269840 - protein, 17 aa, Plasmodium falciparum
MKNIYIPTNAEFVKVAD

SEQ ID NO: 3269841 - protein, 18 aa, Plasmodium falciparum
MKNKELLNKDISNKDMKN

SEQ ID NO: 3269842 - protein, 17 aa, Plasmodium falciparum
MKNKLLCIKTCVINKTK

SEQ ID NO: 3269843 - protein, 24 aa, Plasmodium falciparum
MKNKNFLKLCIFMNKKKCRSYVME

SEQ ID NO: 3269844 - protein, 22 aa, Plasmodium falciparum
MKNKSFIPYSIRLCNLPIKNTK

SEQ ID NO: 3269845 - protein, 23 aa, Plasmodium falciparum
MKNLCLFESCIPSVGKTRYIPPE

SEQ ID NO: 3269846 - protein, 24 aa, Plasmodium falciparum
MKNLMKKKFCNFISRSNEITSDEY

SEQ ID NO: 3269847 - protein, 19 aa, Plasmodium falciparum
MKNNLKLFSKRKFKKKIDR

SEQ ID NO: 3269848 - protein, 22 aa, Plasmodium falciparum
MKNNVCDGIYYLIRQENGLNIC

SEQ ID NO: 3269849 - protein, 26 aa, Plasmodium falciparum
MKNNYLVNVIERLLPIIIKPIKNNNT

SEQ ID NO: 3269850 - protein, 19 aa, Plasmodium falciparum
MKNPLDIIAHVGYANKKLS

SEQ ID NO: 3269851 - protein, 22 aa, Plasmodium falciparum
MKNSLEYYTFLSAHSYLEDIVC

SEQ ID NO: 3269852 - protein, 18 aa, Plasmodium falciparum
MKNYYAYNFLNLDINTNV

SEQ ID NO: 3269853 - protein, 17 aa, Plasmodium falciparum
MKPKIPFIIDIYSTFGI

SEQ ID NO: 3269854 - protein, 32 aa, Plasmodium falciparum
MKQGGLPTIFWMMLCVKYCRISRERSEKNEII

SEQ ID NO: 3269855 - protein, 19 aa, Plasmodium falciparum
MKQLLNMFEYFFVITNKKD

SEQ ID NO: 3269856 - protein, 24 aa, Plasmodium falciparum
MKRKIRARIFIPFIKIYEEKDMNK

SEQ ID NO: 3269857 - protein, 28 aa, Plasmodium falciparum
MKRLKVFRFRPYLPISFGIITSCSFLYV

SEQ ID NO: 3269858 - protein, 19 aa, Plasmodium falciparum
MKRLYKFSLQNKIYMIDNN

SEQ ID NO: 3269859 - protein, 21 aa, Plasmodium falciparum
MKRNCIYIILLLLKFSIMLLC

SEQ ID NO: 3269860 - protein, 22 aa, Plasmodium falciparum
MKRNRLSCNLHFENVKYKKDIN

SEQ ID NO: 3269861 - protein, 19 aa, Plasmodium falciparum
MKRSYRHCSEHVGKDIGLE

SEQ ID NO: 3269862 - protein, 21 aa, Plasmodium falciparum
MKRWKYLINTYCFNNYIMFFQ

SEQ ID NO: 3269863 - protein, 24 aa, Plasmodium falciparum
MKSFSLHFTHLFVHFFNLYILIYL

SEQ ID NO: 3269864 - protein, 18 aa, Plasmodium falciparum
MKSITKAFLNLCTSGFFS

SEQ ID NO: 3269865 - protein, 21 aa, Plasmodium falciparum
MKSLLILSTHINWKYRQKFIL

SEQ ID NO: 3269866 - protein, 28 aa, Plasmodium falciparum
MKSRQCNDFTFNSCLSSFVSYPDDILLY

SEQ ID NO: 3269867 - protein, 17 aa, Plasmodium falciparum
MKSSVKMFLEDLQHLTE

SEQ ID NO: 3269868 - protein, 25 aa, Plasmodium falciparum
MKSTIPLERRMSINMNNSSNSKAYN

SEQ ID NO: 3269869 - protein, 27 aa, Plasmodium falciparum
MKTCYEELLNWVICKITTKYNDNLINN

SEQ ID NO: 3269870 - protein, 20 aa, Plasmodium falciparum
MKTFCKSAIQKLRKQYDELM

SEQ ID NO: 3269871 - protein, 22 aa, Plasmodium falciparum
MKTNYLIDKYFCKILTFCKIKK

SEQ ID NO: 3269872 - protein, 22 aa, Plasmodium falciparum
MKVINFLFFFNIVKNINRYFLF

SEQ ID NO: 3269873 - protein, 22 aa, Plasmodium falciparum
MKVKRGDHFNPIYPYNDDIYTA

SEQ ID NO: 3269874 - protein, 23 aa, Plasmodium falciparum
MKYFKMLKKIYKYNLNKIFSNNY

SEQ ID NO: 3269875 - protein, 23 aa, Plasmodium falciparum
MKYFYLYCELLVILTQIIKILNN

SEQ ID NO: 3269876 - protein, 20 aa, Plasmodium falciparum
MKYKHIYNTLNILHVCSHLK

SEQ ID NO: 3269877 - protein, 21 aa, Plasmodium falciparum
MKYLCDSIIRSSDNYISSCNY

SEQ ID NO: 3269878 - protein, 19 aa, Plasmodium falciparum
MKYLDFLFIILRYITYFWF

SEQ ID NO: 3269879 - protein, 25 aa, Plasmodium falciparum
MKYLKILWNLSLSFLSFVGVLLITI

SEQ ID NO: 3269880 - protein, 32 aa, Plasmodium falciparum
MKYSPLDVLKCLKNIEIEHIMKCFKLVDISFI

SEQ ID NO: 3269881 - protein, 26 aa, Plasmodium falciparum
MLALGGSIIPCFFIALFIYDMKKEQP

SEQ ID NO: 3269882 - protein, 23 aa, Plasmodium falciparum
MLDKIIFECRGNGKVCSGDGEDC

SEQ ID NO: 3269883 - protein, 23 aa, Plasmodium falciparum
MLDKYRRVIRILSGQHDNPFIDS

SEQ ID NO: 3269884 - protein, 24 aa, Plasmodium falciparum
MLDSKIPFCIEADVKYNSDEYSDD

SEQ ID NO: 3269885 - protein, 18 aa, Plasmodium falciparum
MLEDFILIIINLYNIILY

SEQ ID NO: 3269886 - protein, 22 aa, Plasmodium falciparum
MLENCTCIFLSLNDGSFYFINI

SEQ ID NO: 3269887 - protein, 18 aa, Plasmodium falciparum
MLESPFAVNTVRPNLKKE

SEQ ID NO: 3269888 - protein, 20 aa, Plasmodium falciparum
MLETKECFKETNLSNTCTYQ

SEQ ID NO: 3269889 - protein, 19 aa, Plasmodium falciparum
MLETTKEQILLLWNNKKIS

SEQ ID NO: 3269890 - protein, 19 aa, Plasmodium falciparum
MLFQTCILVDLLFITMSLT

SEQ ID NO: 3269891 - protein, 26 aa, Plasmodium falciparum
MLFYIHMLRISYLLKNMTVNECKWLY

SEQ ID NO: 3269892 - protein, 19 aa, Plasmodium falciparum
MLFYRSYLFFLTWYFIGIF

SEQ ID NO: 3269893 - protein, 18 aa, Plasmodium falciparum
MLHIKYIFSFNFIFLILS

SEQ ID NO: 3269894 - protein, 18 aa, Plasmodium falciparum
MLICASGYIHFPDLNMEN

SEQ ID NO: 3269895 - protein, 26 aa, Plasmodium falciparum
MLIFYMIIWRKSPLLYLFKIEIYIIV

SEQ ID NO: 3269896 - protein, 19 aa, Plasmodium falciparum
MLIIPTFYFKNLIFDNFFN

SEQ ID NO: 3269897 - protein, 20 aa, Plasmodium falciparum
MLIKNMKGYVVMVSEYYGKD

SEQ ID NO: 3269898 - protein, 18 aa, Plasmodium falciparum
MLILKKKSIKYMLMHIDF

SEQ ID NO: 3269899 - protein, 36 aa, Plasmodium falciparum
MLKENCLTVFELLYREKKKWCSLYISTMNGPMSNFN

SEQ ID NO: 3269900 - protein, 23 aa, Plasmodium falciparum
MLKENLESVLFLKRIRNNFDIKR

SEQ ID NO: 3269901 - protein, 21 aa, Plasmodium falciparum
MLKNSCNLFELKNIDYINILN

SEQ ID NO: 3269902 - protein, 22 aa, Plasmodium falciparum
MLKRAFHMNIIFNACEKNKLGY

SEQ ID NO: 3269903 - protein, 23 aa, Plasmodium falciparum
MLKRSEKDVTHFINKNLTLDEIQ

SEQ ID NO: 3269904 - protein, 19 aa, Plasmodium falciparum
MLKSIKIKNNNFIKELELQ

SEQ ID NO: 3269905 - protein, 17 aa, Plasmodium falciparum
MLLFYNIFFYYCKLLSR

SEQ ID NO: 3269906 - protein, 23 aa, Plasmodium falciparum
MLLKNKLNYIVLNFENFISSYIH

SEQ ID NO: 3269907 - protein, 24 aa, Plasmodium falciparum
MLLRKNGLGRLFFYNLRKMYNYVY

SEQ ID NO: 3269908 - protein, 17 aa, Plasmodium falciparum
MLNICLSSEYFIYDSDT

SEQ ID NO: 3269909 - protein, 19 aa, Plasmodium falciparum
MLPEELIEVVVPEELIEEV

SEQ ID NO: 3269910 - protein, 24 aa, Plasmodium falciparum
MLPPSVVCSPYIVGNNEMSMKNHM

SEQ ID NO: 3269911 - protein, 27 aa, Plasmodium falciparum
MLQRSKVCIISSKFAGMLNKMVIDALF

SEQ ID NO: 3269912 - protein, 17 aa, Plasmodium falciparum
MLQSYYKKAAINAWKEN

SEQ ID NO: 3269913 - protein, 19 aa, Plasmodium falciparum
MLRGIKISLFEHTCDYVIS

SEQ ID NO: 3269914 - protein, 21 aa, Plasmodium falciparum
MLRKNGYFILEYNKEKKYKLR

SEQ ID NO: 3269915 - protein, 22 aa, Plasmodium falciparum
MLRKQCKFAFDLSNLDIVKSIC

SEQ ID NO: 3269916 - protein, 21 aa, Plasmodium falciparum
MLRSTCSISIPGLVEKENKDD

SEQ ID NO: 3269917 - protein, 26 aa, Plasmodium falciparum
MLSEVAFSPRCLRKYHVKNNFYNFYI

SEQ ID NO: 3269918 - protein, 17 aa, Plasmodium falciparum
MLSEYGVHTSIYKNDEN

SEQ ID NO: 3269919 - protein, 20 aa, Plasmodium falciparum
MLSGSLHYFLDILKNFIFIN

SEQ ID NO: 3269920 - protein, 18 aa, Plasmodium falciparum
MLSNTICRNNICDLKNYN

SEQ ID NO: 3269921 - protein, 22 aa, Plasmodium falciparum
MLSSTIMWSIGIGFATFTYFFL

SEQ ID NO: 3269922 - protein, 17 aa, Plasmodium falciparum
MLTCKKYKDILIDDSDM

SEQ ID NO: 3269923 - protein, 17 aa, Plasmodium falciparum
MLTQYAKPILSSNNISN

SEQ ID NO: 3269924 - protein, 21 aa, Plasmodium falciparum
MLVSAPFSWFLSNETKELIIA

SEQ ID NO: 3269925 - protein, 17 aa, Plasmodium falciparum
MLVYKFPIDVKKYKLTF

SEQ ID NO: 3269926 - protein, 18 aa, Plasmodium falciparum
MLYGLRLLYKELINKYNI

SEQ ID NO: 3269927 - protein, 22 aa, Plasmodium falciparum
MLYRNMKKYSLLNEKKNIYINN

SEQ ID NO: 3269928 - protein, 24 aa, Plasmodium falciparum
MMIFLKLRMKHIISLVQTIYIVMK

SEQ ID NO: 3269929 - protein, 20 aa, Plasmodium falciparum
MMISSALSISLTFFKTNNIH

SEQ ID NO: 3269930 - protein, 22 aa, Plasmodium falciparum
MMKNKKCLLYVISPIQQYNKSS

SEQ ID NO: 3269931 - protein, 20 aa, Plasmodium falciparum
MMLCSIIMHIIYSFYINSLC

SEQ ID NO: 3269932 - protein, 20 aa, Plasmodium falciparum
MMSSLLCKYKVNNLKETIIN

SEQ ID NO: 3269933 - protein, 19 aa, Plasmodium falciparum
MMYDENIFNSISIEMDAAE

SEQ ID NO: 3269934 - protein, 19 aa, Plasmodium falciparum
MMYGIEILEYGIVKYNKIR

SEQ ID NO: 3269935 - protein, 17 aa, Plasmodium falciparum
MNAKSFFFFISTDKKKK

SEQ ID NO: 3269936 - protein, 19 aa, Plasmodium falciparum
MNAVYKMNALNKVSAVNKV

SEQ ID NO: 3269937 - protein, 17 aa, Plasmodium falciparum
MNDFPFLANNQVTHYNY

SEQ ID NO: 3269938 - protein, 24 aa, Plasmodium falciparum
MNDLRFFMNSSFDNMLDGNLINQD

SEQ ID NO: 3269939 - protein, 19 aa, Plasmodium falciparum
MNDRCPYDNYNIFDRDHTG

SEQ ID NO: 3269940 - protein, 18 aa, Plasmodium falciparum
MNENNCYIISKSNNMEEV

SEQ ID NO: 3269941 - protein, 18 aa, Plasmodium falciparum
MNERIKVGSLRKKKRKKE

SEQ ID NO: 3269942 - protein, 23 aa, Plasmodium falciparum
MNERISYMLTLFLFPIIFHSINM

SEQ ID NO: 3269943 - protein, 24 aa, Plasmodium falciparum
MNFLEIILFLYLRKYVPFVQKYNM

SEQ ID NO: 3269944 - protein, 48 aa, Plasmodium falciparum
MNFLGVYSHSFIWQVYCLELEQFCVLKFKRINLGFLYMHDDKQIENKN

SEQ ID NO: 3269945 - protein, 24 aa, Plasmodium falciparum
MNFNLRVGFLIQFISYILLVGAIT

SEQ ID NO: 3269946 - protein, 17 aa, Plasmodium falciparum
MNHIFYLLFIFFSLLFF

SEQ ID NO: 3269947 - protein, 26 aa, Plasmodium falciparum
MNHISWLNFVSFNWITQLLRCLKNDD

SEQ ID NO: 3269948 - protein, 29 aa, Plasmodium falciparum
MNHLSIHFSDFFLDDGIKVARNINDIEES

SEQ ID NO: 3269949 - protein, 17 aa, Plasmodium falciparum
MNHMKLNGFTIYSTSCH

SEQ ID NO: 3269950 - protein, 19 aa, Plasmodium falciparum
MNICLSEAYNSFDYKNKKE

SEQ ID NO: 3269951 - protein, 19 aa, Plasmodium falciparum
MNIFEKFQIVSLLKENYLY

SEQ ID NO: 3269952 - protein, 17 aa, Plasmodium falciparum
MNIFKLALMNFNKFSGR

SEQ ID NO: 3269953 - protein, 23 aa, Plasmodium falciparum
MNIGKKYYKYICPLTPYEIYIIE

SEQ ID NO: 3269954 - protein, 28 aa, Plasmodium falciparum
MNILGLFLSFFLKWELYGFIYSNLICMI

SEQ ID NO: 3269955 - protein, 25 aa, Plasmodium falciparum
MNILHDILCNIILCIKNNYDNIHNV

SEQ ID NO: 3269956 - protein, 24 aa, Plasmodium falciparum
MNILKKRIIDGFLINYYISNIPKK

SEQ ID NO: 3269957 - protein, 18 aa, Plasmodium falciparum
MNILRINNHFQYINYNNI

SEQ ID NO: 3269958 - protein, 19 aa, Plasmodium falciparum
MNINISFIEFILCIIYSEN

SEQ ID NO: 3269959 - protein, 20 aa, Plasmodium falciparum
MNINLAILLNDMFWKHKNRC

SEQ ID NO: 3269960 - protein, 27 aa, Plasmodium falciparum
MNINSFCISISCLSKINIFPKELYEEI

SEQ ID NO: 3269961 - protein, 21 aa, Plasmodium falciparum
MNIPCPSLILSPHLYSKGYVN

SEQ ID NO: 3269962 - protein, 27 aa, Plasmodium falciparum
MNKCMCFTCLNFSFRNNKSCYNKLINY

SEQ ID NO: 3269963 - protein, 22 aa, Plasmodium falciparum
MNKEQYSDIIFRDIKMDIFKSI

SEQ ID NO: 3269964 - protein, 30 aa, Plasmodium falciparum
MNKEWSFNMWNIRWCKYLENMMEEVNYYLN

SEQ ID NO: 3269965 - protein, 17 aa, Plasmodium falciparum
MNKLPLHFINKIIYDLA

SEQ ID NO: 3269966 - protein, 27 aa, Plasmodium falciparum
MNKLRGSKLYFIIGISLLKQINTNPYY

SEQ ID NO: 3269967 - protein, 17 aa, Plasmodium falciparum
MNKNLYLVYDCFKLNII

SEQ ID NO: 3269968 - protein, 18 aa, Plasmodium falciparum
MNKTFKCNVISPKNVCNE

SEQ ID NO: 3269969 - protein, 25 aa, Plasmodium falciparum
MNKVYEFLKKESYRFNLNNVSNDMF

SEQ ID NO: 3269970 - protein, 23 aa, Plasmodium falciparum
MNKYDISLLFSIHKFINNTKGKI

SEQ ID NO: 3269971 - protein, 25 aa, Plasmodium falciparum
MNKYEIYRNIVINNFFPIQMNNKNG

SEQ ID NO: 3269972 - protein, 25 aa, Plasmodium falciparum
MNLEKEIRPIILITHVNPANNSVHI

SEQ ID NO: 3269973 - protein, 20 aa, Plasmodium falciparum
MNLIVLCVSLSSLSEPNVHD

SEQ ID NO: 3269974 - protein, 17 aa, Plasmodium falciparum
MNLKCFVLMFEILNLMD

SEQ ID NO: 3269975 - protein, 23 aa, Plasmodium falciparum
MNLKEVYFTSSVVSVYNRNYVLN

SEQ ID NO: 3269976 - protein, 25 aa, Plasmodium falciparum
MNLKIVPCTIKRCYDVIENICNDLY

SEQ ID NO: 3269977 - protein, 23 aa, Plasmodium falciparum
MNLLKRRLNNIFYGKYRKYDTQT

SEQ ID NO: 3269978 - protein, 17 aa, Plasmodium falciparum
MNLMFYNFHEDFILILI

SEQ ID NO: 3269979 - protein, 21 aa, Plasmodium falciparum
MNLRSYRKCSLYIFNNKVDKT

SEQ ID NO: 3269980 - protein, 27 aa, Plasmodium falciparum
MNLSLTYKLIFPVIFNNYFLNLLHMKL

SEQ ID NO: 3269981 - protein, 22 aa, Plasmodium falciparum
MNLTKYVDLVFIFIDSTKLSIN

SEQ ID NO: 3269982 - protein, 23 aa, Plasmodium falciparum
MNLYFCIFPVFAFMGNSYIPSLL

SEQ ID NO: 3269983 - protein, 18 aa, Plasmodium falciparum
MNMEKYWILKEIIQQEYT

SEQ ID NO: 3269984 - protein, 19 aa, Plasmodium falciparum
MNMFICIDILNNEFDKNIS

SEQ ID NO: 3269985 - protein, 26 aa, Plasmodium falciparum
MNNIFGVIMSYVFKSLLLFFYPLIIP

SEQ ID NO: 3269986 - protein, 38 aa, Plasmodium falciparum
MNNIIMYLSIIFRMITILKMFYSTFIINIFVLHKDIIL

SEQ ID NO: 3269987 - protein, 26 aa, Plasmodium falciparum
MNNNEVVAWGIIWFLIFSIILFYMLK

SEQ ID NO: 3269988 - protein, 24 aa, Plasmodium falciparum
MNNSILCKAIDLFDRDIKEKYVLL

SEQ ID NO: 3269989 - protein, 21 aa, Plasmodium falciparum
MNNSLCSSAYHNMKYEKYVDI

SEQ ID NO: 3269990 - protein, 26 aa, Plasmodium falciparum
MNNYRITDKISFSFGLLSAVRLNNLE

SEQ ID NO: 3269991 - protein, 24 aa, Plasmodium falciparum
MNPNEFICNIPLKEQCDLKSLFSY

SEQ ID NO: 3269992 - protein, 23 aa, Plasmodium falciparum
MNQKNVCVECNDNLIKGNNSNNS

SEQ ID NO: 3269993 - protein, 23 aa, Plasmodium falciparum
MNRKKNKCYVYLKNRYSKRGNYL

SEQ ID NO: 3269994 - protein, 18 aa, Plasmodium falciparum
MNSWGILNYLFFKKSNDS

SEQ ID NO: 3269995 - protein, 24 aa, Plasmodium falciparum
MNTSEYWWPGLKNIFKVEYSHEEA

SEQ ID NO: 3269996 - protein, 17 aa, Plasmodium falciparum
MNVKRKHVFSSFKIPRK

SEQ ID NO: 3269997 - protein, 17 aa, Plasmodium falciparum
MNVSQVILDLFNKLKKI

SEQ ID NO: 3269998 - protein, 18 aa, Plasmodium falciparum
MNYIQLCLFLLPLKNHFL

SEQ ID NO: 3269999 - protein, 17 aa, Plasmodium falciparum
MNYNIPYEHFLENYDII

SEQ ID NO: 3270000 - protein, 28 aa, Plasmodium falciparum
MNYRPKYLGPLFNKWHSIYIGNYNKNEI

SEQ ID NO: 3270001 - protein, 24 aa, Plasmodium falciparum
MPDLIKRVYCLDNKYKVQAVECSE

SEQ ID NO: 3270002 - protein, 26 aa, Plasmodium falciparum
MPIDFLYELIHSITYFYKNMHVKKTR

SEQ ID NO: 3270003 - protein, 18 aa, Plasmodium falciparum
MPILFSYLQKLYIFPKVR

SEQ ID NO: 3270004 - protein, 21 aa, Plasmodium falciparum
MPLCNTCSFFFTYITELVIFK

SEQ ID NO: 3270005 - protein, 17 aa, Plasmodium falciparum
MPLLLVEPIDDITDEMK

SEQ ID NO: 3270006 - protein, 37 aa, Plasmodium falciparum
MPNSIKGYFWEMCIKNKLNLTEYFVQILIKNTNFIQA

SEQ ID NO: 3270007 - protein, 19 aa, Plasmodium falciparum
MPRPVRTRKATGFVKMDMK

SEQ ID NO: 3270008 - protein, 21 aa, Plasmodium falciparum
MPYSCKCNTPISNFELNLNYK

SEQ ID NO: 3270009 - protein, 17 aa, Plasmodium falciparum
MQEMMCSKGSMEVPLNY

SEQ ID NO: 3270010 - protein, 21 aa, Plasmodium falciparum
MQKLKGKCILQDKNKIKRVRK

SEQ ID NO: 3270011 - protein, 18 aa, Plasmodium falciparum
MQKRFIIFSENYRKIELH

SEQ ID NO: 3270012 - protein, 20 aa, Plasmodium falciparum
MQMDCYFVKFNLEKGKKKHI

SEQ ID NO: 3270013 - protein, 18 aa, Plasmodium falciparum
MQNLLKRILYNVEKKKVL

SEQ ID NO: 3270014 - protein, 19 aa, Plasmodium falciparum
MQPIYSVKQNMPFNEENEM

SEQ ID NO: 3270015 - protein, 28 aa, Plasmodium falciparum
MQQIFNYCPIEWPLLDISILIIVCQVVC

SEQ ID NO: 3270016 - protein, 18 aa, Plasmodium falciparum
MQTFFSYYVFLYIYTFET

SEQ ID NO: 3270017 - protein, 21 aa, Plasmodium falciparum
MRDIMKSGGMEVHLKNEESLY

SEQ ID NO: 3270018 - protein, 23 aa, Plasmodium falciparum
MREKEFWLYSELVPLTVEDKNAN

SEQ ID NO: 3270019 - protein, 17 aa, Plasmodium falciparum
MRFIFFIGLLVILKNIL

SEQ ID NO: 3270020 - protein, 30 aa, Plasmodium falciparum
MRFYIRSNMIFKLGVLKKVPKDKLQDFFLS

SEQ ID NO: 3270021 - protein, 20 aa, Plasmodium falciparum
MRHYRIKKELIHHENEHAEK

SEQ ID NO: 3270022 - protein, 32 aa, Plasmodium falciparum
MRKEFSNHAYKCFAGKGFSNMYYFAGGGLFFI

SEQ ID NO: 3270023 - protein, 34 aa, Plasmodium falciparum
MRKKKEIKKILNIIFCSSIPMIGFGFMDQFIMIR

SEQ ID NO: 3270024 - protein, 18 aa, Plasmodium falciparum
MRNFQWDIFYSIYNRLII

SEQ ID NO: 3270025 - protein, 18 aa, Plasmodium falciparum
MRYILKIDKSILFYSTNY

SEQ ID NO: 3270026 - protein, 27 aa, Plasmodium falciparum
MRYLKFNNFRIDNMMKKNGCELFVKDN

SEQ ID NO: 3270027 - protein, 32 aa, Plasmodium falciparum
MSAIKLNKLKLFFVLKDELKYIFPDIPEGLYF

SEQ ID NO: 3270028 - protein, 28 aa, Plasmodium falciparum
MSASAFPWTVGVAFMALSYWVMKKKSKP

SEQ ID NO: 3270029 - protein, 29 aa, Plasmodium falciparum
MSDLLRIGLRILMVSGKLELLGAPVTLNQ

SEQ ID NO: 3270030 - protein, 25 aa, Plasmodium falciparum
MSDNIKAPLFKTGKIVSEMLPSPNY

SEQ ID NO: 3270031 - protein, 23 aa, Plasmodium falciparum
MSFLICFNYFVVENHCEFYFNYL

SEQ ID NO: 3270032 - protein, 20 aa, Plasmodium falciparum
MSGRGFFPKLSCEKKNNNDD

SEQ ID NO: 3270033 - protein, 20 aa, Plasmodium falciparum
MSIISIIMLLNVLRKNCNYS

SEQ ID NO: 3270034 - protein, 24 aa, Plasmodium falciparum
MSILCVYKIIKTCYIIYMIEIHYK

SEQ ID NO: 3270035 - protein, 24 aa, Plasmodium falciparum
MSIYEHFKIILTFKNIELTNVELK

SEQ ID NO: 3270036 - protein, 22 aa, Plasmodium falciparum
MSKEKLHFFLLQLLVDPILGSL

SEQ ID NO: 3270037 - protein, 24 aa, Plasmodium falciparum
MSKELLKESLVFLRTYLSYIDVDQ

SEQ ID NO: 3270038 - protein, 34 aa, Plasmodium falciparum
MSKKCASQLHKLHLTIYMVYQKIIYNFSNILLQI

SEQ ID NO: 3270039 - protein, 22 aa, Plasmodium falciparum
MSKMSHFFDRNCVRVINYVSYK

SEQ ID NO: 3270040 - protein, 17 aa, Plasmodium falciparum
MSKQLNIHIFKVDNTIL

SEQ ID NO: 3270041 - protein, 20 aa, Plasmodium falciparum
MSLFSFYKLYLLKKYDSNTL

SEQ ID NO: 3270042 - protein, 38 aa, Plasmodium falciparum
MSLLFLQFYFSYFFKCKICIFSNTFLFIYFVLFLMMTS

SEQ ID NO: 3270043 - protein, 21 aa, Plasmodium falciparum
MSLLSIFFVIMSFKFHNKMKN

SEQ ID NO: 3270044 - protein, 20 aa, Plasmodium falciparum
MSLYYSMIYMLKVMNIEEED

SEQ ID NO: 3270045 - protein, 23 aa, Plasmodium falciparum
MSNEKRVTNNFVLPINSSSDVEI

SEQ ID NO: 3270046 - protein, 24 aa, Plasmodium falciparum
MSNEKYKFVSFLYHLGNICNNICG

SEQ ID NO: 3270047 - protein, 24 aa, Plasmodium falciparum
MSNLRRYDMENAFKNKMSTYVDDF

SEQ ID NO: 3270048 - protein, 24 aa, Plasmodium falciparum
MSNLRRYDMENAFKNKMVTYVDDF

SEQ ID NO: 3270049 - protein, 33 aa, Plasmodium falciparum
MSNLYFVVTGIQFWITEYMSVVLLTEKMKIVTV

SEQ ID NO: 3270050 - protein, 26 aa, Plasmodium falciparum
MSQKQKIIWRRWVAKHPYRIREKKID

SEQ ID NO: 3270051 - protein, 26 aa, Plasmodium falciparum
MSQKQKIIWRRWVAKHPYRIREKRID

SEQ ID NO: 3270052 - protein, 17 aa, Plasmodium falciparum
MSRPSIMPYHKKFGKLN

SEQ ID NO: 3270053 - protein, 23 aa, Plasmodium falciparum
MSSSYYYYYVNMFSLYKKNYNKY

SEQ ID NO: 3270054 - protein, 19 aa, Plasmodium falciparum
MSSTIMWSIGIGFAAFTYF

SEQ ID NO: 3270055 - protein, 22 aa, Plasmodium falciparum
MSSTIMWSIGIGFAAFTYFFLK

SEQ ID NO: 3270056 - protein, 19 aa, Plasmodium falciparum
MSSTIMWSIGIGFATFTYF

SEQ ID NO: 3270057 - protein, 21 aa, Plasmodium falciparum
MSSTIMWSVGIGFAAFTYFYL

SEQ ID NO: 3270058 - protein, 18 aa, Plasmodium falciparum
MSSVLKSVISGFTETCND

SEQ ID NO: 3270059 - protein, 31 aa, Plasmodium falciparum
MSTKQFLKMFMVILYELVFLFSKKSALIDSP

SEQ ID NO: 3270060 - protein, 26 aa, Plasmodium falciparum
MSTLDYQRFCRVCSGIEYENFERKID

SEQ ID NO: 3270061 - protein, 28 aa, Plasmodium falciparum
MSYFVKDFHSIFSFLSLKFLRHLNLFLG

SEQ ID NO: 3270062 - protein, 17 aa, Plasmodium falciparum
MSYIYFYNISKKGTLYE

SEQ ID NO: 3270063 - protein, 28 aa, Plasmodium falciparum
MTEDCYTKMWFDFMSDFGIATMNETEHT

SEQ ID NO: 3270064 - protein, 24 aa, Plasmodium falciparum
MTFNMCSIAGKTYGSKCKNKKKIY

SEQ ID NO: 3270065 - protein, 25 aa, Plasmodium falciparum
MTHKLLLEVCMAAKYEGNSIDTHYP

SEQ ID NO: 3270066 - protein, 26 aa, Plasmodium falciparum
MTIQEITCLTFWYEEILPLVNNDKKK

SEQ ID NO: 3270067 - protein, 23 aa, Plasmodium falciparum
MTKREVLRLKLLKEGEIKRENIY

SEQ ID NO: 3270068 - protein, 30 aa, Plasmodium falciparum
MTNHCNFFNIFLFHFFNYTFNFPMDNFFQL

SEQ ID NO: 3270069 - protein, 18 aa, Plasmodium falciparum
MTRGGALSMNDVIETAVK

SEQ ID NO: 3270070 - protein, 20 aa, Plasmodium falciparum
MTVNECKWLYIYRKITTLYF

SEQ ID NO: 3270071 - protein, 22 aa, Plasmodium falciparum
MTYKIDNILLYISLLISSHYVT

SEQ ID NO: 3270072 - protein, 26 aa, Plasmodium falciparum
MVDDIFMFFFLMKLNFVMNMKKDIQR

SEQ ID NO: 3270073 - protein, 18 aa, Plasmodium falciparum
MVDFLKFLNVPKHVTYKN

SEQ ID NO: 3270074 - protein, 19 aa, Plasmodium falciparum
MVDGIKWGWGFTNTPKETS

SEQ ID NO: 3270075 - protein, 18 aa, Plasmodium falciparum
MVDMCINQSYIFLLLEEK

SEQ ID NO: 3270076 - protein, 23 aa, Plasmodium falciparum
MVDRLKVQMLLKNAFETEDGNVF

SEQ ID NO: 3270077 - protein, 18 aa, Plasmodium falciparum
MVFFKKEPIFRFNMPSVN

SEQ ID NO: 3270078 - protein, 18 aa, Plasmodium falciparum
MVFSLFIWILKSAKHNVS

SEQ ID NO: 3270079 - protein, 18 aa, Plasmodium falciparum
MVHSLFFFLNSLNKCNNI

SEQ ID NO: 3270080 - protein, 22 aa, Plasmodium falciparum
MVIDALFYGCVVISDKTHNKDI

SEQ ID NO: 3270081 - protein, 27 aa, Plasmodium falciparum
MVIYKKYRCIENFKILKKILKLSTEEI

SEQ ID NO: 3270082 - protein, 17 aa, Plasmodium falciparum
MVKNVFSLFSFTSNVDD

SEQ ID NO: 3270083 - protein, 44 aa, Plasmodium falciparum
MVKTLLIKLTFMMPFIYKLKIPACVIRLYIRVIKSLDKEILDTI

SEQ ID NO: 3270084 - protein, 19 aa, Plasmodium falciparum
MVLFMCENFLKKSYMTSIN

SEQ ID NO: 3270085 - protein, 21 aa, Plasmodium falciparum
MVPPRRRQLCLIGNRRFVGRV

SEQ ID NO: 3270086 - protein, 21 aa, Plasmodium falciparum
MVRPVRTRKPTGFVKMDVSKL

SEQ ID NO: 3270087 - protein, 22 aa, Plasmodium falciparum
MVSDNFYSFIVLYKMNKKREEE

SEQ ID NO: 3270088 - protein, 29 aa, Plasmodium falciparum
MVSIILLDMLKLILCRYYILYLNDPEKIQ

SEQ ID NO: 3270089 - protein, 24 aa, Plasmodium falciparum
MVTKMYKNFFVFNVSYMTIKDIKN

SEQ ID NO: 3270090 - protein, 24 aa, Plasmodium falciparum
MVTSNLKNNCRIIDDKELPILIKD

SEQ ID NO: 3270091 - protein, 25 aa, Plasmodium falciparum
MVYEKIKYAFNWEFSFYTLVNILIL

SEQ ID NO: 3270092 - protein, 26 aa, Plasmodium falciparum
MVYFCLKCNDIIKIIVTLLDYTTEDV

SEQ ID NO: 3270093 - protein, 25 aa, Plasmodium falciparum
MWDNFKSHIFKNFVDYLVNFKQKKN

SEQ ID NO: 3270094 - protein, 20 aa, Plasmodium falciparum
MWMHLACSISATLTFLSTCI

SEQ ID NO: 3270095 - protein, 18 aa, Plasmodium falciparum
MWMYLFRKYYMSYIYYGD

SEQ ID NO: 3270096 - protein, 26 aa, Plasmodium falciparum
MWPNLFSVHICRGIEKGVYIIAKEKN

SEQ ID NO: 3270097 - protein, 25 aa, Plasmodium falciparum
MWYIPEGSSPFFLREGCKASKIFEL

SEQ ID NO: 3270098 - protein, 27 aa, Plasmodium falciparum
MYDKFDLSFIIFKNIFFFLKIYIDNDI

SEQ ID NO: 3270099 - protein, 32 aa, Plasmodium falciparum
MYDYPRYFKKWEIMKIWSPIWITLSKVDDQSC

SEQ ID NO: 3270100 - protein, 21 aa, Plasmodium falciparum
MYFIETYLGIDIYSVSIQYIF

SEQ ID NO: 3270101 - protein, 25 aa, Plasmodium falciparum
MYFILPHCIFFFSFVSIYKELIYYK

SEQ ID NO: 3270102 - protein, 17 aa, Plasmodium falciparum
MYFYFGFIYIFPRILTK

SEQ ID NO: 3270103 - protein, 22 aa, Plasmodium falciparum
MYFYKIFFYLLSFLNFYLEDMI

SEQ ID NO: 3270104 - protein, 19 aa, Plasmodium falciparum
MYHCLPLIYKDYKKVYLKY

SEQ ID NO: 3270105 - protein, 21 aa, Plasmodium falciparum
MYIKHKCLLIFLDNPSKYKIK

SEQ ID NO: 3270106 - protein, 32 aa, Plasmodium falciparum
MYIVLKNLYYLYIFKRTRIKIIESLNNDNNVE

SEQ ID NO: 3270107 - protein, 24 aa, Plasmodium falciparum
MYIYFLFCNATLLLHFREIDKSIQ

SEQ ID NO: 3270108 - protein, 22 aa, Plasmodium falciparum
MYKCTRGKIYLYNKLINNYTRH

SEQ ID NO: 3270109 - protein, 25 aa, Plasmodium falciparum
MYKEKKCPLNILLLLQEISDKDLEM

SEQ ID NO: 3270110 - protein, 17 aa, Plasmodium falciparum
MYKEYVLLDGKRNFTNE

SEQ ID NO: 3270111 - protein, 20 aa, Plasmodium falciparum
MYKLKCCGESMLTLDEMKEL

SEQ ID NO: 3270112 - protein, 20 aa, Plasmodium falciparum
MYLLFQMNIIYNIYKKKLMN

SEQ ID NO: 3270113 - protein, 19 aa, Plasmodium falciparum
MYLYEYLYHMILNRILYIS

SEQ ID NO: 3270114 - protein, 24 aa, Plasmodium falciparum
MYNEIKRGPNIFILNYEYKEKLIS

SEQ ID NO: 3270115 - protein, 18 aa, Plasmodium falciparum
MYNNCLKKKLMISDDEKN

SEQ ID NO: 3270116 - protein, 32 aa, Plasmodium falciparum
MYRWDHKCTGCFLSCSHFRTWIDNQKLEFLKQ

SEQ ID NO: 3270117 - protein, 20 aa, Plasmodium falciparum
MYSFFLNLLLSECLPINHLG

SEQ ID NO: 3270118 - protein, 22 aa, Plasmodium falciparum
MYSNNFKYKHFVVMEKNENDGS

SEQ ID NO: 3270119 - protein, 23 aa, Plasmodium falciparum
MYSREIFIEHSILMDPFKSKMDE

SEQ ID NO: 3270120 - protein, 26 aa, Plasmodium falciparum
MYTHCFRIFLMFTLFYFIPKEATSFI

SEQ ID NO: 3270121 - protein, 22 aa, Plasmodium falciparum
MYTKLICSQSMNSPIYPDVSIE

SEQ ID NO: 3270122 - protein, 24 aa, Plasmodium falciparum
MYYANDGGRIFLFILQLINLNDGD

SEQ ID NO: 3270123 - protein, 18 aa, Plasmodium falciparum
MYYFAGGGLFFIILFLLG

SEQ ID NO: 3270124 - protein, 17 aa, Plasmodium falciparum
MYYILKEHFDIESIKLL

SEQ ID NO: 3270125 - protein, 19 aa, Plasmodium falciparum
MYYVGMFLLCRFDGNTNRK

SEQ ID NO: 3270126 - protein, 25 aa, Plasmodium falciparum
NACMECLTKAISVYNIDLFLDDLSK

SEQ ID NO: 3270127 - protein, 25 aa, Plasmodium falciparum
NADIRFCFYKESKKVLGKTYSICIL

SEQ ID NO: 3270128 - protein, 19 aa, Plasmodium falciparum
NAEIYLNTLFNQWINNNRL

SEQ ID NO: 3270129 - protein, 21 aa, Plasmodium falciparum
NAFDMGFGILKKDGVTNGLLP

SEQ ID NO: 3270130 - protein, 17 aa, Plasmodium falciparum
NAFNEFFYIINEDTLSK

SEQ ID NO: 3270131 - protein, 29 aa, Plasmodium falciparum
NAFSDYYYFFPYFIQKLLEKGGMIERLIK

SEQ ID NO: 3270132 - protein, 19 aa, Plasmodium falciparum
NAFSLPWFNTYFKTSWTYT

SEQ ID NO: 3270133 - protein, 25 aa, Plasmodium falciparum
NAGALLFIRRDLTVIPKLIYPAKDE

SEQ ID NO: 3270134 - protein, 22 aa, Plasmodium falciparum
NAHAKLKIKDMKLINKFLNIII

SEQ ID NO: 3270135 - protein, 23 aa, Plasmodium falciparum
NAIIRPNLQTFVGRKIISFLNEK

SEQ ID NO: 3270136 - protein, 17 aa, Plasmodium falciparum
NAIKPCNDLNAFEKSCG

SEQ ID NO: 3270137 - protein, 21 aa, Plasmodium falciparum
NAIMKKYWDDMEIQWIDYDNK

SEQ ID NO: 3270138 - protein, 18 aa, Plasmodium falciparum
NAISFFLHYIPLLLNKKK

SEQ ID NO: 3270139 - protein, 26 aa, Plasmodium falciparum
NAKRLFKILFVTVFIVLAGGFSYYIF

SEQ ID NO: 3270140 - protein, 26 aa, Plasmodium falciparum
NALFPLRINNKILNFFVNNFCAYNLK

SEQ ID NO: 3270141 - protein, 20 aa, Plasmodium falciparum
NALHFKRKMDFFFEFLPQLV

SEQ ID NO: 3270142 - protein, 27 aa, Plasmodium falciparum
NALYLEEYRRLTVLNQIVWKALSNQIE

SEQ ID NO: 3270143 - protein, 21 aa, Plasmodium falciparum
NAMISINIYKLIILLYKADYY

SEQ ID NO: 3270144 - protein, 18 aa, Plasmodium falciparum
NANIKKKKHNIYIFRHEN

SEQ ID NO: 3270145 - protein, 22 aa, Plasmodium falciparum
NANLMRNGADFAVYVNTASEYD

SEQ ID NO: 3270146 - protein, 25 aa, Plasmodium falciparum
NANSKLPALLWNKIIGKGNDNEVNF

SEQ ID NO: 3270147 - protein, 26 aa, Plasmodium falciparum
NAPSIWKGMICALTYKEDGEKSTDDK

SEQ ID NO: 3270148 - protein, 20 aa, Plasmodium falciparum
NAPVSWKCIPTSGSGVTATG

SEQ ID NO: 3270149 - protein, 24 aa, Plasmodium falciparum
NAPYEPFIYFLFENIKKNNINYSK

SEQ ID NO: 3270150 - protein, 24 aa, Plasmodium falciparum
NAQCGLKLIKEEIMILQENFNLKI

SEQ ID NO: 3270151 - protein, 27 aa, Plasmodium falciparum
NAQNAKCLKKIFFLKKELFDMAKNINN

SEQ ID NO: 3270152 - protein, 24 aa, Plasmodium falciparum
NASDSEKGFICINGNNYIINPGTY

SEQ ID NO: 3270153 - protein, 27 aa, Plasmodium falciparum
NASICNFLSFSFLRLLFHDQIKYNLSI

SEQ ID NO: 3270154 - protein, 18 aa, Plasmodium falciparum
NASLYLFFHYHFNSLNEQ

SEQ ID NO: 3270155 - protein, 19 aa, Plasmodium falciparum
NATHIYRKKILLLKKNFLI

SEQ ID NO: 3270156 - protein, 24 aa, Plasmodium falciparum
NATPKYFSVYGMVDLNWPEQFEEN

SEQ ID NO: 3270157 - protein, 27 aa, Plasmodium falciparum
NAYKSCVYLLYLLRGGSDINYNMGNNS

SEQ ID NO: 3270158 - protein, 20 aa, Plasmodium falciparum
NAYTYMFFIVISFVVVVLIA

SEQ ID NO: 3270159 - protein, 24 aa, Plasmodium falciparum
NCDCYKRWVEKKQQEWSNIKKHFG

SEQ ID NO: 3270160 - protein, 24 aa, Plasmodium falciparum
NCDLLKLKITFQIIKTMIYVFNLI

SEQ ID NO: 3270161 - protein, 25 aa, Plasmodium falciparum
NCEEIKILFLSIIKLLSFSLDHFPF

SEQ ID NO: 3270162 - protein, 21 aa, Plasmodium falciparum
NCGACAPYRRLHLCHHNLESI

SEQ ID NO: 3270163 - protein, 19 aa, Plasmodium falciparum
NCGKNLGGFVPGLGLIGGS

SEQ ID NO: 3270164 - protein, 18 aa, Plasmodium falciparum
NCGKTMGAVAPAWGLLSG

SEQ ID NO: 3270165 - protein, 27 aa, Plasmodium falciparum
NCGRKKLGNIFCCANIICVKERVKKIK

SEQ ID NO: 3270166 - protein, 21 aa, Plasmodium falciparum
NCHFPIHLRRNGLYVDNVSIF

SEQ ID NO: 3270167 - protein, 21 aa, Plasmodium falciparum
NCHKCFFACNPFVKWLGNQKL

SEQ ID NO: 3270168 - protein, 17 aa, Plasmodium falciparum
NCIELYRYTYLLEKKNI

SEQ ID NO: 3270169 - protein, 17 aa, Plasmodium falciparum
NCIKRYPLDEGIIKKTI

SEQ ID NO: 3270170 - protein, 27 aa, Plasmodium falciparum
NCIMYRKVNFFIFVYILIYIIKTSTRK

SEQ ID NO: 3270171 - protein, 19 aa, Plasmodium falciparum
NCIQLYYNLFYSVHHDISL

SEQ ID NO: 3270172 - protein, 18 aa, Plasmodium falciparum
NCKNILNIEISYRKNKIV

SEQ ID NO: 3270173 - protein, 26 aa, Plasmodium falciparum
NCLLSLCLLLPLLIKYKSKYLKDILY

SEQ ID NO: 3270174 - protein, 19 aa, Plasmodium falciparum
NCLPVNYKGIYINGNLFIP

SEQ ID NO: 3270175 - protein, 22 aa, Plasmodium falciparum
NCLSAYCKLKSVWMQNRNITVK

SEQ ID NO: 3270176 - protein, 18 aa, Plasmodium falciparum
NCLSDARHSQSYAETQCN

SEQ ID NO: 3270177 - protein, 22 aa, Plasmodium falciparum
NCLSESILHMFRSLPSIVEEVT

SEQ ID NO: 3270178 - protein, 26 aa, Plasmodium falciparum
NCLVGQRAQTNFLFLKKNHLNTTTEN

SEQ ID NO: 3270179 - protein, 21 aa, Plasmodium falciparum
NCMKCTQNLGGIVAPSSGVLA

SEQ ID NO: 3270180 - protein, 20 aa, Plasmodium falciparum
NCMNYNLGLLKLINQNNKNN

SEQ ID NO: 3270181 - protein, 31 aa, Plasmodium falciparum
NCNILFDNPCCFNKNLLCEIFCLNKICEEEL

SEQ ID NO: 3270182 - protein, 29 aa, Plasmodium falciparum
NCNKGGCGACAPYRRLHVCDKNMEKMGRT

SEQ ID NO: 3270183 - protein, 27 aa, Plasmodium falciparum
NCNKMLSHIKYLFVKLLRNQIKDIIGI

SEQ ID NO: 3270184 - protein, 26 aa, Plasmodium falciparum
NCNNIGYYHFKYCNFKKIVINYNKYY

SEQ ID NO: 3270185 - protein, 21 aa, Plasmodium falciparum
NCNNKNKFVRKVRVKEKKYTN

SEQ ID NO: 3270186 - protein, 18 aa, Plasmodium falciparum
NCNYCLDKNMLKVGYSLK

SEQ ID NO: 3270187 - protein, 28 aa, Plasmodium falciparum
NCNYFKISFYLKKAFSLLTQEGFTNDDL

SEQ ID NO: 3270188 - protein, 42 aa, Plasmodium falciparum
NCSNGKYKSTLYIVGNHLRFRGFRILAENEYEMKTKYKTLMV

SEQ ID NO: 3270189 - protein, 20 aa, Plasmodium falciparum
NCSVSSYLDQCVKENSSSSK

SEQ ID NO: 3270190 - protein, 18 aa, Plasmodium falciparum
NCSVWCRLYESWIDNQKL

SEQ ID NO: 3270191 - protein, 21 aa, Plasmodium falciparum
NCTNGKWIDCEKIHDEYRKKK

SEQ ID NO: 3270192 - protein, 19 aa, Plasmodium falciparum
NCVHIKLYILDILSNKLSQ

SEQ ID NO: 3270193 - protein, 25 aa, Plasmodium falciparum
NCVQLRNLILSAFPRNIKLPHPFNP

SEQ ID NO: 3270194 - protein, 18 aa, Plasmodium falciparum
NCVSRKCYTIHHNDKEMV

SEQ ID NO: 3270195 - protein, 24 aa, Plasmodium falciparum
NCYFYELLNYLKIKGISMKPKTPT

SEQ ID NO: 3270196 - protein, 28 aa, Plasmodium falciparum
NCYTLILLCFCHPLLFYKNINNYKSQKK

SEQ ID NO: 3270197 - protein, 17 aa, Plasmodium falciparum
NDAFKGGNIIEASNVSL

SEQ ID NO: 3270198 - protein, 17 aa, Plasmodium falciparum
NDAFLNMYIRNNDDDDD

SEQ ID NO: 3270199 - protein, 26 aa, Plasmodium falciparum
NDAFNCIRMVFILIKHVIIKIYEKIT

SEQ ID NO: 3270200 - protein, 23 aa, Plasmodium falciparum
NDAIPTCICEKSLADKTEKFCLN

SEQ ID NO: 3270201 - protein, 23 aa, Plasmodium falciparum
NDAIPTCICEKSLADKVEKTCLR

SEQ ID NO: 3270202 - protein, 20 aa, Plasmodium falciparum
NDAKFPLFYVEENKNRIKNK

SEQ ID NO: 3270203 - protein, 19 aa, Plasmodium falciparum
NDCDCFESWVKQKKEKEWK

SEQ ID NO: 3270204 - protein, 24 aa, Plasmodium falciparum
NDCPNKCKCVKEWVEEKTNEWKTL

SEQ ID NO: 3270205 - protein, 24 aa, Plasmodium falciparum
NDCPNKCKCVRKWIEKKKNEWEEI

SEQ ID NO: 3270206 - protein, 28 aa, Plasmodium falciparum
NDDDICILPCNYLHYYHKDCIFTWLKKN

SEQ ID NO: 3270207 - protein, 18 aa, Plasmodium falciparum
NDDIYMTYLRLVIKENIN

SEQ ID NO: 3270208 - protein, 23 aa, Plasmodium falciparum
NDDTVKCYLQFLSSLMRRAKNEF

SEQ ID NO: 3270209 - protein, 28 aa, Plasmodium falciparum
NDEICKKCVKVFIIFFHYTRDLIIDIKN

SEQ ID NO: 3270210 - protein, 18 aa, Plasmodium falciparum
NDEKDHWGGNLNSKVGNY

SEQ ID NO: 3270211 - protein, 24 aa, Plasmodium falciparum
NDEKLGYFKYSMTKPYMLDAKKEI

SEQ ID NO: 3270212 - protein, 24 aa, Plasmodium falciparum
NDEKNCIYGTKYAKGDIDVIYESQ

SEQ ID NO: 3270213 - protein, 24 aa, Plasmodium falciparum
NDEKRMNVLLTRMKKKIIIIGNSN

SEQ ID NO: 3270214 - protein, 23 aa, Plasmodium falciparum
NDELFKSIFRNECIIKKKKNIQK

SEQ ID NO: 3270215 - protein, 24 aa, Plasmodium falciparum
NDEMLHMLLYIYFIIWGEDLHFYE

SEQ ID NO: 3270216 - protein, 23 aa, Plasmodium falciparum
NDFACGDTHCLLNLNNQVYGWGY

SEQ ID NO: 3270217 - protein, 26 aa, Plasmodium falciparum
NDFDFCKLSYCLDFLCFCDNMEYEQK

SEQ ID NO: 3270218 - protein, 24 aa, Plasmodium falciparum
NDFFRNMFVILSFFVNHFVDKITV

SEQ ID NO: 3270219 - protein, 22 aa, Plasmodium falciparum
NDFFYKSRRCFILVESNVNLLK

SEQ ID NO: 3270220 - protein, 17 aa, Plasmodium falciparum
NDFKGESNFMLAQNKEI

SEQ ID NO: 3270221 - protein, 23 aa, Plasmodium falciparum
NDFYSLFPRRVIYMSNKQSYDMI

SEQ ID NO: 3270222 - protein, 22 aa, Plasmodium falciparum
NDGILYLIHLCNIYFENDFNNT

SEQ ID NO: 3270223 - protein, 25 aa, Plasmodium falciparum
NDHKSVCSDEYYLSISSEGKYNYDG

SEQ ID NO: 3270224 - protein, 23 aa, Plasmodium falciparum
NDHRMCNICQHFNQKLKNEIKFI

SEQ ID NO: 3270225 - protein, 22 aa, Plasmodium falciparum
NDHVYLNYLLKEMKILDDSNSI

SEQ ID NO: 3270226 - protein, 18 aa, Plasmodium falciparum
NDIAYEFVLYKNGIEKAA

SEQ ID NO: 3270227 - protein, 24 aa, Plasmodium falciparum
NDICFDFIYIFSLIMLGNILMSLN

SEQ ID NO: 3270228 - protein, 26 aa, Plasmodium falciparum
NDIEKKICKMEKCSSVFNVVNSSIGL

SEQ ID NO: 3270229 - protein, 17 aa, Plasmodium falciparum
NDIESNMNYFFNNIYIY

SEQ ID NO: 3270230 - protein, 17 aa, Plasmodium falciparum
NDIFLVVKFSYPSIWNT

SEQ ID NO: 3270231 - protein, 20 aa, Plasmodium falciparum
NDIFYPYILIIPRFFHCKKK

SEQ ID NO: 3270232 - protein, 18 aa, Plasmodium falciparum
NDIIGCGINYFDNSAFFT

SEQ ID NO: 3270233 - protein, 23 aa, Plasmodium falciparum
NDIIKRYNFHLNHINKGISEIKH

SEQ ID NO: 3270234 - protein, 17 aa, Plasmodium falciparum
NDIKCKIIIECNNISCM

SEQ ID NO: 3270235 - protein, 23 aa, Plasmodium falciparum
NDIKIGSNILYDFFKNRNSTEST

SEQ ID NO: 3270236 - protein, 17 aa, Plasmodium falciparum
NDIKMGMEMEMEMRKEM

SEQ ID NO: 3270237 - protein, 17 aa, Plasmodium falciparum
NDIKRKYNIIYLKKKNN

SEQ ID NO: 3270238 - protein, 25 aa, Plasmodium falciparum
NDILDNICICIWDMCSILTNEEKQY

SEQ ID NO: 3270239 - protein, 23 aa, Plasmodium falciparum
NDILFKYDYIRDVNKNQIYYDTG

SEQ ID NO: 3270240 - protein, 25 aa, Plasmodium falciparum
NDILNCLNNLLSIFVDIINKYDNNL

SEQ ID NO: 3270241 - protein, 20 aa, Plasmodium falciparum
NDILNVLITYSFTVSYIFFM

SEQ ID NO: 3270242 - protein, 25 aa, Plasmodium falciparum
NDIPNEFFSFFDFFKEDNIEELKSI

SEQ ID NO: 3270243 - protein, 22 aa, Plasmodium falciparum
NDIPTCICEKSLADKVEKNCLK

SEQ ID NO: 3270244 - protein, 19 aa, Plasmodium falciparum
NDIPTCICEKSMADKLEKE

SEQ ID NO: 3270245 - protein, 18 aa, Plasmodium falciparum
NDIPTCVCKKSLADKTEK

SEQ ID NO: 3270246 - protein, 19 aa, Plasmodium falciparum
NDIPVIVSSLLPFERKVTV

SEQ ID NO: 3270247 - protein, 31 aa, Plasmodium falciparum
NDIVIKALRTFICKGLKKKINKLIIFMKFGL

SEQ ID NO: 3270248 - protein, 23 aa, Plasmodium falciparum
NDIYKIEGSFVIFKYNPYGDFKT

SEQ ID NO: 3270249 - protein, 22 aa, Plasmodium falciparum
NDIYKIVLLFSPLALTSIKNKQ

SEQ ID NO: 3270250 - protein, 20 aa, Plasmodium falciparum
NDIYMSIFFLTYSFVFLKYT

SEQ ID NO: 3270251 - protein, 23 aa, Plasmodium falciparum
NDIYRLTSLLYFSLLNLNYIFLI

SEQ ID NO: 3270252 - protein, 24 aa, Plasmodium falciparum
NDKALKWAEIFSGTKSLGKNVFDL

SEQ ID NO: 3270253 - protein, 23 aa, Plasmodium falciparum
NDKCFRFLKNRTRRLYKGREKIK

SEQ ID NO: 3270254 - protein, 26 aa, Plasmodium falciparum
NDKCKNNCKKCCKKVKVRKSQRENKK

SEQ ID NO: 3270255 - protein, 23 aa, Plasmodium falciparum
NDKCNMNVHIVYEKNLLQDEFID

SEQ ID NO: 3270256 - protein, 24 aa, Plasmodium falciparum
NDKFGKQLFCFGDNKYFQCGRHLG

SEQ ID NO: 3270257 - protein, 22 aa, Plasmodium falciparum
NDKGCAFLYEDIYYRNVAQTNS

SEQ ID NO: 3270258 - protein, 23 aa, Plasmodium falciparum
NDKHLNFYIIFYIGELDKKGRPH

SEQ ID NO: 3270259 - protein, 26 aa, Plasmodium falciparum
NDKILKIYFFFDCRKISHTLLNLSSI

SEQ ID NO: 3270260 - protein, 24 aa, Plasmodium falciparum
NDKKCIFFLKRNYFINSKFLKNNF

SEQ ID NO: 3270261 - protein, 29 aa, Plasmodium falciparum
NDKKKLFKFFLHILILKQIIFESFINLAI

SEQ ID NO: 3270262 - protein, 23 aa, Plasmodium falciparum
NDKKLKIIFAIFITLLLSGSLAS

SEQ ID NO: 3270263 - protein, 27 aa, Plasmodium falciparum
NDKRCGKKCVKKCEKKCEKKCEKKCEK

SEQ ID NO: 3270264 - protein, 21 aa, Plasmodium falciparum
NDKRNSYLYTHYTRNNSSINI

SEQ ID NO: 3270265 - protein, 22 aa, Plasmodium falciparum
NDKSCLYGYISDHNYMHNKHLN

SEQ ID NO: 3270266 - protein, 46 aa, Plasmodium falciparum
NDKVLNIFINQHFIHFFNILCRFLYYDEEWCIHFLFNNYNKGSKKS

SEQ ID NO: 3270267 - protein, 22 aa, Plasmodium falciparum
NDKVMKYFWGFLLNKKQLNEVL

SEQ ID NO: 3270268 - protein, 24 aa, Plasmodium falciparum
NDKYKLFFNFCKDSYLKIPIINIL

SEQ ID NO: 3270269 - protein, 21 aa, Plasmodium falciparum
NDLCSILNMLQIILNLNLTGL

SEQ ID NO: 3270270 - protein, 19 aa, Plasmodium falciparum
NDLFIRWITDNDVLNHGEF

SEQ ID NO: 3270271 - protein, 24 aa, Plasmodium falciparum
NDLFKTSRLFKGIRKQEWTCKYKG

SEQ ID NO: 3270272 - protein, 20 aa, Plasmodium falciparum
NDLFSENWLYFLPSSSDYLL

SEQ ID NO: 3270273 - protein, 25 aa, Plasmodium falciparum
NDLFSIYLRTIYKCNEHFRNLNHVF

SEQ ID NO: 3270274 - protein, 17 aa, Plasmodium falciparum
NDLFYKEHISAYNKLGD

SEQ ID NO: 3270275 - protein, 26 aa, Plasmodium falciparum
NDLIHLMRWNITYKFMATIKTSTFFT

SEQ ID NO: 3270276 - protein, 23 aa, Plasmodium falciparum
NDLKAKICINKEFNILFNILNKM

SEQ ID NO: 3270277 - protein, 19 aa, Plasmodium falciparum
NDLKGIVSLLNLGNKTKVP

SEQ ID NO: 3270278 - protein, 20 aa, Plasmodium falciparum
NDLKLLFAELTKYLYNNDME

SEQ ID NO: 3270279 - protein, 18 aa, Plasmodium falciparum
NDLLAEVCMAANYEAQSL

SEQ ID NO: 3270280 - protein, 18 aa, Plasmodium falciparum
NDLLERYEMYAIDFSDEI

SEQ ID NO: 3270281 - protein, 20 aa, Plasmodium falciparum
NDLPSVMTCTNYLKIPDYKN

SEQ ID NO: 3270282 - protein, 23 aa, Plasmodium falciparum
NDLQYHFNSVILLDEEKGKDTDC

SEQ ID NO: 3270283 - protein, 23 aa, Plasmodium falciparum
NDLRILKKKIREYSKDLYHTLIL

SEQ ID NO: 3270284 - protein, 19 aa, Plasmodium falciparum
NDLRLCSRNYININNNEKE

SEQ ID NO: 3270285 - protein, 28 aa, Plasmodium falciparum
NDLRNILFFPSLFWFNGQFCPPIPVVKY

SEQ ID NO: 3270286 - protein, 22 aa, Plasmodium falciparum
NDLRVFEEYEMFISNIKYILKM

SEQ ID NO: 3270287 - protein, 23 aa, Plasmodium falciparum
NDLSMGFIFACIFLVSFSHYIMC

SEQ ID NO: 3270288 - protein, 17 aa, Plasmodium falciparum
NDLSSYVDNIWVRFIRR

SEQ ID NO: 3270289 - protein, 23 aa, Plasmodium falciparum
NDLTCAFYICIILFVENLKDDQN

SEQ ID NO: 3270290 - protein, 21 aa, Plasmodium falciparum
NDLVKCLLDKLGEKAKTCEQK

SEQ ID NO: 3270291 - protein, 19 aa, Plasmodium falciparum
NDLWKDCYSNYLSEKKNVE

SEQ ID NO: 3270292 - protein, 26 aa, Plasmodium falciparum
NDLWTFPLEMLDKYIFKNKNHDYKKW

SEQ ID NO: 3270293 - protein, 22 aa, Plasmodium falciparum
NDLYIFFCYFVLLRYLKKFHIY

SEQ ID NO: 3270294 - protein, 26 aa, Plasmodium falciparum
NDLYIPLEIYKLILNLLKKCISFFYL

SEQ ID NO: 3270295 - protein, 20 aa, Plasmodium falciparum
NDLYLCIYIYENIMTITKKT

SEQ ID NO: 3270296 - protein, 20 aa, Plasmodium falciparum
NDLYNCYKQMITYHNNNILN

SEQ ID NO: 3270297 - protein, 26 aa, Plasmodium falciparum
NDMCILSCAFLIYNFEYNNFEIKEKS

SEQ ID NO: 3270298 - protein, 18 aa, Plasmodium falciparum
NDMCKPAFMEIEVSSEYG

SEQ ID NO: 3270299 - protein, 17 aa, Plasmodium falciparum
NDMFKLIPFSFFIIIPF

SEQ ID NO: 3270300 - protein, 24 aa, Plasmodium falciparum
NDMHLHMLFTFWLRIKYDHSNLHL

SEQ ID NO: 3270301 - protein, 24 aa, Plasmodium falciparum
NDMIKFKFFENICLKDVSKTMIKM

SEQ ID NO: 3270302 - protein, 23 aa, Plasmodium falciparum
NDMKGLCNNDNFIFLQGDILNNK

SEQ ID NO: 3270303 - protein, 26 aa, Plasmodium falciparum
NDMLHFRKYYDILNMLTCKKYKDILI

SEQ ID NO: 3270304 - protein, 17 aa, Plasmodium falciparum
NDMSSEINFVIYIDYII

SEQ ID NO: 3270305 - protein, 24 aa, Plasmodium falciparum
NDNEDLVALGFTLSSVLKLSEFKS

SEQ ID NO: 3270306 - protein, 18 aa, Plasmodium falciparum
NDNEYKKNVLAFQLNKND

SEQ ID NO: 3270307 - protein, 21 aa, Plasmodium falciparum
NDNKIKLIFDKLLANCKNILN

SEQ ID NO: 3270308 - protein, 18 aa, Plasmodium falciparum
NDNNFAWCNAKNTIDKDK

SEQ ID NO: 3270309 - protein, 17 aa, Plasmodium falciparum
NDNSFRSIIGILDKSLL

SEQ ID NO: 3270310 - protein, 24 aa, Plasmodium falciparum
NDNTCSIYNQFLIKFYLYNNSKIN

SEQ ID NO: 3270311 - protein, 25 aa, Plasmodium falciparum
NDPANWLPWLKWISSKRAIVHVTKL

SEQ ID NO: 3270312 - protein, 24 aa, Plasmodium falciparum
NDPSAKWKFIFRDIKKMDKNMFHE

SEQ ID NO: 3270313 - protein, 18 aa, Plasmodium falciparum
NDQPRVVSNLNLVNELKR

SEQ ID NO: 3270314 - protein, 18 aa, Plasmodium falciparum
NDQWKCAIILSKVSEKPE

SEQ ID NO: 3270315 - protein, 26 aa, Plasmodium falciparum
NDQYNSFFSFEFLYLAYICSNSFPDN

SEQ ID NO: 3270316 - protein, 19 aa, Plasmodium falciparum
NDRCDYCPIVEDLCEPDTK

SEQ ID NO: 3270317 - protein, 30 aa, Plasmodium falciparum
NDREPDHLIKLITLKNIFSRQLPKMPREYI

SEQ ID NO: 3270318 - protein, 24 aa, Plasmodium falciparum
NDRMFENLPSFNLKDENVDHTLNF

SEQ ID NO: 3270319 - protein, 22 aa, Plasmodium falciparum
NDRSKKYIFCYPSNKDKNSLDM

SEQ ID NO: 3270320 - protein, 25 aa, Plasmodium falciparum
NDSKRKLMFCCEGILSIVIHYLLWN

SEQ ID NO: 3270321 - protein, 22 aa, Plasmodium falciparum
NDSKYILQFCSFNRNSYNNRKE

SEQ ID NO: 3270322 - protein, 26 aa, Plasmodium falciparum
NDSLDIILKLIILYKEKCINIEKDIM

SEQ ID NO: 3270323 - protein, 22 aa, Plasmodium falciparum
NDSMYWRGKIGGCLKNKSEKCK

SEQ ID NO: 3270324 - protein, 21 aa, Plasmodium falciparum
NDSYCNARNTWHHEINNQLNV

SEQ ID NO: 3270325 - protein, 24 aa, Plasmodium falciparum
NDSYKFLIILIIYAFFSVFILLYI

SEQ ID NO: 3270326 - protein, 23 aa, Plasmodium falciparum
NDTCALFPFHMIDNYAKTKEKKK

SEQ ID NO: 3270327 - protein, 24 aa, Plasmodium falciparum
NDTCKSFKSIKSMYTDMDYANKYN

SEQ ID NO: 3270328 - protein, 22 aa, Plasmodium falciparum
NDTFLHNCLYIRIPKPDKILFN

SEQ ID NO: 3270329 - protein, 30 aa, Plasmodium falciparum
NDTILKSAICNRMYNRLCKAIPKVHIKLPL

SEQ ID NO: 3270330 - protein, 22 aa, Plasmodium falciparum
NDTLKIAKIFKEDFVLDQMNLK

SEQ ID NO: 3270331 - protein, 25 aa, Plasmodium falciparum
NDVFNYNICLFLFLFKKEDIEEYFF

SEQ ID NO: 3270332 - protein, 20 aa, Plasmodium falciparum
NDVFQIYISLFFNNYINHNL

SEQ ID NO: 3270333 - protein, 18 aa, Plasmodium falciparum
NDVNKFYEIYKMMNAGND

SEQ ID NO: 3270334 - protein, 20 aa, Plasmodium falciparum
NDVRTGGGLCILQKKNGEEN

SEQ ID NO: 3270335 - protein, 21 aa, Plasmodium falciparum
NDVYIKLFFTEDFLIQKTNIP

SEQ ID NO: 3270336 - protein, 21 aa, Plasmodium falciparum
NDVYILIKICNLLDINAVSHV

SEQ ID NO: 3270337 - protein, 17 aa, Plasmodium falciparum
NDYDMIYSIYFVLINIM

SEQ ID NO: 3270338 - protein, 22 aa, Plasmodium falciparum
NDYESFGAYLFEKTYATYKSKN

SEQ ID NO: 3270339 - protein, 30 aa, Plasmodium falciparum
NDYFYSEHIFKCLLKLLYGIISLCSSHSAI

SEQ ID NO: 3270340 - protein, 27 aa, Plasmodium falciparum
NDYIFRIYNLFKLQSYYDIKKNILEYV

SEQ ID NO: 3270341 - protein, 18 aa, Plasmodium falciparum
NDYIMKYLLKNKVYEHVD

SEQ ID NO: 3270342 - protein, 19 aa, Plasmodium falciparum
NDYMLPFFEFIFKENCFLI

SEQ ID NO: 3270343 - protein, 17 aa, Plasmodium falciparum
NDYNFLFFFDKIEIDNK

SEQ ID NO: 3270344 - protein, 22 aa, Plasmodium falciparum
NDYRTLNEWEYHISPSRHGTIV

SEQ ID NO: 3270345 - protein, 20 aa, Plasmodium falciparum
NEALFIKDMITLHIVNMLNQ

SEQ ID NO: 3270346 - protein, 20 aa, Plasmodium falciparum
NEANEIFYLSRERNNQFLNQ

SEQ ID NO: 3270347 - protein, 21 aa, Plasmodium falciparum
NEANFIFFLWLIYLLILLDSL

SEQ ID NO: 3270348 - protein, 36 aa, Plasmodium falciparum
NEAPPKLSDFVLRPTYFRYLEEWGETFCSERMKRLK

SEQ ID NO: 3270349 - protein, 22 aa, Plasmodium falciparum
NECLTLFSFLSYLIVFPNILNI

SEQ ID NO: 3270350 - protein, 19 aa, Plasmodium falciparum
NECRILAAFFSYYALFIGA

SEQ ID NO: 3270351 - protein, 23 aa, Plasmodium falciparum
NECSDCFHMMNLNYTSYTKELCK

SEQ ID NO: 3270352 - protein, 25 aa, Plasmodium falciparum
NEDFRREFHNILSIHEDTDLMELKR

SEQ ID NO: 3270353 - protein, 24 aa, Plasmodium falciparum
NEDFYSSTFIHFAFADPYDTFDLL

SEQ ID NO: 3270354 - protein, 29 aa, Plasmodium falciparum
NEDIKMILECLGNIKIKYEYTLHLFNIEY

SEQ ID NO: 3270355 - protein, 27 aa, Plasmodium falciparum
NEDLSLDLPTIFAHLILFNEKEAKDMS

SEQ ID NO: 3270356 - protein, 22 aa, Plasmodium falciparum
NEDMSYDEYMGYKKKEEDESYN

SEQ ID NO: 3270357 - protein, 17 aa, Plasmodium falciparum
NEEAAAILDDWASLLKS

SEQ ID NO: 3270358 - protein, 23 aa, Plasmodium falciparum
NEEGKIYNCFDKFYDTYIKNNKY

SEQ ID NO: 3270359 - protein, 24 aa, Plasmodium falciparum
NEEIDILCFLVFVQLNKKKCYNFD

SEQ ID NO: 3270360 - protein, 23 aa, Plasmodium falciparum
NEEIEKGKFCRVVKIVERKNVEV

SEQ ID NO: 3270361 - protein, 26 aa, Plasmodium falciparum
NEEIIQLFCFSKYILEKYMDKIKMKL

SEQ ID NO: 3270362 - protein, 32 aa, Plasmodium falciparum
NEEKGVIIACLFAEWYFIYKNYLNILKMSISN

SEQ ID NO: 3270363 - protein, 24 aa, Plasmodium falciparum
NEEKHEKKHVLSHNSYEKTKNNEN

SEQ ID NO: 3270364 - protein, 24 aa, Plasmodium falciparum
NEEKRKGGVIQMNYQGSIYPDVYI

SEQ ID NO: 3270365 - protein, 32 aa, Plasmodium falciparum
NEEKYILGSEIIKKLLLDKCKENCDLDIELTK

SEQ ID NO: 3270366 - protein, 19 aa, Plasmodium falciparum
NEELTILTINSFKNDLNNN

SEQ ID NO: 3270367 - protein, 20 aa, Plasmodium falciparum
NEEMCYINKWVLKLLDTHSS

SEQ ID NO: 3270368 - protein, 24 aa, Plasmodium falciparum
NEEQKVEISLFFDGLTNYECYVLI

SEQ ID NO: 3270369 - protein, 26 aa, Plasmodium falciparum
NEERKSLCCSISDFCLKYFDHNSNKY

SEQ ID NO: 3270370 - protein, 17 aa, Plasmodium falciparum
NEESLYMNNMYNMNSNN

SEQ ID NO: 3270371 - protein, 20 aa, Plasmodium falciparum
NEEYTIIGLPNFNKLDIYEN

SEQ ID NO: 3270372 - protein, 21 aa, Plasmodium falciparum
NEFEISLLLCVNVSNCISPSE

SEQ ID NO: 3270373 - protein, 17 aa, Plasmodium falciparum
NEFELSYNVLKICINEF

SEQ ID NO: 3270374 - protein, 21 aa, Plasmodium falciparum
NEFGKLLLFVCNMNDAFSTTA

SEQ ID NO: 3270375 - protein, 23 aa, Plasmodium falciparum
NEFICSFLSYILLYIYMFTKNNL

SEQ ID NO: 3270376 - protein, 27 aa, Plasmodium falciparum
NEFILKVYTDFYYKKRENIYKQEGLEL

SEQ ID NO: 3270377 - protein, 27 aa, Plasmodium falciparum
NEFITLISACRLLWRKLADDMTKACKV

SEQ ID NO: 3270378 - protein, 22 aa, Plasmodium falciparum
NEFNVLLELQLCILDMLCKKNK

SEQ ID NO: 3270379 - protein, 21 aa, Plasmodium falciparum
NEFTLHPFLFAFYKTSNNKKN

SEQ ID NO: 3270380 - protein, 20 aa, Plasmodium falciparum
NEFYESVKLYQSILESDNEI

SEQ ID NO: 3270381 - protein, 21 aa, Plasmodium falciparum
NEHFFKLFMFINKYLNFFNIN

SEQ ID NO: 3270382 - protein, 17 aa, Plasmodium falciparum
NEHFRNLNHVFFIYSNY

SEQ ID NO: 3270383 - protein, 18 aa, Plasmodium falciparum
NEHIEICPYYLSKENIKN

SEQ ID NO: 3270384 - protein, 18 aa, Plasmodium falciparum
NEHIHFVLHLSLYTLYKS

SEQ ID NO: 3270385 - protein, 22 aa, Plasmodium falciparum
NEHISFYLSKWIIEDNNTSYYI

SEQ ID NO: 3270386 - protein, 19 aa, Plasmodium falciparum
NEHKKELEELGLLNIKSLL

SEQ ID NO: 3270387 - protein, 17 aa, Plasmodium falciparum
NEHVIDFVHFFFYSIYK

SEQ ID NO: 3270388 - protein, 37 aa, Plasmodium falciparum
NEHYEYVFFFLIIFYKYMQINLLHFISIFNDFYSLFP

SEQ ID NO: 3270389 - protein, 25 aa, Plasmodium falciparum
NEIEKEIFSLISLLTSIKIFIPFFS

SEQ ID NO: 3270390 - protein, 26 aa, Plasmodium falciparum
NEIFNCLKGSFILFYIHYDITNINVY

SEQ ID NO: 3270391 - protein, 23 aa, Plasmodium falciparum
NEIKGCCYPYIFLNTILYCSKIV

SEQ ID NO: 3270392 - protein, 25 aa, Plasmodium falciparum
NEIKKKLPIRIQKVILTYQLQAIYF

SEQ ID NO: 3270393 - protein, 26 aa, Plasmodium falciparum
NEIKKRLRTNFNLLVKEAKIVINNII

SEQ ID NO: 3270394 - protein, 24 aa, Plasmodium falciparum
NEIKSVLIKNGYDIRKCYNGIDLI

SEQ ID NO: 3270395 - protein, 27 aa, Plasmodium falciparum
NEIKTIWKNYRLEKMEYWKKYLSSKFK

SEQ ID NO: 3270396 - protein, 18 aa, Plasmodium falciparum
NEINELFLTSYNIKLNIE

SEQ ID NO: 3270397 - protein, 22 aa, Plasmodium falciparum
NEINKDLGILIDIYKSIKNILY

SEQ ID NO: 3270398 - protein, 25 aa, Plasmodium falciparum
NEINKKILSSICHGGVWDELVTLYD

SEQ ID NO: 3270399 - protein, 25 aa, Plasmodium falciparum
NEIRRKQYDFLLSHNIFYNCNKKEL

SEQ ID NO: 3270400 - protein, 25 aa, Plasmodium falciparum
NEISFMNLYLSFLIIDIDKKTVKLF

SEQ ID NO: 3270401 - protein, 19 aa, Plasmodium falciparum
NEIYEYFKNINIMQNIKRI

SEQ ID NO: 3270402 - protein, 26 aa, Plasmodium falciparum
NEIYIVREIIRIGGDLFVNKYHECGL

SEQ ID NO: 3270403 - protein, 19 aa, Plasmodium falciparum
NEKCIRSQILSYFGETYPN

SEQ ID NO: 3270404 - protein, 20 aa, Plasmodium falciparum
NEKDDLIILNYIYNKFVKEN

SEQ ID NO: 3270405 - protein, 26 aa, Plasmodium falciparum
NEKECAKMIIPLYKLLVTRLKICLYY

SEQ ID NO: 3270406 - protein, 17 aa, Plasmodium falciparum
NEKFEVMENIDPKDNTI

SEQ ID NO: 3270407 - protein, 33 aa, Plasmodium falciparum
NEKIMEILHFLPLKYLLDLLILYDLKDYIKFKT

SEQ ID NO: 3270408 - protein, 20 aa, Plasmodium falciparum
NEKISFFLPFKCLPAQHRKL

SEQ ID NO: 3270409 - protein, 32 aa, Plasmodium falciparum
NEKLELKKSVKILKKRLNSISNDLEKRTEEIE

SEQ ID NO: 3270410 - protein, 22 aa, Plasmodium falciparum
NEKLLIFLLKMIKIFYSEWYNL

SEQ ID NO: 3270411 - protein, 23 aa, Plasmodium falciparum
NEKLRKPKHKKLKQPADGNPDPN

SEQ ID NO: 3270412 - protein, 23 aa, Plasmodium falciparum
NEKNEIFRIFDFGLFLTDIHLNK

SEQ ID NO: 3270413 - protein, 22 aa, Plasmodium falciparum
NEKNIICHGLIFLKLLNCFYPY

SEQ ID NO: 3270414 - protein, 22 aa, Plasmodium falciparum
NEKQEIIISFSVRKYSYDIAKA

SEQ ID NO: 3270415 - protein, 24 aa, Plasmodium falciparum
NEKYNELILYSFFYNKNIKSTRDY

SEQ ID NO: 3270416 - protein, 29 aa, Plasmodium falciparum
NEKYRILICLYIALNFCMELILRFSPEST

SEQ ID NO: 3270417 - protein, 25 aa, Plasmodium falciparum
NEKYYKIIYYLLLYNFKYVFKKLKL

SEQ ID NO: 3270418 - protein, 20 aa, Plasmodium falciparum
NELCFMTRAHFHIFLNVLIE

SEQ ID NO: 3270419 - protein, 24 aa, Plasmodium falciparum
NELDKFLLKLNELLSHNNNDIKDL

SEQ ID NO: 3270420 - protein, 24 aa, Plasmodium falciparum
NELEYKVMYPFALTADNMLFIINL

SEQ ID NO: 3270421 - protein, 25 aa, Plasmodium falciparum
NELIIKYDKYVLCVDDDKRITNAYR

SEQ ID NO: 3270422 - protein, 25 aa, Plasmodium falciparum
NELIKTFYYFHNFTFLFLKETNIRI

SEQ ID NO: 3270423 - protein, 17 aa, Plasmodium falciparum
NELISLDIFLPMNKQYC

SEQ ID NO: 3270424 - protein, 22 aa, Plasmodium falciparum
NELIYFFFNFVFDINNEQTKLL

SEQ ID NO: 3270425 - protein, 25 aa, Plasmodium falciparum
NELKEWKILLIRIINNTYKDVDIMK

SEQ ID NO: 3270426 - protein, 24 aa, Plasmodium falciparum
NELKKIVNIFIFLKNVITFLKGKK

SEQ ID NO: 3270427 - protein, 17 aa, Plasmodium falciparum
NELKLSDNMYSNFTSPL

SEQ ID NO: 3270428 - protein, 21 aa, Plasmodium falciparum
NELKSYLLLVHHLINARNSPC

SEQ ID NO: 3270429 - protein, 22 aa, Plasmodium falciparum
NELKTNEYFTFIKDIFISIHQN

SEQ ID NO: 3270430 - protein, 17 aa, Plasmodium falciparum
NELKVSMKSFFQSSNSQ

SEQ ID NO: 3270431 - protein, 21 aa, Plasmodium falciparum
NELMIYLLIKIHSSGSLFFKI

SEQ ID NO: 3270432 - protein, 25 aa, Plasmodium falciparum
NELNIRMIYFFLNYIKFYQYENMNF

SEQ ID NO: 3270433 - protein, 20 aa, Plasmodium falciparum
NELPSERALVLFRYIPIPGD

SEQ ID NO: 3270434 - protein, 18 aa, Plasmodium falciparum
NELRCVISNDELRNEINL

SEQ ID NO: 3270435 - protein, 26 aa, Plasmodium falciparum
NELSCFYPNNADVFHFLSSKEKEIDD

SEQ ID NO: 3270436 - protein, 19 aa, Plasmodium falciparum
NELSLFIFNAIMSLNNFYL

SEQ ID NO: 3270437 - protein, 21 aa, Plasmodium falciparum
NELTCFLLRREERRNKSKANY

SEQ ID NO: 3270438 - protein, 26 aa, Plasmodium falciparum
NELVCPKEKLLFLINNYYYIIYILKQ

SEQ ID NO: 3270439 - protein, 17 aa, Plasmodium falciparum
NELVETFFYLNDISHNN

SEQ ID NO: 3270440 - protein, 20 aa, Plasmodium falciparum
NELYSLSGYDKKNFKKELRK

SEQ ID NO: 3270441 - protein, 24 aa, Plasmodium falciparum
NEMCSSTLKKYEEWYNKRKTEWTE

SEQ ID NO: 3270442 - protein, 44 aa, Plasmodium falciparum
NEMKSDVKIIKTVWLCNIFCCIIYYIFGYVLCTAYPNINNDNIL

SEQ ID NO: 3270443 - protein, 17 aa, Plasmodium falciparum
NEMKYDPNHYMWKDLYP

SEQ ID NO: 3270444 - protein, 17 aa, Plasmodium falciparum
NEMYDFLNLQMNEENIS

SEQ ID NO: 3270445 - protein, 20 aa, Plasmodium falciparum
NENFFWGRGKHDSKYTSKLS

SEQ ID NO: 3270446 - protein, 20 aa, Plasmodium falciparum
NENFLKLYLYLCSQNSKGGM

SEQ ID NO: 3270447 - protein, 26 aa, Plasmodium falciparum
NENIFDCADYIYKHIFKNKKEKINDE

SEQ ID NO: 3270448 - protein, 19 aa, Plasmodium falciparum
NENKIICSTNNVFDDFSFF

SEQ ID NO: 3270449 - protein, 24 aa, Plasmodium falciparum
NENKMERCTNILGLDKRETVIKIN

SEQ ID NO: 3270450 - protein, 23 aa, Plasmodium falciparum
NENKRKLLLYIFPFMKEKKHEKV

SEQ ID NO: 3270451 - protein, 25 aa, Plasmodium falciparum
NENMCMYLHLLYICSLYNEHILYNK

SEQ ID NO: 3270452 - protein, 25 aa, Plasmodium falciparum
NENNNKCYFEMFNFLIKNGAKKVLN

SEQ ID NO: 3270453 - protein, 22 aa, Plasmodium falciparum
NENRNKICFITSYLKSLKDEDT

SEQ ID NO: 3270454 - protein, 21 aa, Plasmodium falciparum
NENVIKLIILYIKYNMNKFSF

SEQ ID NO: 3270455 - protein, 26 aa, Plasmodium falciparum
NENVVFLSFFENFYFFNTFTNNGQAS

SEQ ID NO: 3270456 - protein, 30 aa, Plasmodium falciparum
NEPQINRWILEWGKYNCRLMKEKEKLLTGE

SEQ ID NO: 3270457 - protein, 28 aa, Plasmodium falciparum
NEPSLYYYTCIKILTGHNARVWDIDMGK

SEQ ID NO: 3270458 - protein, 25 aa, Plasmodium falciparum
NEPYRHFYNGLSMHLYGVILFSGCN

SEQ ID NO: 3270459 - protein, 25 aa, Plasmodium falciparum
NEQENIWGDRCVPIIQGDEKKKEIR

SEQ ID NO: 3270460 - protein, 21 aa, Plasmodium falciparum
NERHGIKLAFMNSGEQGKVMK

SEQ ID NO: 3270461 - protein, 22 aa, Plasmodium falciparum
NERLYRRNVEFNDADIYKKNGN

SEQ ID NO: 3270462 - protein, 34 aa, Plasmodium falciparum
NERRIKDMHLFLDNKMKYMIDKQHKLIEQLQKDI

SEQ ID NO: 3270463 - protein, 26 aa, Plasmodium falciparum
NERRRTLRWRGYKDAKLNSPFVDDLF

SEQ ID NO: 3270464 - protein, 20 aa, Plasmodium falciparum
NERVRTIFTIFLIKLGIEEI

SEQ ID NO: 3270465 - protein, 28 aa, Plasmodium falciparum
NESDNIYCMLCSSNTRGFGCDCKDAANY

SEQ ID NO: 3270466 - protein, 28 aa, Plasmodium falciparum
NESFTYWRKVRRSIYQNIQYKDYLNNKK

SEQ ID NO: 3270467 - protein, 24 aa, Plasmodium falciparum
NESHKCLNKILDIITRFINITTSL

SEQ ID NO: 3270468 - protein, 18 aa, Plasmodium falciparum
NESIEWRERLKSCINDAK

SEQ ID NO: 3270469 - protein, 25 aa, Plasmodium falciparum
NESIYFKKRINMLDFVMNDYKKENF

SEQ ID NO: 3270470 - protein, 30 aa, Plasmodium falciparum
NESKIHGFFLLRCLPPIKMFPKQLVIQETQ

SEQ ID NO: 3270471 - protein, 23 aa, Plasmodium falciparum
NESKRKSRRKKVKVNLKDNLAKR

SEQ ID NO: 3270472 - protein, 17 aa, Plasmodium falciparum
NESQSMFPLGASSNQQG

SEQ ID NO: 3270473 - protein, 21 aa, Plasmodium falciparum
NESRKVYNYVPIFYTSKINFL

SEQ ID NO: 3270474 - protein, 34 aa, Plasmodium falciparum
NESYSFIKLLFRKCIIFFIIYFLFIIPLNEVIYN

SEQ ID NO: 3270475 - protein, 25 aa, Plasmodium falciparum
NESYTFMVPMKFYINHEMYNISDEE

SEQ ID NO: 3270476 - protein, 18 aa, Plasmodium falciparum
NESYVLSDLCIDDKKGNE

SEQ ID NO: 3270477 - protein, 22 aa, Plasmodium falciparum
NETIFLKHIIQYICNTDKCIYV

SEQ ID NO: 3270478 - protein, 21 aa, Plasmodium falciparum
NETNEGLSFFNEILGTELALY

SEQ ID NO: 3270479 - protein, 28 aa, Plasmodium falciparum
NETYRSYLIIECISLFLYTYGHLLNDEK

SEQ ID NO: 3270480 - protein, 26 aa, Plasmodium falciparum
NEVKVVDVLCEWNCKNSSNIYSEDPN

SEQ ID NO: 3270481 - protein, 17 aa, Plasmodium falciparum
NEVLWLIYEHDFLYYFR

SEQ ID NO: 3270482 - protein, 25 aa, Plasmodium falciparum
NEVSEGIVFFCFIFISATMLQFILS

SEQ ID NO: 3270483 - protein, 17 aa, Plasmodium falciparum
NEVSLYCGQIIAEYFKK

SEQ ID NO: 3270484 - protein, 29 aa, Plasmodium falciparum
NEVTKLIYVYTWCILYIFGHSYSYVKYAK

SEQ ID NO: 3270485 - protein, 19 aa, Plasmodium falciparum
NEVYFIFSHYINIECQRKY

SEQ ID NO: 3270486 - protein, 25 aa, Plasmodium falciparum
NEWELHLDCCINCYKEYEKKNFCIM

SEQ ID NO: 3270487 - protein, 24 aa, Plasmodium falciparum
NEWKLILQHFKKQGGFSIFGNDYN

SEQ ID NO: 3270488 - protein, 17 aa, Plasmodium falciparum
NEYAEICLPIFTDSVPV

SEQ ID NO: 3270489 - protein, 21 aa, Plasmodium falciparum
NEYFFNNIILIIAYKNKYLNT

SEQ ID NO: 3270490 - protein, 19 aa, Plasmodium falciparum
NEYFLYNFLRKEYLQCEVF

SEQ ID NO: 3270491 - protein, 24 aa, Plasmodium falciparum
NEYIKKCLRRNLNIIDLEKDVQNL

SEQ ID NO: 3270492 - protein, 27 aa, Plasmodium falciparum
NEYILRILSFCYLKIYVLLNSYNNISK

SEQ ID NO: 3270493 - protein, 35 aa, Plasmodium falciparum
NEYKIIIKLYVNFCKKMFSYIVENYFMWKNNSLSQ

SEQ ID NO: 3270494 - protein, 20 aa, Plasmodium falciparum
NEYLIRKAAHIMVASLASSL

SEQ ID NO: 3270495 - protein, 21 aa, Plasmodium falciparum
NEYLNCYGMPEWAEKNGEENE

SEQ ID NO: 3270496 - protein, 20 aa, Plasmodium falciparum
NEYLYSYLFILAIKKMFYDI

SEQ ID NO: 3270497 - protein, 20 aa, Plasmodium falciparum
NEYMKIFLKYVNDDIIKVYK

SEQ ID NO: 3270498 - protein, 27 aa, Plasmodium falciparum
NEYMYIFFCNNLYFFVIFINGEVTQIS

SEQ ID NO: 3270499 - protein, 17 aa, Plasmodium falciparum
NEYNYRHILLNNYTNNL

SEQ ID NO: 3270500 - protein, 17 aa, Plasmodium falciparum
NEYSYLLYYILALTTFL

SEQ ID NO: 3270501 - protein, 18 aa, Plasmodium falciparum
NEYTNCINIFKLALKQNA

SEQ ID NO: 3270502 - protein, 26 aa, Plasmodium falciparum
NFAIMCKQAYIIKWICLRMFILKKYD

SEQ ID NO: 3270503 - protein, 23 aa, Plasmodium falciparum
NFALKMKNFIIISSDIRSVQNNK

SEQ ID NO: 3270504 - protein, 33 aa, Plasmodium falciparum
NFASFYFYKYLCNIFKRDSRRYIDMKRTNVLKY

SEQ ID NO: 3270505 - protein, 17 aa, Plasmodium falciparum
NFDIFILLQKGNISLNE

SEQ ID NO: 3270506 - protein, 20 aa, Plasmodium falciparum
NFDIKHFIKIFIYSDNKLRN

SEQ ID NO: 3270507 - protein, 17 aa, Plasmodium falciparum
NFDSAVDDVQWCGNNHM

SEQ ID NO: 3270508 - protein, 18 aa, Plasmodium falciparum
NFEDKYDLYTCSFHLFYY

SEQ ID NO: 3270509 - protein, 27 aa, Plasmodium falciparum
NFEEYIHALVLFLKLVPYLSHDVLYHI

SEQ ID NO: 3270510 - protein, 24 aa, Plasmodium falciparum
NFEFIYLFKRSFRLYNKNLNNSFL

SEQ ID NO: 3270511 - protein, 18 aa, Plasmodium falciparum
NFEFLKILFNYNSSIFSY

SEQ ID NO: 3270512 - protein, 24 aa, Plasmodium falciparum
NFEKFMKIMDSFFLLLNSKMNINI

SEQ ID NO: 3270513 - protein, 22 aa, Plasmodium falciparum
NFENFKNLFIIYTNSFLQKNKI

SEQ ID NO: 3270514 - protein, 22 aa, Plasmodium falciparum
NFEVFSTYIINDFMLNKKRINV

SEQ ID NO: 3270515 - protein, 24 aa, Plasmodium falciparum
NFFAEFIPILIFLSNIIIFNNDDY

SEQ ID NO: 3270516 - protein, 31 aa, Plasmodium falciparum
NFFFPFLCFLFFSFLFIFKIIMSLYYEYVYE

SEQ ID NO: 3270517 - protein, 20 aa, Plasmodium falciparum
NFFIFLFLDRLYLILETYLR

SEQ ID NO: 3270518 - protein, 18 aa, Plasmodium falciparum
NFFLSALCGIIFFHEKRK

SEQ ID NO: 3270519 - protein, 22 aa, Plasmodium falciparum
NFFRFLEKNNFIYDIKNCNIHS

SEQ ID NO: 3270520 - protein, 19 aa, Plasmodium falciparum
NFFVDEFMKSSNYEQAKKN

SEQ ID NO: 3270521 - protein, 22 aa, Plasmodium falciparum
NFFWENCTIFYNILLKENYKFL

SEQ ID NO: 3270522 - protein, 24 aa, Plasmodium falciparum
NFGSYRYMAPETFSCTTEVTEKID

SEQ ID NO: 3270523 - protein, 25 aa, Plasmodium falciparum
NFHEHMYLFILLAINKWFKRIIVEC

SEQ ID NO: 3270524 - protein, 20 aa, Plasmodium falciparum
NFHMSIPIKNIFGSNKMQYK

SEQ ID NO: 3270525 - protein, 18 aa, Plasmodium falciparum
NFHSLFWFIPASDFNINL

SEQ ID NO: 3270526 - protein, 20 aa, Plasmodium falciparum
NFIDIFTLSILTFHFNCADI

SEQ ID NO: 3270527 - protein, 18 aa, Plasmodium falciparum
NFIDTLIMFYILLKNKLN

SEQ ID NO: 3270528 - protein, 20 aa, Plasmodium falciparum
NFIFYFFRYYYRINNNINKH

SEQ ID NO: 3270529 - protein, 25 aa, Plasmodium falciparum
NFIIIADLFKGIFINMYNYEEQYDS

SEQ ID NO: 3270530 - protein, 20 aa, Plasmodium falciparum
NFIIKIILNYLYNGNNQYKK

SEQ ID NO: 3270531 - protein, 28 aa, Plasmodium falciparum
NFIKESFIPKFIDLVIWGHEHFSKPYLE

SEQ ID NO: 3270532 - protein, 26 aa, Plasmodium falciparum
NFIREFAYVYKIYVDKVLNKFLKSSK

SEQ ID NO: 3270533 - protein, 23 aa, Plasmodium falciparum
NFIRNEIYSHKWINRLQFKLQNY

SEQ ID NO: 3270534 - protein, 27 aa, Plasmodium falciparum
NFISVKGPELLTMWFGESEANVRDLFD

SEQ ID NO: 3270535 - protein, 18 aa, Plasmodium falciparum
NFIYACLPFEFINKYEFL

SEQ ID NO: 3270536 - protein, 27 aa, Plasmodium falciparum
NFIYLKEVELFFLLTCVLYYMERDMNL

SEQ ID NO: 3270537 - protein, 19 aa, Plasmodium falciparum
NFKKLGVKLGYNIKNIQNK

SEQ ID NO: 3270538 - protein, 23 aa, Plasmodium falciparum
NFKLIKKFFLYLSKLRNIEYQSF

SEQ ID NO: 3270539 - protein, 23 aa, Plasmodium falciparum
NFKNELFTHIPFLIKQYKQYIIV

SEQ ID NO: 3270540 - protein, 22 aa, Plasmodium falciparum
NFKRIKMLHIFSILNCLVNIFF

SEQ ID NO: 3270541 - protein, 24 aa, Plasmodium falciparum
NFKSESVLKEFLHEQTHAILEKIK

SEQ ID NO: 3270542 - protein, 18 aa, Plasmodium falciparum
NFLCCLKINKYYYYYSWL

SEQ ID NO: 3270543 - protein, 28 aa, Plasmodium falciparum
NFLCKNFPSYIGLFAHLWFECKILLAEK

SEQ ID NO: 3270544 - protein, 17 aa, Plasmodium falciparum
NFLEIFFSNFMNKNEDI

SEQ ID NO: 3270545 - protein, 24 aa, Plasmodium falciparum
NFLFIKSVYPFDMLTKEKGEEEFD

SEQ ID NO: 3270546 - protein, 28 aa, Plasmodium falciparum
NFLFMIKKLKSFFFFTTKFSYLHMFHDT

SEQ ID NO: 3270547 - protein, 26 aa, Plasmodium falciparum
NFLIFLCSYFLYFICLSGLFHCLINK

SEQ ID NO: 3270548 - protein, 18 aa, Plasmodium falciparum
NFLKKCKDQILFNLKSKW

SEQ ID NO: 3270549 - protein, 17 aa, Plasmodium falciparum
NFLKRDYNLIFQNLRNS

SEQ ID NO: 3270550 - protein, 19 aa, Plasmodium falciparum
NFLPYGIAIAVFIAVIIIV

SEQ ID NO: 3270551 - protein, 28 aa, Plasmodium falciparum
NFLRAKKELYLKAFLYHFYSRNITELFK

SEQ ID NO: 3270552 - protein, 21 aa, Plasmodium falciparum
NFLYIGLVHNHIWDSKTTIMQ

SEQ ID NO: 3270553 - protein, 17 aa, Plasmodium falciparum
NFLYLNIPKSIKRYLFF

SEQ ID NO: 3270554 - protein, 23 aa, Plasmodium falciparum
NFMEFCKNSAFIIADIIITLLLN

SEQ ID NO: 3270555 - protein, 19 aa, Plasmodium falciparum
NFMNLCIDKNINYNNNNNN

SEQ ID NO: 3270556 - protein, 24 aa, Plasmodium falciparum
NFNCPDCGKSCRSYKKWINIKKDE

SEQ ID NO: 3270557 - protein, 18 aa, Plasmodium falciparum
NFNDLLIRIKNGSIGYNL

SEQ ID NO: 3270558 - protein, 24 aa, Plasmodium falciparum
NFNELETFCVLVSLMNNYYLKDFY

SEQ ID NO: 3270559 - protein, 34 aa, Plasmodium falciparum
NFNHLCSYIFLTIIYCLHSYLFKYNSSNDQIYYL

SEQ ID NO: 3270560 - protein, 19 aa, Plasmodium falciparum
NFNICPKKNIDILNYHIKV

SEQ ID NO: 3270561 - protein, 23 aa, Plasmodium falciparum
NFNIKICLNDILILDSSTNKKVS

SEQ ID NO: 3270562 - protein, 18 aa, Plasmodium falciparum
NFNIKKCLDNIDEQMTYY

SEQ ID NO: 3270563 - protein, 26 aa, Plasmodium falciparum
NFNIPPFYSVDGFKGENSNFYEQKLS

SEQ ID NO: 3270564 - protein, 24 aa, Plasmodium falciparum
NFNMVSSLVIKRTLTEMLIYNSKS

SEQ ID NO: 3270565 - protein, 24 aa, Plasmodium falciparum
NFNNIRLNIFFSYTSRNEMSLCSF

SEQ ID NO: 3270566 - protein, 28 aa, Plasmodium falciparum
NFNQRPYYRLFLSILIEINKYEKSFEDI

SEQ ID NO: 3270567 - protein, 20 aa, Plasmodium falciparum
NFNRRIVKFINALNKQDNSN

SEQ ID NO: 3270568 - protein, 21 aa, Plasmodium falciparum
NFPNVPIIYKFNIPRITFTWI

SEQ ID NO: 3270569 - protein, 25 aa, Plasmodium falciparum
NFPSIPFSLCIHGKESTFSFVIPMS

SEQ ID NO: 3270570 - protein, 25 aa, Plasmodium falciparum
NFPTRKESTFDYIPGKSIETNCSKE

SEQ ID NO: 3270571 - protein, 31 aa, Plasmodium falciparum
NFPVDSLLLILKQAYIGKEFYNIQWDIYYNM

SEQ ID NO: 3270572 - protein, 26 aa, Plasmodium falciparum
NFQNTKELLLCIGFLIDSTSLFEQYD

SEQ ID NO: 3270573 - protein, 46 aa, Plasmodium falciparum
NFREKLFIFIILCLISVCLALLVSIAIKVYASVMKKKIGDKHDVVL

SEQ ID NO: 3270574 - protein, 22 aa, Plasmodium falciparum
NFRFLERYFNIFNKYFVELFRR

SEQ ID NO: 3270575 - protein, 19 aa, Plasmodium falciparum
NFRNLFLLYQLTIRGIHKL

SEQ ID NO: 3270576 - protein, 22 aa, Plasmodium falciparum
NFSGHILESVGWIYENVGKCYI

SEQ ID NO: 3270577 - protein, 26 aa, Plasmodium falciparum
NFSGTLLKFPMKINIEKKHMCDKIIM

SEQ ID NO: 3270578 - protein, 33 aa, Plasmodium falciparum
NFSPLKPCEGLECLPQVLFLYVIFLLLCTGIFM

SEQ ID NO: 3270579 - protein, 18 aa, Plasmodium falciparum
NFSTIIIHHSRDSKLKQW

SEQ ID NO: 3270580 - protein, 18 aa, Plasmodium falciparum
NFSYKCRYYKCTTENQEF

SEQ ID NO: 3270581 - protein, 27 aa, Plasmodium falciparum
NFSYKYMIINRLVEICINSINKKMFFL

SEQ ID NO: 3270582 - protein, 19 aa, Plasmodium falciparum
NFTHFIHLFLSIHEESYNN

SEQ ID NO: 3270583 - protein, 22 aa, Plasmodium falciparum
NFTNLIEFVILLFKNILIDFHI

SEQ ID NO: 3270584 - protein, 21 aa, Plasmodium falciparum
NFVDLPLLYFLKNSKDVKNKM

SEQ ID NO: 3270585 - protein, 20 aa, Plasmodium falciparum
NFVSCKSLNIPKDIVNTITY

SEQ ID NO: 3270586 - protein, 30 aa, Plasmodium falciparum
NFWILLLCSITWIFYIRFTYLLIYYREKVK

SEQ ID NO: 3270587 - protein, 25 aa, Plasmodium falciparum
NFYDNWYIYCAFVNLIYYILNYKEN

SEQ ID NO: 3270588 - protein, 19 aa, Plasmodium falciparum
NFYLFLFISIIEFTLLYTR

SEQ ID NO: 3270589 - protein, 27 aa, Plasmodium falciparum
NFYLKEIYKNFFFYLTRMNLINKYLHD

SEQ ID NO: 3270590 - protein, 21 aa, Plasmodium falciparum
NFYNNCLKYAIYQNKENTNLH

SEQ ID NO: 3270591 - protein, 18 aa, Plasmodium falciparum
NFYRCCLLSLSMTINVSV

SEQ ID NO: 3270592 - protein, 25 aa, Plasmodium falciparum
NFYRYKGNISFEFLCLDICMQLSIK

SEQ ID NO: 3270593 - protein, 20 aa, Plasmodium falciparum
NGCQNKCNCVKEWIEKKKEE

SEQ ID NO: 3270594 - protein, 18 aa, Plasmodium falciparum
NGDCSNSTEKKCDAQEFK

SEQ ID NO: 3270595 - protein, 34 aa, Plasmodium falciparum
NGDIKYPPLFKEHILNILLSFCINNYQDNMYKYL

SEQ ID NO: 3270596 - protein, 18 aa, Plasmodium falciparum
NGDSFKFSAYNAEQHDNM

SEQ ID NO: 3270597 - protein, 26 aa, Plasmodium falciparum
NGEKKKKFHAIWSCAHYKKYKRRRNI

SEQ ID NO: 3270598 - protein, 25 aa, Plasmodium falciparum
NGEVCEVVVIIKIFNYIFEIIDIER

SEQ ID NO: 3270599 - protein, 18 aa, Plasmodium falciparum
NGFGILLFGYKVVPKNEY

SEQ ID NO: 3270600 - protein, 34 aa, Plasmodium falciparum
NGFLHSSITFSNDFCKGMNLHFLISAEEIDSKFF

SEQ ID NO: 3270601 - protein, 18 aa, Plasmodium falciparum
NGFSNFFNKLFGKKKDNK

SEQ ID NO: 3270602 - protein, 26 aa, Plasmodium falciparum
NGFVKCGRNSYSRACSKSLNSSIYIN

SEQ ID NO: 3270603 - protein, 18 aa, Plasmodium falciparum
NGGLLFNITHLMRDYNNR

SEQ ID NO: 3270604 - protein, 29 aa, Plasmodium falciparum
NGGLYICWSKILFRLCYYDFMFLSSDIIF

SEQ ID NO: 3270605 - protein, 19 aa, Plasmodium falciparum
NGIKEKLCSFVNKNILKRI

SEQ ID NO: 3270606 - protein, 23 aa, Plasmodium falciparum
NGIPESTRFGFTHDVVLGEFLEL

SEQ ID NO: 3270607 - protein, 17 aa, Plasmodium falciparum
NGIYKFINIFGSNIIRS

SEQ ID NO: 3270608 - protein, 24 aa, Plasmodium falciparum
NGKCFLNNVPLFFANLSQNIMNII

SEQ ID NO: 3270609 - protein, 30 aa, Plasmodium falciparum
NGKFFFPYEQLRAVFWIWIQSLFSDISYLE

SEQ ID NO: 3270610 - protein, 18 aa, Plasmodium falciparum
NGKFKGYHTFCSFDNIKY

SEQ ID NO: 3270611 - protein, 24 aa, Plasmodium falciparum
NGKFWIQIVHNIWIPLIINHFNSI

SEQ ID NO: 3270612 - protein, 23 aa, Plasmodium falciparum
NGKKQVCLYPFIQISNSINKGMS

SEQ ID NO: 3270613 - protein, 22 aa, Plasmodium falciparum
NGKVCFMKYISCLNKINHYFKN

SEQ ID NO: 3270614 - protein, 21 aa, Plasmodium falciparum
NGKYIDCFDLSPSTTVDQFKE

SEQ ID NO: 3270615 - protein, 29 aa, Plasmodium falciparum
NGKYLGKACTINFKYDYYATVGLSTLGDR

SEQ ID NO: 3270616 - protein, 18 aa, Plasmodium falciparum
NGLVKLVKSVKCNCGNNS

SEQ ID NO: 3270617 - protein, 37 aa, Plasmodium falciparum
NGNHERMYFASGIVVSILFLFSFGFVINSKNNKQEYD

SEQ ID NO: 3270618 - protein, 28 aa, Plasmodium falciparum
NGNKCYELLRFLFFFIKQNDLITINIYK

SEQ ID NO: 3270619 - protein, 37 aa, Plasmodium falciparum
NGNKKCGKKICNGDCECFKRWVEQKETEWGKIKEHFK

SEQ ID NO: 3270620 - protein, 29 aa, Plasmodium falciparum
NGNKKCGKKICNGDCECFQRWVEKKKTEW

SEQ ID NO: 3270621 - protein, 33 aa, Plasmodium falciparum
NGNKKCGKKICNSDCDCFKRWVDQKKEQEWMKI

SEQ ID NO: 3270622 - protein, 21 aa, Plasmodium falciparum
NGNLYNRILMKYIKKKRKEKR

SEQ ID NO: 3270623 - protein, 20 aa, Plasmodium falciparum
NGNNCCKYVHLLQTFDEKYF

SEQ ID NO: 3270624 - protein, 21 aa, Plasmodium falciparum
NGNSLLHWAVFLNNVYLVYYL

SEQ ID NO: 3270625 - protein, 25 aa, Plasmodium falciparum
NGPATLKGLCEYMASLISSSNDFDF

SEQ ID NO: 3270626 - protein, 17 aa, Plasmodium falciparum
NGPDAGSFLDFVDEPEQ

SEQ ID NO: 3270627 - protein, 26 aa, Plasmodium falciparum
NGPMSNFNYHLFKILCSNDEIYMYFF

SEQ ID NO: 3270628 - protein, 22 aa, Plasmodium falciparum
NGQEKCVHRLGGLNCTHDEDDK

SEQ ID NO: 3270629 - protein, 20 aa, Plasmodium falciparum
NGRFSFLQIEILKEIIKKKN

SEQ ID NO: 3270630 - protein, 21 aa, Plasmodium falciparum
NGTFKDCLCIEGYIKNYQESY

SEQ ID NO: 3270631 - protein, 19 aa, Plasmodium falciparum
NGTKILCKNGCNKNCKCYE

SEQ ID NO: 3270632 - protein, 24 aa, Plasmodium falciparum
NGTSKYARTGACSLSVLIDERNYY

SEQ ID NO: 3270633 - protein, 19 aa, Plasmodium falciparum
NGVCNHIIFTYKYNKSKFL

SEQ ID NO: 3270634 - protein, 23 aa, Plasmodium falciparum
NGYKHLKILKGIHSRIFQHEFDH

SEQ ID NO: 3270635 - protein, 19 aa, Plasmodium falciparum
NGYKKYILFQLEKNFYDLY

SEQ ID NO: 3270636 - protein, 24 aa, Plasmodium falciparum
NGYYFKKLIRLPVIVKINNIIFTH

SEQ ID NO: 3270637 - protein, 33 aa, Plasmodium falciparum
NHANFSFSPHEVMLLKKWNLLKFKQARKNHILR

SEQ ID NO: 3270638 - protein, 23 aa, Plasmodium falciparum
NHCCSSHYYKSFIMNDTSDNNNN

SEQ ID NO: 3270639 - protein, 18 aa, Plasmodium falciparum
NHCQKYFSNFDIYFQNIQ

SEQ ID NO: 3270640 - protein, 18 aa, Plasmodium falciparum
NHEFRKKMIKSFRKRSID

SEQ ID NO: 3270641 - protein, 23 aa, Plasmodium falciparum
NHFARNQFLFNFIFYSNILIYLE

SEQ ID NO: 3270642 - protein, 19 aa, Plasmodium falciparum
NHFFFFFQNCHPFVHGENE

SEQ ID NO: 3270643 - protein, 18 aa, Plasmodium falciparum
NHFHHIAYASSPFVKINL

SEQ ID NO: 3270644 - protein, 17 aa, Plasmodium falciparum
NHFLKRNILSVSEQECC

SEQ ID NO: 3270645 - protein, 24 aa, Plasmodium falciparum
NHFQKLIYHFCNIDTNIFKNILYL

SEQ ID NO: 3270646 - protein, 21 aa, Plasmodium falciparum
NHFSNIFFSSFVHIMSEIKYD

SEQ ID NO: 3270647 - protein, 19 aa, Plasmodium falciparum
NHINRLIYMNSFKTYILSA

SEQ ID NO: 3270648 - protein, 25 aa, Plasmodium falciparum
NHKEPNEYICFIVDTIFIYMEILYE

SEQ ID NO: 3270649 - protein, 22 aa, Plasmodium falciparum
NHKKDYRSSSIVMNKINYFSFY

SEQ ID NO: 3270650 - protein, 21 aa, Plasmodium falciparum
NHKKYKRKRIFLHMKNDNKIV

SEQ ID NO: 3270651 - protein, 22 aa, Plasmodium falciparum
NHLEILSNFYFLINNKKYVNQL

SEQ ID NO: 3270652 - protein, 24 aa, Plasmodium falciparum
NHLKLKMLNIYLWIMRFLNINCSN

SEQ ID NO: 3270653 - protein, 17 aa, Plasmodium falciparum
NHLKNKFVYNIKDTDVY

SEQ ID NO: 3270654 - protein, 17 aa, Plasmodium falciparum
NHLNVLYGNGLSNYLQS

SEQ ID NO: 3270655 - protein, 24 aa, Plasmodium falciparum
NHLSKGICSDSIFYKSSQSKSSSQ

SEQ ID NO: 3270656 - protein, 20 aa, Plasmodium falciparum
NHLYYLYNIYPLLFKLKEIK

SEQ ID NO: 3270657 - protein, 18 aa, Plasmodium falciparum
NHMNICLKHLIKYYQKQK

SEQ ID NO: 3270658 - protein, 29 aa, Plasmodium falciparum
NHNFMLAKEYSWYVWKKQLNVAKYNKDDY

SEQ ID NO: 3270659 - protein, 38 aa, Plasmodium falciparum
NHNHLKSAYSLFIKNSRDLYLFTLMVIYKKYRCIENFK

SEQ ID NO: 3270660 - protein, 24 aa, Plasmodium falciparum
NHNIYKLLFLWLLFLYVTSFFTFY

SEQ ID NO: 3270661 - protein, 24 aa, Plasmodium falciparum
NHQDVKIIILYYFIENISKKIKTL

SEQ ID NO: 3270662 - protein, 17 aa, Plasmodium falciparum
NHQNICSHKNYGTYYYR

SEQ ID NO: 3270663 - protein, 19 aa, Plasmodium falciparum
NHSFIWEIDFNRILHRINP

SEQ ID NO: 3270664 - protein, 22 aa, Plasmodium falciparum
NHSIIPLKWIKSNYLKEYKNCI

SEQ ID NO: 3270665 - protein, 19 aa, Plasmodium falciparum
NHSYTMKPYKICIGTLNNI

SEQ ID NO: 3270666 - protein, 24 aa, Plasmodium falciparum
NHTCTFKNIYMFDVIHFINNNINI

SEQ ID NO: 3270667 - protein, 22 aa, Plasmodium falciparum
NHTEPIFYMSFLKSPFYFSRKF

SEQ ID NO: 3270668 - protein, 32 aa, Plasmodium falciparum
NHYLCSGFKKENRLFFLLFYKTIKMMKLYIRN

SEQ ID NO: 3270669 - protein, 37 aa, Plasmodium falciparum
NHYMNYGYKYSFHVLDIRFRIMRLLESLQFHDLFCTY

SEQ ID NO: 3270670 - protein, 22 aa, Plasmodium falciparum
NIAESFNPISLNTHMYLEKAQE

SEQ ID NO: 3270671 - protein, 25 aa, Plasmodium falciparum
NIAKTEFYYLFNIFYSQNIDMLRKQ

SEQ ID NO: 3270672 - protein, 19 aa, Plasmodium falciparum
NIALCCWLFYLNKLVDFVD

SEQ ID NO: 3270673 - protein, 19 aa, Plasmodium falciparum
NIASFCFELQFRFIEDDTT

SEQ ID NO: 3270674 - protein, 24 aa, Plasmodium falciparum
NICDYDMEFFFLIFSQIFDHYSQQ

SEQ ID NO: 3270675 - protein, 26 aa, Plasmodium falciparum
NICFCYFCVKYNFVILNYIYLYNIFH

SEQ ID NO: 3270676 - protein, 18 aa, Plasmodium falciparum
NICFQFFVENLFLGHNMD

SEQ ID NO: 3270677 - protein, 33 aa, Plasmodium falciparum
NICIDKYICLFFKEVYYIISRTNMEYFALVTHL

SEQ ID NO: 3270678 - protein, 22 aa, Plasmodium falciparum
NICILFKYVWVLGLLLCHKDIW

SEQ ID NO: 3270679 - protein, 24 aa, Plasmodium falciparum
NICIYIKSLCYFFQRNYIYYYINM

SEQ ID NO: 3270680 - protein, 23 aa, Plasmodium falciparum
NICKNLHMITCIFFLLMNNKVNN

SEQ ID NO: 3270681 - protein, 19 aa, Plasmodium falciparum
NICLLKLKVNQGILIKFRN

SEQ ID NO: 3270682 - protein, 18 aa, Plasmodium falciparum
NICQKSCEKVYTPLIVQL

SEQ ID NO: 3270683 - protein, 28 aa, Plasmodium falciparum
NICSCTSLHFLHSISFILKKFNNNNFTT

SEQ ID NO: 3270684 - protein, 21 aa, Plasmodium falciparum
NICTYEYKNAVGFQSNNFHNR

SEQ ID NO: 3270685 - protein, 26 aa, Plasmodium falciparum
NICTYIRGGADFAYDIFLVTTHVVTT

SEQ ID NO: 3270686 - protein, 24 aa, Plasmodium falciparum
NIDHMFDFDLDDILKIPEAQRKLN

SEQ ID NO: 3270687 - protein, 18 aa, Plasmodium falciparum
NIDICNILYSFSRCQLAI

SEQ ID NO: 3270688 - protein, 22 aa, Plasmodium falciparum
NIDIKSSLLLLKDLIISSEFGL

SEQ ID NO: 3270689 - protein, 21 aa, Plasmodium falciparum
NIDIWNSTFFYLHFNENINIL

SEQ ID NO: 3270690 - protein, 24 aa, Plasmodium falciparum
NIDKCLRLIVNLINIYKKIKKKKK

SEQ ID NO: 3270691 - protein, 18 aa, Plasmodium falciparum
NIDKFKFKYSKRDYENMK

SEQ ID NO: 3270692 - protein, 21 aa, Plasmodium falciparum
NIDLMCDPFSFLTYEEEDVNK

SEQ ID NO: 3270693 - protein, 22 aa, Plasmodium falciparum
NIDNFFTVCIYKAVEGACTVLN

SEQ ID NO: 3270694 - protein, 19 aa, Plasmodium falciparum
NIDSYFIIEMLKIFDEFLK

SEQ ID NO: 3270695 - protein, 26 aa, Plasmodium falciparum
NIDYKCPTCSIGTFHDKIERILYLLF

SEQ ID NO: 3270696 - protein, 18 aa, Plasmodium falciparum
NIECSLIYMQGRICGINH

SEQ ID NO: 3270697 - protein, 24 aa, Plasmodium falciparum
NIECYKLDGLCVNWNDMSENIFHG

SEQ ID NO: 3270698 - protein, 24 aa, Plasmodium falciparum
NIEENNCIYNLFGKKNIIKDDVTE

SEQ ID NO: 3270699 - protein, 22 aa, Plasmodium falciparum
NIEHIKQILINYIQECKPIQNI

SEQ ID NO: 3270700 - protein, 22 aa, Plasmodium falciparum
NIEIRNPFIILYQLIFKNFRMN

SEQ ID NO: 3270701 - protein, 30 aa, Plasmodium falciparum
NIEIYFCMICWNNILFCKESLFKDTINYFF

SEQ ID NO: 3270702 - protein, 23 aa, Plasmodium falciparum
NIEKYEHICFLFLITEMLSVVLL

SEQ ID NO: 3270703 - protein, 24 aa, Plasmodium falciparum
NIEMLKIRINYICDKENIKINNEA

SEQ ID NO: 3270704 - protein, 23 aa, Plasmodium falciparum
NIERIKHLFITFNYNKEKKINNY

SEQ ID NO: 3270705 - protein, 23 aa, Plasmodium falciparum
NIFCCKDDCVWKVRETENEKKFE

SEQ ID NO: 3270706 - protein, 18 aa, Plasmodium falciparum
NIFECIMCRNKCHIECAP

SEQ ID NO: 3270707 - protein, 25 aa, Plasmodium falciparum
NIFFEIFKSNSFFIVLSLFIHSFIE

SEQ ID NO: 3270708 - protein, 20 aa, Plasmodium falciparum
NIFFFTSYISYWFNYNIIYN

SEQ ID NO: 3270709 - protein, 20 aa, Plasmodium falciparum
NIFFIYNLLPIFIKNLLYSQ

SEQ ID NO: 3270710 - protein, 20 aa, Plasmodium falciparum
NIFFKNSINYNYLIEEAINK

SEQ ID NO: 3270711 - protein, 24 aa, Plasmodium falciparum
NIFFNKELAGFIVAALERAIQMER

SEQ ID NO: 3270712 - protein, 22 aa, Plasmodium falciparum
NIFFPRYNMETLIKINKKLYEK

SEQ ID NO: 3270713 - protein, 23 aa, Plasmodium falciparum
NIFHKDTYPYSSFTVQEHNEKKN

SEQ ID NO: 3270714 - protein, 30 aa, Plasmodium falciparum
NIFHYYSDKCIFKIIFIDEHKELLKFKNFT

SEQ ID NO: 3270715 - protein, 18 aa, Plasmodium falciparum
NIFIISWTKFKYAYTPID

SEQ ID NO: 3270716 - protein, 18 aa, Plasmodium falciparum
NIFIKNLLVFINNLIILY

SEQ ID NO: 3270717 - protein, 21 aa, Plasmodium falciparum
NIFIPIIIYLTIYFKTKKIPP

SEQ ID NO: 3270718 - protein, 24 aa, Plasmodium falciparum
NIFKLLHLMIPYDIATTILNEQWI

SEQ ID NO: 3270719 - protein, 29 aa, Plasmodium falciparum
NIFKNAEFYRLFTSLFLHSNFNHICANTY

SEQ ID NO: 3270720 - protein, 42 aa, Plasmodium falciparum
NIFKYICLTCAFKIYKLFKIIFENILLYILFILFFIKNWYTR

SEQ ID NO: 3270721 - protein, 20 aa, Plasmodium falciparum
NIFLCSWGIILIDLSCIHYS

SEQ ID NO: 3270722 - protein, 17 aa, Plasmodium falciparum
NIFLKILLFPVVCPEMW

SEQ ID NO: 3270723 - protein, 27 aa, Plasmodium falciparum
NIFLLFRLQYLIKCPFLNNNNNNNIYL

SEQ ID NO: 3270724 - protein, 19 aa, Plasmodium falciparum
NIFLPIDSFLKFISNTFNF

SEQ ID NO: 3270725 - protein, 20 aa, Plasmodium falciparum
NIFLPLAYLFYNIYKIKCFY

SEQ ID NO: 3270726 - protein, 26 aa, Plasmodium falciparum
NIFLTWKCLGINLSLTIPALYLYLYL

SEQ ID NO: 3270727 - protein, 18 aa, Plasmodium falciparum
NIFLVFQKTLKYYLFCYM

SEQ ID NO: 3270728 - protein, 17 aa, Plasmodium falciparum
NIFLYLQLRLNILSQSN

SEQ ID NO: 3270729 - protein, 30 aa, Plasmodium falciparum
NIFMIRECVCLSYIFSLFCDKYKILDSLLC

SEQ ID NO: 3270730 - protein, 24 aa, Plasmodium falciparum
NIFQLCVLFSFFKKFHINNTILIS

SEQ ID NO: 3270731 - protein, 22 aa, Plasmodium falciparum
NIFSILINIFFKNCTNVIFVIF

SEQ ID NO: 3270732 - protein, 23 aa, Plasmodium falciparum
NIFSKNFFCECMDECCCNDGYET

SEQ ID NO: 3270733 - protein, 17 aa, Plasmodium falciparum
NIFSRQLPKMPREYIVR

SEQ ID NO: 3270734 - protein, 17 aa, Plasmodium falciparum
NIFTIGCDINFYRIKQC

SEQ ID NO: 3270735 - protein, 17 aa, Plasmodium falciparum
NIFTLRISEEIQKFLLL

SEQ ID NO: 3270736 - protein, 18 aa, Plasmodium falciparum
NIFVELYFNINYPFSYMH

SEQ ID NO: 3270737 - protein, 33 aa, Plasmodium falciparum
NIGEPCILLRSTSWGHLSLFYGSHLNRDYYTYE

SEQ ID NO: 3270738 - protein, 27 aa, Plasmodium falciparum
NIGGIKGRFHKFISFKNKSNISFFFNS

SEQ ID NO: 3270739 - protein, 30 aa, Plasmodium falciparum
NIGIMKKFYKFCGKGLILVNVQYINNDTEK

SEQ ID NO: 3270740 - protein, 23 aa, Plasmodium falciparum
NIGKLWYPKEANIFFQNVQSQYN

SEQ ID NO: 3270741 - protein, 23 aa, Plasmodium falciparum
NIGYFCPGGYKIGEKKCPKNTTN

SEQ ID NO: 3270742 - protein, 25 aa, Plasmodium falciparum
NIHFKFKINKLLCNTLNNLLIEQMI

SEQ ID NO: 3270743 - protein, 17 aa, Plasmodium falciparum
NIHFPIKSDIYGEEQNC

SEQ ID NO: 3270744 - protein, 19 aa, Plasmodium falciparum
NIHHITCNLSIHIIIQLII

SEQ ID NO: 3270745 - protein, 17 aa, Plasmodium falciparum
NIHIAKTDLQHMTINEL

SEQ ID NO: 3270746 - protein, 23 aa, Plasmodium falciparum
NIHIPIYIYNIFKYYIKKKLSTF

SEQ ID NO: 3270747 - protein, 29 aa, Plasmodium falciparum
NIHKACVTIELFLKIIILCFKHINDNKHN

SEQ ID NO: 3270748 - protein, 23 aa, Plasmodium falciparum
NIHKEHIYHIFPHKNYYNIQNMN

SEQ ID NO: 3270749 - protein, 25 aa, Plasmodium falciparum
NIHKHKLIYNRYIILNSIVESKLSS

SEQ ID NO: 3270750 - protein, 25 aa, Plasmodium falciparum
NIHKYLFYMFECVLNKISLKNNMKY

SEQ ID NO: 3270751 - protein, 18 aa, Plasmodium falciparum
NIHYIHCGYPNIFNNCRN

SEQ ID NO: 3270752 - protein, 26 aa, Plasmodium falciparum
NIICNELKCHLPFLQPYSITVTLNYL

SEQ ID NO: 3270753 - protein, 28 aa, Plasmodium falciparum
NIICWKWKILEPFKLLTVFLHEFSHASA

SEQ ID NO: 3270754 - protein, 18 aa, Plasmodium falciparum
NIIELYIYYYNKIVLLLL

SEQ ID NO: 3270755 - protein, 24 aa, Plasmodium falciparum
NIIELYNKVSIALNRYLYRFCEWN

SEQ ID NO: 3270756 - protein, 25 aa, Plasmodium falciparum
NIIFSLCILGTFLVLPLYLSLPRND

SEQ ID NO: 3270757 - protein, 26 aa, Plasmodium falciparum
NIIIKYAVFHSCLLLLSGIQIYFICP

SEQ ID NO: 3270758 - protein, 23 aa, Plasmodium falciparum
NIIKYENFHMLKSVSMAMKKLTN

SEQ ID NO: 3270759 - protein, 19 aa, Plasmodium falciparum
NIILFLFVISLKIYDISHV

SEQ ID NO: 3270760 - protein, 20 aa, Plasmodium falciparum
NIILVFVFLFCYKYYDSFSD

SEQ ID NO: 3270761 - protein, 22 aa, Plasmodium falciparum
NIILYFILIVTFTFYNKDLFNK

SEQ ID NO: 3270762 - protein, 25 aa, Plasmodium falciparum
NIILYRKHMIHEFIKMCTSQENQDE

SEQ ID NO: 3270763 - protein, 18 aa, Plasmodium falciparum
NIIMPKQLSIFINYLGRN

SEQ ID NO: 3270764 - protein, 45 aa, Plasmodium falciparum
NIINFLLECCISNGCIIRYMSLRVFYKMTKLFILYIKNRKLEYEE

SEQ ID NO: 3270765 - protein, 25 aa, Plasmodium falciparum
NIINFLLLFKYHFLHNYFIYNEYKL

SEQ ID NO: 3270766 - protein, 20 aa, Plasmodium falciparum
NIINNFLKYVKFFKTLKKKK

SEQ ID NO: 3270767 - protein, 26 aa, Plasmodium falciparum
NIINPFFLYNKMFCMNNNANNFNNGN

SEQ ID NO: 3270768 - protein, 27 aa, Plasmodium falciparum
NIIQTRMLYLRAILFIPDSIYLNILYF

SEQ ID NO: 3270769 - protein, 24 aa, Plasmodium falciparum
NIIRYYIYNMLWFELYYFITNLKI

SEQ ID NO: 3270770 - protein, 18 aa, Plasmodium falciparum
NIITFGWIYCVKHNFIKF

SEQ ID NO: 3270771 - protein, 17 aa, Plasmodium falciparum
NIIVINISFFFIKDDKK

SEQ ID NO: 3270772 - protein, 40 aa, Plasmodium falciparum
NIIVKSCKNSLKWKGKMFKKRSLIEMTLKVPAKIKYIEDE

SEQ ID NO: 3270773 - protein, 34 aa, Plasmodium falciparum
NIIWSEPRERGGIFSDSFIQFTIYNLEVCNKNIF

SEQ ID NO: 3270774 - protein, 24 aa, Plasmodium falciparum
NIIYCLCNYNFFICQLFYNLIFPL

SEQ ID NO: 3270775 - protein, 34 aa, Plasmodium falciparum
NIIYICIFCFLKNYMILYSFLYNCRFSIFCILFI

SEQ ID NO: 3270776 - protein, 18 aa, Plasmodium falciparum
NIIYSIVLCNMIKQEYYT

SEQ ID NO: 3270777 - protein, 18 aa, Plasmodium falciparum
NIIYVSSSYAYCLKDHRI

SEQ ID NO: 3270778 - protein, 17 aa, Plasmodium falciparum
NIKDCIMYYDMLPIHKI

SEQ ID NO: 3270779 - protein, 25 aa, Plasmodium falciparum
NIKEFLQLKFSYDILSNKKKRKMYD

SEQ ID NO: 3270780 - protein, 30 aa, Plasmodium falciparum
NIKEIFCIIIDYFLCFICRIIDTHMMNLKM

SEQ ID NO: 3270781 - protein, 23 aa, Plasmodium falciparum
NIKEIKKLIKYITFYNNQNENHI

SEQ ID NO: 3270782 - protein, 18 aa, Plasmodium falciparum
NIKEKKNLLELLNVKEED

SEQ ID NO: 3270783 - protein, 23 aa, Plasmodium falciparum
NIKELNDFFLKRGHQLNQNCDST

SEQ ID NO: 3270784 - protein, 30 aa, Plasmodium falciparum
NIKETCLYLLRYIFKYIFNIYNYINNFSYH

SEQ ID NO: 3270785 - protein, 18 aa, Plasmodium falciparum
NIKFMFPSLYALNICSLN

SEQ ID NO: 3270786 - protein, 20 aa, Plasmodium falciparum
NIKFYDIFKIILKGIYSIKC

SEQ ID NO: 3270787 - protein, 20 aa, Plasmodium falciparum
NIKGILSRVAQIFFQVLRNE

SEQ ID NO: 3270788 - protein, 24 aa, Plasmodium falciparum
NIKHLSFIFNFMFYEHIIQPTKLF

SEQ ID NO: 3270789 - protein, 25 aa, Plasmodium falciparum
NIKISSYLSKGGFGVVYKGSLIRKV

SEQ ID NO: 3270790 - protein, 23 aa, Plasmodium falciparum
NIKKEENHEIPILNNNPLNQMTN

SEQ ID NO: 3270791 - protein, 22 aa, Plasmodium falciparum
NIKKEFQLREAFIKCAGAEIFL

SEQ ID NO: 3270792 - protein, 19 aa, Plasmodium falciparum
NIKKINCDEIGKNWDYSFI

SEQ ID NO: 3270793 - protein, 25 aa, Plasmodium falciparum
NIKKNIKHTIVWVKTGILLFLTNMK

SEQ ID NO: 3270794 - protein, 23 aa, Plasmodium falciparum
NIKKNRIIHILNIIYNKITYNVN

SEQ ID NO: 3270795 - protein, 18 aa, Plasmodium falciparum
NIKKWKSYLKKYIYNNTA

SEQ ID NO: 3270796 - protein, 31 aa, Plasmodium falciparum
NIKKYMVLYKICIFMLTCLIQTIYINNKYIT

SEQ ID NO: 3270797 - protein, 35 aa, Plasmodium falciparum
NIKLGKWSWTGICCSCGYLQIPAFMINSSNVDRMN

SEQ ID NO: 3270798 - protein, 18 aa, Plasmodium falciparum
NIKLSTFIWSKYVFEKIL

SEQ ID NO: 3270799 - protein, 21 aa, Plasmodium falciparum
NIKLYDKWYEHMLYIYEEKFK

SEQ ID NO: 3270800 - protein, 17 aa, Plasmodium falciparum
NIKNGLPSLEFIIDYIV

SEQ ID NO: 3270801 - protein, 24 aa, Plasmodium falciparum
NIKNKSTWDFVSFKITKKENNYNI

SEQ ID NO: 3270802 - protein, 24 aa, Plasmodium falciparum
NIKNLYLKRIINFLNISEEKASIV

SEQ ID NO: 3270803 - protein, 26 aa, Plasmodium falciparum
NIKNNISGYCFLNFGLKKNAIIKKRE

SEQ ID NO: 3270804 - protein, 20 aa, Plasmodium falciparum
NIKQLCPIIYKLKNDEKYNL

SEQ ID NO: 3270805 - protein, 23 aa, Plasmodium falciparum
NIKRLKKCRNFNDNDSYSSLDEL

SEQ ID NO: 3270806 - protein, 24 aa, Plasmodium falciparum
NIKRRKFQECLDINEYAYKNDYLL

SEQ ID NO: 3270807 - protein, 21 aa, Plasmodium falciparum
NIKSDKCFLCNKKKKNYNETL

SEQ ID NO: 3270808 - protein, 33 aa, Plasmodium falciparum
NIKSEGFIFFVLVFFICIIFGCIYESLHEGPYK

SEQ ID NO: 3270809 - protein, 21 aa, Plasmodium falciparum
NIKYGKWKIKKIIDHSIIINN

SEQ ID NO: 3270810 - protein, 22 aa, Plasmodium falciparum
NIKYKIRYLYNISHQEKKKKKK

SEQ ID NO: 3270811 - protein, 26 aa, Plasmodium falciparum
NILCHYFAYHVFIIFCNIMQNDIAYE

SEQ ID NO: 3270812 - protein, 26 aa, Plasmodium falciparum
NILCKLKLKSYRTRNRFIDKGEGHEL

SEQ ID NO: 3270813 - protein, 26 aa, Plasmodium falciparum
NILCYAVYKYLSACAVLYTNNDSNIK

SEQ ID NO: 3270814 - protein, 20 aa, Plasmodium falciparum
NILECIKREININGKDIILK

SEQ ID NO: 3270815 - protein, 23 aa, Plasmodium falciparum
NILEPFCLNFFFLKDDYSYDKNA

SEQ ID NO: 3270816 - protein, 18 aa, Plasmodium falciparum
NILERRGNENAKEGNDND

SEQ ID NO: 3270817 - protein, 22 aa, Plasmodium falciparum
NILEYFTELYIVSNLRHPNVTL

SEQ ID NO: 3270818 - protein, 17 aa, Plasmodium falciparum
NILEYLFYCFFRNDEYF

SEQ ID NO: 3270819 - protein, 21 aa, Plasmodium falciparum
NILFCGLNNGMIIIYQLDKKL

SEQ ID NO: 3270820 - protein, 18 aa, Plasmodium falciparum
NILFNFVTELFKYVENMN

SEQ ID NO: 3270821 - protein, 23 aa, Plasmodium falciparum
NILFPYFHMEILKDNEMNITKYY

SEQ ID NO: 3270822 - protein, 25 aa, Plasmodium falciparum
NILFYFPYEHSYTYDWRSHTTVQIK

SEQ ID NO: 3270823 - protein, 25 aa, Plasmodium falciparum
NILHELWGDINFKWIDEDNEKDWLK

SEQ ID NO: 3270824 - protein, 17 aa, Plasmodium falciparum
NILIDFVPLVLKKNKKK

SEQ ID NO: 3270825 - protein, 18 aa, Plasmodium falciparum
NILIKSLYIFNLIFFLTF

SEQ ID NO: 3270826 - protein, 21 aa, Plasmodium falciparum
NILKIKFGIENFVIYTHIYTD

SEQ ID NO: 3270827 - protein, 33 aa, Plasmodium falciparum
NILKKERKYLGFAMFCLIASSLGQMIFPMCISK

SEQ ID NO: 3270828 - protein, 28 aa, Plasmodium falciparum
NILKKKRLIHIYIKYMYLYEYLYHMILN

SEQ ID NO: 3270829 - protein, 23 aa, Plasmodium falciparum
NILKKSNLHMCIINIVDQKIKEF

SEQ ID NO: 3270830 - protein, 29 aa, Plasmodium falciparum
NILKNNCFFKEQYVYIKLYINKKTFNLSL

SEQ ID NO: 3270831 - protein, 17 aa, Plasmodium falciparum
NILKRIKHETGYKNKMK

SEQ ID NO: 3270832 - protein, 23 aa, Plasmodium falciparum
NILLCSSEKYLITSFQKTITKKI

SEQ ID NO: 3270833 - protein, 24 aa, Plasmodium falciparum
NILLEKEIYYYVSINNKKNFENVT

SEQ ID NO: 3270834 - protein, 20 aa, Plasmodium falciparum
NILLKLCSFIFLYNNKNTYV

SEQ ID NO: 3270835 - protein, 24 aa, Plasmodium falciparum
NILLKQWYFFYFKKFQKKNHLFNI

SEQ ID NO: 3270836 - protein, 18 aa, Plasmodium falciparum
NILLKYLVNYCLVVLIKL

SEQ ID NO: 3270837 - protein, 18 aa, Plasmodium falciparum
NILLYSIEDLNKYKTLEL

SEQ ID NO: 3270838 - protein, 24 aa, Plasmodium falciparum
NILNCKCLNTILYYLKEFFKDYKM

SEQ ID NO: 3270839 - protein, 41 aa, Plasmodium falciparum
NILNIRKILRIMRELYIGFIGLQLIYFITYILFGNNNVYLI

SEQ ID NO: 3270840 - protein, 19 aa, Plasmodium falciparum
NILNIYGTPLFYNKNLEKW

SEQ ID NO: 3270841 - protein, 22 aa, Plasmodium falciparum
NILNNCYVHFFITFNSKYYYKN

SEQ ID NO: 3270842 - protein, 27 aa, Plasmodium falciparum
NILREFVSSIIIPLLIQKKIWTNKFIW

SEQ ID NO: 3270843 - protein, 28 aa, Plasmodium falciparum
NILRNYYLLECFFFKTKKILFLQKNQMF

SEQ ID NO: 3270844 - protein, 23 aa, Plasmodium falciparum
NILSLCILCVIFMSLKFIQDINL

SEQ ID NO: 3270845 - protein, 26 aa, Plasmodium falciparum
NILSSFLCTFFSIKINKNVLSNINNI

SEQ ID NO: 3270846 - protein, 22 aa, Plasmodium falciparum
NILTCLFFFFLFFFFFFVYYKP

SEQ ID NO: 3270847 - protein, 17 aa, Plasmodium falciparum
NILTDVYLFLPLEYHPY

SEQ ID NO: 3270848 - protein, 21 aa, Plasmodium falciparum
NILVVCHFIISCLCRNGQTTR

SEQ ID NO: 3270849 - protein, 19 aa, Plasmodium falciparum
NILYHICMHPYLDINELTQ

SEQ ID NO: 3270850 - protein, 20 aa, Plasmodium falciparum
NILYHIPFLLFFNLLKNENV

SEQ ID NO: 3270851 - protein, 18 aa, Plasmodium falciparum
NILYKKKCIQQMYFNNSI

SEQ ID NO: 3270852 - protein, 18 aa, Plasmodium falciparum
NILYNILYTYNFHLHNFL

SEQ ID NO: 3270853 - protein, 24 aa, Plasmodium falciparum
NILYVLKRCEVFYFYTNYKVEEFS

SEQ ID NO: 3270854 - protein, 20 aa, Plasmodium falciparum
NIMDLFKYNVVFIKCKILDD

SEQ ID NO: 3270855 - protein, 20 aa, Plasmodium falciparum
NIMFDTCIMLIDIFVDNKIY

SEQ ID NO: 3270856 - protein, 26 aa, Plasmodium falciparum
NIMKFKLNKYFPFFLQIFLTIMHYIN

SEQ ID NO: 3270857 - protein, 23 aa, Plasmodium falciparum
NIMSSLWFLYILFIIENNHIYVF

SEQ ID NO: 3270858 - protein, 23 aa, Plasmodium falciparum
NIMTLRDLIKWANRYPNNNMEAC

SEQ ID NO: 3270859 - protein, 24 aa, Plasmodium falciparum
NIMYRCVNILKYIIKMQSTFNIED

SEQ ID NO: 3270860 - protein, 27 aa, Plasmodium falciparum
NINAFPLVFSELYLLNLMIRNSYNLIL

SEQ ID NO: 3270861 - protein, 18 aa, Plasmodium falciparum
NINCKSITHLGSIYNIKI

SEQ ID NO: 3270862 - protein, 22 aa, Plasmodium falciparum
NINCYYGIFTICSVSHGLDFSF

SEQ ID NO: 3270863 - protein, 30 aa, Plasmodium falciparum
NINEAELRECLGLKFSKNIMKCLTVHKQEN

SEQ ID NO: 3270864 - protein, 25 aa, Plasmodium falciparum
NINELYKTFLILFCSSNFFEKHINY

SEQ ID NO: 3270865 - protein, 24 aa, Plasmodium falciparum
NINEPRKLASFSLYDALADASEQN

SEQ ID NO: 3270866 - protein, 30 aa, Plasmodium falciparum
NINFYLWGMFNWDYRKTLRVSLNSISNKKI

SEQ ID NO: 3270867 - protein, 28 aa, Plasmodium falciparum
NINIFDEFLDIYLLFRLRGGKGGFGANL

SEQ ID NO: 3270868 - protein, 22 aa, Plasmodium falciparum
NINIILVYGELDYYIKKLLLSK

SEQ ID NO: 3270869 - protein, 22 aa, Plasmodium falciparum
NINIKAGIVYKKYIPLYNYTNN

SEQ ID NO: 3270870 - protein, 24 aa, Plasmodium falciparum
NINIQIICCIILSLLIINKTIKDD

SEQ ID NO: 3270871 - protein, 24 aa, Plasmodium falciparum
NINIYKIIFNYIIDLIGCIHMIQD

SEQ ID NO: 3270872 - protein, 24 aa, Plasmodium falciparum
NINKGMFYWIGYNINDFDHYNYMK

SEQ ID NO: 3270873 - protein, 23 aa, Plasmodium falciparum
NINKICYIFKYINFYLTQKCQSL

SEQ ID NO: 3270874 - protein, 17 aa, Plasmodium falciparum
NINKLNSIHLIELLYTL

SEQ ID NO: 3270875 - protein, 24 aa, Plasmodium falciparum
NINLLRLFIEFIFIYNSQSHMLEL

SEQ ID NO: 3270876 - protein, 18 aa, Plasmodium falciparum
NINLTIFIPLFLDNIDFL

SEQ ID NO: 3270877 - protein, 23 aa, Plasmodium falciparum
NINNADNVFLIFNKKYERKKVVV

SEQ ID NO: 3270878 - protein, 25 aa, Plasmodium falciparum
NINNIDILLSMCKFVNILCDESIKA

SEQ ID NO: 3270879 - protein, 29 aa, Plasmodium falciparum
NINNLFYNYCCICKKSGGALKKTTSKTFV

SEQ ID NO: 3270880 - protein, 34 aa, Plasmodium falciparum
NINPYILICIGMKRLCKLFIYFLNMTNINYINNM

SEQ ID NO: 3270881 - protein, 17 aa, Plasmodium falciparum
NINRIIDIIDIFKEYLL

SEQ ID NO: 3270882 - protein, 19 aa, Plasmodium falciparum
NINRMKEIFIKKIKNLYNF

SEQ ID NO: 3270883 - protein, 19 aa, Plasmodium falciparum
NINRYCERFIKELLKKNII

SEQ ID NO: 3270884 - protein, 31 aa, Plasmodium falciparum
NINRYIMEQVFLYLLNFCYKNREDTSIKSFL

SEQ ID NO: 3270885 - protein, 23 aa, Plasmodium falciparum
NINTREAFFVFAKILFDKYKNEY

SEQ ID NO: 3270886 - protein, 21 aa, Plasmodium falciparum
NINYFIKSVMNIFELPESSKL

SEQ ID NO: 3270887 - protein, 22 aa, Plasmodium falciparum
NIPCTKLIPCYIQIINSDLLLY

SEQ ID NO: 3270888 - protein, 20 aa, Plasmodium falciparum
NIPEGLFLNIKYLYYSFDIN

SEQ ID NO: 3270889 - protein, 25 aa, Plasmodium falciparum
NIPFKILEYRSIIILLYSSLLFYVH

SEQ ID NO: 3270890 - protein, 24 aa, Plasmodium falciparum
NIPKCLRTNFNFKRRFSETKQNIQ

SEQ ID NO: 3270891 - protein, 24 aa, Plasmodium falciparum
NIPKCNVCHKCSICTHENGEAQNV

SEQ ID NO: 3270892 - protein, 17 aa, Plasmodium falciparum
NIPLFKPSYFHMFITQI

SEQ ID NO: 3270893 - protein, 33 aa, Plasmodium falciparum
NIPLLWNLNFLFFFKIYIHNVLSNVHICIDDKP

SEQ ID NO: 3270894 - protein, 23 aa, Plasmodium falciparum
NIPQKVLITYNFKLHFVDSKLHF

SEQ ID NO: 3270895 - protein, 18 aa, Plasmodium falciparum
NIPRNARLASWNKNIEDH

SEQ ID NO: 3270896 - protein, 24 aa, Plasmodium falciparum
NIQFVYDFLDKIGMKNSLNELKKE

SEQ ID NO: 3270897 - protein, 22 aa, Plasmodium falciparum
NIQKKIFFCIIQMINNITKYRH

SEQ ID NO: 3270898 - protein, 19 aa, Plasmodium falciparum
NIQKLKYLLTKIVGNNKNK

SEQ ID NO: 3270899 - protein, 23 aa, Plasmodium falciparum
NIQKRIYPFLPKYNIQIQSEVNI

SEQ ID NO: 3270900 - protein, 24 aa, Plasmodium falciparum
NIQNIPLKFIVDIIYFINKYGQMI

SEQ ID NO: 3270901 - protein, 19 aa, Plasmodium falciparum
NIQNVQSFSSTKTNQTTVV

SEQ ID NO: 3270902 - protein, 25 aa, Plasmodium falciparum
NIQYSNPEFRIWISTSSVEYFPYYL

SEQ ID NO: 3270903 - protein, 24 aa, Plasmodium falciparum
NIRDMCYTIIWYISLYYWRRDTYN

SEQ ID NO: 3270904 - protein, 28 aa, Plasmodium falciparum
NIRFYKSYIKEHIDSMFLSKYNLKVAKK

SEQ ID NO: 3270905 - protein, 22 aa, Plasmodium falciparum
NIRGIKKYILKYIKSINYNDIQ

SEQ ID NO: 3270906 - protein, 20 aa, Plasmodium falciparum
NIRIKRSFNIYYIDFVTNRY

SEQ ID NO: 3270907 - protein, 19 aa, Plasmodium falciparum
NIRIRNAINIFNKNKNNNN

SEQ ID NO: 3270908 - protein, 17 aa, Plasmodium falciparum
NIRKRVCNECFYKNEVS

SEQ ID NO: 3270909 - protein, 21 aa, Plasmodium falciparum
NIRKVDLRKSVPMCNQTSREY

SEQ ID NO: 3270910 - protein, 22 aa, Plasmodium falciparum
NIRMNRKFIKQKVYDTFFKNYD

SEQ ID NO: 3270911 - protein, 19 aa, Plasmodium falciparum
NISCFGLFFIFLILKINFD

SEQ ID NO: 3270912 - protein, 17 aa, Plasmodium falciparum
NISCPLIQIKNKTLIIQ

SEQ ID NO: 3270913 - protein, 24 aa, Plasmodium falciparum
NISEGKNSFPYKYYTDTKSVHKII

SEQ ID NO: 3270914 - protein, 20 aa, Plasmodium falciparum
NISICQFSFIYIIQDTYVEL

SEQ ID NO: 3270915 - protein, 25 aa, Plasmodium falciparum
NISICTLTLILFSFLHIYDLSSHFI

SEQ ID NO: 3270916 - protein, 21 aa, Plasmodium falciparum
NISIYEWIHNLYLFEESINKK

SEQ ID NO: 3270917 - protein, 20 aa, Plasmodium falciparum
NISKFLLEIIKFYDKNFSIF

SEQ ID NO: 3270918 - protein, 23 aa, Plasmodium falciparum
NISKRIIVWNALYEKRKEENERI

SEQ ID NO: 3270919 - protein, 23 aa, Plasmodium falciparum
NISLELFFNYPILYHITDKTKFF

SEQ ID NO: 3270920 - protein, 25 aa, Plasmodium falciparum
NISLRGRKGMYKWYNNHADNIVLNN

SEQ ID NO: 3270921 - protein, 26 aa, Plasmodium falciparum
NISLWLQYFNFCFIKKKYDELENAIL

SEQ ID NO: 3270922 - protein, 23 aa, Plasmodium falciparum
NISLYLCNICYLNSKVIIKTNML

SEQ ID NO: 3270923 - protein, 20 aa, Plasmodium falciparum
NISNFSCFLISNGDPLENVE

SEQ ID NO: 3270924 - protein, 20 aa, Plasmodium falciparum
NISPFLNIWEDFLYRNESLQ

SEQ ID NO: 3270925 - protein, 24 aa, Plasmodium falciparum
NISPSLFCQIFFLLKKLKCDARNQ

SEQ ID NO: 3270926 - protein, 24 aa, Plasmodium falciparum
NISQFYPRRGTVAYNMKKINTKIV

SEQ ID NO: 3270927 - protein, 33 aa, Plasmodium falciparum
NISRKVRLCKWLSFCFSCLIAFALISFTTSMAP

SEQ ID NO: 3270928 - protein, 23 aa, Plasmodium falciparum
NISSGISFYSLIFKYNSNLINTL

SEQ ID NO: 3270929 - protein, 19 aa, Plasmodium falciparum
NISTLQWLLTKEVNINHRD

SEQ ID NO: 3270930 - protein, 19 aa, Plasmodium falciparum
NITCSLNFLLVSLILIKNG

SEQ ID NO: 3270931 - protein, 29 aa, Plasmodium falciparum
NITFNYPHIILRNLLHGHMNFSFAHKMVI

SEQ ID NO: 3270932 - protein, 18 aa, Plasmodium falciparum
NITICIILTLKYIYENIG

SEQ ID NO: 3270933 - protein, 22 aa, Plasmodium falciparum
NITLHELCLFLNPVENRRDKKY

SEQ ID NO: 3270934 - protein, 27 aa, Plasmodium falciparum
NITNVCMFLLLPEIFCKYYKKGDKKKK

SEQ ID NO: 3270935 - protein, 21 aa, Plasmodium falciparum
NITSCFLKEFIDIVEMESHLL

SEQ ID NO: 3270936 - protein, 40 aa, Plasmodium falciparum
NITSTIHMKKIYKILFLLKEKIILFIFYIYKKIYKNAYIN

SEQ ID NO: 3270937 - protein, 18 aa, Plasmodium falciparum
NIVDLGYILLKIDSFCCI

SEQ ID NO: 3270938 - protein, 23 aa, Plasmodium falciparum
NIVESYSSCLIHDYLYLNQIVEE

SEQ ID NO: 3270939 - protein, 24 aa, Plasmodium falciparum
NIVFRFNFNLKDIIFKNVICSKNS

SEQ ID NO: 3270940 - protein, 23 aa, Plasmodium falciparum
NIVKDFFLDVCKYSKDYEKEKLY

SEQ ID NO: 3270941 - protein, 24 aa, Plasmodium falciparum
NIVTGRLQLGWGGTFFLLCCVVVI

SEQ ID NO: 3270942 - protein, 22 aa, Plasmodium falciparum
NIWIRLIGIHMIYKEYRKKIKY

SEQ ID NO: 3270943 - protein, 17 aa, Plasmodium falciparum
NIWTILFEVHLSKTKRK

SEQ ID NO: 3270944 - protein, 25 aa, Plasmodium falciparum
NIYALPKLVWIIGITIFILLTGTHP

SEQ ID NO: 3270945 - protein, 32 aa, Plasmodium falciparum
NIYCKSILFKIFPCHIFFKPRKIVCTQFTQIC

SEQ ID NO: 3270946 - protein, 17 aa, Plasmodium falciparum
NIYCTGIEFSRKRVEYT

SEQ ID NO: 3270947 - protein, 17 aa, Plasmodium falciparum
NIYDCINIYPFCKYVNH

SEQ ID NO: 3270948 - protein, 20 aa, Plasmodium falciparum
NIYDHFPIYFFKDNFSNKNN

SEQ ID NO: 3270949 - protein, 24 aa, Plasmodium falciparum
NIYEEAYCCNFLYNKNDLNLLSIN

SEQ ID NO: 3270950 - protein, 22 aa, Plasmodium falciparum
NIYEMLKNLPALIQGYVILNLK

SEQ ID NO: 3270951 - protein, 28 aa, Plasmodium falciparum
NIYFLYMLKSFMLQKFIETMFGNVEINV

SEQ ID NO: 3270952 - protein, 17 aa, Plasmodium falciparum
NIYFRFQGSIKKHNVGY

SEQ ID NO: 3270953 - protein, 22 aa, Plasmodium falciparum
NIYHCALQVLSIIIYNKLYKTE

SEQ ID NO: 3270954 - protein, 18 aa, Plasmodium falciparum
NIYHKFILNRTHYEIDLI

SEQ ID NO: 3270955 - protein, 17 aa, Plasmodium falciparum
NIYIASTLTEFQVNLLL

SEQ ID NO: 3270956 - protein, 20 aa, Plasmodium falciparum
NIYIIKEIIKSIIKLKHNFN

SEQ ID NO: 3270957 - protein, 20 aa, Plasmodium falciparum
NIYISYKFSDIIFLIITIIL

SEQ ID NO: 3270958 - protein, 17 aa, Plasmodium falciparum
NIYIYKILINDFLFLSK

SEQ ID NO: 3270959 - protein, 23 aa, Plasmodium falciparum
NIYIYRRFIFKNLDHYLSNKINT

SEQ ID NO: 3270960 - protein, 23 aa, Plasmodium falciparum
NIYKELLLFLFLIYKDKMNTLVD

SEQ ID NO: 3270961 - protein, 24 aa, Plasmodium falciparum
NIYKFSLYARRVCRNNSSNNNNNN

SEQ ID NO: 3270962 - protein, 21 aa, Plasmodium falciparum
NIYKGVTCFDDILKYNSEDSI

SEQ ID NO: 3270963 - protein, 24 aa, Plasmodium falciparum
NIYKIKLEKLFSCNNKENYYNFFS

SEQ ID NO: 3270964 - protein, 30 aa, Plasmodium falciparum
NIYKNMCTQFRLLYNFIPVLYIDRLDWQFN

SEQ ID NO: 3270965 - protein, 23 aa, Plasmodium falciparum
NIYKTRYSLIIYFKRLLIEYNET

SEQ ID NO: 3270966 - protein, 25 aa, Plasmodium falciparum
NIYKYKCNIESEILNSKIIMKFYKF

SEQ ID NO: 3270967 - protein, 18 aa, Plasmodium falciparum
NIYLINLYLYYIYLIYNI

SEQ ID NO: 3270968 - protein, 19 aa, Plasmodium falciparum
NIYLKIFFSKLEEIEKSSE

SEQ ID NO: 3270969 - protein, 23 aa, Plasmodium falciparum
NIYLKNLYLYNVIKHRNDYQTVS

SEQ ID NO: 3270970 - protein, 25 aa, Plasmodium falciparum
NIYLKSNLWALGYIQNMNDFKCNDD

SEQ ID NO: 3270971 - protein, 22 aa, Plasmodium falciparum
NIYLPKHCEFFIPSFLLNNTKF

SEQ ID NO: 3270972 - protein, 20 aa, Plasmodium falciparum
NIYLPLYIIVEINKIIKASK

SEQ ID NO: 3270973 - protein, 38 aa, Plasmodium falciparum
NIYNISIPVGEIFFFKSEYNCRIAFLYPKSILYDQNDI

SEQ ID NO: 3270974 - protein, 24 aa, Plasmodium falciparum
NIYNKMCVILDFDIKYLSYEDDQK

SEQ ID NO: 3270975 - protein, 18 aa, Plasmodium falciparum
NIYNRFDLNILLVPISSQ

SEQ ID NO: 3270976 - protein, 17 aa, Plasmodium falciparum
NIYRIFKKMNCLKTNIE

SEQ ID NO: 3270977 - protein, 27 aa, Plasmodium falciparum
NKAFHSRFFICICVLLHMMVFGVCIYK

SEQ ID NO: 3270978 - protein, 19 aa, Plasmodium falciparum
NKAIKPCGDLHQFEESRHC

SEQ ID NO: 3270979 - protein, 20 aa, Plasmodium falciparum
NKAIKPCGSLDAFESFCGLN

SEQ ID NO: 3270980 - protein, 19 aa, Plasmodium falciparum
NKAVKPCDDLNAFERSIHC

SEQ ID NO: 3270981 - protein, 25 aa, Plasmodium falciparum
NKCIAKGCVNIICPRKLAESNIANE

SEQ ID NO: 3270982 - protein, 20 aa, Plasmodium falciparum
NKCIPYDLWLRNRRDEFNMQ

SEQ ID NO: 3270983 - protein, 24 aa, Plasmodium falciparum
NKCKCKYKHVYSLDNLEKYHNKLL

SEQ ID NO: 3270984 - protein, 21 aa, Plasmodium falciparum
NKCKESFDFLFNHKDKKQKKI

SEQ ID NO: 3270985 - protein, 17 aa, Plasmodium falciparum
NKCKNIIYMYGDFMELM

SEQ ID NO: 3270986 - protein, 38 aa, Plasmodium falciparum
NKCLCLKGYSYVGVTSYRCSLCDRGSYKNSVGNNKCDN

SEQ ID NO: 3270987 - protein, 21 aa, Plasmodium falciparum
NKCNKLYKCILNIFEDNEILE

SEQ ID NO: 3270988 - protein, 17 aa, Plasmodium falciparum
NKCNKNCECFENWVEQK

SEQ ID NO: 3270989 - protein, 22 aa, Plasmodium falciparum
NKCSYSCIPFRTWIDNQKLEFL

SEQ ID NO: 3270990 - protein, 19 aa, Plasmodium falciparum
NKCVWLRDDDMFNTPNCIY

SEQ ID NO: 3270991 - protein, 18 aa, Plasmodium falciparum
NKCYGRLEKVKSIYQKLL

SEQ ID NO: 3270992 - protein, 18 aa, Plasmodium falciparum
NKDCAIINTILVDKYLFK

SEQ ID NO: 3270993 - protein, 17 aa, Plasmodium falciparum
NKDCLLSLTIKNNNNNK

SEQ ID NO: 3270994 - protein, 18 aa, Plasmodium falciparum
NKDDFLLYSFKYFTTPFV

SEQ ID NO: 3270995 - protein, 24 aa, Plasmodium falciparum
NKDEFKYYIVRTLQRKKVKNALIG

SEQ ID NO: 3270996 - protein, 24 aa, Plasmodium falciparum
NKDEFYRKILLFFNNMYDKYDMEK

SEQ ID NO: 3270997 - protein, 19 aa, Plasmodium falciparum
NKDGYVIKKEHLGDLEERQ

SEQ ID NO: 3270998 - protein, 24 aa, Plasmodium falciparum
NKDHLKYLYNYVIQPNVAKQEITV

SEQ ID NO: 3270999 - protein, 24 aa, Plasmodium falciparum
NKDIFNIYLFKCLYLNNQWIHILN

SEQ ID NO: 3271000 - protein, 24 aa, Plasmodium falciparum
NKDIKRKKDGLVTRSLILNHRGDS

SEQ ID NO: 3271001 - protein, 22 aa, Plasmodium falciparum
NKDILSSILYFFLYNPKNLVQK

SEQ ID NO: 3271002 - protein, 26 aa, Plasmodium falciparum
NKDLFIVQSVISFVYSFLLFIYMCVI

SEQ ID NO: 3271003 - protein, 19 aa, Plasmodium falciparum
NKDMCSLDEDILYERNFLK

SEQ ID NO: 3271004 - protein, 19 aa, Plasmodium falciparum
NKDPDIWKYIKKQFYENIN

SEQ ID NO: 3271005 - protein, 21 aa, Plasmodium falciparum
NKDSLFKMNQKNVCVECNDNL

SEQ ID NO: 3271006 - protein, 18 aa, Plasmodium falciparum
NKECECFQRWITQKQQEW

SEQ ID NO: 3271007 - protein, 26 aa, Plasmodium falciparum
NKECIEELIHLCYLSIELSIKFNINL

SEQ ID NO: 3271008 - protein, 19 aa, Plasmodium falciparum
NKEDFLFICINEFVNDKDR

SEQ ID NO: 3271009 - protein, 34 aa, Plasmodium falciparum
NKEDIKNLLKHVIKLANFSGIIVMSDTNTEITPE

SEQ ID NO: 3271010 - protein, 18 aa, Plasmodium falciparum
NKEDNVEGLFSIRPSRSL

SEQ ID NO: 3271011 - protein, 25 aa, Plasmodium falciparum
NKEEWKMTKCVKIPENGEIFDLSWS

SEQ ID NO: 3271012 - protein, 17 aa, Plasmodium falciparum
NKEFDHITELKKQNKLN

SEQ ID NO: 3271013 - protein, 27 aa, Plasmodium falciparum
NKEFFRHFVDFIKGYKLFDSPVLNALL

SEQ ID NO: 3271014 - protein, 22 aa, Plasmodium falciparum
NKEIKMFICLNKKQKLYNSDIK

SEQ ID NO: 3271015 - protein, 19 aa, Plasmodium falciparum
NKEITQFIIFFSIYGYNIP

SEQ ID NO: 3271016 - protein, 17 aa, Plasmodium falciparum
NKEKINNCCCGNLKEQC

SEQ ID NO: 3271017 - protein, 19 aa, Plasmodium falciparum
NKELAVQIYELYKDIINSF

SEQ ID NO: 3271018 - protein, 24 aa, Plasmodium falciparum
NKELRNKGSDGLKENAELKNKELQ

SEQ ID NO: 3271019 - protein, 24 aa, Plasmodium falciparum
NKELRNKGSDGLKENAELKNKELR

SEQ ID NO: 3271020 - protein, 21 aa, Plasmodium falciparum
NKESYCSISNISKVDNIIESN

SEQ ID NO: 3271021 - protein, 19 aa, Plasmodium falciparum
NKFALKYLSNVNAFINEIK

SEQ ID NO: 3271022 - protein, 18 aa, Plasmodium falciparum
NKFDVLTIWMQVRGSEKL

SEQ ID NO: 3271023 - protein, 20 aa, Plasmodium falciparum
NKFGDIFMLRYSDVFMERYI

SEQ ID NO: 3271024 - protein, 22 aa, Plasmodium falciparum
NKFICYFCFTHNSFGSKNNCFF

SEQ ID NO: 3271025 - protein, 17 aa, Plasmodium falciparum
NKFIEFINDLDISTNIN

SEQ ID NO: 3271026 - protein, 19 aa, Plasmodium falciparum
NKFIEQFCEYYSKNIPNHV

SEQ ID NO: 3271027 - protein, 21 aa, Plasmodium falciparum
NKFILGGYISVLSHQNMSYLK

SEQ ID NO: 3271028 - protein, 23 aa, Plasmodium falciparum
NKFLQDFFVNFVHFFENYNKYID

SEQ ID NO: 3271029 - protein, 23 aa, Plasmodium falciparum
NKFLYNKMVDVFFSKNILNKIIK

SEQ ID NO: 3271030 - protein, 18 aa, Plasmodium falciparum
NKFMNLFFNIIFLDNIIH

SEQ ID NO: 3271031 - protein, 23 aa, Plasmodium falciparum
NKFPFNILFHRWITDFIQYYNKS

SEQ ID NO: 3271032 - protein, 18 aa, Plasmodium falciparum
NKFTEIFVDEILEYNDIH

SEQ ID NO: 3271033 - protein, 22 aa, Plasmodium falciparum
NKFVLKLFFHIFFIYINIYYDE

SEQ ID NO: 3271034 - protein, 32 aa, Plasmodium falciparum
NKFYHFCSSFFLSNRYIKIMPFKNLNINFTSF

SEQ ID NO: 3271035 - protein, 27 aa, Plasmodium falciparum
NKFYHTFCKIIKYFFHIYNILIRKGDR

SEQ ID NO: 3271036 - protein, 34 aa, Plasmodium falciparum
NKFYIYEIVLEYSLKYGILSPHLSLYILKNISEH

SEQ ID NO: 3271037 - protein, 20 aa, Plasmodium falciparum
NKGDFLNICIYEFSNQEKKP

SEQ ID NO: 3271038 - protein, 23 aa, Plasmodium falciparum
NKGNPLLLNFLKYLITLEKFKEY

SEQ ID NO: 3271039 - protein, 25 aa, Plasmodium falciparum
NKGNRLKIGQVWSIKNDTSYTDVYM

SEQ ID NO: 3271040 - protein, 22 aa, Plasmodium falciparum
NKGSHKFVMRYFNSEFTMDDKI

SEQ ID NO: 3271041 - protein, 25 aa, Plasmodium falciparum
NKHLFIDVCIELIKKGHLCKNNLLS

SEQ ID NO: 3271042 - protein, 23 aa, Plasmodium falciparum
NKHLYLFYFIFNIISIMSCMYSF

SEQ ID NO: 3271043 - protein, 32 aa, Plasmodium falciparum
NKHQIKFVDIFSMLYFCYMERIYDLDFLTELS

SEQ ID NO: 3271044 - protein, 18 aa, Plasmodium falciparum
NKHSILWWKQKRTSNNEN

SEQ ID NO: 3271045 - protein, 17 aa, Plasmodium falciparum
NKICTKCDLTIVVGSSS

SEQ ID NO: 3271046 - protein, 18 aa, Plasmodium falciparum
NKICTLKKTVKNYVRKKN

SEQ ID NO: 3271047 - protein, 20 aa, Plasmodium falciparum
NKICYKRLYEQFNKIMIKSK

SEQ ID NO: 3271048 - protein, 23 aa, Plasmodium falciparum
NKIDFLKYIYIYDNIRNIYNNKY

SEQ ID NO: 3271049 - protein, 26 aa, Plasmodium falciparum
NKIDILPFLMFFRTLPFFINNKNKEK

SEQ ID NO: 3271050 - protein, 24 aa, Plasmodium falciparum
NKIDSSGIIKCFYDIYKNEPYRHF

SEQ ID NO: 3271051 - protein, 26 aa, Plasmodium falciparum
NKIEGLIICKLLTYLDLLRSYNTHGL

SEQ ID NO: 3271052 - protein, 17 aa, Plasmodium falciparum
NKIEVIRDFIKFDYISG

SEQ ID NO: 3271053 - protein, 23 aa, Plasmodium falciparum
NKIFKYNFLLEQLEEHINQLFEK

SEQ ID NO: 3271054 - protein, 22 aa, Plasmodium falciparum
NKIGKLVIGKGCINCLYACNPY

SEQ ID NO: 3271055 - protein, 25 aa, Plasmodium falciparum
NKIHDFKNLFYLLCYKNNNIQDLIQ

SEQ ID NO: 3271056 - protein, 28 aa, Plasmodium falciparum
NKIIDNYVGYSWLCLILLEYLNVLDSYI

SEQ ID NO: 3271057 - protein, 24 aa, Plasmodium falciparum
NKIIGYPIYWNRGKGLCRLKRNEC

SEQ ID NO: 3271058 - protein, 23 aa, Plasmodium falciparum
NKIIHLIALKIINFIKTHTSIQT

SEQ ID NO: 3271059 - protein, 17 aa, Plasmodium falciparum
NKIIIDRIIHIHQLIQN

SEQ ID NO: 3271060 - protein, 20 aa, Plasmodium falciparum
NKIIIQRNIIQTKIFNNASV

SEQ ID NO: 3271061 - protein, 24 aa, Plasmodium falciparum
NKIIKDFSFVDAIFYMNDEKAKYA

SEQ ID NO: 3271062 - protein, 24 aa, Plasmodium falciparum
NKIIKYPNRIVCIGEIGLDFDRLY

SEQ ID NO: 3271063 - protein, 27 aa, Plasmodium falciparum
NKIINLFSCKFYLILLKEVNKKFFLHI

SEQ ID NO: 3271064 - protein, 26 aa, Plasmodium falciparum
NKIKCRRKEVPLLFVSSNKCLKDLYL

SEQ ID NO: 3271065 - protein, 23 aa, Plasmodium falciparum
NKIKELKCVVLINEEIINRMKRN

SEQ ID NO: 3271066 - protein, 23 aa, Plasmodium falciparum
NKIKIKLIYLLKLIYYVYENIQY

SEQ ID NO: 3271067 - protein, 22 aa, Plasmodium falciparum
NKIKIPYFIFCLNKCDLVSTCK

SEQ ID NO: 3271068 - protein, 19 aa, Plasmodium falciparum
NKIKLKYEITKYFNEDDIN

SEQ ID NO: 3271069 - protein, 17 aa, Plasmodium falciparum
NKILCSNFVVRNSHISN

SEQ ID NO: 3271070 - protein, 20 aa, Plasmodium falciparum
NKILLRFCTGAMSFGSLSEE

SEQ ID NO: 3271071 - protein, 18 aa, Plasmodium falciparum
NKILRWLYFKFRKRRKDK

SEQ ID NO: 3271072 - protein, 19 aa, Plasmodium falciparum
NKILVCGLISGILTKTLFA

SEQ ID NO: 3271073 - protein, 20 aa, Plasmodium falciparum
NKIMYLEYISIFFNENPNMN

SEQ ID NO: 3271074 - protein, 22 aa, Plasmodium falciparum
NKINICNNISPFRLFIKNNASK

SEQ ID NO: 3271075 - protein, 30 aa, Plasmodium falciparum
NKIPLKYIHLCVIADIFKYLNLDHIVKNIM

SEQ ID NO: 3271076 - protein, 17 aa, Plasmodium falciparum
NKIPLYLKIRVYVLRGI

SEQ ID NO: 3271077 - protein, 17 aa, Plasmodium falciparum
NKIRTNRILKRLEKYVN

SEQ ID NO: 3271078 - protein, 25 aa, Plasmodium falciparum
NKIVFFVPLWLYKKLQGNNFLFMIK

SEQ ID NO: 3271079 - protein, 23 aa, Plasmodium falciparum
NKIYFICYFFFYNISSIVVNHSI

SEQ ID NO: 3271080 - protein, 28 aa, Plasmodium falciparum
NKIYSFYYLRMFFENHINYNNIYFGQYN

SEQ ID NO: 3271081 - protein, 26 aa, Plasmodium falciparum
NKIYWKFLENTVLYTFIFSFVLHNLK

SEQ ID NO: 3271082 - protein, 31 aa, Plasmodium falciparum
NKKAFLNYLYIYFKFLVEYLDISRIHQTFLY

SEQ ID NO: 3271083 - protein, 23 aa, Plasmodium falciparum
NKKDIYILWTYFESSKCVGYNEC

SEQ ID NO: 3271084 - protein, 21 aa, Plasmodium falciparum
NKKDKCINCDSLLNEDIIRKR

SEQ ID NO: 3271085 - protein, 20 aa, Plasmodium falciparum
NKKDPSCMVSSNIKASSNES

SEQ ID NO: 3271086 - protein, 26 aa, Plasmodium falciparum
NKKEFFKKHFNIFLCCEGIDQIRGWF

SEQ ID NO: 3271087 - protein, 24 aa, Plasmodium falciparum
NKKELKCYLNLLGKNYAIRDSDKC

SEQ ID NO: 3271088 - protein, 21 aa, Plasmodium falciparum
NKKEMLYGIFISINIMEIMDL

SEQ ID NO: 3271089 - protein, 19 aa, Plasmodium falciparum
NKKEYSILHYFNKRIINNI

SEQ ID NO: 3271090 - protein, 20 aa, Plasmodium falciparum
NKKFLLCVKIFKKINNILSV

SEQ ID NO: 3271091 - protein, 18 aa, Plasmodium falciparum
NKKFNIFMYFGKNKKNDE

SEQ ID NO: 3271092 - protein, 24 aa, Plasmodium falciparum
NKKGENIFHIWKYEPSMCKTYLSF

SEQ ID NO: 3271093 - protein, 20 aa, Plasmodium falciparum
NKKGGFIFSTLFKIFFPLVI

SEQ ID NO: 3271094 - protein, 20 aa, Plasmodium falciparum
NKKHGVVMYEKVIICNKQKT

SEQ ID NO: 3271095 - protein, 24 aa, Plasmodium falciparum
NKKIDICGYMCPPKDTKFNFFSYI

SEQ ID NO: 3271096 - protein, 18 aa, Plasmodium falciparum
NKKIEMEYLKVLNGFTLV

SEQ ID NO: 3271097 - protein, 28 aa, Plasmodium falciparum
NKKIILRIIMLMLFYFNIKHMYVICLDN

SEQ ID NO: 3271098 - protein, 21 aa, Plasmodium falciparum
NKKIISIKMYKNYLKYQEYKK

SEQ ID NO: 3271099 - protein, 30 aa, Plasmodium falciparum
NKKIVSVDCLLRYYFNLNYSNSFFYSSVLF

SEQ ID NO: 3271100 - protein, 19 aa, Plasmodium falciparum
NKKKCAMKLMCCPLKKTSH

SEQ ID NO: 3271101 - protein, 23 aa, Plasmodium falciparum
NKKKCSSCEIIVPQKDDMMNRMQ

SEQ ID NO: 3271102 - protein, 30 aa, Plasmodium falciparum
NKKKFICVNTCGLFGRVFIDYGDFYYTNNI

SEQ ID NO: 3271103 - protein, 37 aa, Plasmodium falciparum
NKKKFYVRRILVFCTCILLSIICRNICEFFITELNYS

SEQ ID NO: 3271104 - protein, 17 aa, Plasmodium falciparum
NKKKGSVTYDLKNNVEI

SEQ ID NO: 3271105 - protein, 29 aa, Plasmodium falciparum
NKKKIVHVLKCTYLYLYNIYEQLNKTSID

SEQ ID NO: 3271106 - protein, 26 aa, Plasmodium falciparum
NKKKRIKKIWLKWLAITKENKLKKEK

SEQ ID NO: 3271107 - protein, 20 aa, Plasmodium falciparum
NKKKRKGYILNLRLIENHIT

SEQ ID NO: 3271108 - protein, 24 aa, Plasmodium falciparum
NKKKRSSIITVYYRYLYKLYNVLI

SEQ ID NO: 3271109 - protein, 19 aa, Plasmodium falciparum
NKKKSILSLCVKNDKLNDA

SEQ ID NO: 3271110 - protein, 30 aa, Plasmodium falciparum
NKKKSILYMFKIYKIIILYTHHYKDNNFTK

SEQ ID NO: 3271111 - protein, 19 aa, Plasmodium falciparum
NKKKVCKHVKLGVRENDKD

SEQ ID NO: 3271112 - protein, 18 aa, Plasmodium falciparum
NKKLKGYFKKSIDQCTQK

SEQ ID NO: 3271113 - protein, 20 aa, Plasmodium falciparum
NKKLNVVDSIDFEYELTCYN

SEQ ID NO: 3271114 - protein, 32 aa, Plasmodium falciparum
NKKLSDLRRYVCKKSYLLINLLLRYMSEMDTQ

SEQ ID NO: 3271115 - protein, 22 aa, Plasmodium falciparum
NKKLYIKLYINYKYNQLIKKKT

SEQ ID NO: 3271116 - protein, 24 aa, Plasmodium falciparum
NKKMYKWYMRHFKDNRPLSKDNNT

SEQ ID NO: 3271117 - protein, 21 aa, Plasmodium falciparum
NKKNKELKCFVSSFESELKDY

SEQ ID NO: 3271118 - protein, 22 aa, Plasmodium falciparum
NKKPNIFLTYQIVLNNYDFINK

SEQ ID NO: 3271119 - protein, 22 aa, Plasmodium falciparum
NKKQLWEAISCEFYKGNHTGVC

SEQ ID NO: 3271120 - protein, 19 aa, Plasmodium falciparum
NKKREICNNYELGKNKYND

SEQ ID NO: 3271121 - protein, 24 aa, Plasmodium falciparum
NKKRIKKIFLKEYKKYIKEKKKKI

SEQ ID NO: 3271122 - protein, 17 aa, Plasmodium falciparum
NKKRSSISYYFDDYFDE

SEQ ID NO: 3271123 - protein, 23 aa, Plasmodium falciparum
NKKRVLYKYVFLFNNYKFKFKIV

SEQ ID NO: 3271124 - protein, 18 aa, Plasmodium falciparum
NKKSIKYFITSLMEVIEK

SEQ ID NO: 3271125 - protein, 19 aa, Plasmodium falciparum
NKKSLLCYMYGLYQIEIKK

SEQ ID NO: 3271126 - protein, 23 aa, Plasmodium falciparum
NKKYEACFGGCRLPCSSYTSFMK

SEQ ID NO: 3271127 - protein, 18 aa, Plasmodium falciparum
NKKYICIEKKTDYSSEDE

SEQ ID NO: 3271128 - protein, 37 aa, Plasmodium falciparum
NKKYIKLVGTYGYIAPEIIKGFNYSILSDMWSIGIIF

SEQ ID NO: 3271129 - protein, 24 aa, Plasmodium falciparum
NKKYPDIMTGYFFDLDYIQKLIEI

SEQ ID NO: 3271130 - protein, 28 aa, Plasmodium falciparum
NKKYPFKFPEIIENFILQIQEKLLPTKY

SEQ ID NO: 3271131 - protein, 25 aa, Plasmodium falciparum
NKKYTFLRIFKWKSALDIFNISTLM

SEQ ID NO: 3271132 - protein, 24 aa, Plasmodium falciparum
NKLELLSYIPIIFSKLINRNYEQF

SEQ ID NO: 3271133 - protein, 24 aa, Plasmodium falciparum
NKLEMNKFFLTKCIQKNDHNIKHK

SEQ ID NO: 3271134 - protein, 26 aa, Plasmodium falciparum
NKLEVSIVWFLWSFVIFYCGMCMFGS

SEQ ID NO: 3271135 - protein, 20 aa, Plasmodium falciparum
NKLFHEFLIELSINQGISEE

SEQ ID NO: 3271136 - protein, 23 aa, Plasmodium falciparum
NKLFPSKTIHIFDSVFSKNIKQK

SEQ ID NO: 3271137 - protein, 27 aa, Plasmodium falciparum
NKLFYENKYFFDICEYILYNPYIIETS

SEQ ID NO: 3271138 - protein, 25 aa, Plasmodium falciparum
NKLGFRPSFMGTLRLTYGIASLIGI

SEQ ID NO: 3271139 - protein, 23 aa, Plasmodium falciparum
NKLGGLIGLIAIIVLVVIISLAV

SEQ ID NO: 3271140 - protein, 27 aa, Plasmodium falciparum
NKLHFFIVMELCEGIDLVDYVSKENIS

SEQ ID NO: 3271141 - protein, 36 aa, Plasmodium falciparum
NKLICKKKIKCLICVYISILIIYYLRNEEIKIMLIQ

SEQ ID NO: 3271142 - protein, 19 aa, Plasmodium falciparum
NKLILFKTLTKLFVFNKYK

SEQ ID NO: 3271143 - protein, 18 aa, Plasmodium falciparum
NKLILISYYYSKLIDLLY

SEQ ID NO: 3271144 - protein, 21 aa, Plasmodium falciparum
NKLKNAIVFYVPILEIEKSIS

SEQ ID NO: 3271145 - protein, 22 aa, Plasmodium falciparum
NKLKRATVLHVRTKKSNDFINS

SEQ ID NO: 3271146 - protein, 30 aa, Plasmodium falciparum
NKLKRYSTLFMLCFFSFMGFLSVVVTTLNL

SEQ ID NO: 3271147 - protein, 19 aa, Plasmodium falciparum
NKLKSFVNFNGLNEVQQNV

SEQ ID NO: 3271148 - protein, 27 aa, Plasmodium falciparum
NKLKTEEWLHLYGLFKQATIGNMILSN

SEQ ID NO: 3271149 - protein, 19 aa, Plasmodium falciparum
NKLLCIKTCVINKTKNLLK

SEQ ID NO: 3271150 - protein, 18 aa, Plasmodium falciparum
NKLLFMVLKKMESIEFVN

SEQ ID NO: 3271151 - protein, 23 aa, Plasmodium falciparum
NKLLKRKCIEKLGEKDILLDYIR

SEQ ID NO: 3271152 - protein, 27 aa, Plasmodium falciparum
NKLLNFYFSFAVFFSYLGSAFLHISLG

SEQ ID NO: 3271153 - protein, 28 aa, Plasmodium falciparum
NKLLNIQWNYIFPMDLFISSNLSHETEL

SEQ ID NO: 3271154 - protein, 20 aa, Plasmodium falciparum
NKLLYMILDNFFYKNHMIGE

SEQ ID NO: 3271155 - protein, 21 aa, Plasmodium falciparum
NKLNKIFLLAIQYINITKFNY

SEQ ID NO: 3271156 - protein, 17 aa, Plasmodium falciparum
NKLQLSLHINEHYLNTT

SEQ ID NO: 3271157 - protein, 18 aa, Plasmodium falciparum
NKLRKGIDILTGTPGRII

SEQ ID NO: 3271158 - protein, 22 aa, Plasmodium falciparum
NKLRKKVYIGYNLRNNLELNEK

SEQ ID NO: 3271159 - protein, 17 aa, Plasmodium falciparum
NKLRNFMRMLKLNDINN

SEQ ID NO: 3271160 - protein, 25 aa, Plasmodium falciparum
NKLRNKRLIKILSIREEGNKLVKCF

SEQ ID NO: 3271161 - protein, 18 aa, Plasmodium falciparum
NKLSFNIYDVYDQIMNHD

SEQ ID NO: 3271162 - protein, 22 aa, Plasmodium falciparum
NKLSLRLEDYISHMKNSFDLTD

SEQ ID NO: 3271163 - protein, 21 aa, Plasmodium falciparum
NKLSMLLNRYHLINRSLERMR

SEQ ID NO: 3271164 - protein, 20 aa, Plasmodium falciparum
NKLTCKDIKEKKKSKKMKQR

SEQ ID NO: 3271165 - protein, 19 aa, Plasmodium falciparum
NKLTNMFKYFFFYHKMNYH

SEQ ID NO: 3271166 - protein, 17 aa, Plasmodium falciparum
NKLVCLFFYVLSNIFYP

SEQ ID NO: 3271167 - protein, 23 aa, Plasmodium falciparum
NKLVFKGLLILIIILLVIANIGV

SEQ ID NO: 3271168 - protein, 20 aa, Plasmodium falciparum
NKLVLFLKDRLQEYVDVDED

SEQ ID NO: 3271169 - protein, 22 aa, Plasmodium falciparum
NKLVLFLKDRLQEYVDVDEDTW

SEQ ID NO: 3271170 - protein, 21 aa, Plasmodium falciparum
NKLYIYDIFIKRNLVGCHGFT

SEQ ID NO: 3271171 - protein, 22 aa, Plasmodium falciparum
NKLYKEIFCKIFDNIKNNERNS

SEQ ID NO: 3271172 - protein, 17 aa, Plasmodium falciparum
NKMCNMYKKFDIYQKSV

SEQ ID NO: 3271173 - protein, 25 aa, Plasmodium falciparum
NKMFLRKYLKLLLYIGRNILHICTH

SEQ ID NO: 3271174 - protein, 26 aa, Plasmodium falciparum
NKMIALYWLRSCKEIFIENFAKVGND

SEQ ID NO: 3271175 - protein, 18 aa, Plasmodium falciparum
NKMIVLRTHDKYDIDDDY

SEQ ID NO: 3271176 - protein, 24 aa, Plasmodium falciparum
NKMKDLKKLFGIDSYYMNNILKCI

SEQ ID NO: 3271177 - protein, 18 aa, Plasmodium falciparum
NKMNALIIKEEKSNKINM

SEQ ID NO: 3271178 - protein, 23 aa, Plasmodium falciparum
NKMRNCLLIKCYIDNKNKEADEN

SEQ ID NO: 3271179 - protein, 17 aa, Plasmodium falciparum
NKMYLKDNILFLLSNSN

SEQ ID NO: 3271180 - protein, 22 aa, Plasmodium falciparum
NKNAKMPALVRAKSDEKKVKKM

SEQ ID NO: 3271181 - protein, 26 aa, Plasmodium falciparum
NKNDKLNFRCCKFLNHSNSFKDFTYT

SEQ ID NO: 3271182 - protein, 24 aa, Plasmodium falciparum
NKNDLDNHFLLIVNNIYFCKYIND

SEQ ID NO: 3271183 - protein, 20 aa, Plasmodium falciparum
NKNECVRFYLNEKLQHMKFE

SEQ ID NO: 3271184 - protein, 26 aa, Plasmodium falciparum
NKNEICSICSKRILFMKGHDHYSCSL

SEQ ID NO: 3271185 - protein, 20 aa, Plasmodium falciparum
NKNIHGYDLIYDFIYRKKSF

SEQ ID NO: 3271186 - protein, 19 aa, Plasmodium falciparum
NKNILFIISLDYIYKYCNV

SEQ ID NO: 3271187 - protein, 27 aa, Plasmodium falciparum
NKNKERPFYSFVFDIFKNLKHYLQQMK

SEQ ID NO: 3271188 - protein, 17 aa, Plasmodium falciparum
NKNKFLYNIKKYQKKKK

SEQ ID NO: 3271189 - protein, 27 aa, Plasmodium falciparum
NKNKFPRLLVSYFYVLSIVGIIYCLLF

SEQ ID NO: 3271190 - protein, 24 aa, Plasmodium falciparum
NKNKFWFYGCLGIIKAENINFLVI

SEQ ID NO: 3271191 - protein, 40 aa, Plasmodium falciparum
NKNKIGLGRVVNFKIELVLNDIHFYYPCCETSANHCLKIL

SEQ ID NO: 3271192 - protein, 25 aa, Plasmodium falciparum
NKNKILLIIVCDFIKTKNQNNTDQV

SEQ ID NO: 3271193 - protein, 25 aa, Plasmodium falciparum
NKNKLELLYNLYLQHNRLKEQLHAD

SEQ ID NO: 3271194 - protein, 26 aa, Plasmodium falciparum
NKNKLKSLEYISCDCYNILGNNNKEE

SEQ ID NO: 3271195 - protein, 25 aa, Plasmodium falciparum
NKNKMDFMNTFLFFIQLLFYGIKKN

SEQ ID NO: 3271196 - protein, 18 aa, Plasmodium falciparum
NKNKSSFPDKFRAPDKKR

SEQ ID NO: 3271197 - protein, 23 aa, Plasmodium falciparum
NKNLEILKRINIYSKYDKNEETN

SEQ ID NO: 3271198 - protein, 25 aa, Plasmodium falciparum
NKNLPFYNCIKDFYINHINNNNNSL

SEQ ID NO: 3271199 - protein, 26 aa, Plasmodium falciparum
NKNLVIKCYVHFILFYKKRKKEHMNY

SEQ ID NO: 3271200 - protein, 23 aa, Plasmodium falciparum
NKNMCMYLSYVIHIIKSHNLCNK

SEQ ID NO: 3271201 - protein, 43 aa, Plasmodium falciparum
NKNMFSFLCSIACMYNCLNVFIFYCGNIIKWSVFETYVEEQKL

SEQ ID NO: 3271202 - protein, 17 aa, Plasmodium falciparum
NKNMIWIIPILSYHFNK

SEQ ID NO: 3271203 - protein, 18 aa, Plasmodium falciparum
NKNMNTFFGIVQKRKKTK

SEQ ID NO: 3271204 - protein, 19 aa, Plasmodium falciparum
NKNMYKLFCLYYNKNNKKY

SEQ ID NO: 3271205 - protein, 27 aa, Plasmodium falciparum
NKNNNCVYCASIAKILGKPIYCSLCDP

SEQ ID NO: 3271206 - protein, 17 aa, Plasmodium falciparum
NKNRFPLVMKIDHRNFF

SEQ ID NO: 3271207 - protein, 23 aa, Plasmodium falciparum
NKNRYTFATARYIYLQPYTGIIK

SEQ ID NO: 3271208 - protein, 25 aa, Plasmodium falciparum
NKNTCDIRFLPIIYELKKFNEKKKI

SEQ ID NO: 3271209 - protein, 22 aa, Plasmodium falciparum
NKNTCVRNNLNLNVNFNYSPGK

SEQ ID NO: 3271210 - protein, 28 aa, Plasmodium falciparum
NKNVCTRFDKVYSCTSLSFKNDLSEWNN

SEQ ID NO: 3271211 - protein, 29 aa, Plasmodium falciparum
NKNVCTRFDKVYSCTSLSFKNDLSEWNNS

SEQ ID NO: 3271212 - protein, 21 aa, Plasmodium falciparum
NKNVDCKYFFGKINNSLDNLK

SEQ ID NO: 3271213 - protein, 26 aa, Plasmodium falciparum
NKNVDFILCDFFNLVTHFRKGTIDVI

SEQ ID NO: 3271214 - protein, 25 aa, Plasmodium falciparum
NKNVECFPCPPNTFKENEYDNSCSG

SEQ ID NO: 3271215 - protein, 19 aa, Plasmodium falciparum
NKNVNVGICTRDTLREMTK

SEQ ID NO: 3271216 - protein, 18 aa, Plasmodium falciparum
NKNYPLYLLIKLNNDNIN

SEQ ID NO: 3271217 - protein, 25 aa, Plasmodium falciparum
NKPWMKGDFFYYYEYFIKKIVINRQ

SEQ ID NO: 3271218 - protein, 23 aa, Plasmodium falciparum
NKQFKCFVPFPCSIKELIDRNYE

SEQ ID NO: 3271219 - protein, 17 aa, Plasmodium falciparum
NKQKVLNSFGVSWQNMM

SEQ ID NO: 3271220 - protein, 29 aa, Plasmodium falciparum
NKQLMVHIFLRLLLLHFIRTMMPKHMKGN

SEQ ID NO: 3271221 - protein, 25 aa, Plasmodium falciparum
NKQPLLRRHSTAILNHNISNLKTKI

SEQ ID NO: 3271222 - protein, 21 aa, Plasmodium falciparum
NKQRECIKKNVSNISFLSNKL

SEQ ID NO: 3271223 - protein, 26 aa, Plasmodium falciparum
NKQYELITNISFLFYIILIKFPNVSI

SEQ ID NO: 3271224 - protein, 20 aa, Plasmodium falciparum
NKRILCYDFYKAVVENVQKV

SEQ ID NO: 3271225 - protein, 21 aa, Plasmodium falciparum
NKRIREFNMINGMKVDPQDVY

SEQ ID NO: 3271226 - protein, 23 aa, Plasmodium falciparum
NKRKKYFLIYKIVKDSFFRILIL

SEQ ID NO: 3271227 - protein, 21 aa, Plasmodium falciparum
NKRLHTFYKYNIINKKYIINY

SEQ ID NO: 3271228 - protein, 19 aa, Plasmodium falciparum
NKRMLCVYYNIHNKYEKGI

SEQ ID NO: 3271229 - protein, 19 aa, Plasmodium falciparum
NKRNFFCSLSYRRVTINNE

SEQ ID NO: 3271230 - protein, 21 aa, Plasmodium falciparum
NKRYGYRIRFRSILSKSLNEI

SEQ ID NO: 3271231 - protein, 23 aa, Plasmodium falciparum
NKRYKYAFTGLRSQFFNKLKSYK

SEQ ID NO: 3271232 - protein, 21 aa, Plasmodium falciparum
NKSEHKFMLFQVLLNNIMFNF

SEQ ID NO: 3271233 - protein, 18 aa, Plasmodium falciparum
NKSFLSVMENINYTIVNT

SEQ ID NO: 3271234 - protein, 23 aa, Plasmodium falciparum
NKSGKNYIYFLGLFLKNITSCDL

SEQ ID NO: 3271235 - protein, 18 aa, Plasmodium falciparum
NKSHYEFLKNADFTNYFR

SEQ ID NO: 3271236 - protein, 23 aa, Plasmodium falciparum
NKSKISILFPFYSVVLKFTIQYI

SEQ ID NO: 3271237 - protein, 24 aa, Plasmodium falciparum
NKSKRNIYHLVWILKKKKKNSYLG

SEQ ID NO: 3271238 - protein, 27 aa, Plasmodium falciparum
NKSSCSACSGGFNFGPCTARPKKKMCE

SEQ ID NO: 3271239 - protein, 17 aa, Plasmodium falciparum
NKSSICTSLARSFADIG

SEQ ID NO: 3271240 - protein, 27 aa, Plasmodium falciparum
NKSTGKELGCKFILNKYKDAFSGTDKS

SEQ ID NO: 3271241 - protein, 30 aa, Plasmodium falciparum
NKTEVNISFCIYQLIILCNIMEIFEKFEGY

SEQ ID NO: 3271242 - protein, 19 aa, Plasmodium falciparum
NKTGVFGYFQKVLKKKKNG

SEQ ID NO: 3271243 - protein, 24 aa, Plasmodium falciparum
NKTHFIYSYVYKFSTFYDNVKKNK

SEQ ID NO: 3271244 - protein, 18 aa, Plasmodium falciparum
NKTIKCLFENSLNSLRIS

SEQ ID NO: 3271245 - protein, 18 aa, Plasmodium falciparum
NKTILWNKINMLYCHLYD

SEQ ID NO: 3271246 - protein, 27 aa, Plasmodium falciparum
NKTKHLRIKYRWKKLLELRYIQPIIKK

SEQ ID NO: 3271247 - protein, 19 aa, Plasmodium falciparum
NKTQELIPYMCYNKNERGE

SEQ ID NO: 3271248 - protein, 26 aa, Plasmodium falciparum
NKTTKCFIPRIILYLTHQSSILSFQS

SEQ ID NO: 3271249 - protein, 27 aa, Plasmodium falciparum
NKVEFKSICDLLCKYSCKQLKDQENES

SEQ ID NO: 3271250 - protein, 18 aa, Plasmodium falciparum
NKVGELWHSHLNSFIDIV

SEQ ID NO: 3271251 - protein, 23 aa, Plasmodium falciparum
NKVKDIVSKKCGIDVESDIDIET

SEQ ID NO: 3271252 - protein, 31 aa, Plasmodium falciparum
NKVLKNNFLLYIKLFYYLLLVGNIYTTIVFL

SEQ ID NO: 3271253 - protein, 19 aa, Plasmodium falciparum
NKYALFLYICNAKSIDKYN

SEQ ID NO: 3271254 - protein, 25 aa, Plasmodium falciparum
NKYAWLISIMCEFINMNKIIINDLY

SEQ ID NO: 3271255 - protein, 17 aa, Plasmodium falciparum
NKYCDKLSIPILQIQKK

SEQ ID NO: 3271256 - protein, 19 aa, Plasmodium falciparum
NKYDFLEICIQEYIKNENK

SEQ ID NO: 3271257 - protein, 20 aa, Plasmodium falciparum
NKYDNIFLGFTFSFDNKFEQ

SEQ ID NO: 3271258 - protein, 25 aa, Plasmodium falciparum
NKYFGFMTMHILTLILWDIEETTQY

SEQ ID NO: 3271259 - protein, 20 aa, Plasmodium falciparum
NKYFLDLPFKNFKSTHNVRK

SEQ ID NO: 3271260 - protein, 30 aa, Plasmodium falciparum
NKYHMFTDCCILFEKYCIGILLNSSLISSN

SEQ ID NO: 3271261 - protein, 19 aa, Plasmodium falciparum
NKYIDEFEYYKKYKIKCYC

SEQ ID NO: 3271262 - protein, 25 aa, Plasmodium falciparum
NKYIFYGIRKHILIYLNLINYVETK

SEQ ID NO: 3271263 - protein, 23 aa, Plasmodium falciparum
NKYILSHFIPQFIEDLNLKDEFR

SEQ ID NO: 3271264 - protein, 18 aa, Plasmodium falciparum
NKYIPFTYIRISLQLIIN

SEQ ID NO: 3271265 - protein, 18 aa, Plasmodium falciparum
NKYIPKKIHIIYKHVDLR

SEQ ID NO: 3271266 - protein, 41 aa, Plasmodium falciparum
NKYISLYSKPPCFYAPLFMCLYKIIINYSLYNFNDKNKKTN

SEQ ID NO: 3271267 - protein, 19 aa, Plasmodium falciparum
NKYKLLNLDSIKDNLLHMK

SEQ ID NO: 3271268 - protein, 25 aa, Plasmodium falciparum
NKYKRICSFFNLLLILFHNAILLYI

SEQ ID NO: 3271269 - protein, 17 aa, Plasmodium falciparum
NKYKYVCFTNSYVHIEM

SEQ ID NO: 3271270 - protein, 25 aa, Plasmodium falciparum
NKYLCAYALIAAGKLDYVENVDKLF

SEQ ID NO: 3271271 - protein, 17 aa, Plasmodium falciparum
NKYLILYYLHTFYDEIY

SEQ ID NO: 3271272 - protein, 19 aa, Plasmodium falciparum
NKYLKKIIKMMELEKLEEK

SEQ ID NO: 3271273 - protein, 18 aa, Plasmodium falciparum
NKYLNYFLERIKIKYTLR

SEQ ID NO: 3271274 - protein, 17 aa, Plasmodium falciparum
NKYLVRKDIYLKVKNEH

SEQ ID NO: 3271275 - protein, 19 aa, Plasmodium falciparum
NKYNICINIINIILKNIPT

SEQ ID NO: 3271276 - protein, 25 aa, Plasmodium falciparum
NKYNICKWDIEYILKVIKKIERFFI

SEQ ID NO: 3271277 - protein, 28 aa, Plasmodium falciparum
NKYPIKRIIYLDLLYLCCGIETIISKKL

SEQ ID NO: 3271278 - protein, 25 aa, Plasmodium falciparum
NKYSEIYLLIHIIKYIYETYKNVNE

SEQ ID NO: 3271279 - protein, 19 aa, Plasmodium falciparum
NKYSYGFTYKRFINYINND

SEQ ID NO: 3271280 - protein, 20 aa, Plasmodium falciparum
NKYSYLGWVNPFIYVTRNVQ

SEQ ID NO: 3271281 - protein, 19 aa, Plasmodium falciparum
NKYTSFVFNSFNMLYSYYN

SEQ ID NO: 3271282 - protein, 19 aa, Plasmodium falciparum
NKYVDGMIGFFYNDSNNFI

SEQ ID NO: 3271283 - protein, 25 aa, Plasmodium falciparum
NKYVEEKEIKKHEIADHDIKKEFKE

SEQ ID NO: 3271284 - protein, 20 aa, Plasmodium falciparum
NKYYWLVPLSVISCIYIYYK

SEQ ID NO: 3271285 - protein, 23 aa, Plasmodium falciparum
NLAKAAGLATMIGIMRPDIDHPD

SEQ ID NO: 3271286 - protein, 17 aa, Plasmodium falciparum
NLANLFLNIICTRPRDV

SEQ ID NO: 3271287 - protein, 27 aa, Plasmodium falciparum
NLANLIKFLFERRGYFLYQEGYMKKIK

SEQ ID NO: 3271288 - protein, 27 aa, Plasmodium falciparum
NLATGCVLMACKLYYPMFTNDFFCYEN

SEQ ID NO: 3271289 - protein, 31 aa, Plasmodium falciparum
NLATIISLIFSKLINLYCQFSAKKNIDNNNN

SEQ ID NO: 3271290 - protein, 24 aa, Plasmodium falciparum
NLCIKIVDGVQCWKSLENLPNLYI

SEQ ID NO: 3271291 - protein, 17 aa, Plasmodium falciparum
NLDFLISLNEFIKTNNF

SEQ ID NO: 3271292 - protein, 18 aa, Plasmodium falciparum
NLDISFGELQLYENSDED

SEQ ID NO: 3271293 - protein, 23 aa, Plasmodium falciparum
NLDLRSETILNFMKSNFHGSLKK

SEQ ID NO: 3271294 - protein, 22 aa, Plasmodium falciparum
NLEDWKKNEWIKWMDETEEEWQ

SEQ ID NO: 3271295 - protein, 21 aa, Plasmodium falciparum
NLEKKSIVGLRDWCNTYLLDK

SEQ ID NO: 3271296 - protein, 17 aa, Plasmodium falciparum
NLELKYFYQKCINSIIK

SEQ ID NO: 3271297 - protein, 22 aa, Plasmodium falciparum
NLENCIRLAYMYDKKKKFEELK

SEQ ID NO: 3271298 - protein, 23 aa, Plasmodium falciparum
NLENFVCFIPSFQRGFKLSLYLN

SEQ ID NO: 3271299 - protein, 20 aa, Plasmodium falciparum
NLEQYKLELLSDVKVSTPSS

SEQ ID NO: 3271300 - protein, 19 aa, Plasmodium falciparum
NLESFRWQILNIYNSIKDI

SEQ ID NO: 3271301 - protein, 23 aa, Plasmodium falciparum
NLESVTSYILCFINHILYKINII

SEQ ID NO: 3271302 - protein, 17 aa, Plasmodium falciparum
NLFEFLRTLGVWLTLLG

SEQ ID NO: 3271303 - protein, 17 aa, Plasmodium falciparum
NLFFKIFDKTCIFLTSP

SEQ ID NO: 3271304 - protein, 24 aa, Plasmodium falciparum
NLFIFYIEYVLFLILKKGTKTRAQ

SEQ ID NO: 3271305 - protein, 24 aa, Plasmodium falciparum
NLFKDTDGMFGLAGKELSCRNISA

SEQ ID NO: 3271306 - protein, 27 aa, Plasmodium falciparum
NLFKLQCSLCQTILYKKIDLSLYVHTN

SEQ ID NO: 3271307 - protein, 19 aa, Plasmodium falciparum
NLFKMRKNDIIFSDNTKHL

SEQ ID NO: 3271308 - protein, 19 aa, Plasmodium falciparum
NLFKNAIILISLILYHLPV

SEQ ID NO: 3271309 - protein, 18 aa, Plasmodium falciparum
NLFKTIFFIILFNSAIDS

SEQ ID NO: 3271310 - protein, 19 aa, Plasmodium falciparum
NLFLFYKCYEIVCDTENEI

SEQ ID NO: 3271311 - protein, 18 aa, Plasmodium falciparum
NLFLKLGSILLLTSEIVF

SEQ ID NO: 3271312 - protein, 19 aa, Plasmodium falciparum
NLFLRQFTERISMLYKYDN

SEQ ID NO: 3271313 - protein, 17 aa, Plasmodium falciparum
NLFLYKSYFYKIKKIFS

SEQ ID NO: 3271314 - protein, 19 aa, Plasmodium falciparum
NLFMIKLVNNYSYSYLWNI

SEQ ID NO: 3271315 - protein, 20 aa, Plasmodium falciparum
NLFNIKNMEVFLFYHENEIT

SEQ ID NO: 3271316 - protein, 23 aa, Plasmodium falciparum
NLFNISLCIFNYIKHRHTSSFIL

SEQ ID NO: 3271317 - protein, 24 aa, Plasmodium falciparum
NLFNKEICCKLIYELKNVHKELFQ

SEQ ID NO: 3271318 - protein, 34 aa, Plasmodium falciparum
NLFNLKSYFPKNFFKAVFLILPGLSFNINDIQLK

SEQ ID NO: 3271319 - protein, 27 aa, Plasmodium falciparum
NLFNYKGVYYIVFIFFINFSFFLYCLF

SEQ ID NO: 3271320 - protein, 22 aa, Plasmodium falciparum
NLFPHVFFQNQVNIFEFNPLNN

SEQ ID NO: 3271321 - protein, 28 aa, Plasmodium falciparum
NLFPMYMLSCSLFLFSSFFLKRRIHAVK

SEQ ID NO: 3271322 - protein, 18 aa, Plasmodium falciparum
NLFSVFIYYKRNIIIDNE

SEQ ID NO: 3271323 - protein, 33 aa, Plasmodium falciparum
NLFTSIKIDDMIKCNYETFQIVLNNKIVDIINI

SEQ ID NO: 3271324 - protein, 34 aa, Plasmodium falciparum
NLFYELRYRDFFHIEKIDYYKLFTMQKGISNIYM

SEQ ID NO: 3271325 - protein, 26 aa, Plasmodium falciparum
NLFYFICIFEDINLIHPYYIHKMIFF

SEQ ID NO: 3271326 - protein, 35 aa, Plasmodium falciparum
NLFYLKCFLCVRIFFNILKNFPFCNTIHQYCFFLF

SEQ ID NO: 3271327 - protein, 24 aa, Plasmodium falciparum
NLGKIKGLGKFTCIDECFLGMTFC

SEQ ID NO: 3271328 - protein, 18 aa, Plasmodium falciparum
NLGTVIIRCIKYVLRKIG

SEQ ID NO: 3271329 - protein, 17 aa, Plasmodium falciparum
NLHLAVERLKYTLNGKG

SEQ ID NO: 3271330 - protein, 18 aa, Plasmodium falciparum
NLHMWSAHHIYREVGKIG

SEQ ID NO: 3271331 - protein, 19 aa, Plasmodium falciparum
NLHNYHCLYNIFKNIYMIR

SEQ ID NO: 3271332 - protein, 21 aa, Plasmodium falciparum
NLICISIFLNYLISYDYVVLK

SEQ ID NO: 3271333 - protein, 21 aa, Plasmodium falciparum
NLICRYKSSYLYEIILGTLFF

SEQ ID NO: 3271334 - protein, 18 aa, Plasmodium falciparum
NLIFGININNMYLPYLSI

SEQ ID NO: 3271335 - protein, 17 aa, Plasmodium falciparum
NLIGAFCLIFFSLLGHF

SEQ ID NO: 3271336 - protein, 29 aa, Plasmodium falciparum
NLIHIPLTRYMRIPTDWLVEGTNIVILFD

SEQ ID NO: 3271337 - protein, 28 aa, Plasmodium falciparum
NLIHIYHKFKLGIVYLFDHYIIGGINLI

SEQ ID NO: 3271338 - protein, 19 aa, Plasmodium falciparum
NLIIYSFSVIISWINSMSI

SEQ ID NO: 3271339 - protein, 17 aa, Plasmodium falciparum
NLIKCIKKNQDVLQLVE

SEQ ID NO: 3271340 - protein, 24 aa, Plasmodium falciparum
NLIKEIKRNINIHIWTNAQKEEFR

SEQ ID NO: 3271341 - protein, 28 aa, Plasmodium falciparum
NLIKIIFIKCYYLKINISNLEYIFYNIP

SEQ ID NO: 3271342 - protein, 25 aa, Plasmodium falciparum
NLIKKKYMIGYSFKESYNKTSEIFF

SEQ ID NO: 3271343 - protein, 26 aa, Plasmodium falciparum
NLILIKVEIAKRFIFKYYNIEEHECI

SEQ ID NO: 3271344 - protein, 31 aa, Plasmodium falciparum
NLILLFVINIFKACCKEANQIKKEEKLNIEK

SEQ ID NO: 3271345 - protein, 18 aa, Plasmodium falciparum
NLILLFYINKFICYFCFT

SEQ ID NO: 3271346 - protein, 22 aa, Plasmodium falciparum
NLINKKLYSFLIIRDNGSRAIV

SEQ ID NO: 3271347 - protein, 22 aa, Plasmodium falciparum
NLINLFFKYIHNYKDHRKKIPC

SEQ ID NO: 3271348 - protein, 35 aa, Plasmodium falciparum
NLIRLKSVLLLIEIVMSFYSFFIRWEKQRDKEKKN

SEQ ID NO: 3271349 - protein, 18 aa, Plasmodium falciparum
NLISLCKFHKILLNLMID

SEQ ID NO: 3271350 - protein, 18 aa, Plasmodium falciparum
NLIYICASLGIHSILFKK

SEQ ID NO: 3271351 - protein, 20 aa, Plasmodium falciparum
NLIYPKFILLKYIVDKYPQK

SEQ ID NO: 3271352 - protein, 17 aa, Plasmodium falciparum
NLIYYKYHIWRIFLNFL

SEQ ID NO: 3271353 - protein, 26 aa, Plasmodium falciparum
NLKDSLKLLREGYIQSKLEMIRIHSD

SEQ ID NO: 3271354 - protein, 24 aa, Plasmodium falciparum
NLKECCNFLYKIYLDIFQFFKILK

SEQ ID NO: 3271355 - protein, 25 aa, Plasmodium falciparum
NLKIPKDILHEICSNYFPGNKCKKY

SEQ ID NO: 3271356 - protein, 18 aa, Plasmodium falciparum
NLKKAFDLLRTYAEIEGH

SEQ ID NO: 3271357 - protein, 39 aa, Plasmodium falciparum
NLKKKFGVPILLNICVNKIIKIACGYNYVLCVSDVGLVY

SEQ ID NO: 3271358 - protein, 26 aa, Plasmodium falciparum
NLKKKRYTKIFCDIHNLYNLLKDKQY

SEQ ID NO: 3271359 - protein, 21 aa, Plasmodium falciparum
NLKKRFSNIFMEINANDLSKI

SEQ ID NO: 3271360 - protein, 43 aa, Plasmodium falciparum
NLKNMYNIIKFIVVIYIAFNWSEVIYKYVGKLILAFALYMLIN

SEQ ID NO: 3271361 - protein, 21 aa, Plasmodium falciparum
NLKPSRIRPKLIRTNSLPATL

SEQ ID NO: 3271362 - protein, 24 aa, Plasmodium falciparum
NLKRKNICCLLHMYNYIYFIIDIL

SEQ ID NO: 3271363 - protein, 23 aa, Plasmodium falciparum
NLKRLKDFFTIDILFILEQPKND

SEQ ID NO: 3271364 - protein, 31 aa, Plasmodium falciparum
NLKSILRALELCVPYYGCECASKFITTVVGL

SEQ ID NO: 3271365 - protein, 19 aa, Plasmodium falciparum
NLKSKWYWFDLGYPTLMCL

SEQ ID NO: 3271366 - protein, 21 aa, Plasmodium falciparum
NLKVKIFPSHLNYKQHTTNKN

SEQ ID NO: 3271367 - protein, 18 aa, Plasmodium falciparum
NLKYLLCKNKSIHMHKYI

SEQ ID NO: 3271368 - protein, 24 aa, Plasmodium falciparum
NLKYYFKKMEILLNKDLREDVPNI

SEQ ID NO: 3271369 - protein, 19 aa, Plasmodium falciparum
NLLDPLVVVRCCNNEYITK

SEQ ID NO: 3271370 - protein, 19 aa, Plasmodium falciparum
NLLFCFSSLSSFSSSSQKE

SEQ ID NO: 3271371 - protein, 25 aa, Plasmodium falciparum
NLLFPYPKKYLLLWHEDYSLKNVNE

SEQ ID NO: 3271372 - protein, 25 aa, Plasmodium falciparum
NLLHFFKLTKLFFHFNLHSNIQTLW

SEQ ID NO: 3271373 - protein, 22 aa, Plasmodium falciparum
NLLHIYYLYNFIINNKFIDELV

SEQ ID NO: 3271374 - protein, 24 aa, Plasmodium falciparum
NLLKFCKNIHSIYKYRQTNEYVFI

SEQ ID NO: 3271375 - protein, 18 aa, Plasmodium falciparum
NLLKNCNNGHLFENIILF

SEQ ID NO: 3271376 - protein, 20 aa, Plasmodium falciparum
NLLLEVCLAAKYEGESLKGY

SEQ ID NO: 3271377 - protein, 18 aa, Plasmodium falciparum
NLLLEVCMAAQYEGQSIR

SEQ ID NO: 3271378 - protein, 42 aa, Plasmodium falciparum
NLLLLLPLGIYIFYIIKTCMYCTFKLILTKPIIVTDKTWFFL

SEQ ID NO: 3271379 - protein, 24 aa, Plasmodium falciparum
NLLLSSSEFIRWLDYSCIEVPISL

SEQ ID NO: 3271380 - protein, 25 aa, Plasmodium falciparum
NLLLYLLWKCCHIEGKGTDITKLKK

SEQ ID NO: 3271381 - protein, 18 aa, Plasmodium falciparum
NLLREKKGNIGIIYDCSY

SEQ ID NO: 3271382 - protein, 24 aa, Plasmodium falciparum
NLLRGENKYMIPFFFKNNNISNYF

SEQ ID NO: 3271383 - protein, 17 aa, Plasmodium falciparum
NLLSRFLYFYNYNISQY

SEQ ID NO: 3271384 - protein, 24 aa, Plasmodium falciparum
NLLTQLWEKLSFDIKKMNANKLLK

SEQ ID NO: 3271385 - protein, 20 aa, Plasmodium falciparum
NLLVDVCLAAKFEAESLKTY

SEQ ID NO: 3271386 - protein, 23 aa, Plasmodium falciparum
NLLYIKAKCKLTIDEEIFLYQNC

SEQ ID NO: 3271387 - protein, 22 aa, Plasmodium falciparum
NLMIRNSYNLILCVSKAKESLR

SEQ ID NO: 3271388 - protein, 26 aa, Plasmodium falciparum
NLMLKCSRCYMHVHKFCYISTKKSDE

SEQ ID NO: 3271389 - protein, 18 aa, Plasmodium falciparum
NLMNEIIYRNDLLNMKQI

SEQ ID NO: 3271390 - protein, 24 aa, Plasmodium falciparum
NLMNYKPECFLFSLKSVDENDYIM

SEQ ID NO: 3271391 - protein, 25 aa, Plasmodium falciparum
NLNCTLRVVGGWVRDKFLNINNDDI

SEQ ID NO: 3271392 - protein, 23 aa, Plasmodium falciparum
NLNDISMCLFNYIQNENEINNVN

SEQ ID NO: 3271393 - protein, 25 aa, Plasmodium falciparum
NLNEKRMIMNFIYKNIVYDKNYTFS

SEQ ID NO: 3271394 - protein, 32 aa, Plasmodium falciparum
NLNETICVYIFFPLQFHYLRKLLCDKEEDFMK

SEQ ID NO: 3271395 - protein, 20 aa, Plasmodium falciparum
NLNKRNLIYLSISKDYSPPI

SEQ ID NO: 3271396 - protein, 26 aa, Plasmodium falciparum
NLNNFICDFCKYNIKHNHIYNENKYN

SEQ ID NO: 3271397 - protein, 19 aa, Plasmodium falciparum
NLNRFLKFISLFYQNEINN

SEQ ID NO: 3271398 - protein, 37 aa, Plasmodium falciparum
NLNRYKYRKDKFLLDRLSILCRFILSYMKTSWIKNFI

SEQ ID NO: 3271399 - protein, 17 aa, Plasmodium falciparum
NLNSCSFLSNSSENGSY

SEQ ID NO: 3271400 - protein, 23 aa, Plasmodium falciparum
NLNSTILSLSWKQICINRNYDNI

SEQ ID NO: 3271401 - protein, 18 aa, Plasmodium falciparum
NLNYDILNLLLKNELKNI

SEQ ID NO: 3271402 - protein, 24 aa, Plasmodium falciparum
NLNYKNLYHMLAYNSKNRYNQLNI

SEQ ID NO: 3271403 - protein, 23 aa, Plasmodium falciparum
NLNYKYIEDITCIGTMNNSYSTS

SEQ ID NO: 3271404 - protein, 33 aa, Plasmodium falciparum
NLPCFPPNYIHIFEYHPIYSLIMKIYLYASFKS

SEQ ID NO: 3271405 - protein, 18 aa, Plasmodium falciparum
NLPNYNWFFYSTKKIINN

SEQ ID NO: 3271406 - protein, 23 aa, Plasmodium falciparum
NLPRNCTCCKITINRNKKNTMKL

SEQ ID NO: 3271407 - protein, 32 aa, Plasmodium falciparum
NLPSMPYTPLFFTCRTIIKIEVLRDVNTNQII

SEQ ID NO: 3271408 - protein, 17 aa, Plasmodium falciparum
NLQNCIIHDISIEHILI

SEQ ID NO: 3271409 - protein, 24 aa, Plasmodium falciparum
NLQYIQKCICYNIMQYNKLRAKKE

SEQ ID NO: 3271410 - protein, 20 aa, Plasmodium falciparum
NLRDPFLIKKGIRIKLDENT

SEQ ID NO: 3271411 - protein, 17 aa, Plasmodium falciparum
NLRHSNLVLIMGVSIHY

SEQ ID NO: 3271412 - protein, 19 aa, Plasmodium falciparum
NLRMKKIQIITSIINNNIS

SEQ ID NO: 3271413 - protein, 38 aa, Plasmodium falciparum
NLRNFKKLIIIEIQRFYLLFVKLLKMLLLLNRQNGYSI

SEQ ID NO: 3271414 - protein, 25 aa, Plasmodium falciparum
NLRSKKGYCISFFCILWSALTASRF

SEQ ID NO: 3271415 - protein, 23 aa, Plasmodium falciparum
NLRYISCILCGDSIKANTSKMCH

SEQ ID NO: 3271416 - protein, 19 aa, Plasmodium falciparum
NLSCLNYRFHIPLQGQLPT

SEQ ID NO: 3271417 - protein, 25 aa, Plasmodium falciparum
NLSFAIPMCAPYSAIQTHKYKIKLV

SEQ ID NO: 3271418 - protein, 26 aa, Plasmodium falciparum
NLSFKSCYELIKIIKECLNIYDHFPI

SEQ ID NO: 3271419 - protein, 26 aa, Plasmodium falciparum
NLSFRFICPYLYKLKNFKLIIETNLS

SEQ ID NO: 3271420 - protein, 25 aa, Plasmodium falciparum
NLSIFSCNYEGLPFMVPIHKNKEIV

SEQ ID NO: 3271421 - protein, 17 aa, Plasmodium falciparum
NLSLHFVNSIYFNIFCD

SEQ ID NO: 3271422 - protein, 21 aa, Plasmodium falciparum
NLSLLSIIFNFDIFRKYSNKE

SEQ ID NO: 3271423 - protein, 23 aa, Plasmodium falciparum
NLSLNEWLYIYSCKENVTQSNKK

SEQ ID NO: 3271424 - protein, 28 aa, Plasmodium falciparum
NLSRFILSVSLILFFFHFVLCSTIENVE

SEQ ID NO: 3271425 - protein, 22 aa, Plasmodium falciparum
NLSRYEIYFNLKKGMNTLGNNY

SEQ ID NO: 3271426 - protein, 25 aa, Plasmodium falciparum
NLTFYETIKIFLLYYNKNVDKYLNK

SEQ ID NO: 3271427 - protein, 18 aa, Plasmodium falciparum
NLTKIVIAIFAYFAIILF

SEQ ID NO: 3271428 - protein, 26 aa, Plasmodium falciparum
NLTKKELFFWASLKYYLEHFLGNIKS

SEQ ID NO: 3271429 - protein, 24 aa, Plasmodium falciparum
NLTSEYFYAFLMPESKIEEIMKRK

SEQ ID NO: 3271430 - protein, 19 aa, Plasmodium falciparum
NLTSLKLKIDFGSLDTGTK

SEQ ID NO: 3271431 - protein, 23 aa, Plasmodium falciparum
NLVCCCLWTVILFTSLQYVFNKE

SEQ ID NO: 3271432 - protein, 29 aa, Plasmodium falciparum
NLVLIMGVSIHYPFVFIIYEYMKNKCLFS

SEQ ID NO: 3271433 - protein, 25 aa, Plasmodium falciparum
NLVPNLFTFKYLVSYYSNDPNFLQK

SEQ ID NO: 3271434 - protein, 17 aa, Plasmodium falciparum
NLVYSIRRNNMRNKGDG

SEQ ID NO: 3271435 - protein, 28 aa, Plasmodium falciparum
NLWTRLKKGFSRGMCMNFLLNDNNEKKL

SEQ ID NO: 3271436 - protein, 24 aa, Plasmodium falciparum
NLYAFLKKKIKLYYKHNKHLINND

SEQ ID NO: 3271437 - protein, 20 aa, Plasmodium falciparum
NLYEDLFCLIPLNNEKRITF

SEQ ID NO: 3271438 - protein, 26 aa, Plasmodium falciparum
NLYESLKEYYEKYIIGNKNIKKSKNI

SEQ ID NO: 3271439 - protein, 20 aa, Plasmodium falciparum
NLYFCKDIRLFKKEYNNCVS

SEQ ID NO: 3271440 - protein, 24 aa, Plasmodium falciparum
NLYFEILTLLKLKAQNQSYVEFDT

SEQ ID NO: 3271441 - protein, 18 aa, Plasmodium falciparum
NLYIEMEKDLLINKTETF

SEQ ID NO: 3271442 - protein, 24 aa, Plasmodium falciparum
NLYIKYFFENSLYFIYEIYILLIL

SEQ ID NO: 3271443 - protein, 17 aa, Plasmodium falciparum
NLYKFEYIKNMYIIPPY

SEQ ID NO: 3271444 - protein, 30 aa, Plasmodium falciparum
NLYKILKSRLKTLFFVKSILNVLFNFFYNL

SEQ ID NO: 3271445 - protein, 26 aa, Plasmodium falciparum
NLYKYMNCLNVLGIRYINNNNNNNSN

SEQ ID NO: 3271446 - protein, 24 aa, Plasmodium falciparum
NLYLCKTIIIPLFYKWKLLNIYII

SEQ ID NO: 3271447 - protein, 17 aa, Plasmodium falciparum
NLYLVHSGFLSKTLLTI

SEQ ID NO: 3271448 - protein, 17 aa, Plasmodium falciparum
NLYRFFINYNMKSSKSS

SEQ ID NO: 3271449 - protein, 18 aa, Plasmodium falciparum
NLYVTINYLLYFKILNSC

SEQ ID NO: 3271450 - protein, 29 aa, Plasmodium falciparum
NMCMIMYFLKAFIYRCVVRPTNIISSLRD

SEQ ID NO: 3271451 - protein, 25 aa, Plasmodium falciparum
NMCNNKDIKVCVLGEKNCGKTSLIE

SEQ ID NO: 3271452 - protein, 23 aa, Plasmodium falciparum
NMDTLRLSFTFLQKNVEDIVWSK

SEQ ID NO: 3271453 - protein, 23 aa, Plasmodium falciparum
NMDVYKSLFIFFIYPNNNIFFNP

SEQ ID NO: 3271454 - protein, 26 aa, Plasmodium falciparum
NMDYYFKGNRAYVNFVKNKMYGDDNK

SEQ ID NO: 3271455 - protein, 17 aa, Plasmodium falciparum
NMECVKRGGSFENTNYT

SEQ ID NO: 3271456 - protein, 25 aa, Plasmodium falciparum
NMEKGKILLMLGCERGFSELELYLI

SEQ ID NO: 3271457 - protein, 22 aa, Plasmodium falciparum
NMEPRHFLHIFYILVKNTYRDL

SEQ ID NO: 3271458 - protein, 18 aa, Plasmodium falciparum
NMFFLKRKSDMEEVGNNN

SEQ ID NO: 3271459 - protein, 18 aa, Plasmodium falciparum
NMFKKCYCIKENKDDHIN

SEQ ID NO: 3271460 - protein, 27 aa, Plasmodium falciparum
NMFKKKKLYQWLIKYANLNKNYQIINI

SEQ ID NO: 3271461 - protein, 19 aa, Plasmodium falciparum
NMFLKIYILLIEKILINTK

SEQ ID NO: 3271462 - protein, 22 aa, Plasmodium falciparum
NMFVDCYDFIQGKKGYMNFLAF

SEQ ID NO: 3271463 - protein, 25 aa, Plasmodium falciparum
NMFYSKLRLLLCMQYKEKYNVVDNE

SEQ ID NO: 3271464 - protein, 19 aa, Plasmodium falciparum
NMGEKPFIMSIHDRNLYTG

SEQ ID NO: 3271465 - protein, 22 aa, Plasmodium falciparum
NMGEKPFIMSIHDRNLYTGEEI

SEQ ID NO: 3271466 - protein, 18 aa, Plasmodium falciparum
NMHMKLLYIYPAFQNIFN

SEQ ID NO: 3271467 - protein, 27 aa, Plasmodium falciparum
NMHRVNIPFEWLRNIHESIKKRKKKKK

SEQ ID NO: 3271468 - protein, 24 aa, Plasmodium falciparum
NMHTELKLRLSRIEELELIQKNTE

SEQ ID NO: 3271469 - protein, 25 aa, Plasmodium falciparum
NMIFRGVNFWKGLAIYLGALSGGAI

SEQ ID NO: 3271470 - protein, 25 aa, Plasmodium falciparum
NMIFSIFYLRLNAFSDFSTNKLNTH

SEQ ID NO: 3271471 - protein, 18 aa, Plasmodium falciparum
NMIFTKLLILILFDTQLL

SEQ ID NO: 3271472 - protein, 20 aa, Plasmodium falciparum
NMIKIGYVIFLFVLLCLCIY

SEQ ID NO: 3271473 - protein, 17 aa, Plasmodium falciparum
NMIKYKIILKLFIHNNL

SEQ ID NO: 3271474 - protein, 21 aa, Plasmodium falciparum
NMILFCSKMLHPLTKIHNHFE

SEQ ID NO: 3271475 - protein, 23 aa, Plasmodium falciparum
NMIYNWKIGKECFMKKLDSVHNF

SEQ ID NO: 3271476 - protein, 23 aa, Plasmodium falciparum
NMKDLKLNLSKVIGTNPDIQNEI

SEQ ID NO: 3271477 - protein, 18 aa, Plasmodium falciparum
NMKEIFIIELYRKRNKFG

SEQ ID NO: 3271478 - protein, 27 aa, Plasmodium falciparum
NMKILKISCFLLRYISIDNRQSKMVDD

SEQ ID NO: 3271479 - protein, 21 aa, Plasmodium falciparum
NMKNICLYDDYDIFNNLKTKN

SEQ ID NO: 3271480 - protein, 23 aa, Plasmodium falciparum
NMKNIHFLYMYKIIEINRHIELY

SEQ ID NO: 3271481 - protein, 18 aa, Plasmodium falciparum
NMKRTCFDYNHFSNYIHF

SEQ ID NO: 3271482 - protein, 25 aa, Plasmodium falciparum
NMKSIKWEKINNIVISWLAAPILAG

SEQ ID NO: 3271483 - protein, 23 aa, Plasmodium falciparum
NMKYLKQRIRFFDIIEEDILNSE

SEQ ID NO: 3271484 - protein, 26 aa, Plasmodium falciparum
NMLCGKISYPDAYWVISNEYKENKKY

SEQ ID NO: 3271485 - protein, 26 aa, Plasmodium falciparum
NMLFESCCFHNTIFCISQQASKLNKD

SEQ ID NO: 3271486 - protein, 17 aa, Plasmodium falciparum
NMLHIPHAVLKHLYSTH

SEQ ID NO: 3271487 - protein, 23 aa, Plasmodium falciparum
NMLIQCFYHYESLIDMLKSLISY

SEQ ID NO: 3271488 - protein, 23 aa, Plasmodium falciparum
NMLKVLFVPSIFYCLMLVLSNYL

SEQ ID NO: 3271489 - protein, 17 aa, Plasmodium falciparum
NMLLFKFFFSHTKEEPP

SEQ ID NO: 3271490 - protein, 18 aa, Plasmodium falciparum
NMLYILNLIEEFLYIIRN

SEQ ID NO: 3271491 - protein, 18 aa, Plasmodium falciparum
NMMYSQMDNIIWFDNKIN

SEQ ID NO: 3271492 - protein, 29 aa, Plasmodium falciparum
NMNCGKYIHPLCAYMCGLFIKCKNSNKKF

SEQ ID NO: 3271493 - protein, 27 aa, Plasmodium falciparum
NMNNLHCFYDPLSYYMLYEHNKMNLKR

SEQ ID NO: 3271494 - protein, 24 aa, Plasmodium falciparum
NMNRFYNMASIQPAAFNNISQNGN

SEQ ID NO: 3271495 - protein, 24 aa, Plasmodium falciparum
NMNVIKCIHKILYVLILYESRENI

SEQ ID NO: 3271496 - protein, 26 aa, Plasmodium falciparum
NMPLWLKIKEYLFFFQVNKKLNKQKM

SEQ ID NO: 3271497 - protein, 23 aa, Plasmodium falciparum
NMPQFLCTIIEEFELTESNFHEH

SEQ ID NO: 3271498 - protein, 23 aa, Plasmodium falciparum
NMQKWLCLYLERIMKNPNVKCFN

SEQ ID NO: 3271499 - protein, 26 aa, Plasmodium falciparum
NMQMKLWNFCEILAFEYKIPQSTLAN

SEQ ID NO: 3271500 - protein, 20 aa, Plasmodium falciparum
NMRGSTLLEHFFTATYNINN

SEQ ID NO: 3271501 - protein, 26 aa, Plasmodium falciparum
NMRYFSIKVLNTFLLDFIIQLSKEYQ

SEQ ID NO: 3271502 - protein, 22 aa, Plasmodium falciparum
NMSYSVKFFGKILFPEKQVNKE

SEQ ID NO: 3271503 - protein, 19 aa, Plasmodium falciparum
NMTIPIIIHYMFRCLNFQI

SEQ ID NO: 3271504 - protein, 18 aa, Plasmodium falciparum
NMVLKVEFLFFWIPTLII

SEQ ID NO: 3271505 - protein, 19 aa, Plasmodium falciparum
NMVPEKKKIIFLYDQSDHN

SEQ ID NO: 3271506 - protein, 24 aa, Plasmodium falciparum
NMVVKKLRKLYGYSENGRISKERC

SEQ ID NO: 3271507 - protein, 17 aa, Plasmodium falciparum
NMYDFKLESSFFIETIV

SEQ ID NO: 3271508 - protein, 19 aa, Plasmodium falciparum
NMYDRWIKRNSYKDQKNYA

SEQ ID NO: 3271509 - protein, 19 aa, Plasmodium falciparum
NMYFHDGSLKSDIPAHNLN

SEQ ID NO: 3271510 - protein, 18 aa, Plasmodium falciparum
NMYKEGYINNDYMTKDII

SEQ ID NO: 3271511 - protein, 18 aa, Plasmodium falciparum
NMYNYKYILLIIMFIITI

SEQ ID NO: 3271512 - protein, 18 aa, Plasmodium falciparum
NMYPSVIHNYIFKNELLY

SEQ ID NO: 3271513 - protein, 23 aa, Plasmodium falciparum
NMYSEFFNIHLLKYNLRNIFYSD

SEQ ID NO: 3271514 - protein, 25 aa, Plasmodium falciparum
NNANYIFKDKLDFVCNSNTPTCNNI

SEQ ID NO: 3271515 - protein, 31 aa, Plasmodium falciparum
NNAVLCILFMGRIFKSYIISMFLINLFHDIL

SEQ ID NO: 3271516 - protein, 20 aa, Plasmodium falciparum
NNCFYYYYYFHSFFNIITKF

SEQ ID NO: 3271517 - protein, 22 aa, Plasmodium falciparum
NNCIPIKLDDTFEITFDNSITF

SEQ ID NO: 3271518 - protein, 28 aa, Plasmodium falciparum
NNCKCYVCLKYTKAALHYLISKRNTITN

SEQ ID NO: 3271519 - protein, 29 aa, Plasmodium falciparum
NNCNDELYIYLSWVRRQLHLLYMSLYFKF

SEQ ID NO: 3271520 - protein, 22 aa, Plasmodium falciparum
NNCNYIRWENIFPYCNSCKNKY

SEQ ID NO: 3271521 - protein, 22 aa, Plasmodium falciparum
NNCSYFKNTFVHFFDYIYNIKM

SEQ ID NO: 3271522 - protein, 21 aa, Plasmodium falciparum
NNDFNAFVDFDFGGNREECRI

SEQ ID NO: 3271523 - protein, 25 aa, Plasmodium falciparum
NNDIFKITKRLTIHTKKYNLTNQQI

SEQ ID NO: 3271524 - protein, 27 aa, Plasmodium falciparum
NNDIILRIKRILIINNIHIYLIKKIYL

SEQ ID NO: 3271525 - protein, 24 aa, Plasmodium falciparum
NNDKIYYFMCFFDEKKRFQIGSNN

SEQ ID NO: 3271526 - protein, 19 aa, Plasmodium falciparum
NNDYFSIMMHYLCERTNDW

SEQ ID NO: 3271527 - protein, 25 aa, Plasmodium falciparum
NNDYYDYEMCLYLYQILLLGKLKSR

SEQ ID NO: 3271528 - protein, 21 aa, Plasmodium falciparum
NNEAMDFYKSVLIEENNSMNI

SEQ ID NO: 3271529 - protein, 25 aa, Plasmodium falciparum
NNEDMLLKICLRLLESRRINVENDN

SEQ ID NO: 3271530 - protein, 22 aa, Plasmodium falciparum
NNEDTGFCDISFIPFINDNFHI

SEQ ID NO: 3271531 - protein, 25 aa, Plasmodium falciparum
NNEEKLFFSFCIKRIHVDNINYIKY

SEQ ID NO: 3271532 - protein, 24 aa, Plasmodium falciparum
NNEFHYNYFLAHYIVPQGACNHFC

SEQ ID NO: 3271533 - protein, 19 aa, Plasmodium falciparum
NNEFRNSCHRKSYNHKNLS

SEQ ID NO: 3271534 - protein, 20 aa, Plasmodium falciparum
NNEIKFFILNIFLHHLTYTK

SEQ ID NO: 3271535 - protein, 24 aa, Plasmodium falciparum
NNEQICIFVYIYSKLKFLHNMNLI

SEQ ID NO: 3271536 - protein, 24 aa, Plasmodium falciparum
NNERFKIGTEWKIGEKVETSYKDV

SEQ ID NO: 3271537 - protein, 22 aa, Plasmodium falciparum
NNESGLKLFGRRDSSFQFFRRA

SEQ ID NO: 3271538 - protein, 23 aa, Plasmodium falciparum
NNETFKILSLITDFHKLLIKYTC

SEQ ID NO: 3271539 - protein, 18 aa, Plasmodium falciparum
NNFELLKYRRTWKNIMNE

SEQ ID NO: 3271540 - protein, 20 aa, Plasmodium falciparum
NNFFPLESFYNSVKNYYLML

SEQ ID NO: 3271541 - protein, 19 aa, Plasmodium falciparum
NNFIELIVDILMYKEYVLL

SEQ ID NO: 3271542 - protein, 20 aa, Plasmodium falciparum
NNFIHYFLILIIGIIKGILK

SEQ ID NO: 3271543 - protein, 23 aa, Plasmodium falciparum
NNFIKLFMDFYVFKIYKRLYKNK

SEQ ID NO: 3271544 - protein, 26 aa, Plasmodium falciparum
NNFINSFLFSLSFFHTILICRCNYNN

SEQ ID NO: 3271545 - protein, 19 aa, Plasmodium falciparum
NNFIYDGRWNKAMDSYEEG

SEQ ID NO: 3271546 - protein, 21 aa, Plasmodium falciparum
NNFKFIYNFIHDIKNRIKFID

SEQ ID NO: 3271547 - protein, 17 aa, Plasmodium falciparum
NNFKGCIKYIKMSIYIN

SEQ ID NO: 3271548 - protein, 19 aa, Plasmodium falciparum
NNFKGSSVYMAPEKLKTYF

SEQ ID NO: 3271549 - protein, 20 aa, Plasmodium falciparum
NNFKNGYLSPNLNNINYGTR

SEQ ID NO: 3271550 - protein, 23 aa, Plasmodium falciparum
NNFKTMLYWNKWMSYHRYMKIIK

SEQ ID NO: 3271551 - protein, 25 aa, Plasmodium falciparum
NNFLFKCALIFLNIYLNGWFVIMSF

SEQ ID NO: 3271552 - protein, 18 aa, Plasmodium falciparum
NNFLGLYFDILFKNKNKK

SEQ ID NO: 3271553 - protein, 17 aa, Plasmodium falciparum
NNFLHASSPGHDDGGDD

SEQ ID NO: 3271554 - protein, 19 aa, Plasmodium falciparum
NNFNLFLFPYNHAKYLSFI

SEQ ID NO: 3271555 - protein, 17 aa, Plasmodium falciparum
NNFNYYIYHSCNYSNIN

SEQ ID NO: 3271556 - protein, 19 aa, Plasmodium falciparum
NNFPKISFKPIYKNTYRHI

SEQ ID NO: 3271557 - protein, 23 aa, Plasmodium falciparum
NNFRECKRVYYIQKNIKRYSMNN

SEQ ID NO: 3271558 - protein, 24 aa, Plasmodium falciparum
NNFSHEIKKYFFFKQLFHTKNKLE

SEQ ID NO: 3271559 - protein, 30 aa, Plasmodium falciparum
NNFVFSFSLFNKCIVFRKIYAIDSKVKRIN

SEQ ID NO: 3271560 - protein, 20 aa, Plasmodium falciparum
NNFYELVYFIIKIIYKNIYI

SEQ ID NO: 3271561 - protein, 24 aa, Plasmodium falciparum
NNFYENKNKIYSFVEKYKDIKVSS

SEQ ID NO: 3271562 - protein, 21 aa, Plasmodium falciparum
NNFYKVLRICENFIGQHGTLN

SEQ ID NO: 3271563 - protein, 17 aa, Plasmodium falciparum
NNGALGYSQHLSEEIML

SEQ ID NO: 3271564 - protein, 23 aa, Plasmodium falciparum
NNGELFFSLFFLEAENSSSIFLI

SEQ ID NO: 3271565 - protein, 29 aa, Plasmodium falciparum
NNGELRLCDLAKCAPMYTHNLRHIKGNGN

SEQ ID NO: 3271566 - protein, 18 aa, Plasmodium falciparum
NNGEVSKCIKDCVKKWVE

SEQ ID NO: 3271567 - protein, 23 aa, Plasmodium falciparum
NNGGCGACAPYRRIQLCDYNLEY

SEQ ID NO: 3271568 - protein, 22 aa, Plasmodium falciparum
NNGHGYIFLILLNKNFFVDEFM

SEQ ID NO: 3271569 - protein, 19 aa, Plasmodium falciparum
NNGRNCGILLKIKNNEKIN

SEQ ID NO: 3271570 - protein, 24 aa, Plasmodium falciparum
NNGYEYISLILISKIFHYFYELNY

SEQ ID NO: 3271571 - protein, 23 aa, Plasmodium falciparum
NNHDIRKYFSLSFNDNQEKNNLF

SEQ ID NO: 3271572 - protein, 23 aa, Plasmodium falciparum
NNHFCAAYGKTLTVFEYVSKVVI

SEQ ID NO: 3271573 - protein, 24 aa, Plasmodium falciparum
NNHKKYNWKYLHNLEEYNRKSYCE

SEQ ID NO: 3271574 - protein, 21 aa, Plasmodium falciparum
NNHLYRLDILYKMGKNEINNK

SEQ ID NO: 3271575 - protein, 20 aa, Plasmodium falciparum
NNICGFGIIKEKSFYHKKNE

SEQ ID NO: 3271576 - protein, 19 aa, Plasmodium falciparum
NNICYSRDHFYFNHKCKVN

SEQ ID NO: 3271577 - protein, 22 aa, Plasmodium falciparum
NNIDISWVYKLFQLKGGEKNKY

SEQ ID NO: 3271578 - protein, 25 aa, Plasmodium falciparum
NNIDKMRFFPCIFYLDYNDDDLLKM

SEQ ID NO: 3271579 - protein, 17 aa, Plasmodium falciparum
NNIESMNSLLLVNEHND

SEQ ID NO: 3271580 - protein, 22 aa, Plasmodium falciparum
NNIFFIKCIDTLPIYIKSYDSN

SEQ ID NO: 3271581 - protein, 24 aa, Plasmodium falciparum
NNIFNKYCHDFSYELFLKKKIDDN

SEQ ID NO: 3271582 - protein, 25 aa, Plasmodium falciparum
NNIFNWFFICTKTEYLTPVLFIQDK

SEQ ID NO: 3271583 - protein, 20 aa, Plasmodium falciparum
NNIFSMVHSLFFFLNSLNKC

SEQ ID NO: 3271584 - protein, 21 aa, Plasmodium falciparum
NNIFTVCWIIIVRIFQNYEKN

SEQ ID NO: 3271585 - protein, 25 aa, Plasmodium falciparum
NNIFVHTFCATFCVPDLLVNNNVNL

SEQ ID NO: 3271586 - protein, 17 aa, Plasmodium falciparum
NNIHCVKSFVQPPTEHN

SEQ ID NO: 3271587 - protein, 18 aa, Plasmodium falciparum
NNIHIAKTDLQHMTINEL

SEQ ID NO: 3271588 - protein, 26 aa, Plasmodium falciparum
NNIIIKKCFFMWNRLYNFLNKKKRNI

SEQ ID NO: 3271589 - protein, 17 aa, Plasmodium falciparum
NNIIKFSLILTKDQNKN

SEQ ID NO: 3271590 - protein, 23 aa, Plasmodium falciparum
NNIIKIICYIFKIYKNTKYSLLF

SEQ ID NO: 3271591 - protein, 18 aa, Plasmodium falciparum
NNIIPSIVTIVSMISALA

SEQ ID NO: 3271592 - protein, 39 aa, Plasmodium falciparum
NNIIRNSFVFKILFYFFKLKKTLLYLLKCFGIEQIKKEK

SEQ ID NO: 3271593 - protein, 20 aa, Plasmodium falciparum
NNIISKVFHFFERKNNNIKK

SEQ ID NO: 3271594 - protein, 17 aa, Plasmodium falciparum
NNIKCTYENGFNKNMET

SEQ ID NO: 3271595 - protein, 18 aa, Plasmodium falciparum
NNIKEKKKKLVIDINQLN

SEQ ID NO: 3271596 - protein, 25 aa, Plasmodium falciparum
NNIKIYFRLAKGYFMLGEYDKSIKV

SEQ ID NO: 3271597 - protein, 22 aa, Plasmodium falciparum
NNIKIYKYIYLRSNDNLTNADM

SEQ ID NO: 3271598 - protein, 17 aa, Plasmodium falciparum
NNIKKGTLLLCDNSRDN

SEQ ID NO: 3271599 - protein, 27 aa, Plasmodium falciparum
NNIKKTCKFCLKRIKFYLKNEKLYEQE

SEQ ID NO: 3271600 - protein, 39 aa, Plasmodium falciparum
NNIKLKVFTSRTCSFEFPKECYWSSAFVQELVNRKLIPE

SEQ ID NO: 3271601 - protein, 22 aa, Plasmodium falciparum
NNIKLSTSRFGKINKSNDNYIM

SEQ ID NO: 3271602 - protein, 18 aa, Plasmodium falciparum
NNILDCFISLSIEKQIQN

SEQ ID NO: 3271603 - protein, 24 aa, Plasmodium falciparum
NNILDFKRFRGFKRRKKKTKKKKK

SEQ ID NO: 3271604 - protein, 26 aa, Plasmodium falciparum
NNILFIFCFSYLLSITLTFFPRYLLC

SEQ ID NO: 3271605 - protein, 17 aa, Plasmodium falciparum
NNILFKMLNIVYINTHV

SEQ ID NO: 3271606 - protein, 24 aa, Plasmodium falciparum
NNILKCIATLLINFPIITKNKMIE

SEQ ID NO: 3271607 - protein, 17 aa, Plasmodium falciparum
NNILKEELEIIRNNFHI

SEQ ID NO: 3271608 - protein, 20 aa, Plasmodium falciparum
NNILKVFTFILQRSTQIYYL

SEQ ID NO: 3271609 - protein, 17 aa, Plasmodium falciparum
NNILSFNDYIWKKHVQM

SEQ ID NO: 3271610 - protein, 26 aa, Plasmodium falciparum
NNILTHYVICLLKIIIRNIYENRRYE

SEQ ID NO: 3271611 - protein, 24 aa, Plasmodium falciparum
NNIMLLPIIFIYKIIIINTSINLV

SEQ ID NO: 3271612 - protein, 18 aa, Plasmodium falciparum
NNINCSIITFLKIEADKY

SEQ ID NO: 3271613 - protein, 25 aa, Plasmodium falciparum
NNINNLDFFSLVSLFHIYIPKKKKK

SEQ ID NO: 3271614 - protein, 17 aa, Plasmodium falciparum
NNINVDVLENFKEQFDN

SEQ ID NO: 3271615 - protein, 19 aa, Plasmodium falciparum
NNIPLDYAEFFSHINEHIG

SEQ ID NO: 3271616 - protein, 22 aa, Plasmodium falciparum
NNIPLFIYDLLNYIFKSDQTYF

SEQ ID NO: 3271617 - protein, 25 aa, Plasmodium falciparum
NNIQLKFSIIEGICFNFHKNNFDMI

SEQ ID NO: 3271618 - protein, 32 aa, Plasmodium falciparum
NNIQRYYIKMSFIFNDFKLCYTKMQDTNFYYL

SEQ ID NO: 3271619 - protein, 19 aa, Plasmodium falciparum
NNIRICVPSLQYIAQNTGG

SEQ ID NO: 3271620 - protein, 21 aa, Plasmodium falciparum
NNIRSGLLLEQITYSYKKEKI

SEQ ID NO: 3271621 - protein, 17 aa, Plasmodium falciparum
NNISNHYLCSGFKKENR

SEQ ID NO: 3271622 - protein, 26 aa, Plasmodium falciparum
NNITFFLIKFLLYFYHPYKLKYEKGK

SEQ ID NO: 3271623 - protein, 24 aa, Plasmodium falciparum
NNITRKRIQDFFVNMKNKLNNQNE

SEQ ID NO: 3271624 - protein, 29 aa, Plasmodium falciparum
NNIWLKQKYEIWMLLEILRSIKNNYIKFN

SEQ ID NO: 3271625 - protein, 25 aa, Plasmodium falciparum
NNIYADGAICFNNPTLLSLNELKII

SEQ ID NO: 3271626 - protein, 24 aa, Plasmodium falciparum
NNIYSFPMKIFLRKNSTKIKGCSF

SEQ ID NO: 3271627 - protein, 18 aa, Plasmodium falciparum
NNKCCFINPSNVFKSCLC

SEQ ID NO: 3271628 - protein, 19 aa, Plasmodium falciparum
NNKCCFYIKNFSFFLSPIY

SEQ ID NO: 3271629 - protein, 25 aa, Plasmodium falciparum
NNKCKDDCGCFLKWVVQKKTEWENI

SEQ ID NO: 3271630 - protein, 25 aa, Plasmodium falciparum
NNKEILKIKHFFSILNGPVDYTEGD

SEQ ID NO: 3271631 - protein, 24 aa, Plasmodium falciparum
NNKFTFISICRIYILYFENLIQNI

SEQ ID NO: 3271632 - protein, 29 aa, Plasmodium falciparum
NNKHYIGNILLCFLLYFHSFLDLLCGLRD

SEQ ID NO: 3271633 - protein, 21 aa, Plasmodium falciparum
NNKICLLFIYISCSIVSQTYK

SEQ ID NO: 3271634 - protein, 24 aa, Plasmodium falciparum
NNKIYIIRILTGIFIIVLEEYMKD

SEQ ID NO: 3271635 - protein, 30 aa, Plasmodium falciparum
NNKKKKSFLKMCEKKYVWNYQMIKKTKNKC

SEQ ID NO: 3271636 - protein, 23 aa, Plasmodium falciparum
NNKKYGILIAHGVHKIYIYKLYI

SEQ ID NO: 3271637 - protein, 22 aa, Plasmodium falciparum
NNKKYSFVYVFFINYFNISVII

SEQ ID NO: 3271638 - protein, 19 aa, Plasmodium falciparum
NNKLFFLQLLNSFNDYIMK

SEQ ID NO: 3271639 - protein, 24 aa, Plasmodium falciparum
NNKLNKNLFCFTKNMNHHFSNIYN

SEQ ID NO: 3271640 - protein, 25 aa, Plasmodium falciparum
NNKNFKINICILGGGTNVLSNIIKT

SEQ ID NO: 3271641 - protein, 27 aa, Plasmodium falciparum
NNKNIKYGLKMKFSINPFFINTTEKKK

SEQ ID NO: 3271642 - protein, 23 aa, Plasmodium falciparum
NNKNIWYETNFFKKISGSQILYY

SEQ ID NO: 3271643 - protein, 31 aa, Plasmodium falciparum
NNKNLSKICFNYFLNYLIKYKDNCSNDIIYI

SEQ ID NO: 3271644 - protein, 17 aa, Plasmodium falciparum
NNKSNIMSLFFGEKKKK

SEQ ID NO: 3271645 - protein, 24 aa, Plasmodium falciparum
NNKTSCLMGYFGFFNYEYKYETIK

SEQ ID NO: 3271646 - protein, 24 aa, Plasmodium falciparum
NNKWFLFCRRIILQPNFNLCFLSY

SEQ ID NO: 3271647 - protein, 32 aa, Plasmodium falciparum
NNKWNSCGFLFFLCYILQYILKHLKYDLFNST

SEQ ID NO: 3271648 - protein, 25 aa, Plasmodium falciparum
NNKYDCYKYNSGFSNYRDDASKEMW

SEQ ID NO: 3271649 - protein, 22 aa, Plasmodium falciparum
NNKYDECIFVYKTLTKENDYVH

SEQ ID NO: 3271650 - protein, 27 aa, Plasmodium falciparum
NNKYIERCTLCFVHFHVYCYKTYCDDF

SEQ ID NO: 3271651 - protein, 45 aa, Plasmodium falciparum
NNKYKCSRCNKKRNALKWNEIISPPCHLILILNRYNWSFSSNEKK

SEQ ID NO: 3271652 - protein, 27 aa, Plasmodium falciparum
NNKYRKMKIIGEIILSKNLKYENNKKN

SEQ ID NO: 3271653 - protein, 21 aa, Plasmodium falciparum
NNKYSFKYGEIYNDTCTDINI

SEQ ID NO: 3271654 - protein, 17 aa, Plasmodium falciparum
NNLASLLYQLAKYKPQF

SEQ ID NO: 3271655 - protein, 20 aa, Plasmodium falciparum
NNLCVKKMDKNMCKNMNKNT

SEQ ID NO: 3271656 - protein, 17 aa, Plasmodium falciparum
NNLDIYDPFLFSNNMCY

SEQ ID NO: 3271657 - protein, 25 aa, Plasmodium falciparum
NNLDYFYLLILLNFYSLFYILISDQ

SEQ ID NO: 3271658 - protein, 20 aa, Plasmodium falciparum
NNLFDILYMLKRIDSYVKNI

SEQ ID NO: 3271659 - protein, 27 aa, Plasmodium falciparum
NNLFSIKLLCHAKCYNLIKISHVFFSK

SEQ ID NO: 3271660 - protein, 20 aa, Plasmodium falciparum
NNLFYYLSLHYLVKNEKIME

SEQ ID NO: 3271661 - protein, 24 aa, Plasmodium falciparum
NNLGLRASFGVWVNPFSFGLSYTN

SEQ ID NO: 3271662 - protein, 25 aa, Plasmodium falciparum
NNLIIRRKQVKMIKKLKRDFIKKKK

SEQ ID NO: 3271663 - protein, 29 aa, Plasmodium falciparum
NNLIKIIIMFFKIHRRNALLVTHSNIEEL

SEQ ID NO: 3271664 - protein, 26 aa, Plasmodium falciparum
NNLILPFNFCLDLLYIFLNNYECFLD

SEQ ID NO: 3271665 - protein, 18 aa, Plasmodium falciparum
NNLIYGRPLYPLNMKLSK

SEQ ID NO: 3271666 - protein, 22 aa, Plasmodium falciparum
NNLKIILPLLFGQKYYNMLNIH

SEQ ID NO: 3271667 - protein, 26 aa, Plasmodium falciparum
NNLKKCNGSCIINVFIRKNYIYVSNT

SEQ ID NO: 3271668 - protein, 21 aa, Plasmodium falciparum
NNLKNLLCQNIHNIPSNNINN

SEQ ID NO: 3271669 - protein, 17 aa, Plasmodium falciparum
NNLKRKLMWMIKEYIHV

SEQ ID NO: 3271670 - protein, 26 aa, Plasmodium falciparum
NNLLHALIFGFLKFLFNLRKKYHKQP

SEQ ID NO: 3271671 - protein, 24 aa, Plasmodium falciparum
NNLLKKRIKIIITQIWTLQYILVF

SEQ ID NO: 3271672 - protein, 21 aa, Plasmodium falciparum
NNLMWKDIYFSESNKANNTNS

SEQ ID NO: 3271673 - protein, 21 aa, Plasmodium falciparum
NNLNCSEFLKSQENKLIDENM

SEQ ID NO: 3271674 - protein, 27 aa, Plasmodium falciparum
NNLNILCCHYIIFNSFISIIAMDVYNN

SEQ ID NO: 3271675 - protein, 19 aa, Plasmodium falciparum
NNLPCDCILCKKKHNVCYC

SEQ ID NO: 3271676 - protein, 19 aa, Plasmodium falciparum
NNLPYKTNYSFVNIPIAHG

SEQ ID NO: 3271677 - protein, 19 aa, Plasmodium falciparum
NNLRHFPYMNLLKEDYDII

SEQ ID NO: 3271678 - protein, 27 aa, Plasmodium falciparum
NNLSFLLLVRFLWGISLTNLISEPIIN

SEQ ID NO: 3271679 - protein, 38 aa, Plasmodium falciparum
NNLSTYVIKHNRFLSEYQSNFLGGGYSAALKLVNSKKS

SEQ ID NO: 3271680 - protein, 25 aa, Plasmodium falciparum
NNLSYFKWLEEFKIDKNAKLPILQD

SEQ ID NO: 3271681 - protein, 32 aa, Plasmodium falciparum
NNLVIVCVCDKFGYISFFLLNYFLTPFLISLN

SEQ ID NO: 3271682 - protein, 23 aa, Plasmodium falciparum
NNLYIHLLMLFYALQNIVFTIND

SEQ ID NO: 3271683 - protein, 21 aa, Plasmodium falciparum
NNLYILLLYIFCIYSRCLCNI

SEQ ID NO: 3271684 - protein, 21 aa, Plasmodium falciparum
NNLYYNFKFIIYDILFSPYSN

SEQ ID NO: 3271685 - protein, 35 aa, Plasmodium falciparum
NNMCLINYIYKKCRLLQKCLFYKIYISQLKNKKLK

SEQ ID NO: 3271686 - protein, 32 aa, Plasmodium falciparum
NNMEKFIYCIKNFPGPFSRKSNKVDHKIEEFL

SEQ ID NO: 3271687 - protein, 25 aa, Plasmodium falciparum
NNMFRCSNFILPIINKCIFLKGGIL

SEQ ID NO: 3271688 - protein, 25 aa, Plasmodium falciparum
NNMGENFMGIFFFDSIFKRIKERII

SEQ ID NO: 3271689 - protein, 18 aa, Plasmodium falciparum
NNMIDYKFIHFIKKYKYE

SEQ ID NO: 3271690 - protein, 23 aa, Plasmodium falciparum
NNMILCYYYLIYLFSNLSEKKED

SEQ ID NO: 3271691 - protein, 24 aa, Plasmodium falciparum
NNMKITLFHFKKFFTSNDEHKNEH

SEQ ID NO: 3271692 - protein, 19 aa, Plasmodium falciparum
NNMKNCVYVIFNYDGYTLC

SEQ ID NO: 3271693 - protein, 25 aa, Plasmodium falciparum
NNMNSHNLLSVGFFLNEKKKYYKLY

SEQ ID NO: 3271694 - protein, 17 aa, Plasmodium falciparum
NNMWYHFFIILFQNVKK

SEQ ID NO: 3271695 - protein, 18 aa, Plasmodium falciparum
NNNEFFNKLKICSVNQKF

SEQ ID NO: 3271696 - protein, 25 aa, Plasmodium falciparum
NNNEGHVLIKICKLKSEAPKIKRIL

SEQ ID NO: 3271697 - protein, 31 aa, Plasmodium falciparum
NNNFCLNVEMLFSFLFCKKKNYFYNIKNKYF

SEQ ID NO: 3271698 - protein, 18 aa, Plasmodium falciparum
NNNFDCFGMKSKNNKKYD

SEQ ID NO: 3271699 - protein, 23 aa, Plasmodium falciparum
NNNFSKYTYPFIGAPTIIKDLKN

SEQ ID NO: 3271700 - protein, 24 aa, Plasmodium falciparum
NNNICSYNLFQWVYDIKYTIVKYY

SEQ ID NO: 3271701 - protein, 24 aa, Plasmodium falciparum
NNNKICRYRKKLLFIDNYYIGHIF

SEQ ID NO: 3271702 - protein, 27 aa, Plasmodium falciparum
NNNLFKIKNLFFLKSFFSHIHNNVDIL

SEQ ID NO: 3271703 - protein, 26 aa, Plasmodium falciparum
NNNLKCMYFICNNILYDLMIEMDTRS

SEQ ID NO: 3271704 - protein, 18 aa, Plasmodium falciparum
NNNLKKRSFFIICKNCRP

SEQ ID NO: 3271705 - protein, 22 aa, Plasmodium falciparum
NNNPLKISINFNNINIDSLKPT

SEQ ID NO: 3271706 - protein, 19 aa, Plasmodium falciparum
NNNRKMVWIAMTCEAGGSQ

SEQ ID NO: 3271707 - protein, 17 aa, Plasmodium falciparum
NNNRTSVQFNFDNLEDN

SEQ ID NO: 3271708 - protein, 25 aa, Plasmodium falciparum
NNNSCSSCCFYVKHVNRESDNGNSE

SEQ ID NO: 3271709 - protein, 22 aa, Plasmodium falciparum
NNNSRMVLVNKFFFFTNKGDER

SEQ ID NO: 3271710 - protein, 22 aa, Plasmodium falciparum
NNNTRFSNNISFHNNDTNSLNR

SEQ ID NO: 3271711 - protein, 24 aa, Plasmodium falciparum
NNNVPIIYNCFGFLLKDRQVKKSA

SEQ ID NO: 3271712 - protein, 30 aa, Plasmodium falciparum
NNNYEFIKKLHLFLNAPFYFFNMFNNKTKE

SEQ ID NO: 3271713 - protein, 24 aa, Plasmodium falciparum
NNNYQLAFYYEFMMTYLKESSGII

SEQ ID NO: 3271714 - protein, 18 aa, Plasmodium falciparum
NNNYRYNCFIQKKKKNSY

SEQ ID NO: 3271715 - protein, 22 aa, Plasmodium falciparum
NNNYYNCYSHFFSKRNIIKREK

SEQ ID NO: 3271716 - protein, 17 aa, Plasmodium falciparum
NNPAEYLKKLFGNLQGN

SEQ ID NO: 3271717 - protein, 17 aa, Plasmodium falciparum
NNPKCAICLIDESCNII

SEQ ID NO: 3271718 - protein, 24 aa, Plasmodium falciparum
NNPRANENVVRWQFNEDICQLINI

SEQ ID NO: 3271719 - protein, 23 aa, Plasmodium falciparum
NNQLKLLIYNFLYLYMFDEYIYM

SEQ ID NO: 3271720 - protein, 18 aa, Plasmodium falciparum
NNRIGHFLWGSKIRKNPL

SEQ ID NO: 3271721 - protein, 20 aa, Plasmodium falciparum
NNRRGGGNHIMCPKIRNNQN

SEQ ID NO: 3271722 - protein, 23 aa, Plasmodium falciparum
NNRYEYEKHLALYNRNKMNNIPE

SEQ ID NO: 3271723 - protein, 27 aa, Plasmodium falciparum
NNSAIVFPNLVGLILGILYCVIYHKNC

SEQ ID NO: 3271724 - protein, 24 aa, Plasmodium falciparum
NNSFCYYCADELNVKNGKILDTNK

SEQ ID NO: 3271725 - protein, 18 aa, Plasmodium falciparum
NNSFYINGLQSFINKYYD

SEQ ID NO: 3271726 - protein, 26 aa, Plasmodium falciparum
NNSIVQLCYGLTCCNLIECVSKEILI

SEQ ID NO: 3271727 - protein, 18 aa, Plasmodium falciparum
NNSLCVCNLYISSLSLLC

SEQ ID NO: 3271728 - protein, 20 aa, Plasmodium falciparum
NNSLIKYVHFIVEYLSKNKN

SEQ ID NO: 3271729 - protein, 21 aa, Plasmodium falciparum
NNSMIPFVCSHRSKEILYTGN

SEQ ID NO: 3271730 - protein, 23 aa, Plasmodium falciparum
NNSPICCAFIYYLLLYENSSDVI

SEQ ID NO: 3271731 - protein, 21 aa, Plasmodium falciparum
NNSRLGWKCIASDTKSVATVK

SEQ ID NO: 3271732 - protein, 17 aa, Plasmodium falciparum
NNSSRCGRINDLIFEER

SEQ ID NO: 3271733 - protein, 17 aa, Plasmodium falciparum
NNTCFDDDIFLRSRKSV

SEQ ID NO: 3271734 - protein, 27 aa, Plasmodium falciparum
NNTCSKDSFKLSYHFLNSLKNENYEMR

SEQ ID NO: 3271735 - protein, 17 aa, Plasmodium falciparum
NNTDFPLYIFKSVPGNV

SEQ ID NO: 3271736 - protein, 21 aa, Plasmodium falciparum
NNTIHKIHCSKGKKNIMNLNN

SEQ ID NO: 3271737 - protein, 18 aa, Plasmodium falciparum
NNTLNFVENFSCCNKNVS

SEQ ID NO: 3271738 - protein, 28 aa, Plasmodium falciparum
NNTWKLIELSICIIISIIIIVLNKYQMN

SEQ ID NO: 3271739 - protein, 21 aa, Plasmodium falciparum
NNTYFFFDFINKEFIMELYKL

SEQ ID NO: 3271740 - protein, 30 aa, Plasmodium falciparum
NNTYLIKLLIEFFYFYSIDFKLHDACIVVR

SEQ ID NO: 3271741 - protein, 22 aa, Plasmodium falciparum
NNTYSIYFFLFLDFIFNTLKKK

SEQ ID NO: 3271742 - protein, 34 aa, Plasmodium falciparum
NNVCCLCLCAYRSFYRLVNCFYNKFSNFKFKMIT

SEQ ID NO: 3271743 - protein, 17 aa, Plasmodium falciparum
NNVCKFEKYISYINNYN

SEQ ID NO: 3271744 - protein, 29 aa, Plasmodium falciparum
NNVEINIPWRVIEQLLLLLEEETGYRRPD

SEQ ID NO: 3271745 - protein, 24 aa, Plasmodium falciparum
NNVEIWYEKNIIEYFLRHMNDQKD

SEQ ID NO: 3271746 - protein, 31 aa, Plasmodium falciparum
NNVIIFLYKFCKYYKEWSCFERHKICCEKKR

SEQ ID NO: 3271747 - protein, 19 aa, Plasmodium falciparum
NNVKALFYFSFFNFINHKD

SEQ ID NO: 3271748 - protein, 23 aa, Plasmodium falciparum
NNVKSSYCLFYLYYYNEENHFKA

SEQ ID NO: 3271749 - protein, 24 aa, Plasmodium falciparum
NNVLKFLKCIQIVFFYDNNTNECT

SEQ ID NO: 3271750 - protein, 33 aa, Plasmodium falciparum
NNVLKFTNYIYSIKFLYRPILTHVYYNNKTMDN

SEQ ID NO: 3271751 - protein, 20 aa, Plasmodium falciparum
NNVLLNLIFVSLCRCLNIPS

SEQ ID NO: 3271752 - protein, 17 aa, Plasmodium falciparum
NNVPTYIKRKCMAKVNF

SEQ ID NO: 3271753 - protein, 23 aa, Plasmodium falciparum
NNVQRILLVLSIFLHNNNIFENH

SEQ ID NO: 3271754 - protein, 53 aa, Plasmodium falciparum
NNVTNCVMHKNFLRSDIEIIIRICVDLKYLLYHHEVIKIVLFNKYVIKKILKI

SEQ ID NO: 3271755 - protein, 17 aa, Plasmodium falciparum
NNVTWIPGHSFRLKMIF

SEQ ID NO: 3271756 - protein, 17 aa, Plasmodium falciparum
NNWLGSSVKNFSSDNKG

SEQ ID NO: 3271757 - protein, 25 aa, Plasmodium falciparum
NNYDCTYFKLIISLYPMDYFNSIDY

SEQ ID NO: 3271758 - protein, 28 aa, Plasmodium falciparum
NNYDELKNAFNIYKCNLSEYIQNFLKSI

SEQ ID NO: 3271759 - protein, 26 aa, Plasmodium falciparum
NNYILRDFLNIFSLKHPYEIKQKEMK

SEQ ID NO: 3271760 - protein, 20 aa, Plasmodium falciparum
NNYISGLVLYYLHDKTNEQY

SEQ ID NO: 3271761 - protein, 28 aa, Plasmodium falciparum
NNYISTGFFLFLLLITFFVYLSAFTNII

SEQ ID NO: 3271762 - protein, 17 aa, Plasmodium falciparum
NNYIYKSFKVMPYSCKC

SEQ ID NO: 3271763 - protein, 27 aa, Plasmodium falciparum
NNYKMKCILYNIFSVMFFINNYFNIYN

SEQ ID NO: 3271764 - protein, 30 aa, Plasmodium falciparum
NNYKNSIIYFRFVYLTSLLYSNDIETISKV

SEQ ID NO: 3271765 - protein, 24 aa, Plasmodium falciparum
NNYLIEYINIYILSLINSRVNCDI

SEQ ID NO: 3271766 - protein, 22 aa, Plasmodium falciparum
NNYLKCNMLYIYSTYINVDIIK

SEQ ID NO: 3271767 - protein, 25 aa, Plasmodium falciparum
NNYNKRLFSSFIWSYSKYISFLNKK

SEQ ID NO: 3271768 - protein, 24 aa, Plasmodium falciparum
NNYPCTYENLLYVIKTMWPNLFSV

SEQ ID NO: 3271769 - protein, 17 aa, Plasmodium falciparum
NNYPIILEKEFINYNIM

SEQ ID NO: 3271770 - protein, 23 aa, Plasmodium falciparum
NNYREFSILLKRISRYELVHNYP

SEQ ID NO: 3271771 - protein, 22 aa, Plasmodium falciparum
NNYSFKKLLIIRSLRPDRITVT

SEQ ID NO: 3271772 - protein, 25 aa, Plasmodium falciparum
NNYTNNMIYPFPFLISPHYVQDLNY

SEQ ID NO: 3271773 - protein, 18 aa, Plasmodium falciparum
NNYVFIFVPYMSYLCKQE

SEQ ID NO: 3271774 - protein, 18 aa, Plasmodium falciparum
NNYVKLKSILAVFIKWLV

SEQ ID NO: 3271775 - protein, 25 aa, Plasmodium falciparum
NPACPLEPLEPSLIQYNIINLKTNK

SEQ ID NO: 3271776 - protein, 21 aa, Plasmodium falciparum
NPALYNKLFYGQDIHNNSSFF

SEQ ID NO: 3271777 - protein, 21 aa, Plasmodium falciparum
NPDVIPNFIIDFFTKESTDDK

SEQ ID NO: 3271778 - protein, 23 aa, Plasmodium falciparum
NPDVLRLYFMGCGSIYEDKNYKE

SEQ ID NO: 3271779 - protein, 28 aa, Plasmodium falciparum
NPEFFLYDIFLKFCLKYIDGEICHDLFL

SEQ ID NO: 3271780 - protein, 19 aa, Plasmodium falciparum
NPFDLFKFCNLLVLCYTYY

SEQ ID NO: 3271781 - protein, 18 aa, Plasmodium falciparum
NPFFIFLCIESINYWLQK

SEQ ID NO: 3271782 - protein, 23 aa, Plasmodium falciparum
NPFLEIAEKVPFFKTGDIGYIDQ

SEQ ID NO: 3271783 - protein, 17 aa, Plasmodium falciparum
NPFQRKRYSSIRNSVHL

SEQ ID NO: 3271784 - protein, 41 aa, Plasmodium falciparum
NPFSFLGSICYIKEIKIICHFFKIYTLHAINTLHNVISLDN

SEQ ID NO: 3271785 - protein, 20 aa, Plasmodium falciparum
NPFVKWLGNQKLEFDKQKKK

SEQ ID NO: 3271786 - protein, 25 aa, Plasmodium falciparum
NPFYRNRSSVYFDEFDKNGEKNGKE

SEQ ID NO: 3271787 - protein, 25 aa, Plasmodium falciparum
NPHFFFLCIFSLYSYNLSKTRFYYF

SEQ ID NO: 3271788 - protein, 25 aa, Plasmodium falciparum
NPHFKPEVNSQCTLINFSVTCEGLE

SEQ ID NO: 3271789 - protein, 21 aa, Plasmodium falciparum
NPHVFPFTGVRVHGEAGKPVK

SEQ ID NO: 3271790 - protein, 19 aa, Plasmodium falciparum
NPIFLKILHFLLFKPIKIN

SEQ ID NO: 3271791 - protein, 18 aa, Plasmodium falciparum
NPIFSFIEIFIINHSDKY

SEQ ID NO: 3271792 - protein, 19 aa, Plasmodium falciparum
NPILLFPIIYKGASIYVCL

SEQ ID NO: 3271793 - protein, 23 aa, Plasmodium falciparum
NPINNRCPLHLDINVDVKYITLN

SEQ ID NO: 3271794 - protein, 18 aa, Plasmodium falciparum
NPITYAMIGINYYVQNDG

SEQ ID NO: 3271795 - protein, 26 aa, Plasmodium falciparum
NPIVLNELLIGFSFNPIYDYMCKKNN

SEQ ID NO: 3271796 - protein, 22 aa, Plasmodium falciparum
NPKDVHIKLHFVNENSVNIFVV

SEQ ID NO: 3271797 - protein, 22 aa, Plasmodium falciparum
NPKNMRPGFCPEDDTTEQQEEE

SEQ ID NO: 3271798 - protein, 22 aa, Plasmodium falciparum
NPKSIESYELYGYLTKNNEWID

SEQ ID NO: 3271799 - protein, 17 aa, Plasmodium falciparum
NPLHISDYINFIINKDK

SEQ ID NO: 3271800 - protein, 29 aa, Plasmodium falciparum
NPLLMYKKKFDFRIYILLLPGKNYPKIYL

SEQ ID NO: 3271801 - protein, 21 aa, Plasmodium falciparum
NPLTCFNFRDILYKGINKDFY

SEQ ID NO: 3271802 - protein, 19 aa, Plasmodium falciparum
NPMLQRQKIIWRKWIAKNL

SEQ ID NO: 3271803 - protein, 25 aa, Plasmodium falciparum
NPMNTCSFRRIFLNLLSIVGILLLV

SEQ ID NO: 3271804 - protein, 19 aa, Plasmodium falciparum
NPMVFFYIHLGRLSNHFYS

SEQ ID NO: 3271805 - protein, 19 aa, Plasmodium falciparum
NPMVISFIVVVIIVIILLI

SEQ ID NO: 3271806 - protein, 28 aa, Plasmodium falciparum
NPNIPYVRFPHHQWGQGMMYGRPYYPWV

SEQ ID NO: 3271807 - protein, 20 aa, Plasmodium falciparum
NPNIVFYKFFYIYKKLKSKN

SEQ ID NO: 3271808 - protein, 23 aa, Plasmodium falciparum
NPNKRKCEVSEYFNHKYELKKPK

SEQ ID NO: 3271809 - protein, 33 aa, Plasmodium falciparum
NPNLYKSKWIYDFLNCIKLTINLNDQHVLANFL

SEQ ID NO: 3271810 - protein, 19 aa, Plasmodium falciparum
NPNQIISMLNRLSKEKRCD

SEQ ID NO: 3271811 - protein, 18 aa, Plasmodium falciparum
NPQIKYITLIKMKKKNKI

SEQ ID NO: 3271812 - protein, 21 aa, Plasmodium falciparum
NPQLLRRGLGLLRNHLNNDNH

SEQ ID NO: 3271813 - protein, 25 aa, Plasmodium falciparum
NPQVLRPLLNVSWGYLFGSTFWLCF

SEQ ID NO: 3271814 - protein, 32 aa, Plasmodium falciparum
NPSLSNLDKFWCFRMFLHSLILEFNNPDYYFF

SEQ ID NO: 3271815 - protein, 19 aa, Plasmodium falciparum
NPSNCFHDVYFGADLILNS

SEQ ID NO: 3271816 - protein, 24 aa, Plasmodium falciparum
NPTGLKKKILHLLKGGTQINKDNE

SEQ ID NO: 3271817 - protein, 22 aa, Plasmodium falciparum
NPWEHPIVIPALVTSTLAWSVG

SEQ ID NO: 3271818 - protein, 24 aa, Plasmodium falciparum
NPWKNWKVQRIKMFQPHESEELEE

SEQ ID NO: 3271819 - protein, 21 aa, Plasmodium falciparum
NPYLLLFIEFIRRIEFQYLIE

SEQ ID NO: 3271820 - protein, 29 aa, Plasmodium falciparum
NPYTTFKVLLHYWLEDFLYGYYISKKKIE

SEQ ID NO: 3271821 - protein, 17 aa, Plasmodium falciparum
NPYVLKRFLLYLYEYLL

SEQ ID NO: 3271822 - protein, 17 aa, Plasmodium falciparum
NQCKAWNNFRVNKVYDM

SEQ ID NO: 3271823 - protein, 24 aa, Plasmodium falciparum
NQDAFKIIECIMLYIQNKEIFQNI

SEQ ID NO: 3271824 - protein, 22 aa, Plasmodium falciparum
NQDNRLSFTYMKKMSLSNSSIN

SEQ ID NO: 3271825 - protein, 17 aa, Plasmodium falciparum
NQEICFLTYSLVKLNLL

SEQ ID NO: 3271826 - protein, 26 aa, Plasmodium falciparum
NQEYMEVLEIISLIFYGMKIRDLAKY

SEQ ID NO: 3271827 - protein, 32 aa, Plasmodium falciparum
NQFASFSKLCLKLCILGIIVIVNVCCSFESNE

SEQ ID NO: 3271828 - protein, 17 aa, Plasmodium falciparum
NQFIEQADIEFQNFLSN

SEQ ID NO: 3271829 - protein, 31 aa, Plasmodium falciparum
NQIIFIRALFKIWLEYFLKDYNKINAKISYC

SEQ ID NO: 3271830 - protein, 23 aa, Plasmodium falciparum
NQIIPFFNLFHIFNKEGIEQILK

SEQ ID NO: 3271831 - protein, 18 aa, Plasmodium falciparum
NQILLFNALFKRWLEYFL

SEQ ID NO: 3271832 - protein, 18 aa, Plasmodium falciparum
NQILLFNALLKRWVEYFL

SEQ ID NO: 3271833 - protein, 18 aa, Plasmodium falciparum
NQILRNNYLYSFLRNYNK

SEQ ID NO: 3271834 - protein, 27 aa, Plasmodium falciparum
NQILYKRKIIYSKWKAPVQIKKKEKKK

SEQ ID NO: 3271835 - protein, 17 aa, Plasmodium falciparum
NQIRIVYVSAIHPLLHD

SEQ ID NO: 3271836 - protein, 34 aa, Plasmodium falciparum
NQITYKYSCCSMEITTFKGCKFVRFQDIDVVPYY

SEQ ID NO: 3271837 - protein, 28 aa, Plasmodium falciparum
NQKALFLKSIFLDRIYKNCTSIHLKNNH

SEQ ID NO: 3271838 - protein, 23 aa, Plasmodium falciparum
NQKKEYSFHIFLYIIRTYINELI

SEQ ID NO: 3271839 - protein, 25 aa, Plasmodium falciparum
NQKKKMRSTARHILSPSSVLSPTNV

SEQ ID NO: 3271840 - protein, 24 aa, Plasmodium falciparum
NQKLEFKKYVDLFEKEENTYIIET

SEQ ID NO: 3271841 - protein, 24 aa, Plasmodium falciparum
NQKLFEILKHLKIKHEDNQEYMEV

SEQ ID NO: 3271842 - protein, 25 aa, Plasmodium falciparum
NQLIIKICFNLLYFGTIIKKEKTFD

SEQ ID NO: 3271843 - protein, 22 aa, Plasmodium falciparum
NQLKHFVLNFSFDYHGNDTKMS

SEQ ID NO: 3271844 - protein, 21 aa, Plasmodium falciparum
NQLKNSILFDVHITNKDVETK

SEQ ID NO: 3271845 - protein, 28 aa, Plasmodium falciparum
NQLKYFLRNNFLIQILCFVFLVISLGAA

SEQ ID NO: 3271846 - protein, 25 aa, Plasmodium falciparum
NQLLHILEIFSFIKYNKAMFTYIIN

SEQ ID NO: 3271847 - protein, 24 aa, Plasmodium falciparum
NQLLPSCLLFDSIRALTNMKSHYA

SEQ ID NO: 3271848 - protein, 31 aa, Plasmodium falciparum
NQLNIRLLFYKVIFKNIIKYILYIKYDDHKY

SEQ ID NO: 3271849 - protein, 21 aa, Plasmodium falciparum
NQLPLFFLSLLDLYKNTFDVY

SEQ ID NO: 3271850 - protein, 18 aa, Plasmodium falciparum
NQLWNFLSMNNFIAPSDW

SEQ ID NO: 3271851 - protein, 17 aa, Plasmodium falciparum
NQLYNWVYELVYNRDIE

SEQ ID NO: 3271852 - protein, 20 aa, Plasmodium falciparum
NQMRYKLYVHNLKTSKHFKN

SEQ ID NO: 3271853 - protein, 19 aa, Plasmodium falciparum
NQMYLILPTYFLYINVLNI

SEQ ID NO: 3271854 - protein, 25 aa, Plasmodium falciparum
NQNEIKSNYLIRVLYKFFNTNMKKD

SEQ ID NO: 3271855 - protein, 18 aa, Plasmodium falciparum
NQNIFGNLIFFTSLNLHY

SEQ ID NO: 3271856 - protein, 18 aa, Plasmodium falciparum
NQNMLSFYRKNMEESSNI

SEQ ID NO: 3271857 - protein, 25 aa, Plasmodium falciparum
NQNNICLPKGIYLDRSEECEPKNIW

SEQ ID NO: 3271858 - protein, 23 aa, Plasmodium falciparum
NQNSFLKYILPYAQKLSLSEYQL

SEQ ID NO: 3271859 - protein, 18 aa, Plasmodium falciparum
NQPFKYDDSFFFFNSIVL

SEQ ID NO: 3271860 - protein, 19 aa, Plasmodium falciparum
NQQEVFGLYSPVSRTLDSA

SEQ ID NO: 3271861 - protein, 30 aa, Plasmodium falciparum
NQSFLFRSVLKYTRLIPSYSTSGMLLLLTF

SEQ ID NO: 3271862 - protein, 25 aa, Plasmodium falciparum
NQSTTFCGILLYILGIIMSILCVYK

SEQ ID NO: 3271863 - protein, 17 aa, Plasmodium falciparum
NQSYIFLLLEEKLIIIS

SEQ ID NO: 3271864 - protein, 24 aa, Plasmodium falciparum
NQVCISLKILKHVFINMHMKLLYI

SEQ ID NO: 3271865 - protein, 25 aa, Plasmodium falciparum
NQVFYLKCVANFRVLLYNITLFTDY

SEQ ID NO: 3271866 - protein, 20 aa, Plasmodium falciparum
NQVWLCTSKYIFKIIQNKKN

SEQ ID NO: 3271867 - protein, 44 aa, Plasmodium falciparum
NQYFISFFFFFKIHYLFFLIKFKCENEIFLKAYWFLHAVYNITQ

SEQ ID NO: 3271868 - protein, 21 aa, Plasmodium falciparum
NRAECLFHDVSIIKFYAYNNI

SEQ ID NO: 3271869 - protein, 44 aa, Plasmodium falciparum
NRCATLIQSCFRRYRCMVQYEKKMYLKICFLSIKRKYMAYTNVI

SEQ ID NO: 3271870 - protein, 28 aa, Plasmodium falciparum
NRDDFSFDFYFYVVNCIFKNSRKKIDMI

SEQ ID NO: 3271871 - protein, 17 aa, Plasmodium falciparum
NRDHWLRIPNKINNKIC

SEQ ID NO: 3271872 - protein, 22 aa, Plasmodium falciparum
NRDILYVNAFLNIYNDENVKEK

SEQ ID NO: 3271873 - protein, 17 aa, Plasmodium falciparum
NRDQVWKAITCNAPKDA

SEQ ID NO: 3271874 - protein, 17 aa, Plasmodium falciparum
NRDQVWKAMTCVAPENA

SEQ ID NO: 3271875 - protein, 19 aa, Plasmodium falciparum
NRDRMRGMLGKENTHQSLN

SEQ ID NO: 3271876 - protein, 23 aa, Plasmodium falciparum
NREDHIMKLLPIYKDKDNDIIDE

SEQ ID NO: 3271877 - protein, 19 aa, Plasmodium falciparum
NRESSSLLKENKKKDNKNI

SEQ ID NO: 3271878 - protein, 18 aa, Plasmodium falciparum
NRETVWKAITCNAGSYQY

SEQ ID NO: 3271879 - protein, 17 aa, Plasmodium falciparum
NRFIKKLYYCSDIKKIY

SEQ ID NO: 3271880 - protein, 24 aa, Plasmodium falciparum
NRFVTFCALLLFEHFREYVKVKYI

SEQ ID NO: 3271881 - protein, 23 aa, Plasmodium falciparum
NRGEIISYLLLKILRNQKCTEEI

SEQ ID NO: 3271882 - protein, 17 aa, Plasmodium falciparum
NRGFKLTEKDYILIPNV

SEQ ID NO: 3271883 - protein, 21 aa, Plasmodium falciparum
NRIAWKALMNHIQCTCKNIMT

SEQ ID NO: 3271884 - protein, 19 aa, Plasmodium falciparum
NRIDDLLSIKSCLRTKDMI

SEQ ID NO: 3271885 - protein, 17 aa, Plasmodium falciparum
NRIKFIDIYNGSDFIIS

SEQ ID NO: 3271886 - protein, 20 aa, Plasmodium falciparum
NRIKSFESFDIQQLILCILF

SEQ ID NO: 3271887 - protein, 20 aa, Plasmodium falciparum
NRILEKFIYEKEVIIYPYSP

SEQ ID NO: 3271888 - protein, 18 aa, Plasmodium falciparum
NRILSDPFFLELNEPTPK

SEQ ID NO: 3271889 - protein, 25 aa, Plasmodium falciparum
NRISDEFYSSFLYHSYIENLKSTKE

SEQ ID NO: 3271890 - protein, 18 aa, Plasmodium falciparum
NRKCNKEKYHFFNTAMNI

SEQ ID NO: 3271891 - protein, 21 aa, Plasmodium falciparum
NRKGNGCVYSLSDQNVEDHII

SEQ ID NO: 3271892 - protein, 18 aa, Plasmodium falciparum
NRKKIFCVVRPPGHHLGT

SEQ ID NO: 3271893 - protein, 47 aa, Plasmodium falciparum
NRKKLAFRLTRNIKEFIGFQGLHGSFPLCFYSSIMAIKKKKMEIKNF

SEQ ID NO: 3271894 - protein, 23 aa, Plasmodium falciparum
NRKMIKNIFPLMKLSSMEHYISG

SEQ ID NO: 3271895 - protein, 24 aa, Plasmodium falciparum
NRKRKLHKFPYLRDFIYYEKYFLK

SEQ ID NO: 3271896 - protein, 27 aa, Plasmodium falciparum
NRKSLFIKLALAISFFFYNNIILLIIK

SEQ ID NO: 3271897 - protein, 24 aa, Plasmodium falciparum
NRKSSKFSVLNLFNNIKKSKDKKK

SEQ ID NO: 3271898 - protein, 17 aa, Plasmodium falciparum
NRLCLFHKSRIILTYLY

SEQ ID NO: 3271899 - protein, 19 aa, Plasmodium falciparum
NRLDVRFSDIYGGQCTDNK

SEQ ID NO: 3271900 - protein, 17 aa, Plasmodium falciparum
NRLESVMNIINKDDDKY

SEQ ID NO: 3271901 - protein, 38 aa, Plasmodium falciparum
NRLIKGLKYFLFRINKIKKRKVRLHIMNLNYLINKKKK

SEQ ID NO: 3271902 - protein, 17 aa, Plasmodium falciparum
NRLLLIIKEIYEKHMEK

SEQ ID NO: 3271903 - protein, 17 aa, Plasmodium falciparum
NRLLYIIRKSECYKKCC

SEQ ID NO: 3271904 - protein, 19 aa, Plasmodium falciparum
NRLQILKSVLLLLFVCFHF

SEQ ID NO: 3271905 - protein, 25 aa, Plasmodium falciparum
NRLSLKRLGILLGLDEIGDENELDF

SEQ ID NO: 3271906 - protein, 27 aa, Plasmodium falciparum
NRLSTYPHWRIYTCTDLMQLSNSTENF

SEQ ID NO: 3271907 - protein, 28 aa, Plasmodium falciparum
NRLYTLSSIEFIKFIFLLLDKNISTNSN

SEQ ID NO: 3271908 - protein, 24 aa, Plasmodium falciparum
NRMLKYMIVYNFSLLFYMFFVFII

SEQ ID NO: 3271909 - protein, 22 aa, Plasmodium falciparum
NRNEGMFKFVLNNFMSEICRLY

SEQ ID NO: 3271910 - protein, 31 aa, Plasmodium falciparum
NRNELIVHSFLRFFNYPFFKKPLIGDIITNY

SEQ ID NO: 3271911 - protein, 19 aa, Plasmodium falciparum
NRNFQKVIYNICINHLKLN

SEQ ID NO: 3271912 - protein, 18 aa, Plasmodium falciparum
NRNISLFCDDFVKIKLNH

SEQ ID NO: 3271913 - protein, 22 aa, Plasmodium falciparum
NRNKAECIVGLIHIKDLINIWF

SEQ ID NO: 3271914 - protein, 20 aa, Plasmodium falciparum
NRNKFLFDRQFYIDLFYVHK

SEQ ID NO: 3271915 - protein, 18 aa, Plasmodium falciparum
NRNKLCLYFKPLQNYFCS

SEQ ID NO: 3271916 - protein, 21 aa, Plasmodium falciparum
NRNMSYFFLMNVIRDHYDSFK

SEQ ID NO: 3271917 - protein, 19 aa, Plasmodium falciparum
NRNVTILGIFSFKEEIKNG

SEQ ID NO: 3271918 - protein, 21 aa, Plasmodium falciparum
NRPNFKLTRSLSFNINMNKDD

SEQ ID NO: 3271919 - protein, 23 aa, Plasmodium falciparum
NRPNLKYIIIYSDLIKDEKKNSV

SEQ ID NO: 3271920 - protein, 18 aa, Plasmodium falciparum
NRRNGLCGRICSNGYIKE

SEQ ID NO: 3271921 - protein, 24 aa, Plasmodium falciparum
NRSDGRLGIINGMIGSNHNINNNN

SEQ ID NO: 3271922 - protein, 29 aa, Plasmodium falciparum
NRTQIIGYWPLRGDFDIEYDNDAELLLAD

SEQ ID NO: 3271923 - protein, 26 aa, Plasmodium falciparum
NRVHKSRLILILIYHFLFIISSNNLH

SEQ ID NO: 3271924 - protein, 19 aa, Plasmodium falciparum
NRVIEFYNIHETYLIEIYN

SEQ ID NO: 3271925 - protein, 22 aa, Plasmodium falciparum
NRVWVLILCLNFIYCNLNDDIM

SEQ ID NO: 3271926 - protein, 21 aa, Plasmodium falciparum
NRWKLSSCTVSIFNINLFNCI

SEQ ID NO: 3271927 - protein, 18 aa, Plasmodium falciparum
NRYDCKNTASGKHVFFED

SEQ ID NO: 3271928 - protein, 31 aa, Plasmodium falciparum
NRYIFSYLYNFFDTFEMFKKNFLDINNIRND

SEQ ID NO: 3271929 - protein, 18 aa, Plasmodium falciparum
NRYNKFYLTTEVDKEEIK

SEQ ID NO: 3271930 - protein, 21 aa, Plasmodium falciparum
NRYPCKNLKGITNEERFSDTL

SEQ ID NO: 3271931 - protein, 23 aa, Plasmodium falciparum
NRYSRKLCERFIYYNPNVQGVYP

SEQ ID NO: 3271932 - protein, 22 aa, Plasmodium falciparum
NRYYKSKLKRIIFVGDSNQLPP

SEQ ID NO: 3271933 - protein, 19 aa, Plasmodium falciparum
NRYYSCVFQMSDGYMSINE

SEQ ID NO: 3271934 - protein, 24 aa, Plasmodium falciparum
NSAIFLRYARLLIYKKNYDIGNVD

SEQ ID NO: 3271935 - protein, 31 aa, Plasmodium falciparum
NSCMDKKAICKKLDMLLNHRIEGNYCQDDVS

SEQ ID NO: 3271936 - protein, 23 aa, Plasmodium falciparum
NSCVCFLIGLLIKKKQEINILKN

SEQ ID NO: 3271937 - protein, 25 aa, Plasmodium falciparum
NSCYLINFFNVFIIHFQEVYINYIE

SEQ ID NO: 3271938 - protein, 18 aa, Plasmodium falciparum
NSDLVIRGGLTNKEIDKL

SEQ ID NO: 3271939 - protein, 18 aa, Plasmodium falciparum
NSDNFFPYFQRINKLNTE

SEQ ID NO: 3271940 - protein, 23 aa, Plasmodium falciparum
NSDNFIIEFNFFMERKYYKEKID

SEQ ID NO: 3271941 - protein, 19 aa, Plasmodium falciparum
NSDNISLLGKRKISQDSIK

SEQ ID NO: 3271942 - protein, 23 aa, Plasmodium falciparum
NSDPSLCEKWKCYKHEHVQKVKN

SEQ ID NO: 3271943 - protein, 23 aa, Plasmodium falciparum
NSDRFSLYILILLTQNDFIDNIF

SEQ ID NO: 3271944 - protein, 28 aa, Plasmodium falciparum
NSDYIKNFVRSYCILKYKKLKDNHKYID

SEQ ID NO: 3271945 - protein, 27 aa, Plasmodium falciparum
NSDYLLWGFCVPSSFRSLSSLQLTYIH

SEQ ID NO: 3271946 - protein, 25 aa, Plasmodium falciparum
NSEILFNCFINFLLRKSLKIASFDF

SEQ ID NO: 3271947 - protein, 26 aa, Plasmodium falciparum
NSEKFETMCFMFKKLIYSNFKLITPI

SEQ ID NO: 3271948 - protein, 25 aa, Plasmodium falciparum
NSEKNCYENVIILKYMVSLFSNNKD

SEQ ID NO: 3271949 - protein, 20 aa, Plasmodium falciparum
NSFCSLKFETFYKHKGNYKK

SEQ ID NO: 3271950 - protein, 18 aa, Plasmodium falciparum
NSFIKLNPSYILYYNIFF

SEQ ID NO: 3271951 - protein, 17 aa, Plasmodium falciparum
NSFIRTFFQTFLFSAVN

SEQ ID NO: 3271952 - protein, 35 aa, Plasmodium falciparum
NSFKNIYRPYGLLRIMPKYLFIPFIRELAYLNLLY

SEQ ID NO: 3271953 - protein, 24 aa, Plasmodium falciparum
NSFLSIDISVFFPINTYTYIADMC

SEQ ID NO: 3271954 - protein, 18 aa, Plasmodium falciparum
NSFLSLIVTCFLFFHIWL

SEQ ID NO: 3271955 - protein, 17 aa, Plasmodium falciparum
NSFLYNYYNFFKRKINN

SEQ ID NO: 3271956 - protein, 19 aa, Plasmodium falciparum
NSFNIKFGLFNTRGKPIGS

SEQ ID NO: 3271957 - protein, 26 aa, Plasmodium falciparum
NSFPYEVLNKFIFVFFLFYLTSIFLF

SEQ ID NO: 3271958 - protein, 18 aa, Plasmodium falciparum
NSFTCCLENDRVRKEILL

SEQ ID NO: 3271959 - protein, 20 aa, Plasmodium falciparum
NSFVQRSYIRGCKGKRSTHT

SEQ ID NO: 3271960 - protein, 26 aa, Plasmodium falciparum
NSFVTFYNKRIIKYEHDMIANNLLEQ

SEQ ID NO: 3271961 - protein, 30 aa, Plasmodium falciparum
NSFYFIKHILSFIYKSYISFKYLNYPSTPL

SEQ ID NO: 3271962 - protein, 24 aa, Plasmodium falciparum
NSFYKLNDMFNFLVNKILNYFNEN

SEQ ID NO: 3271963 - protein, 17 aa, Plasmodium falciparum
NSGCTRSINLYSFENEK

SEQ ID NO: 3271964 - protein, 21 aa, Plasmodium falciparum
NSGLLKYLGCNIEKSLNVKRN

SEQ ID NO: 3271965 - protein, 33 aa, Plasmodium falciparum
NSGWLPSLVANILICILTIFNSLLFLRTMTMIP

SEQ ID NO: 3271966 - protein, 20 aa, Plasmodium falciparum
NSHFVIHLYILILKSTRLVT

SEQ ID NO: 3271967 - protein, 23 aa, Plasmodium falciparum
NSHLCLSILSIIEYLTTTYNNVV

SEQ ID NO: 3271968 - protein, 23 aa, Plasmodium falciparum
NSHSRFQIEYEVEYKYYEHECHI

SEQ ID NO: 3271969 - protein, 18 aa, Plasmodium falciparum
NSIANVFVKLKYTIGSDK

SEQ ID NO: 3271970 - protein, 26 aa, Plasmodium falciparum
NSICSSSGIFCCLRRDMYRIKLWNIL

SEQ ID NO: 3271971 - protein, 24 aa, Plasmodium falciparum
NSIEKSFCHFIMCINTCRKKINTE

SEQ ID NO: 3271972 - protein, 18 aa, Plasmodium falciparum
NSIFKISIVFTLLILSLY

SEQ ID NO: 3271973 - protein, 26 aa, Plasmodium falciparum
NSIHLIELLYTLSILHIDKSKIVKVI

SEQ ID NO: 3271974 - protein, 23 aa, Plasmodium falciparum
NSIHPINIYFFFHSDNIKITYPE

SEQ ID NO: 3271975 - protein, 28 aa, Plasmodium falciparum
NSIICYYSLWILCYYLIYFLCFLSFLYG

SEQ ID NO: 3271976 - protein, 25 aa, Plasmodium falciparum
NSIIKYERLSVLKCGYNKSGGNLLI

SEQ ID NO: 3271977 - protein, 25 aa, Plasmodium falciparum
NSIKFKGVYDIMKFVGNHFPKNRLF

SEQ ID NO: 3271978 - protein, 23 aa, Plasmodium falciparum
NSIKKDKYGVCKISDSKNKTFNN

SEQ ID NO: 3271979 - protein, 22 aa, Plasmodium falciparum
NSIKSKISNFIFNNNKLNSDSS

SEQ ID NO: 3271980 - protein, 18 aa, Plasmodium falciparum
NSILGLKAVRGHMQAYLR

SEQ ID NO: 3271981 - protein, 24 aa, Plasmodium falciparum
NSILNCKMLACFLNSTSLICDNIN

SEQ ID NO: 3271982 - protein, 29 aa, Plasmodium falciparum
NSILNYYYLCIIYLYNLKINKCLYICKNF

SEQ ID NO: 3271983 - protein, 24 aa, Plasmodium falciparum
NSILRIFFFFFLISFLFSNCKLND

SEQ ID NO: 3271984 - protein, 18 aa, Plasmodium falciparum
NSINENVVFLSFFENFYF

SEQ ID NO: 3271985 - protein, 28 aa, Plasmodium falciparum
NSIVLRQCKSRFISIITNYYPFKEQNNP

SEQ ID NO: 3271986 - protein, 17 aa, Plasmodium falciparum
NSIYVFFYLFVHINNII

SEQ ID NO: 3271987 - protein, 18 aa, Plasmodium falciparum
NSKCLSIYLLYISKFNII

SEQ ID NO: 3271988 - protein, 18 aa, Plasmodium falciparum
NSKELFETVLLFERDDII

SEQ ID NO: 3271989 - protein, 19 aa, Plasmodium falciparum
NSKFSVYIRKMFEENVSGK

SEQ ID NO: 3271990 - protein, 24 aa, Plasmodium falciparum
NSKRLFYNFFFNHKYVFDISLQQF

SEQ ID NO: 3271991 - protein, 19 aa, Plasmodium falciparum
NSKTLKRCNKKKNIKTNFL

SEQ ID NO: 3271992 - protein, 17 aa, Plasmodium falciparum
NSLCCYKTIHKINNYVK

SEQ ID NO: 3271993 - protein, 21 aa, Plasmodium falciparum
NSLFKLRFKIDQAKQMDNFYY

SEQ ID NO: 3271994 - protein, 19 aa, Plasmodium falciparum
NSLHVVHNFSFVKNDIERN

SEQ ID NO: 3271995 - protein, 24 aa, Plasmodium falciparum
NSLHYYHKCCVLSFINKEEYTKLK

SEQ ID NO: 3271996 - protein, 25 aa, Plasmodium falciparum
NSLIHLFYSFSFMNIFDKKKIDFYF

SEQ ID NO: 3271997 - protein, 23 aa, Plasmodium falciparum
NSLILRFIDDFLFITLNKKNIKI

SEQ ID NO: 3271998 - protein, 23 aa, Plasmodium falciparum
NSLKDLCSLLLKKNSIDLDKLIV

SEQ ID NO: 3271999 - protein, 23 aa, Plasmodium falciparum
NSLKGIICSSIFFDNKNKKKSYI

SEQ ID NO: 3272000 - protein, 26 aa, Plasmodium falciparum
NSLLKSNCIKTNFNMIKIGYVIFLFV

SEQ ID NO: 3272001 - protein, 19 aa, Plasmodium falciparum
NSLLPFFFFHLSKEDKMNL

SEQ ID NO: 3272002 - protein, 17 aa, Plasmodium falciparum
NSLLSNKDLIIFNLQDI

SEQ ID NO: 3272003 - protein, 33 aa, Plasmodium falciparum
NSLPRMCSVDHRNRPLPTLKFFLSDNDIVSDNN

SEQ ID NO: 3272004 - protein, 26 aa, Plasmodium falciparum
NSLSFLKKKIKGIGLLSFIILFYLLM

SEQ ID NO: 3272005 - protein, 28 aa, Plasmodium falciparum
NSLSFSHNAIRIFSKVCPKINNDNVLKC

SEQ ID NO: 3272006 - protein, 19 aa, Plasmodium falciparum
NSLSYLLTHVYFYNEKYYK

SEQ ID NO: 3272007 - protein, 23 aa, Plasmodium falciparum
NSMCLPFDIALGLSDAKGTPIGP

SEQ ID NO: 3272008 - protein, 25 aa, Plasmodium falciparum
NSMFCFRPAKDISFQNYTYLSKNVV

SEQ ID NO: 3272009 - protein, 25 aa, Plasmodium falciparum
NSMIKQRILYFSIFLLIVAFIILFP

SEQ ID NO: 3272010 - protein, 24 aa, Plasmodium falciparum
NSMKIKRSVIKKISMKNIIQKETE

SEQ ID NO: 3272011 - protein, 21 aa, Plasmodium falciparum
NSMSEKDYLLSLMKSKKSALR

SEQ ID NO: 3272012 - protein, 32 aa, Plasmodium falciparum
NSMTLLCGFMNIFKIAFLIRNIKELNDFFLKR

SEQ ID NO: 3272013 - protein, 17 aa, Plasmodium falciparum
NSNCSSHGRVFFKTTYV

SEQ ID NO: 3272014 - protein, 22 aa, Plasmodium falciparum
NSNEPHHIFNIFQKEFSEADNA

SEQ ID NO: 3272015 - protein, 24 aa, Plasmodium falciparum
NSNLFFKKFCSFINMEYDETTKDL

SEQ ID NO: 3272016 - protein, 20 aa, Plasmodium falciparum
NSNMEKFGELINVDMNNIEN

SEQ ID NO: 3272017 - protein, 22 aa, Plasmodium falciparum
NSNNICLTKYILKCLEKKNLTK

SEQ ID NO: 3272018 - protein, 24 aa, Plasmodium falciparum
NSNNILKCIDEFLRKTCEKKTESK

SEQ ID NO: 3272019 - protein, 25 aa, Plasmodium falciparum
NSNRKEILEDILFCCSALNEYSAYI

SEQ ID NO: 3272020 - protein, 25 aa, Plasmodium falciparum
NSPFKNIICIVVIIRYLLWNLYKNH

SEQ ID NO: 3272021 - protein, 22 aa, Plasmodium falciparum
NSPKTILLFTVRDWFEEFAPIE

SEQ ID NO: 3272022 - protein, 18 aa, Plasmodium falciparum
NSPLNFCYIFKGTFRIYD

SEQ ID NO: 3272023 - protein, 19 aa, Plasmodium falciparum
NSPRFTFLHFIKSEQNHNN

SEQ ID NO: 3272024 - protein, 18 aa, Plasmodium falciparum
NSQICYDKSLLLQSNINI

SEQ ID NO: 3272025 - protein, 24 aa, Plasmodium falciparum
NSRGEHILMLYGIVQLSLIIIVKI

SEQ ID NO: 3272026 - protein, 20 aa, Plasmodium falciparum
NSRKKLMKIINIIDEEKCLD

SEQ ID NO: 3272027 - protein, 33 aa, Plasmodium falciparum
NSRKNICLLKIKSLEELFLYCFEINKNDYMCIN

SEQ ID NO: 3272028 - protein, 18 aa, Plasmodium falciparum
NSRLGWKCIPSGDSTTTS

SEQ ID NO: 3272029 - protein, 20 aa, Plasmodium falciparum
NSRQMIKYSGFIYLYEIIEK

SEQ ID NO: 3272030 - protein, 20 aa, Plasmodium falciparum
NSRYPIVISQVYGLPSEKPT

SEQ ID NO: 3272031 - protein, 30 aa, Plasmodium falciparum
NSSDINSLLSYCYFPKYFSLKHENNLKNKI

SEQ ID NO: 3272032 - protein, 18 aa, Plasmodium falciparum
NSSFNIKKNENFDVQKKY

SEQ ID NO: 3272033 - protein, 29 aa, Plasmodium falciparum
NSSIKEIICRHSFDFLKYNLYAQTLKLKT

SEQ ID NO: 3272034 - protein, 19 aa, Plasmodium falciparum
NSSILRTYIVLIFLFILVS

SEQ ID NO: 3272035 - protein, 18 aa, Plasmodium falciparum
NSSIPFNANYDMYYECDA

SEQ ID NO: 3272036 - protein, 25 aa, Plasmodium falciparum
NSSKKWYYEWLVLYYKELELHEKEI

SEQ ID NO: 3272037 - protein, 17 aa, Plasmodium falciparum
NSSLIYRYDYKKYPPPG

SEQ ID NO: 3272038 - protein, 20 aa, Plasmodium falciparum
NSSLWIYAISILKILLKRIY

SEQ ID NO: 3272039 - protein, 18 aa, Plasmodium falciparum
NSSYSYRRNEHMSNNIDT

SEQ ID NO: 3272040 - protein, 17 aa, Plasmodium falciparum
NSTCAIINNKGKAISKG

SEQ ID NO: 3272041 - protein, 18 aa, Plasmodium falciparum
NSTCRYIISCICLIFSYT

SEQ ID NO: 3272042 - protein, 18 aa, Plasmodium falciparum
NSTEKKCDAQEFKVTYDV

SEQ ID NO: 3272043 - protein, 19 aa, Plasmodium falciparum
NSTHKFFFLQYFLNKDIKN

SEQ ID NO: 3272044 - protein, 18 aa, Plasmodium falciparum
NSTLPTINTFIILDIILR

SEQ ID NO: 3272045 - protein, 18 aa, Plasmodium falciparum
NSTSYFFGFSKELIFHCL

SEQ ID NO: 3272046 - protein, 17 aa, Plasmodium falciparum
NSVCKIKTENSLLENNS

SEQ ID NO: 3272047 - protein, 37 aa, Plasmodium falciparum
NSVDSRLYIKCCSCIFLSYIIFFSLIFKNLEMYYMHF

SEQ ID NO: 3272048 - protein, 25 aa, Plasmodium falciparum
NSVLYCLYISVIISYIYLNDFRNAY

SEQ ID NO: 3272049 - protein, 17 aa, Plasmodium falciparum
NSVSIKGLDVFRNDERI

SEQ ID NO: 3272050 - protein, 21 aa, Plasmodium falciparum
NSYAGNNCYNHFLKNNWFDNE

SEQ ID NO: 3272051 - protein, 22 aa, Plasmodium falciparum
NSYDLTNIFNFYFDNQNEDVIS

SEQ ID NO: 3272052 - protein, 22 aa, Plasmodium falciparum
NSYEEGVEFLVNLQNDLKKKLD

SEQ ID NO: 3272053 - protein, 24 aa, Plasmodium falciparum
NSYFIKSLNIIYMLSRNKKMKDYI

SEQ ID NO: 3272054 - protein, 19 aa, Plasmodium falciparum
NSYGELLSGCIKNKSSDMN

SEQ ID NO: 3272055 - protein, 24 aa, Plasmodium falciparum
NSYIPSLLRFYNWMLFVSSIISIF

SEQ ID NO: 3272056 - protein, 36 aa, Plasmodium falciparum
NSYKPPCLFCNINLCGSLLCSYKSIEVIKKNKKYIE

SEQ ID NO: 3272057 - protein, 21 aa, Plasmodium falciparum
NSYLIDIYHILSFEKNQKLFF

SEQ ID NO: 3272058 - protein, 18 aa, Plasmodium falciparum
NSYMLSFDILKILYFLYE

SEQ ID NO: 3272059 - protein, 19 aa, Plasmodium falciparum
NSYNKWKSGRFSVYNNICF

SEQ ID NO: 3272060 - protein, 19 aa, Plasmodium falciparum
NSYNTRGSHDITYKIIKKR

SEQ ID NO: 3272061 - protein, 17 aa, Plasmodium falciparum
NSYRFSRTIIYNIINNN

SEQ ID NO: 3272062 - protein, 17 aa, Plasmodium falciparum
NSYSFLFKGFEERKNKV

SEQ ID NO: 3272063 - protein, 19 aa, Plasmodium falciparum
NSYTRNSIEYIPYIDEEEY

SEQ ID NO: 3272064 - protein, 24 aa, Plasmodium falciparum
NSYTWLNIFLLILFKTIQILMTQT

SEQ ID NO: 3272065 - protein, 18 aa, Plasmodium falciparum
NTAKSLCVYNFLNKQKQI

SEQ ID NO: 3272066 - protein, 18 aa, Plasmodium falciparum
NTCELIFYTYYNYNSFFF

SEQ ID NO: 3272067 - protein, 26 aa, Plasmodium falciparum
NTCQIRYEYQMSFVMNLFFHLYEEYS

SEQ ID NO: 3272068 - protein, 27 aa, Plasmodium falciparum
NTDKVIENFSFFLILYFLNIKRRKFQE

SEQ ID NO: 3272069 - protein, 30 aa, Plasmodium falciparum
NTEECKTLYSLKTICVILGIQGSGKTTLIK

SEQ ID NO: 3272070 - protein, 26 aa, Plasmodium falciparum
NTETKSGNCITRFIKNITFGKNRNND

SEQ ID NO: 3272071 - protein, 19 aa, Plasmodium falciparum
NTFIWKERKVFIKGKGKMK

SEQ ID NO: 3272072 - protein, 23 aa, Plasmodium falciparum
NTFLKSFIFQFIDKEFKREDFYE

SEQ ID NO: 3272073 - protein, 24 aa, Plasmodium falciparum
NTFLKTYEYIREWYVINNDYTISY

SEQ ID NO: 3272074 - protein, 18 aa, Plasmodium falciparum
NTFLSRDGGVTWIEAHKG

SEQ ID NO: 3272075 - protein, 19 aa, Plasmodium falciparum
NTFSCKWKKEKWFEELKND

SEQ ID NO: 3272076 - protein, 39 aa, Plasmodium falciparum
NTFVYYIYNCIYCFFHIYINRFAFFIIFIKQEHMNLHDY

SEQ ID NO: 3272077 - protein, 18 aa, Plasmodium falciparum
NTGLILRKLHFSIKDKNI

SEQ ID NO: 3272078 - protein, 22 aa, Plasmodium falciparum
NTGRKRFYLFINKNADQQNNAI

SEQ ID NO: 3272079 - protein, 23 aa, Plasmodium falciparum
NTHFCYKVEIVPFYKTNNITKYL

SEQ ID NO: 3272080 - protein, 20 aa, Plasmodium falciparum
NTHLNKCCNIYQEEENMINS

SEQ ID NO: 3272081 - protein, 33 aa, Plasmodium falciparum
NTHNEGFLILSYCFAISLFMYIVLKNLYYLYIF

SEQ ID NO: 3272082 - protein, 23 aa, Plasmodium falciparum
NTIFLYNFIKTYGFKDLYKGFTF

SEQ ID NO: 3272083 - protein, 28 aa, Plasmodium falciparum
NTIHKHPYLLCIFKYKDLKEDGNEKKNN

SEQ ID NO: 3272084 - protein, 24 aa, Plasmodium falciparum
NTIILEILKYLLLSIDQMPLLLQN

SEQ ID NO: 3272085 - protein, 18 aa, Plasmodium falciparum
NTILRYGTFLNLMNIAQL

SEQ ID NO: 3272086 - protein, 24 aa, Plasmodium falciparum
NTILVYRCNIDLGSFDKFKIKCPS

SEQ ID NO: 3272087 - protein, 17 aa, Plasmodium falciparum
NTIRIKKIYGCVEKTKK

SEQ ID NO: 3272088 - protein, 26 aa, Plasmodium falciparum
NTISELLCNAYIVFLLLLRELNKFNN

SEQ ID NO: 3272089 - protein, 20 aa, Plasmodium falciparum
NTISKWILKNINIFINHLII

SEQ ID NO: 3272090 - protein, 28 aa, Plasmodium falciparum
NTKCKTCNKIGIYSCIHKYYNLEYIYNK

SEQ ID NO: 3272091 - protein, 24 aa, Plasmodium falciparum
NTKDILLKKEKKGINFNLLSFHNY

SEQ ID NO: 3272092 - protein, 25 aa, Plasmodium falciparum
NTKELLNSLSLYYLVIIFIYIKNNL

SEQ ID NO: 3272093 - protein, 17 aa, Plasmodium falciparum
NTKKCEECIKILQKIFI

SEQ ID NO: 3272094 - protein, 18 aa, Plasmodium falciparum
NTKKECRNLNILHCNTNN

SEQ ID NO: 3272095 - protein, 27 aa, Plasmodium falciparum
NTKKKVLDLWSLFRNRFDVDIQTIFSQ

SEQ ID NO: 3272096 - protein, 33 aa, Plasmodium falciparum
NTKLSRYERVLIHTCIYKLNWKKYIDNINKGMF

SEQ ID NO: 3272097 - protein, 18 aa, Plasmodium falciparum
NTLDCNHPIHSVWKDTTR

SEQ ID NO: 3272098 - protein, 29 aa, Plasmodium falciparum
NTLDIISGVPFSFEINQFYSKYDLFIRLI

SEQ ID NO: 3272099 - protein, 19 aa, Plasmodium falciparum
NTLEIILFIYIMRKDRLFY

SEQ ID NO: 3272100 - protein, 20 aa, Plasmodium falciparum
NTLFLKFYIKVFMVKMKKLQ

SEQ ID NO: 3272101 - protein, 17 aa, Plasmodium falciparum
NTLFNIMFDTCIMLIDI

SEQ ID NO: 3272102 - protein, 24 aa, Plasmodium falciparum
NTLHERFYFMLSIICIMKNDKNIN

SEQ ID NO: 3272103 - protein, 18 aa, Plasmodium falciparum
NTLILSMGLCMKKINSHK

SEQ ID NO: 3272104 - protein, 26 aa, Plasmodium falciparum
NTLKLWDLFFLFGMKILIKLTLILLY

SEQ ID NO: 3272105 - protein, 17 aa, Plasmodium falciparum
NTLLLTIFHIEKYNYHH

SEQ ID NO: 3272106 - protein, 24 aa, Plasmodium falciparum
NTLRRNNCHFYEFGNNIDEYRNHI

SEQ ID NO: 3272107 - protein, 17 aa, Plasmodium falciparum
NTLSCCDYIYVLRKGEI

SEQ ID NO: 3272108 - protein, 18 aa, Plasmodium falciparum
NTLTTLFITHIFKSLFLF

SEQ ID NO: 3272109 - protein, 21 aa, Plasmodium falciparum
NTLVEKICHLSHHLRKHPYVN

SEQ ID NO: 3272110 - protein, 26 aa, Plasmodium falciparum
NTMNLCVYEILYVCFEKKIETLTIPI

SEQ ID NO: 3272111 - protein, 18 aa, Plasmodium falciparum
NTNNVCLLQMFFSNLTKK

SEQ ID NO: 3272112 - protein, 29 aa, Plasmodium falciparum
NTNYLMNICPLFYSFMIFFNQLNSRKKLM

SEQ ID NO: 3272113 - protein, 17 aa, Plasmodium falciparum
NTPKIMPHHIIINNKTE

SEQ ID NO: 3272114 - protein, 22 aa, Plasmodium falciparum
NTPPECWDLFLKYESLNVEDPL

SEQ ID NO: 3272115 - protein, 36 aa, Plasmodium falciparum
NTQLLGSCPYCKHAFNFFTRTCNICQRYVHICYYLF

SEQ ID NO: 3272116 - protein, 24 aa, Plasmodium falciparum
NTRESVLRMSLRKKGNFKRTASVT

SEQ ID NO: 3272117 - protein, 30 aa, Plasmodium falciparum
NTRKECTSEMYFLKNICKKFGIHFKSKKLT

SEQ ID NO: 3272118 - protein, 23 aa, Plasmodium falciparum
NTRRKGFLSFNWIGYKNGETNKN

SEQ ID NO: 3272119 - protein, 22 aa, Plasmodium falciparum
NTSFFEKWVHSINTNSMPIRTK

SEQ ID NO: 3272120 - protein, 25 aa, Plasmodium falciparum
NTSPTWYAAHPFRRICHNGEINTIS

SEQ ID NO: 3272121 - protein, 19 aa, Plasmodium falciparum
NTSSCSYCNYRIKNVNCLT

SEQ ID NO: 3272122 - protein, 17 aa, Plasmodium falciparum
NTSSILYPQAHNSVSSN

SEQ ID NO: 3272123 - protein, 22 aa, Plasmodium falciparum
NTSTRVGNCFMIYDKNIKLNKI

SEQ ID NO: 3272124 - protein, 25 aa, Plasmodium falciparum
NTSVYKIKILSSLALIHIPLYYNIQ

SEQ ID NO: 3272125 - protein, 24 aa, Plasmodium falciparum
NTTECANCINNIFKNNKLTPKQET

SEQ ID NO: 3272126 - protein, 32 aa, Plasmodium falciparum
NTTLLLRIFYIMCFQKSFYINTAMHYKTNEKY

SEQ ID NO: 3272127 - protein, 24 aa, Plasmodium falciparum
NTTTCSFYSPYLIYLGNNTTNYMN

SEQ ID NO: 3272128 - protein, 24 aa, Plasmodium falciparum
NTVKNFSFILCSKLKDSNKQVSNA

SEQ ID NO: 3272129 - protein, 27 aa, Plasmodium falciparum
NTYFNMYMKYHHEWILNKKEIIMKDDK

SEQ ID NO: 3272130 - protein, 20 aa, Plasmodium falciparum
NTYIKKWKKYNLKKKIAKKN

SEQ ID NO: 3272131 - protein, 24 aa, Plasmodium falciparum
NTYIRKIKKGFYFLYDVIYNNVEI

SEQ ID NO: 3272132 - protein, 19 aa, Plasmodium falciparum
NTYKSLSFLPKKMVVGQIV

SEQ ID NO: 3272133 - protein, 21 aa, Plasmodium falciparum
NTYLCRNCVLLYQNDFSYNTY

SEQ ID NO: 3272134 - protein, 22 aa, Plasmodium falciparum
NTYNYFPLLIINNIYNKKQFKN

SEQ ID NO: 3272135 - protein, 20 aa, Plasmodium falciparum
NTYRIKYILYLFSYTYCNFI

SEQ ID NO: 3272136 - protein, 17 aa, Plasmodium falciparum
NTYRQTYNYLYKHYNYR

SEQ ID NO: 3272137 - protein, 23 aa, Plasmodium falciparum
NTYVNFCACPTKLNQYNSSNNNR

SEQ ID NO: 3272138 - protein, 25 aa, Plasmodium falciparum
NTYVQLTVGFLLEYLYGTYVVFLVY

SEQ ID NO: 3272139 - protein, 17 aa, Plasmodium falciparum
NTYYIYILFILCVIQIK

SEQ ID NO: 3272140 - protein, 20 aa, Plasmodium falciparum
NVCDEIYEDLFLIYNKNIQV

SEQ ID NO: 3272141 - protein, 18 aa, Plasmodium falciparum
NVCHTIILCVKRCIQISD

SEQ ID NO: 3272142 - protein, 27 aa, Plasmodium falciparum
NVCIKKELYKYFFLVLRKYNKKKYYKM

SEQ ID NO: 3272143 - protein, 18 aa, Plasmodium falciparum
NVCKREEFIKSYKIKEFF

SEQ ID NO: 3272144 - protein, 21 aa, Plasmodium falciparum
NVCLLKGTFLIELLECINVQI

SEQ ID NO: 3272145 - protein, 30 aa, Plasmodium falciparum
NVDMYKCSFNIYKPICWYKQKEMYHKKKIV

SEQ ID NO: 3272146 - protein, 25 aa, Plasmodium falciparum
NVEDFKKKCRIFINQFVCNYKKYGH

SEQ ID NO: 3272147 - protein, 25 aa, Plasmodium falciparum
NVEGLFSIRPSRSLTERKQRNNGKP

SEQ ID NO: 3272148 - protein, 19 aa, Plasmodium falciparum
NVEHNFTWFDFHSEFKKLN

SEQ ID NO: 3272149 - protein, 25 aa, Plasmodium falciparum
NVEKSFRILFRLLKVNNCKDPVFLF

SEQ ID NO: 3272150 - protein, 17 aa, Plasmodium falciparum
NVERFRAILPFIINLCL

SEQ ID NO: 3272151 - protein, 25 aa, Plasmodium falciparum
NVEVRRRVLFLFSEFLYINSKYYYK

SEQ ID NO: 3272152 - protein, 18 aa, Plasmodium falciparum
NVEYCFIFDINILSDILY

SEQ ID NO: 3272153 - protein, 24 aa, Plasmodium falciparum
NVFKKKWTELFPHTFDTKYINETN

SEQ ID NO: 3272154 - protein, 23 aa, Plasmodium falciparum
NVFKNMWNKFLSLKGISKLRGIF

SEQ ID NO: 3272155 - protein, 19 aa, Plasmodium falciparum
NVFPKQFRHHPSFYELVNK

SEQ ID NO: 3272156 - protein, 20 aa, Plasmodium falciparum
NVFYKFKYSLLRYTTSKQSV

SEQ ID NO: 3272157 - protein, 19 aa, Plasmodium falciparum
NVFYLCIHVSIFIILINPF

SEQ ID NO: 3272158 - protein, 29 aa, Plasmodium falciparum
NVGIFKADLYIPLMSSITYILLYTLTITA

SEQ ID NO: 3272159 - protein, 28 aa, Plasmodium falciparum
NVGIPLGLLPNRTVLFLLNNIEQTIATK

SEQ ID NO: 3272160 - protein, 18 aa, Plasmodium falciparum
NVGVRIRHFISHMFDMVG

SEQ ID NO: 3272161 - protein, 18 aa, Plasmodium falciparum
NVGYTYDKIRLFKNNIYI

SEQ ID NO: 3272162 - protein, 26 aa, Plasmodium falciparum
NVHEGIIRKGAKWICSMNKAFHSRFF

SEQ ID NO: 3272163 - protein, 17 aa, Plasmodium falciparum
NVHEMHAKFTYPFLLNI

SEQ ID NO: 3272164 - protein, 30 aa, Plasmodium falciparum
NVHPYYKSIRIFPGRTFLPYYQNVKDKKKR

SEQ ID NO: 3272165 - protein, 25 aa, Plasmodium falciparum
NVICKNFFYTFCLNTEKIKTTNIPY

SEQ ID NO: 3272166 - protein, 19 aa, Plasmodium falciparum
NVIECFKKLCKTNISNNVI

SEQ ID NO: 3272167 - protein, 19 aa, Plasmodium falciparum
NVIEFSRYGVTNKCISILV

SEQ ID NO: 3272168 - protein, 18 aa, Plasmodium falciparum
NVIHLLKPGDFVFDEKYK

SEQ ID NO: 3272169 - protein, 18 aa, Plasmodium falciparum
NVIKECINIINKIIFLYN

SEQ ID NO: 3272170 - protein, 22 aa, Plasmodium falciparum
NVIKYKCLFFYDNKKSDWEIFN

SEQ ID NO: 3272171 - protein, 33 aa, Plasmodium falciparum
NVILFKGKYTRQLICDYLKFLLNSIQNEHTIKA

SEQ ID NO: 3272172 - protein, 26 aa, Plasmodium falciparum
NVILNCIYKYLRIHCYTLSKEEFFFF

SEQ ID NO: 3272173 - protein, 17 aa, Plasmodium falciparum
NVILTDRIHKFYVYTWM

SEQ ID NO: 3272174 - protein, 18 aa, Plasmodium falciparum
NVISELYATMSWAYAFVY

SEQ ID NO: 3272175 - protein, 25 aa, Plasmodium falciparum
NVITTWRSPFLIQAFLLLPIFLIMI

SEQ ID NO: 3272176 - protein, 19 aa, Plasmodium falciparum
NVKAAILYLMKSLKNGEDP

SEQ ID NO: 3272177 - protein, 17 aa, Plasmodium falciparum
NVKDIFWYLYIKSKFVK

SEQ ID NO: 3272178 - protein, 25 aa, Plasmodium falciparum
NVKFKEVEKIIAFKISILTFEKLIL

SEQ ID NO: 3272179 - protein, 18 aa, Plasmodium falciparum
NVKGRLNEWINEFDENNT

SEQ ID NO: 3272180 - protein, 22 aa, Plasmodium falciparum
NVKIKGGEGIIKEYHLKGYKRN

SEQ ID NO: 3272181 - protein, 22 aa, Plasmodium falciparum
NVKKKKACGYVRLNNEANVEKN

SEQ ID NO: 3272182 - protein, 20 aa, Plasmodium falciparum
NVKNCLKCKDYIELNNLINM

SEQ ID NO: 3272183 - protein, 21 aa, Plasmodium falciparum
NVKQKFKRLFIYSYRDDAKSN

SEQ ID NO: 3272184 - protein, 23 aa, Plasmodium falciparum
NVKYNNCCYFNITGVLNGFPKKI

SEQ ID NO: 3272185 - protein, 19 aa, Plasmodium falciparum
NVLEDFCKSEFLNRFNEFF

SEQ ID NO: 3272186 - protein, 29 aa, Plasmodium falciparum
NVLFFLRPYFYEIKNIFEIIDKIEKSKST

SEQ ID NO: 3272187 - protein, 40 aa, Plasmodium falciparum
NVLNIFFPLIIWGSFYWTYENFFIFPIFVIYAYHIYMFYH

SEQ ID NO: 3272188 - protein, 20 aa, Plasmodium falciparum
NVLNLCGRFNDINNMIKVIE

SEQ ID NO: 3272189 - protein, 22 aa, Plasmodium falciparum
NVLNSLHFIFFVSPVSLQVKQK

SEQ ID NO: 3272190 - protein, 24 aa, Plasmodium falciparum
NVLPIDVVLCIPRPKVLNKLLQQL

SEQ ID NO: 3272191 - protein, 24 aa, Plasmodium falciparum
NVLSKILFVYCFFEINNKKMNEML

SEQ ID NO: 3272192 - protein, 19 aa, Plasmodium falciparum
NVLVLKIYLNNIIGNFSNL

SEQ ID NO: 3272193 - protein, 18 aa, Plasmodium falciparum
NVMLKGWTFHDLLKIRTL

SEQ ID NO: 3272194 - protein, 28 aa, Plasmodium falciparum
NVMWKDIMERRMKWYAFRLKKDKTIFEW

SEQ ID NO: 3272195 - protein, 17 aa, Plasmodium falciparum
NVNGWKKSCEIIKRNDD

SEQ ID NO: 3272196 - protein, 18 aa, Plasmodium falciparum
NVNINDIRLIYQGQCLLN

SEQ ID NO: 3272197 - protein, 17 aa, Plasmodium falciparum
NVNVYLHNMELYGGIPY

SEQ ID NO: 3272198 - protein, 33 aa, Plasmodium falciparum
NVNYFRKEIQNEFSFRNGLYFSPTTVGEYNKLV

SEQ ID NO: 3272199 - protein, 26 aa, Plasmodium falciparum
NVPFFFEKLMSFSFLLCLDNILYDIT

SEQ ID NO: 3272200 - protein, 20 aa, Plasmodium falciparum
NVQEKLFWRFREMGNIPLTT

SEQ ID NO: 3272201 - protein, 24 aa, Plasmodium falciparum
NVSGDIRKALQICRKAFENKRGHK

SEQ ID NO: 3272202 - protein, 32 aa, Plasmodium falciparum
NVSSCELIKDCSYSVFFYNLFIKGLYLNKQNL

SEQ ID NO: 3272203 - protein, 24 aa, Plasmodium falciparum
NVSSCLPSVPFLGGPPVPGAGANK

SEQ ID NO: 3272204 - protein, 21 aa, Plasmodium falciparum
NVSTLRFLYSHMKSEHTNNTN

SEQ ID NO: 3272205 - protein, 18 aa, Plasmodium falciparum
NVSYLKKKSLIIDKDILS

SEQ ID NO: 3272206 - protein, 19 aa, Plasmodium falciparum
NVSYREGRGYMMADSCAYN

SEQ ID NO: 3272207 - protein, 22 aa, Plasmodium falciparum
NVVGCSYLKYYINSSSKALLIS

SEQ ID NO: 3272208 - protein, 25 aa, Plasmodium falciparum
NVVIYCLYKVLKFYKRKKYKCKKNY

SEQ ID NO: 3272209 - protein, 24 aa, Plasmodium falciparum
NVVVYKNNCDLIIQHIINKIKYYL

SEQ ID NO: 3272210 - protein, 27 aa, Plasmodium falciparum
NVYFKLKIFLYKEFIIKKVLMLKNVQC

SEQ ID NO: 3272211 - protein, 25 aa, Plasmodium falciparum
NVYHNKDYRYCFSTSQQNDGKYLEQ

SEQ ID NO: 3272212 - protein, 20 aa, Plasmodium falciparum
NVYKLILFDFNKIFKKGEIW

SEQ ID NO: 3272213 - protein, 22 aa, Plasmodium falciparum
NVYLKITNVFTIIMNILNSKVY

SEQ ID NO: 3272214 - protein, 28 aa, Plasmodium falciparum
NVYLKIYFKELFIKFKIIQHNNTCSYIF

SEQ ID NO: 3272215 - protein, 28 aa, Plasmodium falciparum
NVYMKKRFVKILCIDLILKRKSQEDLDI

SEQ ID NO: 3272216 - protein, 32 aa, Plasmodium falciparum
NVYNCGTVCRFILPLLCLYICKQNIKAQEENK

SEQ ID NO: 3272217 - protein, 20 aa, Plasmodium falciparum
NVYNNYIHRFFLSLNKCENA

SEQ ID NO: 3272218 - protein, 23 aa, Plasmodium falciparum
NVYPHSLGYIFLPLYNKLSRSNT

SEQ ID NO: 3272219 - protein, 18 aa, Plasmodium falciparum
NVYSMRKLFKIALEGSEE

SEQ ID NO: 3272220 - protein, 21 aa, Plasmodium falciparum
NVYYKSFFSLMNMQYRDYLLR

SEQ ID NO: 3272221 - protein, 19 aa, Plasmodium falciparum
NWCNSLLLRKDYYRKLIKA

SEQ ID NO: 3272222 - protein, 20 aa, Plasmodium falciparum
NWESFAFKYINIFRMKEMKY

SEQ ID NO: 3272223 - protein, 23 aa, Plasmodium falciparum
NWFKKEITHNIFAYQKMDYFYDF

SEQ ID NO: 3272224 - protein, 24 aa, Plasmodium falciparum
NYAILLCIYIIIWILLTLYCLFNK

SEQ ID NO: 3272225 - protein, 23 aa, Plasmodium falciparum
NYCKEALLNYNLFHKKNYVSIMS

SEQ ID NO: 3272226 - protein, 27 aa, Plasmodium falciparum
NYCYRNEKFHSSRHLNEFMSLDIEKVI

SEQ ID NO: 3272227 - protein, 23 aa, Plasmodium falciparum
NYDDFFPLFIIKILNKKKIKQIY

SEQ ID NO: 3272228 - protein, 26 aa, Plasmodium falciparum
NYDDLRFLFNVSNIFICDNICQVEEK

SEQ ID NO: 3272229 - protein, 25 aa, Plasmodium falciparum
NYDIMYRNNISIFLKRRNNFHTLNK

SEQ ID NO: 3272230 - protein, 24 aa, Plasmodium falciparum
NYDISKLNFFRVYDFDFLNNDTLI

SEQ ID NO: 3272231 - protein, 18 aa, Plasmodium falciparum
NYEGAKCHIRESVEYFVQ

SEQ ID NO: 3272232 - protein, 25 aa, Plasmodium falciparum
NYEKCYIVILYLPIRKLIDTFHTLN

SEQ ID NO: 3272233 - protein, 25 aa, Plasmodium falciparum
NYEKNECVELFKLHLLEEVLIEDAE

SEQ ID NO: 3272234 - protein, 18 aa, Plasmodium falciparum
NYENFLLLIYNKVLHLYF

SEQ ID NO: 3272235 - protein, 29 aa, Plasmodium falciparum
NYENWSAHYFLKLPIFVILMIVFSLNAFI

SEQ ID NO: 3272236 - protein, 18 aa, Plasmodium falciparum
NYFFTHFNEFLLIDDLLV

SEQ ID NO: 3272237 - protein, 23 aa, Plasmodium falciparum
NYFHTIHKGLLLGVFTFIGNLGF

SEQ ID NO: 3272238 - protein, 27 aa, Plasmodium falciparum
NYFILAPCCHHRCEVKKIVGYKYLKEL

SEQ ID NO: 3272239 - protein, 18 aa, Plasmodium falciparum
NYFKCIPMKDMNCSKNNG

SEQ ID NO: 3272240 - protein, 24 aa, Plasmodium falciparum
NYFLHCSSLYAFKFSDVQINSAYN

SEQ ID NO: 3272241 - protein, 20 aa, Plasmodium falciparum
NYFLYFLIVILTASLIFFIM

SEQ ID NO: 3272242 - protein, 24 aa, Plasmodium falciparum
NYFMKANVSFTISHRIIKRKYDYR

SEQ ID NO: 3272243 - protein, 23 aa, Plasmodium falciparum
NYFMYSCIFYKNKIIYVDMLFSK

SEQ ID NO: 3272244 - protein, 18 aa, Plasmodium falciparum
NYFQLREDWWTANRATVW

SEQ ID NO: 3272245 - protein, 24 aa, Plasmodium falciparum
NYFSCMKIFYVMGISELYFPVTFS

SEQ ID NO: 3272246 - protein, 19 aa, Plasmodium falciparum
NYFSFFKNIYIHPFKNKNQ

SEQ ID NO: 3272247 - protein, 23 aa, Plasmodium falciparum
NYFSRINGILSLFFNSLYYINSF

SEQ ID NO: 3272248 - protein, 19 aa, Plasmodium falciparum
NYFYLKYIICGTNYDIKEM

SEQ ID NO: 3272249 - protein, 25 aa, Plasmodium falciparum
NYGELYRLFWSMYLHGGFMHILFNV

SEQ ID NO: 3272250 - protein, 45 aa, Plasmodium falciparum
NYGFVMKDFLIFHVKLLKNLLIKGLKLGYWKSIDYDYIEKHVDNS

SEQ ID NO: 3272251 - protein, 17 aa, Plasmodium falciparum
NYGKYSFIFKGLYEQFL

SEQ ID NO: 3272252 - protein, 17 aa, Plasmodium falciparum
NYGPFDFTRKFKERHVS

SEQ ID NO: 3272253 - protein, 24 aa, Plasmodium falciparum
NYGTCSFIYFMFIKQISYSLNMMN

SEQ ID NO: 3272254 - protein, 19 aa, Plasmodium falciparum
NYGWKCIPTSGGDKTATSE

SEQ ID NO: 3272255 - protein, 18 aa, Plasmodium falciparum
NYHILKNHLENFAERHPF

SEQ ID NO: 3272256 - protein, 26 aa, Plasmodium falciparum
NYHTSKFFFNESMKFPLYTESLRLYK

SEQ ID NO: 3272257 - protein, 23 aa, Plasmodium falciparum
NYHWRPFLNHAPSQIKNEITIST

SEQ ID NO: 3272258 - protein, 20 aa, Plasmodium falciparum
NYHYWSFPQMDDFINKYGYL

SEQ ID NO: 3272259 - protein, 31 aa, Plasmodium falciparum
NYIFFLDLKKIFYFLIIFLIYLYIRAKLEFL

SEQ ID NO: 3272260 - protein, 37 aa, Plasmodium falciparum
NYIFKNLNLFIILLKGANYALRYLFRENFESDLNSTS

SEQ ID NO: 3272261 - protein, 19 aa, Plasmodium falciparum
NYIGCLHPIINVEATKKCS

SEQ ID NO: 3272262 - protein, 27 aa, Plasmodium falciparum
NYIGYRCLIVSLLIFYLIIQLSYDNFG

SEQ ID NO: 3272263 - protein, 17 aa, Plasmodium falciparum
NYIKEYILHLLKKKQSE

SEQ ID NO: 3272264 - protein, 21 aa, Plasmodium falciparum
NYIKVCNVMNGCILFNDYHNY

SEQ ID NO: 3272265 - protein, 19 aa, Plasmodium falciparum
NYILIKFTPSTVLLKTIGL

SEQ ID NO: 3272266 - protein, 24 aa, Plasmodium falciparum
NYILRKVLKYDDFANICSRALDNI

SEQ ID NO: 3272267 - protein, 20 aa, Plasmodium falciparum
NYILSFPLIPLFYPHHKPPL

SEQ ID NO: 3272268 - protein, 19 aa, Plasmodium falciparum
NYINEEWFKQVLKLYKQHY

SEQ ID NO: 3272269 - protein, 25 aa, Plasmodium falciparum
NYINNMCLFLIYKIIIMNEDDAEYP

SEQ ID NO: 3272270 - protein, 23 aa, Plasmodium falciparum
NYIYESYFYKFYCTNDNMNIYVS

SEQ ID NO: 3272271 - protein, 18 aa, Plasmodium falciparum
NYIYHIIDTYSLISNIYV

SEQ ID NO: 3272272 - protein, 23 aa, Plasmodium falciparum
NYIYYYINMCILLNENLNTLKEC

SEQ ID NO: 3272273 - protein, 22 aa, Plasmodium falciparum
NYKCIYIVLFYFTIKLIIILGN

SEQ ID NO: 3272274 - protein, 25 aa, Plasmodium falciparum
NYKEIFKIGITYTFFFLTIIIIIDS

SEQ ID NO: 3272275 - protein, 23 aa, Plasmodium falciparum
NYKELIKNYFLYNKYFYINDLFQ

SEQ ID NO: 3272276 - protein, 17 aa, Plasmodium falciparum
NYKELSSQILLKVAGKN

SEQ ID NO: 3272277 - protein, 24 aa, Plasmodium falciparum
NYKISKKKSILCIKDINRLNKSQQ

SEQ ID NO: 3272278 - protein, 20 aa, Plasmodium falciparum
NYKKIISYILKYGKNFEIKK

SEQ ID NO: 3272279 - protein, 22 aa, Plasmodium falciparum
NYKKSRLMLEMIDKYNTHFVQT

SEQ ID NO: 3272280 - protein, 18 aa, Plasmodium falciparum
NYKLIAWIQIHMMILERL

SEQ ID NO: 3272281 - protein, 22 aa, Plasmodium falciparum
NYKMCKSKIFSNRFTMKEYDPK

SEQ ID NO: 3272282 - protein, 22 aa, Plasmodium falciparum
NYKMIYNIISLFIINPKNKIHG

SEQ ID NO: 3272283 - protein, 21 aa, Plasmodium falciparum
NYKMKNCRNKNELNIHSEKQC

SEQ ID NO: 3272284 - protein, 26 aa, Plasmodium falciparum
NYKRYGMLPPNFKKYFTLSEECLKNI

SEQ ID NO: 3272285 - protein, 22 aa, Plasmodium falciparum
NYKSKFSGCPAHFHNINYNLCD

SEQ ID NO: 3272286 - protein, 25 aa, Plasmodium falciparum
NYKSPEIPLAINIQYMQIDKFTLIV

SEQ ID NO: 3272287 - protein, 18 aa, Plasmodium falciparum
NYKTFNFYNYFINTIHIQ

SEQ ID NO: 3272288 - protein, 25 aa, Plasmodium falciparum
NYLDIDLFLAFSIFTMLSENHIKSI

SEQ ID NO: 3272289 - protein, 20 aa, Plasmodium falciparum
NYLDREIKLRIENINSNYKT

SEQ ID NO: 3272290 - protein, 17 aa, Plasmodium falciparum
NYLEEINLLNAKSVDVE

SEQ ID NO: 3272291 - protein, 23 aa, Plasmodium falciparum
NYLFFCSFCFILYNYDLTNCVRC

SEQ ID NO: 3272292 - protein, 23 aa, Plasmodium falciparum
NYLFYELYNNMSIDIENVEIILE

SEQ ID NO: 3272293 - protein, 24 aa, Plasmodium falciparum
NYLGCKRKGLFFFYNTYKDPGLMK

SEQ ID NO: 3272294 - protein, 18 aa, Plasmodium falciparum
NYLKEKFIKLDNVTNILD

SEQ ID NO: 3272295 - protein, 20 aa, Plasmodium falciparum
NYLKICKNIFVVPNEYKNNQ

SEQ ID NO: 3272296 - protein, 18 aa, Plasmodium falciparum
NYLLYFKILNSCKLYLYL

SEQ ID NO: 3272297 - protein, 18 aa, Plasmodium falciparum
NYLNCLFNVYDINIKSLI

SEQ ID NO: 3272298 - protein, 20 aa, Plasmodium falciparum
NYLPNCTIVNLSHKITTVNK

SEQ ID NO: 3272299 - protein, 18 aa, Plasmodium falciparum
NYLQINFMKTFDQLSEEI

SEQ ID NO: 3272300 - protein, 17 aa, Plasmodium falciparum
NYLRKIKNIEAFMEYVL

SEQ ID NO: 3272301 - protein, 18 aa, Plasmodium falciparum
NYLSINAIHRIHRGDDTN

SEQ ID NO: 3272302 - protein, 17 aa, Plasmodium falciparum
NYLSNIILLTIYVETSM

SEQ ID NO: 3272303 - protein, 19 aa, Plasmodium falciparum
NYLTCIAYVKMIYIIIVCI

SEQ ID NO: 3272304 - protein, 25 aa, Plasmodium falciparum
NYLTWKKCLYYIYKIKKYTRKIETH

SEQ ID NO: 3272305 - protein, 18 aa, Plasmodium falciparum
NYLYYIFDNICKIKLNII

SEQ ID NO: 3272306 - protein, 21 aa, Plasmodium falciparum
NYMFGRPPFLIPQNVADSPST

SEQ ID NO: 3272307 - protein, 27 aa, Plasmodium falciparum
NYMPKEIKRQICNKMCSHKEYNMDNSM

SEQ ID NO: 3272308 - protein, 29 aa, Plasmodium falciparum
NYMQNLIICISLFYSIYICLEKLCKKEYN

SEQ ID NO: 3272309 - protein, 25 aa, Plasmodium falciparum
NYMTYDIITYFQLKKTFLLDMCEHV

SEQ ID NO: 3272310 - protein, 24 aa, Plasmodium falciparum
NYNEEYIMFLLINYIISIQFLYIT

SEQ ID NO: 3272311 - protein, 23 aa, Plasmodium falciparum
NYNFITARFRYKKNFEISMLQKS

SEQ ID NO: 3272312 - protein, 20 aa, Plasmodium falciparum
NYNHSLECYSYYFDELKNDQ

SEQ ID NO: 3272313 - protein, 21 aa, Plasmodium falciparum
NYNIIKSCVILKINFIIILSY

SEQ ID NO: 3272314 - protein, 22 aa, Plasmodium falciparum
NYNIKGSTFVKIGHVNYNINSF

SEQ ID NO: 3272315 - protein, 21 aa, Plasmodium falciparum
NYNILKFFYILPEQVRKKYIS

SEQ ID NO: 3272316 - protein, 24 aa, Plasmodium falciparum
NYNISAFIQYMSKKVCNYLFDEHH

SEQ ID NO: 3272317 - protein, 18 aa, Plasmodium falciparum
NYNKGAFPNKFEKNDNYI

SEQ ID NO: 3272318 - protein, 22 aa, Plasmodium falciparum
NYNKKLYLIIDIIDSIDGTYYY

SEQ ID NO: 3272319 - protein, 24 aa, Plasmodium falciparum
NYNLKTWLSRCLIIAQTIILVYTY

SEQ ID NO: 3272320 - protein, 26 aa, Plasmodium falciparum
NYNLPCCIHSILLFIKYYKIEMRDKN

SEQ ID NO: 3272321 - protein, 19 aa, Plasmodium falciparum
NYNMFEWNNNLDIYDPFLF

SEQ ID NO: 3272322 - protein, 23 aa, Plasmodium falciparum
NYNMNSCSMNNYNVSNNNMYNYN

SEQ ID NO: 3272323 - protein, 26 aa, Plasmodium falciparum
NYNPIKCMFFYFLSIISHKPSMNRDT

SEQ ID NO: 3272324 - protein, 26 aa, Plasmodium falciparum
NYNTLILKRFFICFEKEKNVNNNDNI

SEQ ID NO: 3272325 - protein, 17 aa, Plasmodium falciparum
NYPFICGKVDITKESTI

SEQ ID NO: 3272326 - protein, 28 aa, Plasmodium falciparum
NYPIIKEFILLLIFLFQRIRAENEYKNV

SEQ ID NO: 3272327 - protein, 24 aa, Plasmodium falciparum
NYPKIYLSKVGFARLCTEEYKKKK

SEQ ID NO: 3272328 - protein, 21 aa, Plasmodium falciparum
NYPKPRRVIGLIKDDNVQGGN

SEQ ID NO: 3272329 - protein, 25 aa, Plasmodium falciparum
NYPNKRFFRILKFRCISYVIHILIF

SEQ ID NO: 3272330 - protein, 25 aa, Plasmodium falciparum
NYPTNHIYKSYSFRCDTLNCDTKYS

SEQ ID NO: 3272331 - protein, 24 aa, Plasmodium falciparum
NYQFNFEKCISYFSPEWGYYIYTT

SEQ ID NO: 3272332 - protein, 19 aa, Plasmodium falciparum
NYQNCKNFELKNVSNVEIE

SEQ ID NO: 3272333 - protein, 22 aa, Plasmodium falciparum
NYQPKSSYSIHIINSYIQHESY

SEQ ID NO: 3272334 - protein, 18 aa, Plasmodium falciparum
NYQSESNMNISIKKYRKN

SEQ ID NO: 3272335 - protein, 21 aa, Plasmodium falciparum
NYRKKVTIARKWKNLHCLLPM

SEQ ID NO: 3272336 - protein, 20 aa, Plasmodium falciparum
NYRLPFVNLENFKLYIDDIV

SEQ ID NO: 3272337 - protein, 26 aa, Plasmodium falciparum
NYRTLSCLEKLFIHGFKHVENNRETE

SEQ ID NO: 3272338 - protein, 22 aa, Plasmodium falciparum
NYRYKPPILLGSCIISLKSVTE

SEQ ID NO: 3272339 - protein, 21 aa, Plasmodium falciparum
NYSDFYKKCSILIDNMSVSKI

SEQ ID NO: 3272340 - protein, 24 aa, Plasmodium falciparum
NYSEECHRILKLLIDEEETIIHQR

SEQ ID NO: 3272341 - protein, 24 aa, Plasmodium falciparum
NYSEYSFNISFIYYILSNKKRKQF

SEQ ID NO: 3272342 - protein, 29 aa, Plasmodium falciparum
NYSFVYNFSFEWINCMKLKNEYITKEDCV

SEQ ID NO: 3272343 - protein, 26 aa, Plasmodium falciparum
NYSIKLCFLKMNFFFHNSLSLVKYPE

SEQ ID NO: 3272344 - protein, 17 aa, Plasmodium falciparum
NYSIYFNTFYKLKIINN

SEQ ID NO: 3272345 - protein, 18 aa, Plasmodium falciparum
NYSKCIYYIKIFINKGIF

SEQ ID NO: 3272346 - protein, 24 aa, Plasmodium falciparum
NYSLSSPFLWLLLLIKNRNLKTFC

SEQ ID NO: 3272347 - protein, 25 aa, Plasmodium falciparum
NYSLYWSPQLVKSYFGNVDHKKKCN

SEQ ID NO: 3272348 - protein, 25 aa, Plasmodium falciparum
NYSSAECFLILKSSTPITLIVLYFY

SEQ ID NO: 3272349 - protein, 19 aa, Plasmodium falciparum
NYSSCFRVENRESVIMTSF

SEQ ID NO: 3272350 - protein, 17 aa, Plasmodium falciparum
NYTEFMSLNSYDFNYIK

SEQ ID NO: 3272351 - protein, 19 aa, Plasmodium falciparum
NYTPIYNLFHFVIQRDYFF

SEQ ID NO: 3272352 - protein, 33 aa, Plasmodium falciparum
NYTTYVFCLAFALLIILTLMLIYKKIRDVEKKH

SEQ ID NO: 3272353 - protein, 21 aa, Plasmodium falciparum
NYVFHSTFFIINWKHGEMERE

SEQ ID NO: 3272354 - protein, 25 aa, Plasmodium falciparum
NYVICKNCNMVAHGSCCFPNVPDIY

SEQ ID NO: 3272355 - protein, 33 aa, Plasmodium falciparum
NYVLRVPRVLFLASRKSFSSSFDRSLFHIYNIM

SEQ ID NO: 3272356 - protein, 23 aa, Plasmodium falciparum
NYVQFLLILGFIIQFLSGSIGSV

SEQ ID NO: 3272357 - protein, 19 aa, Plasmodium falciparum
NYVSFDFLNYLLSNTLIFI

SEQ ID NO: 3272358 - protein, 18 aa, Plasmodium falciparum
NYVSTIFGRVQFLYKNKL

SEQ ID NO: 3272359 - protein, 29 aa, Plasmodium falciparum
NYVSVVYLKYVIRFVSIIFCNCANVNYYN

SEQ ID NO: 3272360 - protein, 23 aa, Plasmodium falciparum
NYVYGYPLFCIKKKNSNNENITT

SEQ ID NO: 3272361 - protein, 25 aa, Plasmodium falciparum
NYYCTYKFSKKYSFLSSLVKNKDLH

SEQ ID NO: 3272362 - protein, 22 aa, Plasmodium falciparum
NYYDHLVCLSNINYSLNKSNII

SEQ ID NO: 3272363 - protein, 19 aa, Plasmodium falciparum
NYYDICNDYNLLLEGNFYL

SEQ ID NO: 3272364 - protein, 29 aa, Plasmodium falciparum
NYYFPTNFLHKFLDTFLLKKDNAYIMTEQ

SEQ ID NO: 3272365 - protein, 25 aa, Plasmodium falciparum
NYYHFNFYQIFILLLQISMISLFLF

SEQ ID NO: 3272366 - protein, 18 aa, Plasmodium falciparum
NYYISRFIYFLKQKLNLL

SEQ ID NO: 3272367 - protein, 21 aa, Plasmodium falciparum
NYYKCLEKCHKKDEFYNDSEK

SEQ ID NO: 3272368 - protein, 24 aa, Plasmodium falciparum
NYYKDEIFIVYDITKWTENCMNTT

SEQ ID NO: 3272369 - protein, 20 aa, Plasmodium falciparum
NYYKMGVKYIYDRKKDYFNL

SEQ ID NO: 3272370 - protein, 31 aa, Plasmodium falciparum
NYYKSKRGFFKNIFKKVFKRKKGKEGDEGEG

SEQ ID NO: 3272371 - protein, 17 aa, Plasmodium falciparum
NYYKWTQWIIIQLFLNN

SEQ ID NO: 3272372 - protein, 24 aa, Plasmodium falciparum
NYYKYPIYPIWVISSSNHYTVLFS

SEQ ID NO: 3272373 - protein, 19 aa, Plasmodium falciparum
NYYLHVIRYISSIQNKYDS

SEQ ID NO: 3272374 - protein, 26 aa, Plasmodium falciparum
NYYLLLRLLLPLLFSASLDHYILLSK

SEQ ID NO: 3272375 - protein, 17 aa, Plasmodium falciparum
NYYNLALEYFLDKNTND

SEQ ID NO: 3272376 - protein, 18 aa, Plasmodium falciparum
NYYPLPYDIRNSANRTNL

SEQ ID NO: 3272377 - protein, 19 aa, Plasmodium falciparum
NYYQLREDWWYANRRQVWK

SEQ ID NO: 3272378 - protein, 26 aa, Plasmodium falciparum
NYYRNRIKKNILQQWKMKKKKKKKKR

SEQ ID NO: 3272379 - protein, 28 aa, Plasmodium falciparum
NYYSILEICILKGINKVANFFINKKEYL

SEQ ID NO: 3272380 - protein, 23 aa, Plasmodium falciparum
NYYYDQKCCDLKKEKNTLYSSNP

SEQ ID NO: 3272381 - protein, 17 aa, Plasmodium falciparum
PAIAGGCSCNRSLMIFI

SEQ ID NO: 3272382 - protein, 26 aa, Plasmodium falciparum
PAIISPRSSFLFFVEYDKNDDHELGD

SEQ ID NO: 3272383 - protein, 20 aa, Plasmodium falciparum
PAITRPGRFDRIVNISKPDI

SEQ ID NO: 3272384 - protein, 20 aa, Plasmodium falciparum
PAKDCKPCSQFRVKSEKCNC

SEQ ID NO: 3272385 - protein, 25 aa, Plasmodium falciparum
PALVRGKVVGICFQSYKVSNNISYI

SEQ ID NO: 3272386 - protein, 20 aa, Plasmodium falciparum
PAPRIPKDEFKRCSNDENID

SEQ ID NO: 3272387 - protein, 20 aa, Plasmodium falciparum
PATDCKPCSLNELKCNSDVC

SEQ ID NO: 3272388 - protein, 25 aa, Plasmodium falciparum
PATNCKPCSQFKIYCKNCKSSGDDT

SEQ ID NO: 3272389 - protein, 22 aa, Plasmodium falciparum
PAWGLISCIGYVGWSQYVAAKI

SEQ ID NO: 3272390 - protein, 25 aa, Plasmodium falciparum
PAYELSYSLLDLFLHECSFNEKDIF

SEQ ID NO: 3272391 - protein, 25 aa, Plasmodium falciparum
PAYFRWLEEWGDGFCRERKKRLAQI

SEQ ID NO: 3272392 - protein, 22 aa, Plasmodium falciparum
PCCPLCRNPIENVYKISYEDDE

SEQ ID NO: 3272393 - protein, 20 aa, Plasmodium falciparum
PCDCFQRWVQQKETEWGKIK

SEQ ID NO: 3272394 - protein, 17 aa, Plasmodium falciparum
PCDGGECSDWETWVECK

SEQ ID NO: 3272395 - protein, 18 aa, Plasmodium falciparum
PCERGFFKTIIGDFSCES

SEQ ID NO: 3272396 - protein, 17 aa, Plasmodium falciparum
PCGSANIFKGIRKDVWK

SEQ ID NO: 3272397 - protein, 20 aa, Plasmodium falciparum
PCGSLDAFESFCGLNGDENS

SEQ ID NO: 3272398 - protein, 20 aa, Plasmodium falciparum
PCIFHCYPNSYSLVQGSRSE

SEQ ID NO: 3272399 - protein, 20 aa, Plasmodium falciparum
PCKGLENFEKSCGLHGDANE

SEQ ID NO: 3272400 - protein, 20 aa, Plasmodium falciparum
PCKTFDDFKSFCGLNGAESS

SEQ ID NO: 3272401 - protein, 25 aa, Plasmodium falciparum
PCNIQKNIFKWILLFYQIQTNQNSF

SEQ ID NO: 3272402 - protein, 20 aa, Plasmodium falciparum
PCNNESYNLHINKRSTNEPL

SEQ ID NO: 3272403 - protein, 21 aa, Plasmodium falciparum
PCNQGVCYKNLVSLKEDEKWK

SEQ ID NO: 3272404 - protein, 37 aa, Plasmodium falciparum
PCSDPLCASPFSLVFSIFLCLISIFLTSFGGILREIF

SEQ ID NO: 3272405 - protein, 19 aa, Plasmodium falciparum
PCSLNELKCNSDVCGGNTK

SEQ ID NO: 3272406 - protein, 23 aa, Plasmodium falciparum
PCSSFKIDCRNGKCKSGDTKGKC

SEQ ID NO: 3272407 - protein, 25 aa, Plasmodium falciparum
PCSVTCNMGYHFSKRDSLGYIKNSK

SEQ ID NO: 3272408 - protein, 17 aa, Plasmodium falciparum
PCTELGEKVEPRFSDTL

SEQ ID NO: 3272409 - protein, 21 aa, Plasmodium falciparum
PCTSLDKFKASLKCNSTENSE

SEQ ID NO: 3272410 - protein, 17 aa, Plasmodium falciparum
PCYDKNILVELINGEHN

SEQ ID NO: 3272411 - protein, 19 aa, Plasmodium falciparum
PCYFKDIYNSESWKKSLHI

SEQ ID NO: 3272412 - protein, 17 aa, Plasmodium falciparum
PDCVPLMKYYNKYVTTD

SEQ ID NO: 3272413 - protein, 20 aa, Plasmodium falciparum
PDDFEYYNTLYILKNQIYQY

SEQ ID NO: 3272414 - protein, 18 aa, Plasmodium falciparum
PDDFKFILKKLLHMEHRR

SEQ ID NO: 3272415 - protein, 22 aa, Plasmodium falciparum
PDDFKRQMFYTFGDYKDILFGK

SEQ ID NO: 3272416 - protein, 24 aa, Plasmodium falciparum
PDDFKRQMFYTFGDYRDFLFGTDI

SEQ ID NO: 3272417 - protein, 23 aa, Plasmodium falciparum
PDDFLRQMFYTFGDYRDIFFGNN

SEQ ID NO: 3272418 - protein, 21 aa, Plasmodium falciparum
PDDFLRQMFYTLGDYRDILVR

SEQ ID NO: 3272419 - protein, 25 aa, Plasmodium falciparum
PDDSLHLLGSYGFVKGLPYGNLGLS

SEQ ID NO: 3272420 - protein, 23 aa, Plasmodium falciparum
PDDYQLRLVIWKVNNAAMDDNST

SEQ ID NO: 3272421 - protein, 19 aa, Plasmodium falciparum
PDFLRQMFYTLGDYRDICI

SEQ ID NO: 3272422 - protein, 19 aa, Plasmodium falciparum
PDFLRQMFYTLGDYRDILF

SEQ ID NO: 3272423 - protein, 22 aa, Plasmodium falciparum
PDGFLRQMFYTLGDYRDILEGK

SEQ ID NO: 3272424 - protein, 22 aa, Plasmodium falciparum
PDGFLRQMFYTLGDYRDILYSG

SEQ ID NO: 3272425 - protein, 18 aa, Plasmodium falciparum
PDIKGRYEILKMYSNKIV

SEQ ID NO: 3272426 - protein, 33 aa, Plasmodium falciparum
PDINILKRAICIMCPYLSFDIYVSKNIYYVYFH

SEQ ID NO: 3272427 - protein, 20 aa, Plasmodium falciparum
PDIYESFNLLIRRKQKENNF

SEQ ID NO: 3272428 - protein, 32 aa, Plasmodium falciparum
PDIYSFVWLNLFISFLVFFLFNIKNVFFNDIN

SEQ ID NO: 3272429 - protein, 20 aa, Plasmodium falciparum
PDKKYYLLGEKIEFKCQEGY

SEQ ID NO: 3272430 - protein, 18 aa, Plasmodium falciparum
PDLENLYKSYINVEGCNF

SEQ ID NO: 3272431 - protein, 17 aa, Plasmodium falciparum
PDLLTPTSFLHKTYNTN

SEQ ID NO: 3272432 - protein, 22 aa, Plasmodium falciparum
PDLRSHFITLLVSRKQLIYIEY

SEQ ID NO: 3272433 - protein, 19 aa, Plasmodium falciparum
PDNIHMFFKYLKRNVYNSS

SEQ ID NO: 3272434 - protein, 17 aa, Plasmodium falciparum
PDNLQHWEVTKCGSTED

SEQ ID NO: 3272435 - protein, 21 aa, Plasmodium falciparum
PDPYIKIELAGQVIKTSTILH

SEQ ID NO: 3272436 - protein, 19 aa, Plasmodium falciparum
PDQLKYILHSCLHKNTHKR

SEQ ID NO: 3272437 - protein, 29 aa, Plasmodium falciparum
PDRLIPRCRSRLAFGRLVFSPYKGDEIEK

SEQ ID NO: 3272438 - protein, 24 aa, Plasmodium falciparum
PDRTVKAICPLAGDLQTVLDNELE

SEQ ID NO: 3272439 - protein, 18 aa, Plasmodium falciparum
PDTERSINIITDWINNIF

SEQ ID NO: 3272440 - protein, 24 aa, Plasmodium falciparum
PDVCGPPRRQQLCLGNLDKDEFKN

SEQ ID NO: 3272441 - protein, 23 aa, Plasmodium falciparum
PDVKPGGALSRGDWWEQHGKDIW

SEQ ID NO: 3272442 - protein, 24 aa, Plasmodium falciparum
PDYYKLREDWWIANRDQVWKAITC

SEQ ID NO: 3272443 - protein, 22 aa, Plasmodium falciparum
PEEFKRQMFYTLADYKDILFGD

SEQ ID NO: 3272444 - protein, 18 aa, Plasmodium falciparum
PEGLKYIIRKLLDYESRK

SEQ ID NO: 3272445 - protein, 21 aa, Plasmodium falciparum
PEHIRSMPYIEPSIIIKIKQL

SEQ ID NO: 3272446 - protein, 21 aa, Plasmodium falciparum
PEHMYKKAMQFFTTITDDISG

SEQ ID NO: 3272447 - protein, 19 aa, Plasmodium falciparum
PEIFDESEFKPSVFDPSEY

SEQ ID NO: 3272448 - protein, 20 aa, Plasmodium falciparum
PEINDILIYKRELIKKKKKE

SEQ ID NO: 3272449 - protein, 21 aa, Plasmodium falciparum
PEIYASSWFLTLFASKCNMRI

SEQ ID NO: 3272450 - protein, 26 aa, Plasmodium falciparum
PEKDMSEYRYPLNVFVLENPKYNLLN

SEQ ID NO: 3272451 - protein, 20 aa, Plasmodium falciparum
PEKLKTYFYHIVNKFKSDVF

SEQ ID NO: 3272452 - protein, 20 aa, Plasmodium falciparum
PEKNFLKFLDLRKKCVKGLL

SEQ ID NO: 3272453 - protein, 20 aa, Plasmodium falciparum
PEKRLSIIDCEERKYINDEL

SEQ ID NO: 3272454 - protein, 19 aa, Plasmodium falciparum
PELLKSIGTKIPYYDIARI

SEQ ID NO: 3272455 - protein, 22 aa, Plasmodium falciparum
PELVYLFWSSIQIIYWRTNIIL

SEQ ID NO: 3272456 - protein, 18 aa, Plasmodium falciparum
PELYWRKMNKYGEFDLRL

SEQ ID NO: 3272457 - protein, 21 aa, Plasmodium falciparum
PEMALKILLNDVFLQDMEKAQ

SEQ ID NO: 3272458 - protein, 17 aa, Plasmodium falciparum
PENGEIFDLSWSRDNEH

SEQ ID NO: 3272459 - protein, 17 aa, Plasmodium falciparum
PEPPLDVSEEYDKDFYF

SEQ ID NO: 3272460 - protein, 23 aa, Plasmodium falciparum
PERIENLYFTFAILLRSMCRLKS

SEQ ID NO: 3272461 - protein, 19 aa, Plasmodium falciparum
PERRLPPNINEQVEQELYN

SEQ ID NO: 3272462 - protein, 19 aa, Plasmodium falciparum
PEVKSPYFTLREKTFPQKY

SEQ ID NO: 3272463 - protein, 19 aa, Plasmodium falciparum
PEVRFSYTEGAECNKSKVK

SEQ ID NO: 3272464 - protein, 20 aa, Plasmodium falciparum
PEYYLSGFSKETKYVLNKNE

SEQ ID NO: 3272465 - protein, 18 aa, Plasmodium falciparum
PFASVEVGTNFKMLKRGI

SEQ ID NO: 3272466 - protein, 17 aa, Plasmodium falciparum
PFDIAIIDSIGWTLQYV

SEQ ID NO: 3272467 - protein, 24 aa, Plasmodium falciparum
PFDIKALHVLIHIFFIKKNKNWIP

SEQ ID NO: 3272468 - protein, 21 aa, Plasmodium falciparum
PFDKEIFGWTDVCKPKVIKCF

SEQ ID NO: 3272469 - protein, 19 aa, Plasmodium falciparum
PFDTNKCFVISKETNGLMK

SEQ ID NO: 3272470 - protein, 19 aa, Plasmodium falciparum
PFEEYYLNISLHVFITGLN

SEQ ID NO: 3272471 - protein, 24 aa, Plasmodium falciparum
PFERHKLYLKKAINHLLFIQKNIH

SEQ ID NO: 3272472 - protein, 19 aa, Plasmodium falciparum
PFERNRNAYVYTHTSTYEY

SEQ ID NO: 3272473 - protein, 19 aa, Plasmodium falciparum
PFFHIILLNMNKFIIPIIS

SEQ ID NO: 3272474 - protein, 24 aa, Plasmodium falciparum
PFFLRFFVARIFFKIIPYLEGLNY

SEQ ID NO: 3272475 - protein, 18 aa, Plasmodium falciparum
PFFPKISTGLDHYACVAY

SEQ ID NO: 3272476 - protein, 17 aa, Plasmodium falciparum
PFFPKNKIDDIIYVESK

SEQ ID NO: 3272477 - protein, 18 aa, Plasmodium falciparum
PFFQSYICTNFIKLGESF

SEQ ID NO: 3272478 - protein, 18 aa, Plasmodium falciparum
PFFSIKSKYLEKILLQEG

SEQ ID NO: 3272479 - protein, 19 aa, Plasmodium falciparum
PFIFFFLCIFFFILCTLIT

SEQ ID NO: 3272480 - protein, 17 aa, Plasmodium falciparum
PFIKFLVTNHIDLNVAH

SEQ ID NO: 3272481 - protein, 20 aa, Plasmodium falciparum
PFISNMYWFTFVMTLGLTFL

SEQ ID NO: 3272482 - protein, 20 aa, Plasmodium falciparum
PFISPKFWKKVEYIEKLEDL

SEQ ID NO: 3272483 - protein, 18 aa, Plasmodium falciparum
PFITICVIFICLYMIISI

SEQ ID NO: 3272484 - protein, 25 aa, Plasmodium falciparum
PFKLTREMIMLLTIKSQKKQYFIFS

SEQ ID NO: 3272485 - protein, 18 aa, Plasmodium falciparum
PFLFLSHLVVVFIGIDCF

SEQ ID NO: 3272486 - protein, 17 aa, Plasmodium falciparum
PFLMLPDLAKWTTSHFD

SEQ ID NO: 3272487 - protein, 19 aa, Plasmodium falciparum
PFLQRKMLESPFAVNTVRP

SEQ ID NO: 3272488 - protein, 26 aa, Plasmodium falciparum
PFLSKGRLHKGYLFMFEQTVKPYLDG

SEQ ID NO: 3272489 - protein, 22 aa, Plasmodium falciparum
PFLSSRFGKTIVYIMFTIIIAM

SEQ ID NO: 3272490 - protein, 19 aa, Plasmodium falciparum
PFLVIGVGVDDVFVILNSY

SEQ ID NO: 3272491 - protein, 17 aa, Plasmodium falciparum
PFMGDGRGYNFYNPHQH

SEQ ID NO: 3272492 - protein, 23 aa, Plasmodium falciparum
PFMLKISGILIRILTNKFIEQAK

SEQ ID NO: 3272493 - protein, 33 aa, Plasmodium falciparum
PFNEHIKNVILFKFYLRLVVSRIMLASKTLTLC

SEQ ID NO: 3272494 - protein, 19 aa, Plasmodium falciparum
PFNHYCSYQEKKQHYRILA

SEQ ID NO: 3272495 - protein, 25 aa, Plasmodium falciparum
PFPILSYKNVHAFYKNFLNFYQFLY

SEQ ID NO: 3272496 - protein, 21 aa, Plasmodium falciparum
PFPLEALQILFLNLMTDGCPA

SEQ ID NO: 3272497 - protein, 19 aa, Plasmodium falciparum
PFPNFFDYTDFNLSDFSLS

SEQ ID NO: 3272498 - protein, 25 aa, Plasmodium falciparum
PFPRCSHCFYVFMITTGIYALCFLS

SEQ ID NO: 3272499 - protein, 23 aa, Plasmodium falciparum
PFSDLPFDGIVGLGFSDPDFRSQ

SEQ ID NO: 3272500 - protein, 24 aa, Plasmodium falciparum
PFSKKFFITYHNWRDTEKDKIKEE

SEQ ID NO: 3272501 - protein, 32 aa, Plasmodium falciparum
PFSKRAIPIFWLYDCTLPYIKILRKKEKKRHS

SEQ ID NO: 3272502 - protein, 19 aa, Plasmodium falciparum
PFSNLLQYKIICDKLKLLN

SEQ ID NO: 3272503 - protein, 27 aa, Plasmodium falciparum
PFVFFRFLFFVTCSYFIIRSYELTEDG

SEQ ID NO: 3272504 - protein, 18 aa, Plasmodium falciparum
PFYHCHHMFMNLHKKKNK

SEQ ID NO: 3272505 - protein, 26 aa, Plasmodium falciparum
PFYITSQILFCLLDFHKYIEQAIVTI

SEQ ID NO: 3272506 - protein, 22 aa, Plasmodium falciparum
PFYLRLCQCLIRFNNEREKVHI

SEQ ID NO: 3272507 - protein, 20 aa, Plasmodium falciparum
PFYTIQCFKILSLNNLNIIH

SEQ ID NO: 3272508 - protein, 23 aa, Plasmodium falciparum
PFYTSCIYPQWKTIFRLYYYLLL

SEQ ID NO: 3272509 - protein, 19 aa, Plasmodium falciparum
PFYYPRKSDIYGMQNMLNS

SEQ ID NO: 3272510 - protein, 19 aa, Plasmodium falciparum
PGIAYRMRKDFFLKDSSFN

SEQ ID NO: 3272511 - protein, 20 aa, Plasmodium falciparum
PGIKGLPGFNLANIVNPNNY

SEQ ID NO: 3272512 - protein, 18 aa, Plasmodium falciparum
PGIYVWKIAALAAAKEFA

SEQ ID NO: 3272513 - protein, 20 aa, Plasmodium falciparum
PGLLFSRAKRTKAFIEKYFK

SEQ ID NO: 3272514 - protein, 20 aa, Plasmodium falciparum
PGLNMGRPYMFTPRQYPQMN

SEQ ID NO: 3272515 - protein, 20 aa, Plasmodium falciparum
PGSIKQKFLYHQNRENLLWK

SEQ ID NO: 3272516 - protein, 18 aa, Plasmodium falciparum
PGVLDVHDLHVWSLSIGK

SEQ ID NO: 3272517 - protein, 24 aa, Plasmodium falciparum
PGYKYKYKYICPSMSKMNDEKIKE

SEQ ID NO: 3272518 - protein, 19 aa, Plasmodium falciparum
PGYNNLFFVNSLHPLSIIY

SEQ ID NO: 3272519 - protein, 17 aa, Plasmodium falciparum
PHGKGSLYYTRRKYLFI

SEQ ID NO: 3272520 - protein, 23 aa, Plasmodium falciparum
PHHYWSLPICSQAFYMKIFYHGL

SEQ ID NO: 3272521 - protein, 21 aa, Plasmodium falciparum
PHIFPSYNLFSTFVRYQFLTI

SEQ ID NO: 3272522 - protein, 34 aa, Plasmodium falciparum
PHLETVKKWHKLECGLCHRIDLETSGSLIIAKTK

SEQ ID NO: 3272523 - protein, 24 aa, Plasmodium falciparum
PHLIFIRFLFIYTLFAPILSSYII

SEQ ID NO: 3272524 - protein, 18 aa, Plasmodium falciparum
PHLIKYNHILFLFICVKN

SEQ ID NO: 3272525 - protein, 18 aa, Plasmodium falciparum
PHLKGRNVSINFLGQLPE

SEQ ID NO: 3272526 - protein, 23 aa, Plasmodium falciparum
PHLPHQCYFLLYYNYEPFLEKNL

SEQ ID NO: 3272527 - protein, 18 aa, Plasmodium falciparum
PHMSILSLFSLYGTITFC

SEQ ID NO: 3272528 - protein, 18 aa, Plasmodium falciparum
PHRYYKEYLMFTNNIKRI

SEQ ID NO: 3272529 - protein, 17 aa, Plasmodium falciparum
PHSQPSFIPETFQDSNI

SEQ ID NO: 3272530 - protein, 25 aa, Plasmodium falciparum
PHVDMKRNYMVKEYNNIHLYENNNY

SEQ ID NO: 3272531 - protein, 23 aa, Plasmodium falciparum
PHYFAEILIYFSFFLLNKNITCS

SEQ ID NO: 3272532 - protein, 17 aa, Plasmodium falciparum
PICSLCILFNFIQLNNV

SEQ ID NO: 3272533 - protein, 18 aa, Plasmodium falciparum
PIDFCLKAFQKNDGTYDI

SEQ ID NO: 3272534 - protein, 25 aa, Plasmodium falciparum
PIDIVGNIRLYKLFYINMIKNNYSY

SEQ ID NO: 3272535 - protein, 17 aa, Plasmodium falciparum
PIEGCYFYKNSAKYNYL

SEQ ID NO: 3272536 - protein, 25 aa, Plasmodium falciparum
PIEIMLCKLYQSYLTYNMFIKQIDT

SEQ ID NO: 3272537 - protein, 21 aa, Plasmodium falciparum
PIENEGFCLVSLNDEGQFIKG

SEQ ID NO: 3272538 - protein, 24 aa, Plasmodium falciparum
PIFLRPYYTGSNMYDLRFSNSYDF

SEQ ID NO: 3272539 - protein, 20 aa, Plasmodium falciparum
PIFMEHVSNIFKRRGFKYIG

SEQ ID NO: 3272540 - protein, 21 aa, Plasmodium falciparum
PIFPYITSLILDYENDNKKPE

SEQ ID NO: 3272541 - protein, 18 aa, Plasmodium falciparum
PIFTNHTFMAYYVLINSF

SEQ ID NO: 3272542 - protein, 17 aa, Plasmodium falciparum
PIISFIIEILELLFYNH

SEQ ID NO: 3272543 - protein, 24 aa, Plasmodium falciparum
PIIYKGASIYVCLHNVKEQKILDM

SEQ ID NO: 3272544 - protein, 24 aa, Plasmodium falciparum
PIKYLFDIPLKYYEYFKSYKKKDI

SEQ ID NO: 3272545 - protein, 26 aa, Plasmodium falciparum
PILAFKKSFLYKICEVNDNLHNKKNR

SEQ ID NO: 3272546 - protein, 25 aa, Plasmodium falciparum
PILASLLRSFSYLSFNDINFYNVFI

SEQ ID NO: 3272547 - protein, 21 aa, Plasmodium falciparum
PILEVINFVYTEMFPYTNKLT

SEQ ID NO: 3272548 - protein, 19 aa, Plasmodium falciparum
PIMIIKITMSILILFFLIL

SEQ ID NO: 3272549 - protein, 24 aa, Plasmodium falciparum
PIMKKKLIRWLCERYDNFGINGRV

SEQ ID NO: 3272550 - protein, 21 aa, Plasmodium falciparum
PIPEHIKSIYMLSEVAFSPRC

SEQ ID NO: 3272551 - protein, 23 aa, Plasmodium falciparum
PIPVKIYVEYDLKILKTNIILDG

SEQ ID NO: 3272552 - protein, 21 aa, Plasmodium falciparum
PIQVCVFNLSYRVKKKITNNT

SEQ ID NO: 3272553 - protein, 25 aa, Plasmodium falciparum
PIWINRPLPCLPMITGKNCLGSILY

SEQ ID NO: 3272554 - protein, 17 aa, Plasmodium falciparum
PKCIKTCDKKCNCAGKW

SEQ ID NO: 3272555 - protein, 22 aa, Plasmodium falciparum
PKDMPSNSIILFLENNVKRNVL

SEQ ID NO: 3272556 - protein, 21 aa, Plasmodium falciparum
PKEILSILYYFLINSEEEMNK

SEQ ID NO: 3272557 - protein, 17 aa, Plasmodium falciparum
PKELKNIIKQLLHMDYR

SEQ ID NO: 3272558 - protein, 23 aa, Plasmodium falciparum
PKEVKGVKGKLKKDVKAKHLKGS

SEQ ID NO: 3272559 - protein, 22 aa, Plasmodium falciparum
PKFCNLFLKKFVPIGSGLDRNA

SEQ ID NO: 3272560 - protein, 24 aa, Plasmodium falciparum
PKFIPNLILLFNIQCYIIIHDFVF

SEQ ID NO: 3272561 - protein, 19 aa, Plasmodium falciparum
PKFKVGKIITAGRFTDDVT

SEQ ID NO: 3272562 - protein, 25 aa, Plasmodium falciparum
PKFLRFKFPLSERDWIIHSSYNSSN

SEQ ID NO: 3272563 - protein, 19 aa, Plasmodium falciparum
PKFPRINIIVISRLTYRKG

SEQ ID NO: 3272564 - protein, 18 aa, Plasmodium falciparum
PKFTVLKEDVFRTKEGDF

SEQ ID NO: 3272565 - protein, 23 aa, Plasmodium falciparum
PKGKEIDALALLGSIISAHIFYL

SEQ ID NO: 3272566 - protein, 18 aa, Plasmodium falciparum
PKGLLFLSGDVHFGSIIG

SEQ ID NO: 3272567 - protein, 18 aa, Plasmodium falciparum
PKHICMECDIGYYKDTIS

SEQ ID NO: 3272568 - protein, 17 aa, Plasmodium falciparum
PKHLFIFGSSMGAAVAI

SEQ ID NO: 3272569 - protein, 23 aa, Plasmodium falciparum
PKIIKRLIFKKLLLQNENNENNE

SEQ ID NO: 3272570 - protein, 24 aa, Plasmodium falciparum
PKINNDNVLKCEFEESSLYNPKII

SEQ ID NO: 3272571 - protein, 23 aa, Plasmodium falciparum
PKIPFIIDIYSTFGINYSTCYIE

SEQ ID NO: 3272572 - protein, 19 aa, Plasmodium falciparum
PKIRKRYLEQYKNAGGSDD

SEQ ID NO: 3272573 - protein, 19 aa, Plasmodium falciparum
PKITAEKLLNYPLIPVVIQ

SEQ ID NO: 3272574 - protein, 24 aa, Plasmodium falciparum
PKIYKKKKALFFERTQHNIDCVFR

SEQ ID NO: 3272575 - protein, 17 aa, Plasmodium falciparum
PKKCSRKSRSLSELVLA

SEQ ID NO: 3272576 - protein, 17 aa, Plasmodium falciparum
PKKGYFIYMFKSINIDY

SEQ ID NO: 3272577 - protein, 27 aa, Plasmodium falciparum
PKKILICLYCGSTVCLHEGDHVSGPLS

SEQ ID NO: 3272578 - protein, 29 aa, Plasmodium falciparum
PKKINRKSFKIILFSLFKILDLCKLYNIY

SEQ ID NO: 3272579 - protein, 23 aa, Plasmodium falciparum
PKKKITKKKVRFDIKDKEPKDEI

SEQ ID NO: 3272580 - protein, 23 aa, Plasmodium falciparum
PKKLEFSRQIFLVYNIASFCFEL

SEQ ID NO: 3272581 - protein, 20 aa, Plasmodium falciparum
PKKNVCNFDIDCIIMLILYN

SEQ ID NO: 3272582 - protein, 20 aa, Plasmodium falciparum
PKKPSVHGFTQMVFLQLTNI

SEQ ID NO: 3272583 - protein, 23 aa, Plasmodium falciparum
PKKWTAHATFEITKLFSSGLKEK

SEQ ID NO: 3272584 - protein, 23 aa, Plasmodium falciparum
PKLDLKLEKEIHSFKEIMDKFAK

SEQ ID NO: 3272585 - protein, 33 aa, Plasmodium falciparum
PKLKEFVEIPTFFRYLHEWGQNFCKERKKRLKQ

SEQ ID NO: 3272586 - protein, 21 aa, Plasmodium falciparum
PKLNKEEFINLGDIKDCSISE

SEQ ID NO: 3272587 - protein, 22 aa, Plasmodium falciparum
PKLPTLEFRSATNVYTLEPEYY

SEQ ID NO: 3272588 - protein, 20 aa, Plasmodium falciparum
PKLRPTKLFRVIDIPQNDYN

SEQ ID NO: 3272589 - protein, 19 aa, Plasmodium falciparum
PKLSGYYYIWEKLLQDGKE

SEQ ID NO: 3272590 - protein, 29 aa, Plasmodium falciparum
PKLSNVFVEDIKRILPISNNNLENSITTI

SEQ ID NO: 3272591 - protein, 18 aa, Plasmodium falciparum
PKNIPLLFVHSKDDSVCS

SEQ ID NO: 3272592 - protein, 19 aa, Plasmodium falciparum
PKNNWKKKDMVSILLSELQ

SEQ ID NO: 3272593 - protein, 18 aa, Plasmodium falciparum
PKQVNIKKAMLVYKNMIY

SEQ ID NO: 3272594 - protein, 24 aa, Plasmodium falciparum
PKRKESFELFALSCFCIGLSSIAG

SEQ ID NO: 3272595 - protein, 19 aa, Plasmodium falciparum
PKRMEYFLLNLLKNNEKKR

SEQ ID NO: 3272596 - protein, 24 aa, Plasmodium falciparum
PKSFLRKYWFIILIFFLSFSFSKH

SEQ ID NO: 3272597 - protein, 29 aa, Plasmodium falciparum
PKSKICLPLYCTWYYKNIEKLYSNILLQE

SEQ ID NO: 3272598 - protein, 20 aa, Plasmodium falciparum
PKSSCIYTNSFFFIYQFKLH

SEQ ID NO: 3272599 - protein, 25 aa, Plasmodium falciparum
PKSVKTCRSLCECELYAPSNYDNDP

SEQ ID NO: 3272600 - protein, 26 aa, Plasmodium falciparum
PKSYMACNYFKMVIIKYQKYNKEKKN

SEQ ID NO: 3272601 - protein, 20 aa, Plasmodium falciparum
PKTIEEIFYEFMLERKNTNI

SEQ ID NO: 3272602 - protein, 19 aa, Plasmodium falciparum
PKTIVKINCFTHNYIYIYL

SEQ ID NO: 3272603 - protein, 22 aa, Plasmodium falciparum
PKTTFGPLEYCKTCPPNKVNCN

SEQ ID NO: 3272604 - protein, 29 aa, Plasmodium falciparum
PKVVRTLLCELCLQLPVNYFLKDHFNIYV

SEQ ID NO: 3272605 - protein, 25 aa, Plasmodium falciparum
PKYCLPFNINCLFNIKTTTPYKLYN

SEQ ID NO: 3272606 - protein, 26 aa, Plasmodium falciparum
PKYFFNCFIKSASLAFWKKKKIFSRI

SEQ ID NO: 3272607 - protein, 21 aa, Plasmodium falciparum
PKYGYNYKCIISYYEDILLSN

SEQ ID NO: 3272608 - protein, 23 aa, Plasmodium falciparum
PKYIWSYMPEKLYAHFQQEDPLL

SEQ ID NO: 3272609 - protein, 19 aa, Plasmodium falciparum
PKYKTLIEVVLEPSGNNTP

SEQ ID NO: 3272610 - protein, 17 aa, Plasmodium falciparum
PKYKTLIEVVLEPSKRD

SEQ ID NO: 3272611 - protein, 17 aa, Plasmodium falciparum
PKYKTLIEVVLEPSKSN

SEQ ID NO: 3272612 - protein, 25 aa, Plasmodium falciparum
PKYRKEILYIYSLFILKKKQKQYYY

SEQ ID NO: 3272613 - protein, 18 aa, Plasmodium falciparum
PLAKLLIVGLDFKIIYKH

SEQ ID NO: 3272614 - protein, 20 aa, Plasmodium falciparum
PLCGVKRNGRKWERKEVMKD

SEQ ID NO: 3272615 - protein, 23 aa, Plasmodium falciparum
PLCITFSLYYFLKMNLNYKHLSY

SEQ ID NO: 3272616 - protein, 29 aa, Plasmodium falciparum
PLDNFIIIYDFLYNILIHYFNDNKKIIDQ

SEQ ID NO: 3272617 - protein, 19 aa, Plasmodium falciparum
PLEIGRNTIGLAVYAVDNV

SEQ ID NO: 3272618 - protein, 19 aa, Plasmodium falciparum
PLENPSLREALGLEEMERK

SEQ ID NO: 3272619 - protein, 22 aa, Plasmodium falciparum
PLESPRNNFLKKFHKIDKISDF

SEQ ID NO: 3272620 - protein, 17 aa, Plasmodium falciparum
PLETFRHSKYCETCPFN

SEQ ID NO: 3272621 - protein, 19 aa, Plasmodium falciparum
PLFIHGSPNLPLRDLNEGK

SEQ ID NO: 3272622 - protein, 20 aa, Plasmodium falciparum
PLFKYFKKYCLYIYENKNCE

SEQ ID NO: 3272623 - protein, 24 aa, Plasmodium falciparum
PLFNLCTLVYIFTKMLMPLINACT

SEQ ID NO: 3272624 - protein, 22 aa, Plasmodium falciparum
PLGDAKGVGGMIVGDLDEHHMY

SEQ ID NO: 3272625 - protein, 19 aa, Plasmodium falciparum
PLIFAAAKIELLKMKKNKT

SEQ ID NO: 3272626 - protein, 35 aa, Plasmodium falciparum
PLIKLNYLFKVILRFTFLVSFSFLAIIVSTLYVEN

SEQ ID NO: 3272627 - protein, 19 aa, Plasmodium falciparum
PLIKRSNTYNVYRTNDMNT

SEQ ID NO: 3272628 - protein, 24 aa, Plasmodium falciparum
PLIPLKESKRFTCSDGDDDEENDT

SEQ ID NO: 3272629 - protein, 18 aa, Plasmodium falciparum
PLISLLIISCALFFLFKR

SEQ ID NO: 3272630 - protein, 17 aa, Plasmodium falciparum
PLIYRMDLKNGKRKFDE

SEQ ID NO: 3272631 - protein, 20 aa, Plasmodium falciparum
PLKDKCLRNNKINIELLFVS

SEQ ID NO: 3272632 - protein, 18 aa, Plasmodium falciparum
PLKKFNFENIRQYLCFDQ

SEQ ID NO: 3272633 - protein, 17 aa, Plasmodium falciparum
PLKNYLYYNNNHRFELK

SEQ ID NO: 3272634 - protein, 24 aa, Plasmodium falciparum
PLKSELHWPYGINRDIDLVNVVRN

SEQ ID NO: 3272635 - protein, 23 aa, Plasmodium falciparum
PLKYELLKLIGKICDPFKPLCCY

SEQ ID NO: 3272636 - protein, 19 aa, Plasmodium falciparum
PLLEEVPNLYLDVFRRNSG

SEQ ID NO: 3272637 - protein, 20 aa, Plasmodium falciparum
PLLKKFCTINQFLRPICIDN

SEQ ID NO: 3272638 - protein, 20 aa, Plasmodium falciparum
PLMIHIHILHQFYLSIYIKE

SEQ ID NO: 3272639 - protein, 19 aa, Plasmodium falciparum
PLNDSRYVVPFLYHMFTIC

SEQ ID NO: 3272640 - protein, 22 aa, Plasmodium falciparum
PLNHKRFLFFKEIYNITKKYIF

SEQ ID NO: 3272641 - protein, 23 aa, Plasmodium falciparum
PLNIKRFYLLIILVIYTATSACI

SEQ ID NO: 3272642 - protein, 26 aa, Plasmodium falciparum
PLNLSCPWYEKKIENIYCLNIPGYKY

SEQ ID NO: 3272643 - protein, 17 aa, Plasmodium falciparum
PLNTCFLQLAAYNNNNV

SEQ ID NO: 3272644 - protein, 18 aa, Plasmodium falciparum
PLQNFRFNSSNVYGNIKN

SEQ ID NO: 3272645 - protein, 18 aa, Plasmodium falciparum
PLRRYASLNKSMGYKNSF

SEQ ID NO: 3272646 - protein, 19 aa, Plasmodium falciparum
PLSAISFLLWLQKYELAYY

SEQ ID NO: 3272647 - protein, 24 aa, Plasmodium falciparum
PLSKGLNCCTFLIGCSSGLISSYG

SEQ ID NO: 3272648 - protein, 24 aa, Plasmodium falciparum
PLSKIRNIYKFKKSIIHFVENNSD

SEQ ID NO: 3272649 - protein, 19 aa, Plasmodium falciparum
PLSKLELSHIISRLNKDVP

SEQ ID NO: 3272650 - protein, 25 aa, Plasmodium falciparum
PLSNCSKIFSFTSLYALSEKIIALE

SEQ ID NO: 3272651 - protein, 24 aa, Plasmodium falciparum
PLSSIPCVVFGRFINKYGASVIIL

SEQ ID NO: 3272652 - protein, 18 aa, Plasmodium falciparum
PLTKLLYHFFMPKNCIQV

SEQ ID NO: 3272653 - protein, 19 aa, Plasmodium falciparum
PLVLLLKFFLHSRNLNETY

SEQ ID NO: 3272654 - protein, 18 aa, Plasmodium falciparum
PLYIFAHTSMVFFCIIFT

SEQ ID NO: 3272655 - protein, 18 aa, Plasmodium falciparum
PLYIFPVLRENYIKKEDI

SEQ ID NO: 3272656 - protein, 25 aa, Plasmodium falciparum
PLYIKNLYLHYTPFYFPYINDSNTY

SEQ ID NO: 3272657 - protein, 19 aa, Plasmodium falciparum
PLYLKIRVYVLRGIGLYGI

SEQ ID NO: 3272658 - protein, 20 aa, Plasmodium falciparum
PLYNYYRFMNKINANIKQNN

SEQ ID NO: 3272659 - protein, 24 aa, Plasmodium falciparum
PLYSGLRLLLPLDYKKEMPWFDVF

SEQ ID NO: 3272660 - protein, 26 aa, Plasmodium falciparum
PLYSSFKFLIYNCAIHYYRSKNKDMY

SEQ ID NO: 3272661 - protein, 26 aa, Plasmodium falciparum
PMFIYDEIKKIWFYLLEKNIENMNVY

SEQ ID NO: 3272662 - protein, 26 aa, Plasmodium falciparum
PMHIMSLPAATAYFLCKIKLSMSSSG

SEQ ID NO: 3272663 - protein, 18 aa, Plasmodium falciparum
PMINKSVFLKRSEKKYHP

SEQ ID NO: 3272664 - protein, 19 aa, Plasmodium falciparum
PMLWECISSHIPLITQMAF

SEQ ID NO: 3272665 - protein, 23 aa, Plasmodium falciparum
PMNTCNYYPYGFAYKRKKNKKNI

SEQ ID NO: 3272666 - protein, 21 aa, Plasmodium falciparum
PMPQYICYRKQTLIENNEYLF

SEQ ID NO: 3272667 - protein, 18 aa, Plasmodium falciparum
PMRLRNSTVSNCKKENSQ

SEQ ID NO: 3272668 - protein, 21 aa, Plasmodium falciparum
PMRYLPHYNNFDSYMNMNNLH

SEQ ID NO: 3272669 - protein, 24 aa, Plasmodium falciparum
PMYNDCKRFHKIYFSVKLDQLYMS

SEQ ID NO: 3272670 - protein, 19 aa, Plasmodium falciparum
PNCGLGCIKELKKRDIHEN

SEQ ID NO: 3272671 - protein, 26 aa, Plasmodium falciparum
PNCLITTYLCISIIFILIGCIFIILS

SEQ ID NO: 3272672 - protein, 25 aa, Plasmodium falciparum
PNDETCYFYLFKTILNVFSIFKRNF

SEQ ID NO: 3272673 - protein, 20 aa, Plasmodium falciparum
PNDFLRQMFYTLADYKDILD

SEQ ID NO: 3272674 - protein, 20 aa, Plasmodium falciparum
PNDKKALILSYIRNGNDNNM

SEQ ID NO: 3272675 - protein, 25 aa, Plasmodium falciparum
PNEKFHMFEYFFSYILIFLTLFCLS

SEQ ID NO: 3272676 - protein, 20 aa, Plasmodium falciparum
PNEKFHMFGSPYVTEEDYTE

SEQ ID NO: 3272677 - protein, 19 aa, Plasmodium falciparum
PNEMNLFLINSIYTLTLLM

SEQ ID NO: 3272678 - protein, 20 aa, Plasmodium falciparum
PNERKIKRDYLIGCLSSLIN

SEQ ID NO: 3272679 - protein, 17 aa, Plasmodium falciparum
PNEYLGNEFPKIINNYD

SEQ ID NO: 3272680 - protein, 17 aa, Plasmodium falciparum
PNFCPRYTENTSSFFNQ

SEQ ID NO: 3272681 - protein, 19 aa, Plasmodium falciparum
PNFFEIINEINLIKDIQNI

SEQ ID NO: 3272682 - protein, 20 aa, Plasmodium falciparum
PNFLKRVALNLKIPQTINLI

SEQ ID NO: 3272683 - protein, 24 aa, Plasmodium falciparum
PNFYECWWDHIFLDVLSCNLIGIV

SEQ ID NO: 3272684 - protein, 19 aa, Plasmodium falciparum
PNGEYDHIPSYRNDYNDEQ

SEQ ID NO: 3272685 - protein, 17 aa, Plasmodium falciparum
PNGSFYFHFSDEKDESG

SEQ ID NO: 3272686 - protein, 19 aa, Plasmodium falciparum
PNGYCVAQCESLWIHVGTI

SEQ ID NO: 3272687 - protein, 46 aa, Plasmodium falciparum
PNHMYGVPIEVLRFFIPHYKQCRPEDFIYCPGYKPYENDYYNVDGT

SEQ ID NO: 3272688 - protein, 19 aa, Plasmodium falciparum
PNIISIKPYESFYYHPINT

SEQ ID NO: 3272689 - protein, 21 aa, Plasmodium falciparum
PNILCRCLETVIGGGLIIFLI

SEQ ID NO: 3272690 - protein, 18 aa, Plasmodium falciparum
PNILILILYYYFKLNLIP

SEQ ID NO: 3272691 - protein, 17 aa, Plasmodium falciparum
PNINPRNIIVIKNYNTE

SEQ ID NO: 3272692 - protein, 29 aa, Plasmodium falciparum
PNIRKKAFLCLANIYKKRHDLLLRGKNDF

SEQ ID NO: 3272693 - protein, 17 aa, Plasmodium falciparum
PNKGIFSNDMWKSKIKV

SEQ ID NO: 3272694 - protein, 23 aa, Plasmodium falciparum
PNKIEGLQMLNIWIKNENNIMIL

SEQ ID NO: 3272695 - protein, 27 aa, Plasmodium falciparum
PNKIISIFFKLLEEVPIPLGEEEDKVV

SEQ ID NO: 3272696 - protein, 22 aa, Plasmodium falciparum
PNKLHSSLCIRKNSQHDIGVYK

SEQ ID NO: 3272697 - protein, 23 aa, Plasmodium falciparum
PNKNIFCFQGNFKLDKHPRSLLL

SEQ ID NO: 3272698 - protein, 19 aa, Plasmodium falciparum
PNKYYPWDNKNVFEPFLEL

SEQ ID NO: 3272699 - protein, 28 aa, Plasmodium falciparum
PNLIIHFIVHFFKHYTIFKNVIKNSNSL

SEQ ID NO: 3272700 - protein, 20 aa, Plasmodium falciparum
PNLYKLPVHFSLKDIGIICP

SEQ ID NO: 3272701 - protein, 17 aa, Plasmodium falciparum
PNLYLPTYNYFENTNSK

SEQ ID NO: 3272702 - protein, 18 aa, Plasmodium falciparum
PNMLKLSGIQTKLFHSKI

SEQ ID NO: 3272703 - protein, 20 aa, Plasmodium falciparum
PNMNIPFFIRFLIGSSSGAI

SEQ ID NO: 3272704 - protein, 20 aa, Plasmodium falciparum
PNNIKSLFRSFHFIKPDFFT

SEQ ID NO: 3272705 - protein, 19 aa, Plasmodium falciparum
PNPEILLERLLGINKITSL

SEQ ID NO: 3272706 - protein, 32 aa, Plasmodium falciparum
PNPLLFKYDSQLPIVFIFTIMFSFVCLYFQIR

SEQ ID NO: 3272707 - protein, 17 aa, Plasmodium falciparum
PNPRVTITLSHTPKGHE

SEQ ID NO: 3272708 - protein, 21 aa, Plasmodium falciparum
PNRHILLCINNIMFLKTKRAN

SEQ ID NO: 3272709 - protein, 26 aa, Plasmodium falciparum
PNRYWGWRCVTPSGKPSDTGSVPTTR

SEQ ID NO: 3272710 - protein, 17 aa, Plasmodium falciparum
PNSFKYVYNYKSYYIFK

SEQ ID NO: 3272711 - protein, 21 aa, Plasmodium falciparum
PNSNNYFLHMLKTYDEENKGI

SEQ ID NO: 3272712 - protein, 23 aa, Plasmodium falciparum
PNTNFIQRLIKKCVHNNNSNNNN

SEQ ID NO: 3272713 - protein, 19 aa, Plasmodium falciparum
PNVNCNIKLGKWSWTGICC

SEQ ID NO: 3272714 - protein, 22 aa, Plasmodium falciparum
PNYKDRVIFHVDILKNCKNIFI

SEQ ID NO: 3272715 - protein, 19 aa, Plasmodium falciparum
PNYKDTLIFIDKILSNLDD

SEQ ID NO: 3272716 - protein, 26 aa, Plasmodium falciparum
PNYNIIICFTLLLLVHIIICIAIHIA

SEQ ID NO: 3272717 - protein, 29 aa, Plasmodium falciparum
PNYNLKENIIFSGIWVYGISKRNDLYHNF

SEQ ID NO: 3272718 - protein, 17 aa, Plasmodium falciparum
PNYPFSHFIISDKIESL

SEQ ID NO: 3272719 - protein, 22 aa, Plasmodium falciparum
PPAACTKFQLNLGIHKKIGAMI

SEQ ID NO: 3272720 - protein, 19 aa, Plasmodium falciparum
PPDFLRQMFYTLGDYRDIL

SEQ ID NO: 3272721 - protein, 25 aa, Plasmodium falciparum
PPEKFKKACKCKIPNPLEKCPNEEN

SEQ ID NO: 3272722 - protein, 19 aa, Plasmodium falciparum
PPFEYSVFLKYKIYKKNKT

SEQ ID NO: 3272723 - protein, 18 aa, Plasmodium falciparum
PPFMKELEDIYNICYSGL

SEQ ID NO: 3272724 - protein, 22 aa, Plasmodium falciparum
PPGLFCLPFIVLIFIIYIVARY

SEQ ID NO: 3272725 - protein, 23 aa, Plasmodium falciparum
PPKECLDVTHAVLIALKEIKNYS

SEQ ID NO: 3272726 - protein, 18 aa, Plasmodium falciparum
PPPALEYTKGFNPMEQRR

SEQ ID NO: 3272727 - protein, 17 aa, Plasmodium falciparum
PPPPCLGDDCFCQNYYD

SEQ ID NO: 3272728 - protein, 18 aa, Plasmodium falciparum
PPPPLPAALLKSVNVAKE

SEQ ID NO: 3272729 - protein, 19 aa, Plasmodium falciparum
PPRRQKLCLYFLAHKIETP

SEQ ID NO: 3272730 - protein, 28 aa, Plasmodium falciparum
PPTILNYLLPLMEAYLFIEEVILVSQYK

SEQ ID NO: 3272731 - protein, 25 aa, Plasmodium falciparum
PPTKLPEYEKGHVSREYQLDNEVRD

SEQ ID NO: 3272732 - protein, 31 aa, Plasmodium falciparum
PPVGLPRSYPLSLILEHKFKEWMNSSPAGFY

SEQ ID NO: 3272733 - protein, 24 aa, Plasmodium falciparum
PPYDLMFCQCLLNFIYSVLKKEGI

SEQ ID NO: 3272734 - protein, 24 aa, Plasmodium falciparum
PPYFRYLEEWGETFCRERAKRLAQ

SEQ ID NO: 3272735 - protein, 23 aa, Plasmodium falciparum
PPYFRYLEEWGQNFCKKRTEMLG

SEQ ID NO: 3272736 - protein, 21 aa, Plasmodium falciparum
PPYGTGVVFHGRMQPVKYAIK

SEQ ID NO: 3272737 - protein, 19 aa, Plasmodium falciparum
PPYMPDLIITESPTNTSGT

SEQ ID NO: 3272738 - protein, 21 aa, Plasmodium falciparum
PPYYFDIHFISRILFLLNKRK

SEQ ID NO: 3272739 - protein, 18 aa, Plasmodium falciparum
PQFLRWFDEWAEEFCRIR

SEQ ID NO: 3272740 - protein, 18 aa, Plasmodium falciparum
PQFLRWFDEWSEEFCRKR

SEQ ID NO: 3272741 - protein, 19 aa, Plasmodium falciparum
PQFLRWFTEWGDEFCREQK

SEQ ID NO: 3272742 - protein, 19 aa, Plasmodium falciparum
PQFLRWLNEWSEEFCRIKN

SEQ ID NO: 3272743 - protein, 18 aa, Plasmodium falciparum
PQHLRWFDEWSEEFCRKR

SEQ ID NO: 3272744 - protein, 26 aa, Plasmodium falciparum
PQIKKCLPPYFIFVIECSYNSIYSNI

SEQ ID NO: 3272745 - protein, 20 aa, Plasmodium falciparum
PQKALLKAFVESAAVETFFL

SEQ ID NO: 3272746 - protein, 22 aa, Plasmodium falciparum
PQNKCPFTNIPLPPIKKKFLGF

SEQ ID NO: 3272747 - protein, 19 aa, Plasmodium falciparum
PQQLYPYQFVELTNLLFPL

SEQ ID NO: 3272748 - protein, 22 aa, Plasmodium falciparum
PQRLRWLSEWADNYCKMVKTDY

SEQ ID NO: 3272749 - protein, 26 aa, Plasmodium falciparum
PQSICSKHGLAIGGFFAPLIYVLKFL

SEQ ID NO: 3272750 - protein, 18 aa, Plasmodium falciparum
PQVFKVVFDTGSSNLAIP

SEQ ID NO: 3272751 - protein, 20 aa, Plasmodium falciparum
PQYIALLLINVMKFINNSQL

SEQ ID NO: 3272752 - protein, 24 aa, Plasmodium falciparum
PQYLRFLQEWVEHFCKQRQEKVKP

SEQ ID NO: 3272753 - protein, 19 aa, Plasmodium falciparum
PQYLRWFEEWAEEFCRIKE

SEQ ID NO: 3272754 - protein, 20 aa, Plasmodium falciparum
PQYLRWFEEWAEEFCRKRKK

SEQ ID NO: 3272755 - protein, 18 aa, Plasmodium falciparum
PRAPKYKTLIEVILEPSK

SEQ ID NO: 3272756 - protein, 20 aa, Plasmodium falciparum
PRAPKYKTLIEVVLEPSGKN

SEQ ID NO: 3272757 - protein, 18 aa, Plasmodium falciparum
PRAPKYKTLIEVVLEPSK

SEQ ID NO: 3272758 - protein, 19 aa, Plasmodium falciparum
PRAPKYKTLIEVVLEPSKR

SEQ ID NO: 3272759 - protein, 25 aa, Plasmodium falciparum
PRDLKNVRINFEFLFKNIYFKDELK

SEQ ID NO: 3272760 - protein, 27 aa, Plasmodium falciparum
PRISNKFRYSFFKIRNRFKHNFNACDN

SEQ ID NO: 3272761 - protein, 23 aa, Plasmodium falciparum
PRKDYIKAGIFPFNLSKNNRKIE

SEQ ID NO: 3272762 - protein, 21 aa, Plasmodium falciparum
PRKYEWFEWNMVVKKLRKLYG

SEQ ID NO: 3272763 - protein, 17 aa, Plasmodium falciparum
PRNIIIIAVFINSSTSF

SEQ ID NO: 3272764 - protein, 18 aa, Plasmodium falciparum
PRNILILFDIIYLLCNAY

SEQ ID NO: 3272765 - protein, 26 aa, Plasmodium falciparum
PRRRHLCLRIDVNKFLRLRNDINNLK

SEQ ID NO: 3272766 - protein, 21 aa, Plasmodium falciparum
PRSFYFILLRSSFILFHSFTF

SEQ ID NO: 3272767 - protein, 19 aa, Plasmodium falciparum
PRSFYSIFDIYHYVFVNYD

SEQ ID NO: 3272768 - protein, 20 aa, Plasmodium falciparum
PRTQELCLYYLKELSDTTQK

SEQ ID NO: 3272769 - protein, 20 aa, Plasmodium falciparum
PRVVSNLNLVNELKRDKESN

SEQ ID NO: 3272770 - protein, 27 aa, Plasmodium falciparum
PRYSKKSIMYYIFSLFCNKIYNINKKK

SEQ ID NO: 3272771 - protein, 28 aa, Plasmodium falciparum
PSCAKPCSSYRRWIERKKDEFIKQKDRY

SEQ ID NO: 3272772 - protein, 19 aa, Plasmodium falciparum
PSDWLIILMIIQKGIYTIL

SEQ ID NO: 3272773 - protein, 20 aa, Plasmodium falciparum
PSEEIYGMIKPMGKDPAIVL

SEQ ID NO: 3272774 - protein, 37 aa, Plasmodium falciparum
PSEKLKSWWSQNGEYIWKGMVCALTYEENGARGTDGK

SEQ ID NO: 3272775 - protein, 34 aa, Plasmodium falciparum
PSFFFMNNSFYFSCLNIDIDILKIFEIIKILDKS

SEQ ID NO: 3272776 - protein, 37 aa, Plasmodium falciparum
PSFLNYKLIQAFLLFFKYSWFCKILVCETCDVYENSD

SEQ ID NO: 3272777 - protein, 25 aa, Plasmodium falciparum
PSFQIAPCFSQCFPNFLGKNIPCLV

SEQ ID NO: 3272778 - protein, 25 aa, Plasmodium falciparum
PSFRVEHALWFGATIDIKKAFILLE

SEQ ID NO: 3272779 - protein, 28 aa, Plasmodium falciparum
PSGEYLKTGSFVIRGKKNYLPHVKLEMG

SEQ ID NO: 3272780 - protein, 19 aa, Plasmodium falciparum
PSGFTLRMTHDVVLDGVLK

SEQ ID NO: 3272781 - protein, 18 aa, Plasmodium falciparum
PSGQIVHYGPYIQNGNHI

SEQ ID NO: 3272782 - protein, 20 aa, Plasmodium falciparum
PSHEIYDVILIGGGLFNCCL

SEQ ID NO: 3272783 - protein, 20 aa, Plasmodium falciparum
PSHLYKEKIYIFRYSIYYII

SEQ ID NO: 3272784 - protein, 19 aa, Plasmodium falciparum
PSIIIKIKQLYSMNTNKVN

SEQ ID NO: 3272785 - protein, 36 aa, Plasmodium falciparum
PSILITCFGCFLFVFFPSLLFICFAYLSNEYIREVF

SEQ ID NO: 3272786 - protein, 18 aa, Plasmodium falciparum
PSKMCTMLARSFADIGDI

SEQ ID NO: 3272787 - protein, 25 aa, Plasmodium falciparum
PSLIKNIIYSFGYLENFYITKCMAA

SEQ ID NO: 3272788 - protein, 26 aa, Plasmodium falciparum
PSLIPLLPFIIKFFISCASLPMKLFS

SEQ ID NO: 3272789 - protein, 25 aa, Plasmodium falciparum
PSLIRLSFYILLLMFCMQCPYVNNN

SEQ ID NO: 3272790 - protein, 20 aa, Plasmodium falciparum
PSLKCQSCGEECRKYKKWIE

SEQ ID NO: 3272791 - protein, 17 aa, Plasmodium falciparum
PSLKKKKSVFTKINNLF

SEQ ID NO: 3272792 - protein, 28 aa, Plasmodium falciparum
PSLNCPSCGTPCRYYKKWINTKKTEYDK

SEQ ID NO: 3272793 - protein, 26 aa, Plasmodium falciparum
PSNIYKTKFEEIIKCMIQRLKGEDEK

SEQ ID NO: 3272794 - protein, 20 aa, Plasmodium falciparum
PSPFFSYPCYKSIDHSNNLY

SEQ ID NO: 3272795 - protein, 17 aa, Plasmodium falciparum
PSRTARFNTAVSFDGTI

SEQ ID NO: 3272796 - protein, 34 aa, Plasmodium falciparum
PSRWNKIKLSSWGYKGSLLINFFYSYFYNTKHKL

SEQ ID NO: 3272797 - protein, 30 aa, Plasmodium falciparum
PSSLSMHLGHLIPFYFCKYLQEAFNVPLVI

SEQ ID NO: 3272798 - protein, 18 aa, Plasmodium falciparum
PSSYRHTQNILNMNSTHN

SEQ ID NO: 3272799 - protein, 18 aa, Plasmodium falciparum
PSTLPGHVSLFLIGIRMF

SEQ ID NO: 3272800 - protein, 19 aa, Plasmodium falciparum
PSTQLKNAMLFSTILWMVG

SEQ ID NO: 3272801 - protein, 19 aa, Plasmodium falciparum
PSTRSYRALNEIEDLRDTK

SEQ ID NO: 3272802 - protein, 29 aa, Plasmodium falciparum
PSTVRDFLCPTCGRHCSFYKKWIDIKKKE

SEQ ID NO: 3272803 - protein, 17 aa, Plasmodium falciparum
PSTYCLEEKNYLNVNPV

SEQ ID NO: 3272804 - protein, 30 aa, Plasmodium falciparum
PSVLCSICSCLSCVLPLYYSSIYRILKKIL

SEQ ID NO: 3272805 - protein, 19 aa, Plasmodium falciparum
PSVSELLNYNYIDSWTKMI

SEQ ID NO: 3272806 - protein, 18 aa, Plasmodium falciparum
PSWRASFYYNCLSFLTGL

SEQ ID NO: 3272807 - protein, 20 aa, Plasmodium falciparum
PSYKGCGLMQPLGISDEILK

SEQ ID NO: 3272808 - protein, 24 aa, Plasmodium falciparum
PSYVLKFVLEKDVLLTSIKSGYGK

SEQ ID NO: 3272809 - protein, 21 aa, Plasmodium falciparum
PTCAKYCRFYKKWINTKKTEY

SEQ ID NO: 3272810 - protein, 20 aa, Plasmodium falciparum
PTCVCEKSLADKMEKVCLKC

SEQ ID NO: 3272811 - protein, 18 aa, Plasmodium falciparum
PTDILTMRRKARHGDYKT

SEQ ID NO: 3272812 - protein, 22 aa, Plasmodium falciparum
PTDLEYSFSHRDFIPFHELGEQ

SEQ ID NO: 3272813 - protein, 24 aa, Plasmodium falciparum
PTDLPQCFIPFINPKKMTKYNMTQ

SEQ ID NO: 3272814 - protein, 18 aa, Plasmodium falciparum
PTDTLIFSHWIQPYYDIY

SEQ ID NO: 3272815 - protein, 21 aa, Plasmodium falciparum
PTEFLIYKFFSSIQYKQNIAH

SEQ ID NO: 3272816 - protein, 24 aa, Plasmodium falciparum
PTEWWSQNGEHIWNAMICALTYDT

SEQ ID NO: 3272817 - protein, 23 aa, Plasmodium falciparum
PTEWWSQNGQHIWNGMICALTYT

SEQ ID NO: 3272818 - protein, 24 aa, Plasmodium falciparum
PTEWWSQNGQHIWNGMICALTYTD

SEQ ID NO: 3272819 - protein, 24 aa, Plasmodium falciparum
PTFFRWLEEWGEDFCRKRNDKLKN

SEQ ID NO: 3272820 - protein, 28 aa, Plasmodium falciparum
PTGILAILPFYWMWRSHKTSILTIVSVF

SEQ ID NO: 3272821 - protein, 30 aa, Plasmodium falciparum
PTIFNMYKYSSLLICIYFIHTINVFVNCVT

SEQ ID NO: 3272822 - protein, 21 aa, Plasmodium falciparum
PTINTFIILDIILRILKIRGN

SEQ ID NO: 3272823 - protein, 23 aa, Plasmodium falciparum
PTITTSRIKSIFMGTIPNYMEVN

SEQ ID NO: 3272824 - protein, 26 aa, Plasmodium falciparum
PTKYGSKAPTSWKCIPTKPNSDSSTT

SEQ ID NO: 3272825 - protein, 20 aa, Plasmodium falciparum
PTLNSTYTWRSDFMDCSKNI

SEQ ID NO: 3272826 - protein, 17 aa, Plasmodium falciparum
PTLRSFIKRNSVRPKNA

SEQ ID NO: 3272827 - protein, 25 aa, Plasmodium falciparum
PTLVELKDALNLDALMMMLNIEDMQ

SEQ ID NO: 3272828 - protein, 24 aa, Plasmodium falciparum
PTNACNLSYEELMYKMQNNNNIYC

SEQ ID NO: 3272829 - protein, 25 aa, Plasmodium falciparum
PTNELECLECFNLLSSLNSLDSEKK

SEQ ID NO: 3272830 - protein, 27 aa, Plasmodium falciparum
PTNKFFCLYSFFVFFIWSLLALSTKKL

SEQ ID NO: 3272831 - protein, 25 aa, Plasmodium falciparum
PTSKYCFGLCYGICILDIINHIIYR

SEQ ID NO: 3272832 - protein, 23 aa, Plasmodium falciparum
PTSSGKTFICYYVMDKVLRLNND

SEQ ID NO: 3272833 - protein, 21 aa, Plasmodium falciparum
PTVKILQFFYVIYKHYIFKGY

SEQ ID NO: 3272834 - protein, 23 aa, Plasmodium falciparum
PTYFRWLEEWGEEFCKKRTDKLK

SEQ ID NO: 3272835 - protein, 24 aa, Plasmodium falciparum
PTYFRYLEEWGETFCRERKKRLEK

SEQ ID NO: 3272836 - protein, 23 aa, Plasmodium falciparum
PTYFRYLEEWGETFCRQRTKRLD

SEQ ID NO: 3272837 - protein, 22 aa, Plasmodium falciparum
PTYFRYLEEWGQNFCKERKKRL

SEQ ID NO: 3272838 - protein, 18 aa, Plasmodium falciparum
PVDLCYSNSCFNKNATNP

SEQ ID NO: 3272839 - protein, 24 aa, Plasmodium falciparum
PVEDKLICAFGMRDGLVAGQYASS

SEQ ID NO: 3272840 - protein, 22 aa, Plasmodium falciparum
PVEGRVSLSRVRPVRTRKPTGF

SEQ ID NO: 3272841 - protein, 25 aa, Plasmodium falciparum
PVEYKEYVCFAGIPCNATIKIKRSA

SEQ ID NO: 3272842 - protein, 17 aa, Plasmodium falciparum
PVFFFYINFNKSHMNPI

SEQ ID NO: 3272843 - protein, 19 aa, Plasmodium falciparum
PVFYWTYGAIWTFILYFKF

SEQ ID NO: 3272844 - protein, 17 aa, Plasmodium falciparum
PVHCLKSAGDTYVDTLR

SEQ ID NO: 3272845 - protein, 20 aa, Plasmodium falciparum
PVKCFMKKDDLEVIENPKFA

SEQ ID NO: 3272846 - protein, 25 aa, Plasmodium falciparum
PVKDQALCGSCWAFSSVGSVESQYA

SEQ ID NO: 3272847 - protein, 20 aa, Plasmodium falciparum
PVLDKLIYMNTIISKTNELD

SEQ ID NO: 3272848 - protein, 21 aa, Plasmodium falciparum
PVLFIYRRIIKRRKGSSKGNK

SEQ ID NO: 3272849 - protein, 17 aa, Plasmodium falciparum
PVLPRPIKSIFHLNWFR

SEQ ID NO: 3272850 - protein, 21 aa, Plasmodium falciparum
PVNTRLANPNLIYDPNYETIY

SEQ ID NO: 3272851 - protein, 21 aa, Plasmodium falciparum
PVNYFLKDHFNIYVKSLLICL

SEQ ID NO: 3272852 - protein, 26 aa, Plasmodium falciparum
PVRPQFEIINATKFIIAYATDINKYT

SEQ ID NO: 3272853 - protein, 24 aa, Plasmodium falciparum
PVYLQCLKLNINILTDYSIGLPTI

SEQ ID NO: 3272854 - protein, 20 aa, Plasmodium falciparum
PVYYCKELKTAIPKMDIQFK

SEQ ID NO: 3272855 - protein, 23 aa, Plasmodium falciparum
PYDACKLKLLSYISYAKTPVSKS

SEQ ID NO: 3272856 - protein, 26 aa, Plasmodium falciparum
PYDIWTVGCATYFLTVLIVNFKILFE

SEQ ID NO: 3272857 - protein, 31 aa, Plasmodium falciparum
PYDNLIILYLPIEFCELPSFFYNSENIESSF

SEQ ID NO: 3272858 - protein, 22 aa, Plasmodium falciparum
PYDRFKTDMIVIFSDILIIFVA

SEQ ID NO: 3272859 - protein, 18 aa, Plasmodium falciparum
PYENYMILYVIYRLKANN

SEQ ID NO: 3272860 - protein, 20 aa, Plasmodium falciparum
PYERIKDIIKIIKHANNNIG

SEQ ID NO: 3272861 - protein, 18 aa, Plasmodium falciparum
PYFCLKVLYHKKLYFLSS

SEQ ID NO: 3272862 - protein, 35 aa, Plasmodium falciparum
PYFISRKKIKAFYEHMYKFLIYRILLVENDTLNEC

SEQ ID NO: 3272863 - protein, 25 aa, Plasmodium falciparum
PYFPQPKFEEWWIIATYKNDDRILK

SEQ ID NO: 3272864 - protein, 17 aa, Plasmodium falciparum
PYFRYLEEWGEEFCRKQ

SEQ ID NO: 3272865 - protein, 19 aa, Plasmodium falciparum
PYFYETFEYFFNVLCLLYF

SEQ ID NO: 3272866 - protein, 19 aa, Plasmodium falciparum
PYGNYVFSMDRFIYKRKRR

SEQ ID NO: 3272867 - protein, 18 aa, Plasmodium falciparum
PYIDHIDHIISLIESLKH

SEQ ID NO: 3272868 - protein, 20 aa, Plasmodium falciparum
PYIISRIITVVPQFIISNKL

SEQ ID NO: 3272869 - protein, 25 aa, Plasmodium falciparum
PYIKKICKILYIIEIYNNFKNDSNK

SEQ ID NO: 3272870 - protein, 19 aa, Plasmodium falciparum
PYIRRKDAHFNLLYENENS

SEQ ID NO: 3272871 - protein, 23 aa, Plasmodium falciparum
PYIWIYRVLFDFVESLFLSSFDN

SEQ ID NO: 3272872 - protein, 19 aa, Plasmodium falciparum
PYKEIKGLYDIYQMNIYLK

SEQ ID NO: 3272873 - protein, 17 aa, Plasmodium falciparum
PYKICIGTLNNIITQSN

SEQ ID NO: 3272874 - protein, 26 aa, Plasmodium falciparum
PYKNINHSFYIYGLVFSNCSIYFDDL

SEQ ID NO: 3272875 - protein, 25 aa, Plasmodium falciparum
PYKNWSIEFMDNIIIIKIINIMNIE

SEQ ID NO: 3272876 - protein, 24 aa, Plasmodium falciparum
PYKTLEWVLDLSYFPIIKEAHPKE

SEQ ID NO: 3272877 - protein, 17 aa, Plasmodium falciparum
PYLDLSYNVDSYYNYRN

SEQ ID NO: 3272878 - protein, 17 aa, Plasmodium falciparum
PYLEESILNSFYNIQLG

SEQ ID NO: 3272879 - protein, 18 aa, Plasmodium falciparum
PYLPPALKNAMLSSTIMW

SEQ ID NO: 3272880 - protein, 19 aa, Plasmodium falciparum
PYLVTNLFKSLRFYIFHKY

SEQ ID NO: 3272881 - protein, 18 aa, Plasmodium falciparum
PYLYVESCEYFKQQNSSA

SEQ ID NO: 3272882 - protein, 21 aa, Plasmodium falciparum
PYMHKPTCIPTYIYTNTYILI

SEQ ID NO: 3272883 - protein, 19 aa, Plasmodium falciparum
PYNDISMDCYKHMDVDNYN

SEQ ID NO: 3272884 - protein, 18 aa, Plasmodium falciparum
PYNFKSIFIKNELNDLNK

SEQ ID NO: 3272885 - protein, 30 aa, Plasmodium falciparum
PYNKIKYHNIWKGFNIFTFNLFNVDYNDKI

SEQ ID NO: 3272886 - protein, 33 aa, Plasmodium falciparum
PYNKNTLCGYKYKKKRRFRFFFYRNNINKPLES

SEQ ID NO: 3272887 - protein, 19 aa, Plasmodium falciparum
PYNKPHKSPIERRKQIISQ

SEQ ID NO: 3272888 - protein, 17 aa, Plasmodium falciparum
PYPTIHIPFFPRSPRIY

SEQ ID NO: 3272889 - protein, 21 aa, Plasmodium falciparum
PYQTLHIHWSFIPLTYGLITL

SEQ ID NO: 3272890 - protein, 18 aa, Plasmodium falciparum
PYSYEYISPLDILNISNL

SEQ ID NO: 3272891 - protein, 25 aa, Plasmodium falciparum
PYTRSCFYDSIFLCEAAELSPHIKY

SEQ ID NO: 3272892 - protein, 19 aa, Plasmodium falciparum
PYTRYKACEILFEKEYDQN

SEQ ID NO: 3272893 - protein, 18 aa, Plasmodium falciparum
PYVPPFTCKYCFRTDETF

SEQ ID NO: 3272894 - protein, 19 aa, Plasmodium falciparum
PYYIHKMIFFFNNMFSSHT

SEQ ID NO: 3272895 - protein, 20 aa, Plasmodium falciparum
PYYIYDFFINYPLLKWYITN

SEQ ID NO: 3272896 - protein, 18 aa, Plasmodium falciparum
PYYLLEVISKDALRNLSK

SEQ ID NO: 3272897 - protein, 17 aa, Plasmodium falciparum
PYYWVPPPPALEYTKGF

SEQ ID NO: 3272898 - protein, 19 aa, Plasmodium falciparum
QAAYHICVYYFMRKNYSKC

SEQ ID NO: 3272899 - protein, 22 aa, Plasmodium falciparum
QAETYMPIILSMYLNNLLTMYN

SEQ ID NO: 3272900 - protein, 25 aa, Plasmodium falciparum
QALYFSGSIPLHFTKDKGGWGVKQG

SEQ ID NO: 3272901 - protein, 26 aa, Plasmodium falciparum
QAMKFLKEFKFMFFFYIFIYIISIYI

SEQ ID NO: 3272902 - protein, 18 aa, Plasmodium falciparum
QASIWRETVSSLKTCDII

SEQ ID NO: 3272903 - protein, 21 aa, Plasmodium falciparum
QAVLFPLYTFVILRLPFVNAV

SEQ ID NO: 3272904 - protein, 21 aa, Plasmodium falciparum
QCAMDFWMMYNNYSSSFYEKY

SEQ ID NO: 3272905 - protein, 19 aa, Plasmodium falciparum
QCDILSYNIIKDMYKNLDN

SEQ ID NO: 3272906 - protein, 17 aa, Plasmodium falciparum
QCFPNFLGKNIPCLVPQ

SEQ ID NO: 3272907 - protein, 20 aa, Plasmodium falciparum
QCLGKAYSVFHKNFERAQIA

SEQ ID NO: 3272908 - protein, 21 aa, Plasmodium falciparum
QCLLLNIPHFCLGRDRLTELT

SEQ ID NO: 3272909 - protein, 17 aa, Plasmodium falciparum
QCLPKKGYFIYMFKSIN

SEQ ID NO: 3272910 - protein, 20 aa, Plasmodium falciparum
QCTDKSYYVVVFLLPECYDY

SEQ ID NO: 3272911 - protein, 17 aa, Plasmodium falciparum
QCTLINFSVTCEGLEEQ

SEQ ID NO: 3272912 - protein, 23 aa, Plasmodium falciparum
QCYKCKKNYAVVFTREKSCKECF

SEQ ID NO: 3272913 - protein, 20 aa, Plasmodium falciparum
QDADRYCDLNGYDCEKTKRG

SEQ ID NO: 3272914 - protein, 18 aa, Plasmodium falciparum
QDAIKILLEHELEDAKKC

SEQ ID NO: 3272915 - protein, 21 aa, Plasmodium falciparum
QDAKHLLDMIGEVVQKQAYSE

SEQ ID NO: 3272916 - protein, 33 aa, Plasmodium falciparum
QDDDKRNSFDIFPFFKKFKGIRTKLLSYYDIDT

SEQ ID NO: 3272917 - protein, 24 aa, Plasmodium falciparum
QDEYIFLLHFFFFLIFYFYSKPKK

SEQ ID NO: 3272918 - protein, 17 aa, Plasmodium falciparum
QDFSSLYFYHYYPCTNI

SEQ ID NO: 3272919 - protein, 27 aa, Plasmodium falciparum
QDGSFFFKMIICFFCTYNYDGFLSGVP

SEQ ID NO: 3272920 - protein, 20 aa, Plasmodium falciparum
QDGTSIWFRPEVLKATQDGI

SEQ ID NO: 3272921 - protein, 28 aa, Plasmodium falciparum
QDIHFFPIPPIFFFMKILPSNCIFFPNN

SEQ ID NO: 3272922 - protein, 22 aa, Plasmodium falciparum
QDIKGSNLFKGFIEEPSSKKSP

SEQ ID NO: 3272923 - protein, 17 aa, Plasmodium falciparum
QDILKKHINIIALEKSN

SEQ ID NO: 3272924 - protein, 23 aa, Plasmodium falciparum
QDISSLIQIMVMFFSHYKLKDLI

SEQ ID NO: 3272925 - protein, 20 aa, Plasmodium falciparum
QDIWYIFFHYVISLKRKIEQ

SEQ ID NO: 3272926 - protein, 20 aa, Plasmodium falciparum
QDIYKSYLFISLCLSSDEQI

SEQ ID NO: 3272927 - protein, 23 aa, Plasmodium falciparum
QDKEIYKKLNVSIVHNDISNNIN

SEQ ID NO: 3272928 - protein, 20 aa, Plasmodium falciparum
QDLFFYFNIYQYVKKKKKEK

SEQ ID NO: 3272929 - protein, 21 aa, Plasmodium falciparum
QDLIPRIALTNDKKHFKTLDD

SEQ ID NO: 3272930 - protein, 21 aa, Plasmodium falciparum
QDLKKKICEHMAYVHTSTNEM

SEQ ID NO: 3272931 - protein, 19 aa, Plasmodium falciparum
QDLYQKWTCYEIDELEKDE

SEQ ID NO: 3272932 - protein, 26 aa, Plasmodium falciparum
QDMIIYFSRKAFYPWETNVEQQKKQT

SEQ ID NO: 3272933 - protein, 18 aa, Plasmodium falciparum
QDNCCYKIKTIVLINNIQ

SEQ ID NO: 3272934 - protein, 19 aa, Plasmodium falciparum
QDTEIIEPFYEYKKQETEI

SEQ ID NO: 3272935 - protein, 23 aa, Plasmodium falciparum
QDTEKNVQCTIHINNMLNKENIK

SEQ ID NO: 3272936 - protein, 17 aa, Plasmodium falciparum
QDTSSICNIDFNIDHIN

SEQ ID NO: 3272937 - protein, 25 aa, Plasmodium falciparum
QDYDFLKRKILSLYKNKEDNLNELI

SEQ ID NO: 3272938 - protein, 18 aa, Plasmodium falciparum
QEAIRLSILGSNKREPSS

SEQ ID NO: 3272939 - protein, 23 aa, Plasmodium falciparum
QECIDIILCSGKYNNNRRSFLGS

SEQ ID NO: 3272940 - protein, 17 aa, Plasmodium falciparum
QECVVAHEVEGEYTSDN

SEQ ID NO: 3272941 - protein, 18 aa, Plasmodium falciparum
QEDIKKKLQLFINTHSPT

SEQ ID NO: 3272942 - protein, 19 aa, Plasmodium falciparum
QEDLLKWFIETAAIETFFL

SEQ ID NO: 3272943 - protein, 18 aa, Plasmodium falciparum
QEDLLKWFVKSAAVETFF

SEQ ID NO: 3272944 - protein, 19 aa, Plasmodium falciparum
QEDNYLISYEILKNYFEKI

SEQ ID NO: 3272945 - protein, 17 aa, Plasmodium falciparum
QEEIEEIVVEELPIDEH

SEQ ID NO: 3272946 - protein, 23 aa, Plasmodium falciparum
QEESEIKFSIQILVEEGNQMYLI

SEQ ID NO: 3272947 - protein, 25 aa, Plasmodium falciparum
QEFSNIIWSLAVCNYYNYDMLILLY

SEQ ID NO: 3272948 - protein, 19 aa, Plasmodium falciparum
QEHIYLFLHLIDYYINVLE

SEQ ID NO: 3272949 - protein, 21 aa, Plasmodium falciparum
QEILHVIYFLFLFYIKLPSNV

SEQ ID NO: 3272950 - protein, 41 aa, Plasmodium falciparum
QEKCSIRFGVFFFITLSNFLLCIIIYMKLIRNLGQGTYLKL

SEQ ID NO: 3272951 - protein, 28 aa, Plasmodium falciparum
QEKDKFKRLYVLAALGLIAKLKLILFFS

SEQ ID NO: 3272952 - protein, 24 aa, Plasmodium falciparum
QEKFRASFIFIDTWALMVGFPIIR

SEQ ID NO: 3272953 - protein, 18 aa, Plasmodium falciparum
QELFLSSFFFVYISTDDV

SEQ ID NO: 3272954 - protein, 19 aa, Plasmodium falciparum
QELKERWINEEKYILYEQE

SEQ ID NO: 3272955 - protein, 21 aa, Plasmodium falciparum
QELKHMGWSGDFIIKKNVKKM

SEQ ID NO: 3272956 - protein, 25 aa, Plasmodium falciparum
QELNELRRITGWYKYATKDKYIEAF

SEQ ID NO: 3272957 - protein, 20 aa, Plasmodium falciparum
QELYKVWSYIGGEKNNCHIW

SEQ ID NO: 3272958 - protein, 24 aa, Plasmodium falciparum
QEMPEKSIHYFLLKEVDYDVSHEN

SEQ ID NO: 3272959 - protein, 26 aa, Plasmodium falciparum
QENEMKRYVSIDSIYGLHEINKIDKE

SEQ ID NO: 3272960 - protein, 21 aa, Plasmodium falciparum
QENKNICDIYCMKNIVHFYLN

SEQ ID NO: 3272961 - protein, 23 aa, Plasmodium falciparum
QENKVKIVVCTDVMSRGIDNIVC

SEQ ID NO: 3272962 - protein, 61 aa, Plasmodium falciparum
QEPIPKKFLRKIKIYRRLEFSLIFTLCETRKKLHAYSSITRRIDSFLSDYAFFSESQKFRF

SEQ ID NO: 3272963 - protein, 19 aa, Plasmodium falciparum
QEQIIRVLLERILAHRPHP

SEQ ID NO: 3272964 - protein, 24 aa, Plasmodium falciparum
QEQSMLPPYWIEKIEECSEDINNM

SEQ ID NO: 3272965 - protein, 18 aa, Plasmodium falciparum
QERKCCICMVSDFFYPNL

SEQ ID NO: 3272966 - protein, 20 aa, Plasmodium falciparum
QERPCLMRATSMEDIHDGCI

SEQ ID NO: 3272967 - protein, 29 aa, Plasmodium falciparum
QESILKLVRRLMSILLSFLASVVLLFLFG

SEQ ID NO: 3272968 - protein, 24 aa, Plasmodium falciparum
QESVCTSANNITCFNTENMLADKY

SEQ ID NO: 3272969 - protein, 18 aa, Plasmodium falciparum
QETDKIFISDSVQNILHK

SEQ ID NO: 3272970 - protein, 21 aa, Plasmodium falciparum
QETYLFLPLADYKLSGYGDGA

SEQ ID NO: 3272971 - protein, 19 aa, Plasmodium falciparum
QEWDEHFVFMRRNSYDIPI

SEQ ID NO: 3272972 - protein, 35 aa, Plasmodium falciparum
QEWEDMFIIDWLLGDDIFCVIKLEFFDKSINKKIE

SEQ ID NO: 3272973 - protein, 25 aa, Plasmodium falciparum
QEWHISPYCIYVFPKENKYFSVSTS

SEQ ID NO: 3272974 - protein, 25 aa, Plasmodium falciparum
QEYCKSNENTWCFRNMCLKDKNKEN

SEQ ID NO: 3272975 - protein, 18 aa, Plasmodium falciparum
QEYKECNRLFTLNYKKLY

SEQ ID NO: 3272976 - protein, 25 aa, Plasmodium falciparum
QEYLDFYLSTFGYKFHTFILEYKTG

SEQ ID NO: 3272977 - protein, 26 aa, Plasmodium falciparum
QFCENSFFFLFKFIYIYMYKIIKNVN

SEQ ID NO: 3272978 - protein, 23 aa, Plasmodium falciparum
QFHKISNVYFFFIGILQVIPQFT

SEQ ID NO: 3272979 - protein, 17 aa, Plasmodium falciparum
QFIGVVVNFLYLIILLS

SEQ ID NO: 3272980 - protein, 26 aa, Plasmodium falciparum
QFINKELVRALGLWLEFNDNPTNASS

SEQ ID NO: 3272981 - protein, 27 aa, Plasmodium falciparum
QFISSILPYICFSFMLFFPHILICLYI

SEQ ID NO: 3272982 - protein, 18 aa, Plasmodium falciparum
QFKEICFDYISYFQNINS

SEQ ID NO: 3272983 - protein, 21 aa, Plasmodium falciparum
QFKIDFLIVVVKRLLIILTGM

SEQ ID NO: 3272984 - protein, 26 aa, Plasmodium falciparum
QFKLLFLEGHIFKNCLIEMKSIHRFS

SEQ ID NO: 3272985 - protein, 18 aa, Plasmodium falciparum
QFLLKRHRVKFILTLKGR

SEQ ID NO: 3272986 - protein, 20 aa, Plasmodium falciparum
QFLLPINVSYNIPKTGMLHS

SEQ ID NO: 3272987 - protein, 17 aa, Plasmodium falciparum
QFLLYSFLKKQFFLNKS

SEQ ID NO: 3272988 - protein, 24 aa, Plasmodium falciparum
QFLRLPNIWFLLISLLEFIPQYQN

SEQ ID NO: 3272989 - protein, 23 aa, Plasmodium falciparum
QFLRWFKEWGDDFCEKRKEKIYS

SEQ ID NO: 3272990 - protein, 25 aa, Plasmodium falciparum
QFLRWFQEWTEIFCIKRKTLYDKMV

SEQ ID NO: 3272991 - protein, 21 aa, Plasmodium falciparum
QFLWCMLYFKSPGFYKENHMF

SEQ ID NO: 3272992 - protein, 18 aa, Plasmodium falciparum
QFLYFLFKVHEIRNIEFH

SEQ ID NO: 3272993 - protein, 25 aa, Plasmodium falciparum
QFNEDICQLINIIICCYNSLTYNFV

SEQ ID NO: 3272994 - protein, 27 aa, Plasmodium falciparum
QFNEIRRLKKKMLKYIYSDKKSDKIII

SEQ ID NO: 3272995 - protein, 20 aa, Plasmodium falciparum
QFPKCAIIISAKYLALFLSL

SEQ ID NO: 3272996 - protein, 20 aa, Plasmodium falciparum
QFSGSLCRSDCNSNYNKDIE

SEQ ID NO: 3272997 - protein, 18 aa, Plasmodium falciparum
QFYDDCIYIWKRLQENNN

SEQ ID NO: 3272998 - protein, 17 aa, Plasmodium falciparum
QFYNCLEKELLDTQNKK

SEQ ID NO: 3272999 - protein, 20 aa, Plasmodium falciparum
QGCNDKCECVKEWLSKKKQE

SEQ ID NO: 3273000 - protein, 26 aa, Plasmodium falciparum
QGEECKKCSVVCIPFGPWIDNQKQEF

SEQ ID NO: 3273001 - protein, 18 aa, Plasmodium falciparum
QGKLFCNYGSMFGENVDN

SEQ ID NO: 3273002 - protein, 22 aa, Plasmodium falciparum
QGKLSILLCYKSWKKGKKTKKK

SEQ ID NO: 3273003 - protein, 21 aa, Plasmodium falciparum
QGKLSYKTVEMILRHFLMQCG

SEQ ID NO: 3273004 - protein, 17 aa, Plasmodium falciparum
QGKRPGVKISLMTYEAR

SEQ ID NO: 3273005 - protein, 27 aa, Plasmodium falciparum
QGKSLIKFLIGIAIFLVVLIFIKSSHP

SEQ ID NO: 3273006 - protein, 19 aa, Plasmodium falciparum
QGLEIFDIYWITIEKDNKY

SEQ ID NO: 3273007 - protein, 33 aa, Plasmodium falciparum
QGLTFECLYRFLNIYPPNPFRIVYLEKVLKMID

SEQ ID NO: 3273008 - protein, 17 aa, Plasmodium falciparum
QGLTLIDFFLLMQEISL

SEQ ID NO: 3273009 - protein, 17 aa, Plasmodium falciparum
QGMLCGLSHAVSARDKE

SEQ ID NO: 3273010 - protein, 27 aa, Plasmodium falciparum
QGMMYGRPYYPWVPFMGDGRGYNFYNP

SEQ ID NO: 3273011 - protein, 19 aa, Plasmodium falciparum
QGNLYVLHCEVQCLNGNNE

SEQ ID NO: 3273012 - protein, 35 aa, Plasmodium falciparum
QGNMLPYNFFLFIKALHLMSIYDIIKNFYITIEYD

SEQ ID NO: 3273013 - protein, 24 aa, Plasmodium falciparum
QGPWRFLEIISIILVFFIGMTYNA

SEQ ID NO: 3273014 - protein, 22 aa, Plasmodium falciparum
QGSYIRSKCIGRNMFNNLYLYH

SEQ ID NO: 3273015 - protein, 27 aa, Plasmodium falciparum
QGTYYCFLLFYVLCTKTKLLLSTCKIN

SEQ ID NO: 3273016 - protein, 25 aa, Plasmodium falciparum
QHEKVRVKLMLQRLSNSYLEAVNNF

SEQ ID NO: 3273017 - protein, 17 aa, Plasmodium falciparum
QHFKKNSSFILSISEII

SEQ ID NO: 3273018 - protein, 17 aa, Plasmodium falciparum
QHILKNIGLFLFGSINT

SEQ ID NO: 3273019 - protein, 18 aa, Plasmodium falciparum
QHILRTIKIKTLEDLEKK

SEQ ID NO: 3273020 - protein, 20 aa, Plasmodium falciparum
QHKCRHNFYHILSKVETYMN

SEQ ID NO: 3273021 - protein, 18 aa, Plasmodium falciparum
QHKLLTIRFDYKKMREYM

SEQ ID NO: 3273022 - protein, 18 aa, Plasmodium falciparum
QHMYEIFLDINFFSTSTF

SEQ ID NO: 3273023 - protein, 17 aa, Plasmodium falciparum
QHREVILFRNLVESKTF

SEQ ID NO: 3273024 - protein, 18 aa, Plasmodium falciparum
QHSLDHILCPSVSIDTTT

SEQ ID NO: 3273025 - protein, 25 aa, Plasmodium falciparum
QHTDYCGTCSLIGVKCKKGHCDNAA

SEQ ID NO: 3273026 - protein, 20 aa, Plasmodium falciparum
QICILISCNVIKALKKILNN

SEQ ID NO: 3273027 - protein, 28 aa, Plasmodium falciparum
QICTIFLCTCTFFLLIFYKSLKALRQHR

SEQ ID NO: 3273028 - protein, 17 aa, Plasmodium falciparum
QICVKKGNKKNVVKKKK

SEQ ID NO: 3273029 - protein, 23 aa, Plasmodium falciparum
QIDKLLTCMCRNLGISKYINHIN

SEQ ID NO: 3273030 - protein, 19 aa, Plasmodium falciparum
QIEIPRYIIFNEENKHVKY

SEQ ID NO: 3273031 - protein, 18 aa, Plasmodium falciparum
QIESYKITLNYFIYFVNA

SEQ ID NO: 3273032 - protein, 21 aa, Plasmodium falciparum
QIFIRDCKTTINILKRDNESF

SEQ ID NO: 3273033 - protein, 22 aa, Plasmodium falciparum
QIFNYLWKKYINQYVIIKNMFI

SEQ ID NO: 3273034 - protein, 20 aa, Plasmodium falciparum
QIIDFCLNTNWNIIQIKKKS

SEQ ID NO: 3273035 - protein, 19 aa, Plasmodium falciparum
QIIHHLLFLYYYFTVKKYY

SEQ ID NO: 3273036 - protein, 23 aa, Plasmodium falciparum
QIIIFYYKCELYVSNYDNDPDLE

SEQ ID NO: 3273037 - protein, 29 aa, Plasmodium falciparum
QIIIIRALFKIWLEYFLEDYNKIKKKLNP

SEQ ID NO: 3273038 - protein, 20 aa, Plasmodium falciparum
QIIIITAFVKLWVEYFFEDY

SEQ ID NO: 3273039 - protein, 22 aa, Plasmodium falciparum
QIIKFMAIHGENEKECIEYLKQ

SEQ ID NO: 3273040 - protein, 22 aa, Plasmodium falciparum
QIIKRKKNVFLKDAFSCARLKL

SEQ ID NO: 3273041 - protein, 23 aa, Plasmodium falciparum
QIINHCICFNKLFFNNIQTYLLL

SEQ ID NO: 3273042 - protein, 21 aa, Plasmodium falciparum
QIIPNFLCNNIYLGENRILHM

SEQ ID NO: 3273043 - protein, 21 aa, Plasmodium falciparum
QIISRIFKLLNHLVSSKYFDF

SEQ ID NO: 3273044 - protein, 26 aa, Plasmodium falciparum
QIIVIKGKGSFYFNLQIEKGIFIEKK

SEQ ID NO: 3273045 - protein, 33 aa, Plasmodium falciparum
QIKKIYCFICIINKFCKFFENINLEKNLENIIS

SEQ ID NO: 3273046 - protein, 25 aa, Plasmodium falciparum
QIKNIFYIFITRINLQYIQKCICYN

SEQ ID NO: 3273047 - protein, 24 aa, Plasmodium falciparum
QIKNRISSLLSREFIFFKNNNYHY

SEQ ID NO: 3273048 - protein, 19 aa, Plasmodium falciparum
QIKSYINVIEDLRKEISEM

SEQ ID NO: 3273049 - protein, 25 aa, Plasmodium falciparum
QILCNMKILLFENFYLLKNTIKIYN

SEQ ID NO: 3273050 - protein, 23 aa, Plasmodium falciparum
QILKEPFFYLTVEKKYINEKEKE

SEQ ID NO: 3273051 - protein, 17 aa, Plasmodium falciparum
QILRYIILRKIEILYVF

SEQ ID NO: 3273052 - protein, 25 aa, Plasmodium falciparum
QILTKRNIEVYKEIVKHYNIDNIFI

SEQ ID NO: 3273053 - protein, 37 aa, Plasmodium falciparum
QILTSYEWHGHGAFESFVSIWRFKKRYSKSYTSTKSV

SEQ ID NO: 3273054 - protein, 24 aa, Plasmodium falciparum
QILWIETCLFLLYQNGIILVYTPV

SEQ ID NO: 3273055 - protein, 28 aa, Plasmodium falciparum
QILYELSLHLYFFIIFVYHLLNFLFTEN

SEQ ID NO: 3273056 - protein, 18 aa, Plasmodium falciparum
QILYVLLFCSVMCGLFYY

SEQ ID NO: 3273057 - protein, 19 aa, Plasmodium falciparum
QIMKAWAADPVYRKHVNVL

SEQ ID NO: 3273058 - protein, 20 aa, Plasmodium falciparum
QIMKRSRTLTFFNMKKKKNV

SEQ ID NO: 3273059 - protein, 22 aa, Plasmodium falciparum
QINHDIKNGFTFSKDIYNNNAF

SEQ ID NO: 3273060 - protein, 20 aa, Plasmodium falciparum
QINILFFFKLLHVLDICNYK

SEQ ID NO: 3273061 - protein, 19 aa, Plasmodium falciparum
QINRKLCSKRNFTKKSRKI

SEQ ID NO: 3273062 - protein, 26 aa, Plasmodium falciparum
QINVQFCKGIHKIKYNEYCYSYIKCN

SEQ ID NO: 3273063 - protein, 18 aa, Plasmodium falciparum
QIPLAMGAINGYVPSGDD

SEQ ID NO: 3273064 - protein, 26 aa, Plasmodium falciparum
QIQLSENVWKIFKLALSPKWMNNEDF

SEQ ID NO: 3273065 - protein, 26 aa, Plasmodium falciparum
QIRHIYCHLCNIYLYDFDTYMKHVNK

SEQ ID NO: 3273066 - protein, 21 aa, Plasmodium falciparum
QIRIYALLPIFVIVVLVCIIK

SEQ ID NO: 3273067 - protein, 19 aa, Plasmodium falciparum
QIRKCGFSSEYFKFDSSSD

SEQ ID NO: 3273068 - protein, 24 aa, Plasmodium falciparum
QISFYLFKILIKYHDPVLSEILEN

SEQ ID NO: 3273069 - protein, 19 aa, Plasmodium falciparum
QISQWNWYYSLEEQYFNWQ

SEQ ID NO: 3273070 - protein, 17 aa, Plasmodium falciparum
QITCLTFNFLYISKKNS

SEQ ID NO: 3273071 - protein, 26 aa, Plasmodium falciparum
QITKKKGKLGFNFLFALIKNYIKNCK

SEQ ID NO: 3273072 - protein, 18 aa, Plasmodium falciparum
QIVNKIIYMYSLLLNIYA

SEQ ID NO: 3273073 - protein, 25 aa, Plasmodium falciparum
QIVSYPFLVLRTRMQTLNNEIATNY

SEQ ID NO: 3273074 - protein, 32 aa, Plasmodium falciparum
QIYADMFYKKFHCRNLSSFMCRNVSQKNVKNF

SEQ ID NO: 3273075 - protein, 17 aa, Plasmodium falciparum
QIYELYKDIINSFYKSY

SEQ ID NO: 3273076 - protein, 22 aa, Plasmodium falciparum
QIYKDKRINFMNPHKVNMYHDN

SEQ ID NO: 3273077 - protein, 25 aa, Plasmodium falciparum
QIYKQCKYESIYYCDHIMNDIYENF

SEQ ID NO: 3273078 - protein, 21 aa, Plasmodium falciparum
QIYQYSIHLLFNYKKYKTNKI

SEQ ID NO: 3273079 - protein, 28 aa, Plasmodium falciparum
QIYTCLLCLHLNIIKFCYYIRPYNNKKN

SEQ ID NO: 3273080 - protein, 17 aa, Plasmodium falciparum
QKAKYKFIIDGFPRNYD

SEQ ID NO: 3273081 - protein, 19 aa, Plasmodium falciparum
QKALLKAFVESAAVETFFL

SEQ ID NO: 3273082 - protein, 24 aa, Plasmodium falciparum
QKALQILLRLSHRGGVQGNNGDGA

SEQ ID NO: 3273083 - protein, 24 aa, Plasmodium falciparum
QKCFKGCKENCDCVKKWVEEKEKE

SEQ ID NO: 3273084 - protein, 26 aa, Plasmodium falciparum
QKCLQNCYKIIIPHNTFITLMIECYI

SEQ ID NO: 3273085 - protein, 17 aa, Plasmodium falciparum
QKDFPLSYIEQSLLGSL

SEQ ID NO: 3273086 - protein, 25 aa, Plasmodium falciparum
QKEKELKNMTGICFHCTCRKLEKKN

SEQ ID NO: 3273087 - protein, 24 aa, Plasmodium falciparum
QKEKLQLPMLMEFENYTQTPYISV

SEQ ID NO: 3273088 - protein, 34 aa, Plasmodium falciparum
QKEPKFITCIFWMTFKSLSVFFKPAVDEFIKIVQ

SEQ ID NO: 3273089 - protein, 24 aa, Plasmodium falciparum
QKESEHILVLCLKKLNEYEKIKDK

SEQ ID NO: 3273090 - protein, 23 aa, Plasmodium falciparum
QKEYKLIHNIKWYKGGKQETRIP

SEQ ID NO: 3273091 - protein, 31 aa, Plasmodium falciparum
QKEYSSIMTPMFKDFMETHRISSKLSKTILV

SEQ ID NO: 3273092 - protein, 25 aa, Plasmodium falciparum
QKFCIEFHYHIPYIILKENKYIFQV

SEQ ID NO: 3273093 - protein, 25 aa, Plasmodium falciparum
QKFDHIFISILYKFHMLKEEDVEDI

SEQ ID NO: 3273094 - protein, 20 aa, Plasmodium falciparum
QKHEKILTLDIFYKNISYSL

SEQ ID NO: 3273095 - protein, 17 aa, Plasmodium falciparum
QKICIARALTRYPKILL

SEQ ID NO: 3273096 - protein, 18 aa, Plasmodium falciparum
QKICSIPNNYIINYDNII

SEQ ID NO: 3273097 - protein, 26 aa, Plasmodium falciparum
QKIFDFRNYTIFKWSITIWASLYVQL

SEQ ID NO: 3273098 - protein, 23 aa, Plasmodium falciparum
QKIFFLIPLCLVKLMNINTNLFN

SEQ ID NO: 3273099 - protein, 22 aa, Plasmodium falciparum
QKIKCKHTYILTKYFDKQIKRH

SEQ ID NO: 3273100 - protein, 17 aa, Plasmodium falciparum
QKILYKILRDLIILLGP

SEQ ID NO: 3273101 - protein, 23 aa, Plasmodium falciparum
QKIQECLYIVLTIDEHVECYTRE

SEQ ID NO: 3273102 - protein, 25 aa, Plasmodium falciparum
QKISMPKERWFGYIKDYDGGTLMEC

SEQ ID NO: 3273103 - protein, 24 aa, Plasmodium falciparum
QKIYCSKYFYMFDLSKVMFINTHL

SEQ ID NO: 3273104 - protein, 22 aa, Plasmodium falciparum
QKIYFYYSIHFFISILLLPIMI

SEQ ID NO: 3273105 - protein, 21 aa, Plasmodium falciparum
QKIYIKMIMNLSCIPISNYLH

SEQ ID NO: 3273106 - protein, 24 aa, Plasmodium falciparum
QKKEELRLLVTEMYKHNNKIKKKY

SEQ ID NO: 3273107 - protein, 28 aa, Plasmodium falciparum
QKKFKNKLLRRLIVPNIHLDNVIQFLLN

SEQ ID NO: 3273108 - protein, 21 aa, Plasmodium falciparum
QKKGIVCPFLHGMNNEKKDNT

SEQ ID NO: 3273109 - protein, 25 aa, Plasmodium falciparum
QKKGKEFSDHWILSARFDIKNKNRN

SEQ ID NO: 3273110 - protein, 32 aa, Plasmodium falciparum
QKKGLLFISGVTWHLFGLVKIYQSFYIHGFRK

SEQ ID NO: 3273111 - protein, 19 aa, Plasmodium falciparum
QKKKCIRNFVNIYDHISLH

SEQ ID NO: 3273112 - protein, 23 aa, Plasmodium falciparum
QKKKNVCFWINIKHIHKNMMILK

SEQ ID NO: 3273113 - protein, 17 aa, Plasmodium falciparum
QKKRWIYILKHFLTKKL

SEQ ID NO: 3273114 - protein, 27 aa, Plasmodium falciparum
QKLFMKRIYCYPRFHKHIHISLNNKFL

SEQ ID NO: 3273115 - protein, 26 aa, Plasmodium falciparum
QKLIINFLYDCIYFTMKYEKKKIYFS

SEQ ID NO: 3273116 - protein, 22 aa, Plasmodium falciparum
QKLIKLQSCFDNIMNNNNNKES

SEQ ID NO: 3273117 - protein, 17 aa, Plasmodium falciparum
QKLLLLLTYDFVHYCIY

SEQ ID NO: 3273118 - protein, 40 aa, Plasmodium falciparum
QKLNLLIKAMFTFKFKCLLSICFFRFTSAFASNLMSNIFF

SEQ ID NO: 3273119 - protein, 19 aa, Plasmodium falciparum
QKLPRHVMDTNNNVPSINN

SEQ ID NO: 3273120 - protein, 18 aa, Plasmodium falciparum
QKLSNLICNNKNNILQKK

SEQ ID NO: 3273121 - protein, 27 aa, Plasmodium falciparum
QKLTPMWCFLLKYFITTIFIFLLISNL

SEQ ID NO: 3273122 - protein, 19 aa, Plasmodium falciparum
QKLYQEWKCYQLEELTKVV

SEQ ID NO: 3273123 - protein, 27 aa, Plasmodium falciparum
QKMKIYFKNGYIFYGYFTPDFKRHGIG

SEQ ID NO: 3273124 - protein, 25 aa, Plasmodium falciparum
QKMLYLCVYNIIYLLKKIKINFMTL

SEQ ID NO: 3273125 - protein, 22 aa, Plasmodium falciparum
QKNEILQTFYLINKKSELENIM

SEQ ID NO: 3273126 - protein, 18 aa, Plasmodium falciparum
QKNGEHIWNGMICALTYE

SEQ ID NO: 3273127 - protein, 19 aa, Plasmodium falciparum
QKNILKIIIYIENKVYDMN

SEQ ID NO: 3273128 - protein, 17 aa, Plasmodium falciparum
QKNISIKLITMLYLPIS

SEQ ID NO: 3273129 - protein, 22 aa, Plasmodium falciparum
QKNKEIIVSILIDKLIKIKHKN

SEQ ID NO: 3273130 - protein, 26 aa, Plasmodium falciparum
QKNKLKDMWEAILINMSFFDEHVIND

SEQ ID NO: 3273131 - protein, 26 aa, Plasmodium falciparum
QKNPILHLWKIYSFQKCPHNYYCEQE

SEQ ID NO: 3273132 - protein, 20 aa, Plasmodium falciparum
QKPTFEFLLCLENKKINDEV

SEQ ID NO: 3273133 - protein, 22 aa, Plasmodium falciparum
QKRHGGIPFYSFLKRPKIKIKN

SEQ ID NO: 3273134 - protein, 25 aa, Plasmodium falciparum
QKRMKFTILCKVFNLFSQYLEIVIK

SEQ ID NO: 3273135 - protein, 19 aa, Plasmodium falciparum
QKRTHLFACGIKRKSIKWI

SEQ ID NO: 3273136 - protein, 21 aa, Plasmodium falciparum
QKRVFYKLNVETVLSSCWFLD

SEQ ID NO: 3273137 - protein, 18 aa, Plasmodium falciparum
QKRYAFFSKIFGDIEKKI

SEQ ID NO: 3273138 - protein, 20 aa, Plasmodium falciparum
QKSDENIIVYGYLLNDELIF

SEQ ID NO: 3273139 - protein, 19 aa, Plasmodium falciparum
QKSKLLFYVFYKKKRKKSI

SEQ ID NO: 3273140 - protein, 17 aa, Plasmodium falciparum
QKSKVVKIFNNFQEFSN

SEQ ID NO: 3273141 - protein, 25 aa, Plasmodium falciparum
QKSRKFKEIFISFIKRDDSKKTEDM

SEQ ID NO: 3273142 - protein, 26 aa, Plasmodium falciparum
QKSYIKHCYILAFSFISHVLNNVIPS

SEQ ID NO: 3273143 - protein, 28 aa, Plasmodium falciparum
QKTFHDFFYFWIGRFLNDSMYWRGKVNS

SEQ ID NO: 3273144 - protein, 34 aa, Plasmodium falciparum
QKTFNEFFYFWIGRFLNDSMYWRGKVNSCINKSK

SEQ ID NO: 3273145 - protein, 27 aa, Plasmodium falciparum
QKTFNEFFYFWIVRFLNDSMYWRGKIG

SEQ ID NO: 3273146 - protein, 29 aa, Plasmodium falciparum
QKTFNPFFYYWVVHMLKDSIHWRTKKLDK

SEQ ID NO: 3273147 - protein, 17 aa, Plasmodium falciparum
QKTHISSSVHKKISNDL

SEQ ID NO: 3273148 - protein, 23 aa, Plasmodium falciparum
QKTQECALCKAACDAYKKEIEKW

SEQ ID NO: 3273149 - protein, 17 aa, Plasmodium falciparum
QKVLLIKKIEDLRKIEL

SEQ ID NO: 3273150 - protein, 30 aa, Plasmodium falciparum
QKVTSYNAFFWKWVHDMLHDSVEWRERLNS

SEQ ID NO: 3273151 - protein, 25 aa, Plasmodium falciparum
QKVTSYNAFFWKWVSEMLDDSIKWR

SEQ ID NO: 3273152 - protein, 17 aa, Plasmodium falciparum
QKYEILTTLFILFIPLI

SEQ ID NO: 3273153 - protein, 25 aa, Plasmodium falciparum
QKYGYPQRHWGWKCISDTTTGKSGD

SEQ ID NO: 3273154 - protein, 24 aa, Plasmodium falciparum
QKYGYPQRHWGWRCVAPSDTTKTT

SEQ ID NO: 3273155 - protein, 19 aa, Plasmodium falciparum
QKYIKRFLLKKLKKDEKIL

SEQ ID NO: 3273156 - protein, 24 aa, Plasmodium falciparum
QKYILRMVNGLSIIKNIDKEFKDF

SEQ ID NO: 3273157 - protein, 17 aa, Plasmodium falciparum
QKYITFQPFVSWNYIDC

SEQ ID NO: 3273158 - protein, 25 aa, Plasmodium falciparum
QKYKINIFDIYKYFMKWIKNTKDII

SEQ ID NO: 3273159 - protein, 22 aa, Plasmodium falciparum
QKYNILPSFNCRDCGKYCTFYK

SEQ ID NO: 3273160 - protein, 21 aa, Plasmodium falciparum
QKYTIETSILITYEKIYNFLL

SEQ ID NO: 3273161 - protein, 17 aa, Plasmodium falciparum
QKYVIIYFYDYLKILKQ

SEQ ID NO: 3273162 - protein, 22 aa, Plasmodium falciparum
QLCTALARSFADIGDIVRGKDL

SEQ ID NO: 3273163 - protein, 22 aa, Plasmodium falciparum
QLCTVLARSFADIGDIVRGKDL

SEQ ID NO: 3273164 - protein, 25 aa, Plasmodium falciparum
QLDVFKLRLKPFYYNIKIDISNIGP

SEQ ID NO: 3273165 - protein, 52 aa, Plasmodium falciparum
QLEKQLHFKFCLDIFFLKNMKLISLEASKPWIFYWCIHSIHILYNTFEIEEK

SEQ ID NO: 3273166 - protein, 17 aa, Plasmodium falciparum
QLENFLKGMNFNNKFFF

SEQ ID NO: 3273167 - protein, 26 aa, Plasmodium falciparum
QLFNKYRLYIIFIFIILTFLLILSIK

SEQ ID NO: 3273168 - protein, 19 aa, Plasmodium falciparum
QLFPQYDNMIFKNNFDHQP

SEQ ID NO: 3273169 - protein, 23 aa, Plasmodium falciparum
QLHFIRSRFQLSFIFLSGPLSDI

SEQ ID NO: 3273170 - protein, 17 aa, Plasmodium falciparum
QLICKYIIIQIVKCNNV

SEQ ID NO: 3273171 - protein, 25 aa, Plasmodium falciparum
QLIFIFSLILSFFILKRKYNIHHII

SEQ ID NO: 3273172 - protein, 26 aa, Plasmodium falciparum
QLIFKNFRMNLNIRKINDMYVEIEIH

SEQ ID NO: 3273173 - protein, 26 aa, Plasmodium falciparum
QLIKDTRISTGIGIMAYIQKNISLEL

SEQ ID NO: 3273174 - protein, 26 aa, Plasmodium falciparum
QLIKEIKILFLWIYKLTNIEIRPLIH

SEQ ID NO: 3273175 - protein, 27 aa, Plasmodium falciparum
QLILPDTLKLLPLFTSCLLKHNVVKKD

SEQ ID NO: 3273176 - protein, 25 aa, Plasmodium falciparum
QLIQEFLKNLKIVYFFNYSLMFKFF

SEQ ID NO: 3273177 - protein, 28 aa, Plasmodium falciparum
QLIYKNFYSIFLHYYYRYSEVKMIKLNK

SEQ ID NO: 3273178 - protein, 18 aa, Plasmodium falciparum
QLKAVRWMELSVGSIIRL

SEQ ID NO: 3273179 - protein, 24 aa, Plasmodium falciparum
QLKKRVYSYYSLIPIYGNIQQTEK

SEQ ID NO: 3273180 - protein, 17 aa, Plasmodium falciparum
QLKLICYQILYIHEYTL

SEQ ID NO: 3273181 - protein, 30 aa, Plasmodium falciparum
QLLDSGIIPPEFLRSMFYTFGDYRDICLDT

SEQ ID NO: 3273182 - protein, 29 aa, Plasmodium falciparum
QLLQMKGIFCILYILIVQIYIFFINNYFY

SEQ ID NO: 3273183 - protein, 19 aa, Plasmodium falciparum
QLLTPRPFLFLSHLVVVFI

SEQ ID NO: 3273184 - protein, 42 aa, Plasmodium falciparum
QLLYDHFNSLTLPAVIYWSIQHIYDLLVIIVINYIFFLDLKK

SEQ ID NO: 3273185 - protein, 24 aa, Plasmodium falciparum
QLLYLDFFECISLNEKVDINEIKK

SEQ ID NO: 3273186 - protein, 25 aa, Plasmodium falciparum
QLNEVLSGYFSRCAISIYNKNTKEV

SEQ ID NO: 3273187 - protein, 24 aa, Plasmodium falciparum
QLNKKLFLCKKCEETILIKFEPIY

SEQ ID NO: 3273188 - protein, 19 aa, Plasmodium falciparum
QLNYAFKLIIIGSTSIIAS

SEQ ID NO: 3273189 - protein, 27 aa, Plasmodium falciparum
QLPKMPREYIVRLVFDRNHYTFCLLKK

SEQ ID NO: 3273190 - protein, 28 aa, Plasmodium falciparum
QLPLIKKKFEKYILQYVCTRTTNVESIS

SEQ ID NO: 3273191 - protein, 23 aa, Plasmodium falciparum
QLQHKINNLMIISFDKNKSSDLM

SEQ ID NO: 3273192 - protein, 23 aa, Plasmodium falciparum
QLQSFLRFVSGRSRLPTTKNDWY

SEQ ID NO: 3273193 - protein, 22 aa, Plasmodium falciparum
QLRGLQALCMLSKYFKHLKKKK

SEQ ID NO: 3273194 - protein, 34 aa, Plasmodium falciparum
QLRGRNGKSIFIYLNKICHVYELFSDDKDINNCD

SEQ ID NO: 3273195 - protein, 27 aa, Plasmodium falciparum
QLRKFSVKGLRSMIFAFRYLSEEETIK

SEQ ID NO: 3273196 - protein, 25 aa, Plasmodium falciparum
QLSDFKPSYYIRILYKSLYKNKKEK

SEQ ID NO: 3273197 - protein, 20 aa, Plasmodium falciparum
QLTLLLLLISIIVFISTYGF

SEQ ID NO: 3273198 - protein, 25 aa, Plasmodium falciparum
QLTYEGFKILTIHDIQKLTNIVSSC

SEQ ID NO: 3273199 - protein, 24 aa, Plasmodium falciparum
QLYLDLFHPFLFVIYYFVVTSNPG

SEQ ID NO: 3273200 - protein, 29 aa, Plasmodium falciparum
QLYMKYILNEFSKFFKLFKFLNKNVENID

SEQ ID NO: 3273201 - protein, 18 aa, Plasmodium falciparum
QLYQVCSLLLKSTKNKDL

SEQ ID NO: 3273202 - protein, 18 aa, Plasmodium falciparum
QLYYRIQTFVLSFDKIKK

SEQ ID NO: 3273203 - protein, 25 aa, Plasmodium falciparum
QMEAKLAVCMGGRTAEEIVFGKSET

SEQ ID NO: 3273204 - protein, 18 aa, Plasmodium falciparum
QMHMFYFLFEINSDQPKY

SEQ ID NO: 3273205 - protein, 17 aa, Plasmodium falciparum
QMIKRYYNISVMNENIY

SEQ ID NO: 3273206 - protein, 25 aa, Plasmodium falciparum
QMILWMIIIVLHLMNMKKLKVISEE

SEQ ID NO: 3273207 - protein, 20 aa, Plasmodium falciparum
QMIQIFKSIHLYIHDNNSNL

SEQ ID NO: 3273208 - protein, 24 aa, Plasmodium falciparum
QMKARKESVLSFLYDQNVGRINNY

SEQ ID NO: 3273209 - protein, 22 aa, Plasmodium falciparum
QMKIDRCTFFFDKKYINEEDIL

SEQ ID NO: 3273210 - protein, 21 aa, Plasmodium falciparum
QMKLKRGNVCVGKDKVDVNRK

SEQ ID NO: 3273211 - protein, 25 aa, Plasmodium falciparum
QMLFFKKEILINFAQCLIDLDNPNS

SEQ ID NO: 3273212 - protein, 25 aa, Plasmodium falciparum
QMLSDTCQLPFLLPEKGEYAVAQIF

SEQ ID NO: 3273213 - protein, 24 aa, Plasmodium falciparum
QMNDCLDILFNYIFNNIKRIIIIK

SEQ ID NO: 3273214 - protein, 23 aa, Plasmodium falciparum
QMNELRIIFCICESTKKSMSTLE

SEQ ID NO: 3273215 - protein, 17 aa, Plasmodium falciparum
QMVNVLGAIDFIGNPLI

SEQ ID NO: 3273216 - protein, 20 aa, Plasmodium falciparum
QNCKDKFYALKKIKFHANPK

SEQ ID NO: 3273217 - protein, 17 aa, Plasmodium falciparum
QNDKKTCIRKCNDNCKC

SEQ ID NO: 3273218 - protein, 23 aa, Plasmodium falciparum
QNDLCKRYWKDLDKMWLENEDKI

SEQ ID NO: 3273219 - protein, 22 aa, Plasmodium falciparum
QNDYIKRWNIVKLKNEIISEII

SEQ ID NO: 3273220 - protein, 26 aa, Plasmodium falciparum
QNELNECMDFLALLYIAKNEKSKLML

SEQ ID NO: 3273221 - protein, 25 aa, Plasmodium falciparum
QNELNLYYTFWLIYKSIKSMDERFE

SEQ ID NO: 3273222 - protein, 17 aa, Plasmodium falciparum
QNEVYQKQIEYFKEQID

SEQ ID NO: 3273223 - protein, 19 aa, Plasmodium falciparum
QNFCKKRKGMLENIKKECM

SEQ ID NO: 3273224 - protein, 19 aa, Plasmodium falciparum
QNFCKKRTEMLGKIKDNCT

SEQ ID NO: 3273225 - protein, 19 aa, Plasmodium falciparum
QNFCKKRTEMLGKIKEECR

SEQ ID NO: 3273226 - protein, 19 aa, Plasmodium falciparum
QNFCKKRTEMLGKIKGDCR

SEQ ID NO: 3273227 - protein, 28 aa, Plasmodium falciparum
QNFEDYELICFGETDALSGNKFRETSEQ

SEQ ID NO: 3273228 - protein, 28 aa, Plasmodium falciparum
QNFILKIELSFHKNIFPYKMYIDENYDD

SEQ ID NO: 3273229 - protein, 17 aa, Plasmodium falciparum
QNFKNRIIGLLKNKFNV

SEQ ID NO: 3273230 - protein, 17 aa, Plasmodium falciparum
QNFMYRKIRNMSDKLLD

SEQ ID NO: 3273231 - protein, 25 aa, Plasmodium falciparum
QNFPERNPNLIIVDDFIKTLINDNI

SEQ ID NO: 3273232 - protein, 18 aa, Plasmodium falciparum
QNFPRPKSFRLNMNSSSV

SEQ ID NO: 3273233 - protein, 17 aa, Plasmodium falciparum
QNGIWNKCIERNRYILE

SEQ ID NO: 3273234 - protein, 24 aa, Plasmodium falciparum
QNIDLCLFIYKLLYISVNTNILKN

SEQ ID NO: 3273235 - protein, 17 aa, Plasmodium falciparum
QNIFKYYFNKFLKIKIE

SEQ ID NO: 3273236 - protein, 18 aa, Plasmodium falciparum
QNIIELLVCLYKIEINKN

SEQ ID NO: 3273237 - protein, 23 aa, Plasmodium falciparum
QNIIPKYSIKFHCINLCLDIIEY

SEQ ID NO: 3273238 - protein, 18 aa, Plasmodium falciparum
QNILRYITIRGKGSHDAR

SEQ ID NO: 3273239 - protein, 19 aa, Plasmodium falciparum
QNIPLKVIIGRSGLVGEDG

SEQ ID NO: 3273240 - protein, 24 aa, Plasmodium falciparum
QNISFLNFLSFDWIRPLINDLIKG

SEQ ID NO: 3273241 - protein, 18 aa, Plasmodium falciparum
QNIYKGSLLIKINETDLS

SEQ ID NO: 3273242 - protein, 27 aa, Plasmodium falciparum
QNIYLKFLFSLSFTPLFIHGSPNLPLR

SEQ ID NO: 3273243 - protein, 21 aa, Plasmodium falciparum
QNKLRTQHGFDVKKEKKIINN

SEQ ID NO: 3273244 - protein, 23 aa, Plasmodium falciparum
QNKTKYFVHNFFKKNNVHPYYKS

SEQ ID NO: 3273245 - protein, 24 aa, Plasmodium falciparum
QNLIKCKIMIIDVIKILSENYQDE

SEQ ID NO: 3273246 - protein, 21 aa, Plasmodium falciparum
QNLKCTVKICPYNKEQTKTSQ

SEQ ID NO: 3273247 - protein, 20 aa, Plasmodium falciparum
QNLLLIKRLISIFRNKLYLN

SEQ ID NO: 3273248 - protein, 18 aa, Plasmodium falciparum
QNLTWAFDGNKKENYIGN

SEQ ID NO: 3273249 - protein, 18 aa, Plasmodium falciparum
QNNFIPILMIIDTPASNN

SEQ ID NO: 3273250 - protein, 18 aa, Plasmodium falciparum
QNNICLNDKIGDIIVSRN

SEQ ID NO: 3273251 - protein, 19 aa, Plasmodium falciparum
QNNLMKIYAKIYMNHSSMT

SEQ ID NO: 3273252 - protein, 17 aa, Plasmodium falciparum
QNNNFFMYIFSKIKNVY

SEQ ID NO: 3273253 - protein, 18 aa, Plasmodium falciparum
QNNTLVFGFSLEFHTNFQ

SEQ ID NO: 3273254 - protein, 23 aa, Plasmodium falciparum
QNPKNMRPGFCPQNDTTEQQEEE

SEQ ID NO: 3273255 - protein, 19 aa, Plasmodium falciparum
QNRCWEIINIIKVSFIIIP

SEQ ID NO: 3273256 - protein, 18 aa, Plasmodium falciparum
QNRKRFSNRINLLPYNIL

SEQ ID NO: 3273257 - protein, 17 aa, Plasmodium falciparum
QNRKVSLGMQHLINNIG

SEQ ID NO: 3273258 - protein, 22 aa, Plasmodium falciparum
QNRYTDMYPFFQANTNQKVASD

SEQ ID NO: 3273259 - protein, 37 aa, Plasmodium falciparum
QNSQCKNEKLMLYLSFLLKHIHKLNCEQNNMLTFQKF

SEQ ID NO: 3273260 - protein, 24 aa, Plasmodium falciparum
QNTFLKIIFLQVVKSKHFDRFIVV

SEQ ID NO: 3273261 - protein, 25 aa, Plasmodium falciparum
QNVIKLQNWLASWEDVCIKGIKKPA

SEQ ID NO: 3273262 - protein, 33 aa, Plasmodium falciparum
QNVKIKKFFCDFIYLPYTIKYGYIRSLDLQIPL

SEQ ID NO: 3273263 - protein, 18 aa, Plasmodium falciparum
QNVKNCRKLSTHSMEKYG

SEQ ID NO: 3273264 - protein, 25 aa, Plasmodium falciparum
QNVVYRYSLLELIELDFYVYYKENF

SEQ ID NO: 3273265 - protein, 25 aa, Plasmodium falciparum
QNVYFCYKNNFSLLKSSILKFICCI

SEQ ID NO: 3273266 - protein, 30 aa, Plasmodium falciparum
QNYEAEELLKLCTMIKMFKGHEKIKQIINK

SEQ ID NO: 3273267 - protein, 18 aa, Plasmodium falciparum
QNYLTSFLKGIWLKKDHS

SEQ ID NO: 3273268 - protein, 18 aa, Plasmodium falciparum
QNYLYVVIFLFFVINILL

SEQ ID NO: 3273269 - protein, 18 aa, Plasmodium falciparum
QPCPICGMKKKGGKWEAK

SEQ ID NO: 3273270 - protein, 20 aa, Plasmodium falciparum
QPDIFKSLHIDMTLQKNVRE

SEQ ID NO: 3273271 - protein, 25 aa, Plasmodium falciparum
QPIMTKRWWFYGILPHTIFEALCVL

SEQ ID NO: 3273272 - protein, 32 aa, Plasmodium falciparum
QPLISLGCIMMRKCHLNICPVGICTQDPELRK

SEQ ID NO: 3273273 - protein, 18 aa, Plasmodium falciparum
QPLYQCLLFYKNGTYQFG

SEQ ID NO: 3273274 - protein, 22 aa, Plasmodium falciparum
QPNPDILFLYLVEIFLFPDKDC

SEQ ID NO: 3273275 - protein, 23 aa, Plasmodium falciparum
QPPMFRNTLLVFTGIEPTYCYKD

SEQ ID NO: 3273276 - protein, 23 aa, Plasmodium falciparum
QPTDSRLPCFIYDSSNNITNMLL

SEQ ID NO: 3273277 - protein, 20 aa, Plasmodium falciparum
QPYESINCYAGLVRNTCSTD

SEQ ID NO: 3273278 - protein, 41 aa, Plasmodium falciparum
QPYLNHRIHKMFSYFLMYVFMFFCYNDIFKTLNLDQDKIKL

SEQ ID NO: 3273279 - protein, 26 aa, Plasmodium falciparum
QQIAICLTGLLFTRFAYMIKPRNLNL

SEQ ID NO: 3273280 - protein, 24 aa, Plasmodium falciparum
QQKELKLQVLEIYNSKLDERIYRK

SEQ ID NO: 3273281 - protein, 31 aa, Plasmodium falciparum
QQKKIKKKEMETIKKWKEKKDEWELEETNFL

SEQ ID NO: 3273282 - protein, 22 aa, Plasmodium falciparum
QQKRVIQYIIVKIILLLFFYFN

SEQ ID NO: 3273283 - protein, 18 aa, Plasmodium falciparum
QQLIFYNTIEGIRKNQNG

SEQ ID NO: 3273284 - protein, 24 aa, Plasmodium falciparum
QQLILCILFEPYIFKNKYKNVEED

SEQ ID NO: 3273285 - protein, 25 aa, Plasmodium falciparum
QQNEFSLLCCNFLSNINNNICINEK

SEQ ID NO: 3273286 - protein, 25 aa, Plasmodium falciparum
QQNTLKIFPLFLLDSSTHNLPIVHL

SEQ ID NO: 3273287 - protein, 25 aa, Plasmodium falciparum
QQSRLKEIMSFMTLGSLSAYTLFSA

SEQ ID NO: 3273288 - protein, 24 aa, Plasmodium falciparum
QQTWWKKYGEDIWNGMICALTYDT

SEQ ID NO: 3273289 - protein, 29 aa, Plasmodium falciparum
QQYYICNTFFLKIVKSFSRHFNIMNNKQA

SEQ ID NO: 3273290 - protein, 19 aa, Plasmodium falciparum
QRAYKILKNNGSWKDVCNS

SEQ ID NO: 3273291 - protein, 26 aa, Plasmodium falciparum
QRCESLRLFLYFGIVTFLSLDLLINP

SEQ ID NO: 3273292 - protein, 17 aa, Plasmodium falciparum
QRCKECTCNFDEIIEKY

SEQ ID NO: 3273293 - protein, 22 aa, Plasmodium falciparum
QREGVRIGRIRKIFDLFSKVLK

SEQ ID NO: 3273294 - protein, 22 aa, Plasmodium falciparum
QREILNTMLPPFVVDEMIYSEL

SEQ ID NO: 3273295 - protein, 22 aa, Plasmodium falciparum
QRERCTYIIAKLARVIAMTCTH

SEQ ID NO: 3273296 - protein, 24 aa, Plasmodium falciparum
QRGFKLSLYLNKLIIYDYNKINIC

SEQ ID NO: 3273297 - protein, 17 aa, Plasmodium falciparum
QRGMKDEVDEWIKKYDD

SEQ ID NO: 3273298 - protein, 19 aa, Plasmodium falciparum
QRHTAFIMALMNAFENIGS

SEQ ID NO: 3273299 - protein, 21 aa, Plasmodium falciparum
QRHVKSLFKYHNIYNINNKIM

SEQ ID NO: 3273300 - protein, 20 aa, Plasmodium falciparum
QRINFKPILFYSNTSNIIIL

SEQ ID NO: 3273301 - protein, 26 aa, Plasmodium falciparum
QRKHKEIVELLALMGNSSIFIISGII

SEQ ID NO: 3273302 - protein, 26 aa, Plasmodium falciparum
QRKLNKLRTLVDVHLDVIEKMQRDEW

SEQ ID NO: 3273303 - protein, 17 aa, Plasmodium falciparum
QRKNFLLEYSVESSRRK

SEQ ID NO: 3273304 - protein, 19 aa, Plasmodium falciparum
QRKNFLLKLKCSANVSKRN

SEQ ID NO: 3273305 - protein, 26 aa, Plasmodium falciparum
QRKTCFNIALYYCFLKLLNKKLQNSY

SEQ ID NO: 3273306 - protein, 25 aa, Plasmodium falciparum
QRKYFRILLLFVHFRAIKKKKFLHF

SEQ ID NO: 3273307 - protein, 23 aa, Plasmodium falciparum
QRLKNARIHFMDKLSYLKKKEKK

SEQ ID NO: 3273308 - protein, 25 aa, Plasmodium falciparum
QRLPTAVTCGFRLLLPQYSSLDILK

SEQ ID NO: 3273309 - protein, 20 aa, Plasmodium falciparum
QRLSDFMLYQISEFTEIYFI

SEQ ID NO: 3273310 - protein, 23 aa, Plasmodium falciparum
QRMLKHIFSDLSLFELTIVGDFS

SEQ ID NO: 3273311 - protein, 34 aa, Plasmodium falciparum
QRNSVDIKFVFILSLCRLYLPIYIYLYPHNIFQL

SEQ ID NO: 3273312 - protein, 22 aa, Plasmodium falciparum
QRQKELYLRGAKYNNNSNNMKI

SEQ ID NO: 3273313 - protein, 18 aa, Plasmodium falciparum
QRQKIIWKKWIAKHPNKM

SEQ ID NO: 3273314 - protein, 18 aa, Plasmodium falciparum
QRQKIIWKKWIAKHPYKI

SEQ ID NO: 3273315 - protein, 18 aa, Plasmodium falciparum
QRQKIIWRKWIAKHPYRI

SEQ ID NO: 3273316 - protein, 18 aa, Plasmodium falciparum
QRVPADCILLRNLNKNEE

SEQ ID NO: 3273317 - protein, 21 aa, Plasmodium falciparum
QRVVDFLKQLLLRNSAAARNR

SEQ ID NO: 3273318 - protein, 19 aa, Plasmodium falciparum
QRYNRCLAEFGSVRNIFNW

SEQ ID NO: 3273319 - protein, 18 aa, Plasmodium falciparum
QSAFKKHIKPSARRTNLY

SEQ ID NO: 3273320 - protein, 27 aa, Plasmodium falciparum
QSESYHYLYNPSFIKRSKTNNEVNTLT

SEQ ID NO: 3273321 - protein, 23 aa, Plasmodium falciparum
QSFLWNRWMERQTYMLDKYKEEE

SEQ ID NO: 3273322 - protein, 26 aa, Plasmodium falciparum
QSIDILCIYEKLNIRDYRIIKYLYNL

SEQ ID NO: 3273323 - protein, 24 aa, Plasmodium falciparum
QSIEPSNLIPLGHYCNNLVLIGDH

SEQ ID NO: 3273324 - protein, 18 aa, Plasmodium falciparum
QSISSFLYATRMNNDSNL

SEQ ID NO: 3273325 - protein, 17 aa, Plasmodium falciparum
QSIYKKRIELHKEDYFS

SEQ ID NO: 3273326 - protein, 26 aa, Plasmodium falciparum
QSKIQICLFSLKYDKMINEINKDLDI

SEQ ID NO: 3273327 - protein, 22 aa, Plasmodium falciparum
QSLLKMKRFISMNDMENNNWIQ

SEQ ID NO: 3273328 - protein, 26 aa, Plasmodium falciparum
QSLYPSILIAFNICYSTCLGTITLKR

SEQ ID NO: 3273329 - protein, 22 aa, Plasmodium falciparum
QSMCHYRLQLLKDLEKNEEGIL

SEQ ID NO: 3273330 - protein, 28 aa, Plasmodium falciparum
QSNDGDCLNGFICKKCKKTHAKSPNICF

SEQ ID NO: 3273331 - protein, 24 aa, Plasmodium falciparum
QSNLYKRFSLTLNKSFVHNNNIKS

SEQ ID NO: 3273332 - protein, 22 aa, Plasmodium falciparum
QSPKLLSLLIRRHNILLHTIQT

SEQ ID NO: 3273333 - protein, 23 aa, Plasmodium falciparum
QSPLRFSKCISEFLNMYNTSPKK

SEQ ID NO: 3273334 - protein, 19 aa, Plasmodium falciparum
QSRGYRAGTKFLLQATSMG

SEQ ID NO: 3273335 - protein, 21 aa, Plasmodium falciparum
QSSFVFYNWNIRTFIDPYNNF

SEQ ID NO: 3273336 - protein, 23 aa, Plasmodium falciparum
QSTFLNYKCHLLIIKAHRFLNAY

SEQ ID NO: 3273337 - protein, 22 aa, Plasmodium falciparum
QSTWGRCILNLGMEVASEQKEF

SEQ ID NO: 3273338 - protein, 17 aa, Plasmodium falciparum
QSVDIKCFKTWFNNINY

SEQ ID NO: 3273339 - protein, 24 aa, Plasmodium falciparum
QSYFSQEILQIFINFTRKLKTIYI

SEQ ID NO: 3273340 - protein, 17 aa, Plasmodium falciparum
QSYYFYRKSVHVAKTSS

SEQ ID NO: 3273341 - protein, 18 aa, Plasmodium falciparum
QTDSCLIGGPATDKSKTI

SEQ ID NO: 3273342 - protein, 21 aa, Plasmodium falciparum
QTFITCIFIYSLIWSVGSNTY

SEQ ID NO: 3273343 - protein, 17 aa, Plasmodium falciparum
QTFKRNFCSSTNCDKCI

SEQ ID NO: 3273344 - protein, 25 aa, Plasmodium falciparum
QTFKTKENLLYWIEMLKFLRENPQE

SEQ ID NO: 3273345 - protein, 23 aa, Plasmodium falciparum
QTIIKSIMILLIFYNQKNTDIIN

SEQ ID NO: 3273346 - protein, 21 aa, Plasmodium falciparum
QTKIIPIRTANHFIDLFTQYC

SEQ ID NO: 3273347 - protein, 17 aa, Plasmodium falciparum
QTKKCMIDIQMATLMNS

SEQ ID NO: 3273348 - protein, 17 aa, Plasmodium falciparum
QTLDMYILHIYDLISSY

SEQ ID NO: 3273349 - protein, 23 aa, Plasmodium falciparum
QTNKLLLKHAWTVRLDIESLRNE

SEQ ID NO: 3273350 - protein, 27 aa, Plasmodium falciparum
QTSCFGLIFLYEFMRYILKIDKSILFY

SEQ ID NO: 3273351 - protein, 26 aa, Plasmodium falciparum
QTVPLCNFCGIKGMCNINTKHYKMSS

SEQ ID NO: 3273352 - protein, 22 aa, Plasmodium falciparum
QTWWQAHGPDIWNGMVCALTYK

SEQ ID NO: 3273353 - protein, 24 aa, Plasmodium falciparum
QTYAELFIRVAPKFIDPLSNISFQ

SEQ ID NO: 3273354 - protein, 23 aa, Plasmodium falciparum
QTYCSSAFCFVIAPDYHKVLSNY

SEQ ID NO: 3273355 - protein, 17 aa, Plasmodium falciparum
QVCRTLHSMGGCNMYIR

SEQ ID NO: 3273356 - protein, 19 aa, Plasmodium falciparum
QVDVFKFKSYRGRTTKVLK

SEQ ID NO: 3273357 - protein, 20 aa, Plasmodium falciparum
QVEAPKICEGVIKPETKVVD

SEQ ID NO: 3273358 - protein, 31 aa, Plasmodium falciparum
QVIDAYFCRSFYKHMLGRKILPADAESVDPE

SEQ ID NO: 3273359 - protein, 21 aa, Plasmodium falciparum
QVIFLPLIIYFQMLFNKNKNI

SEQ ID NO: 3273360 - protein, 21 aa, Plasmodium falciparum
QVLHIPLYVLDKFYNNLNDLQ

SEQ ID NO: 3273361 - protein, 22 aa, Plasmodium falciparum
QVNKCIYEYFYFEEKIFNIIDH

SEQ ID NO: 3273362 - protein, 18 aa, Plasmodium falciparum
QVQIIICQILYALYYLHI

SEQ ID NO: 3273363 - protein, 26 aa, Plasmodium falciparum
QVQPYPGWDCKLSTFKDKEHGSCMPP

SEQ ID NO: 3273364 - protein, 21 aa, Plasmodium falciparum
QVRYLEYFVILPIISLVTSGI

SEQ ID NO: 3273365 - protein, 23 aa, Plasmodium falciparum
QVSTFVKLFFEKNISVEDISYYV

SEQ ID NO: 3273366 - protein, 24 aa, Plasmodium falciparum
QVVRSICLLISLFFKNASRNIMNI

SEQ ID NO: 3273367 - protein, 25 aa, Plasmodium falciparum
QVYNIPPCFDINYIINVAKKIEVKP

SEQ ID NO: 3273368 - protein, 27 aa, Plasmodium falciparum
QWEDWKVYLEKQWSVWLEISENDKIEW

SEQ ID NO: 3273369 - protein, 18 aa, Plasmodium falciparum
QWIESFILIIEGCNRILL

SEQ ID NO: 3273370 - protein, 24 aa, Plasmodium falciparum
QWKCGKVCGYNVCKPKEGNRETVR

SEQ ID NO: 3273371 - protein, 22 aa, Plasmodium falciparum
QWNIKINLFISYKSLYSKNKEK

SEQ ID NO: 3273372 - protein, 18 aa, Plasmodium falciparum
QWTCGYVCGVDICEQTNV

SEQ ID NO: 3273373 - protein, 29 aa, Plasmodium falciparum
QYCNISDFKSGFIISVSWLCASLISPFIG

SEQ ID NO: 3273374 - protein, 18 aa, Plasmodium falciparum
QYDNMIFKNNFDHQPKIN

SEQ ID NO: 3273375 - protein, 23 aa, Plasmodium falciparum
QYDYKIFFDKAFLDSYLSCEKNE

SEQ ID NO: 3273376 - protein, 18 aa, Plasmodium falciparum
QYFIWCIPFLPIILCAIT

SEQ ID NO: 3273377 - protein, 21 aa, Plasmodium falciparum
QYFYDHIINLILQKKNYLENT

SEQ ID NO: 3273378 - protein, 20 aa, Plasmodium falciparum
QYFYFILFIYFAYFFLQNIL

SEQ ID NO: 3273379 - protein, 23 aa, Plasmodium falciparum
QYHIFKSSFIFLIYQLVFFILLM

SEQ ID NO: 3273380 - protein, 18 aa, Plasmodium falciparum
QYHLFDLFDNYVYIIICL

SEQ ID NO: 3273381 - protein, 25 aa, Plasmodium falciparum
QYIIESFLLKMSIKYNYVLYSPSNK

SEQ ID NO: 3273382 - protein, 25 aa, Plasmodium falciparum
QYIIKKKLECIISLDYYKPLKKALQ

SEQ ID NO: 3273383 - protein, 22 aa, Plasmodium falciparum
QYIKNFCKTYCKEKIYMSTFFF

SEQ ID NO: 3273384 - protein, 18 aa, Plasmodium falciparum
QYILKMLYNFSLHTIGFF

SEQ ID NO: 3273385 - protein, 20 aa, Plasmodium falciparum
QYIRKLYSLINENEKEKFDD

SEQ ID NO: 3273386 - protein, 23 aa, Plasmodium falciparum
QYKKCKAKLLVAFELVPVEKVLD

SEQ ID NO: 3273387 - protein, 23 aa, Plasmodium falciparum
QYLEYFCLAISHSSFVLMYPYLI

SEQ ID NO: 3273388 - protein, 24 aa, Plasmodium falciparum
QYLFNFLLHNFLFYSKDADEYSKK

SEQ ID NO: 3273389 - protein, 18 aa, Plasmodium falciparum
QYLVIILWFNDIKPFFPL

SEQ ID NO: 3273390 - protein, 32 aa, Plasmodium falciparum
QYLYYCIPYICFIKKYILFCAYVSKEKDLIKL

SEQ ID NO: 3273391 - protein, 18 aa, Plasmodium falciparum
QYMGSFFLITGIALIITF

SEQ ID NO: 3273392 - protein, 20 aa, Plasmodium falciparum
QYMHMTLIIAQFILNCNNIN

SEQ ID NO: 3273393 - protein, 27 aa, Plasmodium falciparum
QYSSNAWSIFVVYLLRELLIDGNYDPI

SEQ ID NO: 3273394 - protein, 23 aa, Plasmodium falciparum
QYTFLIQYTHLFADLYNYKILNS

SEQ ID NO: 3273395 - protein, 17 aa, Plasmodium falciparum
QYVPLSFEIIKLKKTKK

SEQ ID NO: 3273396 - protein, 23 aa, Plasmodium falciparum
QYYLRIVPKMSYFEKVMTKDIKV

SEQ ID NO: 3273397 - protein, 36 aa, Plasmodium falciparum
QYYMSLELFNGMKFLLDKYNFFLSRMHKNSIFSKNK

SEQ ID NO: 3273398 - protein, 27 aa, Plasmodium falciparum
RAACNIFLKKWNTVIEDCNKSIHLNDN

SEQ ID NO: 3273399 - protein, 18 aa, Plasmodium falciparum
RAEGMKLLGQKMQKLAKR

SEQ ID NO: 3273400 - protein, 25 aa, Plasmodium falciparum
RAFFAGRAGERFAVRNSGAIAVVEG

SEQ ID NO: 3273401 - protein, 18 aa, Plasmodium falciparum
RAGTKFLLQATSMGTVSW

SEQ ID NO: 3273402 - protein, 26 aa, Plasmodium falciparum
RAHPLSLILEHKFKEWIDSSPAGFYF

SEQ ID NO: 3273403 - protein, 22 aa, Plasmodium falciparum
RAIVTLCKKNIVGCIVTNIYNI

SEQ ID NO: 3273404 - protein, 18 aa, Plasmodium falciparum
RAKGKLRYGNRCTDCLYA

SEQ ID NO: 3273405 - protein, 26 aa, Plasmodium falciparum
RALKYFKKVFLLLLFFFGNPMCSLNS

SEQ ID NO: 3273406 - protein, 24 aa, Plasmodium falciparum
RALLKRWVDHFLEDYIKIKHKISH

SEQ ID NO: 3273407 - protein, 23 aa, Plasmodium falciparum
RALMRRWVEHFLEDYNRIKHKIS

SEQ ID NO: 3273408 - protein, 17 aa, Plasmodium falciparum
RALTYPGSLFIYQNKTN

SEQ ID NO: 3273409 - protein, 23 aa, Plasmodium falciparum
RALVRRWVEYFLEDYNKIRKKLK

SEQ ID NO: 3273410 - protein, 20 aa, Plasmodium falciparum
RANECLNRKRVEYFHVEKIH

SEQ ID NO: 3273411 - protein, 31 aa, Plasmodium falciparum
RANIEIYNLLFIIICLFFRRASLLNLIIYTH

SEQ ID NO: 3273412 - protein, 17 aa, Plasmodium falciparum
RANRKGLAISFIDKKDV

SEQ ID NO: 3273413 - protein, 24 aa, Plasmodium falciparum
RARACNALGNIGCETASEVELLIK

SEQ ID NO: 3273414 - protein, 27 aa, Plasmodium falciparum
RATEIAYKMVTEWGMSDKLGPLNYKKR

SEQ ID NO: 3273415 - protein, 17 aa, Plasmodium falciparum
RATSLSINNVIFKGSHI

SEQ ID NO: 3273416 - protein, 31 aa, Plasmodium falciparum
RAVQHLPELFEFYIHICGPILHFDNLTNGIV

SEQ ID NO: 3273417 - protein, 19 aa, Plasmodium falciparum
RAVYPLKCIETESFKIMIL

SEQ ID NO: 3273418 - protein, 18 aa, Plasmodium falciparum
RCADDCKSYETWVEKKKK

SEQ ID NO: 3273419 - protein, 18 aa, Plasmodium falciparum
RCADDCKSYETWVENKKK

SEQ ID NO: 3273420 - protein, 18 aa, Plasmodium falciparum
RCALSKVIMMYKLMIINS

SEQ ID NO: 3273421 - protein, 17 aa, Plasmodium falciparum
RCAQNLGGIVAPSSGVL

SEQ ID NO: 3273422 - protein, 19 aa, Plasmodium falciparum
RCAQNLGGLVPGMGLIGGT

SEQ ID NO: 3273423 - protein, 17 aa, Plasmodium falciparum
RCDIMKLSDHVNSIELL

SEQ ID NO: 3273424 - protein, 18 aa, Plasmodium falciparum
RCEDFPNISDRCVNNISI

SEQ ID NO: 3273425 - protein, 19 aa, Plasmodium falciparum
RCHDDNKVLLTLYMGGSNH

SEQ ID NO: 3273426 - protein, 18 aa, Plasmodium falciparum
RCHELKYKSKDEINEESC

SEQ ID NO: 3273427 - protein, 17 aa, Plasmodium falciparum
RCIKSTLKKGSKSFLSI

SEQ ID NO: 3273428 - protein, 18 aa, Plasmodium falciparum
RCINGFLKTLTKIVINTQ

SEQ ID NO: 3273429 - protein, 20 aa, Plasmodium falciparum
RCIQISDNIFNHFEKNKNLE

SEQ ID NO: 3273430 - protein, 26 aa, Plasmodium falciparum
RCLLSNKRLGAYVIMNILDQFYNSEN

SEQ ID NO: 3273431 - protein, 17 aa, Plasmodium falciparum
RCLNHILKNYYNILEYH

SEQ ID NO: 3273432 - protein, 20 aa, Plasmodium falciparum
RCSFIKLRMYLYHILIDVFE

SEQ ID NO: 3273433 - protein, 21 aa, Plasmodium falciparum
RCSLRKPHLLFPLLECHEEKK

SEQ ID NO: 3273434 - protein, 18 aa, Plasmodium falciparum
RCTSSIVDRACNGILNNS

SEQ ID NO: 3273435 - protein, 26 aa, Plasmodium falciparum
RCTTAAPGFFNFFSFDNNIYADGAIC

SEQ ID NO: 3273436 - protein, 18 aa, Plasmodium falciparum
RCYEQCRKYRKWIDIKFE

SEQ ID NO: 3273437 - protein, 17 aa, Plasmodium falciparum
RDAEIVAAIAAAKEAGA

SEQ ID NO: 3273438 - protein, 23 aa, Plasmodium falciparum
RDAKAYCKKALINDQLVPTNDTN

SEQ ID NO: 3273439 - protein, 20 aa, Plasmodium falciparum
RDANPDVYYIYLMDTLDIEK

SEQ ID NO: 3273440 - protein, 34 aa, Plasmodium falciparum
RDDCKDDGCKWCMAHSKFKIDILTLNFFMGSKRS

SEQ ID NO: 3273441 - protein, 19 aa, Plasmodium falciparum
RDDVLFPLCNKNIINDVQK

SEQ ID NO: 3273442 - protein, 20 aa, Plasmodium falciparum
RDEKGSIPYNMFKDDNNKEN

SEQ ID NO: 3273443 - protein, 22 aa, Plasmodium falciparum
RDENIIKIGVAFLNNDMLHFRK

SEQ ID NO: 3273444 - protein, 24 aa, Plasmodium falciparum
RDETLEIFLQVGLELLHQLNTSRK

SEQ ID NO: 3273445 - protein, 32 aa, Plasmodium falciparum
RDEWKKNKRDFLYICLKEINKLSEDTLMKFYG

SEQ ID NO: 3273446 - protein, 22 aa, Plasmodium falciparum
RDFKNTIYFIFNIIKDKININN

SEQ ID NO: 3273447 - protein, 19 aa, Plasmodium falciparum
RDGGVTWIEAHKGPYIYEY

SEQ ID NO: 3273448 - protein, 22 aa, Plasmodium falciparum
RDGNFYLGFGYVGSDSLLLSTG

SEQ ID NO: 3273449 - protein, 20 aa, Plasmodium falciparum
RDIIPLLFFIDKKLHLNYSL

SEQ ID NO: 3273450 - protein, 27 aa, Plasmodium falciparum
RDIKLWLECLLNYCKFYYLKKNQQKQS

SEQ ID NO: 3273451 - protein, 20 aa, Plasmodium falciparum
RDIKTIYPMIFLSNFYNNKG

SEQ ID NO: 3273452 - protein, 18 aa, Plasmodium falciparum
RDILILTFQCKLKEEKIQ

SEQ ID NO: 3273453 - protein, 20 aa, Plasmodium falciparum
RDILYQCCLIYDYNELGATK

SEQ ID NO: 3273454 - protein, 23 aa, Plasmodium falciparum
RDINEAYQILSLDQRRMNYNKYG

SEQ ID NO: 3273455 - protein, 17 aa, Plasmodium falciparum
RDINFHFFIFNLILYKC

SEQ ID NO: 3273456 - protein, 26 aa, Plasmodium falciparum
RDIPRSPCDLDFWFHTNVWRDKAYER

SEQ ID NO: 3273457 - protein, 26 aa, Plasmodium falciparum
RDISLLCPFCNDIFFLKNDLLNHIAN

SEQ ID NO: 3273458 - protein, 26 aa, Plasmodium falciparum
RDKIKKWLNCICKNKKNIKEFMNIIN

SEQ ID NO: 3273459 - protein, 23 aa, Plasmodium falciparum
RDKKLLFLYTINSFRVIQIYNNI

SEQ ID NO: 3273460 - protein, 17 aa, Plasmodium falciparum
RDKLKMQLNRWKYKNIK

SEQ ID NO: 3273461 - protein, 22 aa, Plasmodium falciparum
RDKSIQFTIFFTKLLKCLLRGY

SEQ ID NO: 3273462 - protein, 19 aa, Plasmodium falciparum
RDLRGICMACNNVETYNMF

SEQ ID NO: 3273463 - protein, 20 aa, Plasmodium falciparum
RDLYCIVYALNCSKFCDLPF

SEQ ID NO: 3273464 - protein, 27 aa, Plasmodium falciparum
RDMREIMKMKLKRTFLTGYHHDVEEPS

SEQ ID NO: 3273465 - protein, 29 aa, Plasmodium falciparum
RDMYSWKPPSFYWKILRNQYVVKEILKLY

SEQ ID NO: 3273466 - protein, 20 aa, Plasmodium falciparum
RDPNLILYKYFQYVDKKNSN

SEQ ID NO: 3273467 - protein, 19 aa, Plasmodium falciparum
RDRLKYIKKYGFINYFGMQ

SEQ ID NO: 3273468 - protein, 17 aa, Plasmodium falciparum
RDTFPLFLRKKKKKLFQ

SEQ ID NO: 3273469 - protein, 32 aa, Plasmodium falciparum
RDTLREMTKPFFLFFRIFNRILVEKSKKLDFI

SEQ ID NO: 3273470 - protein, 18 aa, Plasmodium falciparum
RDTLSMLNNIFNINHNKK

SEQ ID NO: 3273471 - protein, 17 aa, Plasmodium falciparum
RDTWWKTNGEHIWNAMV

SEQ ID NO: 3273472 - protein, 17 aa, Plasmodium falciparum
RDVEVFVTSMINFMNIK

SEQ ID NO: 3273473 - protein, 25 aa, Plasmodium falciparum
RDYERKLFWLFLYNRKRCINDVSYE

SEQ ID NO: 3273474 - protein, 25 aa, Plasmodium falciparum
RDYFFFDRFGDIAVSVGNIINELEN

SEQ ID NO: 3273475 - protein, 18 aa, Plasmodium falciparum
RDYLIGCLSSLINYDDIN

SEQ ID NO: 3273476 - protein, 20 aa, Plasmodium falciparum
RDYSKIILLLSLYKNKFNTF

SEQ ID NO: 3273477 - protein, 21 aa, Plasmodium falciparum
REAIIKCLKIITCLKTNRNSL

SEQ ID NO: 3273478 - protein, 19 aa, Plasmodium falciparum
REARYEIPMRNLSRNEKDN

SEQ ID NO: 3273479 - protein, 26 aa, Plasmodium falciparum
RECAHKILSCHHVFILLYYIYKNKTS

SEQ ID NO: 3273480 - protein, 18 aa, Plasmodium falciparum
RECIHPSGDCFKGDLKES

SEQ ID NO: 3273481 - protein, 26 aa, Plasmodium falciparum
REDKWSCGYFCGLDICTPNKTTGDIH

SEQ ID NO: 3273482 - protein, 17 aa, Plasmodium falciparum
REDWWALNRKEVWKAIT

SEQ ID NO: 3273483 - protein, 24 aa, Plasmodium falciparum
REDWWALNRQEIWKAITCGHPGGT

SEQ ID NO: 3273484 - protein, 18 aa, Plasmodium falciparum
REDWWDANRETVWKAITC

SEQ ID NO: 3273485 - protein, 18 aa, Plasmodium falciparum
REDWWDANRHTVWEAITC

SEQ ID NO: 3273486 - protein, 18 aa, Plasmodium falciparum
REDWWKVNRDQVWEAITC

SEQ ID NO: 3273487 - protein, 24 aa, Plasmodium falciparum
REDWWNINRKKVWDAITCGAAGGT

SEQ ID NO: 3273488 - protein, 18 aa, Plasmodium falciparum
REDWWTANRATIWEAMTC

SEQ ID NO: 3273489 - protein, 21 aa, Plasmodium falciparum
REDWWTANRDQVWKAITCEAP

SEQ ID NO: 3273490 - protein, 19 aa, Plasmodium falciparum
REDWWTANRDQVWKAMTCV

SEQ ID NO: 3273491 - protein, 19 aa, Plasmodium falciparum
REDWWTANRDQVWRAITCY

SEQ ID NO: 3273492 - protein, 19 aa, Plasmodium falciparum
REDWWTANRETVWKAITCE

SEQ ID NO: 3273493 - protein, 23 aa, Plasmodium falciparum
REEFKQDESFVGDKDQIFEDDNY

SEQ ID NO: 3273494 - protein, 25 aa, Plasmodium falciparum
REERKKLCCQISDYCLKYFNFYSIE

SEQ ID NO: 3273495 - protein, 25 aa, Plasmodium falciparum
REESHEMNRRGDIYSNKRYDKRGRI

SEQ ID NO: 3273496 - protein, 18 aa, Plasmodium falciparum
REFLPEYLCIHDKSVYEE

SEQ ID NO: 3273497 - protein, 18 aa, Plasmodium falciparum
REFQSIYLSRNCPLFNLI

SEQ ID NO: 3273498 - protein, 19 aa, Plasmodium falciparum
REGKYGISIFGKIYEIDTL

SEQ ID NO: 3273499 - protein, 20 aa, Plasmodium falciparum
REGNKIKLFHLITCDCLKIK

SEQ ID NO: 3273500 - protein, 20 aa, Plasmodium falciparum
REHPFFKYLFHMNMLEKSGD

SEQ ID NO: 3273501 - protein, 25 aa, Plasmodium falciparum
REHQYWRLITCFLYFGSFGIHFFWD

SEQ ID NO: 3273502 - protein, 19 aa, Plasmodium falciparum
REIEVCKVKVGLKGNTGNK

SEQ ID NO: 3273503 - protein, 21 aa, Plasmodium falciparum
REIHFNFFINYILKKYKERKT

SEQ ID NO: 3273504 - protein, 17 aa, Plasmodium falciparum
REISKVSGIPITSFHYS

SEQ ID NO: 3273505 - protein, 22 aa, Plasmodium falciparum
REIYKFKYLFEKSVNDHSNNYD

SEQ ID NO: 3273506 - protein, 19 aa, Plasmodium falciparum
REIYWKIYNNVYIGHQDSL

SEQ ID NO: 3273507 - protein, 18 aa, Plasmodium falciparum
REKESIEISNLNKRESCT

SEQ ID NO: 3273508 - protein, 34 aa, Plasmodium falciparum
REKINKYFFLIKILTCTILIWAVQYANNSDINKS

SEQ ID NO: 3273509 - protein, 23 aa, Plasmodium falciparum
REKKKFVCCLSDKCNSFLNEQIK

SEQ ID NO: 3273510 - protein, 18 aa, Plasmodium falciparum
REKLYIPNLNMRIGLHYG

SEQ ID NO: 3273511 - protein, 23 aa, Plasmodium falciparum
REKMLCNRKPYSVERRQKLSEII

SEQ ID NO: 3273512 - protein, 17 aa, Plasmodium falciparum
REKNYLASCARKEKFPF

SEQ ID NO: 3273513 - protein, 17 aa, Plasmodium falciparum
RELKEYGDEEMLSCFHR

SEQ ID NO: 3273514 - protein, 35 aa, Plasmodium falciparum
RELKYICLFYIILLFCFFLWCIFKKYHENRINRKH

SEQ ID NO: 3273515 - protein, 20 aa, Plasmodium falciparum
RELLINICALGVTTNSIVAG

SEQ ID NO: 3273516 - protein, 21 aa, Plasmodium falciparum
RELNSGIIPHEFKRQMYYTFG

SEQ ID NO: 3273517 - protein, 21 aa, Plasmodium falciparum
RELNVPFDRYEVDSLCLWSNM

SEQ ID NO: 3273518 - protein, 18 aa, Plasmodium falciparum
RELQICVKDDNELDNNNN

SEQ ID NO: 3273519 - protein, 20 aa, Plasmodium falciparum
RELSVWWNGRANDYHRLCME

SEQ ID NO: 3273520 - protein, 17 aa, Plasmodium falciparum
RELWKRSLAHSLNIQLV

SEQ ID NO: 3273521 - protein, 21 aa, Plasmodium falciparum
REMVLKIIFINKCLEYDNNFF

SEQ ID NO: 3273522 - protein, 17 aa, Plasmodium falciparum
RENHHFDDIYKLYEEKN

SEQ ID NO: 3273523 - protein, 24 aa, Plasmodium falciparum
RENIYYLNFVYKNLLAKIDLITNL

SEQ ID NO: 3273524 - protein, 28 aa, Plasmodium falciparum
RENPLICILCLDNLKSRILMDKFCLLNS

SEQ ID NO: 3273525 - protein, 21 aa, Plasmodium falciparum
REPEPRTKIVNLKNSGVSKSR

SEQ ID NO: 3273526 - protein, 27 aa, Plasmodium falciparum
REPIMGRLRFDSFFSPLIFLLLLFFSI

SEQ ID NO: 3273527 - protein, 22 aa, Plasmodium falciparum
REPRISNILFMLNNIKKEIENV

SEQ ID NO: 3273528 - protein, 22 aa, Plasmodium falciparum
REPRLLDFVTLFGYLFGSIIYR

SEQ ID NO: 3273529 - protein, 31 aa, Plasmodium falciparum
REQHEKIELLPYVNICLIKILYYLNNFNLVQ

SEQ ID NO: 3273530 - protein, 24 aa, Plasmodium falciparum
RERKYLSNFIIYTFFFLSYIFFGF

SEQ ID NO: 3273531 - protein, 34 aa, Plasmodium falciparum
RESIKKMCRHFLNVMLPGLKIEKIHFYDWNNNYF

SEQ ID NO: 3273532 - protein, 24 aa, Plasmodium falciparum
RESLKFPLKYSKFCVHIFEGFTHL

SEQ ID NO: 3273533 - protein, 20 aa, Plasmodium falciparum
RESSNYVYLGAGIMREEQNK

SEQ ID NO: 3273534 - protein, 33 aa, Plasmodium falciparum
RESWWNAHAPSIWKGMICALTYKDGEEGKSPQV

SEQ ID NO: 3273535 - protein, 18 aa, Plasmodium falciparum
RETVWKAITCNAWGNTYF

SEQ ID NO: 3273536 - protein, 17 aa, Plasmodium falciparum
REVELAVLLKERLQPYV

SEQ ID NO: 3273537 - protein, 19 aa, Plasmodium falciparum
REVGLGGIRLRNGVDNKRT

SEQ ID NO: 3273538 - protein, 17 aa, Plasmodium falciparum
REVYPKNYISIINSEHK

SEQ ID NO: 3273539 - protein, 25 aa, Plasmodium falciparum
REYFDVTHAYVIQKILFILIPYIYI

SEQ ID NO: 3273540 - protein, 20 aa, Plasmodium falciparum
REYWWALNRNDVWEALTCSA

SEQ ID NO: 3273541 - protein, 21 aa, Plasmodium falciparum
REYWWTANRETVWKAITCDEE

SEQ ID NO: 3273542 - protein, 25 aa, Plasmodium falciparum
REYWWTANRHTVWKAITCKADASSA

SEQ ID NO: 3273543 - protein, 22 aa, Plasmodium falciparum
RFFLDLIEYVFFSFSIDIEKIQ

SEQ ID NO: 3273544 - protein, 19 aa, Plasmodium falciparum
RFFSNLFFLLHNFIEQYYF

SEQ ID NO: 3273545 - protein, 27 aa, Plasmodium falciparum
RFLKEKRKEMFIPHIYILMKYFEEAVD

SEQ ID NO: 3273546 - protein, 17 aa, Plasmodium falciparum
RFLNYPYLYVLIKKEKV

SEQ ID NO: 3273547 - protein, 21 aa, Plasmodium falciparum
RFMFCSLCTLYLLNKLFKERN

SEQ ID NO: 3273548 - protein, 19 aa, Plasmodium falciparum
RFNATCIFQLIYPVVDPGI

SEQ ID NO: 3273549 - protein, 18 aa, Plasmodium falciparum
RFNQIIIYNVILKNDIIN

SEQ ID NO: 3273550 - protein, 34 aa, Plasmodium falciparum
RFPTFQEFINSLKLYNSFNVFHFNSFNILYTTYP

SEQ ID NO: 3273551 - protein, 20 aa, Plasmodium falciparum
RFTFSRTRLTLKSFRKKETI

SEQ ID NO: 3273552 - protein, 26 aa, Plasmodium falciparum
RGEINEAFVLYAILRIFYSIIINNIN

SEQ ID NO: 3273553 - protein, 18 aa, Plasmodium falciparum
RGGGLNIYDACKMFIKGD

SEQ ID NO: 3273554 - protein, 26 aa, Plasmodium falciparum
RGIEFCKECLLHFYCPGNVIGIQKCP

SEQ ID NO: 3273555 - protein, 20 aa, Plasmodium falciparum
RGIYNICHIAYVYKKPPYKN

SEQ ID NO: 3273556 - protein, 22 aa, Plasmodium falciparum
RGKDLYRGGGRGRKQLEENLQK

SEQ ID NO: 3273557 - protein, 26 aa, Plasmodium falciparum
RGKKKLFEGADCKKCTVTCDNFVPWI

SEQ ID NO: 3273558 - protein, 30 aa, Plasmodium falciparum
RGKQLKGNHCIKLSGKSSCYIEIESDSCLE

SEQ ID NO: 3273559 - protein, 26 aa, Plasmodium falciparum
RGMTYIATFMIVLSIIITFISGFITL

SEQ ID NO: 3273560 - protein, 19 aa, Plasmodium falciparum
RGNCVNIVKIIPELSIKMY

SEQ ID NO: 3273561 - protein, 29 aa, Plasmodium falciparum
RGNDCTNCSFKCFPYEIWLGNQREAFRKQ

SEQ ID NO: 3273562 - protein, 19 aa, Plasmodium falciparum
RGNEKIEYLKNLKNSTNQQ

SEQ ID NO: 3273563 - protein, 43 aa, Plasmodium falciparum
RGNIIRPQAAAGFCLFSQLWYWFPLIHMISLTFMPTCLIGLTE

SEQ ID NO: 3273564 - protein, 24 aa, Plasmodium falciparum
RGNKYECGDNCYLHLHGITNYHQY

SEQ ID NO: 3273565 - protein, 19 aa, Plasmodium falciparum
RGSCLPSPPDRLTVAAGEE

SEQ ID NO: 3273566 - protein, 19 aa, Plasmodium falciparum
RGSMSKSKFIQLINEQRDN

SEQ ID NO: 3273567 - protein, 20 aa, Plasmodium falciparum
RGSYNECNRMISNMESSLFS

SEQ ID NO: 3273568 - protein, 17 aa, Plasmodium falciparum
RGTVFSLTIAIEGVGSS

SEQ ID NO: 3273569 - protein, 24 aa, Plasmodium falciparum
RHFICEYKDLIIIRKTNIILKSLG

SEQ ID NO: 3273570 - protein, 26 aa, Plasmodium falciparum
RHHEHCSSHLMLIFLLLAFFLVVVYR

SEQ ID NO: 3273571 - protein, 48 aa, Plasmodium falciparum
RHHIIKYTYNFYKKNICLSGCKKRIFLKIYCFHKGGYVFSRLKRYFLC

SEQ ID NO: 3273572 - protein, 27 aa, Plasmodium falciparum
RHILQTEFFKVFFFVYLEEVYYTIKKK

SEQ ID NO: 3273573 - protein, 20 aa, Plasmodium falciparum
RHIPISIYCYSVYLICAYSI

SEQ ID NO: 3273574 - protein, 21 aa, Plasmodium falciparum
RHITYMNVLILFFLFKYEIFL

SEQ ID NO: 3273575 - protein, 22 aa, Plasmodium falciparum
RHIYDLLHLCMYIYMLYMYNVT

SEQ ID NO: 3273576 - protein, 18 aa, Plasmodium falciparum
RHKFAMMQYRLMKYIGHL

SEQ ID NO: 3273577 - protein, 21 aa, Plasmodium falciparum
RHKKFVCERKKGVILQNNNKC

SEQ ID NO: 3273578 - protein, 18 aa, Plasmodium falciparum
RHLAKWRLHCRTTLEKFI

SEQ ID NO: 3273579 - protein, 20 aa, Plasmodium falciparum
RHLKHFEGLYSFESCEPSIG

SEQ ID NO: 3273580 - protein, 21 aa, Plasmodium falciparum
RHMPSMSDLYFARQYSGMKFG

SEQ ID NO: 3273581 - protein, 19 aa, Plasmodium falciparum
RHMYGHIYGHMYGHMYDLF

SEQ ID NO: 3273582 - protein, 22 aa, Plasmodium falciparum
RHRKREKKKREFIKSLRVLQDM

SEQ ID NO: 3273583 - protein, 20 aa, Plasmodium falciparum
RHSESVWNSVFNKEMSTKQF

SEQ ID NO: 3273584 - protein, 18 aa, Plasmodium falciparum
RHSSHVINLISLDVDRNF

SEQ ID NO: 3273585 - protein, 17 aa, Plasmodium falciparum
RHTDLLLNFLIYIYYKY

SEQ ID NO: 3273586 - protein, 20 aa, Plasmodium falciparum
RHYECYSSTMNEFFYKYNEN

SEQ ID NO: 3273587 - protein, 27 aa, Plasmodium falciparum
RIAEPYYPKAVEQFNHFKEPYSKYIYT

SEQ ID NO: 3273588 - protein, 30 aa, Plasmodium falciparum
RIASYPDIFKDFTFESPLWLDSLSLPDPYY

SEQ ID NO: 3273589 - protein, 26 aa, Plasmodium falciparum
RICTTLKERLLYIIEMYISYYTKNIN

SEQ ID NO: 3273590 - protein, 38 aa, Plasmodium falciparum
RIDFNIISCLFKVYIIFLKDYSSFFLSSIMTLLKNNII

SEQ ID NO: 3273591 - protein, 17 aa, Plasmodium falciparum
RIDIFYETFNIFDTEEI

SEQ ID NO: 3273592 - protein, 32 aa, Plasmodium falciparum
RIEKIYSSFRCFIKLLALKHIRINKVIYETSK

SEQ ID NO: 3273593 - protein, 27 aa, Plasmodium falciparum
RIELFLRNRSKVFICQNIIKRWKHYIK

SEQ ID NO: 3273594 - protein, 22 aa, Plasmodium falciparum
RIEMYIKRGVYFISSNVLLIDL

SEQ ID NO: 3273595 - protein, 19 aa, Plasmodium falciparum
RIEYSAVIKYFMSNEKYKF

SEQ ID NO: 3273596 - protein, 24 aa, Plasmodium falciparum
RIFIFKKKGKVFFDQVNFVNVIKF

SEQ ID NO: 3273597 - protein, 40 aa, Plasmodium falciparum
RIFLYSLMKYCYLLEYFSCLRSLVFLEINDYMLPFFEFIF

SEQ ID NO: 3273598 - protein, 19 aa, Plasmodium falciparum
RIFNCLFVVTSFYPDEYFQ

SEQ ID NO: 3273599 - protein, 21 aa, Plasmodium falciparum
RIFYIFYIINIKFKYDVIQAH

SEQ ID NO: 3273600 - protein, 18 aa, Plasmodium falciparum
RIGLEIWLNKIIDGKSFY

SEQ ID NO: 3273601 - protein, 37 aa, Plasmodium falciparum
RIHEINFKLLIKLLLGLCYFSFEKVHIYNLIITNLIK

SEQ ID NO: 3273602 - protein, 25 aa, Plasmodium falciparum
RIHNKCSYIPLLFLNIYDSYIYKNK

SEQ ID NO: 3273603 - protein, 22 aa, Plasmodium falciparum
RIHTLRLEEMVTLTFTGISDNP

SEQ ID NO: 3273604 - protein, 20 aa, Plasmodium falciparum
RIICSFLLERFVLKEKQSLY

SEQ ID NO: 3273605 - protein, 19 aa, Plasmodium falciparum
RIIHIFNLFQLYLLTIDIM

SEQ ID NO: 3273606 - protein, 17 aa, Plasmodium falciparum
RIIILPLTISSERDRRK

SEQ ID NO: 3273607 - protein, 26 aa, Plasmodium falciparum
RIIKKKSNSYFLFNIYKAFENDIKLI

SEQ ID NO: 3273608 - protein, 17 aa, Plasmodium falciparum
RIILSEIEWNVSKIEFE

SEQ ID NO: 3273609 - protein, 20 aa, Plasmodium falciparum
RIINIFDVCLRKYYNNISLW

SEQ ID NO: 3273610 - protein, 18 aa, Plasmodium falciparum
RIINKITCPIGYNNVDSV

SEQ ID NO: 3273611 - protein, 18 aa, Plasmodium falciparum
RIKFPSYSKNLLRYRNGN

SEQ ID NO: 3273612 - protein, 20 aa, Plasmodium falciparum
RIKKFVQLTLLLLLISIIVF

SEQ ID NO: 3273613 - protein, 28 aa, Plasmodium falciparum
RIKKNKLCIIEILYICISFMINEYMNLK

SEQ ID NO: 3273614 - protein, 23 aa, Plasmodium falciparum
RIKSLRINLKYIFYNNPISEYFK

SEQ ID NO: 3273615 - protein, 21 aa, Plasmodium falciparum
RIKTFELILEMNKMKLNRTEF

SEQ ID NO: 3273616 - protein, 19 aa, Plasmodium falciparum
RILCKLKKFQHVMWYIPEG

SEQ ID NO: 3273617 - protein, 24 aa, Plasmodium falciparum
RILCLKLSTSLIYTLVKYYNICSF

SEQ ID NO: 3273618 - protein, 17 aa, Plasmodium falciparum
RILCNLLIVICEYMFPF

SEQ ID NO: 3273619 - protein, 18 aa, Plasmodium falciparum
RILFCIFSQYVYFNTFDL

SEQ ID NO: 3273620 - protein, 18 aa, Plasmodium falciparum
RILINFTNYMFKKEELEK

SEQ ID NO: 3273621 - protein, 21 aa, Plasmodium falciparum
RILLISCLFSFIVSWNQNVAL

SEQ ID NO: 3273622 - protein, 18 aa, Plasmodium falciparum
RILLSEKKFITFLNTCSN

SEQ ID NO: 3273623 - protein, 20 aa, Plasmodium falciparum
RILNEGLLNFTNLINSYENK

SEQ ID NO: 3273624 - protein, 18 aa, Plasmodium falciparum
RILNRLLFLLKYNVHNKI

SEQ ID NO: 3273625 - protein, 19 aa, Plasmodium falciparum
RILYISTIKFYPFLQNIIL

SEQ ID NO: 3273626 - protein, 18 aa, Plasmodium falciparum
RILYLLFLLDKYKNFTFH

SEQ ID NO: 3273627 - protein, 17 aa, Plasmodium falciparum
RIMILFFVSYNSKILDL

SEQ ID NO: 3273628 - protein, 21 aa, Plasmodium falciparum
RIMISGFTIGYLINAIICIHL

SEQ ID NO: 3273629 - protein, 23 aa, Plasmodium falciparum
RIMKILCKNGKGLNGSIFKCTIN

SEQ ID NO: 3273630 - protein, 28 aa, Plasmodium falciparum
RIMLNRKNPFFISTYLFYLSKKVKNKIF

SEQ ID NO: 3273631 - protein, 32 aa, Plasmodium falciparum
RIMVNFFILYNIFRFKEKCFQNENLLKKYKFF

SEQ ID NO: 3273632 - protein, 17 aa, Plasmodium falciparum
RINEIDEGVLFCTQGIL

SEQ ID NO: 3273633 - protein, 19 aa, Plasmodium falciparum
RINFEGIVGLAFPEMLSTG

SEQ ID NO: 3273634 - protein, 20 aa, Plasmodium falciparum
RINRYFMYRNTLVARTINLN

SEQ ID NO: 3273635 - protein, 20 aa, Plasmodium falciparum
RINSLLFHKGNMLNDVTKLY

SEQ ID NO: 3273636 - protein, 19 aa, Plasmodium falciparum
RINTIPKYYMNGREQQVNQ

SEQ ID NO: 3273637 - protein, 19 aa, Plasmodium falciparum
RIQNKFSIINIDDISMKTF

SEQ ID NO: 3273638 - protein, 21 aa, Plasmodium falciparum
RIQTFLWDKIYYIIQENLDSL

SEQ ID NO: 3273639 - protein, 18 aa, Plasmodium falciparum
RIREELKEYYYLQKNVYI

SEQ ID NO: 3273640 - protein, 22 aa, Plasmodium falciparum
RIRNIQCGILLNKTRQTIKNSF

SEQ ID NO: 3273641 - protein, 23 aa, Plasmodium falciparum
RIRVKVGIHSGRIIAGVVGSKKP

SEQ ID NO: 3273642 - protein, 23 aa, Plasmodium falciparum
RISFIQFYPYLVLINLTKYNFEM

SEQ ID NO: 3273643 - protein, 20 aa, Plasmodium falciparum
RISINRFREVFVNYVEDTLE

SEQ ID NO: 3273644 - protein, 18 aa, Plasmodium falciparum
RISKLVVYMFYKNMVLIF

SEQ ID NO: 3273645 - protein, 27 aa, Plasmodium falciparum
RISLLKIIYERSCIILANQYSNKIFIY

SEQ ID NO: 3273646 - protein, 17 aa, Plasmodium falciparum
RIVKAFNVLVNKSTRKY

SEQ ID NO: 3273647 - protein, 25 aa, Plasmodium falciparum
RIVLEYLEIYITEFLETVIEEEKHK

SEQ ID NO: 3273648 - protein, 18 aa, Plasmodium falciparum
RIYELAKIYTNNIFDYLK

SEQ ID NO: 3273649 - protein, 17 aa, Plasmodium falciparum
RIYEMNNIFTYLFEWIV

SEQ ID NO: 3273650 - protein, 19 aa, Plasmodium falciparum
RIYITDIIHKLLKYKNQII

SEQ ID NO: 3273651 - protein, 18 aa, Plasmodium falciparum
RIYKSFYTLFRFLFTLFL

SEQ ID NO: 3273652 - protein, 19 aa, Plasmodium falciparum
RIYQATVVFFADFFWVIFL

SEQ ID NO: 3273653 - protein, 22 aa, Plasmodium falciparum
RKADLYFSVPMYYLMNKHFVMF

SEQ ID NO: 3273654 - protein, 19 aa, Plasmodium falciparum
RKADPLLIVSKRLPSYIKK

SEQ ID NO: 3273655 - protein, 29 aa, Plasmodium falciparum
RKAFIKCAAAETFFSWYYFKKINDKLNKL

SEQ ID NO: 3273656 - protein, 17 aa, Plasmodium falciparum
RKAKKKNKEDILKDQYN

SEQ ID NO: 3273657 - protein, 18 aa, Plasmodium falciparum
RKANKQIYEQKYYNESNK

SEQ ID NO: 3273658 - protein, 19 aa, Plasmodium falciparum
RKCAIRNTIKYNYSCNNTE

SEQ ID NO: 3273659 - protein, 21 aa, Plasmodium falciparum
RKCEEYKKFIEIWKKQFETQN

SEQ ID NO: 3273660 - protein, 19 aa, Plasmodium falciparum
RKCFKYIKIKYLKKKHYLP

SEQ ID NO: 3273661 - protein, 23 aa, Plasmodium falciparum
RKDAHNFFQISIEHVLMINNGLP

SEQ ID NO: 3273662 - protein, 24 aa, Plasmodium falciparum
RKDIWECGNVCGYNVCKPKNVNGE

SEQ ID NO: 3273663 - protein, 18 aa, Plasmodium falciparum
RKDLNLIYIKNHNNEMDV

SEQ ID NO: 3273664 - protein, 18 aa, Plasmodium falciparum
RKDMYLIWHYSHSLLRDK

SEQ ID NO: 3273665 - protein, 20 aa, Plasmodium falciparum
RKDNNVFLPHFRKQNVNNEN

SEQ ID NO: 3273666 - protein, 19 aa, Plasmodium falciparum
RKDQWSCGYFCNLDICSLK

SEQ ID NO: 3273667 - protein, 18 aa, Plasmodium falciparum
RKDWWNENGPYIWKGMLC

SEQ ID NO: 3273668 - protein, 24 aa, Plasmodium falciparum
RKDYLRYYFEPFNYEGYDQEFIET

SEQ ID NO: 3273669 - protein, 32 aa, Plasmodium falciparum
RKEDIIIAFFLRLSNIIFDLILYISIKVKKLN

SEQ ID NO: 3273670 - protein, 19 aa, Plasmodium falciparum
RKEDVLNIINNIERTIFLK

SEQ ID NO: 3273671 - protein, 19 aa, Plasmodium falciparum
RKEICLDVVNNMFTDDTSS

SEQ ID NO: 3273672 - protein, 26 aa, Plasmodium falciparum
RKEKENLKLCFVRFKKTNRCIIIKEK

SEQ ID NO: 3273673 - protein, 21 aa, Plasmodium falciparum
RKEKLFLYKYISPFMDLGKRF

SEQ ID NO: 3273674 - protein, 22 aa, Plasmodium falciparum
RKEKYLFYKLLYFQCFSSGQVQ

SEQ ID NO: 3273675 - protein, 19 aa, Plasmodium falciparum
RKELFSDKEIIAIANKRRH

SEQ ID NO: 3273676 - protein, 21 aa, Plasmodium falciparum
RKELIVPTYLDYVPQFLRWLN

SEQ ID NO: 3273677 - protein, 19 aa, Plasmodium falciparum
RKENELFGTNHVKQTSIHS

SEQ ID NO: 3273678 - protein, 17 aa, Plasmodium falciparum
RKERCAGKVDNTNGGNK

SEQ ID NO: 3273679 - protein, 17 aa, Plasmodium falciparum
RKFFPRKHILNKIHKIF

SEQ ID NO: 3273680 - protein, 21 aa, Plasmodium falciparum
RKFNEFYSCCYILKNDKKEKI

SEQ ID NO: 3273681 - protein, 28 aa, Plasmodium falciparum
RKFVYIFCNGCLVVFLGVSNNICGRMRN

SEQ ID NO: 3273682 - protein, 17 aa, Plasmodium falciparum
RKGGRGCYVNKKKCIKE

SEQ ID NO: 3273683 - protein, 21 aa, Plasmodium falciparum
RKGKKKLCIHFIRTNNKNYYQ

SEQ ID NO: 3273684 - protein, 20 aa, Plasmodium falciparum
RKHDINHILDLSFLSKEEKK

SEQ ID NO: 3273685 - protein, 17 aa, Plasmodium falciparum
RKHFYIFIYKYVTNMNH

SEQ ID NO: 3273686 - protein, 18 aa, Plasmodium falciparum
RKHIKIIAKNVNSSYLDY

SEQ ID NO: 3273687 - protein, 19 aa, Plasmodium falciparum
RKHLIIEIIIHMFLKNISI

SEQ ID NO: 3273688 - protein, 25 aa, Plasmodium falciparum
RKIEWKFSLTYANVISRIYKVIKCI

SEQ ID NO: 3273689 - protein, 17 aa, Plasmodium falciparum
RKIFFQFLYLFLKSNSY

SEQ ID NO: 3273690 - protein, 19 aa, Plasmodium falciparum
RKIFKLLCLNKNNAKKKIY

SEQ ID NO: 3273691 - protein, 26 aa, Plasmodium falciparum
RKIGHIFYFQFFYDIIIRIFNELYYL

SEQ ID NO: 3273692 - protein, 34 aa, Plasmodium falciparum
RKIIELGDFVAVKGFVRKTLRGEITLHVKDIYML

SEQ ID NO: 3273693 - protein, 18 aa, Plasmodium falciparum
RKIIIETKNIYNFDIKHF

SEQ ID NO: 3273694 - protein, 19 aa, Plasmodium falciparum
RKIIKMEIEQLWICDPSNK

SEQ ID NO: 3273695 - protein, 17 aa, Plasmodium falciparum
RKIIKRITSDILKDRYN

SEQ ID NO: 3273696 - protein, 23 aa, Plasmodium falciparum
RKIKDKISVILLSFNVSLIQVIF

SEQ ID NO: 3273697 - protein, 20 aa, Plasmodium falciparum
RKIKEYKIRKKIYIPTNNIV

SEQ ID NO: 3273698 - protein, 24 aa, Plasmodium falciparum
RKIKKEFILLFSIYLYDISFLRYY

SEQ ID NO: 3273699 - protein, 24 aa, Plasmodium falciparum
RKIKKRISLNFVNYDMKSTTIENC

SEQ ID NO: 3273700 - protein, 21 aa, Plasmodium falciparum
RKIKTMFGTLCYVNIMETIRK

SEQ ID NO: 3273701 - protein, 34 aa, Plasmodium falciparum
RKILIYEFLDNYFISFFLFYFLKYKVTKNYNDIY

SEQ ID NO: 3273702 - protein, 37 aa, Plasmodium falciparum
RKILYYMSVNVLFFLCFIFIFSRFNSGQFYEKWKNKP

SEQ ID NO: 3273703 - protein, 21 aa, Plasmodium falciparum
RKINIKKIICELAKLTKIHHK

SEQ ID NO: 3273704 - protein, 29 aa, Plasmodium falciparum
RKINLSFHSSHIFASNPFIVSREHFLLDQ

SEQ ID NO: 3273705 - protein, 21 aa, Plasmodium falciparum
RKINMCTLLFFKSPNDVCLQE

SEQ ID NO: 3273706 - protein, 20 aa, Plasmodium falciparum
RKINNIKLILENCFSNLISE

SEQ ID NO: 3273707 - protein, 22 aa, Plasmodium falciparum
RKIRNPYLCDMYQFLKYSYTKE

SEQ ID NO: 3273708 - protein, 17 aa, Plasmodium falciparum
RKITLPMTHQIPNVPNI

SEQ ID NO: 3273709 - protein, 21 aa, Plasmodium falciparum
RKKCSIKNFLFLYFKNMKSSN

SEQ ID NO: 3273710 - protein, 24 aa, Plasmodium falciparum
RKKDMKIPPFASFISLELIHIKKK

SEQ ID NO: 3273711 - protein, 18 aa, Plasmodium falciparum
RKKEKFFYDSLNLEYDYA

SEQ ID NO: 3273712 - protein, 25 aa, Plasmodium falciparum
RKKELKIFLMKVFKILLNNINDTIS

SEQ ID NO: 3273713 - protein, 25 aa, Plasmodium falciparum
RKKELLKKNIVAIILLYTINDNTPN

SEQ ID NO: 3273714 - protein, 19 aa, Plasmodium falciparum
RKKIKGCDFGDNIPSKRDL

SEQ ID NO: 3273715 - protein, 18 aa, Plasmodium falciparum
RKKIKYCKYFASYIYYKM

SEQ ID NO: 3273716 - protein, 19 aa, Plasmodium falciparum
RKKILIKYYDLWFYYNEKK

SEQ ID NO: 3273717 - protein, 27 aa, Plasmodium falciparum
RKKIPCIFYKARGKNIIISMNKEKQNK

SEQ ID NO: 3273718 - protein, 20 aa, Plasmodium falciparum
RKKIYRRYAQKKKEKETYEE

SEQ ID NO: 3273719 - protein, 19 aa, Plasmodium falciparum
RKKKGYYPIPRFWLSCKHP

SEQ ID NO: 3273720 - protein, 27 aa, Plasmodium falciparum
RKKKKACDMKKIWYILKVYDDKEVVGN

SEQ ID NO: 3273721 - protein, 28 aa, Plasmodium falciparum
RKKKKCITKVKFLPLFSSNNVNKLIGMF

SEQ ID NO: 3273722 - protein, 17 aa, Plasmodium falciparum
RKKKKRIYSKKKKYIFK

SEQ ID NO: 3273723 - protein, 20 aa, Plasmodium falciparum
RKKKNYNFISQTSYEANSNN

SEQ ID NO: 3273724 - protein, 23 aa, Plasmodium falciparum
RKKKRRKEILKKSATIFNTLKGK

SEQ ID NO: 3273725 - protein, 21 aa, Plasmodium falciparum
RKKKYTVHKDICKIRTVCNST

SEQ ID NO: 3273726 - protein, 24 aa, Plasmodium falciparum
RKKLCYFCNSNLLYYGKWPSLFEI

SEQ ID NO: 3273727 - protein, 20 aa, Plasmodium falciparum
RKKLKEYYFNKINKAFFTFL

SEQ ID NO: 3273728 - protein, 25 aa, Plasmodium falciparum
RKKLMNIDMGFLFDLLEKKVLEKNV

SEQ ID NO: 3273729 - protein, 24 aa, Plasmodium falciparum
RKKNEKAYNLFIFFMNHKVIQNVV

SEQ ID NO: 3273730 - protein, 19 aa, Plasmodium falciparum
RKKNFFFLYHFIKKKENIT

SEQ ID NO: 3273731 - protein, 24 aa, Plasmodium falciparum
RKKNLKNYWLFKGTNILHFSSKIV

SEQ ID NO: 3273732 - protein, 26 aa, Plasmodium falciparum
RKKYIWKLIYCHILGYGISLSYLDII

SEQ ID NO: 3273733 - protein, 26 aa, Plasmodium falciparum
RKLFLNKFKRSFCIQEGELIIKTKTK

SEQ ID NO: 3273734 - protein, 20 aa, Plasmodium falciparum
RKLKADIISLNISYVQMEHY

SEQ ID NO: 3273735 - protein, 20 aa, Plasmodium falciparum
RKLKEYTSDVLLKYEYETYI

SEQ ID NO: 3273736 - protein, 19 aa, Plasmodium falciparum
RKLKNPKGCLTNLKNKIIK

SEQ ID NO: 3273737 - protein, 32 aa, Plasmodium falciparum
RKLKTCLKFEPELHPLKLRALQNYKMGNHNKI

SEQ ID NO: 3273738 - protein, 20 aa, Plasmodium falciparum
RKLKTLFNRICHKIFSSEHI

SEQ ID NO: 3273739 - protein, 19 aa, Plasmodium falciparum
RKLLEELLIQIKEEDKIIS

SEQ ID NO: 3273740 - protein, 17 aa, Plasmodium falciparum
RKLLVGLNPNFNYIQNV

SEQ ID NO: 3273741 - protein, 20 aa, Plasmodium falciparum
RKLMINFEVEQLKKLNYDFG

SEQ ID NO: 3273742 - protein, 23 aa, Plasmodium falciparum
RKMEKTLVCFTLGKYVLKDNTLN

SEQ ID NO: 3273743 - protein, 19 aa, Plasmodium falciparum
RKMKESKFMDIAYRKKNEI

SEQ ID NO: 3273744 - protein, 17 aa, Plasmodium falciparum
RKMKKKNKFGYNNVENN

SEQ ID NO: 3273745 - protein, 22 aa, Plasmodium falciparum
RKMKNVLFIYNFNSFLSYFKNI

SEQ ID NO: 3273746 - protein, 18 aa, Plasmodium falciparum
RKMYVFLISLLFQQINDL

SEQ ID NO: 3273747 - protein, 21 aa, Plasmodium falciparum
RKNCNYSLMINFYINMLIEKF

SEQ ID NO: 3273748 - protein, 17 aa, Plasmodium falciparum
RKNDCTHIDNFKILDNV

SEQ ID NO: 3273749 - protein, 27 aa, Plasmodium falciparum
RKNEQRVYTSLHKKNHIEFRDISVQWS

SEQ ID NO: 3273750 - protein, 21 aa, Plasmodium falciparum
RKNEYLNFYCDGMGQVKKHGY

SEQ ID NO: 3273751 - protein, 34 aa, Plasmodium falciparum
RKNFKRLNNIINYILIEMIENFLFEDNKNGRIIL

SEQ ID NO: 3273752 - protein, 17 aa, Plasmodium falciparum
RKNIFIITIKIMTVFLF

SEQ ID NO: 3273753 - protein, 20 aa, Plasmodium falciparum
RKNIFRFVSKYILKKTSKKL

SEQ ID NO: 3273754 - protein, 19 aa, Plasmodium falciparum
RKNIICLLNNLNLEHFSLF

SEQ ID NO: 3273755 - protein, 20 aa, Plasmodium falciparum
RKNIKRFSMSAVHRKENIEH

SEQ ID NO: 3273756 - protein, 20 aa, Plasmodium falciparum
RKNIYQKYSLLFSLNNNKKN

SEQ ID NO: 3273757 - protein, 22 aa, Plasmodium falciparum
RKNKDFQEILGILCPNKKIDKD

SEQ ID NO: 3273758 - protein, 22 aa, Plasmodium falciparum
RKNKEMIILQGIINKLENKIDE

SEQ ID NO: 3273759 - protein, 28 aa, Plasmodium falciparum
RKNKKFFFLCGIYLIYILQFLNKNILYR

SEQ ID NO: 3273760 - protein, 20 aa, Plasmodium falciparum
RKNKVLSYFFILKKLKIHKL

SEQ ID NO: 3273761 - protein, 24 aa, Plasmodium falciparum
RKNLKYYIMNSLYIQTCRKERKEI

SEQ ID NO: 3273762 - protein, 18 aa, Plasmodium falciparum
RKNSHLFYLNKSGENCDP

SEQ ID NO: 3273763 - protein, 22 aa, Plasmodium falciparum
RKNSISSASCWSFTNNSLSRGW

SEQ ID NO: 3273764 - protein, 45 aa, Plasmodium falciparum
RKNVNLLKRYVRLFDFCNLSLLSSLRLFLRCFKLPGEAQLIERIL

SEQ ID NO: 3273765 - protein, 19 aa, Plasmodium falciparum
RKNYKYNVHEGIIRKGAKW

SEQ ID NO: 3273766 - protein, 21 aa, Plasmodium falciparum
RKPQLMLWIGDYFYTECSEIK

SEQ ID NO: 3273767 - protein, 19 aa, Plasmodium falciparum
RKPVKFLYTRSFFFFEELL

SEQ ID NO: 3273768 - protein, 19 aa, Plasmodium falciparum
RKQFVKFCTGTSALPNNGF

SEQ ID NO: 3273769 - protein, 21 aa, Plasmodium falciparum
RKQTFFYVWLLLYQYEKKYYY

SEQ ID NO: 3273770 - protein, 19 aa, Plasmodium falciparum
RKRDFTWHGKLFFIYPKMR

SEQ ID NO: 3273771 - protein, 19 aa, Plasmodium falciparum
RKREVVLALLLRERIQPYV

SEQ ID NO: 3273772 - protein, 17 aa, Plasmodium falciparum
RKRGRKKGKKRGRKKGV

SEQ ID NO: 3273773 - protein, 26 aa, Plasmodium falciparum
RKRITELRKILVEKLRILYLEKNNLF

SEQ ID NO: 3273774 - protein, 19 aa, Plasmodium falciparum
RKRKEKIIIFLNHNSSAYK

SEQ ID NO: 3273775 - protein, 21 aa, Plasmodium falciparum
RKRKKELYDLKSFNINYETQN

SEQ ID NO: 3273776 - protein, 20 aa, Plasmodium falciparum
RKRKYIKGRYLKGTNKIVRN

SEQ ID NO: 3273777 - protein, 17 aa, Plasmodium falciparum
RKRNIIRSAKWNNKNSK

SEQ ID NO: 3273778 - protein, 24 aa, Plasmodium falciparum
RKRRRKYMKYNFCITHYNDKKIEY

SEQ ID NO: 3273779 - protein, 18 aa, Plasmodium falciparum
RKRSIQWEAISEGYKKYK

SEQ ID NO: 3273780 - protein, 18 aa, Plasmodium falciparum
RKRYKRKTLKRIYVAMKY

SEQ ID NO: 3273781 - protein, 19 aa, Plasmodium falciparum
RKSHDYDHVISIKDDDVES

SEQ ID NO: 3273782 - protein, 20 aa, Plasmodium falciparum
RKSIFEIFKNFIILSKGSEE

SEQ ID NO: 3273783 - protein, 19 aa, Plasmodium falciparum
RKSKDILSTFKLFNFDDFI

SEQ ID NO: 3273784 - protein, 24 aa, Plasmodium falciparum
RKSRKRLSYVWVWARRCCSKYWNI

SEQ ID NO: 3273785 - protein, 19 aa, Plasmodium falciparum
RKSSNLSYEYNIRKTNILN

SEQ ID NO: 3273786 - protein, 18 aa, Plasmodium falciparum
RKSTVKIIQMILWMIIIV

SEQ ID NO: 3273787 - protein, 38 aa, Plasmodium falciparum
RKTAVKKKLKYFFLHLCLESGISINVALMLFINATKQS

SEQ ID NO: 3273788 - protein, 19 aa, Plasmodium falciparum
RKTENIFKMSTKKNIHEYN

SEQ ID NO: 3273789 - protein, 18 aa, Plasmodium falciparum
RKTINIKGSHKYKDKKNQ

SEQ ID NO: 3273790 - protein, 23 aa, Plasmodium falciparum
RKTKKKKKKKCMNYDNMLNDENI

SEQ ID NO: 3273791 - protein, 25 aa, Plasmodium falciparum
RKTLKRIYVAMKYACRHMLKKYLLF

SEQ ID NO: 3273792 - protein, 18 aa, Plasmodium falciparum
RKTLRIVADPGKSFVKQK

SEQ ID NO: 3273793 - protein, 17 aa, Plasmodium falciparum
RKTNIMSQINKFIFNKK

SEQ ID NO: 3273794 - protein, 19 aa, Plasmodium falciparum
RKVHSYPWINIFKTRRIKE

SEQ ID NO: 3273795 - protein, 20 aa, Plasmodium falciparum
RKVKLDKLVYAFVELYDESN

SEQ ID NO: 3273796 - protein, 29 aa, Plasmodium falciparum
RKVRIAKKIFKGLGAFMILLTSFLIVLDN

SEQ ID NO: 3273797 - protein, 33 aa, Plasmodium falciparum
RKVSMHKLYGGWFHFLGIMVINGYNCNIYEKNT

SEQ ID NO: 3273798 - protein, 23 aa, Plasmodium falciparum
RKVYWFEKFHWFISSENYLVIAG

SEQ ID NO: 3273799 - protein, 17 aa, Plasmodium falciparum
RKWGRLVNNYNKHNNHN

SEQ ID NO: 3273800 - protein, 24 aa, Plasmodium falciparum
RKYELFMKNYINFFTCSMNKNLYL

SEQ ID NO: 3273801 - protein, 23 aa, Plasmodium falciparum
RKYGSFIQMCIYFDLKKKKVDSI

SEQ ID NO: 3273802 - protein, 18 aa, Plasmodium falciparum
RKYHELLNYCVFVDKQKA

SEQ ID NO: 3273803 - protein, 20 aa, Plasmodium falciparum
RKYIRMKICEPLEQLSPITD

SEQ ID NO: 3273804 - protein, 33 aa, Plasmodium falciparum
RKYKFLSQFFIWRARIFFHLAKFHKYVLSDCCK

SEQ ID NO: 3273805 - protein, 20 aa, Plasmodium falciparum
RKYLCLSLLLNYFKNSMCEK

SEQ ID NO: 3273806 - protein, 17 aa, Plasmodium falciparum
RKYLSRQIQIVYSVCKF

SEQ ID NO: 3273807 - protein, 25 aa, Plasmodium falciparum
RKYNEEKSELAILKEEMFSLEKQIK

SEQ ID NO: 3273808 - protein, 17 aa, Plasmodium falciparum
RKYNIHHIISVIIVLIG

SEQ ID NO: 3273809 - protein, 19 aa, Plasmodium falciparum
RKYQEEFPINNTVINNYNK

SEQ ID NO: 3273810 - protein, 19 aa, Plasmodium falciparum
RKYSICEKLTNTFYKEEII

SEQ ID NO: 3273811 - protein, 22 aa, Plasmodium falciparum
RKYSLDACDKFTVRNVRKLEKP

SEQ ID NO: 3273812 - protein, 17 aa, Plasmodium falciparum
RLAQIKVDCRGDENTNR

SEQ ID NO: 3273813 - protein, 23 aa, Plasmodium falciparum
RLCSSWSTCFERFSRNSDNYSIV

SEQ ID NO: 3273814 - protein, 20 aa, Plasmodium falciparum
RLEAFLKMHTTYCSNIAQGY

SEQ ID NO: 3273815 - protein, 17 aa, Plasmodium falciparum
RLEEVLLNNGYKKKIED

SEQ ID NO: 3273816 - protein, 18 aa, Plasmodium falciparum
RLEILQNIWNGAHERYFL

SEQ ID NO: 3273817 - protein, 23 aa, Plasmodium falciparum
RLEKKLKTGLLINKLNNYHRSNS

SEQ ID NO: 3273818 - protein, 34 aa, Plasmodium falciparum
RLENCKEIIDHTAIQLCARKVANVSGDIRKALQI

SEQ ID NO: 3273819 - protein, 30 aa, Plasmodium falciparum
RLFFFCHLYNLCYFCKIYVNSAPLHDMNRE

SEQ ID NO: 3273820 - protein, 26 aa, Plasmodium falciparum
RLFKYFKLLGQLCAKILTDNRNINVN

SEQ ID NO: 3273821 - protein, 19 aa, Plasmodium falciparum
RLFLDLCEEKEILLYKILK

SEQ ID NO: 3273822 - protein, 24 aa, Plasmodium falciparum
RLFLRYSVGIFLGLFYIVLLNICK

SEQ ID NO: 3273823 - protein, 31 aa, Plasmodium falciparum
RLFYKDWWNASSFAEYWRKWNLPIYYFVCRH

SEQ ID NO: 3273824 - protein, 18 aa, Plasmodium falciparum
RLGSYLFKKDEAYMNEKD

SEQ ID NO: 3273825 - protein, 28 aa, Plasmodium falciparum
RLGTTRSRIRGKCLLKNKKMHMYDDNEE

SEQ ID NO: 3273826 - protein, 17 aa, Plasmodium falciparum
RLHTIKFKKFLRKFKKV

SEQ ID NO: 3273827 - protein, 26 aa, Plasmodium falciparum
RLIEECFCLLLSSLFIGYVGDMNIYI

SEQ ID NO: 3273828 - protein, 20 aa, Plasmodium falciparum
RLILENFKKYGLIIKIPKNC

SEQ ID NO: 3273829 - protein, 20 aa, Plasmodium falciparum
RLIQKIFYLILCNKQFNDIQ

SEQ ID NO: 3273830 - protein, 35 aa, Plasmodium falciparum
RLIVKIAFIASTMTFCFSLLLYIVISLIPQRQNEN

SEQ ID NO: 3273831 - protein, 23 aa, Plasmodium falciparum
RLKEYRILVEFSNSYYYDEPKVR

SEQ ID NO: 3273832 - protein, 34 aa, Plasmodium falciparum
RLKGGMSLVSFFCFLSFFLFFFLFHNNNNTILYV

SEQ ID NO: 3273833 - protein, 19 aa, Plasmodium falciparum
RLKKIKKIMMKRMKININK

SEQ ID NO: 3273834 - protein, 58 aa, Plasmodium falciparum
RLKKIYECIKVFSIKEFRWLINKLEIIYFYFFCHLLLLCIFQNIFLLTYMSKEYFLKN

SEQ ID NO: 3273835 - protein, 26 aa, Plasmodium falciparum
RLKLFLNKYNMQWLHFNECLFISSQL

SEQ ID NO: 3273836 - protein, 22 aa, Plasmodium falciparum
RLKLQDVDVFFCILNEVINDKK

SEQ ID NO: 3273837 - protein, 20 aa, Plasmodium falciparum
RLKNWLYRKMFKECNFRKYL

SEQ ID NO: 3273838 - protein, 17 aa, Plasmodium falciparum
RLKTILMKEEYNKYNKL

SEQ ID NO: 3273839 - protein, 19 aa, Plasmodium falciparum
RLLHFGIAFFFGAISTIIG

SEQ ID NO: 3273840 - protein, 29 aa, Plasmodium falciparum
RLLHQAKVYLEFVRCLKLNNCSVIDNEKY

SEQ ID NO: 3273841 - protein, 25 aa, Plasmodium falciparum
RLLYMKCFKCNNSPMYTISKKDEYK

SEQ ID NO: 3273842 - protein, 17 aa, Plasmodium falciparum
RLNDFRNYYTVPDYVKI

SEQ ID NO: 3273843 - protein, 18 aa, Plasmodium falciparum
RLNKMFKDCFKQKMIYLE

SEQ ID NO: 3273844 - protein, 20 aa, Plasmodium falciparum
RLNKQISDILCKKEMELFYI

SEQ ID NO: 3273845 - protein, 27 aa, Plasmodium falciparum
RLNPNDFFYFIIIHVIIILSIIFLLYL

SEQ ID NO: 3273846 - protein, 26 aa, Plasmodium falciparum
RLNRFSLCKVFLWIIYLKITVVSFYF

SEQ ID NO: 3273847 - protein, 19 aa, Plasmodium falciparum
RLNSNCIMWDTLMKEEKTI

SEQ ID NO: 3273848 - protein, 23 aa, Plasmodium falciparum
RLPSGKCPVFGKGIIIENSNTTF

SEQ ID NO: 3273849 - protein, 26 aa, Plasmodium falciparum
RLQCSQCGIFSCLLHFITWIILLPGM

SEQ ID NO: 3273850 - protein, 17 aa, Plasmodium falciparum
RLQFKLQNYCNLYKNSF

SEQ ID NO: 3273851 - protein, 19 aa, Plasmodium falciparum
RLQPYIDSIRNWDVQIKDQ

SEQ ID NO: 3273852 - protein, 22 aa, Plasmodium falciparum
RLQSVEGKNFFEGRSQNLEGRS

SEQ ID NO: 3273853 - protein, 17 aa, Plasmodium falciparum
RLRGGKGGFGANLRNKK

SEQ ID NO: 3273854 - protein, 24 aa, Plasmodium falciparum
RLSQCLNPLLPSGVHSKALIIYSS

SEQ ID NO: 3273855 - protein, 25 aa, Plasmodium falciparum
RLSRDRTKCSLIYEEFITRSCGFLV

SEQ ID NO: 3273856 - protein, 18 aa, Plasmodium falciparum
RLSYRRISKLVVYMFYKN

SEQ ID NO: 3273857 - protein, 18 aa, Plasmodium falciparum
RLTWTFDYLNSFLDYVNQ

SEQ ID NO: 3273858 - protein, 22 aa, Plasmodium falciparum
RLVKEYLNEKGCTCGYNKVGKK

SEQ ID NO: 3273859 - protein, 25 aa, Plasmodium falciparum
RLYDKLKVCEECMRKGESCTKGSGE

SEQ ID NO: 3273860 - protein, 19 aa, Plasmodium falciparum
RLYKKRFVKILEEKYKDKG

SEQ ID NO: 3273861 - protein, 21 aa, Plasmodium falciparum
RLYLYKYHKIHVMVLSKEKVD

SEQ ID NO: 3273862 - protein, 18 aa, Plasmodium falciparum
RLYRSSDGGKIWTNITGN

SEQ ID NO: 3273863 - protein, 19 aa, Plasmodium falciparum
RLYSFDLSYLLNLFSTDST

SEQ ID NO: 3273864 - protein, 21 aa, Plasmodium falciparum
RMEKKKKKKILIKNMSSCYNE

SEQ ID NO: 3273865 - protein, 20 aa, Plasmodium falciparum
RMFQLFDCSYIKYTKYLGKY

SEQ ID NO: 3273866 - protein, 30 aa, Plasmodium falciparum
RMGNQCTKCFFACYPYEKWIDKKKEEFLKQ

SEQ ID NO: 3273867 - protein, 28 aa, Plasmodium falciparum
RMIFNLIPLNWKNVCTKKKYDVKIKYIY

SEQ ID NO: 3273868 - protein, 25 aa, Plasmodium falciparum
RMISKRLKRIKGIILENDKYNNTKK

SEQ ID NO: 3273869 - protein, 26 aa, Plasmodium falciparum
RMKEKLRLIMKKKWKNHEFRKKMIKS

SEQ ID NO: 3273870 - protein, 24 aa, Plasmodium falciparum
RMKLFSFYINKYIKRNITCNQISK

SEQ ID NO: 3273871 - protein, 18 aa, Plasmodium falciparum
RMKNSLLNKDNFFYCKEK

SEQ ID NO: 3273872 - protein, 18 aa, Plasmodium falciparum
RMLSKKIKSSYERAHKNL

SEQ ID NO: 3273873 - protein, 22 aa, Plasmodium falciparum
RMMNIGRPFVYVLKDTKFSFLN

SEQ ID NO: 3273874 - protein, 19 aa, Plasmodium falciparum
RMNFLFVIKYVSTFILMFA

SEQ ID NO: 3273875 - protein, 19 aa, Plasmodium falciparum
RMPSGTFFDGIENLQRVHK

SEQ ID NO: 3273876 - protein, 25 aa, Plasmodium falciparum
RMQNVYLIICKKLLYYQKNQKDMEK

SEQ ID NO: 3273877 - protein, 22 aa, Plasmodium falciparum
RMRKEMLKFDIIIDHKEKLINS

SEQ ID NO: 3273878 - protein, 30 aa, Plasmodium falciparum
RMRTIVDTLIFCFNDKKFVYFFEENINITK

SEQ ID NO: 3273879 - protein, 17 aa, Plasmodium falciparum
RMSNLYSSFDGYQKLYD

SEQ ID NO: 3273880 - protein, 21 aa, Plasmodium falciparum
RMTTVPINHVMNFPNSYMSGA

SEQ ID NO: 3273881 - protein, 41 aa, Plasmodium falciparum
RMVLMKYRSLKIVAEDKMKLCLDFYSDIFVHVLDFASVLCN

SEQ ID NO: 3273882 - protein, 19 aa, Plasmodium falciparum
RMYYCISYIAFVKLICLLK

SEQ ID NO: 3273883 - protein, 17 aa, Plasmodium falciparum
RNACEKINMSLNQNTLC

SEQ ID NO: 3273884 - protein, 25 aa, Plasmodium falciparum
RNADRIPIMFNKFGILLEALIYKCI

SEQ ID NO: 3273885 - protein, 25 aa, Plasmodium falciparum
RNAEYCDPCPVFGVICNNGDCSNST

SEQ ID NO: 3273886 - protein, 17 aa, Plasmodium falciparum
RNAFKRSNINPEFGCLW

SEQ ID NO: 3273887 - protein, 19 aa, Plasmodium falciparum
RNANIYVFNYHSPLYPDGN

SEQ ID NO: 3273888 - protein, 27 aa, Plasmodium falciparum
RNCALQFCYYFHLYYCIFFYNKKENAF

SEQ ID NO: 3273889 - protein, 20 aa, Plasmodium falciparum
RNCCNRCFGRNIPLWYCSFG

SEQ ID NO: 3273890 - protein, 20 aa, Plasmodium falciparum
RNCILLGNTNYEFVELLEEL

SEQ ID NO: 3273891 - protein, 21 aa, Plasmodium falciparum
RNDLKEGCSYTSEHCFNKKNN

SEQ ID NO: 3273892 - protein, 26 aa, Plasmodium falciparum
RNDMILKERIFEYAKHKTSIDMLKHP

SEQ ID NO: 3273893 - protein, 30 aa, Plasmodium falciparum
RNDVWKCGKVCGLDVCGLKNANGKNYDQII

SEQ ID NO: 3273894 - protein, 19 aa, Plasmodium falciparum
RNECKQIKIIEFTRERKLM

SEQ ID NO: 3273895 - protein, 17 aa, Plasmodium falciparum
RNEECLILANAITYKDN

SEQ ID NO: 3273896 - protein, 18 aa, Plasmodium falciparum
RNEFQRYCEFIINEKNLV

SEQ ID NO: 3273897 - protein, 30 aa, Plasmodium falciparum
RNEKPFFKRALYLMDCFDNIYIDKLIDQNV

SEQ ID NO: 3273898 - protein, 20 aa, Plasmodium falciparum
RNELDFNIITYIMKRLYSFD

SEQ ID NO: 3273899 - protein, 20 aa, Plasmodium falciparum
RNELITDFLSGNIFDKIILN

SEQ ID NO: 3273900 - protein, 17 aa, Plasmodium falciparum
RNFMRMLKLNDINNINN

SEQ ID NO: 3273901 - protein, 18 aa, Plasmodium falciparum
RNFSQSFKSSLIDNEPDY

SEQ ID NO: 3273902 - protein, 18 aa, Plasmodium falciparum
RNFYEILYLLSTIANLIL

SEQ ID NO: 3273903 - protein, 26 aa, Plasmodium falciparum
RNGFKSFLWKNINIFKYSELDEITNP

SEQ ID NO: 3273904 - protein, 17 aa, Plasmodium falciparum
RNGKYCSFSDYEMNERI

SEQ ID NO: 3273905 - protein, 17 aa, Plasmodium falciparum
RNHFVSFNISLYALGNK

SEQ ID NO: 3273906 - protein, 18 aa, Plasmodium falciparum
RNHKHIIEFAKSVYNNMF

SEQ ID NO: 3273907 - protein, 19 aa, Plasmodium falciparum
RNHRNCISPLIPPLKKKKK

SEQ ID NO: 3273908 - protein, 22 aa, Plasmodium falciparum
RNHSLNYAWNAYFDKNKVKKNI

SEQ ID NO: 3273909 - protein, 28 aa, Plasmodium falciparum
RNICSPYKWKIKIIKVVGIKNNLCMISY

SEQ ID NO: 3273910 - protein, 17 aa, Plasmodium falciparum
RNIDVNGSKDEYSPETE

SEQ ID NO: 3273911 - protein, 18 aa, Plasmodium falciparum
RNIETQLIESGDGMNAGN

SEQ ID NO: 3273912 - protein, 22 aa, Plasmodium falciparum
RNIFFKHTFRVVSKNVVDKGQK

SEQ ID NO: 3273913 - protein, 32 aa, Plasmodium falciparum
RNIIKTIIFYFPYFICGGIASYMRIYFTNQCI

SEQ ID NO: 3273914 - protein, 21 aa, Plasmodium falciparum
RNIKLYIKKNIKNIIYNDIFY

SEQ ID NO: 3273915 - protein, 26 aa, Plasmodium falciparum
RNILDYCIFFIQKFNISYIKCIENNV

SEQ ID NO: 3273916 - protein, 18 aa, Plasmodium falciparum
RNILSVSEQECCIFNRTI

SEQ ID NO: 3273917 - protein, 24 aa, Plasmodium falciparum
RNINKNLFLNVCILLFKKQNFLLY

SEQ ID NO: 3273918 - protein, 22 aa, Plasmodium falciparum
RNINSCNTFSCNINSCNINSCN

SEQ ID NO: 3273919 - protein, 23 aa, Plasmodium falciparum
RNIRRRSKCLYDENKKAKKCIKK

SEQ ID NO: 3273920 - protein, 25 aa, Plasmodium falciparum
RNISEYTYACVFLKSIENSEVSISL

SEQ ID NO: 3273921 - protein, 26 aa, Plasmodium falciparum
RNITELFKVLLFVKVPYLSIFDIKNI

SEQ ID NO: 3273922 - protein, 20 aa, Plasmodium falciparum
RNITFYDFYDRLLILNYFHI

SEQ ID NO: 3273923 - protein, 22 aa, Plasmodium falciparum
RNITICKILLMINEYKHYRYIE

SEQ ID NO: 3273924 - protein, 25 aa, Plasmodium falciparum
RNIYKLLIVLSICIIYYFNLNFFSV

SEQ ID NO: 3273925 - protein, 18 aa, Plasmodium falciparum
RNIYKSNRINNTDNILRY

SEQ ID NO: 3273926 - protein, 28 aa, Plasmodium falciparum
RNKCVLYKYTDLLLFLFLIFILFQDIYS

SEQ ID NO: 3273927 - protein, 20 aa, Plasmodium falciparum
RNKDWYNLINLITLALLGCV

SEQ ID NO: 3273928 - protein, 20 aa, Plasmodium falciparum
RNKIESFYKNYLLKVKNNKK

SEQ ID NO: 3273929 - protein, 17 aa, Plasmodium falciparum
RNKILIVINNINTNHIL

SEQ ID NO: 3273930 - protein, 35 aa, Plasmodium falciparum
RNKIVLDIIEIFVYIPWNFGVDTGMYTPLVPMLPE

SEQ ID NO: 3273931 - protein, 17 aa, Plasmodium falciparum
RNKKCIDGFFSTKKKDF

SEQ ID NO: 3273932 - protein, 25 aa, Plasmodium falciparum
RNKKFLINKKFCPIYLIEKLGIKNH

SEQ ID NO: 3273933 - protein, 23 aa, Plasmodium falciparum
RNKKKNVCKLYFVNNNYKNNYNN

SEQ ID NO: 3273934 - protein, 18 aa, Plasmodium falciparum
RNKKLKKIILYINAYINL

SEQ ID NO: 3273935 - protein, 20 aa, Plasmodium falciparum
RNKLKLNRFVLELQENKRKN

SEQ ID NO: 3273936 - protein, 25 aa, Plasmodium falciparum
RNKRIRSECYIKFFKYGNEGDKQIL

SEQ ID NO: 3273937 - protein, 21 aa, Plasmodium falciparum
RNKRLPSYNILFASKDLKKKK

SEQ ID NO: 3273938 - protein, 17 aa, Plasmodium falciparum
RNKSGTFAFEYLTNKNF

SEQ ID NO: 3273939 - protein, 23 aa, Plasmodium falciparum
RNKSYELLRITSFMDSNSNNSSG

SEQ ID NO: 3273940 - protein, 25 aa, Plasmodium falciparum
RNKYKRPTFEHILKTISTLYQKANT

SEQ ID NO: 3273941 - protein, 21 aa, Plasmodium falciparum
RNLCINLLYICSKLMSSNFLS

SEQ ID NO: 3273942 - protein, 17 aa, Plasmodium falciparum
RNLFCLFNNYIKEEENL

SEQ ID NO: 3273943 - protein, 19 aa, Plasmodium falciparum
RNLFTTKFLPLSIQKIPKE

SEQ ID NO: 3273944 - protein, 21 aa, Plasmodium falciparum
RNLKIGTAVGYQLKQKDFYNM

SEQ ID NO: 3273945 - protein, 22 aa, Plasmodium falciparum
RNLKKKIFFRNYQYQYLFKDDS

SEQ ID NO: 3273946 - protein, 24 aa, Plasmodium falciparum
RNLSECFRGKSALNDDSESCRCSN

SEQ ID NO: 3273947 - protein, 30 aa, Plasmodium falciparum
RNLSFKFHYFFTRKFWLIYLSLAFIVLPGG

SEQ ID NO: 3273948 - protein, 18 aa, Plasmodium falciparum
RNMHKFKMLKNHIIYNKL

SEQ ID NO: 3273949 - protein, 18 aa, Plasmodium falciparum
RNMIFYIQYYLKSLRKNT

SEQ ID NO: 3273950 - protein, 22 aa, Plasmodium falciparum
RNMKLWIKKKEQSPDMKRYKEV

SEQ ID NO: 3273951 - protein, 18 aa, Plasmodium falciparum
RNNEEAAMLLIDYNADPN

SEQ ID NO: 3273952 - protein, 20 aa, Plasmodium falciparum
RNNEFLLIYKYERMIKMFKE

SEQ ID NO: 3273953 - protein, 20 aa, Plasmodium falciparum
RNNFIKNFFCAKNKSGLLLN

SEQ ID NO: 3273954 - protein, 19 aa, Plasmodium falciparum
RNNIFYDNVETFNVINETQ

SEQ ID NO: 3273955 - protein, 18 aa, Plasmodium falciparum
RNNIILLLYLFIYIHSVH

SEQ ID NO: 3273956 - protein, 23 aa, Plasmodium falciparum
RNNKNCYMRSYIKPRDKKKNTEN

SEQ ID NO: 3273957 - protein, 17 aa, Plasmodium falciparum
RNNKSCYNKLINYFLNL

SEQ ID NO: 3273958 - protein, 31 aa, Plasmodium falciparum
RNNNKLYAIKFLKIFSLKYMKKVKNMSEVNF

SEQ ID NO: 3273959 - protein, 21 aa, Plasmodium falciparum
RNNNMHLFHKYGIQYKDLIPM

SEQ ID NO: 3273960 - protein, 17 aa, Plasmodium falciparum
RNPDKCATLILCACEQK

SEQ ID NO: 3273961 - protein, 25 aa, Plasmodium falciparum
RNPKFKNLFYNYGFDTFENVKYSVI

SEQ ID NO: 3273962 - protein, 18 aa, Plasmodium falciparum
RNPNLTMWSWWLEKVNLK

SEQ ID NO: 3273963 - protein, 19 aa, Plasmodium falciparum
RNPYFFTIYQIFNPKNNEN

SEQ ID NO: 3273964 - protein, 18 aa, Plasmodium falciparum
RNQRWELLPPNLLIKQDI

SEQ ID NO: 3273965 - protein, 17 aa, Plasmodium falciparum
RNQYVMCSIYFLLIFSC

SEQ ID NO: 3273966 - protein, 24 aa, Plasmodium falciparum
RNRRSISLNIPKRSNLFKLRSNVI

SEQ ID NO: 3273967 - protein, 19 aa, Plasmodium falciparum
RNSCHRKSYNHKNLSSDKF

SEQ ID NO: 3273968 - protein, 18 aa, Plasmodium falciparum
RNSFMSVLINLILFSQLF

SEQ ID NO: 3273969 - protein, 19 aa, Plasmodium falciparum
RNSFNFPIYTSYKYNYKKT

SEQ ID NO: 3273970 - protein, 19 aa, Plasmodium falciparum
RNSKIAQMYKMDFEKKNEK

SEQ ID NO: 3273971 - protein, 17 aa, Plasmodium falciparum
RNSKSWSPTKGSLSYNK

SEQ ID NO: 3273972 - protein, 18 aa, Plasmodium falciparum
RNSLAIIIGNVGSGKSAF

SEQ ID NO: 3273973 - protein, 33 aa, Plasmodium falciparum
RNSRCKYKKAKLLKRFKIQISHLNKNKKDEDID

SEQ ID NO: 3273974 - protein, 26 aa, Plasmodium falciparum
RNSTILPQKGIRGRNTLDCNHPIHSV

SEQ ID NO: 3273975 - protein, 23 aa, Plasmodium falciparum
RNTEVASICNVCNVETNEKQRKK

SEQ ID NO: 3273976 - protein, 26 aa, Plasmodium falciparum
RNTLLKVIFFESFKKCILFSKKFSAK

SEQ ID NO: 3273977 - protein, 19 aa, Plasmodium falciparum
RNTWHHEINNQLNVINKYI

SEQ ID NO: 3273978 - protein, 17 aa, Plasmodium falciparum
RNVDSNDVKHCYHNNME

SEQ ID NO: 3273979 - protein, 17 aa, Plasmodium falciparum
RNVEFFYECLEDVDEFA

SEQ ID NO: 3273980 - protein, 19 aa, Plasmodium falciparum
RNVHKLIIIHELYCISIYS

SEQ ID NO: 3273981 - protein, 26 aa, Plasmodium falciparum
RNVLIPHFYPLFKLIALNVNNVKYKD

SEQ ID NO: 3273982 - protein, 25 aa, Plasmodium falciparum
RNVVNKCPYYLFRNLIYNFIPENAF

SEQ ID NO: 3273983 - protein, 25 aa, Plasmodium falciparum
RNYEEICSLIIFFLINSYKRIYVYF

SEQ ID NO: 3273984 - protein, 17 aa, Plasmodium falciparum
RNYEIIQMIILGLYSIH

SEQ ID NO: 3273985 - protein, 19 aa, Plasmodium falciparum
RNYFDMVKCNLYMNKDINL

SEQ ID NO: 3273986 - protein, 17 aa, Plasmodium falciparum
RNYICRNFIKHNVKNKK

SEQ ID NO: 3273987 - protein, 18 aa, Plasmodium falciparum
RNYKYFVYFVFNLYVLIC

SEQ ID NO: 3273988 - protein, 35 aa, Plasmodium falciparum
RNYLSCLYQYFIFNMDLCLLKDCTNFYIYHFKHSF

SEQ ID NO: 3273989 - protein, 42 aa, Plasmodium falciparum
RNYNICLLCEIPRMYYIFYLKDLRLFLEYLDDGILNVFISKS

SEQ ID NO: 3273990 - protein, 20 aa, Plasmodium falciparum
RNYNKEIFNKLNIKTYDIDC

SEQ ID NO: 3273991 - protein, 24 aa, Plasmodium falciparum
RPAENCKPCSLIEIKCKNGVCNGD

SEQ ID NO: 3273992 - protein, 24 aa, Plasmodium falciparum
RPEVSSLLNIKWMIFFLNLLFISA

SEQ ID NO: 3273993 - protein, 24 aa, Plasmodium falciparum
RPFKCLENSALIRELHVYGSLLKH

SEQ ID NO: 3273994 - protein, 30 aa, Plasmodium falciparum
RPIIKGFLWPNPKCRLAFIDVSIGKPGSKF

SEQ ID NO: 3273995 - protein, 17 aa, Plasmodium falciparum
RPKESYMNKGINFLLTN

SEQ ID NO: 3273996 - protein, 19 aa, Plasmodium falciparum
RPLFGIPEISYHSGRLNTL

SEQ ID NO: 3273997 - protein, 21 aa, Plasmodium falciparum
RPPFFRWFQEWGEEFCRKKKI

SEQ ID NO: 3273998 - protein, 23 aa, Plasmodium falciparum
RPPYFRYLEEWGENFCKERKKRL

SEQ ID NO: 3273999 - protein, 23 aa, Plasmodium falciparum
RPPYFRYLEEWGETFCRERKKRL

SEQ ID NO: 3274000 - protein, 25 aa, Plasmodium falciparum
RPPYFRYLEEWGETFCRQRTRMLKN

SEQ ID NO: 3274001 - protein, 23 aa, Plasmodium falciparum
RPPYFRYLEEWGQNFCKERKKRL

SEQ ID NO: 3274002 - protein, 24 aa, Plasmodium falciparum
RPPYFRYLEEWGQNFCKERKKRLE

SEQ ID NO: 3274003 - protein, 26 aa, Plasmodium falciparum
RPPYFRYLHEWGQNFCKKRKGMLENI

SEQ ID NO: 3274004 - protein, 25 aa, Plasmodium falciparum
RPQFLRWFIEWSDEFCRERKKKEEK

SEQ ID NO: 3274005 - protein, 19 aa, Plasmodium falciparum
RPSDFCKTKNLYFGYSLQP

SEQ ID NO: 3274006 - protein, 25 aa, Plasmodium falciparum
RPSFLRWMTEWGDQFCRERITQLQI

SEQ ID NO: 3274007 - protein, 18 aa, Plasmodium falciparum
RPSLNLKKINTYCLIDED

SEQ ID NO: 3274008 - protein, 23 aa, Plasmodium falciparum
RPTIFQCKKWKGGNPSTAEGQNK

SEQ ID NO: 3274009 - protein, 26 aa, Plasmodium falciparum
RPTYFRWLHEWGESFCRERKKRLKDI

SEQ ID NO: 3274010 - protein, 24 aa, Plasmodium falciparum
RPTYFRYLEEWGQNFCKERKKRLE

SEQ ID NO: 3274011 - protein, 20 aa, Plasmodium falciparum
RPVGTFKFSGPVCNLVQPNH

SEQ ID NO: 3274012 - protein, 22 aa, Plasmodium falciparum
RPVRTRKATGFVQVDMSKLLKE

SEQ ID NO: 3274013 - protein, 22 aa, Plasmodium falciparum
RQEFWGTYGKDIWKGMLCALQE

SEQ ID NO: 3274014 - protein, 24 aa, Plasmodium falciparum
RQEKLLFSFCKYIYYKWKGIMNYL

SEQ ID NO: 3274015 - protein, 20 aa, Plasmodium falciparum
RQFSELINNIHIIKKENTLL

SEQ ID NO: 3274016 - protein, 17 aa, Plasmodium falciparum
RQFTERISMLYKYDNNK

SEQ ID NO: 3274017 - protein, 23 aa, Plasmodium falciparum
RQHKEIKKTFNLCENINNNKMNR

SEQ ID NO: 3274018 - protein, 25 aa, Plasmodium falciparum
RQIECIKSGIYKGITIIEGVPGSGK

SEQ ID NO: 3274019 - protein, 23 aa, Plasmodium falciparum
RQISPDISSFFTFDYEESNENND

SEQ ID NO: 3274020 - protein, 23 aa, Plasmodium falciparum
RQKIIWRKWIAKHVYNIDIMENE

SEQ ID NO: 3274021 - protein, 19 aa, Plasmodium falciparum
RQLIISWLFFLQNIPTINI

SEQ ID NO: 3274022 - protein, 21 aa, Plasmodium falciparum
RQLRVCTTVAIAIVADTCLPY

SEQ ID NO: 3274023 - protein, 24 aa, Plasmodium falciparum
RQLSFCNFLSYPIILPNSIVNPRE

SEQ ID NO: 3274024 - protein, 20 aa, Plasmodium falciparum
RQLYRISYRKIYSIVLKVKL

SEQ ID NO: 3274025 - protein, 30 aa, Plasmodium falciparum
RQNGYSITCFEYFFFKLMKLIDNDIIDIYT

SEQ ID NO: 3274026 - protein, 20 aa, Plasmodium falciparum
RQNQQFIHCRDLYEIENNLL

SEQ ID NO: 3274027 - protein, 24 aa, Plasmodium falciparum
RQNWNCKYKCNLHVCELNNFNNEI

SEQ ID NO: 3274028 - protein, 20 aa, Plasmodium falciparum
RQRFMLFGTALLQFISTYFI

SEQ ID NO: 3274029 - protein, 20 aa, Plasmodium falciparum
RQSLPSAWLSNPFAIIKGFI

SEQ ID NO: 3274030 - protein, 20 aa, Plasmodium falciparum
RQTFHYCLNFNNIKNVIMLT

SEQ ID NO: 3274031 - protein, 17 aa, Plasmodium falciparum
RQTLCGATKSTLDKATC

SEQ ID NO: 3274032 - protein, 20 aa, Plasmodium falciparum
RQTPVSFVHKLFFIKNVLIH

SEQ ID NO: 3274033 - protein, 17 aa, Plasmodium falciparum
RRCTISPNISKKMINVY

SEQ ID NO: 3274034 - protein, 19 aa, Plasmodium falciparum
RRDLFPFSNISKMYYGKYM

SEQ ID NO: 3274035 - protein, 20 aa, Plasmodium falciparum
RRDTYNMIWGFNKIPTYIYN

SEQ ID NO: 3274036 - protein, 19 aa, Plasmodium falciparum
RRERINKRIEVLFITISNY

SEQ ID NO: 3274037 - protein, 17 aa, Plasmodium falciparum
RRETLIFLSCINDKNYA

SEQ ID NO: 3274038 - protein, 21 aa, Plasmodium falciparum
RRHSFKKILYIYLNNNIKIND

SEQ ID NO: 3274039 - protein, 20 aa, Plasmodium falciparum
RRIANIKTFEFIMLNGNISK

SEQ ID NO: 3274040 - protein, 18 aa, Plasmodium falciparum
RRIELEIVNLMKTKNESN

SEQ ID NO: 3274041 - protein, 22 aa, Plasmodium falciparum
RRIIYKLPVIILNLPSRKNKIY

SEQ ID NO: 3274042 - protein, 24 aa, Plasmodium falciparum
RRIKKEIYKLILFMNRKKKKLIDH

SEQ ID NO: 3274043 - protein, 17 aa, Plasmodium falciparum
RRIKLCVSGLTQTNNII

SEQ ID NO: 3274044 - protein, 29 aa, Plasmodium falciparum
RRIKNKHKWFCKKKNVFEYFTDHDFISTR

SEQ ID NO: 3274045 - protein, 18 aa, Plasmodium falciparum
RRIKNKKSDKNVKMNVMI

SEQ ID NO: 3274046 - protein, 19 aa, Plasmodium falciparum
RRILCDVIKDGIGANNLKK

SEQ ID NO: 3274047 - protein, 21 aa, Plasmodium falciparum
RRKEEEKKKSRKLEEDEEDDE

SEQ ID NO: 3274048 - protein, 24 aa, Plasmodium falciparum
RRKEKEGILFSKFDKMFKESFNED

SEQ ID NO: 3274049 - protein, 17 aa, Plasmodium falciparum
RRKEKILFDKYRNDNYD

SEQ ID NO: 3274050 - protein, 25 aa, Plasmodium falciparum
RRKELEIKSDFLLKKLENEMKYDPN

SEQ ID NO: 3274051 - protein, 17 aa, Plasmodium falciparum
RRKGNNVLLNLIFVSLC

SEQ ID NO: 3274052 - protein, 25 aa, Plasmodium falciparum
RRKIKLRNNMLFMIKNNIDNIRNYF

SEQ ID NO: 3274053 - protein, 24 aa, Plasmodium falciparum
RRKKEYKKKLAYVYPQYVIAEILR

SEQ ID NO: 3274054 - protein, 25 aa, Plasmodium falciparum
RRKKKWEFYNPSKLYYLDSRKIYKC

SEQ ID NO: 3274055 - protein, 19 aa, Plasmodium falciparum
RRKNMFSLYLLSFLIFHIY

SEQ ID NO: 3274056 - protein, 17 aa, Plasmodium falciparum
RRKSILLKEKWKMKDFR

SEQ ID NO: 3274057 - protein, 22 aa, Plasmodium falciparum
RRKVMKKNLLLLGYGNINKYSF

SEQ ID NO: 3274058 - protein, 26 aa, Plasmodium falciparum
RRKYKSTIIHFFKKKILRIKKKKKET

SEQ ID NO: 3274059 - protein, 20 aa, Plasmodium falciparum
RRLAPICGERENIKDNNLLK

SEQ ID NO: 3274060 - protein, 18 aa, Plasmodium falciparum
RRLLPVMFYCMVLLQINV

SEQ ID NO: 3274061 - protein, 25 aa, Plasmodium falciparum
RRLRRLRLLVLRFRRRLRRGHRDYK

SEQ ID NO: 3274062 - protein, 23 aa, Plasmodium falciparum
RRLSQYLCLYILYKDINIYNICN

SEQ ID NO: 3274063 - protein, 17 aa, Plasmodium falciparum
RRMIRGRLDDIKNVENV

SEQ ID NO: 3274064 - protein, 25 aa, Plasmodium falciparum
RRMSRTSLHIKRGSIGMNELLPSVI

SEQ ID NO: 3274065 - protein, 19 aa, Plasmodium falciparum
RRNDDLFVHYTNIYIKKYI

SEQ ID NO: 3274066 - protein, 17 aa, Plasmodium falciparum
RRNKEKFALYLRLMSLF

SEQ ID NO: 3274067 - protein, 27 aa, Plasmodium falciparum
RRNKGKKILGIRINKSLAEMDHTKYHP

SEQ ID NO: 3274068 - protein, 17 aa, Plasmodium falciparum
RRNNICFYIYNNKINNN

SEQ ID NO: 3274069 - protein, 20 aa, Plasmodium falciparum
RRNNILFIILEIIIKMNDAL

SEQ ID NO: 3274070 - protein, 24 aa, Plasmodium falciparum
RRNNILKIWIHQHLINKMKKIKNK

SEQ ID NO: 3274071 - protein, 21 aa, Plasmodium falciparum
RRNNIYLKNMNNFSSTKDEDE

SEQ ID NO: 3274072 - protein, 18 aa, Plasmodium falciparum
RRNNLHILLLKYRILECM

SEQ ID NO: 3274073 - protein, 20 aa, Plasmodium falciparum
RRNSESSSRIHVDDENYKRL

SEQ ID NO: 3274074 - protein, 18 aa, Plasmodium falciparum
RRQELCLGNIDRIYDKNL

SEQ ID NO: 3274075 - protein, 17 aa, Plasmodium falciparum
RRQESVLSLNKISILME

SEQ ID NO: 3274076 - protein, 26 aa, Plasmodium falciparum
RRQHIDISVLFFFPYNDFIYIIDKTG

SEQ ID NO: 3274077 - protein, 22 aa, Plasmodium falciparum
RRQHMCINHLKQIIKYTDTDST

SEQ ID NO: 3274078 - protein, 35 aa, Plasmodium falciparum
RRQLHLLYMSLYFKFKRFMIFIPYLYNLYKRYNNN

SEQ ID NO: 3274079 - protein, 17 aa, Plasmodium falciparum
RRQNLCVHYLTQLDDKD

SEQ ID NO: 3274080 - protein, 25 aa, Plasmodium falciparum
RRQQLCLYELFPIIIKNKNDITNAK

SEQ ID NO: 3274081 - protein, 26 aa, Plasmodium falciparum
RRRGYRMKRHMKVLITQSYQNFCSFN

SEQ ID NO: 3274082 - protein, 32 aa, Plasmodium falciparum
RRRKIFQTWYMAYLFIHKIYLISKMWNIVKNW

SEQ ID NO: 3274083 - protein, 25 aa, Plasmodium falciparum
RRRKKGRGTEIYFYKNTSNYVNKDY

SEQ ID NO: 3274084 - protein, 18 aa, Plasmodium falciparum
RRRQLCFRNIRKFHGRID

SEQ ID NO: 3274085 - protein, 25 aa, Plasmodium falciparum
RRRRKRMGSIYFKFNDHDEIKFINE

SEQ ID NO: 3274086 - protein, 19 aa, Plasmodium falciparum
RRRRKRRIEKKSDIDKTQI

SEQ ID NO: 3274087 - protein, 26 aa, Plasmodium falciparum
RRRSKKWNYFIIFFLGVCLGFAIWPF

SEQ ID NO: 3274088 - protein, 25 aa, Plasmodium falciparum
RRSLEKERMLNFPLIHLGENDVIVK

SEQ ID NO: 3274089 - protein, 20 aa, Plasmodium falciparum
RRSRKHKTVMGFEKKKRRNK

SEQ ID NO: 3274090 - protein, 18 aa, Plasmodium falciparum
RRSRLWNIVECLFYNVIN

SEQ ID NO: 3274091 - protein, 20 aa, Plasmodium falciparum
RRTILSVFAVICMLSLNLSI

SEQ ID NO: 3274092 - protein, 17 aa, Plasmodium falciparum
RRYGHVMVYSKPNLIVF

SEQ ID NO: 3274093 - protein, 19 aa, Plasmodium falciparum
RRYIFFLLYLIFLLINIFL

SEQ ID NO: 3274094 - protein, 26 aa, Plasmodium falciparum
RRYNMNCFKFLPWIFEAIFYSMIIYF

SEQ ID NO: 3274095 - protein, 25 aa, Plasmodium falciparum
RSATDNSICPWVMTKQGAAPRIQGK

SEQ ID NO: 3274096 - protein, 18 aa, Plasmodium falciparum
RSAYSDACSLTYKFHTNI

SEQ ID NO: 3274097 - protein, 20 aa, Plasmodium falciparum
RSCTCKEYKIIVKLYPQYFF

SEQ ID NO: 3274098 - protein, 23 aa, Plasmodium falciparum
RSDCSFILFPVGFTYLKKMEKTL

SEQ ID NO: 3274099 - protein, 30 aa, Plasmodium falciparum
RSEKEIYDQIKFSFIVKSIFQNSKLQLNYE

SEQ ID NO: 3274100 - protein, 17 aa, Plasmodium falciparum
RSELPNNIKSLFRSFHF

SEQ ID NO: 3274101 - protein, 25 aa, Plasmodium falciparum
RSEYCKSCPITDILCDDNECKTINE

SEQ ID NO: 3274102 - protein, 24 aa, Plasmodium falciparum
RSEYCKSCPMLGVTCKGEQCNSLD

SEQ ID NO: 3274103 - protein, 20 aa, Plasmodium falciparum
RSEYCQVCPDCGVKYNGSGW

SEQ ID NO: 3274104 - protein, 17 aa, Plasmodium falciparum
RSFEKESICLSDEHMVD

SEQ ID NO: 3274105 - protein, 32 aa, Plasmodium falciparum
RSFFKGSLARMALCIPASAVSWGTYETMKRFF

SEQ ID NO: 3274106 - protein, 18 aa, Plasmodium falciparum
RSFVWPIPLASFSEVYDF

SEQ ID NO: 3274107 - protein, 18 aa, Plasmodium falciparum
RSGKYCIIEICGKIRWVE

SEQ ID NO: 3274108 - protein, 23 aa, Plasmodium falciparum
RSGSELKGLLSLAKFEKNPPDKQ

SEQ ID NO: 3274109 - protein, 17 aa, Plasmodium falciparum
RSHEKSERIFLVVNDGN

SEQ ID NO: 3274110 - protein, 23 aa, Plasmodium falciparum
RSICRIFFFLFFLSLSYKTLLNI

SEQ ID NO: 3274111 - protein, 30 aa, Plasmodium falciparum
RSIFCTIHSYFIYDKIRLIIPKKSSSPEFK

SEQ ID NO: 3274112 - protein, 17 aa, Plasmodium falciparum
RSIKQCFKNCLKKTKKI

SEQ ID NO: 3274113 - protein, 22 aa, Plasmodium falciparum
RSINIPLFFNKTMHSFHSNFIY

SEQ ID NO: 3274114 - protein, 24 aa, Plasmodium falciparum
RSIRIFRSLRRIRRKKKFHQMGNV

SEQ ID NO: 3274115 - protein, 17 aa, Plasmodium falciparum
RSISSFILFLVFIICVM

SEQ ID NO: 3274116 - protein, 24 aa, Plasmodium falciparum
RSKEIEIVDHFKLYMKRDYCNYII

SEQ ID NO: 3274117 - protein, 25 aa, Plasmodium falciparum
RSKELYQEWKCYKGKDVEKVKDGKD

SEQ ID NO: 3274118 - protein, 20 aa, Plasmodium falciparum
RSKKAIYLLLNFNINKNVLK

SEQ ID NO: 3274119 - protein, 17 aa, Plasmodium falciparum
RSKLEVLENSKLLHKMG

SEQ ID NO: 3274120 - protein, 24 aa, Plasmodium falciparum
RSKNICNLFKLTHIKLEDIQINAI

SEQ ID NO: 3274121 - protein, 20 aa, Plasmodium falciparum
RSKYCQPCPICGMKKKGGKW

SEQ ID NO: 3274122 - protein, 19 aa, Plasmodium falciparum
RSKYCQPCPLCGVKKNDNG

SEQ ID NO: 3274123 - protein, 19 aa, Plasmodium falciparum
RSLCECKLYSPANYDSDPQ

SEQ ID NO: 3274124 - protein, 18 aa, Plasmodium falciparum
RSLCKNVLFVKTPLQGAQ

SEQ ID NO: 3274125 - protein, 24 aa, Plasmodium falciparum
RSLDLQIPLLYLFQKASLKVSDVV

SEQ ID NO: 3274126 - protein, 19 aa, Plasmodium falciparum
RSLEAFKNFVLETYKNAKA

SEQ ID NO: 3274127 - protein, 20 aa, Plasmodium falciparum
RSLISLKPRGFIIGIIYILY

SEQ ID NO: 3274128 - protein, 18 aa, Plasmodium falciparum
RSLLRILLDINNNVKEDY

SEQ ID NO: 3274129 - protein, 27 aa, Plasmodium falciparum
RSLRHVNDFSSFFFLDYRFSKKEIFQN

SEQ ID NO: 3274130 - protein, 24 aa, Plasmodium falciparum
RSLSTECYVYFRSFLKQAISPHSL

SEQ ID NO: 3274131 - protein, 23 aa, Plasmodium falciparum
RSNDLLIKRGWRTSGKSNGDNKL

SEQ ID NO: 3274132 - protein, 21 aa, Plasmodium falciparum
RSNMFTKYITYYAKRNVIQSL

SEQ ID NO: 3274133 - protein, 18 aa, Plasmodium falciparum
RSNTYNVYRTNDMNTNFL

SEQ ID NO: 3274134 - protein, 26 aa, Plasmodium falciparum
RSPHPINNPRVVFCGEYLSKSYFQCV

SEQ ID NO: 3274135 - protein, 22 aa, Plasmodium falciparum
RSPSMLRSLLISCYKNKNRKNL

SEQ ID NO: 3274136 - protein, 23 aa, Plasmodium falciparum
RSQNEFKLFTLRLINSLIGSSTY

SEQ ID NO: 3274137 - protein, 18 aa, Plasmodium falciparum
RSQYKHAFLFISMGSIVT

SEQ ID NO: 3274138 - protein, 17 aa, Plasmodium falciparum
RSRKRFRTITWKYTKTI

SEQ ID NO: 3274139 - protein, 20 aa, Plasmodium falciparum
RSSKKLKKKYFVQITYINYI

SEQ ID NO: 3274140 - protein, 17 aa, Plasmodium falciparum
RSSKRNNSSFNMIKVNV

SEQ ID NO: 3274141 - protein, 18 aa, Plasmodium falciparum
RSSSDFIQNEYFKTHNKT

SEQ ID NO: 3274142 - protein, 20 aa, Plasmodium falciparum
RSSWTAQYKVSGGKRRAKRF

SEQ ID NO: 3274143 - protein, 18 aa, Plasmodium falciparum
RSTDEWMGSVLAKISKDL

SEQ ID NO: 3274144 - protein, 17 aa, Plasmodium falciparum
RSTIFGFLHFFSSVSHM

SEQ ID NO: 3274145 - protein, 17 aa, Plasmodium falciparum
RSVKCDISNNIFMWLTY

SEQ ID NO: 3274146 - protein, 18 aa, Plasmodium falciparum
RSVSFCDFEKVQGYNYLN

SEQ ID NO: 3274147 - protein, 26 aa, Plasmodium falciparum
RSYMIKKRINDLILYNLKNIFEKINN

SEQ ID NO: 3274148 - protein, 21 aa, Plasmodium falciparum
RSYPLSLVLEHKFKEWMDSSP

SEQ ID NO: 3274149 - protein, 24 aa, Plasmodium falciparum
RSYPLSLVLEHKFKEWMNSSPAGF

SEQ ID NO: 3274150 - protein, 18 aa, Plasmodium falciparum
RSYSRLLVNEVFNKEYPS

SEQ ID NO: 3274151 - protein, 25 aa, Plasmodium falciparum
RTDILKCLLILLSSYMYYNNENFLK

SEQ ID NO: 3274152 - protein, 19 aa, Plasmodium falciparum
RTEDAIIPFIYHKNKEKYK

SEQ ID NO: 3274153 - protein, 17 aa, Plasmodium falciparum
RTEKIRWIHVAKHIFEV

SEQ ID NO: 3274154 - protein, 17 aa, Plasmodium falciparum
RTFFQTFLFSAVNLKID

SEQ ID NO: 3274155 - protein, 17 aa, Plasmodium falciparum
RTFLTGYHHDVEEPSQE

SEQ ID NO: 3274156 - protein, 25 aa, Plasmodium falciparum
RTFYENLKLFLLPLLQNIYHNRLIY

SEQ ID NO: 3274157 - protein, 19 aa, Plasmodium falciparum
RTHHCSACNRCVLNMDHHC

SEQ ID NO: 3274158 - protein, 18 aa, Plasmodium falciparum
RTHIRFLNLFEKLKKIKN

SEQ ID NO: 3274159 - protein, 23 aa, Plasmodium falciparum
RTHNILWCYKKKLDFSTSKKKRY

SEQ ID NO: 3274160 - protein, 25 aa, Plasmodium falciparum
RTIKPEWLVNIGICTHLGCVPAQGG

SEQ ID NO: 3274161 - protein, 57 aa, Plasmodium falciparum
RTIKSYKTKHIWIYNNIIHMFNFFDVFMIFSFSILAFFFIFICLNSISFIITSTILF

SEQ ID NO: 3274162 - protein, 17 aa, Plasmodium falciparum
RTINIISKFFGGVNKSN

SEQ ID NO: 3274163 - protein, 18 aa, Plasmodium falciparum
RTISIKNYYGFINLCNQY

SEQ ID NO: 3274164 - protein, 17 aa, Plasmodium falciparum
RTKCSLIVKAGDCFEIH

SEQ ID NO: 3274165 - protein, 21 aa, Plasmodium falciparum
RTKEALKEKQFRDHKRKEALK

SEQ ID NO: 3274166 - protein, 26 aa, Plasmodium falciparum
RTKEEKELYAALKPLSRFHSPQHHEY

SEQ ID NO: 3274167 - protein, 26 aa, Plasmodium falciparum
RTKKHVNCFFCDIYINKNNFDDSTKM

SEQ ID NO: 3274168 - protein, 18 aa, Plasmodium falciparum
RTKKSVLKRYSFQLYNKK

SEQ ID NO: 3274169 - protein, 31 aa, Plasmodium falciparum
RTKNVINIVLCIFKLLILTKEILVYYILNLF

SEQ ID NO: 3274170 - protein, 28 aa, Plasmodium falciparum
RTKYCEACPWCGAEKVEGGWKAKEENCS

SEQ ID NO: 3274171 - protein, 22 aa, Plasmodium falciparum
RTKYCEACPWCGAQKVEGGWKD

SEQ ID NO: 3274172 - protein, 24 aa, Plasmodium falciparum
RTLEELKLRGKNNIFKKDEKYNSL

SEQ ID NO: 3274173 - protein, 17 aa, Plasmodium falciparum
RTLFLFVHPRNYLINKK

SEQ ID NO: 3274174 - protein, 27 aa, Plasmodium falciparum
RTNDNIIRKWLPVHKFKHVGIYTIEDI

SEQ ID NO: 3274175 - protein, 21 aa, Plasmodium falciparum
RTNEMFSYEAFNFYINHMKNI

SEQ ID NO: 3274176 - protein, 23 aa, Plasmodium falciparum
RTNIFLKNCCNFLSIIYNDKSIL

SEQ ID NO: 3274177 - protein, 19 aa, Plasmodium falciparum
RTNMENIDLIKLANDPLNI

SEQ ID NO: 3274178 - protein, 19 aa, Plasmodium falciparum
RTNMEYFALVTHLYLYTYD

SEQ ID NO: 3274179 - protein, 21 aa, Plasmodium falciparum
RTNQGILRFNMRRGKKGSNEN

SEQ ID NO: 3274180 - protein, 22 aa, Plasmodium falciparum
RTNRWLKRCIDIHKKKEEQSLF

SEQ ID NO: 3274181 - protein, 22 aa, Plasmodium falciparum
RTRCSFDAAILKLGSKVLNITD

SEQ ID NO: 3274182 - protein, 22 aa, Plasmodium falciparum
RTRFFKSISNYGEFLLLQSSSR

SEQ ID NO: 3274183 - protein, 23 aa, Plasmodium falciparum
RTRKNSYNFLKPIKYDLFTHKKN

SEQ ID NO: 3274184 - protein, 17 aa, Plasmodium falciparum
RTSDIILCIAIFTTFPN

SEQ ID NO: 3274185 - protein, 19 aa, Plasmodium falciparum
RTVEKLKNFIFAFIDKMEK

SEQ ID NO: 3274186 - protein, 25 aa, Plasmodium falciparum
RTVTTCYWFPSPIKKYYTLYVRKHL

SEQ ID NO: 3274187 - protein, 17 aa, Plasmodium falciparum
RTYEICSIILKNYFVYY

SEQ ID NO: 3274188 - protein, 22 aa, Plasmodium falciparum
RVDDKLLKLSIYDIIRRNIFDI

SEQ ID NO: 3274189 - protein, 20 aa, Plasmodium falciparum
RVDYKYFLIDTINNEIYEKI

SEQ ID NO: 3274190 - protein, 27 aa, Plasmodium falciparum
RVESFHLFMMKSFPHLETVKKWHKLEC

SEQ ID NO: 3274191 - protein, 19 aa, Plasmodium falciparum
RVEYRTYPLIKEVETPIYQ

SEQ ID NO: 3274192 - protein, 30 aa, Plasmodium falciparum
RVFDSRNSYECSFPLLTNGPYYYENENNTS

SEQ ID NO: 3274193 - protein, 25 aa, Plasmodium falciparum
RVFIKNKFYPGLAMSRAIGDTIGHQ

SEQ ID NO: 3274194 - protein, 20 aa, Plasmodium falciparum
RVFVLFMYFFVQNVNSNKST

SEQ ID NO: 3274195 - protein, 19 aa, Plasmodium falciparum
RVHHCAECFHCIVHQDHHC

SEQ ID NO: 3274196 - protein, 19 aa, Plasmodium falciparum
RVHINLIIILIIYIASIKI

SEQ ID NO: 3274197 - protein, 21 aa, Plasmodium falciparum
RVHNRFKYMKKMKVYNSQHAK

SEQ ID NO: 3274198 - protein, 26 aa, Plasmodium falciparum
RVIDACTRLNIKLPYGGDTHLNKECF

SEQ ID NO: 3274199 - protein, 20 aa, Plasmodium falciparum
RVIMIYYIMKMMVLIFKIIY

SEQ ID NO: 3274200 - protein, 30 aa, Plasmodium falciparum
RVISIKVFIKRWLESFLKDYNKLKENLNPC

SEQ ID NO: 3274201 - protein, 23 aa, Plasmodium falciparum
RVIYYRFNFSFCRNNISFMFRKH

SEQ ID NO: 3274202 - protein, 21 aa, Plasmodium falciparum
RVKKISFGNCIASCITENDEI

SEQ ID NO: 3274203 - protein, 19 aa, Plasmodium falciparum
RVKMILLIKYILILLIIFL

SEQ ID NO: 3274204 - protein, 26 aa, Plasmodium falciparum
RVKNILRPTHLVFIKDWIDKFTKYMF

SEQ ID NO: 3274205 - protein, 18 aa, Plasmodium falciparum
RVKVCDVYPKSGDFISLM

SEQ ID NO: 3274206 - protein, 18 aa, Plasmodium falciparum
RVKYDLFGMDALKQSGFN

SEQ ID NO: 3274207 - protein, 19 aa, Plasmodium falciparum
RVLRECDIHKSIYDNDEDM

SEQ ID NO: 3274208 - protein, 26 aa, Plasmodium falciparum
RVLWWELHKKIIWAGMINQIEKESKE

SEQ ID NO: 3274209 - protein, 17 aa, Plasmodium falciparum
RVNEKSCHIKWNSINNI

SEQ ID NO: 3274210 - protein, 24 aa, Plasmodium falciparum
RVNKICKYNFFSIIEEIENQNQAC

SEQ ID NO: 3274211 - protein, 19 aa, Plasmodium falciparum
RVRPVRTRKPTGFVNVDVS

SEQ ID NO: 3274212 - protein, 24 aa, Plasmodium falciparum
RVRYERVNILSINFYQIYSSLSLQ

SEQ ID NO: 3274213 - protein, 17 aa, Plasmodium falciparum
RVSDCLILSEDVKKKNN

SEQ ID NO: 3274214 - protein, 18 aa, Plasmodium falciparum
RVSMIYFRHPVISETNFK

SEQ ID NO: 3274215 - protein, 26 aa, Plasmodium falciparum
RVVVFLCVCLFIVNICFDINKERKIN

SEQ ID NO: 3274216 - protein, 28 aa, Plasmodium falciparum
RVYKKNLCYNIKTFLKKKMKGSKKMYHQ

SEQ ID NO: 3274217 - protein, 20 aa, Plasmodium falciparum
RWALFFFLLVTLFKINNVFS

SEQ ID NO: 3274218 - protein, 30 aa, Plasmodium falciparum
RWDHKCTGCFLSCSHFRTWIDNQKEQFHKQ

SEQ ID NO: 3274219 - protein, 18 aa, Plasmodium falciparum
RWFILVFFMLQRFFEFKS

SEQ ID NO: 3274220 - protein, 20 aa, Plasmodium falciparum
RWFTHDMLFNLVLPQINFTY

SEQ ID NO: 3274221 - protein, 19 aa, Plasmodium falciparum
RWIFYKDFITHNVLAVSFC

SEQ ID NO: 3274222 - protein, 18 aa, Plasmodium falciparum
RWQFFIPHINKEGLYNIM

SEQ ID NO: 3274223 - protein, 22 aa, Plasmodium falciparum
RWTMKRFLCFSIGTASIIYAIL

SEQ ID NO: 3274224 - protein, 18 aa, Plasmodium falciparum
RYANCIFNNIGNNNSNKK

SEQ ID NO: 3274225 - protein, 24 aa, Plasmodium falciparum
RYCFYRRIYENIQIIRALQIKEKA

SEQ ID NO: 3274226 - protein, 20 aa, Plasmodium falciparum
RYDLANILGYENWTHYCINE

SEQ ID NO: 3274227 - protein, 17 aa, Plasmodium falciparum
RYEFIKYYYEKPLCNTT

SEQ ID NO: 3274228 - protein, 18 aa, Plasmodium falciparum
RYEILKMYSNKIVLSKDV

SEQ ID NO: 3274229 - protein, 20 aa, Plasmodium falciparum
RYEKKYKIDFFENKKKHIQN

SEQ ID NO: 3274230 - protein, 23 aa, Plasmodium falciparum
RYELKYVILKLLFLISESSKNEN

SEQ ID NO: 3274231 - protein, 21 aa, Plasmodium falciparum
RYEVDSLCLWSNMSSESSMNY

SEQ ID NO: 3274232 - protein, 60 aa, Plasmodium falciparum
RYFNLTILFNHLYHKKCSVCLFNFPSLKCSIYNCYNFIHLNCAYNYLSWPNYSKTSRHEI

SEQ ID NO: 3274233 - protein, 20 aa, Plasmodium falciparum
RYFSHIFCEYDINILSKNYS

SEQ ID NO: 3274234 - protein, 17 aa, Plasmodium falciparum
RYGKQCISCLYACNPYV

SEQ ID NO: 3274235 - protein, 17 aa, Plasmodium falciparum
RYGKQCISCLYGCNPYV

SEQ ID NO: 3274236 - protein, 30 aa, Plasmodium falciparum
RYGNRCTDCLYACYPYVHWIDKKKEEFDKQ

SEQ ID NO: 3274237 - protein, 18 aa, Plasmodium falciparum
RYGSGYGEDCKNNLPENP

SEQ ID NO: 3274238 - protein, 21 aa, Plasmodium falciparum
RYHLIKSRILFTQCIYNEDNK

SEQ ID NO: 3274239 - protein, 19 aa, Plasmodium falciparum
RYIERTIKNIIILKIFIII

SEQ ID NO: 3274240 - protein, 17 aa, Plasmodium falciparum
RYIKTTYLFNDIKRLVG

SEQ ID NO: 3274241 - protein, 25 aa, Plasmodium falciparum
RYIPPECWDLVKIYIKENVDYPFEY

SEQ ID NO: 3274242 - protein, 33 aa, Plasmodium falciparum
RYIREKHICSLHLLEYIFFKKITILLFLNKFSY

SEQ ID NO: 3274243 - protein, 29 aa, Plasmodium falciparum
RYISSIYLKELLKFCLSFITNILYSKHLT

SEQ ID NO: 3274244 - protein, 23 aa, Plasmodium falciparum
RYIYLKKWIPFKSMILSKLEKRK

SEQ ID NO: 3274245 - protein, 24 aa, Plasmodium falciparum
RYKDCGYFSFHFVDMYTFRFLINA

SEQ ID NO: 3274246 - protein, 22 aa, Plasmodium falciparum
RYKENICLRTSQELLDYLFTQL

SEQ ID NO: 3274247 - protein, 19 aa, Plasmodium falciparum
RYKNIYTFGYIRDDILFLY

SEQ ID NO: 3274248 - protein, 18 aa, Plasmodium falciparum
RYLLIIYEKVFKVIYIKN

SEQ ID NO: 3274249 - protein, 22 aa, Plasmodium falciparum
RYLVDRINFFNVRHCGKKKKIY

SEQ ID NO: 3274250 - protein, 22 aa, Plasmodium falciparum
RYLYVLLHIVHKILLKKKEEIL

SEQ ID NO: 3274251 - protein, 20 aa, Plasmodium falciparum
RYMLEKWKKEEWFYNLKNEW

SEQ ID NO: 3274252 - protein, 24 aa, Plasmodium falciparum
RYNFFLIYFWVIFMYPCETNKGNV

SEQ ID NO: 3274253 - protein, 26 aa, Plasmodium falciparum
RYNFLINDLCLLYFFEFTRRFKPSYN

SEQ ID NO: 3274254 - protein, 19 aa, Plasmodium falciparum
RYNNFYIKAERDFQNSLYK

SEQ ID NO: 3274255 - protein, 22 aa, Plasmodium falciparum
RYNRENEWMSSFFFKENNNREI

SEQ ID NO: 3274256 - protein, 29 aa, Plasmodium falciparum
RYNVLGIQKSICRNVSGAFRRKLRSGNKD

SEQ ID NO: 3274257 - protein, 20 aa, Plasmodium falciparum
RYNVSFNFVSCKSLNIPKDI

SEQ ID NO: 3274258 - protein, 19 aa, Plasmodium falciparum
RYQGMRYVDFMLSLKNILY

SEQ ID NO: 3274259 - protein, 17 aa, Plasmodium falciparum
RYRNCKSNNNIEVKDKK

SEQ ID NO: 3274260 - protein, 19 aa, Plasmodium falciparum
RYSKWYNKSDIGFSTHKLT

SEQ ID NO: 3274261 - protein, 21 aa, Plasmodium falciparum
RYTFYNQKIDLFINMINEKLV

SEQ ID NO: 3274262 - protein, 38 aa, Plasmodium falciparum
RYTNWVENSHIFSGQMIKICRNKRPLSNAYVGSNASKD

SEQ ID NO: 3274263 - protein, 17 aa, Plasmodium falciparum
RYTSFIISVLNQYADKY

SEQ ID NO: 3274264 - protein, 18 aa, Plasmodium falciparum
RYVDEEHMYSLKLPVYFI

SEQ ID NO: 3274265 - protein, 30 aa, Plasmodium falciparum
RYVDFPLHILMCIADYLLYIFKIIIIEKFD

SEQ ID NO: 3274266 - protein, 19 aa, Plasmodium falciparum
RYVEIKSMYTLYKEIIESS

SEQ ID NO: 3274267 - protein, 21 aa, Plasmodium falciparum
RYVEILYYYIDVIKNDRKKNS

SEQ ID NO: 3274268 - protein, 21 aa, Plasmodium falciparum
RYVKLSKSFGVHYSNLISAKF

SEQ ID NO: 3274269 - protein, 17 aa, Plasmodium falciparum
RYWGWKCIGDKTATGEA

SEQ ID NO: 3274270 - protein, 40 aa, Plasmodium falciparum
RYYFFKKSKIMNFPKGLVYLSGYFLWLVAFLNNEKQEIII

SEQ ID NO: 3274271 - protein, 17 aa, Plasmodium falciparum
RYYKYNELEGGGKEEED

SEQ ID NO: 3274272 - protein, 21 aa, Plasmodium falciparum
SAALACFLLFSAFLSEVSVHS

SEQ ID NO: 3274273 - protein, 21 aa, Plasmodium falciparum
SAASIPLCFSENIKNGKIKTN

SEQ ID NO: 3274274 - protein, 18 aa, Plasmodium falciparum
SACFFKRNKIVVLKRRVG

SEQ ID NO: 3274275 - protein, 24 aa, Plasmodium falciparum
SACKSNDDLTEFYLYNEINNHKYN

SEQ ID NO: 3274276 - protein, 19 aa, Plasmodium falciparum
SAEELNRLLNIQHLTIPEI

SEQ ID NO: 3274277 - protein, 18 aa, Plasmodium falciparum
SAFVVVPFVKYITSLQNY

SEQ ID NO: 3274278 - protein, 18 aa, Plasmodium falciparum
SAGDCLREYLKKCEKNEV

SEQ ID NO: 3274279 - protein, 17 aa, Plasmodium falciparum
SAGGLCILPNPKKKEES

SEQ ID NO: 3274280 - protein, 22 aa, Plasmodium falciparum
SAHFPLQLPYVLFGLGRTSNYV

SEQ ID NO: 3274281 - protein, 21 aa, Plasmodium falciparum
SAHLKALNYVGLKHFYNSEKE

SEQ ID NO: 3274282 - protein, 28 aa, Plasmodium falciparum
SAIGIAIGCLLGMIPLLFIDNNKLEERK

SEQ ID NO: 3274283 - protein, 19 aa, Plasmodium falciparum
SAIICEIIMVIGYMLKICL

SEQ ID NO: 3274284 - protein, 20 aa, Plasmodium falciparum
SAIMSFNSLCIYNNTHRNNN

SEQ ID NO: 3274285 - protein, 20 aa, Plasmodium falciparum
SAIRLNMPILLNGKNNSGKS

SEQ ID NO: 3274286 - protein, 17 aa, Plasmodium falciparum
SAITCISDPILSNDTSY

SEQ ID NO: 3274287 - protein, 23 aa, Plasmodium falciparum
SAKSRRCAISFRDYVLKDIFKVG

SEQ ID NO: 3274288 - protein, 21 aa, Plasmodium falciparum
SALGIPSLILFLKAVCQSKKN

SEQ ID NO: 3274289 - protein, 20 aa, Plasmodium falciparum
SALIGGICALHISPRNLFQS

SEQ ID NO: 3274290 - protein, 24 aa, Plasmodium falciparum
SALIGKCSFGLNFVYSKVQHWLYR

SEQ ID NO: 3274291 - protein, 24 aa, Plasmodium falciparum
SALSAWKPVAIEAAEKAAIAKATD

SEQ ID NO: 3274292 - protein, 20 aa, Plasmodium falciparum
SALTRRLTLVQGPPGTGKTH

SEQ ID NO: 3274293 - protein, 19 aa, Plasmodium falciparum
SANMNTFRLANNLGTLKGY

SEQ ID NO: 3274294 - protein, 23 aa, Plasmodium falciparum
SAPCGACTSAGAIIHHRRYKEKR

SEQ ID NO: 3274295 - protein, 30 aa, Plasmodium falciparum
SAPECVFCGPSHVYMSFKPINVITAENEYY

SEQ ID NO: 3274296 - protein, 19 aa, Plasmodium falciparum
SAQFCKNIQKPLCDTFNKI

SEQ ID NO: 3274297 - protein, 17 aa, Plasmodium falciparum
SASFLYMFSEFFMMSHE

SEQ ID NO: 3274298 - protein, 21 aa, Plasmodium falciparum
SASLNKWNVFSQIAHDLSLAD

SEQ ID NO: 3274299 - protein, 25 aa, Plasmodium falciparum
SASLRQLYMSILMLYYLYPLHVCTN

SEQ ID NO: 3274300 - protein, 19 aa, Plasmodium falciparum
SASNIYLLAHFLVLSLAYL

SEQ ID NO: 3274301 - protein, 18 aa, Plasmodium falciparum
SASQLIWIAQKLFKMYVP

SEQ ID NO: 3274302 - protein, 23 aa, Plasmodium falciparum
SASVFKVPFLSLYVTTCGNTKLP

SEQ ID NO: 3274303 - protein, 17 aa, Plasmodium falciparum
SAVPSFIAFSSFVGIIL

SEQ ID NO: 3274304 - protein, 25 aa, Plasmodium falciparum
SAYMPPECWKIYKRHRILNIKNPLQ

SEQ ID NO: 3274305 - protein, 18 aa, Plasmodium falciparum
SCALYDCVKNIEEVEGCS

SEQ ID NO: 3274306 - protein, 23 aa, Plasmodium falciparum
SCANSCSSYRKWIERKKYEFKKQ

SEQ ID NO: 3274307 - protein, 24 aa, Plasmodium falciparum
SCATSCSYYRKWINTKKAEYEKQE

SEQ ID NO: 3274308 - protein, 22 aa, Plasmodium falciparum
SCDCSEPIYIRGCQPKIYDGKI

SEQ ID NO: 3274309 - protein, 19 aa, Plasmodium falciparum
SCDVFNRILVIAILIKSIG

SEQ ID NO: 3274310 - protein, 18 aa, Plasmodium falciparum
SCFINLFYFEKHIKLNSF

SEQ ID NO: 3274311 - protein, 25 aa, Plasmodium falciparum
SCFKSLLSKPIVMIIAGILYIVILN

SEQ ID NO: 3274312 - protein, 17 aa, Plasmodium falciparum
SCFLNLPILFNHQTKEC

SEQ ID NO: 3274313 - protein, 23 aa, Plasmodium falciparum
SCFYPKEFELIKSRMIHPNIVDR

SEQ ID NO: 3274314 - protein, 17 aa, Plasmodium falciparum
SCFYRNKYIKKKKKVIY

SEQ ID NO: 3274315 - protein, 21 aa, Plasmodium falciparum
SCGIIRHICNLYFKSKIFYLN

SEQ ID NO: 3274316 - protein, 23 aa, Plasmodium falciparum
SCGLSGWVAVLGIWSVFVFLLII

SEQ ID NO: 3274317 - protein, 23 aa, Plasmodium falciparum
SCGNSALKIAVDILKSRNGNGNV

SEQ ID NO: 3274318 - protein, 24 aa, Plasmodium falciparum
SCGYNKPQYFYIFFHFYLNNTKKY

SEQ ID NO: 3274319 - protein, 24 aa, Plasmodium falciparum
SCHFILERKKIWIFKDLIDNIKIY

SEQ ID NO: 3274320 - protein, 21 aa, Plasmodium falciparum
SCIIIQIFNSFILILISNNFI

SEQ ID NO: 3274321 - protein, 25 aa, Plasmodium falciparum
SCILRCNKKIIKRKNWEHAYFKYDG

SEQ ID NO: 3274322 - protein, 19 aa, Plasmodium falciparum
SCILSVYNFHYALFNYYFF

SEQ ID NO: 3274323 - protein, 37 aa, Plasmodium falciparum
SCIMSPFCFPKCCMKHCIPRNDFEVVYDKLMWNAFAK

SEQ ID NO: 3274324 - protein, 20 aa, Plasmodium falciparum
SCINSFELMVVWKYSISNLF

SEQ ID NO: 3274325 - protein, 18 aa, Plasmodium falciparum
SCIPCPYNTFQPHHSYGK

SEQ ID NO: 3274326 - protein, 19 aa, Plasmodium falciparum
SCIRKKYNFINQLSDEQRN

SEQ ID NO: 3274327 - protein, 21 aa, Plasmodium falciparum
SCKECFLQLVEYNFKNTLREK

SEQ ID NO: 3274328 - protein, 22 aa, Plasmodium falciparum
SCKKPLKNMLIQNLRNIIEQNF

SEQ ID NO: 3274329 - protein, 23 aa, Plasmodium falciparum
SCKLCESCESYKLCKLCTSCYYN

SEQ ID NO: 3274330 - protein, 24 aa, Plasmodium falciparum
SCKQGCKGNCDCVDKWLKNKSTEW

SEQ ID NO: 3274331 - protein, 25 aa, Plasmodium falciparum
SCLNFAKIGFLYSFYENSLQKIRAT

SEQ ID NO: 3274332 - protein, 21 aa, Plasmodium falciparum
SCLVNGLCIEEWLNIPEINDI

SEQ ID NO: 3274333 - protein, 18 aa, Plasmodium falciparum
SCMPPRRIKLCVSGLTQT

SEQ ID NO: 3274334 - protein, 21 aa, Plasmodium falciparum
SCNIPMYLSSNIFVNFRNKKC

SEQ ID NO: 3274335 - protein, 24 aa, Plasmodium falciparum
SCNYLNYLFNFIINYADYHLPLIL

SEQ ID NO: 3274336 - protein, 20 aa, Plasmodium falciparum
SCPSTNWFKSTAIKWSLSIE

SEQ ID NO: 3274337 - protein, 21 aa, Plasmodium falciparum
SCPYIKILEMIKKYVPDYLHF

SEQ ID NO: 3274338 - protein, 21 aa, Plasmodium falciparum
SCRKKGNCKYGMSTVHTLYFI

SEQ ID NO: 3274339 - protein, 23 aa, Plasmodium falciparum
SCRNIKNSIVGTIMKIFSIEYEK

SEQ ID NO: 3274340 - protein, 29 aa, Plasmodium falciparum
SCSVVLMCISSLYHLTKFFYKEYIIDSII

SEQ ID NO: 3274341 - protein, 19 aa, Plasmodium falciparum
SCSYRRAHNNIKYDIKEGG

SEQ ID NO: 3274342 - protein, 22 aa, Plasmodium falciparum
SCSYSSDIYLCMNKIDSYPIFH

SEQ ID NO: 3274343 - protein, 26 aa, Plasmodium falciparum
SCTFPIMKVPTEWKKSPIWIPLKSSQ

SEQ ID NO: 3274344 - protein, 26 aa, Plasmodium falciparum
SCTKKYTNVCLLLFDYFGYYNVVIQY

SEQ ID NO: 3274345 - protein, 18 aa, Plasmodium falciparum
SCTYDHLFKKAKELLLRV

SEQ ID NO: 3274346 - protein, 26 aa, Plasmodium falciparum
SCVCPVMRIKILKSFMSGRVNFPTAF

SEQ ID NO: 3274347 - protein, 38 aa, Plasmodium falciparum
SCVEKLSFDHFSFFFINAIVCLSIYTKVIHKHKHIYRI

SEQ ID NO: 3274348 - protein, 19 aa, Plasmodium falciparum
SCVILKINFIIILSYTLSS

SEQ ID NO: 3274349 - protein, 17 aa, Plasmodium falciparum
SCVNLRLFRTVFLSWIL

SEQ ID NO: 3274350 - protein, 20 aa, Plasmodium falciparum
SCVSKVFLVLGSYYFINNNN

SEQ ID NO: 3274351 - protein, 22 aa, Plasmodium falciparum
SCYPNKNVNVIFSLFDNGNNCY

SEQ ID NO: 3274352 - protein, 21 aa, Plasmodium falciparum
SCYYWSVSGDPVYNIYGNAKS

SEQ ID NO: 3274353 - protein, 19 aa, Plasmodium falciparum
SDACGLKYGPGGKEKFPNW

SEQ ID NO: 3274354 - protein, 20 aa, Plasmodium falciparum
SDACGLKYGPGGKERYSQWK

SEQ ID NO: 3274355 - protein, 20 aa, Plasmodium falciparum
SDACTLKYVTGKNYGWKCIP

SEQ ID NO: 3274356 - protein, 22 aa, Plasmodium falciparum
SDAIPSCVCEKSIAEKAEKGCL

SEQ ID NO: 3274357 - protein, 22 aa, Plasmodium falciparum
SDAIPTCICEKSIADKVEKTCL

SEQ ID NO: 3274358 - protein, 24 aa, Plasmodium falciparum
SDAIPTCICEKSLADKVEKGCLRC

SEQ ID NO: 3274359 - protein, 23 aa, Plasmodium falciparum
SDAIPTCICEKSLADKVEKNCLK

SEQ ID NO: 3274360 - protein, 23 aa, Plasmodium falciparum
SDAIPTCICEKSLADKVEKTCLK

SEQ ID NO: 3274361 - protein, 24 aa, Plasmodium falciparum
SDAIPTCICEKSLADKVERGCLRC

SEQ ID NO: 3274362 - protein, 23 aa, Plasmodium falciparum
SDAIPTCICEKSLEDKMEKECLK

SEQ ID NO: 3274363 - protein, 23 aa, Plasmodium falciparum
SDAIPTCICKTSMADKVEKTCLK

SEQ ID NO: 3274364 - protein, 24 aa, Plasmodium falciparum
SDAIPTCVCEKSIADKMEKGCLRC

SEQ ID NO: 3274365 - protein, 23 aa, Plasmodium falciparum
SDAIPTCVCEKSIEDKVEKGCLR

SEQ ID NO: 3274366 - protein, 21 aa, Plasmodium falciparum
SDAIPTCVCEKSLADKTEKFC

SEQ ID NO: 3274367 - protein, 22 aa, Plasmodium falciparum
SDAIPTCVCEKSLADKVEKTCL

SEQ ID NO: 3274368 - protein, 23 aa, Plasmodium falciparum
SDAIPTCVCEKSLADKVEKTCLR

SEQ ID NO: 3274369 - protein, 21 aa, Plasmodium falciparum
SDAIPTCVCEKSMADKVEKGC

SEQ ID NO: 3274370 - protein, 23 aa, Plasmodium falciparum
SDALPTCICERSIADKVEKNCMK

SEQ ID NO: 3274371 - protein, 18 aa, Plasmodium falciparum
SDAPIYLYFYFFSNLYLD

SEQ ID NO: 3274372 - protein, 23 aa, Plasmodium falciparum
SDCYNFLKNIYVYNICKRKNEEN

SEQ ID NO: 3274373 - protein, 24 aa, Plasmodium falciparum
SDDFFSICILFSHFILSNINENII

SEQ ID NO: 3274374 - protein, 24 aa, Plasmodium falciparum
SDDIPTCICEMSMADKVEKGCLRC

SEQ ID NO: 3274375 - protein, 17 aa, Plasmodium falciparum
SDDKKLEGYKCAENFLK

SEQ ID NO: 3274376 - protein, 23 aa, Plasmodium falciparum
SDDLEFIDLVGVQTKYIRNKKKK

SEQ ID NO: 3274377 - protein, 18 aa, Plasmodium falciparum
SDDREGRVWYRMKNEEYI

SEQ ID NO: 3274378 - protein, 19 aa, Plasmodium falciparum
SDDSLCFNNTSSIETNSKR

SEQ ID NO: 3274379 - protein, 20 aa, Plasmodium falciparum
SDELEEFYLRKNLLDLCDNN

SEQ ID NO: 3274380 - protein, 17 aa, Plasmodium falciparum
SDESLNFLKYIKKRTTN

SEQ ID NO: 3274381 - protein, 24 aa, Plasmodium falciparum
SDESRIAVLNTIYLFLNRANSKLL

SEQ ID NO: 3274382 - protein, 19 aa, Plasmodium falciparum
SDEVLNVWVYYRHKKKKAY

SEQ ID NO: 3274383 - protein, 20 aa, Plasmodium falciparum
SDFFLLYYALPFEEEINIKN

SEQ ID NO: 3274384 - protein, 24 aa, Plasmodium falciparum
SDFIKSLILLLNIIYKYSYNIHFD

SEQ ID NO: 3274385 - protein, 17 aa, Plasmodium falciparum
SDFPMCTMLARSFADIG

SEQ ID NO: 3274386 - protein, 17 aa, Plasmodium falciparum
SDFRYYEYVTFISSLYL

SEQ ID NO: 3274387 - protein, 22 aa, Plasmodium falciparum
SDFSGLMLRGLANLKIVPQPNL

SEQ ID NO: 3274388 - protein, 18 aa, Plasmodium falciparum
SDGGKIWTNITGNLSDKE

SEQ ID NO: 3274389 - protein, 29 aa, Plasmodium falciparum
SDGHECFVCPKCGLILSPIMQFNTTGKIM

SEQ ID NO: 3274390 - protein, 23 aa, Plasmodium falciparum
SDGIPTCICEKSLADKVEKVCLR

SEQ ID NO: 3274391 - protein, 17 aa, Plasmodium falciparum
SDGISCNLSHKFHTNIT

SEQ ID NO: 3274392 - protein, 26 aa, Plasmodium falciparum
SDIFELYSLYIFYFVCDKNLFIYEIN

SEQ ID NO: 3274393 - protein, 17 aa, Plasmodium falciparum
SDIGLNRRIFKYLYLYE

SEQ ID NO: 3274394 - protein, 19 aa, Plasmodium falciparum
SDIILCIAIFTTFPNDVNL

SEQ ID NO: 3274395 - protein, 21 aa, Plasmodium falciparum
SDIKDFMVFSIYGIFNIYDNN

SEQ ID NO: 3274396 - protein, 19 aa, Plasmodium falciparum
SDIKNYECRIKKKAGDIYL

SEQ ID NO: 3274397 - protein, 18 aa, Plasmodium falciparum
SDILFEYFLDDIRLNCYD

SEQ ID NO: 3274398 - protein, 17 aa, Plasmodium falciparum
SDILFLVSVKNYTNLYK

SEQ ID NO: 3274399 - protein, 23 aa, Plasmodium falciparum
SDILKTTIPFGIALALTSIAFLF

SEQ ID NO: 3274400 - protein, 24 aa, Plasmodium falciparum
SDILKTTIPFGIALALTSIVFLYL

SEQ ID NO: 3274401 - protein, 26 aa, Plasmodium falciparum
SDIMPQWAGSSWYFLRYIDSKNKKRI

SEQ ID NO: 3274402 - protein, 22 aa, Plasmodium falciparum
SDINEDCYFSATGFEGESIYHN

SEQ ID NO: 3274403 - protein, 17 aa, Plasmodium falciparum
SDIPIVKLHNSFDNVKE

SEQ ID NO: 3274404 - protein, 17 aa, Plasmodium falciparum
SDIRRWIIDSVLLDEND

SEQ ID NO: 3274405 - protein, 18 aa, Plasmodium falciparum
SDIYWTLSNVSFYTADWY

SEQ ID NO: 3274406 - protein, 25 aa, Plasmodium falciparum
SDKILCISKKMPLYIDGIYFCCCLD

SEQ ID NO: 3274407 - protein, 18 aa, Plasmodium falciparum
SDKLKYYMLRGEVKKNKD

SEQ ID NO: 3274408 - protein, 20 aa, Plasmodium falciparum
SDKYLLPEHNFWLEPKTLST

SEQ ID NO: 3274409 - protein, 24 aa, Plasmodium falciparum
SDKYSRKWMLVFGTALWGVATILL

SEQ ID NO: 3274410 - protein, 24 aa, Plasmodium falciparum
SDLIKCVLEIEVLDIKIRKKGNED

SEQ ID NO: 3274411 - protein, 18 aa, Plasmodium falciparum
SDLKCVGGHITNDRYENS

SEQ ID NO: 3274412 - protein, 23 aa, Plasmodium falciparum
SDLNKFYLLRSIYNFDYSSKHFQ

SEQ ID NO: 3274413 - protein, 24 aa, Plasmodium falciparum
SDLNKIKIILLFTQIIFDEINQIH

SEQ ID NO: 3274414 - protein, 25 aa, Plasmodium falciparum
SDLRRTISSCFISFYNRINKNNEDI

SEQ ID NO: 3274415 - protein, 23 aa, Plasmodium falciparum
SDLRYLCVHGFFNIISKVEYTYV

SEQ ID NO: 3274416 - protein, 22 aa, Plasmodium falciparum
SDLSKLCLELNLKNIYLKYQAE

SEQ ID NO: 3274417 - protein, 20 aa, Plasmodium falciparum
SDLVCSICCVEYANDDDICI

SEQ ID NO: 3274418 - protein, 18 aa, Plasmodium falciparum
SDMVNSYGLFSFIEESCE

SEQ ID NO: 3274419 - protein, 30 aa, Plasmodium falciparum
SDNDPKSWWKLHAPYIWNGMIYALTYDTNT

SEQ ID NO: 3274420 - protein, 24 aa, Plasmodium falciparum
SDNEKRKVLHFMIKNIKNVVQGDI

SEQ ID NO: 3274421 - protein, 25 aa, Plasmodium falciparum
SDNENIFFGFLFFYGLILEPTRELC

SEQ ID NO: 3274422 - protein, 19 aa, Plasmodium falciparum
SDNFLKKKVRTEDKNTNGQ

SEQ ID NO: 3274423 - protein, 18 aa, Plasmodium falciparum
SDNFVCIITTLATTNNYT

SEQ ID NO: 3274424 - protein, 24 aa, Plasmodium falciparum
SDNIFKKKIENLIMIRSNLYKYMN

SEQ ID NO: 3274425 - protein, 25 aa, Plasmodium falciparum
SDNITCLWKKINISGDSKNYCGNFY

SEQ ID NO: 3274426 - protein, 20 aa, Plasmodium falciparum
SDNYFYFLICANNINNMLSR

SEQ ID NO: 3274427 - protein, 24 aa, Plasmodium falciparum
SDNYIKTCEYIKCNKLDHIKVESY

SEQ ID NO: 3274428 - protein, 18 aa, Plasmodium falciparum
SDPNYKSVFFYFKKEEIS

SEQ ID NO: 3274429 - protein, 27 aa, Plasmodium falciparum
SDSCNVLCLFLFFLSLFFIMIISADNN

SEQ ID NO: 3274430 - protein, 23 aa, Plasmodium falciparum
SDSIPTCICEKSLEDKMEKECLK

SEQ ID NO: 3274431 - protein, 17 aa, Plasmodium falciparum
SDSLSFISTFPTFNNIE

SEQ ID NO: 3274432 - protein, 24 aa, Plasmodium falciparum
SDSQICALSILKLYLKNNLDVNDG

SEQ ID NO: 3274433 - protein, 23 aa, Plasmodium falciparum
SDSSLCEPWQCYQPEELTKDDQG

SEQ ID NO: 3274434 - protein, 18 aa, Plasmodium falciparum
SDSYKYCSECLSINLEDL

SEQ ID NO: 3274435 - protein, 25 aa, Plasmodium falciparum
SDTFFEFLFKITINISNLIHTIDEK

SEQ ID NO: 3274436 - protein, 24 aa, Plasmodium falciparum
SDTLLLEVCMAAKYEGQSINTHYT

SEQ ID NO: 3274437 - protein, 24 aa, Plasmodium falciparum
SDTRYVWYSFFFFVSICVYITMRR

SEQ ID NO: 3274438 - protein, 17 aa, Plasmodium falciparum
SDVCLDVLALSKFTKQY

SEQ ID NO: 3274439 - protein, 23 aa, Plasmodium falciparum
SDVCTALARSFADIGDIVRGIDM

SEQ ID NO: 3274440 - protein, 20 aa, Plasmodium falciparum
SDVFKKPFFFIQLNTDSSQH

SEQ ID NO: 3274441 - protein, 28 aa, Plasmodium falciparum
SDVKIKIKLMLKKKISMNDIYNLIYNIG

SEQ ID NO: 3274442 - protein, 19 aa, Plasmodium falciparum
SDVLKCLKGQTSVYNKIEE

SEQ ID NO: 3274443 - protein, 18 aa, Plasmodium falciparum
SDWWKVMSASAFPWTVGV

SEQ ID NO: 3274444 - protein, 25 aa, Plasmodium falciparum
SDYCLKYFNFYSIEYYNCIKSEIKS

SEQ ID NO: 3274445 - protein, 21 aa, Plasmodium falciparum
SDYDFLTILCMQLLLYHNINN

SEQ ID NO: 3274446 - protein, 23 aa, Plasmodium falciparum
SDYECNNLIPLFLNNLEYSNISQ

SEQ ID NO: 3274447 - protein, 23 aa, Plasmodium falciparum
SDYFYNILEKICMKCKIKTKFMC

SEQ ID NO: 3274448 - protein, 18 aa, Plasmodium falciparum
SDYGFILFDNQKVHIKSK

SEQ ID NO: 3274449 - protein, 19 aa, Plasmodium falciparum
SDYKFNRILSDPFFLELNE

SEQ ID NO: 3274450 - protein, 27 aa, Plasmodium falciparum
SDYKNKCTMCPEVKDVPISIIRNNEQT

SEQ ID NO: 3274451 - protein, 23 aa, Plasmodium falciparum
SDYNLNPILSHPLFLELDEQTKK

SEQ ID NO: 3274452 - protein, 24 aa, Plasmodium falciparum
SEAIPFYSVLGEKDYFYFPSEQIQ

SEQ ID NO: 3274453 - protein, 17 aa, Plasmodium falciparum
SEAQTRKSVLFCIRELF

SEQ ID NO: 3274454 - protein, 23 aa, Plasmodium falciparum
SECCKRIFLKNIIKHEKEILDFL

SEQ ID NO: 3274455 - protein, 26 aa, Plasmodium falciparum
SECFDKYEFQFCVIDAPWTIKSDIVE

SEQ ID NO: 3274456 - protein, 18 aa, Plasmodium falciparum
SECMSYVLFSLMVALWGL

SEQ ID NO: 3274457 - protein, 22 aa, Plasmodium falciparum
SECPINLFLLYFLNPFINLSDD

SEQ ID NO: 3274458 - protein, 17 aa, Plasmodium falciparum
SEDCIDCNCKKNISEDL

SEQ ID NO: 3274459 - protein, 30 aa, Plasmodium falciparum
SEDFLCDKCMFNKYVRKLFSNDDINNNNKS

SEQ ID NO: 3274460 - protein, 19 aa, Plasmodium falciparum
SEDGYICNVFPECKWNDKS

SEQ ID NO: 3274461 - protein, 26 aa, Plasmodium falciparum
SEDIMSLEYLFLYFSPSSYVLHNNTL

SEQ ID NO: 3274462 - protein, 26 aa, Plasmodium falciparum
SEDKKICKNRRLDLHNSSSRESKDMK

SEQ ID NO: 3274463 - protein, 20 aa, Plasmodium falciparum
SEDMIRNMIAISIGNMDVLN

SEQ ID NO: 3274464 - protein, 18 aa, Plasmodium falciparum
SEEFPKEKYNIEDMEETE

SEQ ID NO: 3274465 - protein, 23 aa, Plasmodium falciparum
SEEKCKRCSDNVYTDGLQSTSIS

SEQ ID NO: 3274466 - protein, 17 aa, Plasmodium falciparum
SEEKMILIFKCDNKFYI

SEQ ID NO: 3274467 - protein, 21 aa, Plasmodium falciparum
SEESFAEWYHLYKEASLSIKD

SEQ ID NO: 3274468 - protein, 21 aa, Plasmodium falciparum
SEESKKNCACVKVWVDQKKEE

SEQ ID NO: 3274469 - protein, 24 aa, Plasmodium falciparum
SEESLYMYNIFLSYFSYLHYVMKY

SEQ ID NO: 3274470 - protein, 22 aa, Plasmodium falciparum
SEEVAECLNLVLSYGMDRKEIK

SEQ ID NO: 3274471 - protein, 31 aa, Plasmodium falciparum
SEFKNNFDGCLKKEVSVPRLSVSEFENNDDV

SEQ ID NO: 3274472 - protein, 53 aa, Plasmodium falciparum
SEFKNNFDGCLKKEVSVPRLSVSEFKNNFDGCLKKEVSVPRLSVSEFENNDDV

SEQ ID NO: 3274473 - protein, 17 aa, Plasmodium falciparum
SEFKPSVFDPSEYKNSP

SEQ ID NO: 3274474 - protein, 27 aa, Plasmodium falciparum
SEFKYLKKLLFVHGRESLRRNSFLVYF

SEQ ID NO: 3274475 - protein, 21 aa, Plasmodium falciparum
SEFLRSMIYTFGDYRDLCLNT

SEQ ID NO: 3274476 - protein, 20 aa, Plasmodium falciparum
SEFVKIPLYTPPFLSSSSVS

SEQ ID NO: 3274477 - protein, 24 aa, Plasmodium falciparum
SEGACAPFRRLHVCDKNIQQIKTE

SEQ ID NO: 3274478 - protein, 23 aa, Plasmodium falciparum
SEGLKLGTAAECVFAADKCLVHS

SEQ ID NO: 3274479 - protein, 31 aa, Plasmodium falciparum
SEHIFQFDYYFLKFIAEICTTYNNYIKSYLI

SEQ ID NO: 3274480 - protein, 22 aa, Plasmodium falciparum
SEICSTSSFLNSFVKNTNGNNK

SEQ ID NO: 3274481 - protein, 21 aa, Plasmodium falciparum
SEIFFNKKLQYLTCSYSKEYY

SEQ ID NO: 3274482 - protein, 26 aa, Plasmodium falciparum
SEIGRQYNIRLSRLYKKTSLLDNDIQ

SEQ ID NO: 3274483 - protein, 26 aa, Plasmodium falciparum
SEIIYFTDLCLLKLKKLVNNKKIMNN

SEQ ID NO: 3274484 - protein, 27 aa, Plasmodium falciparum
SEIIYKKRVCNSFYFFYTFFKISDTFL

SEQ ID NO: 3274485 - protein, 24 aa, Plasmodium falciparum
SEIKKEDFLVFTLYIQKKYNINND

SEQ ID NO: 3274486 - protein, 20 aa, Plasmodium falciparum
SEIKNNCTLLKFKRKTGQRF

SEQ ID NO: 3274487 - protein, 19 aa, Plasmodium falciparum
SEINFVIYIDYIILKLNEY

SEQ ID NO: 3274488 - protein, 22 aa, Plasmodium falciparum
SEIPSIVLSTSMYVSNSTDYYY

SEQ ID NO: 3274489 - protein, 28 aa, Plasmodium falciparum
SEIQPEICKLPLEWKKLNNYSFKKLLII

SEQ ID NO: 3274490 - protein, 18 aa, Plasmodium falciparum
SEISICWVFMYINFKEQK

SEQ ID NO: 3274491 - protein, 25 aa, Plasmodium falciparum
SEIVDACGNIKGGALKVKDLITEGG

SEQ ID NO: 3274492 - protein, 19 aa, Plasmodium falciparum
SEIWIHYLYNIISLSNEPQ

SEQ ID NO: 3274493 - protein, 20 aa, Plasmodium falciparum
SEKDFRMMRSYIIELILSTD

SEQ ID NO: 3274494 - protein, 20 aa, Plasmodium falciparum
SEKILPLSIEPLSNKYLSKV

SEQ ID NO: 3274495 - protein, 22 aa, Plasmodium falciparum
SEKIVWRRWLKKQEQNIQIYKN

SEQ ID NO: 3274496 - protein, 19 aa, Plasmodium falciparum
SEKIYKCYENVIKEEKRKK

SEQ ID NO: 3274497 - protein, 28 aa, Plasmodium falciparum
SEKKILKISVLFLILTIFFLCLRIALII

SEQ ID NO: 3274498 - protein, 27 aa, Plasmodium falciparum
SEKKLPDRFELFFNYLLTYSEKNVIRI

SEQ ID NO: 3274499 - protein, 21 aa, Plasmodium falciparum
SEKKVNMGILLFSDKIREFIK

SEQ ID NO: 3274500 - protein, 26 aa, Plasmodium falciparum
SEKLGILKFDLLFGSEYHLAKNEMLN

SEQ ID NO: 3274501 - protein, 22 aa, Plasmodium falciparum
SEKLNVVDFLKSVGADINKTNS

SEQ ID NO: 3274502 - protein, 17 aa, Plasmodium falciparum
SEKNQVILFGFGISVLN

SEQ ID NO: 3274503 - protein, 19 aa, Plasmodium falciparum
SEKNRMMYNECNLTNDFFE

SEQ ID NO: 3274504 - protein, 26 aa, Plasmodium falciparum
SEKSFKDSYLFKSLRTEEWECRFNKE

SEQ ID NO: 3274505 - protein, 25 aa, Plasmodium falciparum
SEKSPLPFIGVYTMIVPCTSAYLYY

SEQ ID NO: 3274506 - protein, 22 aa, Plasmodium falciparum
SEKYANFFPNFERNNVISIRFE

SEQ ID NO: 3274507 - protein, 20 aa, Plasmodium falciparum
SEKYINIILLYMLIMNRKIF

SEQ ID NO: 3274508 - protein, 19 aa, Plasmodium falciparum
SELIFKRNFQFISSDSCKN

SEQ ID NO: 3274509 - protein, 17 aa, Plasmodium falciparum
SELKTQDFWYIYKYNPF

SEQ ID NO: 3274510 - protein, 21 aa, Plasmodium falciparum
SELLKEWIIAAFHEGKNLKPS

SEQ ID NO: 3274511 - protein, 24 aa, Plasmodium falciparum
SELLKYGHKYSVLKSREDVKLLRS

SEQ ID NO: 3274512 - protein, 20 aa, Plasmodium falciparum
SELLQELGLYLKNIKLKYSE

SEQ ID NO: 3274513 - protein, 22 aa, Plasmodium falciparum
SELNEALYPFIFKNPQIYEDIL

SEQ ID NO: 3274514 - protein, 20 aa, Plasmodium falciparum
SELQIRYVFYNLLVAGYKLD

SEQ ID NO: 3274515 - protein, 20 aa, Plasmodium falciparum
SELRDGCYDPKRLMYHFPFF

SEQ ID NO: 3274516 - protein, 17 aa, Plasmodium falciparum
SELYAINELLAIRSDEC

SEQ ID NO: 3274517 - protein, 24 aa, Plasmodium falciparum
SENHPWIKYYSYNIEKLYDYLRNE

SEQ ID NO: 3274518 - protein, 25 aa, Plasmodium falciparum
SENKEYLYICSKLKVDEVMNNFLIN

SEQ ID NO: 3274519 - protein, 18 aa, Plasmodium falciparum
SENKSTCIKGCVEKWIDK

SEQ ID NO: 3274520 - protein, 31 aa, Plasmodium falciparum
SENLKKKIFQVIAFLLFVVLIYLYLKLKKVN

SEQ ID NO: 3274521 - protein, 22 aa, Plasmodium falciparum
SENNNCILLAKGGEGGKGNNMN

SEQ ID NO: 3274522 - protein, 21 aa, Plasmodium falciparum
SENWFYSFFNIYKKGNFYDID

SEQ ID NO: 3274523 - protein, 18 aa, Plasmodium falciparum
SENYKLENSFLYDMDDDG

SEQ ID NO: 3274524 - protein, 22 aa, Plasmodium falciparum
SEPFIAQMFVCKRSVFKNYDDF

SEQ ID NO: 3274525 - protein, 32 aa, Plasmodium falciparum
SEPIMLRNVFLEWLCVYLLYVQGLKKENKFHR

SEQ ID NO: 3274526 - protein, 19 aa, Plasmodium falciparum
SEQAWKYVQKLIKLYYNDF

SEQ ID NO: 3274527 - protein, 25 aa, Plasmodium falciparum
SEQKKCKLLFHIIRNIQKHIISKKK

SEQ ID NO: 3274528 - protein, 25 aa, Plasmodium falciparum
SERILKNLFDYCLNNCFYKRGNQIC

SEQ ID NO: 3274529 - protein, 25 aa, Plasmodium falciparum
SERKSWKLPPPPPNIPPSYDRSSQR

SEQ ID NO: 3274530 - protein, 25 aa, Plasmodium falciparum
SERRPCLKYLISLLLLLMLMLILRK

SEQ ID NO: 3274531 - protein, 17 aa, Plasmodium falciparum
SESFLNLTSGKNYPDII

SEQ ID NO: 3274532 - protein, 23 aa, Plasmodium falciparum
SESIYFFHFITRVLLVSWVYTPL

SEQ ID NO: 3274533 - protein, 34 aa, Plasmodium falciparum
SESLKSCNDLICLYLFKHFSYILDYLLLLNGNNI

SEQ ID NO: 3274534 - protein, 22 aa, Plasmodium falciparum
SESLSFESYNLFYKKDNYSYEG

SEQ ID NO: 3274535 - protein, 21 aa, Plasmodium falciparum
SESMKNWILMIYIPINLQNIK

SEQ ID NO: 3274536 - protein, 32 aa, Plasmodium falciparum
SESQKFRFIYHFYSVRLLGVSPSDLYMKTNKF

SEQ ID NO: 3274537 - protein, 21 aa, Plasmodium falciparum
SESWLSYLIGIVFTFRLLTGM

SEQ ID NO: 3274538 - protein, 21 aa, Plasmodium falciparum
SESYFKLAKQYYPPKYSVNEG

SEQ ID NO: 3274539 - protein, 18 aa, Plasmodium falciparum
SETGLGYLHRDAGGAKEE

SEQ ID NO: 3274540 - protein, 17 aa, Plasmodium falciparum
SETLALYGLIIGIYISI

SEQ ID NO: 3274541 - protein, 22 aa, Plasmodium falciparum
SETPVGRYSFFLFSKNKKKYET

SEQ ID NO: 3274542 - protein, 17 aa, Plasmodium falciparum
SEVCIALARSFADIGDI

SEQ ID NO: 3274543 - protein, 25 aa, Plasmodium falciparum
SEVECAICMKLLIVPVTIPCGHNFC

SEQ ID NO: 3274544 - protein, 18 aa, Plasmodium falciparum
SEVNNFNIMLGKCYSFNE

SEQ ID NO: 3274545 - protein, 19 aa, Plasmodium falciparum
SEWNLERIPTLGFCKEDDR

SEQ ID NO: 3274546 - protein, 19 aa, Plasmodium falciparum
SEYCKPCPHCGMKKKDGKW

SEQ ID NO: 3274547 - protein, 22 aa, Plasmodium falciparum
SEYCQPCPGCGVKRKDNQWKEK

SEQ ID NO: 3274548 - protein, 19 aa, Plasmodium falciparum
SEYCQVCPDCGVKYNGSGW

SEQ ID NO: 3274549 - protein, 21 aa, Plasmodium falciparum
SEYFPNYYIVNHFKKRKLAKK

SEQ ID NO: 3274550 - protein, 21 aa, Plasmodium falciparum
SEYIYIYDICVKKDNPNDNNK

SEQ ID NO: 3274551 - protein, 37 aa, Plasmodium falciparum
SEYKKLIIRKIISMNFILCLRLLYLIINTLNYFLKYE

SEQ ID NO: 3274552 - protein, 25 aa, Plasmodium falciparum
SEYRLCKILLIKLMFALLFLLIALI

SEQ ID NO: 3274553 - protein, 19 aa, Plasmodium falciparum
SFAEFKRSPFFLSTMLIAS

SEQ ID NO: 3274554 - protein, 23 aa, Plasmodium falciparum
SFASFPFLLSKNIIYFEDEIGRS

SEQ ID NO: 3274555 - protein, 21 aa, Plasmodium falciparum
SFCLSSIICYLMYSSLNINKG

SEQ ID NO: 3274556 - protein, 19 aa, Plasmodium falciparum
SFDEFQEGVEFIKETDSIL

SEQ ID NO: 3274557 - protein, 18 aa, Plasmodium falciparum
SFDFLKTFIETVSSVGCN

SEQ ID NO: 3274558 - protein, 24 aa, Plasmodium falciparum
SFDTIEKFSLLLLLFLIFLVFIGT

SEQ ID NO: 3274559 - protein, 24 aa, Plasmodium falciparum
SFEIELYLKINNDIFLQFNKHNYN

SEQ ID NO: 3274560 - protein, 17 aa, Plasmodium falciparum
SFEKYEIYHVYLKNNKK

SEQ ID NO: 3274561 - protein, 17 aa, Plasmodium falciparum
SFELFNIYEYCKNYDED

SEQ ID NO: 3274562 - protein, 17 aa, Plasmodium falciparum
SFELKKDIFKDMKNDDR

SEQ ID NO: 3274563 - protein, 18 aa, Plasmodium falciparum
SFELKKNYLAIFTSIIMN

SEQ ID NO: 3274564 - protein, 17 aa, Plasmodium falciparum
SFETIMLSMSMNHQNEM

SEQ ID NO: 3274565 - protein, 18 aa, Plasmodium falciparum
SFFEFKYILFGFYDLFLM

SEQ ID NO: 3274566 - protein, 32 aa, Plasmodium falciparum
SFFEKKCLFSRSYIYCYRKANIVLKKISNCFR

SEQ ID NO: 3274567 - protein, 26 aa, Plasmodium falciparum
SFFGELLVISIIVFSLFILKILIKDN

SEQ ID NO: 3274568 - protein, 36 aa, Plasmodium falciparum
SFFHKHLYLIWKLQNCTYRSFLLFFNEEFYNFNDYI

SEQ ID NO: 3274569 - protein, 30 aa, Plasmodium falciparum
SFFHTILICRCNYNNFGFDHFYYFDNKDFE

SEQ ID NO: 3274570 - protein, 18 aa, Plasmodium falciparum
SFFKIPKNYILHQNKHLM

SEQ ID NO: 3274571 - protein, 18 aa, Plasmodium falciparum
SFFKNVMFFPYYDNTHIS

SEQ ID NO: 3274572 - protein, 27 aa, Plasmodium falciparum
SFFSDYFFWYRLNIVVQLNEPMKILYL

SEQ ID NO: 3274573 - protein, 24 aa, Plasmodium falciparum
SFFSINRFNFIPTLIKQYLIHFIY

SEQ ID NO: 3274574 - protein, 18 aa, Plasmodium falciparum
SFFTCIISYFLTREIYNF

SEQ ID NO: 3274575 - protein, 21 aa, Plasmodium falciparum
SFFTFYFRKYYIMNLIPEKHH

SEQ ID NO: 3274576 - protein, 24 aa, Plasmodium falciparum
SFFYFYRLFYFISLLPRSFYFILL

SEQ ID NO: 3274577 - protein, 18 aa, Plasmodium falciparum
SFFYKSRNLYISFKTKEI

SEQ ID NO: 3274578 - protein, 18 aa, Plasmodium falciparum
SFFYVCHSLNFILLRLSF

SEQ ID NO: 3274579 - protein, 26 aa, Plasmodium falciparum
SFGNFPNYIKLFLFNWPSGKNLLEFF

SEQ ID NO: 3274580 - protein, 24 aa, Plasmodium falciparum
SFHAKNITLIFGIIYVALLGVYIC

SEQ ID NO: 3274581 - protein, 24 aa, Plasmodium falciparum
SFHINCKIIFYLFFFILNNKEYIY

SEQ ID NO: 3274582 - protein, 24 aa, Plasmodium falciparum
SFHSKQIILIFGIIYVALLNVYIC

SEQ ID NO: 3274583 - protein, 20 aa, Plasmodium falciparum
SFHVAELYKKYDIYKKYRLI

SEQ ID NO: 3274584 - protein, 18 aa, Plasmodium falciparum
SFICSTIELLLECFNTYI

SEQ ID NO: 3274585 - protein, 26 aa, Plasmodium falciparum
SFIDKLPIPFLKKIINDISLKKIIQF

SEQ ID NO: 3274586 - protein, 20 aa, Plasmodium falciparum
SFIFTLFYSFQFLFIPTYIL

SEQ ID NO: 3274587 - protein, 21 aa, Plasmodium falciparum
SFIKKCLLLIYIINTIIIPFI

SEQ ID NO: 3274588 - protein, 18 aa, Plasmodium falciparum
SFIKRKNHIYNIDMKYIK

SEQ ID NO: 3274589 - protein, 18 aa, Plasmodium falciparum
SFIKRPPYFRYLEEWGQN

SEQ ID NO: 3274590 - protein, 24 aa, Plasmodium falciparum
SFILDEAFIQYFFFIKNKNEEPVI

SEQ ID NO: 3274591 - protein, 19 aa, Plasmodium falciparum
SFILFVCYIIKYADAYLPG

SEQ ID NO: 3274592 - protein, 26 aa, Plasmodium falciparum
SFINLAIKMSILLHVVKRYLTYNKKN

SEQ ID NO: 3274593 - protein, 24 aa, Plasmodium falciparum
SFINRISRELIYKISYASVDELSK

SEQ ID NO: 3274594 - protein, 18 aa, Plasmodium falciparum
SFINRLLFLYKLYYDIYK

SEQ ID NO: 3274595 - protein, 21 aa, Plasmodium falciparum
SFKCEVYKKFSIILKGKATLN

SEQ ID NO: 3274596 - protein, 18 aa, Plasmodium falciparum
SFKEDYSKFFFLGLTGTI

SEQ ID NO: 3274597 - protein, 23 aa, Plasmodium falciparum
SFKKKGNENMIFFFEKIFHLNIL

SEQ ID NO: 3274598 - protein, 18 aa, Plasmodium falciparum
SFKKLNFIRNKILFYISD

SEQ ID NO: 3274599 - protein, 25 aa, Plasmodium falciparum
SFKNKFCLIYFGFTYCPDICPQELE

SEQ ID NO: 3274600 - protein, 17 aa, Plasmodium falciparum
SFKRLSAHILNYGSHRL

SEQ ID NO: 3274601 - protein, 20 aa, Plasmodium falciparum
SFKYYFSFNQFVVYFFNYSF

SEQ ID NO: 3274602 - protein, 18 aa, Plasmodium falciparum
SFLFFIINTQCVTHESYQ

SEQ ID NO: 3274603 - protein, 18 aa, Plasmodium falciparum
SFLGYRLVLRNKNTMCIE

SEQ ID NO: 3274604 - protein, 20 aa, Plasmodium falciparum
SFLLWASFMLIYFTNISIYV

SEQ ID NO: 3274605 - protein, 23 aa, Plasmodium falciparum
SFLLWLQKYELAYYISSYLTLLD

SEQ ID NO: 3274606 - protein, 26 aa, Plasmodium falciparum
SFLMRCVYMKRRFHIINLKEHQDYIS

SEQ ID NO: 3274607 - protein, 43 aa, Plasmodium falciparum
SFLNTICFFIFVIMFLWALAILSRFYLSYNIMKYLKNRKAIYM

SEQ ID NO: 3274608 - protein, 24 aa, Plasmodium falciparum
SFLPMCTYNGKLIYEYDNKRDIKD

SEQ ID NO: 3274609 - protein, 19 aa, Plasmodium falciparum
SFLSLYLMISIFSYNGNVL

SEQ ID NO: 3274610 - protein, 20 aa, Plasmodium falciparum
SFLYNIFCILGIICAWGTVD

SEQ ID NO: 3274611 - protein, 21 aa, Plasmodium falciparum
SFMCVGSIHLLGTIVYLVQSL

SEQ ID NO: 3274612 - protein, 30 aa, Plasmodium falciparum
SFMIEILKIIWKKWIEKNVKYINESVTNEW

SEQ ID NO: 3274613 - protein, 24 aa, Plasmodium falciparum
SFMSRCPRSLLGLEDSKEYFADDM

SEQ ID NO: 3274614 - protein, 18 aa, Plasmodium falciparum
SFNLLFYVPLKINFNEMN

SEQ ID NO: 3274615 - protein, 27 aa, Plasmodium falciparum
SFNSLFWHWINEMLKDSILWSKELDRC

SEQ ID NO: 3274616 - protein, 18 aa, Plasmodium falciparum
SFNVFDFYSLDIAAKKHF

SEQ ID NO: 3274617 - protein, 21 aa, Plasmodium falciparum
SFNVIILIILFCHIIIARNNK

SEQ ID NO: 3274618 - protein, 24 aa, Plasmodium falciparum
SFPNYIPPWLPNILISVAKLSNSS

SEQ ID NO: 3274619 - protein, 22 aa, Plasmodium falciparum
SFRSDIFIQLLFEFALTFILSI

SEQ ID NO: 3274620 - protein, 18 aa, Plasmodium falciparum
SFRSFRYYFPKNFERRTK

SEQ ID NO: 3274621 - protein, 24 aa, Plasmodium falciparum
SFSDTYISYGCRKRRWKKKKKNIY

SEQ ID NO: 3274622 - protein, 28 aa, Plasmodium falciparum
SFSKLPAYIQPFVFHWEGAMWGAFSALS

SEQ ID NO: 3274623 - protein, 21 aa, Plasmodium falciparum
SFSRTNFFFYLTILNKKNVKK

SEQ ID NO: 3274624 - protein, 19 aa, Plasmodium falciparum
SFSSHMWCTASRRKTFSYN

SEQ ID NO: 3274625 - protein, 20 aa, Plasmodium falciparum
SFSSLIVLEIMNIHLEVESW

SEQ ID NO: 3274626 - protein, 42 aa, Plasmodium falciparum
SFTIHFFLPFLNFVTFFLFFLFFKMEDLFFITSKKKKLVSEK

SEQ ID NO: 3274627 - protein, 20 aa, Plasmodium falciparum
SFVACMVYILSIMIEITLKE

SEQ ID NO: 3274628 - protein, 22 aa, Plasmodium falciparum
SFVEFCKNITFITYLDKDKKKK

SEQ ID NO: 3274629 - protein, 19 aa, Plasmodium falciparum
SFVKRNFSWNFFKKQHTNN

SEQ ID NO: 3274630 - protein, 19 aa, Plasmodium falciparum
SFVNFKINRLNNMTTHEEE

SEQ ID NO: 3274631 - protein, 36 aa, Plasmodium falciparum
SFYETICDYMKWHFNKFSSIDIIKIIYAFSKVRIRD

SEQ ID NO: 3274632 - protein, 18 aa, Plasmodium falciparum
SFYFLIILIHIYINRIKK

SEQ ID NO: 3274633 - protein, 28 aa, Plasmodium falciparum
SFYGYIECTFQWCGVFDYFFGLYFSNNK

SEQ ID NO: 3274634 - protein, 20 aa, Plasmodium falciparum
SFYIKLFYYFLFSIIFTILM

SEQ ID NO: 3274635 - protein, 28 aa, Plasmodium falciparum
SFYKETRLKKRIYGYLFYTTLLKNITSL

SEQ ID NO: 3274636 - protein, 20 aa, Plasmodium falciparum
SFYKGCYVRASYLCFGGMIF

SEQ ID NO: 3274637 - protein, 19 aa, Plasmodium falciparum
SFYKKFFLFNQCPFCNHEL

SEQ ID NO: 3274638 - protein, 17 aa, Plasmodium falciparum
SFYLKSKVDEFIEKCPD

SEQ ID NO: 3274639 - protein, 20 aa, Plasmodium falciparum
SFYSCYILLNKIDVVPLLIK

SEQ ID NO: 3274640 - protein, 27 aa, Plasmodium falciparum
SFYSFLKYYCFYAMSLNEIYFVKNENI

SEQ ID NO: 3274641 - protein, 20 aa, Plasmodium falciparum
SFYYNCLSFLTGLSIVCTLI

SEQ ID NO: 3274642 - protein, 20 aa, Plasmodium falciparum
SGADKSICPWVMEKYLPAQN

SEQ ID NO: 3274643 - protein, 20 aa, Plasmodium falciparum
SGAEKPICTWVRAKEGAARV

SEQ ID NO: 3274644 - protein, 25 aa, Plasmodium falciparum
SGASESFCSWVRANFFAPQEISGKV

SEQ ID NO: 3274645 - protein, 26 aa, Plasmodium falciparum
SGCNKDCDCFKKWIGKKKEEWDAIKK

SEQ ID NO: 3274646 - protein, 17 aa, Plasmodium falciparum
SGCNRFGYIKNYDQSDR

SEQ ID NO: 3274647 - protein, 23 aa, Plasmodium falciparum
SGDFGPRISPYVTLEGNLQYSYL

SEQ ID NO: 3274648 - protein, 24 aa, Plasmodium falciparum
SGDFGPRISPYVTLEGNLQYSYLE

SEQ ID NO: 3274649 - protein, 28 aa, Plasmodium falciparum
SGDYIKLCCDIFCSFYKYDIFKKTFFFL

SEQ ID NO: 3274650 - protein, 37 aa, Plasmodium falciparum
SGEKTYLSKFVLRPPYFRYLEEWGETFCRERTRRLEK

SEQ ID NO: 3274651 - protein, 26 aa, Plasmodium falciparum
SGELEGIIVLCFLAIFFAVIFKVIEV

SEQ ID NO: 3274652 - protein, 19 aa, Plasmodium falciparum
SGELIKLKVNDSVELSTHD

SEQ ID NO: 3274653 - protein, 20 aa, Plasmodium falciparum
SGETPSSFFVSHKLEEPCVY

SEQ ID NO: 3274654 - protein, 17 aa, Plasmodium falciparum
SGFCSSALFLLTSILSF

SEQ ID NO: 3274655 - protein, 18 aa, Plasmodium falciparum
SGFLSFALYALWEIFEHI

SEQ ID NO: 3274656 - protein, 20 aa, Plasmodium falciparum
SGGCCDCGDTSWNINGSCFD

SEQ ID NO: 3274657 - protein, 25 aa, Plasmodium falciparum
SGGKRRAKRFLVTKNMSYEEIENVK

SEQ ID NO: 3274658 - protein, 24 aa, Plasmodium falciparum
SGGKWYNLFGCLGKDPPAYLYFHF

SEQ ID NO: 3274659 - protein, 17 aa, Plasmodium falciparum
SGGLFYNYINLIINDNI

SEQ ID NO: 3274660 - protein, 23 aa, Plasmodium falciparum
SGGMTCYYKSMGIYKNINIKDPN

SEQ ID NO: 3274661 - protein, 17 aa, Plasmodium falciparum
SGHPAFIRLHNRKLFRR

SEQ ID NO: 3274662 - protein, 27 aa, Plasmodium falciparum
SGITEGRCAPIPILVNIEYADNNCGNE

SEQ ID NO: 3274663 - protein, 18 aa, Plasmodium falciparum
SGIVCFILSLIFECNVVN

SEQ ID NO: 3274664 - protein, 24 aa, Plasmodium falciparum
SGKIPPDFLRQMFYTLGDYRDILF

SEQ ID NO: 3274665 - protein, 29 aa, Plasmodium falciparum
SGKTENCKFLFKYFHYIFFHKNGGTHNDN

SEQ ID NO: 3274666 - protein, 25 aa, Plasmodium falciparum
SGKTTICLYYLILKFFYNCEFIFKE

SEQ ID NO: 3274667 - protein, 24 aa, Plasmodium falciparum
SGLLPIRSGDYFYFIPHQKIKQKG

SEQ ID NO: 3274668 - protein, 19 aa, Plasmodium falciparum
SGLSFYGPHGHNILSTGLK

SEQ ID NO: 3274669 - protein, 27 aa, Plasmodium falciparum
SGLVLLFCISFIIYYFDIIQKVKMKLN

SEQ ID NO: 3274670 - protein, 24 aa, Plasmodium falciparum
SGLWYVKWSQYVPVAVTKAGITEG

SEQ ID NO: 3274671 - protein, 26 aa, Plasmodium falciparum
SGMKTFKLMCNKICNLEERNVVNKCP

SEQ ID NO: 3274672 - protein, 20 aa, Plasmodium falciparum
SGMLLKNFEYLLTFNNYEGC

SEQ ID NO: 3274673 - protein, 23 aa, Plasmodium falciparum
SGNDLKGKLVVTFKNEEGVDAGG

SEQ ID NO: 3274674 - protein, 25 aa, Plasmodium falciparum
SGNGFDCTKTIYKKGRIVIGEHCTK

SEQ ID NO: 3274675 - protein, 22 aa, Plasmodium falciparum
SGNLHAGHFFNFIHQHIFFLYN

SEQ ID NO: 3274676 - protein, 29 aa, Plasmodium falciparum
SGNTFFTIHLCHIKFNPTHPMFIVKLNEE

SEQ ID NO: 3274677 - protein, 28 aa, Plasmodium falciparum
SGRFKYSKVCLLGYSLGSAMAYEILHNV

SEQ ID NO: 3274678 - protein, 25 aa, Plasmodium falciparum
SGVDSLCLLYSFIFVIYKILISMIY

SEQ ID NO: 3274679 - protein, 23 aa, Plasmodium falciparum
SGVHSKALIIYSSIFKKVEMDFF

SEQ ID NO: 3274680 - protein, 22 aa, Plasmodium falciparum
SGYFIFHFGYSIFVCLEEIQHI

SEQ ID NO: 3274681 - protein, 22 aa, Plasmodium falciparum
SGYKSPESFFFTHGLAAEASKY

SEQ ID NO: 3274682 - protein, 25 aa, Plasmodium falciparum
SHAYSFSLKAKEEFNEVLNDNYKDV

SEQ ID NO: 3274683 - protein, 19 aa, Plasmodium falciparum
SHCKIRYNPPYVEKYILIF

SEQ ID NO: 3274684 - protein, 19 aa, Plasmodium falciparum
SHEEFCIIQKKDLKPHGLR

SEQ ID NO: 3274685 - protein, 27 aa, Plasmodium falciparum
SHEEWKKKLLKGIGILNEFSDIKWITD

SEQ ID NO: 3274686 - protein, 23 aa, Plasmodium falciparum
SHFIKCIKRTYKILFVNNSGNNN

SEQ ID NO: 3274687 - protein, 18 aa, Plasmodium falciparum
SHFKKVFEKNNLYKLVDD

SEQ ID NO: 3274688 - protein, 36 aa, Plasmodium falciparum
SHFNCFNLILCHWIFRLRRVCTDSGKEWVFPSELFA

SEQ ID NO: 3274689 - protein, 22 aa, Plasmodium falciparum
SHFYCSIQILEFYKGCINQYNS

SEQ ID NO: 3274690 - protein, 23 aa, Plasmodium falciparum
SHGSLRCWFEIFNEEFAQLNPIK

SEQ ID NO: 3274691 - protein, 25 aa, Plasmodium falciparum
SHIFHVDCLKSWFIQQQTCPICRTE

SEQ ID NO: 3274692 - protein, 24 aa, Plasmodium falciparum
SHIGDWNLNIALVITFIIIFSNIH

SEQ ID NO: 3274693 - protein, 19 aa, Plasmodium falciparum
SHIISLKLFYYETNNVNLF

SEQ ID NO: 3274694 - protein, 26 aa, Plasmodium falciparum
SHIKMFSRIMLFLFFVKKKYIILYEQ

SEQ ID NO: 3274695 - protein, 20 aa, Plasmodium falciparum
SHILIPRVNILQHDNNFLNK

SEQ ID NO: 3274696 - protein, 19 aa, Plasmodium falciparum
SHINYEYILKQGFIKYDDL

SEQ ID NO: 3274697 - protein, 23 aa, Plasmodium falciparum
SHISLFIRYDIVHYTNLDKSMSK

SEQ ID NO: 3274698 - protein, 20 aa, Plasmodium falciparum
SHIWDRIILSEIEWNVSKIE

SEQ ID NO: 3274699 - protein, 35 aa, Plasmodium falciparum
SHIYCFFFYDNEIIKILSFSLSFYLICDEKILLLY

SEQ ID NO: 3274700 - protein, 23 aa, Plasmodium falciparum
SHKREVTSLIFLNDKSLILNEKK

SEQ ID NO: 3274701 - protein, 23 aa, Plasmodium falciparum
SHLFFLRRRLFDVNRNKTDNKKN

SEQ ID NO: 3274702 - protein, 21 aa, Plasmodium falciparum
SHLGLAFILMYAFMKYDEFYL

SEQ ID NO: 3274703 - protein, 18 aa, Plasmodium falciparum
SHLIKCGYFNTYKSFMNY

SEQ ID NO: 3274704 - protein, 17 aa, Plasmodium falciparum
SHLKKLNDFILLLYNKQ

SEQ ID NO: 3274705 - protein, 18 aa, Plasmodium falciparum
SHLLRTGFFLQCVSLVLM

SEQ ID NO: 3274706 - protein, 22 aa, Plasmodium falciparum
SHLNCLCKKGFEFIKTDDNEFD

SEQ ID NO: 3274707 - protein, 29 aa, Plasmodium falciparum
SHNFYPYKIPSCISNHFSIFQKMNSLHNN

SEQ ID NO: 3274708 - protein, 23 aa, Plasmodium falciparum
SHNPRYVCDKGNYSIISDMRKEK

SEQ ID NO: 3274709 - protein, 18 aa, Plasmodium falciparum
SHRAFKAGHIVQVLFLIL

SEQ ID NO: 3274710 - protein, 24 aa, Plasmodium falciparum
SHSFECLFNIWGVYFLSQNYYPLK

SEQ ID NO: 3274711 - protein, 20 aa, Plasmodium falciparum
SHSIYLRNCTMENIDMNKMN

SEQ ID NO: 3274712 - protein, 27 aa, Plasmodium falciparum
SHSKIMKFYEFFIFWVTYMLNDCIDWK

SEQ ID NO: 3274713 - protein, 24 aa, Plasmodium falciparum
SHTEYCDRCPLCGVDCSSDNCRKK

SEQ ID NO: 3274714 - protein, 21 aa, Plasmodium falciparum
SHTFPIFSTIVLFIFTLFIGI

SEQ ID NO: 3274715 - protein, 21 aa, Plasmodium falciparum
SHTKLKCIKNGKPRNINQKEN

SEQ ID NO: 3274716 - protein, 17 aa, Plasmodium falciparum
SHTLILTSLSSLYHLIT

SEQ ID NO: 3274717 - protein, 25 aa, Plasmodium falciparum
SHVFFYIFSCYYIDKFILLDDHYLL

SEQ ID NO: 3274718 - protein, 23 aa, Plasmodium falciparum
SHYIMCIICSYIITKDVIKSVET

SEQ ID NO: 3274719 - protein, 25 aa, Plasmodium falciparum
SHYINYDCCILPIGISNYFELNILK

SEQ ID NO: 3274720 - protein, 26 aa, Plasmodium falciparum
SIALNRYLYRFCEWNNGDYKRIIEND

SEQ ID NO: 3274721 - protein, 24 aa, Plasmodium falciparum
SIALYSAMILFEFLPSLFKSKYLI

SEQ ID NO: 3274722 - protein, 18 aa, Plasmodium falciparum
SICECVKKNILTQYNMLT

SEQ ID NO: 3274723 - protein, 17 aa, Plasmodium falciparum
SICKANKAILNFSILDD

SEQ ID NO: 3274724 - protein, 25 aa, Plasmodium falciparum
SICKLKINSLNIFYALNYRVHYLWK

SEQ ID NO: 3274725 - protein, 25 aa, Plasmodium falciparum
SIDGFRVALGPAIIFQYLVQGIFHP

SEQ ID NO: 3274726 - protein, 32 aa, Plasmodium falciparum
SIDKKFLFKLCVDLCNPFIWIYINDTYLNTFL

SEQ ID NO: 3274727 - protein, 18 aa, Plasmodium falciparum
SIDYMSVNSYEILKNLCE

SEQ ID NO: 3274728 - protein, 26 aa, Plasmodium falciparum
SIEEEIESIFSLFLLFKKYYISICGN

SEQ ID NO: 3274729 - protein, 26 aa, Plasmodium falciparum
SIFENYKIFFLFLFIMIIHICAIQYG

SEQ ID NO: 3274730 - protein, 19 aa, Plasmodium falciparum
SIFINVLNSLHFIFFVSPV

SEQ ID NO: 3274731 - protein, 24 aa, Plasmodium falciparum
SIFMQLIFLPTIFKIIKKKTTGEL

SEQ ID NO: 3274732 - protein, 18 aa, Plasmodium falciparum
SIFPKKSILIIFLILYLR

SEQ ID NO: 3274733 - protein, 23 aa, Plasmodium falciparum
SIFSNLISLQFFKFLKQVESLRM

SEQ ID NO: 3274734 - protein, 20 aa, Plasmodium falciparum
SIFYHFCLNQYNLIKQKKVR

SEQ ID NO: 3274735 - protein, 26 aa, Plasmodium falciparum
SIFYLCIFFPFFSCECNNIKLNDKEN

SEQ ID NO: 3274736 - protein, 19 aa, Plasmodium falciparum
SIGLFGAVAINIWKPAALK

SEQ ID NO: 3274737 - protein, 20 aa, Plasmodium falciparum
SIHGYGLYTCEFINEGEPVI

SEQ ID NO: 3274738 - protein, 23 aa, Plasmodium falciparum
SIHSEIPYTDFLINIISELKEIP

SEQ ID NO: 3274739 - protein, 32 aa, Plasmodium falciparum
SIHSKESWTHVFSIMMIRYLILKKPEFIKYLY

SEQ ID NO: 3274740 - protein, 21 aa, Plasmodium falciparum
SIIFLNMNIFKLALMNFNKFS

SEQ ID NO: 3274741 - protein, 24 aa, Plasmodium falciparum
SIIHMKNFFDYFFVLLVKLINIII

SEQ ID NO: 3274742 - protein, 25 aa, Plasmodium falciparum
SIIIFCVSISFLGYFGKELHNNNKL

SEQ ID NO: 3274743 - protein, 29 aa, Plasmodium falciparum
SIIINSSLCFYKLYRFFFEIHKCNSKACS

SEQ ID NO: 3274744 - protein, 26 aa, Plasmodium falciparum
SIIIPKVGCLYLYPFIYADEICLTLL

SEQ ID NO: 3274745 - protein, 21 aa, Plasmodium falciparum
SIIMKNVMKMLVSVPLGLIRY

SEQ ID NO: 3274746 - protein, 25 aa, Plasmodium falciparum
SIISKRLYRNYTFDYIIDLIDVNGK

SEQ ID NO: 3274747 - protein, 26 aa, Plasmodium falciparum
SIIYFFIKKIEDWHCINGVVNFFFLM

SEQ ID NO: 3274748 - protein, 18 aa, Plasmodium falciparum
SIKCKKKLWRDFLTNESF

SEQ ID NO: 3274749 - protein, 28 aa, Plasmodium falciparum
SIKEVITSIVDRFVLIGCITTRELVKKD

SEQ ID NO: 3274750 - protein, 23 aa, Plasmodium falciparum
SIKEVPYILLLYIRCVVVTHAIM

SEQ ID NO: 3274751 - protein, 23 aa, Plasmodium falciparum
SIKHKFINFHFIKLFDILNIHTY

SEQ ID NO: 3274752 - protein, 25 aa, Plasmodium falciparum
SIKHSLFNICLFKLQNISINLKNIL

SEQ ID NO: 3274753 - protein, 28 aa, Plasmodium falciparum
SIKKYCSYSELFSLIFLFHKRNDMRPII

SEQ ID NO: 3274754 - protein, 23 aa, Plasmodium falciparum
SIKNVRKGMILFIAPSVMVTISN

SEQ ID NO: 3274755 - protein, 20 aa, Plasmodium falciparum
SIKPLSFFMHFNIMPIYTND

SEQ ID NO: 3274756 - protein, 21 aa, Plasmodium falciparum
SIKVKFHFYSFLFILLYEFTD

SEQ ID NO: 3274757 - protein, 26 aa, Plasmodium falciparum
SIKVLFKRWLEYFLEDYNKLKEKLNP

SEQ ID NO: 3274758 - protein, 18 aa, Plasmodium falciparum
SIKYNLLIDPHFIATNFL

SEQ ID NO: 3274759 - protein, 19 aa, Plasmodium falciparum
SIKYRNIIQSFFFIIKEEG

SEQ ID NO: 3274760 - protein, 23 aa, Plasmodium falciparum
SILCNITIYFVFILFFLINHTIK

SEQ ID NO: 3274761 - protein, 48 aa, Plasmodium falciparum
SILEKIRSSKLLLRFIVTLSEICLILTPHYVNIINFIEILCDFGHIIP

SEQ ID NO: 3274762 - protein, 25 aa, Plasmodium falciparum
SILFLKEEYLRYLMILNKEEKNKKK

SEQ ID NO: 3274763 - protein, 28 aa, Plasmodium falciparum
SILFNFIICSIIKNVIEFSRYGVTNKCI

SEQ ID NO: 3274764 - protein, 25 aa, Plasmodium falciparum
SILHIKIKLSYEIILYDLFDNEDND

SEQ ID NO: 3274765 - protein, 18 aa, Plasmodium falciparum
SILIIFLILYLRNLTKRK

SEQ ID NO: 3274766 - protein, 20 aa, Plasmodium falciparum
SILILFDFLSSYQIDEIMIL

SEQ ID NO: 3274767 - protein, 25 aa, Plasmodium falciparum
SILLCKFLLSLTFFFSVPLNFMGSY

SEQ ID NO: 3274768 - protein, 18 aa, Plasmodium falciparum
SILLSLSSLWGIRIHYNH

SEQ ID NO: 3274769 - protein, 18 aa, Plasmodium falciparum
SILNCIQSYILIKHNKNT

SEQ ID NO: 3274770 - protein, 18 aa, Plasmodium falciparum
SILNKIDFLSAFKKNLYV

SEQ ID NO: 3274771 - protein, 27 aa, Plasmodium falciparum
SILNTTCLLWWQYLLAIFWALLNLFLD

SEQ ID NO: 3274772 - protein, 26 aa, Plasmodium falciparum
SILRKELYDRYIMIVIRKLTNECIND

SEQ ID NO: 3274773 - protein, 23 aa, Plasmodium falciparum
SILSNLLLVLGMSFFAGGLYHHI

SEQ ID NO: 3274774 - protein, 20 aa, Plasmodium falciparum
SILYLPEMVHIYIYLINIIL

SEQ ID NO: 3274775 - protein, 26 aa, Plasmodium falciparum
SIMHGLKWTGVWIVVGVIVIGIFFLI

SEQ ID NO: 3274776 - protein, 19 aa, Plasmodium falciparum
SIMNICYNIKNTILINPSL

SEQ ID NO: 3274777 - protein, 21 aa, Plasmodium falciparum
SINDILHIWWQLREVERHKFA

SEQ ID NO: 3274778 - protein, 19 aa, Plasmodium falciparum
SINFYQIYSSLSLQSVVDH

SEQ ID NO: 3274779 - protein, 19 aa, Plasmodium falciparum
SINHIYPFIFLNKYLYNNY

SEQ ID NO: 3274780 - protein, 19 aa, Plasmodium falciparum
SINNIKCSSYIIKTNSLKT

SEQ ID NO: 3274781 - protein, 19 aa, Plasmodium falciparum
SINQLRLISEEMLLSKREN

SEQ ID NO: 3274782 - protein, 26 aa, Plasmodium falciparum
SINQWLRLGLIREKFCNINIDNLIVY

SEQ ID NO: 3274783 - protein, 19 aa, Plasmodium falciparum
SINSCKFEQPFLYYYFFIE

SEQ ID NO: 3274784 - protein, 22 aa, Plasmodium falciparum
SIPFFICYYWSFAKCSIVNPGY

SEQ ID NO: 3274785 - protein, 20 aa, Plasmodium falciparum
SIPLCGGALLYICGTSQMTK

SEQ ID NO: 3274786 - protein, 18 aa, Plasmodium falciparum
SIQILKLIGMLISVHKHN

SEQ ID NO: 3274787 - protein, 18 aa, Plasmodium falciparum
SIQRKTENIFKMSTKKNI

SEQ ID NO: 3274788 - protein, 17 aa, Plasmodium falciparum
SIRNHSLNYAWNAYFDK

SEQ ID NO: 3274789 - protein, 18 aa, Plasmodium falciparum
SIRSEIKKRIIGNRTERT

SEQ ID NO: 3274790 - protein, 21 aa, Plasmodium falciparum
SIRYYLYLNKVIFKSAKTYLD

SEQ ID NO: 3274791 - protein, 21 aa, Plasmodium falciparum
SISCTINLFSKMNLLKYNLLG

SEQ ID NO: 3274792 - protein, 30 aa, Plasmodium falciparum
SISKKNIFSLCFKQGGGFITFGGYDQNVLT

SEQ ID NO: 3274793 - protein, 29 aa, Plasmodium falciparum
SISLPLPFENFFLFFKNFYSINNNYINNM

SEQ ID NO: 3274794 - protein, 24 aa, Plasmodium falciparum
SISLSFYNIIYIEYISKVFEHAFL

SEQ ID NO: 3274795 - protein, 35 aa, Plasmodium falciparum
SISLWLCLFTGSALVPVCVGMLLSCVNNHQKSLSS

SEQ ID NO: 3274796 - protein, 22 aa, Plasmodium falciparum
SISNFKCIRKSLYKHKYENKTK

SEQ ID NO: 3274797 - protein, 20 aa, Plasmodium falciparum
SISQCLCLPGYELNNNDLCV

SEQ ID NO: 3274798 - protein, 31 aa, Plasmodium falciparum
SISYPLCIFPVFMLYMLVRFFPDMKMGFKKI

SEQ ID NO: 3274799 - protein, 28 aa, Plasmodium falciparum
SITKFLRAFKMIVMYLLIIILVLFITSR

SEQ ID NO: 3274800 - protein, 28 aa, Plasmodium falciparum
SITLDKKCLLCYFMLSVPHFLYPFKLYN

SEQ ID NO: 3274801 - protein, 18 aa, Plasmodium falciparum
SIVALPFVVYRIIVAVLN

SEQ ID NO: 3274802 - protein, 29 aa, Plasmodium falciparum
SIVCKMKKEMKLLINYIIYYYNELIFNYY

SEQ ID NO: 3274803 - protein, 17 aa, Plasmodium falciparum
SIVFGKLLGFASLCGGI

SEQ ID NO: 3274804 - protein, 24 aa, Plasmodium falciparum
SIVLSNNSLLCFNNNKVIVLNLIW

SEQ ID NO: 3274805 - protein, 17 aa, Plasmodium falciparum
SIVNFGAPLSYIQIVIK

SEQ ID NO: 3274806 - protein, 24 aa, Plasmodium falciparum
SIVPILRMIFSMNISINLYTDECS

SEQ ID NO: 3274807 - protein, 21 aa, Plasmodium falciparum
SIVYTCIRKRLNYSNDKDEDE

SEQ ID NO: 3274808 - protein, 18 aa, Plasmodium falciparum
SIWDGMVCALTYNTDTAS

SEQ ID NO: 3274809 - protein, 18 aa, Plasmodium falciparum
SIWNGMVCALTYRDSGDK

SEQ ID NO: 3274810 - protein, 19 aa, Plasmodium falciparum
SIYCYKFNLNSEVLAFLFF

SEQ ID NO: 3274811 - protein, 23 aa, Plasmodium falciparum
SIYEIEELFNLKNYRTQHFILFI

SEQ ID NO: 3274812 - protein, 22 aa, Plasmodium falciparum
SIYGCLKLLYMIQNGIKENGKK

SEQ ID NO: 3274813 - protein, 24 aa, Plasmodium falciparum
SIYHEYKFLFIAIIECIMPSIVKN

SEQ ID NO: 3274814 - protein, 24 aa, Plasmodium falciparum
SIYHYFYFFHIFRNINYAHLTQKD

SEQ ID NO: 3274815 - protein, 31 aa, Plasmodium falciparum
SIYILRYNIIYILRIFYLWFNKTSDNQSFLF

SEQ ID NO: 3274816 - protein, 18 aa, Plasmodium falciparum
SIYILTVGVNEYFRGLSL

SEQ ID NO: 3274817 - protein, 18 aa, Plasmodium falciparum
SIYKIEKVHYIPYNVDII

SEQ ID NO: 3274818 - protein, 19 aa, Plasmodium falciparum
SIYKLVIVNGYIVSFKSQR

SEQ ID NO: 3274819 - protein, 18 aa, Plasmodium falciparum
SIYNYEILCFKKGVCLNV

SEQ ID NO: 3274820 - protein, 19 aa, Plasmodium falciparum
SIYRIFKNINLLIINSASC

SEQ ID NO: 3274821 - protein, 26 aa, Plasmodium falciparum
SIYSLFPGKVFFYITIYLHTYNTLLF

SEQ ID NO: 3274822 - protein, 18 aa, Plasmodium falciparum
SIYYFNFNYLLNILNNLI

SEQ ID NO: 3274823 - protein, 17 aa, Plasmodium falciparum
SKAIILSICECVKKNIL

SEQ ID NO: 3274824 - protein, 27 aa, Plasmodium falciparum
SKAKSFLFLLELMVFSLFIWILKSAKH

SEQ ID NO: 3274825 - protein, 18 aa, Plasmodium falciparum
SKAVSFLSVVLLTMTLTN

SEQ ID NO: 3274826 - protein, 18 aa, Plasmodium falciparum
SKCIGRAQVSLFFTTIGF

SEQ ID NO: 3274827 - protein, 24 aa, Plasmodium falciparum
SKCIKNCECYEAWIERKKDEWEKL

SEQ ID NO: 3274828 - protein, 19 aa, Plasmodium falciparum
SKCKKCQNLFYEILHFILL

SEQ ID NO: 3274829 - protein, 23 aa, Plasmodium falciparum
SKCLEKYSAIFSYFLEIKKSFHI

SEQ ID NO: 3274830 - protein, 29 aa, Plasmodium falciparum
SKCNFNRTICYRKYIKCVNKYKNNKRNRV

SEQ ID NO: 3274831 - protein, 17 aa, Plasmodium falciparum
SKCSNYNMFEWNNNLDI

SEQ ID NO: 3274832 - protein, 27 aa, Plasmodium falciparum
SKCVLKKCPEAFGLKKAAKVPEKRPLG

SEQ ID NO: 3274833 - protein, 24 aa, Plasmodium falciparum
SKDILRLFIEVSIGCFFTLTLLNL

SEQ ID NO: 3274834 - protein, 28 aa, Plasmodium falciparum
SKDKEKRIFCMICKNMNTNVLMKKKGKD

SEQ ID NO: 3274835 - protein, 48 aa, Plasmodium falciparum
SKDLKKWKSQVITKKYADDWLSSDVLLSCFLNFIKLKKYVNITELSVK

SEQ ID NO: 3274836 - protein, 19 aa, Plasmodium falciparum
SKEGITWYSDYNKFKNPSD

SEQ ID NO: 3274837 - protein, 21 aa, Plasmodium falciparum
SKEIISLIAKAFMGPIEKEED

SEQ ID NO: 3274838 - protein, 19 aa, Plasmodium falciparum
SKEKITYHLYALVISQNKN

SEQ ID NO: 3274839 - protein, 17 aa, Plasmodium falciparum
SKEKKMSIYDWYYYYNI

SEQ ID NO: 3274840 - protein, 28 aa, Plasmodium falciparum
SKELDMEGRYLLLSNIVNHIRYPNSHTH

SEQ ID NO: 3274841 - protein, 22 aa, Plasmodium falciparum
SKELYDEWQCYEFKQLTTDGQE

SEQ ID NO: 3274842 - protein, 22 aa, Plasmodium falciparum
SKELYEEWTCYHVKQLEKENKE

SEQ ID NO: 3274843 - protein, 19 aa, Plasmodium falciparum
SKESYELLINILYSNEYSK

SEQ ID NO: 3274844 - protein, 18 aa, Plasmodium falciparum
SKFCGVVSSMAKYKNITF

SEQ ID NO: 3274845 - protein, 33 aa, Plasmodium falciparum
SKFDCLLINMGIKFRIIYIFKKILSACFFKRNK

SEQ ID NO: 3274846 - protein, 18 aa, Plasmodium falciparum
SKFHLIKIIEHLKNIILH

SEQ ID NO: 3274847 - protein, 19 aa, Plasmodium falciparum
SKFKRVYNKDIPYICNEGK

SEQ ID NO: 3274848 - protein, 19 aa, Plasmodium falciparum
SKFLDFIFNTNICYSNSYK

SEQ ID NO: 3274849 - protein, 28 aa, Plasmodium falciparum
SKFLFLSALIQLNAWGLINIIIKHMETY

SEQ ID NO: 3274850 - protein, 20 aa, Plasmodium falciparum
SKFLVNFLKHLLSFEKYEHV

SEQ ID NO: 3274851 - protein, 25 aa, Plasmodium falciparum
SKFSDLRYKWKFSHISEKYKNKIYK

SEQ ID NO: 3274852 - protein, 21 aa, Plasmodium falciparum
SKFVPFLDIIERIYSPNNILN

SEQ ID NO: 3274853 - protein, 20 aa, Plasmodium falciparum
SKGGLLGGVMTADFVLKTVL

SEQ ID NO: 3274854 - protein, 18 aa, Plasmodium falciparum
SKGLILGPLIGSIPLILH

SEQ ID NO: 3274855 - protein, 24 aa, Plasmodium falciparum
SKGMPTYLIPLVFIIVVAMIKEFF

SEQ ID NO: 3274856 - protein, 18 aa, Plasmodium falciparum
SKGRVYFPYINNYKNSRR

SEQ ID NO: 3274857 - protein, 24 aa, Plasmodium falciparum
SKGYCLECLEGALCKGGLNKNVMQ

SEQ ID NO: 3274858 - protein, 45 aa, Plasmodium falciparum
SKHFFSEIINYLFSFFYMNEFFFKNVHLWGKYSYYNDLDLPKYIL

SEQ ID NO: 3274859 - protein, 18 aa, Plasmodium falciparum
SKHLKSKYFSTSHETLKG

SEQ ID NO: 3274860 - protein, 33 aa, Plasmodium falciparum
SKHSSFFLLLFFICVSIIKNIYEDSRRSNIDYQ

SEQ ID NO: 3274861 - protein, 18 aa, Plasmodium falciparum
SKHVWKYLFQHSSDLLKS

SEQ ID NO: 3274862 - protein, 26 aa, Plasmodium falciparum
SKIEKRLKYYTNIERFEMILDKMEKN

SEQ ID NO: 3274863 - protein, 22 aa, Plasmodium falciparum
SKIEYRKMFDLSVAQTIPEHVD

SEQ ID NO: 3274864 - protein, 30 aa, Plasmodium falciparum
SKIFELKYINCIFIFMFLSLLIIFTSMNEY

SEQ ID NO: 3274865 - protein, 28 aa, Plasmodium falciparum
SKIFKDKGVGGLRVVPRPQQVTNEHEEI

SEQ ID NO: 3274866 - protein, 19 aa, Plasmodium falciparum
SKIIEITPILSIKYLTQCD

SEQ ID NO: 3274867 - protein, 20 aa, Plasmodium falciparum
SKIIGLLNCKYKNNFIQSIK

SEQ ID NO: 3274868 - protein, 17 aa, Plasmodium falciparum
SKIISYIFHNHFEKNKN

SEQ ID NO: 3274869 - protein, 17 aa, Plasmodium falciparum
SKIKIGRVKNKIYREPI

SEQ ID NO: 3274870 - protein, 25 aa, Plasmodium falciparum
SKIKLHRIYKHFVFIKKIFYHDNLA

SEQ ID NO: 3274871 - protein, 19 aa, Plasmodium falciparum
SKIKLLFYSFNIIFGGYVI

SEQ ID NO: 3274872 - protein, 18 aa, Plasmodium falciparum
SKIKSFIYEYNIPCHPYC

SEQ ID NO: 3274873 - protein, 18 aa, Plasmodium falciparum
SKILFKNFLPSFNLLKLI

SEQ ID NO: 3274874 - protein, 18 aa, Plasmodium falciparum
SKILFYIWSNNLQKIRVN

SEQ ID NO: 3274875 - protein, 21 aa, Plasmodium falciparum
SKINLEKWVAYGLTNSTYYFE

SEQ ID NO: 3274876 - protein, 19 aa, Plasmodium falciparum
SKISFNILKNIDIINKLFI

SEQ ID NO: 3274877 - protein, 20 aa, Plasmodium falciparum
SKIVIEIDGPNHFFQKGEMI

SEQ ID NO: 3274878 - protein, 37 aa, Plasmodium falciparum
SKIVKREISFFLGISVNDLFQPFGLCDSFINDDNEKI

SEQ ID NO: 3274879 - protein, 17 aa, Plasmodium falciparum
SKIVKVIERNMNKNIFY

SEQ ID NO: 3274880 - protein, 20 aa, Plasmodium falciparum
SKIVLKHIIKIPIKTQLKNK

SEQ ID NO: 3274881 - protein, 34 aa, Plasmodium falciparum
SKIYCLFPDLFSSFLIEGFIKYIKLFHERIDDNP

SEQ ID NO: 3274882 - protein, 25 aa, Plasmodium falciparum
SKIYGEIHIPIKIVTDVNIPNFQES

SEQ ID NO: 3274883 - protein, 21 aa, Plasmodium falciparum
SKIYKCFINYIYQPLIPHNIR

SEQ ID NO: 3274884 - protein, 23 aa, Plasmodium falciparum
SKKFFFNNLHFIFTTLKCSTLSE

SEQ ID NO: 3274885 - protein, 20 aa, Plasmodium falciparum
SKKIILLWINCILISNEKKT

SEQ ID NO: 3274886 - protein, 18 aa, Plasmodium falciparum
SKKIKINQVCLNKKIILT

SEQ ID NO: 3274887 - protein, 19 aa, Plasmodium falciparum
SKKIKLNFYKYSMKKPKEE

SEQ ID NO: 3274888 - protein, 20 aa, Plasmodium falciparum
SKKINYIFFDMITRNRKSKD

SEQ ID NO: 3274889 - protein, 19 aa, Plasmodium falciparum
SKKISWKHFHYKVKYVFLV

SEQ ID NO: 3274890 - protein, 17 aa, Plasmodium falciparum
SKKKHVYLLDKEKKDYD

SEQ ID NO: 3274891 - protein, 24 aa, Plasmodium falciparum
SKKKLCDMQEVIIEVWHEREVDKK

SEQ ID NO: 3274892 - protein, 24 aa, Plasmodium falciparum
SKKKMKSKIRRRNHKVVFDEDNVK

SEQ ID NO: 3274893 - protein, 23 aa, Plasmodium falciparum
SKKKNKCNMLYKKEHSRKSIRKK

SEQ ID NO: 3274894 - protein, 21 aa, Plasmodium falciparum
SKKKVMLKMCGIYQNTFDHLI

SEQ ID NO: 3274895 - protein, 18 aa, Plasmodium falciparum
SKKLDFILSNRKYKTHDN

SEQ ID NO: 3274896 - protein, 22 aa, Plasmodium falciparum
SKKLEISFNFFIKYFLLTHSII

SEQ ID NO: 3274897 - protein, 33 aa, Plasmodium falciparum
SKKLFLFSYDMKDIWIKKIYKLFYNMIICLILY

SEQ ID NO: 3274898 - protein, 20 aa, Plasmodium falciparum
SKKLIARNVIFLLKKSDIGL

SEQ ID NO: 3274899 - protein, 21 aa, Plasmodium falciparum
SKKNIFHLLASMKNKVTNKTN

SEQ ID NO: 3274900 - protein, 28 aa, Plasmodium falciparum
SKKNRKIFKKKLSFYLNNFYNKFQKKTK

SEQ ID NO: 3274901 - protein, 24 aa, Plasmodium falciparum
SKKNRLKYVLVHLCKHRNLDLSYF

SEQ ID NO: 3274902 - protein, 20 aa, Plasmodium falciparum
SKKRNARIGNHMTDMNDVEY

SEQ ID NO: 3274903 - protein, 23 aa, Plasmodium falciparum
SKKSHIFHTLKILVPSIHEINRL

SEQ ID NO: 3274904 - protein, 25 aa, Plasmodium falciparum
SKKSYFKSRFFYFDSSNIIPMKFFK

SEQ ID NO: 3274905 - protein, 19 aa, Plasmodium falciparum
SKKYCDFIYFGSNAINKFD

SEQ ID NO: 3274906 - protein, 27 aa, Plasmodium falciparum
SKKYEKEILVLKVKRLKTILMKEEYNK

SEQ ID NO: 3274907 - protein, 20 aa, Plasmodium falciparum
SKLFFNGLYYYPFNKNMNNN

SEQ ID NO: 3274908 - protein, 18 aa, Plasmodium falciparum
SKLFVFPDYIMKNLKYAI

SEQ ID NO: 3274909 - protein, 25 aa, Plasmodium falciparum
SKLFYLLNFCASNGLFVILDIGPYI

SEQ ID NO: 3274910 - protein, 18 aa, Plasmodium falciparum
SKLGILFERVILSHPAFF

SEQ ID NO: 3274911 - protein, 17 aa, Plasmodium falciparum
SKLGVCSVGLAGTGKTE

SEQ ID NO: 3274912 - protein, 21 aa, Plasmodium falciparum
SKLGYYINFDFIEIIFYTLSW

SEQ ID NO: 3274913 - protein, 21 aa, Plasmodium falciparum
SKLHALGNILIFLEDYKHINF

SEQ ID NO: 3274914 - protein, 23 aa, Plasmodium falciparum
SKLHEFYKNLIIYLNYNYICILF

SEQ ID NO: 3274915 - protein, 20 aa, Plasmodium falciparum
SKLHIFVFLLLNTLLKIEKN

SEQ ID NO: 3274916 - protein, 17 aa, Plasmodium falciparum
SKLKKSRLKKINREKIQ

SEQ ID NO: 3274917 - protein, 18 aa, Plasmodium falciparum
SKLKQWIESFILIIEGCN

SEQ ID NO: 3274918 - protein, 24 aa, Plasmodium falciparum
SKLKVDEVMNNFLINDGKISEKLK

SEQ ID NO: 3274919 - protein, 18 aa, Plasmodium falciparum
SKLLKQEFYFITFASLLI

SEQ ID NO: 3274920 - protein, 18 aa, Plasmodium falciparum
SKLNAVYKVNSVHKMNAV

SEQ ID NO: 3274921 - protein, 23 aa, Plasmodium falciparum
SKLNELYPYVSYYLFKKLWNIIN

SEQ ID NO: 3274922 - protein, 20 aa, Plasmodium falciparum
SKLNLCIKCSGHIMNILHMI

SEQ ID NO: 3274923 - protein, 26 aa, Plasmodium falciparum
SKLNYFYIFLRLTKNIKHEYIINPNY

SEQ ID NO: 3274924 - protein, 17 aa, Plasmodium falciparum
SKLVWQKGIKKTDEQKN

SEQ ID NO: 3274925 - protein, 19 aa, Plasmodium falciparum
SKLYRFLNTFVIDKNKCFK

SEQ ID NO: 3274926 - protein, 19 aa, Plasmodium falciparum
SKMKVCDLIGDAIGCKHKT

SEQ ID NO: 3274927 - protein, 18 aa, Plasmodium falciparum
SKMLHPLTKIHNHFEGQR

SEQ ID NO: 3274928 - protein, 20 aa, Plasmodium falciparum
SKMSMSFNIPKVRDHKKKSH

SEQ ID NO: 3274929 - protein, 30 aa, Plasmodium falciparum
SKNELKGEIDLLNAQIQWIGEYKGRNSVFV

SEQ ID NO: 3274930 - protein, 19 aa, Plasmodium falciparum
SKNEVHVGILLFSSKNRDY

SEQ ID NO: 3274931 - protein, 29 aa, Plasmodium falciparum
SKNIFLISYIEYIYILLLIIKEKKNTEKD

SEQ ID NO: 3274932 - protein, 19 aa, Plasmodium falciparum
SKNIIKIDFIKIFEKDERA

SEQ ID NO: 3274933 - protein, 25 aa, Plasmodium falciparum
SKNKFRMFMLKSYCFKYVASLSQYS

SEQ ID NO: 3274934 - protein, 23 aa, Plasmodium falciparum
SKNKLLRRNFNRSATYIMEKKTN

SEQ ID NO: 3274935 - protein, 19 aa, Plasmodium falciparum
SKNKSEDGYICNVFPECKW

SEQ ID NO: 3274936 - protein, 27 aa, Plasmodium falciparum
SKNKSPHLCLLWNVKLIEKYQPKNLSM

SEQ ID NO: 3274937 - protein, 19 aa, Plasmodium falciparum
SKNLFTFIFYKNLKNIGRK

SEQ ID NO: 3274938 - protein, 25 aa, Plasmodium falciparum
SKNNIFRLLKKVLLPITLYNNITLN

SEQ ID NO: 3274939 - protein, 25 aa, Plasmodium falciparum
SKNNNCNRYAKYCILQMDKDKIKHI

SEQ ID NO: 3274940 - protein, 17 aa, Plasmodium falciparum
SKNPMIRKIILKIFDRI

SEQ ID NO: 3274941 - protein, 19 aa, Plasmodium falciparum
SKNVFNIISKCMIEKNDHI

SEQ ID NO: 3274942 - protein, 18 aa, Plasmodium falciparum
SKNVRSFSSQGIREDFPY

SEQ ID NO: 3274943 - protein, 30 aa, Plasmodium falciparum
SKNYKTSMIICMNKKRAVILLSAVAYILNI

SEQ ID NO: 3274944 - protein, 25 aa, Plasmodium falciparum
SKPFPLSIFYLIYFSFGYLNPDLLS

SEQ ID NO: 3274945 - protein, 33 aa, Plasmodium falciparum
SKQVRCKRLLSEPAVEFDTIFDVFKESFLDQMG

SEQ ID NO: 3274946 - protein, 22 aa, Plasmodium falciparum
SKRIKLSMINIFDRKDFLNNNI

SEQ ID NO: 3274947 - protein, 28 aa, Plasmodium falciparum
SKRKKYYYHICQILIKFIVSSLSDNTID

SEQ ID NO: 3274948 - protein, 22 aa, Plasmodium falciparum
SKRKRKTYVKNVKWYPQRINHY

SEQ ID NO: 3274949 - protein, 21 aa, Plasmodium falciparum
SKRLCCSISDYCMKFFNFNSS

SEQ ID NO: 3274950 - protein, 42 aa, Plasmodium falciparum
SKRRKEAIVRKRSIVHFGLKLFLFSFCIWTLQYANNNYDYRD

SEQ ID NO: 3274951 - protein, 18 aa, Plasmodium falciparum
SKRRRLLVYLGRKDREMF

SEQ ID NO: 3274952 - protein, 20 aa, Plasmodium falciparum
SKSCDNYSWSGDFHSESHNS

SEQ ID NO: 3274953 - protein, 30 aa, Plasmodium falciparum
SKSGFLDLLLKWTYYTLYGHKNNNEILSAS

SEQ ID NO: 3274954 - protein, 21 aa, Plasmodium falciparum
SKSIEFCYFILRFIQKNPVLC

SEQ ID NO: 3274955 - protein, 23 aa, Plasmodium falciparum
SKSIFPKIIKIFINLILHNLNRL

SEQ ID NO: 3274956 - protein, 27 aa, Plasmodium falciparum
SKSIFSCRPVKYVCLSVAVAAVGYANY

SEQ ID NO: 3274957 - protein, 30 aa, Plasmodium falciparum
SKSIKGCKKCKENVKLLFYILIQENLNYSP

SEQ ID NO: 3274958 - protein, 22 aa, Plasmodium falciparum
SKSSKIYMVHFITSEISFNKKK

SEQ ID NO: 3274959 - protein, 19 aa, Plasmodium falciparum
SKSSPRAVYPLKCIETESF

SEQ ID NO: 3274960 - protein, 21 aa, Plasmodium falciparum
SKSVHCVFCDTEFLINENVLF

SEQ ID NO: 3274961 - protein, 23 aa, Plasmodium falciparum
SKTCALIYFSCICYISTFYYSYN

SEQ ID NO: 3274962 - protein, 18 aa, Plasmodium falciparum
SKTFQYDVFKSCIMYKTI

SEQ ID NO: 3274963 - protein, 18 aa, Plasmodium falciparum
SKTICNWVRANFVAPQDS

SEQ ID NO: 3274964 - protein, 18 aa, Plasmodium falciparum
SKTICSIKNIIDRNKKEE

SEQ ID NO: 3274965 - protein, 17 aa, Plasmodium falciparum
SKTTMLLNLSKNNKNIS

SEQ ID NO: 3274966 - protein, 27 aa, Plasmodium falciparum
SKVAGDAMSCLKYISIYSFLLTDISFF

SEQ ID NO: 3274967 - protein, 26 aa, Plasmodium falciparum
SKVEYFKIMLRICKVLIPQFDIKEII

SEQ ID NO: 3274968 - protein, 18 aa, Plasmodium falciparum
SKVKMFLETLIPLMDLVN

SEQ ID NO: 3274969 - protein, 18 aa, Plasmodium falciparum
SKVLKLLSSILVKNMYFI

SEQ ID NO: 3274970 - protein, 29 aa, Plasmodium falciparum
SKVTFCSIKLKGLLYKHLRNDGKQKNKEK

SEQ ID NO: 3274971 - protein, 17 aa, Plasmodium falciparum
SKWKNKFFHEVIQNMLY

SEQ ID NO: 3274972 - protein, 25 aa, Plasmodium falciparum
SKWWNEIKYQVWHAMLCGYRTANDK

SEQ ID NO: 3274973 - protein, 17 aa, Plasmodium falciparum
SKYAEPIWNGMICALTY

SEQ ID NO: 3274974 - protein, 18 aa, Plasmodium falciparum
SKYAEPIWNGMIYALTYK

SEQ ID NO: 3274975 - protein, 22 aa, Plasmodium falciparum
SKYCQPCPLCGMKRTKNGGNKW

SEQ ID NO: 3274976 - protein, 24 aa, Plasmodium falciparum
SKYEEGKCNMNLIKELEDQILQTV

SEQ ID NO: 3274977 - protein, 24 aa, Plasmodium falciparum
SKYEYPINILFKLLNSSLYLTSKK

SEQ ID NO: 3274978 - protein, 20 aa, Plasmodium falciparum
SKYFICCCIVLVLITEVACI

SEQ ID NO: 3274979 - protein, 47 aa, Plasmodium falciparum
SKYFMPKFLSNICGWDNYKKLLIHLFTFLKCFLKKIQVSKAIESLYI

SEQ ID NO: 3274980 - protein, 17 aa, Plasmodium falciparum
SKYGMFNIHKNNSYLYK

SEQ ID NO: 3274981 - protein, 27 aa, Plasmodium falciparum
SKYIIYGLCCIYEFLTYYYKKNYDCFV

SEQ ID NO: 3274982 - protein, 18 aa, Plasmodium falciparum
SKYLYPTKVRVFYGILYL

SEQ ID NO: 3274983 - protein, 21 aa, Plasmodium falciparum
SKYNIRIKKLFNILTSYINFV

SEQ ID NO: 3274984 - protein, 19 aa, Plasmodium falciparum
SKYPPHFKISYDEEKKKRK

SEQ ID NO: 3274985 - protein, 17 aa, Plasmodium falciparum
SKYRYENNSELLIERIK

SEQ ID NO: 3274986 - protein, 24 aa, Plasmodium falciparum
SKYYKKRKMHLLKENNEFRNEKND

SEQ ID NO: 3274987 - protein, 20 aa, Plasmodium falciparum
SKYYKYRTNYYLILTKLLFM

SEQ ID NO: 3274988 - protein, 17 aa, Plasmodium falciparum
SKYYLSHRIIRKRYKNN

SEQ ID NO: 3274989 - protein, 21 aa, Plasmodium falciparum
SLAELKKRIGAIREMINNDSF

SEQ ID NO: 3274990 - protein, 31 aa, Plasmodium falciparum
SLALATCKEPLRISLTQHLRQLLQPTSTKDC

SEQ ID NO: 3274991 - protein, 18 aa, Plasmodium falciparum
SLALMLIFFAFANLVLSD

SEQ ID NO: 3274992 - protein, 18 aa, Plasmodium falciparum
SLARSFADIGDIIRGKDM

SEQ ID NO: 3274993 - protein, 30 aa, Plasmodium falciparum
SLASYLIEYTIYFFYFILYKMFLYNDKFYC

SEQ ID NO: 3274994 - protein, 18 aa, Plasmodium falciparum
SLAVCLYSLPGNFISCYI

SEQ ID NO: 3274995 - protein, 18 aa, Plasmodium falciparum
SLCECKLYSPANYDSDPE

SEQ ID NO: 3274996 - protein, 20 aa, Plasmodium falciparum
SLCEPWKCYEAQYVKEDKKE

SEQ ID NO: 3274997 - protein, 19 aa, Plasmodium falciparum
SLCEPWQCYEGKHVQKDQN

SEQ ID NO: 3274998 - protein, 22 aa, Plasmodium falciparum
SLCGLYKLVIWFSYENIQESIE

SEQ ID NO: 3274999 - protein, 19 aa, Plasmodium falciparum
SLCISIMLTFSFIKKKVNN

SEQ ID NO: 3275000 - protein, 19 aa, Plasmodium falciparum
SLCIYNIQKKVFSYFVDDY

SEQ ID NO: 3275001 - protein, 20 aa, Plasmodium falciparum
SLCLVRGCFYSLVQGNEKFE

SEQ ID NO: 3275002 - protein, 26 aa, Plasmodium falciparum
SLDALRLNNFYLLYVYLQDIWYIFFH

SEQ ID NO: 3275003 - protein, 24 aa, Plasmodium falciparum
SLDILKERLLYAIKNCTAIDLDAY

SEQ ID NO: 3275004 - protein, 20 aa, Plasmodium falciparum
SLDNFKLLIITANFYLTLSR

SEQ ID NO: 3275005 - protein, 24 aa, Plasmodium falciparum
SLECPNCAKYCRFYKRWIDRKRKE

SEQ ID NO: 3275006 - protein, 25 aa, Plasmodium falciparum
SLEIFLKRKSHYFSPMFKQNWGCIK

SEQ ID NO: 3275007 - protein, 23 aa, Plasmodium falciparum
SLEIKWLSNFLVTVSGWNDIIID

SEQ ID NO: 3275008 - protein, 25 aa, Plasmodium falciparum
SLENKVKWGGFINVYDLVRFTIDSL

SEQ ID NO: 3275009 - protein, 19 aa, Plasmodium falciparum
SLENLGCDKKLIALTKIFG

SEQ ID NO: 3275010 - protein, 18 aa, Plasmodium falciparum
SLEPLFLTKEIARESDIS

SEQ ID NO: 3275011 - protein, 18 aa, Plasmodium falciparum
SLEWFYKTLSDIYFILNE

SEQ ID NO: 3275012 - protein, 19 aa, Plasmodium falciparum
SLFEHTCDYVISFEINELL

SEQ ID NO: 3275013 - protein, 23 aa, Plasmodium falciparum
SLFEIPPWRNMYLVLATIGSLLL

SEQ ID NO: 3275014 - protein, 18 aa, Plasmodium falciparum
SLFEPMMLYYIILIYFYK

SEQ ID NO: 3275015 - protein, 24 aa, Plasmodium falciparum
SLFILKIYVCKEEHMDSYIELLKK

SEQ ID NO: 3275016 - protein, 23 aa, Plasmodium falciparum
SLFKYIYSFFFFKKEENHIYDLF

SEQ ID NO: 3275017 - protein, 32 aa, Plasmodium falciparum
SLFLKKYLYKQMSKFFFIVGSLRQKYEEKRQI

SEQ ID NO: 3275018 - protein, 17 aa, Plasmodium falciparum
SLFMLIIIILKKYTIKH

SEQ ID NO: 3275019 - protein, 18 aa, Plasmodium falciparum
SLFPILYINFIFDKLMKY

SEQ ID NO: 3275020 - protein, 19 aa, Plasmodium falciparum
SLFSLFFIYLFIIIFVFPF

SEQ ID NO: 3275021 - protein, 17 aa, Plasmodium falciparum
SLFSRKAMIPLLGILYV

SEQ ID NO: 3275022 - protein, 24 aa, Plasmodium falciparum
SLFSSAKLKKMFNLSHTYNKKING

SEQ ID NO: 3275023 - protein, 25 aa, Plasmodium falciparum
SLFSSCVTIASSTYLLSKVDKTINK

SEQ ID NO: 3275024 - protein, 17 aa, Plasmodium falciparum
SLFYKYCPVSYINDNKI

SEQ ID NO: 3275025 - protein, 17 aa, Plasmodium falciparum
SLFYLSANNINEFCLKK

SEQ ID NO: 3275026 - protein, 17 aa, Plasmodium falciparum
SLFYSDEYIELIRKEER

SEQ ID NO: 3275027 - protein, 23 aa, Plasmodium falciparum
SLGAYKYVIMIALLDIVANTLYF

SEQ ID NO: 3275028 - protein, 27 aa, Plasmodium falciparum
SLGNEKKCTFPFFKQNRFYRIINKKFL

SEQ ID NO: 3275029 - protein, 17 aa, Plasmodium falciparum
SLHRSELYSPVNDIYNI

SEQ ID NO: 3275030 - protein, 21 aa, Plasmodium falciparum
SLHSVKFVLHYVNSIYNDDQN

SEQ ID NO: 3275031 - protein, 24 aa, Plasmodium falciparum
SLICLNLNCDFIYAFGDEKQLTFH

SEQ ID NO: 3275032 - protein, 27 aa, Plasmodium falciparum
SLIDCGYKAHLLHICQILSNKSLEIKW

SEQ ID NO: 3275033 - protein, 25 aa, Plasmodium falciparum
SLIDKRIVYIYSHIYVCNYPLSYLK

SEQ ID NO: 3275034 - protein, 25 aa, Plasmodium falciparum
SLIENCILSLLGLSFIPSKNVEKKR

SEQ ID NO: 3275035 - protein, 27 aa, Plasmodium falciparum
SLIFIYCILNFITGNSYLFYFLLIAPL

SEQ ID NO: 3275036 - protein, 30 aa, Plasmodium falciparum
SLIFLIFFFYIIRITSHFNLDNFVKGPYIT

SEQ ID NO: 3275037 - protein, 24 aa, Plasmodium falciparum
SLIGKLSLLMGCLDISMECFNKVE

SEQ ID NO: 3275038 - protein, 22 aa, Plasmodium falciparum
SLIICSSLFLLHFVNDDELTLL

SEQ ID NO: 3275039 - protein, 18 aa, Plasmodium falciparum
SLIIVYSFYLWKKYKKCK

SEQ ID NO: 3275040 - protein, 17 aa, Plasmodium falciparum
SLIKACVNRNKYKRPTF

SEQ ID NO: 3275041 - protein, 17 aa, Plasmodium falciparum
SLIKEGSGKCTGSSDEE

SEQ ID NO: 3275042 - protein, 21 aa, Plasmodium falciparum
SLIKENRWNIGKVDERLHLTN

SEQ ID NO: 3275043 - protein, 21 aa, Plasmodium falciparum
SLILIKFIFYKECNNNNNYYL

SEQ ID NO: 3275044 - protein, 28 aa, Plasmodium falciparum
SLILYHLPVRLSYHIPTIIDYSKKIRKS

SEQ ID NO: 3275045 - protein, 25 aa, Plasmodium falciparum
SLINPEFIKNIGICYNIINDETKFE

SEQ ID NO: 3275046 - protein, 26 aa, Plasmodium falciparum
SLIRFKKKNSKHIVHMTKLGKKSLLQ

SEQ ID NO: 3275047 - protein, 21 aa, Plasmodium falciparum
SLISDNWKFFCVCSKDNEKKL

SEQ ID NO: 3275048 - protein, 19 aa, Plasmodium falciparum
SLISICLNSLIDIFESLLL

SEQ ID NO: 3275049 - protein, 19 aa, Plasmodium falciparum
SLIYFSSLITYIFIFFFDL

SEQ ID NO: 3275050 - protein, 31 aa, Plasmodium falciparum
SLIYKEKRKIYKTKIDSMLKNNEIIDIQNTL

SEQ ID NO: 3275051 - protein, 21 aa, Plasmodium falciparum
SLKINIKRGVYREYYNNKYLD

SEQ ID NO: 3275052 - protein, 25 aa, Plasmodium falciparum
SLKLEKDRILAFGGEVKKLHGDVAY

SEQ ID NO: 3275053 - protein, 20 aa, Plasmodium falciparum
SLKNQLKFMWRKTKLNFTSS

SEQ ID NO: 3275054 - protein, 21 aa, Plasmodium falciparum
SLKNRLFDFTKKFKDVLQIRS

SEQ ID NO: 3275055 - protein, 17 aa, Plasmodium falciparum
SLKPNGFTPFAFLLWGI

SEQ ID NO: 3275056 - protein, 23 aa, Plasmodium falciparum
SLKQINIIICLLIVTLEDILKIF

SEQ ID NO: 3275057 - protein, 27 aa, Plasmodium falciparum
SLKSGTIPIDFLRLMFYTIADYKDIFE

SEQ ID NO: 3275058 - protein, 19 aa, Plasmodium falciparum
SLKSLLVVIKKFFIMINLA

SEQ ID NO: 3275059 - protein, 25 aa, Plasmodium falciparum
SLKTCDIIKYEGHKLLAARGDPCKK

SEQ ID NO: 3275060 - protein, 19 aa, Plasmodium falciparum
SLKVSDVVIVLKEKHFSEY

SEQ ID NO: 3275061 - protein, 23 aa, Plasmodium falciparum
SLLCKRYSAPIIGLVYVIVLTVG

SEQ ID NO: 3275062 - protein, 17 aa, Plasmodium falciparum
SLLCTFVITLFYKNVKR

SEQ ID NO: 3275063 - protein, 24 aa, Plasmodium falciparum
SLLESTTLIFSWGNNLYFTSYQPN

SEQ ID NO: 3275064 - protein, 18 aa, Plasmodium falciparum
SLLFAIIYYWSRREAWSH

SEQ ID NO: 3275065 - protein, 20 aa, Plasmodium falciparum
SLLFILMLFILFCTEFLFVY

SEQ ID NO: 3275066 - protein, 26 aa, Plasmodium falciparum
SLLFLEECFFLISIMNLYEDSIHMLS

SEQ ID NO: 3275067 - protein, 20 aa, Plasmodium falciparum
SLLFSMPIYIIRDVENEGKR

SEQ ID NO: 3275068 - protein, 27 aa, Plasmodium falciparum
SLLGFSFFLSFVIDYLRFVTAHVTIIY

SEQ ID NO: 3275069 - protein, 23 aa, Plasmodium falciparum
SLLIFLFFCVYVFTQRRRVISSP

SEQ ID NO: 3275070 - protein, 24 aa, Plasmodium falciparum
SLLKNCLLINTFIHLYFLNSPMHE

SEQ ID NO: 3275071 - protein, 30 aa, Plasmodium falciparum
SLLLCSLFLGIPVLAFVCFGTLWDKQKHSW

SEQ ID NO: 3275072 - protein, 27 aa, Plasmodium falciparum
SLLLHLKIYLTYLFECDIIKLFIFILH

SEQ ID NO: 3275073 - protein, 17 aa, Plasmodium falciparum
SLLRTIMIYDISKLKND

SEQ ID NO: 3275074 - protein, 22 aa, Plasmodium falciparum
SLLSKRGIGLCDEFFLKKYSYV

SEQ ID NO: 3275075 - protein, 24 aa, Plasmodium falciparum
SLLTCLLFIFQCHYILKKNNLMWK

SEQ ID NO: 3275076 - protein, 19 aa, Plasmodium falciparum
SLLYICWIFFLIISILTIF

SEQ ID NO: 3275077 - protein, 19 aa, Plasmodium falciparum
SLMEFYFNILLSIIKIGKH

SEQ ID NO: 3275078 - protein, 17 aa, Plasmodium falciparum
SLMKCSLLLNFLILLLY

SEQ ID NO: 3275079 - protein, 34 aa, Plasmodium falciparum
SLMNCLSVIMFIILYIISLHIFFYKTNSFHLSLR

SEQ ID NO: 3275080 - protein, 20 aa, Plasmodium falciparum
SLMSSPMCFHSFNDIQEMIN

SEQ ID NO: 3275081 - protein, 25 aa, Plasmodium falciparum
SLNCPSCGRHCSFYKKWIKKKRTEF

SEQ ID NO: 3275082 - protein, 21 aa, Plasmodium falciparum
SLNERSSCIIHAYSNDVLGIN

SEQ ID NO: 3275083 - protein, 27 aa, Plasmodium falciparum
SLNFKVDCKNMLPCIENTNTSLNRANQ

SEQ ID NO: 3275084 - protein, 19 aa, Plasmodium falciparum
SLNFKYNFLNIKQMYYQNK

SEQ ID NO: 3275085 - protein, 18 aa, Plasmodium falciparum
SLNFLLIHLKGSKYNFSN

SEQ ID NO: 3275086 - protein, 25 aa, Plasmodium falciparum
SLNGFDCTQTIWKKKVFGRGNDCTN

SEQ ID NO: 3275087 - protein, 25 aa, Plasmodium falciparum
SLNILKNRWFLILLKYFMHKYATYA

SEQ ID NO: 3275088 - protein, 18 aa, Plasmodium falciparum
SLNIPYNINYVINFLTSH

SEQ ID NO: 3275089 - protein, 21 aa, Plasmodium falciparum
SLNISKLLFPFFGYTTSEESV

SEQ ID NO: 3275090 - protein, 25 aa, Plasmodium falciparum
SLNKIPPKWSMYFNKKIKYVNNFIT

SEQ ID NO: 3275091 - protein, 20 aa, Plasmodium falciparum
SLNKKFIFFKSVYKNKSINE

SEQ ID NO: 3275092 - protein, 18 aa, Plasmodium falciparum
SLNKSMGYKNSFNDNLNT

SEQ ID NO: 3275093 - protein, 19 aa, Plasmodium falciparum
SLNLISVFISILIISLIIF

SEQ ID NO: 3275094 - protein, 24 aa, Plasmodium falciparum
SLNSLRISIKYIFTPNNYKNEKKN

SEQ ID NO: 3275095 - protein, 23 aa, Plasmodium falciparum
SLNYLRKIMKYELSLNNDGILMY

SEQ ID NO: 3275096 - protein, 28 aa, Plasmodium falciparum
SLNYNILINPCYNKNNVINELFMNTKEK

SEQ ID NO: 3275097 - protein, 23 aa, Plasmodium falciparum
SLPRCFIDRTGLGIKAINSNKYY

SEQ ID NO: 3275098 - protein, 24 aa, Plasmodium falciparum
SLRKISVVINLDFSMYSNEYLNFL

SEQ ID NO: 3275099 - protein, 31 aa, Plasmodium falciparum
SLRKMRFQRCVTVIKIYNWMNTYFKMYIEKK

SEQ ID NO: 3275100 - protein, 25 aa, Plasmodium falciparum
SLSDECIRYLSLVRLFLNRHKYKLI

SEQ ID NO: 3275101 - protein, 23 aa, Plasmodium falciparum
SLSEIPKKCEILGIWYQAIYIAR

SEQ ID NO: 3275102 - protein, 20 aa, Plasmodium falciparum
SLSESKLIFNQNVLIEEILS

SEQ ID NO: 3275103 - protein, 24 aa, Plasmodium falciparum
SLSFPCNGCKDCGIHMEKPYNLNY

SEQ ID NO: 3275104 - protein, 24 aa, Plasmodium falciparum
SLSICVCILVFFFILKYIIYYNVM

SEQ ID NO: 3275105 - protein, 28 aa, Plasmodium falciparum
SLSIFLLTLLGIWVYKTLIINKEKKKKK

SEQ ID NO: 3275106 - protein, 25 aa, Plasmodium falciparum
SLSLDIEIFFSIYIIILERINQSIL

SEQ ID NO: 3275107 - protein, 19 aa, Plasmodium falciparum
SLSNLTSLIIVFPGDTVRK

SEQ ID NO: 3275108 - protein, 18 aa, Plasmodium falciparum
SLSNRLLLIIKEIYEKHM

SEQ ID NO: 3275109 - protein, 17 aa, Plasmodium falciparum
SLSWKIYLKNLLKKRKS

SEQ ID NO: 3275110 - protein, 19 aa, Plasmodium falciparum
SLTCLKNNFNISNHNILLM

SEQ ID NO: 3275111 - protein, 17 aa, Plasmodium falciparum
SLTLKHERLQADLLKNI

SEQ ID NO: 3275112 - protein, 25 aa, Plasmodium falciparum
SLTSAYSLKLTKIIFSQMQLPYLSQ

SEQ ID NO: 3275113 - protein, 18 aa, Plasmodium falciparum
SLTSSFFILISYLTVQVG

SEQ ID NO: 3275114 - protein, 17 aa, Plasmodium falciparum
SLVCAFVTLTFYKRYRY

SEQ ID NO: 3275115 - protein, 19 aa, Plasmodium falciparum
SLVIPIAVQFIRKNLNKWK

SEQ ID NO: 3275116 - protein, 32 aa, Plasmodium falciparum
SLVKSGNHFLFFSIISLFLLHLIYYGNYLIAH

SEQ ID NO: 3275117 - protein, 24 aa, Plasmodium falciparum
SLVNYFINKCRFVRDYNIFDDSNN

SEQ ID NO: 3275118 - protein, 24 aa, Plasmodium falciparum
SLVPGLCKETTFSQFFNNFNWKSH

SEQ ID NO: 3275119 - protein, 18 aa, Plasmodium falciparum
SLVTCFNMFLYVLFTTLI

SEQ ID NO: 3275120 - protein, 27 aa, Plasmodium falciparum
SLYDIFYRYQYLLTMKNKIYLRRTKQK

SEQ ID NO: 3275121 - protein, 18 aa, Plasmodium falciparum
SLYEKWKIYFEDKQIDIS

SEQ ID NO: 3275122 - protein, 18 aa, Plasmodium falciparum
SLYESLYILYSINKCELP

SEQ ID NO: 3275123 - protein, 19 aa, Plasmodium falciparum
SLYFTYLHFFIYITNHPYI

SEQ ID NO: 3275124 - protein, 25 aa, Plasmodium falciparum
SLYIYFDIINIFPPNFFEIINEINL

SEQ ID NO: 3275125 - protein, 23 aa, Plasmodium falciparum
SLYKKQHVFNRFLLHKRSSSKRL

SEQ ID NO: 3275126 - protein, 18 aa, Plasmodium falciparum
SLYNFIITTISKVCAPLI

SEQ ID NO: 3275127 - protein, 17 aa, Plasmodium falciparum
SLYSCLHSTYGNIIQPN

SEQ ID NO: 3275128 - protein, 20 aa, Plasmodium falciparum
SMAEKIKKTFSFENEEKLPD

SEQ ID NO: 3275129 - protein, 24 aa, Plasmodium falciparum
SMFFPFNIIFKKLIFTNLIKLPYE

SEQ ID NO: 3275130 - protein, 19 aa, Plasmodium falciparum
SMGCIIAAGFTRKHTEKVK

SEQ ID NO: 3275131 - protein, 18 aa, Plasmodium falciparum
SMHLYGVILFSGCNMSIY

SEQ ID NO: 3275132 - protein, 18 aa, Plasmodium falciparum
SMHRSFRKKIKYCKYFAS

SEQ ID NO: 3275133 - protein, 25 aa, Plasmodium falciparum
SMITQRTRLLLGRHMNDIDKRKNRK

SEQ ID NO: 3275134 - protein, 29 aa, Plasmodium falciparum
SMKFPLYTESLRLYKFNDIITRTYVKNII

SEQ ID NO: 3275135 - protein, 18 aa, Plasmodium falciparum
SMLKCIPSGAIQFMSYEI

SEQ ID NO: 3275136 - protein, 23 aa, Plasmodium falciparum
SMLLFLYDFLLRVKCVDVCSIFS

SEQ ID NO: 3275137 - protein, 29 aa, Plasmodium falciparum
SMNITLFHLCFFGFLFVILNFTLDNSNFS

SEQ ID NO: 3275138 - protein, 23 aa, Plasmodium falciparum
SMRRKKEFANLILYNQHFDHQII

SEQ ID NO: 3275139 - protein, 27 aa, Plasmodium falciparum
SMSLGLSIMGYRVIKTVGMKLIKITPA

SEQ ID NO: 3275140 - protein, 17 aa, Plasmodium falciparum
SNAYCYIINGPEIMSKH

SEQ ID NO: 3275141 - protein, 22 aa, Plasmodium falciparum
SNCAEGIYYGCQSFINILTISF

SEQ ID NO: 3275142 - protein, 22 aa, Plasmodium falciparum
SNCKKCYSSIIFILFIFLVYSI

SEQ ID NO: 3275143 - protein, 21 aa, Plasmodium falciparum
SNCKKIKCMDLLKDDEPYFYL

SEQ ID NO: 3275144 - protein, 17 aa, Plasmodium falciparum
SNCKNFNSKNCSKYSLM

SEQ ID NO: 3275145 - protein, 25 aa, Plasmodium falciparum
SNCREKRKGMKWDCKKKNDRSNYVC

SEQ ID NO: 3275146 - protein, 25 aa, Plasmodium falciparum
SNDALKHLLIIVALLRIEKRTNRYS

SEQ ID NO: 3275147 - protein, 23 aa, Plasmodium falciparum
SNDCPTFCGGILGLQEDIMCVQT

SEQ ID NO: 3275148 - protein, 25 aa, Plasmodium falciparum
SNDFLTFLLPYIFSACFDNYKIFRL

SEQ ID NO: 3275149 - protein, 20 aa, Plasmodium falciparum
SNEFFDDLLELLIILITKKH

SEQ ID NO: 3275150 - protein, 19 aa, Plasmodium falciparum
SNEGIFYEDLHALNIEQMN

SEQ ID NO: 3275151 - protein, 18 aa, Plasmodium falciparum
SNEIFYFKKNVLIKKRNK

SEQ ID NO: 3275152 - protein, 22 aa, Plasmodium falciparum
SNENLLPWKIKVEAINLLCDKM

SEQ ID NO: 3275153 - protein, 28 aa, Plasmodium falciparum
SNERYFLPLISFIPIIILYDYLKKKNEI

SEQ ID NO: 3275154 - protein, 24 aa, Plasmodium falciparum
SNEWLCQRCEFEKKSLGNNFLYIF

SEQ ID NO: 3275155 - protein, 17 aa, Plasmodium falciparum
SNEYYETYICDMNNISD

SEQ ID NO: 3275156 - protein, 31 aa, Plasmodium falciparum
SNFFNLDFWDIFCNLNYIFLFNSNNINMYIN

SEQ ID NO: 3275157 - protein, 27 aa, Plasmodium falciparum
SNFIKFSLKLKISYLDYLCFFLNEKPS

SEQ ID NO: 3275158 - protein, 19 aa, Plasmodium falciparum
SNFLKRSLFYDFYNNLLCK

SEQ ID NO: 3275159 - protein, 28 aa, Plasmodium falciparum
SNFLLLPLKEAFFFFFFFFSHAESVHLE

SEQ ID NO: 3275160 - protein, 18 aa, Plasmodium falciparum
SNFLSDFYERVICSNLHS

SEQ ID NO: 3275161 - protein, 26 aa, Plasmodium falciparum
SNFNCPGCGRECRKYKNWIKTKRTEF

SEQ ID NO: 3275162 - protein, 17 aa, Plasmodium falciparum
SNFNFLLNVCDHIDSCI

SEQ ID NO: 3275163 - protein, 22 aa, Plasmodium falciparum
SNFPTCLEKDSYLKFLEVKIKI

SEQ ID NO: 3275164 - protein, 24 aa, Plasmodium falciparum
SNFSYIHKFLHNMIPVYKYTIING

SEQ ID NO: 3275165 - protein, 19 aa, Plasmodium falciparum
SNGKFYLIERGIIYHKTLR

SEQ ID NO: 3275166 - protein, 20 aa, Plasmodium falciparum
SNHIFTWDFFMNHFQNTFGF

SEQ ID NO: 3275167 - protein, 18 aa, Plasmodium falciparum
SNHLLLDSFLFYKTQRTI

SEQ ID NO: 3275168 - protein, 23 aa, Plasmodium falciparum
SNHTCIKKKCTHLHSHKYNLKNN

SEQ ID NO: 3275169 - protein, 18 aa, Plasmodium falciparum
SNHYNHFDLSKQHVLKNI

SEQ ID NO: 3275170 - protein, 18 aa, Plasmodium falciparum
SNHYTVLFSLNINNSKCT

SEQ ID NO: 3275171 - protein, 21 aa, Plasmodium falciparum
SNICGLIKVHPFLDINKTKEL

SEQ ID NO: 3275172 - protein, 25 aa, Plasmodium falciparum
SNIEKRSFLFFDCLLVNEYNTFFYN

SEQ ID NO: 3275173 - protein, 28 aa, Plasmodium falciparum
SNIEYDYRWSVILPYIIFKHDKSKPFAK

SEQ ID NO: 3275174 - protein, 17 aa, Plasmodium falciparum
SNIFFTFYILKKYYHTW

SEQ ID NO: 3275175 - protein, 24 aa, Plasmodium falciparum
SNIIECLFLKYNFYEEVVNECNNF

SEQ ID NO: 3275176 - protein, 26 aa, Plasmodium falciparum
SNIIFKYKYICILLGKLRYFTNQDIL

SEQ ID NO: 3275177 - protein, 17 aa, Plasmodium falciparum
SNIILSLSIYPHHNTQM

SEQ ID NO: 3275178 - protein, 19 aa, Plasmodium falciparum
SNIILYKIIFRNKILLNNN

SEQ ID NO: 3275179 - protein, 27 aa, Plasmodium falciparum
SNIKLERAFKHFFIFAQEKEHILKYFS

SEQ ID NO: 3275180 - protein, 36 aa, Plasmodium falciparum
SNIKLLPCCIPILVILYKYIHRNICSKKEKNNSDVY

SEQ ID NO: 3275181 - protein, 25 aa, Plasmodium falciparum
SNIKNVRIKFLWSSIFSSNISPINI

SEQ ID NO: 3275182 - protein, 17 aa, Plasmodium falciparum
SNILIKIILQYIDNKES

SEQ ID NO: 3275183 - protein, 18 aa, Plasmodium falciparum
SNILSLLFHFLKFRNIHV

SEQ ID NO: 3275184 - protein, 19 aa, Plasmodium falciparum
SNIMWFLKNECNIINEECF

SEQ ID NO: 3275185 - protein, 28 aa, Plasmodium falciparum
SNINFEFLKNLFFGIATNGIFFCFDEFN

SEQ ID NO: 3275186 - protein, 27 aa, Plasmodium falciparum
SNINILYKCRICKYVMNKKCVHKCCSV

SEQ ID NO: 3275187 - protein, 17 aa, Plasmodium falciparum
SNINRFSQTSIYNTHNK

SEQ ID NO: 3275188 - protein, 32 aa, Plasmodium falciparum
SNIPKKKVDFIFSRGILDLEIINEVRISLISD

SEQ ID NO: 3275189 - protein, 20 aa, Plasmodium falciparum
SNIQKFVCFLLGTNIGEIIY

SEQ ID NO: 3275190 - protein, 22 aa, Plasmodium falciparum
SNIQNVCKYNCDMQNKNSLFNY

SEQ ID NO: 3275191 - protein, 17 aa, Plasmodium falciparum
SNIRKPLFYYKLPVQFE

SEQ ID NO: 3275192 - protein, 21 aa, Plasmodium falciparum
SNISKCRYLYKHIYMNKDNQK

SEQ ID NO: 3275193 - protein, 25 aa, Plasmodium falciparum
SNISSFCSLCLNNVYINPNTNKDEA

SEQ ID NO: 3275194 - protein, 19 aa, Plasmodium falciparum
SNISSYHFSDCSSTISDTS

SEQ ID NO: 3275195 - protein, 17 aa, Plasmodium falciparum
SNITFLIKNCEQKIQSV

SEQ ID NO: 3275196 - protein, 20 aa, Plasmodium falciparum
SNIYFVCINTLFLLLNNITQ

SEQ ID NO: 3275197 - protein, 22 aa, Plasmodium falciparum
SNIYINYEWSLYFLSLIKQKHA

SEQ ID NO: 3275198 - protein, 21 aa, Plasmodium falciparum
SNIYLIDFISLYIRKNFFDLK

SEQ ID NO: 3275199 - protein, 23 aa, Plasmodium falciparum
SNKEIKSGLKANIRNNNCMNNIE

SEQ ID NO: 3275200 - protein, 22 aa, Plasmodium falciparum
SNKESLPIISFVLKNVEGKEIT

SEQ ID NO: 3275201 - protein, 27 aa, Plasmodium falciparum
SNKFYSSFHFMCLVVYIISLFFITLTN

SEQ ID NO: 3275202 - protein, 28 aa, Plasmodium falciparum
SNKGGRIKYFFSYIFYKLFSHIYNKKNK

SEQ ID NO: 3275203 - protein, 23 aa, Plasmodium falciparum
SNKHAFRLLLFYDENITKSKNFV

SEQ ID NO: 3275204 - protein, 19 aa, Plasmodium falciparum
SNKKLKINLYRVIDILNET

SEQ ID NO: 3275205 - protein, 31 aa, Plasmodium falciparum
SNKKLYLCSLLSIGLVGYIYFNWYEKKKKVT

SEQ ID NO: 3275206 - protein, 24 aa, Plasmodium falciparum
SNKLIPIPLYWLVAENSFIWLSIQ

SEQ ID NO: 3275207 - protein, 27 aa, Plasmodium falciparum
SNKLMLLLEYYAKGNLFNFLKNKNKIH

SEQ ID NO: 3275208 - protein, 18 aa, Plasmodium falciparum
SNKLNYYIKRFQKGKQDY

SEQ ID NO: 3275209 - protein, 31 aa, Plasmodium falciparum
SNKLYYGFTGWRICYFIISFFPVFVSIFIFK

SEQ ID NO: 3275210 - protein, 19 aa, Plasmodium falciparum
SNKMDGCVKNPNEYVQQDT

SEQ ID NO: 3275211 - protein, 23 aa, Plasmodium falciparum
SNKMYSPECIKRLSNSNEELMDN

SEQ ID NO: 3275212 - protein, 23 aa, Plasmodium falciparum
SNKNCKNENFLILGNENEMKTSR

SEQ ID NO: 3275213 - protein, 21 aa, Plasmodium falciparum
SNKNMSFYILKHIMLGDLEKV

SEQ ID NO: 3275214 - protein, 24 aa, Plasmodium falciparum
SNKNTKYLLSFGGVSTQVFTNYDK

SEQ ID NO: 3275215 - protein, 24 aa, Plasmodium falciparum
SNKYMCSYDIFLIGSNKYTIDKNH

SEQ ID NO: 3275216 - protein, 22 aa, Plasmodium falciparum
SNLDVIEFKEYINMLNEYENIK

SEQ ID NO: 3275217 - protein, 20 aa, Plasmodium falciparum
SNLEYYDFINFCVDKYNSLK

SEQ ID NO: 3275218 - protein, 17 aa, Plasmodium falciparum
SNLFKEMILNIGAEEKI

SEQ ID NO: 3275219 - protein, 28 aa, Plasmodium falciparum
SNLFPNIFWGICPIDVFQEGRNEEHFYF

SEQ ID NO: 3275220 - protein, 20 aa, Plasmodium falciparum
SNLFSVIFNLYAFLKKKIKL

SEQ ID NO: 3275221 - protein, 18 aa, Plasmodium falciparum
SNLGKFSYLTNVLSHNIN

SEQ ID NO: 3275222 - protein, 28 aa, Plasmodium falciparum
SNLIFCSFSLMFLQFLFNGVFKNIKSIG

SEQ ID NO: 3275223 - protein, 17 aa, Plasmodium falciparum
SNLIKWLNLNFVTYSTW

SEQ ID NO: 3275224 - protein, 17 aa, Plasmodium falciparum
SNLKEKQFESFEKNQMD

SEQ ID NO: 3275225 - protein, 20 aa, Plasmodium falciparum
SNLLTISGIFLVLVLNCIII

SEQ ID NO: 3275226 - protein, 27 aa, Plasmodium falciparum
SNLNFRYTDRWCFKVIYGYLFSHFIFN

SEQ ID NO: 3275227 - protein, 19 aa, Plasmodium falciparum
SNLRKRKNNNLNDSSTTFN

SEQ ID NO: 3275228 - protein, 19 aa, Plasmodium falciparum
SNLYFLKLLSIGSSIFMQL

SEQ ID NO: 3275229 - protein, 34 aa, Plasmodium falciparum
SNLYGYFLRFIKRLSSSSNICFNRKETSTQNTNE

SEQ ID NO: 3275230 - protein, 18 aa, Plasmodium falciparum
SNMHVYDLLIKRKNLNEL

SEQ ID NO: 3275231 - protein, 22 aa, Plasmodium falciparum
SNMIFPTFNFDFDILKAEEEVL

SEQ ID NO: 3275232 - protein, 18 aa, Plasmodium falciparum
SNMLFISGNIFIRLIECP

SEQ ID NO: 3275233 - protein, 19 aa, Plasmodium falciparum
SNMMCFLYFLSSLLVLLIT

SEQ ID NO: 3275234 - protein, 28 aa, Plasmodium falciparum
SNMVSEIKLRINIFIDVVNKYKSCINKY

SEQ ID NO: 3275235 - protein, 33 aa, Plasmodium falciparum
SNMYDIRRTPAWCDRVLMSGKLVHLSEIEKKRN

SEQ ID NO: 3275236 - protein, 24 aa, Plasmodium falciparum
SNNDVHGLLLILGQEFLKCNTDTL

SEQ ID NO: 3275237 - protein, 26 aa, Plasmodium falciparum
SNNFILKRERIFFFCFLYSLLESVTD

SEQ ID NO: 3275238 - protein, 17 aa, Plasmodium falciparum
SNNILVKDLMDYIINIG

SEQ ID NO: 3275239 - protein, 24 aa, Plasmodium falciparum
SNNKLKYIFSFFSLIDFITTPVSS

SEQ ID NO: 3275240 - protein, 19 aa, Plasmodium falciparum
SNNLIMLFFLLAKNKLFPS

SEQ ID NO: 3275241 - protein, 20 aa, Plasmodium falciparum
SNNMCLALGCLTKSYRIKEQ

SEQ ID NO: 3275242 - protein, 22 aa, Plasmodium falciparum
SNNMCSVCFNIQDGNINILYKC

SEQ ID NO: 3275243 - protein, 32 aa, Plasmodium falciparum
SNNNCSKIKFPRLCSSSSSFLASYNTYNKKQI

SEQ ID NO: 3275244 - protein, 36 aa, Plasmodium falciparum
SNNNFIITCSFSFSIKNVFIRLWKRKSPMKNQNFKT

SEQ ID NO: 3275245 - protein, 25 aa, Plasmodium falciparum
SNNPFFRYLKCFNLVEFNKDTIFYK

SEQ ID NO: 3275246 - protein, 17 aa, Plasmodium falciparum
SNNSIFFKTLSKKKKEF

SEQ ID NO: 3275247 - protein, 18 aa, Plasmodium falciparum
SNNYKYVYAYNVENKNGI

SEQ ID NO: 3275248 - protein, 23 aa, Plasmodium falciparum
SNNYNYICIITFCDNIYNVELFS

SEQ ID NO: 3275249 - protein, 21 aa, Plasmodium falciparum
SNPIYLYDHIISFLLNTQDKE

SEQ ID NO: 3275250 - protein, 30 aa, Plasmodium falciparum
SNQTCMDLNKCFNFVKDIYISRKQNMCIII

SEQ ID NO: 3275251 - protein, 26 aa, Plasmodium falciparum
SNRIFCKQSKITFCDELYIYFNKILK

SEQ ID NO: 3275252 - protein, 17 aa, Plasmodium falciparum
SNRTMFINKILRDNKGK

SEQ ID NO: 3275253 - protein, 21 aa, Plasmodium falciparum
SNSCLNYIFNLLVKENVIHQK

SEQ ID NO: 3275254 - protein, 19 aa, Plasmodium falciparum
SNSKLDVVINYRYYEEKFL

SEQ ID NO: 3275255 - protein, 21 aa, Plasmodium falciparum
SNSLFKFQYFYTTLIKINNKK

SEQ ID NO: 3275256 - protein, 19 aa, Plasmodium falciparum
SNSLVITWNLYFFSEQLPL

SEQ ID NO: 3275257 - protein, 29 aa, Plasmodium falciparum
SNSPIKFLLNILILCFKKDKSEINELNPN

SEQ ID NO: 3275258 - protein, 22 aa, Plasmodium falciparum
SNSSLSFSLCFCKEKNIYFSFK

SEQ ID NO: 3275259 - protein, 23 aa, Plasmodium falciparum
SNTCSHLNFTNCSNVSIRYSSIK

SEQ ID NO: 3275260 - protein, 21 aa, Plasmodium falciparum
SNTFLSFLFNNMISVNINNNK

SEQ ID NO: 3275261 - protein, 18 aa, Plasmodium falciparum
SNTKCLDYDLSLLEKSFQ

SEQ ID NO: 3275262 - protein, 26 aa, Plasmodium falciparum
SNTLFKKRLLRALGYTVISVPISDYT

SEQ ID NO: 3275263 - protein, 30 aa, Plasmodium falciparum
SNTLKTNFFWKEFISFLDFFNSRKSVFTYP

SEQ ID NO: 3275264 - protein, 24 aa, Plasmodium falciparum
SNTLPIYGSYIFQIVVSFEIDNSI

SEQ ID NO: 3275265 - protein, 25 aa, Plasmodium falciparum
SNTNELLKCVLKNSFYNISALTYEI

SEQ ID NO: 3275266 - protein, 24 aa, Plasmodium falciparum
SNTTIELFYTYPIKDMITKSYFSN

SEQ ID NO: 3275267 - protein, 23 aa, Plasmodium falciparum
SNVCIKYMITYIFQNMYHGKNEL

SEQ ID NO: 3275268 - protein, 23 aa, Plasmodium falciparum
SNVDLPFDHFVLRNNNINILLKI

SEQ ID NO: 3275269 - protein, 23 aa, Plasmodium falciparum
SNVFCYNIYNMNYWNVNQLKDYE

SEQ ID NO: 3275270 - protein, 24 aa, Plasmodium falciparum
SNVGLEIFFDYIIQIDDLKLLDSS

SEQ ID NO: 3275271 - protein, 18 aa, Plasmodium falciparum
SNVGWHPFFVFFCGVSGL

SEQ ID NO: 3275272 - protein, 23 aa, Plasmodium falciparum
SNVKIINDNVCSFSNNNIKETFK

SEQ ID NO: 3275273 - protein, 32 aa, Plasmodium falciparum
SNVKNYSCLCIYKFIIIYSSLYYLSNIDNLSF

SEQ ID NO: 3275274 - protein, 19 aa, Plasmodium falciparum
SNVLIHIIEILSQYFKKNI

SEQ ID NO: 3275275 - protein, 19 aa, Plasmodium falciparum
SNVLYKLIRCDSVNTHTYK

SEQ ID NO: 3275276 - protein, 26 aa, Plasmodium falciparum
SNVSFLLLPQICFDTSISYDNILFNF

SEQ ID NO: 3275277 - protein, 30 aa, Plasmodium falciparum
SNYFLCELFINFYVYHLFLKLQQHVENELD

SEQ ID NO: 3275278 - protein, 18 aa, Plasmodium falciparum
SNYFVGSSTKDYWIPTES

SEQ ID NO: 3275279 - protein, 25 aa, Plasmodium falciparum
SNYIPNNIKGSIRFENVSFSYNHYD

SEQ ID NO: 3275280 - protein, 17 aa, Plasmodium falciparum
SNYLKKFLSFVPFIYNI

SEQ ID NO: 3275281 - protein, 25 aa, Plasmodium falciparum
SPALKYLAVCLGNFYSFSKLYRFLN

SEQ ID NO: 3275282 - protein, 22 aa, Plasmodium falciparum
SPAYPLYFSVFLKRLKSYVSDR

SEQ ID NO: 3275283 - protein, 23 aa, Plasmodium falciparum
SPDIIQRWIRVIFNIIITSLIVT

SEQ ID NO: 3275284 - protein, 30 aa, Plasmodium falciparum
SPDMPHPIPPRVCKNSTLGIQVKKEKNKSE

SEQ ID NO: 3275285 - protein, 19 aa, Plasmodium falciparum
SPEEIHFLFYLNLLVLINE

SEQ ID NO: 3275286 - protein, 24 aa, Plasmodium falciparum
SPEKISLFIYHAFDMEKIKKKLPS

SEQ ID NO: 3275287 - protein, 23 aa, Plasmodium falciparum
SPFACSILESIGWTYENVSKRYI

SEQ ID NO: 3275288 - protein, 18 aa, Plasmodium falciparum
SPFLLPLYKVYESNNIFF

SEQ ID NO: 3275289 - protein, 19 aa, Plasmodium falciparum
SPFLYCPLQTMLINKNNVS

SEQ ID NO: 3275290 - protein, 22 aa, Plasmodium falciparum
SPHFKPIRFEEIAGIDESKLEL

SEQ ID NO: 3275291 - protein, 18 aa, Plasmodium falciparum
SPICKKKKKLLFFEGKYI

SEQ ID NO: 3275292 - protein, 24 aa, Plasmodium falciparum
SPIFRCVRNSKFGLRKKERTFFFY

SEQ ID NO: 3275293 - protein, 24 aa, Plasmodium falciparum
SPLCSNNPYFSFREILHGSNYYIP

SEQ ID NO: 3275294 - protein, 27 aa, Plasmodium falciparum
SPLIGYSYSKFYGLKFNYMNIQLRSDG

SEQ ID NO: 3275295 - protein, 18 aa, Plasmodium falciparum
SPLSFSECKYKIENIQWE

SEQ ID NO: 3275296 - protein, 17 aa, Plasmodium falciparum
SPLSLNIDSYFIIEMLK

SEQ ID NO: 3275297 - protein, 18 aa, Plasmodium falciparum
SPLSYKDNFPISSSCSSL

SEQ ID NO: 3275298 - protein, 25 aa, Plasmodium falciparum
SPNLKCYICQCISSIFKNIKKYILY

SEQ ID NO: 3275299 - protein, 18 aa, Plasmodium falciparum
SPNLKKRASNYMHKNPNK

SEQ ID NO: 3275300 - protein, 18 aa, Plasmodium falciparum
SPNLPLRDLNEGKKKSKK

SEQ ID NO: 3275301 - protein, 19 aa, Plasmodium falciparum
SPSDLYMKTNKFLSMYDAY

SEQ ID NO: 3275302 - protein, 17 aa, Plasmodium falciparum
SPSEFLEHFYPYDNFIF

SEQ ID NO: 3275303 - protein, 17 aa, Plasmodium falciparum
SPSKNKCTFENINDPND

SEQ ID NO: 3275304 - protein, 18 aa, Plasmodium falciparum
SPSLLLSVALSYRNIKLN

SEQ ID NO: 3275305 - protein, 26 aa, Plasmodium falciparum
SPTPKRILKKLKIMKYIEYRKYCEEN

SEQ ID NO: 3275306 - protein, 23 aa, Plasmodium falciparum
SQACAKCFFSCHRFVKWIDNQKL

SEQ ID NO: 3275307 - protein, 34 aa, Plasmodium falciparum
SQARNCINYTFNECFKIPIATPILDDSIILKIWD

SEQ ID NO: 3275308 - protein, 24 aa, Plasmodium falciparum
SQEEIYRLYNMLSNLKITNSEFNQ

SEQ ID NO: 3275309 - protein, 32 aa, Plasmodium falciparum
SQEEKNKWLDIFWKYFHKNEEEIEKKEMNEKN

SEQ ID NO: 3275310 - protein, 27 aa, Plasmodium falciparum
SQEFAITASRIWLQYTIASTLSAALTW

SEQ ID NO: 3275311 - protein, 25 aa, Plasmodium falciparum
SQEMWRKGENFYMHGATNTNEQNDD

SEQ ID NO: 3275312 - protein, 25 aa, Plasmodium falciparum
SQFFDALLCYYDFRLRVNMEVTVMY

SEQ ID NO: 3275313 - protein, 17 aa, Plasmodium falciparum
SQFFKYWYEKSQNLSNI

SEQ ID NO: 3275314 - protein, 24 aa, Plasmodium falciparum
SQGNKFRIDSCLTQYDLLQVKDDK

SEQ ID NO: 3275315 - protein, 25 aa, Plasmodium falciparum
SQICIGLSQTGAWGCFDEFNRISIE

SEQ ID NO: 3275316 - protein, 28 aa, Plasmodium falciparum
SQICLLWLSHMIQFKWLEYDLPKFCVLE

SEQ ID NO: 3275317 - protein, 20 aa, Plasmodium falciparum
SQICTVLARSFADIGDIVRG

SEQ ID NO: 3275318 - protein, 29 aa, Plasmodium falciparum
SQIGLIRYIDCLLKRYIKNLNHEKYFNIF

SEQ ID NO: 3275319 - protein, 17 aa, Plasmodium falciparum
SQIIKDSFVLIIRIHNF

SEQ ID NO: 3275320 - protein, 20 aa, Plasmodium falciparum
SQILPVWTPVVLNIGLNIST

SEQ ID NO: 3275321 - protein, 17 aa, Plasmodium falciparum
SQINISILFNFLFFLLS

SEQ ID NO: 3275322 - protein, 24 aa, Plasmodium falciparum
SQISNFLIYYIFKGLIKFLYPFIP

SEQ ID NO: 3275323 - protein, 20 aa, Plasmodium falciparum
SQITFLKFVVMPLFEELSHI

SEQ ID NO: 3275324 - protein, 26 aa, Plasmodium falciparum
SQIYYDICSLYHVYVYKKNFDATIFG

SEQ ID NO: 3275325 - protein, 19 aa, Plasmodium falciparum
SQKLLEGLMEYIVKLSQYE

SEQ ID NO: 3275326 - protein, 20 aa, Plasmodium falciparum
SQKVSFLYIKIEGINTRSDA

SEQ ID NO: 3275327 - protein, 22 aa, Plasmodium falciparum
SQLCTVLARSFADIGDIVRGRD

SEQ ID NO: 3275328 - protein, 20 aa, Plasmodium falciparum
SQLFNRFLFLSTYISGDKKD

SEQ ID NO: 3275329 - protein, 23 aa, Plasmodium falciparum
SQLSYLRINLQNYAKMNEQEKDK

SEQ ID NO: 3275330 - protein, 23 aa, Plasmodium falciparum
SQNEFDECLPKISVFVTLKNMKI

SEQ ID NO: 3275331 - protein, 25 aa, Plasmodium falciparum
SQNIKFYFACFIRKLSFHTKKKKKK

SEQ ID NO: 3275332 - protein, 25 aa, Plasmodium falciparum
SQRKCFRNYFFFFRNVRNSKYLAHR

SEQ ID NO: 3275333 - protein, 20 aa, Plasmodium falciparum
SQRQKIIWRKWIAKHPIRVR

SEQ ID NO: 3275334 - protein, 19 aa, Plasmodium falciparum
SQRQKIIWRKWIAKHPYKI

SEQ ID NO: 3275335 - protein, 19 aa, Plasmodium falciparum
SQRQKIIWRKWIAKHPYRV

SEQ ID NO: 3275336 - protein, 29 aa, Plasmodium falciparum
SQSHPAIEIILYLTYKFDMEGRHYLFSSI

SEQ ID NO: 3275337 - protein, 23 aa, Plasmodium falciparum
SQSNHKWIHFNSLLNYDIHELSK

SEQ ID NO: 3275338 - protein, 20 aa, Plasmodium falciparum
SQTFFKKNINKIFNRNFIHN

SEQ ID NO: 3275339 - protein, 23 aa, Plasmodium falciparum
SQTKRLDAANAYIEKQAIKIVQL

SEQ ID NO: 3275340 - protein, 26 aa, Plasmodium falciparum
SQTNFKSLLRNLGVSENIFLKENKLN

SEQ ID NO: 3275341 - protein, 18 aa, Plasmodium falciparum
SQTYPCFFHFKTHSNRYI

SEQ ID NO: 3275342 - protein, 19 aa, Plasmodium falciparum
SQYCSPVVLLLLVAAVASL

SEQ ID NO: 3275343 - protein, 24 aa, Plasmodium falciparum
SQYHIMFCCSIFFVINPNLFFNNK

SEQ ID NO: 3275344 - protein, 17 aa, Plasmodium falciparum
SRDDFYVFTKKVPIFLR

SEQ ID NO: 3275345 - protein, 21 aa, Plasmodium falciparum
SRDDVNVLLNMAFYEYGINFF

SEQ ID NO: 3275346 - protein, 24 aa, Plasmodium falciparum
SRDFTIKIWNIWQGICEHTIDYHM

SEQ ID NO: 3275347 - protein, 21 aa, Plasmodium falciparum
SRDLRKCLLYICESSYRNLQN

SEQ ID NO: 3275348 - protein, 24 aa, Plasmodium falciparum
SRDLSCSSRSFWGSLYNTSDNISE

SEQ ID NO: 3275349 - protein, 17 aa, Plasmodium falciparum
SRFSMLLGHILNLIGWV

SEQ ID NO: 3275350 - protein, 24 aa, Plasmodium falciparum
SRFVDKNLICLLIYMNNIQKKLSS

SEQ ID NO: 3275351 - protein, 18 aa, Plasmodium falciparum
SRFYYLYVNIHKIEDIYT

SEQ ID NO: 3275352 - protein, 22 aa, Plasmodium falciparum
SRHIDSFIYYFVCVHEKSSFIQ

SEQ ID NO: 3275353 - protein, 26 aa, Plasmodium falciparum
SRHKKLIKFVYINRRVINSLIKQTPI

SEQ ID NO: 3275354 - protein, 20 aa, Plasmodium falciparum
SRHKTVGLLSVYGSYLNSIH

SEQ ID NO: 3275355 - protein, 21 aa, Plasmodium falciparum
SRIEIQFMICFSVISFYTGLF

SEQ ID NO: 3275356 - protein, 17 aa, Plasmodium falciparum
SRIFLKEDNLIINVGIP

SEQ ID NO: 3275357 - protein, 25 aa, Plasmodium falciparum
SRIGNKILYGEVGFRDFCFNTYKYK

SEQ ID NO: 3275358 - protein, 34 aa, Plasmodium falciparum
SRIIRYIIVLFKICYKVTLPIFLYLLSCLFIIIF

SEQ ID NO: 3275359 - protein, 19 aa, Plasmodium falciparum
SRILKVGCHNILNIGDILK

SEQ ID NO: 3275360 - protein, 24 aa, Plasmodium falciparum
SRILSGPRKNFFFGSCNTNNIIND

SEQ ID NO: 3275361 - protein, 24 aa, Plasmodium falciparum
SRINCKRVLFEYICKHVLNKSIHI

SEQ ID NO: 3275362 - protein, 19 aa, Plasmodium falciparum
SRINKEFHTNVDYNIVSGD

SEQ ID NO: 3275363 - protein, 33 aa, Plasmodium falciparum
SRISFDKIIKIRLCFKQAAFSMITLILNYINKY

SEQ ID NO: 3275364 - protein, 19 aa, Plasmodium falciparum
SRIVWPEEFVFAIENEGYD

SEQ ID NO: 3275365 - protein, 24 aa, Plasmodium falciparum
SRKEKNKSVIVVKNNLSYTLFLFL

SEQ ID NO: 3275366 - protein, 20 aa, Plasmodium falciparum
SRKGPTPGKFFFNWKSDAPI

SEQ ID NO: 3275367 - protein, 18 aa, Plasmodium falciparum
SRKISRWDAFIIVLVTVL

SEQ ID NO: 3275368 - protein, 26 aa, Plasmodium falciparum
SRKIWKAVKYFFFFYYLFKYTLLKLF

SEQ ID NO: 3275369 - protein, 26 aa, Plasmodium falciparum
SRKKRKIFLLLILYCFRKMKENNTHL

SEQ ID NO: 3275370 - protein, 21 aa, Plasmodium falciparum
SRKRLQCYILKILIEQKKKKF

SEQ ID NO: 3275371 - protein, 17 aa, Plasmodium falciparum
SRKSRSLSELVLANYPS

SEQ ID NO: 3275372 - protein, 18 aa, Plasmodium falciparum
SRKSSIVRRNTSDSLSKS

SEQ ID NO: 3275373 - protein, 21 aa, Plasmodium falciparum
SRLFKGLRVQNWKCKFNDQKM

SEQ ID NO: 3275374 - protein, 33 aa, Plasmodium falciparum
SRLKRVFSRPTNCLLCLIFCMMSLHSYFLLFDI

SEQ ID NO: 3275375 - protein, 20 aa, Plasmodium falciparum
SRLLLLCIDQIYIIYENYIY

SEQ ID NO: 3275376 - protein, 20 aa, Plasmodium falciparum
SRLYNNFNIIYYNNYNYKEI

SEQ ID NO: 3275377 - protein, 17 aa, Plasmodium falciparum
SRNAPSIWKGMICALTY

SEQ ID NO: 3275378 - protein, 23 aa, Plasmodium falciparum
SRNFTKFLFFLFFHIDKKQKILF

SEQ ID NO: 3275379 - protein, 31 aa, Plasmodium falciparum
SRNKYISIFHLFKFAICEVAYQNIQKFIIKY

SEQ ID NO: 3275380 - protein, 18 aa, Plasmodium falciparum
SRNLYGKELSIKPYLNSR

SEQ ID NO: 3275381 - protein, 19 aa, Plasmodium falciparum
SRNSYYFLFGSLMKENDKK

SEQ ID NO: 3275382 - protein, 22 aa, Plasmodium falciparum
SRNTFECNICFDDVRDPVVTKC

SEQ ID NO: 3275383 - protein, 25 aa, Plasmodium falciparum
SRPPYFRYLEEWGQNFCKERKKRLA

SEQ ID NO: 3275384 - protein, 20 aa, Plasmodium falciparum
SRPRELTGFIKTDVNKLLKE

SEQ ID NO: 3275385 - protein, 26 aa, Plasmodium falciparum
SRQEWWKKYAEDIWKGMVCALSHSVS

SEQ ID NO: 3275386 - protein, 20 aa, Plasmodium falciparum
SRQFLKIVIEQCCLSYNMFK

SEQ ID NO: 3275387 - protein, 22 aa, Plasmodium falciparum
SRQRYWGEPFPFLYKMKDKNGY

SEQ ID NO: 3275388 - protein, 20 aa, Plasmodium falciparum
SRRNVESFNDLYVILYETNL

SEQ ID NO: 3275389 - protein, 21 aa, Plasmodium falciparum
SRSDAPFSRNIIKDNFDRDNY

SEQ ID NO: 3275390 - protein, 20 aa, Plasmodium falciparum
SRSEKVINCIIEKENYNFLN

SEQ ID NO: 3275391 - protein, 26 aa, Plasmodium falciparum
SRSKELYQEWKCYKGKDVEKVKDGKD

SEQ ID NO: 3275392 - protein, 28 aa, Plasmodium falciparum
SRSLKSMLCAGIFGGIKNPIVNMSKKNL

SEQ ID NO: 3275393 - protein, 25 aa, Plasmodium falciparum
SRSTYCKACPIYGVKYNRGTYSAIN

SEQ ID NO: 3275394 - protein, 23 aa, Plasmodium falciparum
SRTDALKFCDFILSKTMSKCKNS

SEQ ID NO: 3275395 - protein, 24 aa, Plasmodium falciparum
SRTEICEPCPWCGIEKQEDGKWKR

SEQ ID NO: 3275396 - protein, 24 aa, Plasmodium falciparum
SRTEICEPCPWCGVKKQEDGNWKR

SEQ ID NO: 3275397 - protein, 19 aa, Plasmodium falciparum
SRTNFKLPTLNILDSERKN

SEQ ID NO: 3275398 - protein, 19 aa, Plasmodium falciparum
SRYDMKRLYKFSLQNKIYM

SEQ ID NO: 3275399 - protein, 28 aa, Plasmodium falciparum
SRYDVLITRFFLFASFLMVLFMCENFLK

SEQ ID NO: 3275400 - protein, 21 aa, Plasmodium falciparum
SRYMLSYFIAFLKKWKYMLSI

SEQ ID NO: 3275401 - protein, 24 aa, Plasmodium falciparum
SRYSHPFLNYFLFDYDMIIRSKMD

SEQ ID NO: 3275402 - protein, 21 aa, Plasmodium falciparum
SRYVVPFLYHMFTICQPLLRE

SEQ ID NO: 3275403 - protein, 19 aa, Plasmodium falciparum
SSASNLIYQKKFKKIMSDV

SEQ ID NO: 3275404 - protein, 23 aa, Plasmodium falciparum
SSCELMYRSFLGFYCEKNEFLKY

SEQ ID NO: 3275405 - protein, 23 aa, Plasmodium falciparum
SSCKDANIFKGIREDVWKCGKFR

SEQ ID NO: 3275406 - protein, 24 aa, Plasmodium falciparum
SSCPKSCSSYRKWINKKKDEFVEQ

SEQ ID NO: 3275407 - protein, 26 aa, Plasmodium falciparum
SSCSSCSSSSSSCCCFNNTTNISPQL

SEQ ID NO: 3275408 - protein, 28 aa, Plasmodium falciparum
SSCSSSIFCCNSSIFCCSSKGDEKKNQR

SEQ ID NO: 3275409 - protein, 18 aa, Plasmodium falciparum
SSCYIRRQESVLSLNKIS

SEQ ID NO: 3275410 - protein, 18 aa, Plasmodium falciparum
SSDATPCIKGCVDKWIKL

SEQ ID NO: 3275411 - protein, 24 aa, Plasmodium falciparum
SSDCSFIPLLNLIYLFPRNHTIYT

SEQ ID NO: 3275412 - protein, 23 aa, Plasmodium falciparum
SSDIWALGVMVFFMLTGKYPFEG

SEQ ID NO: 3275413 - protein, 19 aa, Plasmodium falciparum
SSDVPDFFLNITRNKFSEY

SEQ ID NO: 3275414 - protein, 17 aa, Plasmodium falciparum
SSEGHTCIKNCVEQWIS

SEQ ID NO: 3275415 - protein, 24 aa, Plasmodium falciparum
SSEGLHVGHILCFTITDIISKFKK

SEQ ID NO: 3275416 - protein, 25 aa, Plasmodium falciparum
SSEIKRSYYKLALEYHPDKNPGDEE

SEQ ID NO: 3275417 - protein, 28 aa, Plasmodium falciparum
SSEIRYFLEMYIDLCEYKLNLDNNYNTK

SEQ ID NO: 3275418 - protein, 18 aa, Plasmodium falciparum
SSEKSCYDFMVWVNQNKD

SEQ ID NO: 3275419 - protein, 18 aa, Plasmodium falciparum
SSENLYKVNFFNLILQTK

SEQ ID NO: 3275420 - protein, 21 aa, Plasmodium falciparum
SSEPFLFSIFHHFFEPLINSF

SEQ ID NO: 3275421 - protein, 29 aa, Plasmodium falciparum
SSEYCYYFYLFGLATTYTFFTFQFDRNRI

SEQ ID NO: 3275422 - protein, 19 aa, Plasmodium falciparum
SSFCYREFFKNEDEYKNFI

SEQ ID NO: 3275423 - protein, 19 aa, Plasmodium falciparum
SSFELLKPVLGILKGMPGH

SEQ ID NO: 3275424 - protein, 19 aa, Plasmodium falciparum
SSFFLYIFSSSFFDALFMP

SEQ ID NO: 3275425 - protein, 19 aa, Plasmodium falciparum
SSFNCSLDFKDDEKKNVHE

SEQ ID NO: 3275426 - protein, 22 aa, Plasmodium falciparum
SSFRIKLWKHLWLEHIKNSNIL

SEQ ID NO: 3275427 - protein, 25 aa, Plasmodium falciparum
SSFSESILYSVGWVYKNISSRYIKK

SEQ ID NO: 3275428 - protein, 28 aa, Plasmodium falciparum
SSFYEKYLKCIPDINGIKIYIEASMFYL

SEQ ID NO: 3275429 - protein, 17 aa, Plasmodium falciparum
SSFYFSKIMDLKNRTNL

SEQ ID NO: 3275430 - protein, 25 aa, Plasmodium falciparum
SSFYISVVIKSFFMNFDINVLIYIL

SEQ ID NO: 3275431 - protein, 25 aa, Plasmodium falciparum
SSFYNRLKIYFFRDNVNENYYNYIY

SEQ ID NO: 3275432 - protein, 24 aa, Plasmodium falciparum
SSGELKLGIPFFLNKYLIFDNENE

SEQ ID NO: 3275433 - protein, 25 aa, Plasmodium falciparum
SSGLKITLLIICSKALVMALGSFFL

SEQ ID NO: 3275434 - protein, 23 aa, Plasmodium falciparum
SSGSLRFPFADANRHIPICQSVW

SEQ ID NO: 3275435 - protein, 17 aa, Plasmodium falciparum
SSHFIIHLMEYLYVLLI

SEQ ID NO: 3275436 - protein, 21 aa, Plasmodium falciparum
SSHPFNQLFLKNMECNFLNNI

SEQ ID NO: 3275437 - protein, 22 aa, Plasmodium falciparum
SSIACGFFLYLSFNMTKEIKIT

SEQ ID NO: 3275438 - protein, 22 aa, Plasmodium falciparum
SSICKDSFISDPFINTKESMDV

SEQ ID NO: 3275439 - protein, 22 aa, Plasmodium falciparum
SSICSKMIVNFFTLYKEATAKN

SEQ ID NO: 3275440 - protein, 17 aa, Plasmodium falciparum
SSICSLLSSSLSTNNDI

SEQ ID NO: 3275441 - protein, 25 aa, Plasmodium falciparum
SSIDIQNCFKRLRFLVLDEADLLLQ

SEQ ID NO: 3275442 - protein, 18 aa, Plasmodium falciparum
SSIFIISGIISFGMMENV

SEQ ID NO: 3275443 - protein, 20 aa, Plasmodium falciparum
SSIFSLKFNIINSRINYINK

SEQ ID NO: 3275444 - protein, 23 aa, Plasmodium falciparum
SSIHIKDIQNFFIIKNNNNNNKG

SEQ ID NO: 3275445 - protein, 26 aa, Plasmodium falciparum
SSIHKIRKLSCSDGAILNNKHKNNFE

SEQ ID NO: 3275446 - protein, 24 aa, Plasmodium falciparum
SSIIIGSMCYINFIHGTFSLLTFY

SEQ ID NO: 3275447 - protein, 17 aa, Plasmodium falciparum
SSIIYIYLIELIKKLED

SEQ ID NO: 3275448 - protein, 19 aa, Plasmodium falciparum
SSIKRFFKKYGYVGLGTYF

SEQ ID NO: 3275449 - protein, 17 aa, Plasmodium falciparum
SSILDLYLIYIKNESVQ

SEQ ID NO: 3275450 - protein, 27 aa, Plasmodium falciparum
SSILYKISQFYAILAYFANQRKNYIIS

SEQ ID NO: 3275451 - protein, 17 aa, Plasmodium falciparum
SSIPFMSFITFMGLYFL

SEQ ID NO: 3275452 - protein, 20 aa, Plasmodium falciparum
SSIQIIYWRTNIILKSDSNE

SEQ ID NO: 3275453 - protein, 26 aa, Plasmodium falciparum
SSITIPNVRLVIDFCIQKNIEYNDKK

SEQ ID NO: 3275454 - protein, 26 aa, Plasmodium falciparum
SSIYFKDFHCTLNFFISLIFVSFSLY

SEQ ID NO: 3275455 - protein, 18 aa, Plasmodium falciparum
SSKCILKMSTYYYIKYII

SEQ ID NO: 3275456 - protein, 27 aa, Plasmodium falciparum
SSKEIREYWWALNRDQVWKALTCDEEN

SEQ ID NO: 3275457 - protein, 24 aa, Plasmodium falciparum
SSKEKKCKLFVPFKKRKEKEPRFI

SEQ ID NO: 3275458 - protein, 18 aa, Plasmodium falciparum
SSKGWKLSKRFSLLNYLW

SEQ ID NO: 3275459 - protein, 29 aa, Plasmodium falciparum
SSKIYGMPVIEVWKSKQVIVFKRTLNTGY

SEQ ID NO: 3275460 - protein, 20 aa, Plasmodium falciparum
SSKKFFKIIENFLENDGLLL

SEQ ID NO: 3275461 - protein, 30 aa, Plasmodium falciparum
SSKLFLNFRNLYSCFFFIVYKYLNKEHEEV

SEQ ID NO: 3275462 - protein, 20 aa, Plasmodium falciparum
SSKLLKYAFQYSSIYDLNNY

SEQ ID NO: 3275463 - protein, 22 aa, Plasmodium falciparum
SSKLSKTILVTLGLIVILTITL

SEQ ID NO: 3275464 - protein, 21 aa, Plasmodium falciparum
SSKMKTCYWGIISNIINSFFM

SEQ ID NO: 3275465 - protein, 26 aa, Plasmodium falciparum
SSKPKRSFIKLIFNWINNKKDDLHKK

SEQ ID NO: 3275466 - protein, 21 aa, Plasmodium falciparum
SSKRLSLSFSSSVLSSKSTLT

SEQ ID NO: 3275467 - protein, 24 aa, Plasmodium falciparum
SSKTSSFFSCMSLKNMNYHNDINK

SEQ ID NO: 3275468 - protein, 21 aa, Plasmodium falciparum
SSKYKLILILSKHHLSTASEI

SEQ ID NO: 3275469 - protein, 18 aa, Plasmodium falciparum
SSKYLIKFIDSVNSKAEN

SEQ ID NO: 3275470 - protein, 23 aa, Plasmodium falciparum
SSKYLKNPFCIDVVDSSNKTAKN

SEQ ID NO: 3275471 - protein, 22 aa, Plasmodium falciparum
SSLCEPWKCYKGEDVMKPEDDD

SEQ ID NO: 3275472 - protein, 26 aa, Plasmodium falciparum
SSLCVLKYKIYFFINTLYTYFQWILT

SEQ ID NO: 3275473 - protein, 21 aa, Plasmodium falciparum
SSLEGIYFYRNIRSILNKQLF

SEQ ID NO: 3275474 - protein, 19 aa, Plasmodium falciparum
SSLERLPSYEKKLLSSSQS

SEQ ID NO: 3275475 - protein, 20 aa, Plasmodium falciparum
SSLFFGYLMVLTFLLSFLCI

SEQ ID NO: 3275476 - protein, 19 aa, Plasmodium falciparum
SSLFQAKFIYNEKLPSLNL

SEQ ID NO: 3275477 - protein, 17 aa, Plasmodium falciparum
SSLGKNPVCVLIKNVHI

SEQ ID NO: 3275478 - protein, 22 aa, Plasmodium falciparum
SSLHIPPLILKDAEFLISCDNS

SEQ ID NO: 3275479 - protein, 23 aa, Plasmodium falciparum
SSLHKWKDLHTNKVYKTSENYFL

SEQ ID NO: 3275480 - protein, 21 aa, Plasmodium falciparum
SSLIAKWKEDRDFLKNEFLSL

SEQ ID NO: 3275481 - protein, 26 aa, Plasmodium falciparum
SSLINCLCLSYRILGLEYFLDEYFFF

SEQ ID NO: 3275482 - protein, 17 aa, Plasmodium falciparum
SSLITPLFVYKSLISGV

SEQ ID NO: 3275483 - protein, 25 aa, Plasmodium falciparum
SSLKEIYKILKFVFNKKFYIPINTY

SEQ ID NO: 3275484 - protein, 18 aa, Plasmodium falciparum
SSLLDKLDDRMFFDELNR

SEQ ID NO: 3275485 - protein, 28 aa, Plasmodium falciparum
SSLLHEFNYMYIMYKKFINNVYNEATDI

SEQ ID NO: 3275486 - protein, 26 aa, Plasmodium falciparum
SSLNKCFKMIRTECIIGKRKILYYMS

SEQ ID NO: 3275487 - protein, 23 aa, Plasmodium falciparum
SSLPVALVTFVFLFMFLVFNKMN

SEQ ID NO: 3275488 - protein, 18 aa, Plasmodium falciparum
SSLVYFYAEHVINEYSNG

SEQ ID NO: 3275489 - protein, 20 aa, Plasmodium falciparum
SSLYLGVSVCNISIAESSYF

SEQ ID NO: 3275490 - protein, 24 aa, Plasmodium falciparum
SSMGRGYFGKIIGKLYPLSCYVLK

SEQ ID NO: 3275491 - protein, 20 aa, Plasmodium falciparum
SSNITLLLFRIYRKSMHRSF

SEQ ID NO: 3275492 - protein, 27 aa, Plasmodium falciparum
SSNKFVGPFLRNTECVIINLIKNSCTS

SEQ ID NO: 3275493 - protein, 25 aa, Plasmodium falciparum
SSNKTDCLCNFGYEYIKNPSDPQEF

SEQ ID NO: 3275494 - protein, 22 aa, Plasmodium falciparum
SSNLFRPHLFVTLNEKHFANNP

SEQ ID NO: 3275495 - protein, 24 aa, Plasmodium falciparum
SSNLLTCIIQDYFILQNLVHNLKE

SEQ ID NO: 3275496 - protein, 17 aa, Plasmodium falciparum
SSNSIYCNKNEYTSDNI

SEQ ID NO: 3275497 - protein, 19 aa, Plasmodium falciparum
SSPGQYLIIKIFFYSFFNI

SEQ ID NO: 3275498 - protein, 17 aa, Plasmodium falciparum
SSPLCSDGMCLHKYDQA

SEQ ID NO: 3275499 - protein, 17 aa, Plasmodium falciparum
SSPLVKGYVNRRLNPFS

SEQ ID NO: 3275500 - protein, 18 aa, Plasmodium falciparum
SSPPCCVDIIKNLIYEDN

SEQ ID NO: 3275501 - protein, 23 aa, Plasmodium falciparum
SSQEKIKEIFLLYNERVSDIIFR

SEQ ID NO: 3275502 - protein, 25 aa, Plasmodium falciparum
SSQNFYKMNDSFIILNSIILIFYIF

SEQ ID NO: 3275503 - protein, 20 aa, Plasmodium falciparum
SSRKKITCECTKPDSYPLFD

SEQ ID NO: 3275504 - protein, 20 aa, Plasmodium falciparum
SSRLERIIIMIIGLELILGI

SEQ ID NO: 3275505 - protein, 26 aa, Plasmodium falciparum
SSSCPKSCGLYKRWIEKKKTEYEKQK

SEQ ID NO: 3275506 - protein, 24 aa, Plasmodium falciparum
SSSFLKNPFCTSVYEGIDAISGGN

SEQ ID NO: 3275507 - protein, 18 aa, Plasmodium falciparum
SSSFLYAFNKYYVSNVNT

SEQ ID NO: 3275508 - protein, 18 aa, Plasmodium falciparum
SSSFSYFYSLLLLLFCLI

SEQ ID NO: 3275509 - protein, 33 aa, Plasmodium falciparum
SSSKPKILSFLGIVLICIMNLWIYKNKGTSNFH

SEQ ID NO: 3275510 - protein, 20 aa, Plasmodium falciparum
SSSLKCKMIILDLYGNNIFV

SEQ ID NO: 3275511 - protein, 33 aa, Plasmodium falciparum
SSSLYLNFECLKEIFNNPFFICDNIKNDTPIKR

SEQ ID NO: 3275512 - protein, 33 aa, Plasmodium falciparum
SSSLYRFAINLFNPFSCNVCVKCGLKENKITNK

SEQ ID NO: 3275513 - protein, 19 aa, Plasmodium falciparum
SSSQICTMLARSFADIGDI

SEQ ID NO: 3275514 - protein, 36 aa, Plasmodium falciparum
SSSSEFFLNCVISFFRRIRRSYIMTLGYLLYIKFNK

SEQ ID NO: 3275515 - protein, 20 aa, Plasmodium falciparum
SSSSYIFFDVFFNFDLFFDE

SEQ ID NO: 3275516 - protein, 17 aa, Plasmodium falciparum
SSSYSFHTGFLKKGSSE

SEQ ID NO: 3275517 - protein, 20 aa, Plasmodium falciparum
SSTIMWSIGIGFAAFTYFYL

SEQ ID NO: 3275518 - protein, 22 aa, Plasmodium falciparum
SSTIMWSIGIGFAAFTYFYLKK

SEQ ID NO: 3275519 - protein, 20 aa, Plasmodium falciparum
SSTIMWSVGIGFAAFTYFYL

SEQ ID NO: 3275520 - protein, 18 aa, Plasmodium falciparum
SSTIMWSVGIGFAAISYF

SEQ ID NO: 3275521 - protein, 19 aa, Plasmodium falciparum
SSTKKCEREGCDTEQITKP

SEQ ID NO: 3275522 - protein, 28 aa, Plasmodium falciparum
SSTLFDLLIKCNFMRTYLSSTYRNILKQ

SEQ ID NO: 3275523 - protein, 22 aa, Plasmodium falciparum
SSTYTNTRLAANNSTTTSTTKV

SEQ ID NO: 3275524 - protein, 24 aa, Plasmodium falciparum
SSVEEILYFFSLDPVYVHDKYKDY

SEQ ID NO: 3275525 - protein, 27 aa, Plasmodium falciparum
SSVEYFPYYLLKLCIKVTFENVYNLKS

SEQ ID NO: 3275526 - protein, 21 aa, Plasmodium falciparum
SSVLKLSEFKSSIDSKITSLH

SEQ ID NO: 3275527 - protein, 24 aa, Plasmodium falciparum
SSVLLLCAYVFSRVLSSTMNELRN

SEQ ID NO: 3275528 - protein, 30 aa, Plasmodium falciparum
SSYCHFTLYLNWWADTTIYFKLKKKKKKKK

SEQ ID NO: 3275529 - protein, 28 aa, Plasmodium falciparum
SSYEEFSILVSICYDGYMYIWKEHMNCN

SEQ ID NO: 3275530 - protein, 23 aa, Plasmodium falciparum
SSYFYKFYFVLIHEEISFNRINK

SEQ ID NO: 3275531 - protein, 18 aa, Plasmodium falciparum
SSYYIYQNHINNMIKNKT

SEQ ID NO: 3275532 - protein, 28 aa, Plasmodium falciparum
STACMDLRILKLFREFLANKTVTLPSNL

SEQ ID NO: 3275533 - protein, 27 aa, Plasmodium falciparum
STAIVCGRCIAVVINIGMKTEIGHIQH

SEQ ID NO: 3275534 - protein, 18 aa, Plasmodium falciparum
STANMEYILKLTLEKNKA

SEQ ID NO: 3275535 - protein, 26 aa, Plasmodium falciparum
STCEKNCYNYILKLEKYKNIIKDKIN

SEQ ID NO: 3275536 - protein, 25 aa, Plasmodium falciparum
STCIKGCEIKCNCVSNWIKKKTLEW

SEQ ID NO: 3275537 - protein, 24 aa, Plasmodium falciparum
STCYFPRNKDPVLVYLNNFHNYYF

SEQ ID NO: 3275538 - protein, 18 aa, Plasmodium falciparum
STDIEVMRDIYLKCKKDL

SEQ ID NO: 3275539 - protein, 19 aa, Plasmodium falciparum
STDIKRTNNMIGINKNHFN

SEQ ID NO: 3275540 - protein, 28 aa, Plasmodium falciparum
STDIPILLGCNQLVLTFCKKHNIVIKPL

SEQ ID NO: 3275541 - protein, 19 aa, Plasmodium falciparum
STDIYDMIGSLKFVKNTKE

SEQ ID NO: 3275542 - protein, 26 aa, Plasmodium falciparum
STDLLSFLLCLYKYFHNLQKQNKQHR

SEQ ID NO: 3275543 - protein, 18 aa, Plasmodium falciparum
STEGGYKKKSFFRNAINK

SEQ ID NO: 3275544 - protein, 36 aa, Plasmodium falciparum
STEIPTMVLVPGVLTVFLLTIIWVLVYKHSLIDRVH

SEQ ID NO: 3275545 - protein, 23 aa, Plasmodium falciparum
STFFILRTIELHLQLLKNYIDDI

SEQ ID NO: 3275546 - protein, 32 aa, Plasmodium falciparum
STFFKLKNIFCGAAFKDKECVKQDIHHNNELT

SEQ ID NO: 3275547 - protein, 17 aa, Plasmodium falciparum
STFINWFLQENIQKTGY

SEQ ID NO: 3275548 - protein, 24 aa, Plasmodium falciparum
STFLPQNEKLVLIKSYLNDIKNIM

SEQ ID NO: 3275549 - protein, 19 aa, Plasmodium falciparum
STFLPYGIAIIAIIVLTII

SEQ ID NO: 3275550 - protein, 17 aa, Plasmodium falciparum
STFMIKYYLYLNNVIHN

SEQ ID NO: 3275551 - protein, 17 aa, Plasmodium falciparum
STFNFICAMLIFFSVSH

SEQ ID NO: 3275552 - protein, 18 aa, Plasmodium falciparum
STFQNFILCLTLAQDKLI

SEQ ID NO: 3275553 - protein, 18 aa, Plasmodium falciparum
STFRSVILQVIFYTLFGI

SEQ ID NO: 3275554 - protein, 25 aa, Plasmodium falciparum
STFSFKKFKTVIISYITYFLFLCIF

SEQ ID NO: 3275555 - protein, 26 aa, Plasmodium falciparum
STFTNYMYKSVCPFEKQNSMPLNEVG

SEQ ID NO: 3275556 - protein, 26 aa, Plasmodium falciparum
STFYFSKYSYCFERLLDYAFSLTITF

SEQ ID NO: 3275557 - protein, 27 aa, Plasmodium falciparum
STHINWKYRQKFILPFILSLISNDKYK

SEQ ID NO: 3275558 - protein, 26 aa, Plasmodium falciparum
STHNLPIVHLLLRIMETLLDFTPNFY

SEQ ID NO: 3275559 - protein, 25 aa, Plasmodium falciparum
STHQFLRWLTEWGTQYCKEKQQLKL

SEQ ID NO: 3275560 - protein, 27 aa, Plasmodium falciparum
STIHFFFYLVNIMFRCGNYVGLIQIIK

SEQ ID NO: 3275561 - protein, 43 aa, Plasmodium falciparum
STIIGRKCFHWWNNLPITWKVGIACSVLFPPLWNYNERRKAKE

SEQ ID NO: 3275562 - protein, 28 aa, Plasmodium falciparum
STILCCHFFCWFYFYSICRTSSHSFECL

SEQ ID NO: 3275563 - protein, 17 aa, Plasmodium falciparum
STIMWSIGIGFAAFTYF

SEQ ID NO: 3275564 - protein, 29 aa, Plasmodium falciparum
STINRVAYMWKYLHRKLRSKPFMMEYDIM

SEQ ID NO: 3275565 - protein, 23 aa, Plasmodium falciparum
STIRKNIHYMKEGTKLYYSLVKI

SEQ ID NO: 3275566 - protein, 29 aa, Plasmodium falciparum
STIYSPLLCCFCSSPFFSSSAEDYPIRIT

SEQ ID NO: 3275567 - protein, 17 aa, Plasmodium falciparum
STKCIKGGCASHKKFNP

SEQ ID NO: 3275568 - protein, 17 aa, Plasmodium falciparum
STKIHFLPCKYYENSEL

SEQ ID NO: 3275569 - protein, 24 aa, Plasmodium falciparum
STKIKCAIYLIFLFIFYLFIYLFV

SEQ ID NO: 3275570 - protein, 25 aa, Plasmodium falciparum
STKLNFIPFKSFYYLLLSETNLNYS

SEQ ID NO: 3275571 - protein, 17 aa, Plasmodium falciparum
STKRMYYCISYIAFVKL

SEQ ID NO: 3275572 - protein, 18 aa, Plasmodium falciparum
STKVLRLSEDMKDFNIFH

SEQ ID NO: 3275573 - protein, 24 aa, Plasmodium falciparum
STKYLYRQDIKGIKEDDIYEEHNK

SEQ ID NO: 3275574 - protein, 20 aa, Plasmodium falciparum
STLWPFYSNRKMEFYTNKVK

SEQ ID NO: 3275575 - protein, 24 aa, Plasmodium falciparum
STNKCFKIEWEPMVKYPKKCNNTT

SEQ ID NO: 3275576 - protein, 37 aa, Plasmodium falciparum
STNLFFYYFFDFVLSFFKFNFSYLYYKKREHYYKQNK

SEQ ID NO: 3275577 - protein, 24 aa, Plasmodium falciparum
STPSSFPYSFSASAEFKNALKKLK

SEQ ID NO: 3275578 - protein, 20 aa, Plasmodium falciparum
STQFFNCIYTSLQHKAPTYL

SEQ ID NO: 3275579 - protein, 19 aa, Plasmodium falciparum
STQHFRLFINNPLSNNLTA

SEQ ID NO: 3275580 - protein, 23 aa, Plasmodium falciparum
STQIYYFSRMHSMKCKKNDIDVY

SEQ ID NO: 3275581 - protein, 22 aa, Plasmodium falciparum
STRYAKILTDVCLKSLAMKQLN

SEQ ID NO: 3275582 - protein, 22 aa, Plasmodium falciparum
STSDKSSAFIFTFNSNFNFYKW

SEQ ID NO: 3275583 - protein, 18 aa, Plasmodium falciparum
STSKRLSFDHSIKSEKSG

SEQ ID NO: 3275584 - protein, 20 aa, Plasmodium falciparum
STSLYLGCEFVNRPNLTTIE

SEQ ID NO: 3275585 - protein, 23 aa, Plasmodium falciparum
STSYKSPQSFFYGWPPSSETYLF

SEQ ID NO: 3275586 - protein, 18 aa, Plasmodium falciparum
STTMPTTIFDLSFDETSP

SEQ ID NO: 3275587 - protein, 17 aa, Plasmodium falciparum
STVDRFTYHFFNYLQQI

SEQ ID NO: 3275588 - protein, 18 aa, Plasmodium falciparum
STVHTLYFIWFVLGTLYF

SEQ ID NO: 3275589 - protein, 17 aa, Plasmodium falciparum
STVSIVFIDHKRATQTL

SEQ ID NO: 3275590 - protein, 18 aa, Plasmodium falciparum
STWWEKNKEKIWYVMMCY

SEQ ID NO: 3275591 - protein, 18 aa, Plasmodium falciparum
STYICNILCVLLKESSYH

SEQ ID NO: 3275592 - protein, 19 aa, Plasmodium falciparum
STYILKISVEIPKEGLNSE

SEQ ID NO: 3275593 - protein, 17 aa, Plasmodium falciparum
STYMGFDRRSFLPSNEI

SEQ ID NO: 3275594 - protein, 17 aa, Plasmodium falciparum
STYMSIAPMPFFRTTVM

SEQ ID NO: 3275595 - protein, 25 aa, Plasmodium falciparum
STYSIFFFLFFKRLKNYVLERLKDV

SEQ ID NO: 3275596 - protein, 18 aa, Plasmodium falciparum
STYVCFGITLVGDLISFG

SEQ ID NO: 3275597 - protein, 26 aa, Plasmodium falciparum
STYVYLKACFPFINSIIVSYSCYVKN

SEQ ID NO: 3275598 - protein, 22 aa, Plasmodium falciparum
SVCCKKLRYICINENVYNINKE

SEQ ID NO: 3275599 - protein, 20 aa, Plasmodium falciparum
SVCVASIIGLCTGVYIFNPI

SEQ ID NO: 3275600 - protein, 23 aa, Plasmodium falciparum
SVECGGFRRPLSVFMKSLSNSSL

SEQ ID NO: 3275601 - protein, 20 aa, Plasmodium falciparum
SVENLLLILVLFNKYYPYFE

SEQ ID NO: 3275602 - protein, 19 aa, Plasmodium falciparum
SVETFFAWHKYKMEKKQPA

SEQ ID NO: 3275603 - protein, 29 aa, Plasmodium falciparum
SVFKYICKIIYRFLEYNFSVTIMDYSCFP

SEQ ID NO: 3275604 - protein, 20 aa, Plasmodium falciparum
SVGALICGGNSYNTRGSHDI

SEQ ID NO: 3275605 - protein, 21 aa, Plasmodium falciparum
SVGGPYYRPPHIIERSNYYKN

SEQ ID NO: 3275606 - protein, 26 aa, Plasmodium falciparum
SVGLFGGIAINIWKPTALDAAIEAAI

SEQ ID NO: 3275607 - protein, 17 aa, Plasmodium falciparum
SVHLLKSNWFKIVELIN

SEQ ID NO: 3275608 - protein, 25 aa, Plasmodium falciparum
SVIDLIDIPCRLNFGCVGYFKINLP

SEQ ID NO: 3275609 - protein, 23 aa, Plasmodium falciparum
SVIFFTYKYGRNIPINFKNMCKE

SEQ ID NO: 3275610 - protein, 31 aa, Plasmodium falciparum
SVIFRPNALVFWLSLYILYIIKNIFEKQNKI

SEQ ID NO: 3275611 - protein, 17 aa, Plasmodium falciparum
SVIKEIIDEKSLTEKIV

SEQ ID NO: 3275612 - protein, 20 aa, Plasmodium falciparum
SVIKICIYILLILSLKKYVE

SEQ ID NO: 3275613 - protein, 17 aa, Plasmodium falciparum
SVINGFWMRNSDIDICI

SEQ ID NO: 3275614 - protein, 29 aa, Plasmodium falciparum
SVIQICLTYRLGRKNMLHYLINYIDKNDL

SEQ ID NO: 3275615 - protein, 31 aa, Plasmodium falciparum
SVIYICINNLITLNFFYNFSILSFINLLHIS

SEQ ID NO: 3275616 - protein, 25 aa, Plasmodium falciparum
SVKGDLFIEFDIVFPKKLSPEQKRT

SEQ ID NO: 3275617 - protein, 18 aa, Plasmodium falciparum
SVKLCKSILRGLENILDK

SEQ ID NO: 3275618 - protein, 24 aa, Plasmodium falciparum
SVKLPLYIKICINILIYMPQLVLL

SEQ ID NO: 3275619 - protein, 24 aa, Plasmodium falciparum
SVKQIYLRYKMFVLEEMQEDRLNQ

SEQ ID NO: 3275620 - protein, 23 aa, Plasmodium falciparum
SVKQLRITPRIGMNDLLIKINSA

SEQ ID NO: 3275621 - protein, 24 aa, Plasmodium falciparum
SVLELPIKMIGSIEQCFYFIYKNN

SEQ ID NO: 3275622 - protein, 19 aa, Plasmodium falciparum
SVLFICINNLFVYTFNEYY

SEQ ID NO: 3275623 - protein, 25 aa, Plasmodium falciparum
SVLFKRKTNNFSFKKKEYFLELGAK

SEQ ID NO: 3275624 - protein, 29 aa, Plasmodium falciparum
SVLKMIMSVLIKLCNIVKLYNDLTKNKKG

SEQ ID NO: 3275625 - protein, 17 aa, Plasmodium falciparum
SVLKPAAIIAAKDAALA

SEQ ID NO: 3275626 - protein, 20 aa, Plasmodium falciparum
SVLPIILYKYIQIIMYLMES

SEQ ID NO: 3275627 - protein, 20 aa, Plasmodium falciparum
SVLQSSLLKSLRMISKRLKR

SEQ ID NO: 3275628 - protein, 18 aa, Plasmodium falciparum
SVLTSAPVMGYPIKTKNN

SEQ ID NO: 3275629 - protein, 20 aa, Plasmodium falciparum
SVNDSKCIHALNAPGRKNIK

SEQ ID NO: 3275630 - protein, 25 aa, Plasmodium falciparum
SVNERLPFYVLHGFVHLMHKDHENN

SEQ ID NO: 3275631 - protein, 26 aa, Plasmodium falciparum
SVNFYKYGIIYGFKINKVYLKEVVDE

SEQ ID NO: 3275632 - protein, 25 aa, Plasmodium falciparum
SVNYYKYGIIYGFKVNKEILKEVVD

SEQ ID NO: 3275633 - protein, 24 aa, Plasmodium falciparum
SVRDPMKYRLIININVDDYLCEKR

SEQ ID NO: 3275634 - protein, 24 aa, Plasmodium falciparum
SVRKLCVLFHLYFCKMKVDVYDKS

SEQ ID NO: 3275635 - protein, 25 aa, Plasmodium falciparum
SVRNFSIDKCDLCNNHGEKKLGNIL

SEQ ID NO: 3275636 - protein, 31 aa, Plasmodium falciparum
SVSSFLFVEALFQEYQCYGSSSNTRVLNELN

SEQ ID NO: 3275637 - protein, 22 aa, Plasmodium falciparum
SVSSYCFFFLNEVYKKQNIVNT

SEQ ID NO: 3275638 - protein, 24 aa, Plasmodium falciparum
SVSWFKEWSEQFCIERLQYEKNIR

SEQ ID NO: 3275639 - protein, 20 aa, Plasmodium falciparum
SVTKGIIVGTSFLFISPYLC

SEQ ID NO: 3275640 - protein, 18 aa, Plasmodium falciparum
SVTYKRFDVHPPVQDDLL

SEQ ID NO: 3275641 - protein, 19 aa, Plasmodium falciparum
SVVKDCLYTIFLSQPYIHK

SEQ ID NO: 3275642 - protein, 24 aa, Plasmodium falciparum
SVVVMVIQCILTFLKEDEKYLASK

SEQ ID NO: 3275643 - protein, 19 aa, Plasmodium falciparum
SVVWPNFSSPFSLSCYAVN

SEQ ID NO: 3275644 - protein, 31 aa, Plasmodium falciparum
SVWKDTTRGHCSWRCRWWENGRRLSKNFNVK

SEQ ID NO: 3275645 - protein, 20 aa, Plasmodium falciparum
SVYFIYDYIITFIYFLHIPK

SEQ ID NO: 3275646 - protein, 25 aa, Plasmodium falciparum
SVYKWKENFWFALWHSFSFTYNLIL

SEQ ID NO: 3275647 - protein, 18 aa, Plasmodium falciparum
SWCDISSKLDRNTEHEQY

SEQ ID NO: 3275648 - protein, 23 aa, Plasmodium falciparum
SWGDERWVSCWISKNQFKCRDGI

SEQ ID NO: 3275649 - protein, 17 aa, Plasmodium falciparum
SWGIILIDLSCIHYSML

SEQ ID NO: 3275650 - protein, 20 aa, Plasmodium falciparum
SWIKNEFVKNVSYEKYFNNN

SEQ ID NO: 3275651 - protein, 20 aa, Plasmodium falciparum
SWLTMFKIHKPYFIISSNTL

SEQ ID NO: 3275652 - protein, 19 aa, Plasmodium falciparum
SWSAMVELLGEFRITLFNE

SEQ ID NO: 3275653 - protein, 33 aa, Plasmodium falciparum
SWVFSYILIIWLSFCLYIPFKLKDVDKYMLNNI

SEQ ID NO: 3275654 - protein, 18 aa, Plasmodium falciparum
SYALVPIFALLLYLKASE

SEQ ID NO: 3275655 - protein, 26 aa, Plasmodium falciparum
SYCEKKLSCSWLWMLPKKLALSTTSD

SEQ ID NO: 3275656 - protein, 18 aa, Plasmodium falciparum
SYDCCRNIYYELYTSFDI

SEQ ID NO: 3275657 - protein, 19 aa, Plasmodium falciparum
SYDFLYFSSYEHFCKINCI

SEQ ID NO: 3275658 - protein, 26 aa, Plasmodium falciparum
SYDFSYSLIILLRFLILNHNLFNKII

SEQ ID NO: 3275659 - protein, 41 aa, Plasmodium falciparum
SYDIAKAKCLECYYCLLHKYKFKPLNISGVIDIVLESDIEC

SEQ ID NO: 3275660 - protein, 19 aa, Plasmodium falciparum
SYDILKIKKNNIMWKNYLK

SEQ ID NO: 3275661 - protein, 20 aa, Plasmodium falciparum
SYDLKYRPTLSPFIINKNKK

SEQ ID NO: 3275662 - protein, 24 aa, Plasmodium falciparum
SYDLYEYIKFAFITIFNEAILSIY

SEQ ID NO: 3275663 - protein, 27 aa, Plasmodium falciparum
SYEDLFILFYLICRINYKDTQIIHYML

SEQ ID NO: 3275664 - protein, 19 aa, Plasmodium falciparum
SYEILRIYYHYIMNKCKDE

SEQ ID NO: 3275665 - protein, 18 aa, Plasmodium falciparum
SYELGACEHINCSENYYG

SEQ ID NO: 3275666 - protein, 37 aa, Plasmodium falciparum
SYEPIWIVAILIRIVLWCIVWIWAASYMERKPKNFEI

SEQ ID NO: 3275667 - protein, 18 aa, Plasmodium falciparum
SYERSVLYILQLNDCLFK

SEQ ID NO: 3275668 - protein, 20 aa, Plasmodium falciparum
SYESKGYPLIHLMNNNEYTG

SEQ ID NO: 3275669 - protein, 19 aa, Plasmodium falciparum
SYESLLLVYYFLSTQVNCY

SEQ ID NO: 3275670 - protein, 18 aa, Plasmodium falciparum
SYESRKIFNKVFEKDISS

SEQ ID NO: 3275671 - protein, 20 aa, Plasmodium falciparum
SYFFILKKLKIHKLMDNEVI

SEQ ID NO: 3275672 - protein, 25 aa, Plasmodium falciparum
SYFFLKEFIIYISSILYLPEMVHIY

SEQ ID NO: 3275673 - protein, 25 aa, Plasmodium falciparum
SYFLNRYYYFDSFIALVISKVHNMK

SEQ ID NO: 3275674 - protein, 23 aa, Plasmodium falciparum
SYFNKHFFDIFISNFYIFQLQKC

SEQ ID NO: 3275675 - protein, 19 aa, Plasmodium falciparum
SYFSPEWGYYIYTTSNFNI

SEQ ID NO: 3275676 - protein, 26 aa, Plasmodium falciparum
SYFVKYIFDCVTNIYFSQSYLNNNKV

SEQ ID NO: 3275677 - protein, 20 aa, Plasmodium falciparum
SYGLLKIMIFFVLIFFNFFM

SEQ ID NO: 3275678 - protein, 25 aa, Plasmodium falciparum
SYHHMKDRNVCIGTKYPTWYKSMND

SEQ ID NO: 3275679 - protein, 25 aa, Plasmodium falciparum
SYHQNDLFLFFSFFFNYYHNRNIDQ

SEQ ID NO: 3275680 - protein, 17 aa, Plasmodium falciparum
SYHSKYFIKQNIFLCLS

SEQ ID NO: 3275681 - protein, 21 aa, Plasmodium falciparum
SYHYRYIMHIIDSYKKEKNNI

SEQ ID NO: 3275682 - protein, 24 aa, Plasmodium falciparum
SYIEKRIYLLLNKWVKEENGRKFI

SEQ ID NO: 3275683 - protein, 17 aa, Plasmodium falciparum
SYIFDLCYHVNKYSEIY

SEQ ID NO: 3275684 - protein, 27 aa, Plasmodium falciparum
SYIFSYRKNMMFHIVVLNVSFFLINFE

SEQ ID NO: 3275685 - protein, 21 aa, Plasmodium falciparum
SYIGCQILEWLMPRQNIEEVV

SEQ ID NO: 3275686 - protein, 21 aa, Plasmodium falciparum
SYIIQLCFNTKYIYCDKKLYV

SEQ ID NO: 3275687 - protein, 18 aa, Plasmodium falciparum
SYIIYVVVLLIHIMMYIK

SEQ ID NO: 3275688 - protein, 19 aa, Plasmodium falciparum
SYINEFFNKNIHGYDLIYD

SEQ ID NO: 3275689 - protein, 26 aa, Plasmodium falciparum
SYINLYCLWLLLALTILLSLILYVRK

SEQ ID NO: 3275690 - protein, 18 aa, Plasmodium falciparum
SYINSFHMFINIFKENTN

SEQ ID NO: 3275691 - protein, 19 aa, Plasmodium falciparum
SYIQLTIQFYKPFLQRKML

SEQ ID NO: 3275692 - protein, 22 aa, Plasmodium falciparum
SYIYINNCYLFLNTYNENLNDI

SEQ ID NO: 3275693 - protein, 20 aa, Plasmodium falciparum
SYKFLRIIFDYVSDEQIRQF

SEQ ID NO: 3275694 - protein, 21 aa, Plasmodium falciparum
SYKKRKGMRILKSSSVTKGRL

SEQ ID NO: 3275695 - protein, 26 aa, Plasmodium falciparum
SYKMKKDFFFREGVHKNFFIKILNII

SEQ ID NO: 3275696 - protein, 29 aa, Plasmodium falciparum
SYKRGCFFNPLFLSFLFFFSSSFFPNVCR

SEQ ID NO: 3275697 - protein, 19 aa, Plasmodium falciparum
SYKRYYIKCHDIYISNILI

SEQ ID NO: 3275698 - protein, 25 aa, Plasmodium falciparum
SYKVCARFIILNALLLLANTIMIIS

SEQ ID NO: 3275699 - protein, 23 aa, Plasmodium falciparum
SYLFRQVICEVFTGAKIDFLVNF

SEQ ID NO: 3275700 - protein, 19 aa, Plasmodium falciparum
SYLICLKYFNKYMKQQYCK

SEQ ID NO: 3275701 - protein, 19 aa, Plasmodium falciparum
SYLKILKNFIIYKKDIKLF

SEQ ID NO: 3275702 - protein, 20 aa, Plasmodium falciparum
SYLKKYYTILTFKNDVAYTY

SEQ ID NO: 3275703 - protein, 20 aa, Plasmodium falciparum
SYLPCVVNMNIFLSQITSAI

SEQ ID NO: 3275704 - protein, 23 aa, Plasmodium falciparum
SYLREFDLLSGKTIRFHNLESKY

SEQ ID NO: 3275705 - protein, 18 aa, Plasmodium falciparum
SYLYFAVKDNTLLLNENN

SEQ ID NO: 3275706 - protein, 19 aa, Plasmodium falciparum
SYLYKFLFHLNKLKDYMKF

SEQ ID NO: 3275707 - protein, 24 aa, Plasmodium falciparum
SYLYKNRFYNLLSRKNEKTNDTYD

SEQ ID NO: 3275708 - protein, 17 aa, Plasmodium falciparum
SYMLYTFNIHTLSNEGM

SEQ ID NO: 3275709 - protein, 17 aa, Plasmodium falciparum
SYMNKGINFLLTNISKL

SEQ ID NO: 3275710 - protein, 20 aa, Plasmodium falciparum
SYMNYQIFYQIFIKRNSKKI

SEQ ID NO: 3275711 - protein, 53 aa, Plasmodium falciparum
SYMQDILSLFLFYNYICLYLTKILLYKSGGALITILLVKIIPYVKEFDRNLII

SEQ ID NO: 3275712 - protein, 22 aa, Plasmodium falciparum
SYNKTPICDSVELPIKQMSGNI

SEQ ID NO: 3275713 - protein, 25 aa, Plasmodium falciparum
SYNKTSEIFFCICLFMKNVVSNIFY

SEQ ID NO: 3275714 - protein, 26 aa, Plasmodium falciparum
SYNLLSYFKRKMNIFKNKNKNDINNT

SEQ ID NO: 3275715 - protein, 24 aa, Plasmodium falciparum
SYNRYPGSINHEFLRQIRNLYFSN

SEQ ID NO: 3275716 - protein, 33 aa, Plasmodium falciparum
SYPFCWRSDTPLIYRAIPAWFVRVSNSTNKLVE

SEQ ID NO: 3275717 - protein, 22 aa, Plasmodium falciparum
SYPKKIISFHCDPIILNFSKDI

SEQ ID NO: 3275718 - protein, 18 aa, Plasmodium falciparum
SYPRRKFVSELKSNTYSY

SEQ ID NO: 3275719 - protein, 24 aa, Plasmodium falciparum
SYQYKMKKVHAFYTLDSFKKYIQL

SEQ ID NO: 3275720 - protein, 24 aa, Plasmodium falciparum
SYSFCIFVFFSFFFVKMRKVIYFF

SEQ ID NO: 3275721 - protein, 44 aa, Plasmodium falciparum
SYSKEYYNSLFFYKIKSLGLGILKLLFERDVLFIHMYKLWKNEK

SEQ ID NO: 3275722 - protein, 17 aa, Plasmodium falciparum
SYSSLNFVKNFVLHNEH

SEQ ID NO: 3275723 - protein, 17 aa, Plasmodium falciparum
SYTIFKYEEEILESASF

SEQ ID NO: 3275724 - protein, 24 aa, Plasmodium falciparum
SYTLKRCMKRIFKPIIKFIGKCIS

SEQ ID NO: 3275725 - protein, 25 aa, Plasmodium falciparum
SYTPNFLTIFFKKYIYYQNVYSSFS

SEQ ID NO: 3275726 - protein, 25 aa, Plasmodium falciparum
SYTQLRGSVPIFWNQQVNYKILKKP

SEQ ID NO: 3275727 - protein, 33 aa, Plasmodium falciparum
SYVCNGYAPLSVRLIEYMAAFKNNLQVFPEIFN

SEQ ID NO: 3275728 - protein, 20 aa, Plasmodium falciparum
SYVDNIWVRFIRRRNEEKIE

SEQ ID NO: 3275729 - protein, 17 aa, Plasmodium falciparum
SYVEILKYYSKDENKLG

SEQ ID NO: 3275730 - protein, 18 aa, Plasmodium falciparum
SYVNTLLCCIHNKNKHIS

SEQ ID NO: 3275731 - protein, 18 aa, Plasmodium falciparum
SYVPICLDILNTEKEKKK

SEQ ID NO: 3275732 - protein, 24 aa, Plasmodium falciparum
SYVYSRPFVGSSIIGPRTLGQLKD

SEQ ID NO: 3275733 - protein, 38 aa, Plasmodium falciparum
SYYDIDQRLLLYVYEKCYKFSFEFVNIYLNRNESKKLM

SEQ ID NO: 3275734 - protein, 24 aa, Plasmodium falciparum
SYYDRCILCKRFFIFCSNNNNIIE

SEQ ID NO: 3275735 - protein, 24 aa, Plasmodium falciparum
SYYKFIYKYLTNVFQYRQKEFNIL

SEQ ID NO: 3275736 - protein, 23 aa, Plasmodium falciparum
SYYLKNIACCLVSTYIGGFINFI

SEQ ID NO: 3275737 - protein, 33 aa, Plasmodium falciparum
SYYMDIMNALLIYRVPTKWNFLGNHKKENIKSL

SEQ ID NO: 3275738 - protein, 23 aa, Plasmodium falciparum
SYYSYMICLYFNYIYLLNNIIKL

SEQ ID NO: 3275739 - protein, 24 aa, Plasmodium falciparum
SYYYLLPWAYKINAILKMIHMKQM

SEQ ID NO: 3275740 - protein, 23 aa, Plasmodium falciparum
TAAAETFLSWQYYKIKNGADAKQ

SEQ ID NO: 3275741 - protein, 25 aa, Plasmodium falciparum
TAGSVALCVLIFSSIGLLLIKTNSG

SEQ ID NO: 3275742 - protein, 27 aa, Plasmodium falciparum
TAIAPWWGLVCGVGYAGWSHYVPIAVA

SEQ ID NO: 3275743 - protein, 19 aa, Plasmodium falciparum
TALARSFADIGDIVRGKDL

SEQ ID NO: 3275744 - protein, 19 aa, Plasmodium falciparum
TALARSFADIGDIVRGRDL

SEQ ID NO: 3275745 - protein, 23 aa, Plasmodium falciparum
TALEELKNILTFFPSNPSIDEIY

SEQ ID NO: 3275746 - protein, 18 aa, Plasmodium falciparum
TALLQFISTYFITKMSLT

SEQ ID NO: 3275747 - protein, 19 aa, Plasmodium falciparum
TALSKNVFYIFTRSDQNLN

SEQ ID NO: 3275748 - protein, 19 aa, Plasmodium falciparum
TALTIPLMIYMFISKKPCS

SEQ ID NO: 3275749 - protein, 21 aa, Plasmodium falciparum
TALYTLCQWQTKAIAAAIEKA

SEQ ID NO: 3275750 - protein, 18 aa, Plasmodium falciparum
TASKIFYFFTSFALIINC

SEQ ID NO: 3275751 - protein, 23 aa, Plasmodium falciparum
TCAFYLKNYIKLYLLSKGDILRK

SEQ ID NO: 3275752 - protein, 17 aa, Plasmodium falciparum
TCAPLRRLFLCDQHLSH

SEQ ID NO: 3275753 - protein, 30 aa, Plasmodium falciparum
TCCQMSILCPCPWGPFKYSNFFLRDANSKE

SEQ ID NO: 3275754 - protein, 19 aa, Plasmodium falciparum
TCDNFSIKNIENIKYSYEE

SEQ ID NO: 3275755 - protein, 18 aa, Plasmodium falciparum
TCECIPKEGKLFEPNYDE

SEQ ID NO: 3275756 - protein, 31 aa, Plasmodium falciparum
TCEPPRRQTLCLGRTYLLHRGHEEDYKEHLL

SEQ ID NO: 3275757 - protein, 18 aa, Plasmodium falciparum
TCFLCGYNNASVYCSNED

SEQ ID NO: 3275758 - protein, 23 aa, Plasmodium falciparum
TCFYCLNIIKERCTYINNLWRTY

SEQ ID NO: 3275759 - protein, 25 aa, Plasmodium falciparum
TCIDECFLGMTFCDPDIPKHLCNQK

SEQ ID NO: 3275760 - protein, 24 aa, Plasmodium falciparum
TCIMEPWDGPALIIFTDGYKVGAS

SEQ ID NO: 3275761 - protein, 21 aa, Plasmodium falciparum
TCINALCNEWEEWGDCSSTCG

SEQ ID NO: 3275762 - protein, 22 aa, Plasmodium falciparum
TCISICFEHYQIFRKYYLFHNL

SEQ ID NO: 3275763 - protein, 19 aa, Plasmodium falciparum
TCISMAYSTIFWSYALVPV

SEQ ID NO: 3275764 - protein, 28 aa, Plasmodium falciparum
TCKDKCKKYCECVKKWKSEWENQKNKYT

SEQ ID NO: 3275765 - protein, 29 aa, Plasmodium falciparum
TCKNVCKKPCDCFQKWGVRKTKEWQQVKA

SEQ ID NO: 3275766 - protein, 18 aa, Plasmodium falciparum
TCKPIWKILFPSKNIINL

SEQ ID NO: 3275767 - protein, 17 aa, Plasmodium falciparum
TCLFILINIVLTTYSKV

SEQ ID NO: 3275768 - protein, 21 aa, Plasmodium falciparum
TCLKCGGILGTTVPQLGILGG

SEQ ID NO: 3275769 - protein, 20 aa, Plasmodium falciparum
TCLKCGGVLGGGIAPSVGIL

SEQ ID NO: 3275770 - protein, 25 aa, Plasmodium falciparum
TCLKCGGVLGGGITPGWGLISGIVY

SEQ ID NO: 3275771 - protein, 21 aa, Plasmodium falciparum
TCLKCGGVLGGGVAPELGLIG

SEQ ID NO: 3275772 - protein, 29 aa, Plasmodium falciparum
TCLKCGGVLGGGVTPAWGFLSGIVYTGWK

SEQ ID NO: 3275773 - protein, 21 aa, Plasmodium falciparum
TCLKCGSVLGGGIAPGWGLVS

SEQ ID NO: 3275774 - protein, 18 aa, Plasmodium falciparum
TCLLFFYIQIWINCLFCF

SEQ ID NO: 3275775 - protein, 21 aa, Plasmodium falciparum
TCLNCGGILGTVVPGWGILGS

SEQ ID NO: 3275776 - protein, 23 aa, Plasmodium falciparum
TCLNCYFDYLVGPKCLNIKVKNM

SEQ ID NO: 3275777 - protein, 17 aa, Plasmodium falciparum
TCLTFNFLYISKKNSLY

SEQ ID NO: 3275778 - protein, 22 aa, Plasmodium falciparum
TCLYFCCFEYLKLKKLQYNNVF

SEQ ID NO: 3275779 - protein, 19 aa, Plasmodium falciparum
TCNIIKPARSKHCSYCSSC

SEQ ID NO: 3275780 - protein, 20 aa, Plasmodium falciparum
TCNKLGVSLNKWRNSDGNFC

SEQ ID NO: 3275781 - protein, 22 aa, Plasmodium falciparum
TCPIGTTILMGFSINLNFYKNK

SEQ ID NO: 3275782 - protein, 35 aa, Plasmodium falciparum
TCRINSCNYCSCIFDSIKCRFILISKMKNTKKLVY

SEQ ID NO: 3275783 - protein, 21 aa, Plasmodium falciparum
TCSTCLPNHFCVGDLLQKDLD

SEQ ID NO: 3275784 - protein, 20 aa, Plasmodium falciparum
TCTIKGYGFYNIENDTNKKI

SEQ ID NO: 3275785 - protein, 29 aa, Plasmodium falciparum
TCTNTYFVRYIIRLMLYYADSDVNTIKTY

SEQ ID NO: 3275786 - protein, 21 aa, Plasmodium falciparum
TCVKCGRILGTAVPELSLIGG

SEQ ID NO: 3275787 - protein, 32 aa, Plasmodium falciparum
TCVNFNSLFFYPRGNELLNYIYIYYNLFVNTQ

SEQ ID NO: 3275788 - protein, 22 aa, Plasmodium falciparum
TCVPKLSAVNTITFHPCISSSD

SEQ ID NO: 3275789 - protein, 23 aa, Plasmodium falciparum
TDAWVVKGENDFKRALISVYSPN

SEQ ID NO: 3275790 - protein, 17 aa, Plasmodium falciparum
TDCSVCDYENYVFNHYM

SEQ ID NO: 3275791 - protein, 19 aa, Plasmodium falciparum
TDCYNSNMMGPINMDNKMN

SEQ ID NO: 3275792 - protein, 19 aa, Plasmodium falciparum
TDDILKRLMYLSNNYYNNM

SEQ ID NO: 3275793 - protein, 23 aa, Plasmodium falciparum
TDDKLICAYGMRAGLVQGKSASP

SEQ ID NO: 3275794 - protein, 26 aa, Plasmodium falciparum
TDDTLKEFYLYGGRIFLSANATKTHS

SEQ ID NO: 3275795 - protein, 28 aa, Plasmodium falciparum
TDEILFRRPKFFNCIIEESFENYDINYE

SEQ ID NO: 3275796 - protein, 33 aa, Plasmodium falciparum
TDEVLLNRFNFWIKLYIYQERMKIIKMIIKALN

SEQ ID NO: 3275797 - protein, 20 aa, Plasmodium falciparum
TDFFHKSVLAWYNIKSKSYI

SEQ ID NO: 3275798 - protein, 19 aa, Plasmodium falciparum
TDFIFTRIVEYISKIIHEL

SEQ ID NO: 3275799 - protein, 18 aa, Plasmodium falciparum
TDFINWNIISVALVSYNK

SEQ ID NO: 3275800 - protein, 19 aa, Plasmodium falciparum
TDFNKLCVNFYIKKDYKQY

SEQ ID NO: 3275801 - protein, 17 aa, Plasmodium falciparum
TDGNARVHNRFKYMKKM

SEQ ID NO: 3275802 - protein, 21 aa, Plasmodium falciparum
TDGSYHWKRKIVDHIQDYSNI

SEQ ID NO: 3275803 - protein, 28 aa, Plasmodium falciparum
TDHGERPFSRCFSSWGIQRRSQNEFDEC

SEQ ID NO: 3275804 - protein, 19 aa, Plasmodium falciparum
TDHGPEIWKGMLCALTNGL

SEQ ID NO: 3275805 - protein, 30 aa, Plasmodium falciparum
TDHLCFIFEVLCYFTPYVLIYPLILLFTKR

SEQ ID NO: 3275806 - protein, 21 aa, Plasmodium falciparum
TDKHFTVFFPLIIQKTNENFN

SEQ ID NO: 3275807 - protein, 17 aa, Plasmodium falciparum
TDKKKSSNFVMSTNDNV

SEQ ID NO: 3275808 - protein, 18 aa, Plasmodium falciparum
TDKNRIMIISDIYTNEYY

SEQ ID NO: 3275809 - protein, 26 aa, Plasmodium falciparum
TDKYFSFYFLISIVIVFIGVSYFFYQ

SEQ ID NO: 3275810 - protein, 30 aa, Plasmodium falciparum
TDKYKTHLYCSHFGYIYKTIISFKKKYKQY

SEQ ID NO: 3275811 - protein, 26 aa, Plasmodium falciparum
TDLKHLWDLVNSIIFFIEQEKKKLWK

SEQ ID NO: 3275812 - protein, 20 aa, Plasmodium falciparum
TDLLLNFLIYIYYKYFYYNS

SEQ ID NO: 3275813 - protein, 24 aa, Plasmodium falciparum
TDLLWNKYGFRGFDDFCDDVKNSY

SEQ ID NO: 3275814 - protein, 17 aa, Plasmodium falciparum
TDMCIFKNIKYICLENK

SEQ ID NO: 3275815 - protein, 17 aa, Plasmodium falciparum
TDMDYANKYNYCHQKKT

SEQ ID NO: 3275816 - protein, 24 aa, Plasmodium falciparum
TDMKHHFEIISKFRIRRENEDFDY

SEQ ID NO: 3275817 - protein, 25 aa, Plasmodium falciparum
TDMYKRYHCISSDFLKNTKQEDKKE

SEQ ID NO: 3275818 - protein, 19 aa, Plasmodium falciparum
TDNYKRLFHEVKLLENNNS

SEQ ID NO: 3275819 - protein, 18 aa, Plasmodium falciparum
TDPCFLFTLLKIVLSICK

SEQ ID NO: 3275820 - protein, 24 aa, Plasmodium falciparum
TDPKRLENRFILYNMLRDHIIEKE

SEQ ID NO: 3275821 - protein, 21 aa, Plasmodium falciparum
TDRKNAQFIRDLISKDLNKAL

SEQ ID NO: 3275822 - protein, 32 aa, Plasmodium falciparum
TDSKGRVVIPWIVFGNSFNFYLYVFNNLALFE

SEQ ID NO: 3275823 - protein, 27 aa, Plasmodium falciparum
TDVCKPKVIKCFLIIQKNDVYVFSCNL

SEQ ID NO: 3275824 - protein, 20 aa, Plasmodium falciparum
TDWIMGIVIYVGRETKIQMN

SEQ ID NO: 3275825 - protein, 18 aa, Plasmodium falciparum
TDWLVEGTNIVILFDEFG

SEQ ID NO: 3275826 - protein, 24 aa, Plasmodium falciparum
TEDIPTCICEKSLADKTEKFCLNC

SEQ ID NO: 3275827 - protein, 24 aa, Plasmodium falciparum
TEECVKTFLKYMFDYLSIYYDELV

SEQ ID NO: 3275828 - protein, 24 aa, Plasmodium falciparum
TEECYICGSFSLASISQPFISPNE

SEQ ID NO: 3275829 - protein, 19 aa, Plasmodium falciparum
TEEGWKPGNQINMNDEYAF

SEQ ID NO: 3275830 - protein, 17 aa, Plasmodium falciparum
TEFIPRRILFEFDSENS

SEQ ID NO: 3275831 - protein, 17 aa, Plasmodium falciparum
TEGPININFNYYKYPHY

SEQ ID NO: 3275832 - protein, 38 aa, Plasmodium falciparum
TEHKYKCTLKINICELLYICIYRSYIHANINTDVQIGN

SEQ ID NO: 3275833 - protein, 24 aa, Plasmodium falciparum
TEHPCTYNKFNLIFEFNETQITCL

SEQ ID NO: 3275834 - protein, 21 aa, Plasmodium falciparum
TEIEKILWRNWLRNQKSVMGK

SEQ ID NO: 3275835 - protein, 19 aa, Plasmodium falciparum
TEIRQCDILSYNIIKDMYK

SEQ ID NO: 3275836 - protein, 18 aa, Plasmodium falciparum
TEIYYCKSDKINMNQVDN

SEQ ID NO: 3275837 - protein, 25 aa, Plasmodium falciparum
TEKFCHNCGYGLGSVAPNIGLLGGP

SEQ ID NO: 3275838 - protein, 25 aa, Plasmodium falciparum
TEKFCHNCGYGLGSVAPSIGLLGGP

SEQ ID NO: 3275839 - protein, 25 aa, Plasmodium falciparum
TEKFCLKCGYGLGGALTAWQIFGYT

SEQ ID NO: 3275840 - protein, 23 aa, Plasmodium falciparum
TEKFCLNCGVNVGGGVTLSSGVL

SEQ ID NO: 3275841 - protein, 25 aa, Plasmodium falciparum
TEKFCLNCGVQLGGGVLQASGLLGG

SEQ ID NO: 3275842 - protein, 25 aa, Plasmodium falciparum
TEKFLKRILQKLILCLNDTNENVRD

SEQ ID NO: 3275843 - protein, 18 aa, Plasmodium falciparum
TEKGEGSPCIKECVDTWI

SEQ ID NO: 3275844 - protein, 24 aa, Plasmodium falciparum
TEKNFTVGSGMTFNNFTNMKGDVN

SEQ ID NO: 3275845 - protein, 25 aa, Plasmodium falciparum
TEKQKYCYLNLIIPKDVEELKKFIH

SEQ ID NO: 3275846 - protein, 18 aa, Plasmodium falciparum
TEKSELLQELGLYLKNIK

SEQ ID NO: 3275847 - protein, 24 aa, Plasmodium falciparum
TEKYCLKCGYGLGSVSPNVGLIGA

SEQ ID NO: 3275848 - protein, 23 aa, Plasmodium falciparum
TEKYYLYNLCIHIIRLKSVNTIL

SEQ ID NO: 3275849 - protein, 19 aa, Plasmodium falciparum
TELARSFADIGDIIRGKDL

SEQ ID NO: 3275850 - protein, 19 aa, Plasmodium falciparum
TELARSFADIGDIVRGKDL

SEQ ID NO: 3275851 - protein, 22 aa, Plasmodium falciparum
TELFKSYLRAGANIIITYFAKQ

SEQ ID NO: 3275852 - protein, 19 aa, Plasmodium falciparum
TELIETYLLRNPKQLKNTC

SEQ ID NO: 3275853 - protein, 24 aa, Plasmodium falciparum
TELIKILFDMCTYYNDINIYKHSI

SEQ ID NO: 3275854 - protein, 18 aa, Plasmodium falciparum
TELMVSGVSIGSVLEVLF

SEQ ID NO: 3275855 - protein, 18 aa, Plasmodium falciparum
TELNKLFLQEKMKKDKNK

SEQ ID NO: 3275856 - protein, 25 aa, Plasmodium falciparum
TELNLKWPHGKIRNLIDFVCENKKT

SEQ ID NO: 3275857 - protein, 18 aa, Plasmodium falciparum
TELSKCINNKKGSNCIGG

SEQ ID NO: 3275858 - protein, 20 aa, Plasmodium falciparum
TELYKNLFIYKNKEKRTKNK

SEQ ID NO: 3275859 - protein, 24 aa, Plasmodium falciparum
TENIKGVCFHPSNNLIIAQSSDNI

SEQ ID NO: 3275860 - protein, 19 aa, Plasmodium falciparum
TENKCPKGKISADDIPSLG

SEQ ID NO: 3275861 - protein, 19 aa, Plasmodium falciparum
TENLLKYQIENVSYLSSDK

SEQ ID NO: 3275862 - protein, 19 aa, Plasmodium falciparum
TEPPMSLEEIMRTFDEDHL

SEQ ID NO: 3275863 - protein, 22 aa, Plasmodium falciparum
TEPRRIACIALSKILSELTNEK

SEQ ID NO: 3275864 - protein, 17 aa, Plasmodium falciparum
TEQWKCYEEQDIENDGQ

SEQ ID NO: 3275865 - protein, 21 aa, Plasmodium falciparum
TEQYKNIIIFIIKTILQKKIY

SEQ ID NO: 3275866 - protein, 23 aa, Plasmodium falciparum
TEREFKKRFDFNEGRNNIINVSN

SEQ ID NO: 3275867 - protein, 24 aa, Plasmodium falciparum
TERIYKADVVILALGFSKTDDSIW

SEQ ID NO: 3275868 - protein, 23 aa, Plasmodium falciparum
TERLKRICELLILNIYNKKSIVL

SEQ ID NO: 3275869 - protein, 20 aa, Plasmodium falciparum
TESILDKWGIQRKIKKINLE

SEQ ID NO: 3275870 - protein, 29 aa, Plasmodium falciparum
TESKRCSRCWMYGTVYSFEGEYFCPRCLN

SEQ ID NO: 3275871 - protein, 20 aa, Plasmodium falciparum
TESLRKWFIETAAIETFFLW

SEQ ID NO: 3275872 - protein, 22 aa, Plasmodium falciparum
TETFITPKFIALFFPSYLKYLK

SEQ ID NO: 3275873 - protein, 20 aa, Plasmodium falciparum
TETIEWVTLPSISKFRHTSW

SEQ ID NO: 3275874 - protein, 21 aa, Plasmodium falciparum
TETKYNLIYEKINEEVEKAKF

SEQ ID NO: 3275875 - protein, 17 aa, Plasmodium falciparum
TETPRNCNIYKENMMNM

SEQ ID NO: 3275876 - protein, 21 aa, Plasmodium falciparum
TETYLKIIFDDWFNSEKTSIE

SEQ ID NO: 3275877 - protein, 23 aa, Plasmodium falciparum
TEWNMKNVPSFYGYIECTFQWCG

SEQ ID NO: 3275878 - protein, 22 aa, Plasmodium falciparum
TEYCQACPLCGVKRNGRKWERK

SEQ ID NO: 3275879 - protein, 26 aa, Plasmodium falciparum
TEYCQACPWCGMTCTFDGKCTKNPEE

SEQ ID NO: 3275880 - protein, 24 aa, Plasmodium falciparum
TEYEKKLFEEWQHLNMFEHSNWVN

SEQ ID NO: 3275881 - protein, 26 aa, Plasmodium falciparum
TEYICSRYKKRICAGRDDSENNVSIK

SEQ ID NO: 3275882 - protein, 21 aa, Plasmodium falciparum
TEYILKISRTHIVIVDFNIFR

SEQ ID NO: 3275883 - protein, 27 aa, Plasmodium falciparum
TEYLSCYYCSLCIESFEIDKWRDHFLS

SEQ ID NO: 3275884 - protein, 19 aa, Plasmodium falciparum
TFCRQRARMLDKIKKDCNV

SEQ ID NO: 3275885 - protein, 17 aa, Plasmodium falciparum
TFEAFSVAISSLLKKKA

SEQ ID NO: 3275886 - protein, 19 aa, Plasmodium falciparum
TFEKLLKKEITTYIEYELN

SEQ ID NO: 3275887 - protein, 18 aa, Plasmodium falciparum
TFEMWIGINESFFDRKGE

SEQ ID NO: 3275888 - protein, 17 aa, Plasmodium falciparum
TFENALMKCMIIGNSMI

SEQ ID NO: 3275889 - protein, 17 aa, Plasmodium falciparum
TFERIFLNYKIKNITLD

SEQ ID NO: 3275890 - protein, 34 aa, Plasmodium falciparum
TFFFFLSLFYLEYFLIYCHFFEIIYFIHLSNHEK

SEQ ID NO: 3275891 - protein, 32 aa, Plasmodium falciparum
TFFIYIDIYVCFVLYISICFMYISYIFNIWKK

SEQ ID NO: 3275892 - protein, 19 aa, Plasmodium falciparum
TFFLWDRYKKIKAKEKKEK

SEQ ID NO: 3275893 - protein, 18 aa, Plasmodium falciparum
TFFLWDRYKKIKDIEEKE

SEQ ID NO: 3275894 - protein, 17 aa, Plasmodium falciparum
TFFLWDRYKKIKEKEKK

SEQ ID NO: 3275895 - protein, 17 aa, Plasmodium falciparum
TFFLWDRYKKIKEKEKQ

SEQ ID NO: 3275896 - protein, 19 aa, Plasmodium falciparum
TFFYFLFFLLDMYQGNDAI

SEQ ID NO: 3275897 - protein, 24 aa, Plasmodium falciparum
TFFYIIYPHFFFKHAKQDHEINYE

SEQ ID NO: 3275898 - protein, 36 aa, Plasmodium falciparum
TFGNICFIGCLLISILRLFLEGSLWSPSILITCFGC

SEQ ID NO: 3275899 - protein, 27 aa, Plasmodium falciparum
TFGPLDYCKTCPLNGVNCNVIRGTNGC

SEQ ID NO: 3275900 - protein, 26 aa, Plasmodium falciparum
TFGSSQYCKACPVYGVNCKNSKHKCL

SEQ ID NO: 3275901 - protein, 21 aa, Plasmodium falciparum
TFHDLFYYWVAHMLKDSIYWE

SEQ ID NO: 3275902 - protein, 27 aa, Plasmodium falciparum
TFHINNLCIALLCFSRIYCLHKATKFI

SEQ ID NO: 3275903 - protein, 25 aa, Plasmodium falciparum
TFHMKNVCFMPRYSKKSIMYYIFSL

SEQ ID NO: 3275904 - protein, 27 aa, Plasmodium falciparum
TFHNFFYYWVAHMLKDSIHWRTKKLDK

SEQ ID NO: 3275905 - protein, 26 aa, Plasmodium falciparum
TFHNFFYYWVAHMLKDSIYWRTEKLE

SEQ ID NO: 3275906 - protein, 24 aa, Plasmodium falciparum
TFIKENKSFCGLGAEITKMKAEFR

SEQ ID NO: 3275907 - protein, 25 aa, Plasmodium falciparum
TFIKIKILFFFFIIFDFIKQFVDMH

SEQ ID NO: 3275908 - protein, 24 aa, Plasmodium falciparum
TFILYFKFNYCILYDHGYSSIGSI

SEQ ID NO: 3275909 - protein, 18 aa, Plasmodium falciparum
TFINNAYNMSIRRSMAES

SEQ ID NO: 3275910 - protein, 25 aa, Plasmodium falciparum
TFIPKEFAKHIFLMYANFESNYGFI

SEQ ID NO: 3275911 - protein, 26 aa, Plasmodium falciparum
TFIYEIKYGYWVRNGPQMIFQVGEYD

SEQ ID NO: 3275912 - protein, 23 aa, Plasmodium falciparum
TFIYLFILRYFKNVEIFFNSYRV

SEQ ID NO: 3275913 - protein, 26 aa, Plasmodium falciparum
TFKCLSCAKSCRFYKKWISRKKEEFD

SEQ ID NO: 3275914 - protein, 27 aa, Plasmodium falciparum
TFKIIPEIIDGIFICKNHRLIYNMKEI

SEQ ID NO: 3275915 - protein, 22 aa, Plasmodium falciparum
TFKKELRDFFFLKKNEQRNNNI

SEQ ID NO: 3275916 - protein, 18 aa, Plasmodium falciparum
TFKMKFSKLKTNYMKNRA

SEQ ID NO: 3275917 - protein, 25 aa, Plasmodium falciparum
TFKNSCLVSILLIVFIINDEFQRKI

SEQ ID NO: 3275918 - protein, 24 aa, Plasmodium falciparum
TFKQKKYICPYCEKNLTSSEKLFK

SEQ ID NO: 3275919 - protein, 18 aa, Plasmodium falciparum
TFKSRYINTYTMEEVQKS

SEQ ID NO: 3275920 - protein, 27 aa, Plasmodium falciparum
TFKVFLENWLQDFLEGYYISKRKIEIC

SEQ ID NO: 3275921 - protein, 17 aa, Plasmodium falciparum
TFLCWHVTQSIFGGVKA

SEQ ID NO: 3275922 - protein, 34 aa, Plasmodium falciparum
TFLDDPLRIVRCIRFCGFFNFFLEKSIFNVLKNE

SEQ ID NO: 3275923 - protein, 20 aa, Plasmodium falciparum
TFLFLNKRMLCVYYNIHNKY

SEQ ID NO: 3275924 - protein, 22 aa, Plasmodium falciparum
TFLHNRYDTISGHIISGDINSR

SEQ ID NO: 3275925 - protein, 22 aa, Plasmodium falciparum
TFLIGCSSGLISSYGFDLDAWG

SEQ ID NO: 3275926 - protein, 20 aa, Plasmodium falciparum
TFLKILFQKREHNIIILSDQ

SEQ ID NO: 3275927 - protein, 36 aa, Plasmodium falciparum
TFLKMRKKLSYKWIPKWHMCNDIFLSRLISYDEIQI

SEQ ID NO: 3275928 - protein, 19 aa, Plasmodium falciparum
TFLLSVFIFDCYIHRINQL

SEQ ID NO: 3275929 - protein, 18 aa, Plasmodium falciparum
TFLQNVWPADEWNAKKSF

SEQ ID NO: 3275930 - protein, 21 aa, Plasmodium falciparum
TFLSALCFEKLNKLKLSITEY

SEQ ID NO: 3275931 - protein, 18 aa, Plasmodium falciparum
TFMKKLKCDINTFSKNSN

SEQ ID NO: 3275932 - protein, 20 aa, Plasmodium falciparum
TFMNCIKKSLFYNPLNIMTL

SEQ ID NO: 3275933 - protein, 19 aa, Plasmodium falciparum
TFMSCFFNHKILSKHCRIL

SEQ ID NO: 3275934 - protein, 18 aa, Plasmodium falciparum
TFNFPSKKKHVYLLDKEK

SEQ ID NO: 3275935 - protein, 26 aa, Plasmodium falciparum
TFNNFFYYWVAHMLKDSIYWRMKKLE

SEQ ID NO: 3275936 - protein, 18 aa, Plasmodium falciparum
TFNNLHFMRNIRFAQDLI

SEQ ID NO: 3275937 - protein, 32 aa, Plasmodium falciparum
TFNREIKFSSLFYNLPCAINYIHKYDNFKYKK

SEQ ID NO: 3275938 - protein, 21 aa, Plasmodium falciparum
TFPPLLFEKKELFQMYTKTGL

SEQ ID NO: 3275939 - protein, 24 aa, Plasmodium falciparum
TFSLCECDLFISIHKYRNMLLKYL

SEQ ID NO: 3275940 - protein, 24 aa, Plasmodium falciparum
TFSLLFLNCLFIKRLHDLKNEGNP

SEQ ID NO: 3275941 - protein, 20 aa, Plasmodium falciparum
TFSQHIFSGILFCGVPSIYR

SEQ ID NO: 3275942 - protein, 24 aa, Plasmodium falciparum
TFSRTEICEPCPWCGAEKDNTGNG

SEQ ID NO: 3275943 - protein, 18 aa, Plasmodium falciparum
TFSSVLFYFILNADMDKE

SEQ ID NO: 3275944 - protein, 22 aa, Plasmodium falciparum
TFTILNCLLIKYSYNKNNVEVR

SEQ ID NO: 3275945 - protein, 17 aa, Plasmodium falciparum
TFTRISNNFFYYNFNNF

SEQ ID NO: 3275946 - protein, 19 aa, Plasmodium falciparum
TFVLARLFLNETINATKII

SEQ ID NO: 3275947 - protein, 20 aa, Plasmodium falciparum
TFYEDFRNSGVIINNININH

SEQ ID NO: 3275948 - protein, 25 aa, Plasmodium falciparum
TFYNYIFIHILKLCVISTHDLISIL

SEQ ID NO: 3275949 - protein, 18 aa, Plasmodium falciparum
TFYRPWVSLVTQPIISIN

SEQ ID NO: 3275950 - protein, 18 aa, Plasmodium falciparum
TFYRSKLIYNIRSYDINK

SEQ ID NO: 3275951 - protein, 20 aa, Plasmodium falciparum
TFYSNIFIFFIFPYLKEYIN

SEQ ID NO: 3275952 - protein, 21 aa, Plasmodium falciparum
TFYYIGRCYCNYDIYLKQSGN

SEQ ID NO: 3275953 - protein, 35 aa, Plasmodium falciparum
TFYYLKLNKFFCFLICDFMERFSLYDIFYRYQYLL

SEQ ID NO: 3275954 - protein, 19 aa, Plasmodium falciparum
TFYYLRRNDDLFVHYTNIY

SEQ ID NO: 3275955 - protein, 25 aa, Plasmodium falciparum
TGANWICKGDTWISSRQKKDWITAI

SEQ ID NO: 3275956 - protein, 22 aa, Plasmodium falciparum
TGDEWLIRNMFHDFPRNANSQT

SEQ ID NO: 3275957 - protein, 24 aa, Plasmodium falciparum
TGEAYTFIRYHVFQIKTPDEDFDS

SEQ ID NO: 3275958 - protein, 25 aa, Plasmodium falciparum
TGFKENLKRAFTFFSPDDYEEKDLR

SEQ ID NO: 3275959 - protein, 26 aa, Plasmodium falciparum
TGGIISHPFLPFFALIHINNNEKNMN

SEQ ID NO: 3275960 - protein, 19 aa, Plasmodium falciparum
TGGMALEALNYISFLNSKI

SEQ ID NO: 3275961 - protein, 18 aa, Plasmodium falciparum
TGMFLRIMGIINCSKSFS

SEQ ID NO: 3275962 - protein, 17 aa, Plasmodium falciparum
TGMKVFFISLMTWTPLT

SEQ ID NO: 3275963 - protein, 24 aa, Plasmodium falciparum
TGNKHAFYRSDYCQPCPDCVVECD

SEQ ID NO: 3275964 - protein, 26 aa, Plasmodium falciparum
TGQDILYPWILRSFILLNYFIENDYL

SEQ ID NO: 3275965 - protein, 24 aa, Plasmodium falciparum
TGRVCPAPCEDACVLSINEKAVSI

SEQ ID NO: 3275966 - protein, 19 aa, Plasmodium falciparum
TGSIFFGRMADIWGVKKSF

SEQ ID NO: 3275967 - protein, 25 aa, Plasmodium falciparum
TGTIPPDFLRLMFYTLGDYRDILDG

SEQ ID NO: 3275968 - protein, 26 aa, Plasmodium falciparum
TGYDSLKWEAEDSIIFKLGNINKGVS

SEQ ID NO: 3275969 - protein, 23 aa, Plasmodium falciparum
THAYKNSLICRVLSNYSKQIRKE

SEQ ID NO: 3275970 - protein, 20 aa, Plasmodium falciparum
THDLKLIIMKGEKKNIKCEI

SEQ ID NO: 3275971 - protein, 18 aa, Plasmodium falciparum
THFAPSVYKYIPIYNTIK

SEQ ID NO: 3275972 - protein, 25 aa, Plasmodium falciparum
THFFLYYLYCVIFKKQFSIHMDTYV

SEQ ID NO: 3275973 - protein, 25 aa, Plasmodium falciparum
THFIKKLRYLLSIFYDVVYKKDEHL

SEQ ID NO: 3275974 - protein, 22 aa, Plasmodium falciparum
THFNETIFYIWIDSIYEKTKKL

SEQ ID NO: 3275975 - protein, 18 aa, Plasmodium falciparum
THHLRYNRNKPLQYTSPP

SEQ ID NO: 3275976 - protein, 18 aa, Plasmodium falciparum
THINLKYNIRIMNNHILN

SEQ ID NO: 3275977 - protein, 23 aa, Plasmodium falciparum
THIRIPNFLIFIFKHRIINIGFL

SEQ ID NO: 3275978 - protein, 23 aa, Plasmodium falciparum
THIYNIFNWFSFINYRYGCSYEF

SEQ ID NO: 3275979 - protein, 25 aa, Plasmodium falciparum
THKINCYEAFKKYTHIFNINNDIHI

SEQ ID NO: 3275980 - protein, 24 aa, Plasmodium falciparum
THKMCLFLLNYLYNYSIFNTKEKI

SEQ ID NO: 3275981 - protein, 34 aa, Plasmodium falciparum
THKRFIYIYILKEIYLLLHFHITHIWITIKEHTE

SEQ ID NO: 3275982 - protein, 22 aa, Plasmodium falciparum
THKRKSFLFWSEYFDFLYNVTD

SEQ ID NO: 3275983 - protein, 24 aa, Plasmodium falciparum
THLHAIYKIYLLSLKFCVTEYFEY

SEQ ID NO: 3275984 - protein, 28 aa, Plasmodium falciparum
THLIKSRLLEFVYICLKHLNGDNIYEIF

SEQ ID NO: 3275985 - protein, 32 aa, Plasmodium falciparum
THLSKFVLRPPYFRYLEEWGETFCRERKKRLK

SEQ ID NO: 3275986 - protein, 41 aa, Plasmodium falciparum
THNFDIYINHSWKMYLYFFFYDFFCIAFNQLFYILYENSNK

SEQ ID NO: 3275987 - protein, 20 aa, Plasmodium falciparum
THPDLIYGMKYRKLGESNLC

SEQ ID NO: 3275988 - protein, 19 aa, Plasmodium falciparum
THRSLCECELYSPTNYDSD

SEQ ID NO: 3275989 - protein, 19 aa, Plasmodium falciparum
THRTLCECESYSPSNYEND

SEQ ID NO: 3275990 - protein, 27 aa, Plasmodium falciparum
THSEIFFFSLKCLNIIMNEEIKKISLN

SEQ ID NO: 3275991 - protein, 20 aa, Plasmodium falciparum
THSLFSFHKCFLILLQCCYF

SEQ ID NO: 3275992 - protein, 21 aa, Plasmodium falciparum
THSLHLLYLYILKSMSVLNGL

SEQ ID NO: 3275993 - protein, 31 aa, Plasmodium falciparum
THTDEELICFWLKTLNQLYLIRDGFSNYFKN

SEQ ID NO: 3275994 - protein, 26 aa, Plasmodium falciparum
TIAGIKCPYKLIPPYCFKHVLYEKEI

SEQ ID NO: 3275995 - protein, 26 aa, Plasmodium falciparum
TIARKWKNLHCLLPMNKSTCMFVLHN

SEQ ID NO: 3275996 - protein, 18 aa, Plasmodium falciparum
TICDKCDFLVRPERAHHC

SEQ ID NO: 3275997 - protein, 17 aa, Plasmodium falciparum
TICEYLNSIFLKANKNV

SEQ ID NO: 3275998 - protein, 26 aa, Plasmodium falciparum
TICKKDCKDKCKCVDEWINKKRTEWD

SEQ ID NO: 3275999 - protein, 18 aa, Plasmodium falciparum
TIEDRFFISQAIQHYQYI

SEQ ID NO: 3276000 - protein, 27 aa, Plasmodium falciparum
TIFEALCVLLSLAFSLYICTGFYNLNG

SEQ ID NO: 3276001 - protein, 28 aa, Plasmodium falciparum
TIFFLCLRIALIISRILYDIILFIYMKG

SEQ ID NO: 3276002 - protein, 22 aa, Plasmodium falciparum
TIFKQRKYFFENLRKEKSSNNI

SEQ ID NO: 3276003 - protein, 28 aa, Plasmodium falciparum
TIFSKFVPKSKFAFSSEVIIHPETNYAL

SEQ ID NO: 3276004 - protein, 30 aa, Plasmodium falciparum
TIFYFLLYHERFRFGFFSSTSLLVNLIKLK

SEQ ID NO: 3276005 - protein, 20 aa, Plasmodium falciparum
TIGLCKPCTLENHYCEGGLE

SEQ ID NO: 3276006 - protein, 27 aa, Plasmodium falciparum
TIGYCITFSCSLGFVIKSLLYDYTHVE

SEQ ID NO: 3276007 - protein, 20 aa, Plasmodium falciparum
TIHEFSLFIYNCDTLVGTQI

SEQ ID NO: 3276008 - protein, 17 aa, Plasmodium falciparum
TIIDFLLEHEGEDAKKC

SEQ ID NO: 3276009 - protein, 17 aa, Plasmodium falciparum
TIIEIYMEVMNEYKKDE

SEQ ID NO: 3276010 - protein, 20 aa, Plasmodium falciparum
TIIFSFIFFLAIKSYIKRNK

SEQ ID NO: 3276011 - protein, 18 aa, Plasmodium falciparum
TIIILKYVFKSVNKDIKK

SEQ ID NO: 3276012 - protein, 18 aa, Plasmodium falciparum
TIIKEIWEECPFPFNYVI

SEQ ID NO: 3276013 - protein, 20 aa, Plasmodium falciparum
TIIKEKCNFLYDEISNACNK

SEQ ID NO: 3276014 - protein, 17 aa, Plasmodium falciparum
TIIKFSIFFYILYKYAD

SEQ ID NO: 3276015 - protein, 18 aa, Plasmodium falciparum
TIINFYISYFKIIKLLFS

SEQ ID NO: 3276016 - protein, 24 aa, Plasmodium falciparum
TIINMFFFFGHFNIMIIIYYVIYK

SEQ ID NO: 3276017 - protein, 26 aa, Plasmodium falciparum
TIINNICTNCFIYIYDDEMVGLNKKE

SEQ ID NO: 3276018 - protein, 17 aa, Plasmodium falciparum
TIISKKLFLPCFFSEYF

SEQ ID NO: 3276019 - protein, 24 aa, Plasmodium falciparum
TIKDKKLNCLILFINEDISNYTKE

SEQ ID NO: 3276020 - protein, 23 aa, Plasmodium falciparum
TIKDRNEWCISRQKYWGVNIPLK

SEQ ID NO: 3276021 - protein, 25 aa, Plasmodium falciparum
TIKKRLKMDMLHKISPMSHINAYVI

SEQ ID NO: 3276022 - protein, 18 aa, Plasmodium falciparum
TIKLICSEKPIYGYEDAY

SEQ ID NO: 3276023 - protein, 20 aa, Plasmodium falciparum
TIKSNLKYIKSIININEATQ

SEQ ID NO: 3276024 - protein, 21 aa, Plasmodium falciparum
TILCYILLILIEKSHQNNIYK

SEQ ID NO: 3276025 - protein, 18 aa, Plasmodium falciparum
TILIKFEPIYNMLLASCH

SEQ ID NO: 3276026 - protein, 17 aa, Plasmodium falciparum
TILKYVCELELIPWDEK

SEQ ID NO: 3276027 - protein, 19 aa, Plasmodium falciparum
TILLKYVFFYSNNIKNISL

SEQ ID NO: 3276028 - protein, 24 aa, Plasmodium falciparum
TILQNEWFKNFLIKLSNNDKNILS

SEQ ID NO: 3276029 - protein, 19 aa, Plasmodium falciparum
TILSNCRNVLYPHGKGSLY

SEQ ID NO: 3276030 - protein, 25 aa, Plasmodium falciparum
TIMFSFVCLYFQIRYLGLNMTSIFY

SEQ ID NO: 3276031 - protein, 18 aa, Plasmodium falciparum
TIMKSCRFSLLVNIPISV

SEQ ID NO: 3276032 - protein, 23 aa, Plasmodium falciparum
TINDCLCLPGYYLKGNIQTCIPC

SEQ ID NO: 3276033 - protein, 35 aa, Plasmodium falciparum
TINILKRDNESFNFLKYALRSIFIYNLNKQKFNNC

SEQ ID NO: 3276034 - protein, 18 aa, Plasmodium falciparum
TINKKIIFCLNRNSQFVL

SEQ ID NO: 3276035 - protein, 18 aa, Plasmodium falciparum
TINVKVILEYIINSKTNE

SEQ ID NO: 3276036 - protein, 22 aa, Plasmodium falciparum
TINWKCHYKEKNVYKDDSDKDY

SEQ ID NO: 3276037 - protein, 28 aa, Plasmodium falciparum
TIPCGHNFCRDCIEKAKEYKNLCPLCRS

SEQ ID NO: 3276038 - protein, 24 aa, Plasmodium falciparum
TIPEELVVLIPHIEYNYKIDSYHF

SEQ ID NO: 3276039 - protein, 19 aa, Plasmodium falciparum
TIQFYKPFLQRKMLESPFA

SEQ ID NO: 3276040 - protein, 36 aa, Plasmodium falciparum
TIRRLIRRIPYILNFQWPIEFIIETTIACFIFPLYK

SEQ ID NO: 3276041 - protein, 21 aa, Plasmodium falciparum
TISKVCAPLINILSNEYNDYE

SEQ ID NO: 3276042 - protein, 18 aa, Plasmodium falciparum
TISRACYNLGYMHYYGIG

SEQ ID NO: 3276043 - protein, 24 aa, Plasmodium falciparum
TITKKRFLEIFDIIKNRKKQIEKM

SEQ ID NO: 3276044 - protein, 25 aa, Plasmodium falciparum
TITKWFCLNTIFSLISLYIYYVFFF

SEQ ID NO: 3276045 - protein, 19 aa, Plasmodium falciparum
TITSFPRNHKHIIEFAKSV

SEQ ID NO: 3276046 - protein, 26 aa, Plasmodium falciparum
TIVTFLEKMFRICKRFDENMNNKIQF

SEQ ID NO: 3276047 - protein, 21 aa, Plasmodium falciparum
TIYCLKIFANIQSFYPNFYKC

SEQ ID NO: 3276048 - protein, 20 aa, Plasmodium falciparum
TIYDCLNYSGTTDLDCTLNY

SEQ ID NO: 3276049 - protein, 24 aa, Plasmodium falciparum
TIYEIKCQLRFASLGDWGKDTKGQ

SEQ ID NO: 3276050 - protein, 26 aa, Plasmodium falciparum
TIYHFNCPICFIYIILNIIRKKKKNI

SEQ ID NO: 3276051 - protein, 22 aa, Plasmodium falciparum
TIYKYLFKIISYPSLKKRMEFI

SEQ ID NO: 3276052 - protein, 25 aa, Plasmodium falciparum
TIYMSRMKLGLLYIIEKFFIRLIDM

SEQ ID NO: 3276053 - protein, 18 aa, Plasmodium falciparum
TIYYMLASLEKFAFYTGS

SEQ ID NO: 3276054 - protein, 22 aa, Plasmodium falciparum
TKACKVYMGKPFKDVYNEKKKI

SEQ ID NO: 3276055 - protein, 20 aa, Plasmodium falciparum
TKADDLFFYKSVNKLYHSVN

SEQ ID NO: 3276056 - protein, 25 aa, Plasmodium falciparum
TKCPPRFPLNHTMFGYFNYSTGKCE

SEQ ID NO: 3276057 - protein, 28 aa, Plasmodium falciparum
TKCRKGCKGDCDCFLKWVNEKKTEWGKI

SEQ ID NO: 3276058 - protein, 25 aa, Plasmodium falciparum
TKCSFLCGFYKKWIDNQKKEFLKQK

SEQ ID NO: 3276059 - protein, 19 aa, Plasmodium falciparum
TKCSLACKTFAEWIDNQKE

SEQ ID NO: 3276060 - protein, 24 aa, Plasmodium falciparum
TKCSVWCRMYESWIDNQKKEFLKQ

SEQ ID NO: 3276061 - protein, 25 aa, Plasmodium falciparum
TKDLVTRYLLFFVFFVDKIIEKNED

SEQ ID NO: 3276062 - protein, 19 aa, Plasmodium falciparum
TKEEFLFICINEFVNEKDK

SEQ ID NO: 3276063 - protein, 18 aa, Plasmodium falciparum
TKEFYRLFEYSDKKYELQ

SEQ ID NO: 3276064 - protein, 20 aa, Plasmodium falciparum
TKEIFINEYFIYKMFKKQMT

SEQ ID NO: 3276065 - protein, 25 aa, Plasmodium falciparum
TKEIYLKFIYNYLILIEFSYDHDME

SEQ ID NO: 3276066 - protein, 23 aa, Plasmodium falciparum
TKEKKIVSNLIWFNNNNKISQMI

SEQ ID NO: 3276067 - protein, 27 aa, Plasmodium falciparum
TKELLYMLRIILSINIVYNKIKNECNI

SEQ ID NO: 3276068 - protein, 17 aa, Plasmodium falciparum
TKELSLFKLKNDIFKYR

SEQ ID NO: 3276069 - protein, 18 aa, Plasmodium falciparum
TKEPAKCPILETYINPIF

SEQ ID NO: 3276070 - protein, 20 aa, Plasmodium falciparum
TKEPRAMLLDSLNKIEECIY

SEQ ID NO: 3276071 - protein, 18 aa, Plasmodium falciparum
TKEWEEIKKPYLEQYKNG

SEQ ID NO: 3276072 - protein, 18 aa, Plasmodium falciparum
TKEYVYFIYLQDIYYNIN

SEQ ID NO: 3276073 - protein, 17 aa, Plasmodium falciparum
TKFAIKYILSYRFFFIY

SEQ ID NO: 3276074 - protein, 27 aa, Plasmodium falciparum
TKFCNKSNKALKCVISILKKTSNKIKI

SEQ ID NO: 3276075 - protein, 24 aa, Plasmodium falciparum
TKFEYKYLFYFASFVSINLGICNE

SEQ ID NO: 3276076 - protein, 24 aa, Plasmodium falciparum
TKFFYKEYIIDSIINTLFRCTMEK

SEQ ID NO: 3276077 - protein, 18 aa, Plasmodium falciparum
TKFISIKKGISLGFYEIF

SEQ ID NO: 3276078 - protein, 19 aa, Plasmodium falciparum
TKFKNYRDVFLNGSKNFMS

SEQ ID NO: 3276079 - protein, 17 aa, Plasmodium falciparum
TKFSIDTLLLILNIYIK

SEQ ID NO: 3276080 - protein, 20 aa, Plasmodium falciparum
TKGYRPTIIQSEYYKKRFLS

SEQ ID NO: 3276081 - protein, 17 aa, Plasmodium falciparum
TKHIFMMLWNYIYNTDY

SEQ ID NO: 3276082 - protein, 28 aa, Plasmodium falciparum
TKICEPCPWCGVKPGGPPWKDNDIDSCG

SEQ ID NO: 3276083 - protein, 34 aa, Plasmodium falciparum
TKIEFADPLYRCFKKKEFSNMVYFAGAGIVLILL

SEQ ID NO: 3276084 - protein, 21 aa, Plasmodium falciparum
TKIGLHLPDLSFVYEEYQPTY

SEQ ID NO: 3276085 - protein, 15 aa, Plasmodium falciparum
TKIIIMWKKLMMIII

SEQ ID NO: 3276086 - protein, 25 aa, Plasmodium falciparum
TKIKEKKDLLFLGFRQKSQDFYFKD

SEQ ID NO: 3276087 - protein, 22 aa, Plasmodium falciparum
TKIKNFLNKRIAYLSYELNIYL

SEQ ID NO: 3276088 - protein, 23 aa, Plasmodium falciparum
TKILKLTQFLVMYNYYTYLYQDV

SEQ ID NO: 3276089 - protein, 18 aa, Plasmodium falciparum
TKINEIVNFVSSIINIPI

SEQ ID NO: 3276090 - protein, 17 aa, Plasmodium falciparum
TKIPANWVINDEEMMNK

SEQ ID NO: 3276091 - protein, 17 aa, Plasmodium falciparum
TKIPFLKYQVYKATELY

SEQ ID NO: 3276092 - protein, 17 aa, Plasmodium falciparum
TKIPMPQYICYRKQTLI

SEQ ID NO: 3276093 - protein, 20 aa, Plasmodium falciparum
TKITPLFCSTVEYQGPEELA

SEQ ID NO: 3276094 - protein, 23 aa, Plasmodium falciparum
TKKFKYKLSKILKDINQDNIKSK

SEQ ID NO: 3276095 - protein, 29 aa, Plasmodium falciparum
TKKIFRYYHKIFILFLLYICNMYFQNLKD

SEQ ID NO: 3276096 - protein, 20 aa, Plasmodium falciparum
TKKIKGCLKNGKAIKCTDKC

SEQ ID NO: 3276097 - protein, 19 aa, Plasmodium falciparum
TKKIYRILISNIYHEDDLK

SEQ ID NO: 3276098 - protein, 21 aa, Plasmodium falciparum
TKKIYYSFLKFIKEMQNAIFY

SEQ ID NO: 3276099 - protein, 20 aa, Plasmodium falciparum
TKKKLMFSDDVKIFNENSNN

SEQ ID NO: 3276100 - protein, 22 aa, Plasmodium falciparum
TKKKSFPSFDYFRNKYLPNNSI

SEQ ID NO: 3276101 - protein, 29 aa, Plasmodium falciparum
TKKLKSNLFIKRLFLFCHFLICSKIVTFR

SEQ ID NO: 3276102 - protein, 24 aa, Plasmodium falciparum
TKKLLSYKIKLKWTDENYRKRIIE

SEQ ID NO: 3276103 - protein, 29 aa, Plasmodium falciparum
TKKLSKKVCVKKILLKLKNISLLELDQMT

SEQ ID NO: 3276104 - protein, 34 aa, Plasmodium falciparum
TKKNIPSILYYCLNNCNDLTCAELSGYDGSLIAT

SEQ ID NO: 3276105 - protein, 26 aa, Plasmodium falciparum
TKKRKFSIVHKFFYSLNIFFNSFSTL

SEQ ID NO: 3276106 - protein, 19 aa, Plasmodium falciparum
TKKVEILYKYCKNNINILL

SEQ ID NO: 3276107 - protein, 28 aa, Plasmodium falciparum
TKKYKSFHFYIFMIRYLWNSLQNKSISP

SEQ ID NO: 3276108 - protein, 21 aa, Plasmodium falciparum
TKLAYSYMNGFIIPHEDLIFI

SEQ ID NO: 3276109 - protein, 20 aa, Plasmodium falciparum
TKLEADILCSEGSFKSLSFA

SEQ ID NO: 3276110 - protein, 21 aa, Plasmodium falciparum
TKLFTFYWIYQVYVYGSIFLK

SEQ ID NO: 3276111 - protein, 30 aa, Plasmodium falciparum
TKLIIRVNELFDMIIMFVIFLILLLSVYLI

SEQ ID NO: 3276112 - protein, 24 aa, Plasmodium falciparum
TKLKRLKRRILLFEKNKFSEIVDL

SEQ ID NO: 3276113 - protein, 26 aa, Plasmodium falciparum
TKLLEYVCNVGFNLGFDIINNNNILL

SEQ ID NO: 3276114 - protein, 23 aa, Plasmodium falciparum
TKLLGKILWCLSYYHKTEFIFSF

SEQ ID NO: 3276115 - protein, 18 aa, Plasmodium falciparum
TKLLILAEDRLKIYEILP

SEQ ID NO: 3276116 - protein, 29 aa, Plasmodium falciparum
TKLNELYSIYFYICTIMLSKGSSHKNAPT

SEQ ID NO: 3276117 - protein, 23 aa, Plasmodium falciparum
TKLQEWKALGLQNIEQVQEYEIE

SEQ ID NO: 3276118 - protein, 22 aa, Plasmodium falciparum
TKLVCAGTFCLALYPVYTMLLN

SEQ ID NO: 3276119 - protein, 24 aa, Plasmodium falciparum
TKLYEIFSSLILKKKKNDINKLDI

SEQ ID NO: 3276120 - protein, 36 aa, Plasmodium falciparum
TKLYYSLVKILLITFFICIFTRLNHGQFYEKWKNKP

SEQ ID NO: 3276121 - protein, 17 aa, Plasmodium falciparum
TKMNIVFQEFIKNYTYF

SEQ ID NO: 3276122 - protein, 18 aa, Plasmodium falciparum
TKNIFILKMCAKNFLCNY

SEQ ID NO: 3276123 - protein, 21 aa, Plasmodium falciparum
TKNIIREFVQICIKKLEEEKI

SEQ ID NO: 3276124 - protein, 19 aa, Plasmodium falciparum
TKNILKTSIDLDKNLLREY

SEQ ID NO: 3276125 - protein, 25 aa, Plasmodium falciparum
TKNLKYFFIYNIYEIHRDIFINYFY

SEQ ID NO: 3276126 - protein, 19 aa, Plasmodium falciparum
TKNSLSVLVNIFSSIKNSI

SEQ ID NO: 3276127 - protein, 25 aa, Plasmodium falciparum
TKNYICTIWYPKPLNYIALNCPTNR

SEQ ID NO: 3276128 - protein, 26 aa, Plasmodium falciparum
TKPFSIFYHHLFLRKDNNVFLPHFRK

SEQ ID NO: 3276129 - protein, 22 aa, Plasmodium falciparum
TKPKGPMTYGYKNNYGNNSYYN

SEQ ID NO: 3276130 - protein, 24 aa, Plasmodium falciparum
TKPLIKFGTYVLNNFYVVVDQENY

SEQ ID NO: 3276131 - protein, 24 aa, Plasmodium falciparum
TKPYECYEDSSLNLENKVQYPNVY

SEQ ID NO: 3276132 - protein, 18 aa, Plasmodium falciparum
TKRICIGIYVLFIQLILS

SEQ ID NO: 3276133 - protein, 20 aa, Plasmodium falciparum
TKRKKKSCCDVEKVEEDDLQ

SEQ ID NO: 3276134 - protein, 20 aa, Plasmodium falciparum
TKRSLDFPEIIIKENYENPK

SEQ ID NO: 3276135 - protein, 25 aa, Plasmodium falciparum
TKSFFFKYINNLIIYLCIDYKDSIE

SEQ ID NO: 3276136 - protein, 22 aa, Plasmodium falciparum
TKSIPECLARTGKIQLKKNDIS

SEQ ID NO: 3276137 - protein, 25 aa, Plasmodium falciparum
TKSIYHFSFFFSLIDYFILNIYKCL

SEQ ID NO: 3276138 - protein, 26 aa, Plasmodium falciparum
TKSKFLQWLMEWARKYCSEKIKKSKH

SEQ ID NO: 3276139 - protein, 20 aa, Plasmodium falciparum
TKSNHFVRNYSYKIIKDSYT

SEQ ID NO: 3276140 - protein, 26 aa, Plasmodium falciparum
TKSNKKLCYLRNQLIEKFFDSLNYKI

SEQ ID NO: 3276141 - protein, 23 aa, Plasmodium falciparum
TKSWPEGLKVILKQLLDENNRKN

SEQ ID NO: 3276142 - protein, 22 aa, Plasmodium falciparum
TKSYLCVSFLNQLYYSKTQCIM

SEQ ID NO: 3276143 - protein, 22 aa, Plasmodium falciparum
TKTFLYKPVIPFYNLHNEMLKK

SEQ ID NO: 3276144 - protein, 18 aa, Plasmodium falciparum
TKTFSKELSKLFKKLRTK

SEQ ID NO: 3276145 - protein, 18 aa, Plasmodium falciparum
TKTIRAKYIYAIGDECTK

SEQ ID NO: 3276146 - protein, 24 aa, Plasmodium falciparum
TKTKELFCTPDRFADATWKTVNEI

SEQ ID NO: 3276147 - protein, 18 aa, Plasmodium falciparum
TKTKLAVGKYRMGNQCTK

SEQ ID NO: 3276148 - protein, 22 aa, Plasmodium falciparum
TKVKVGDQVLKLSLNSRLEGVY

SEQ ID NO: 3276149 - protein, 18 aa, Plasmodium falciparum
TKVNLFLIQIFDMFEFQS

SEQ ID NO: 3276150 - protein, 24 aa, Plasmodium falciparum
TKVWECKKPYKLSTKDVCVPPRRQ

SEQ ID NO: 3276151 - protein, 18 aa, Plasmodium falciparum
TKWNEWKDKYFINKKDIF

SEQ ID NO: 3276152 - protein, 17 aa, Plasmodium falciparum
TKWWNSVNWEHLNLDLR

SEQ ID NO: 3276153 - protein, 20 aa, Plasmodium falciparum
TKYADIYSFKNYLNTCEEVY

SEQ ID NO: 3276154 - protein, 19 aa, Plasmodium falciparum
TKYAMKIINQCIGRSLRHV

SEQ ID NO: 3276155 - protein, 21 aa, Plasmodium falciparum
TKYCQACPWCGIEEQKVNGRW

SEQ ID NO: 3276156 - protein, 19 aa, Plasmodium falciparum
TKYEHVFYLNLLKKIIIMN

SEQ ID NO: 3276157 - protein, 27 aa, Plasmodium falciparum
TKYEKGREKFPNWKCIPSGDKTDTRER

SEQ ID NO: 3276158 - protein, 24 aa, Plasmodium falciparum
TKYIKRFFSQALYFLPNFLYIPNH

SEQ ID NO: 3276159 - protein, 20 aa, Plasmodium falciparum
TKYKFNLYIRMEYCKSTLEN

SEQ ID NO: 3276160 - protein, 17 aa, Plasmodium falciparum
TKYPFSYIINTKKKKNK

SEQ ID NO: 3276161 - protein, 17 aa, Plasmodium falciparum
TKYQYSSILYKDIDLNG

SEQ ID NO: 3276162 - protein, 27 aa, Plasmodium falciparum
TKYSLLFKGNCESILINIFHVVMKSYV

SEQ ID NO: 3276163 - protein, 19 aa, Plasmodium falciparum
TLAFKDMQLESGFQIHKKN

SEQ ID NO: 3276164 - protein, 17 aa, Plasmodium falciparum
TLCDALHKFDIPIELPK

SEQ ID NO: 3276165 - protein, 20 aa, Plasmodium falciparum
TLCEECDAMINLKNKIIKKN

SEQ ID NO: 3276166 - protein, 17 aa, Plasmodium falciparum
TLCLFNIDEKIKILKDF

SEQ ID NO: 3276167 - protein, 20 aa, Plasmodium falciparum
TLCNIFKGLAHLPKDKFIAG

SEQ ID NO: 3276168 - protein, 18 aa, Plasmodium falciparum
TLCTPRFVIDRPVGDFIF

SEQ ID NO: 3276169 - protein, 23 aa, Plasmodium falciparum
TLDICNKLLLSNECKTNEKKKKT

SEQ ID NO: 3276170 - protein, 26 aa, Plasmodium falciparum
TLDSALLRPGRFDRIVYVPLPDINGR

SEQ ID NO: 3276171 - protein, 26 aa, Plasmodium falciparum
TLDSELKKKYELCKENNQLLENHHNN

SEQ ID NO: 3276172 - protein, 24 aa, Plasmodium falciparum
TLEYILCCYLRCTYKNYITNNLLN

SEQ ID NO: 3276173 - protein, 20 aa, Plasmodium falciparum
TLEYLKFTWYSHNKKILQEI

SEQ ID NO: 3276174 - protein, 58 aa, Plasmodium falciparum
TLFDLEYSKFYFSNKILRKSVKFYASWLLKKYIIDMTCVMASLVPKLFIDELKTNLMK

SEQ ID NO: 3276175 - protein, 21 aa, Plasmodium falciparum
TLFDYRKKLIKDILENEENEV

SEQ ID NO: 3276176 - protein, 22 aa, Plasmodium falciparum
TLFEIIKKSILIAYLNITFSND

SEQ ID NO: 3276177 - protein, 19 aa, Plasmodium falciparum
TLFFFININIPYKIHKNNL

SEQ ID NO: 3276178 - protein, 18 aa, Plasmodium falciparum
TLFFTLLCVIYMIVKEGS

SEQ ID NO: 3276179 - protein, 17 aa, Plasmodium falciparum
TLFKIQNVFILIIYIKL

SEQ ID NO: 3276180 - protein, 26 aa, Plasmodium falciparum
TLFKLICSGYMWLYSLINLYIQLLKS

SEQ ID NO: 3276181 - protein, 19 aa, Plasmodium falciparum
TLFPFFKEFINIDMNKIVD

SEQ ID NO: 3276182 - protein, 23 aa, Plasmodium falciparum
TLFPTLFSFFGIYILPFLYKSML

SEQ ID NO: 3276183 - protein, 19 aa, Plasmodium falciparum
TLGIYKKIYFYDFFFIYLL

SEQ ID NO: 3276184 - protein, 17 aa, Plasmodium falciparum
TLGQFFVFYSLRVYGSL

SEQ ID NO: 3276185 - protein, 33 aa, Plasmodium falciparum
TLHDLKLAYNMLPCKYYGFFLSNLCSTISTLSY

SEQ ID NO: 3276186 - protein, 26 aa, Plasmodium falciparum
TLHISISILILICFYSVIKTFTYVSL

SEQ ID NO: 3276187 - protein, 23 aa, Plasmodium falciparum
TLHRLKNVWYIYIIFIFSIYIIY

SEQ ID NO: 3276188 - protein, 30 aa, Plasmodium falciparum
TLHTFELYYLFHIFKKLLLKKKDIEDDLII

SEQ ID NO: 3276189 - protein, 26 aa, Plasmodium falciparum
TLIFTAMWRKLLLNKKINHIQLLGIL

SEQ ID NO: 3276190 - protein, 20 aa, Plasmodium falciparum
TLIHMKIIFSKILDMENHKK

SEQ ID NO: 3276191 - protein, 30 aa, Plasmodium falciparum
TLIKKCYRDKLIYGYVQWKLLDRKIFSKRF

SEQ ID NO: 3276192 - protein, 17 aa, Plasmodium falciparum
TLIKRYYFNNLKQQNSI

SEQ ID NO: 3276193 - protein, 18 aa, Plasmodium falciparum
TLILFLFILISLMKNYNM

SEQ ID NO: 3276194 - protein, 31 aa, Plasmodium falciparum
TLIPMSTFILYFVIHLFYSFFDKNLLTLYDN

SEQ ID NO: 3276195 - protein, 23 aa, Plasmodium falciparum
TLIRSKYKLNYDMVEDYIEDIYI

SEQ ID NO: 3276196 - protein, 17 aa, Plasmodium falciparum
TLISSTVSIVFIDHKRA

SEQ ID NO: 3276197 - protein, 25 aa, Plasmodium falciparum
TLITYRYMYIFSLINILKTTSVIIK

SEQ ID NO: 3276198 - protein, 22 aa, Plasmodium falciparum
TLKCMKGYEPHAISALYIANCS

SEQ ID NO: 3276199 - protein, 17 aa, Plasmodium falciparum
TLKEKKCLLSNKNVPNP

SEQ ID NO: 3276200 - protein, 27 aa, Plasmodium falciparum
TLKELLKHPWITGSLIRKKKKKKKKYI

SEQ ID NO: 3276201 - protein, 20 aa, Plasmodium falciparum
TLKIVDTFLTISVYENSLKD

SEQ ID NO: 3276202 - protein, 21 aa, Plasmodium falciparum
TLKKNMTSLEFLNIFHSKILI

SEQ ID NO: 3276203 - protein, 19 aa, Plasmodium falciparum
TLKKWKIEKDYYYNGLKIK

SEQ ID NO: 3276204 - protein, 18 aa, Plasmodium falciparum
TLKNCLCTEFFSTKNEGN

SEQ ID NO: 3276205 - protein, 28 aa, Plasmodium falciparum
TLKNCPRLKICLEETFNYYSCSIKNNNK

SEQ ID NO: 3276206 - protein, 32 aa, Plasmodium falciparum
TLKNFKIGHVFFYNHIIGICFLIKKKIENMKH

SEQ ID NO: 3276207 - protein, 18 aa, Plasmodium falciparum
TLKNFLLQQFKNRFIFKP

SEQ ID NO: 3276208 - protein, 18 aa, Plasmodium falciparum
TLKSRFWPFKTEKKEFNT

SEQ ID NO: 3276209 - protein, 19 aa, Plasmodium falciparum
TLLDCNFALYYNFKGNGPD

SEQ ID NO: 3276210 - protein, 19 aa, Plasmodium falciparum
TLLEYSRDINFHFFIFNLI

SEQ ID NO: 3276211 - protein, 24 aa, Plasmodium falciparum
TLLFCLNESCLIFILSYYYFLNIN

SEQ ID NO: 3276212 - protein, 26 aa, Plasmodium falciparum
TLLFFFYKFFVLRLLFILNSYNFFSQ

SEQ ID NO: 3276213 - protein, 20 aa, Plasmodium falciparum
TLLFQCFFGFFGGILNQNLG

SEQ ID NO: 3276214 - protein, 18 aa, Plasmodium falciparum
TLLFYLILLFYLKNFTIS

SEQ ID NO: 3276215 - protein, 37 aa, Plasmodium falciparum
TLLILLFKISYVFICLKWKEAFCLLLNIFKNENDEIL

SEQ ID NO: 3276216 - protein, 23 aa, Plasmodium falciparum
TLLKEGILHIMLNGIVEQNLKDE

SEQ ID NO: 3276217 - protein, 24 aa, Plasmodium falciparum
TLLKKKRCIEFLDLFSSNKRTRKI

SEQ ID NO: 3276218 - protein, 17 aa, Plasmodium falciparum
TLLKSIRSLIMIPQFYN

SEQ ID NO: 3276219 - protein, 45 aa, Plasmodium falciparum
TLLTCGLSIYFYPMIVRTLRCIIFLCGFNCKKFNHSTIQPFNHST

SEQ ID NO: 3276220 - protein, 19 aa, Plasmodium falciparum
TLMDMKLSLLLVEKYNLTI

SEQ ID NO: 3276221 - protein, 17 aa, Plasmodium falciparum
TLMEFYFAIYIIQFIES

SEQ ID NO: 3276222 - protein, 20 aa, Plasmodium falciparum
TLMKRRKFFRSVSIHDLKNN

SEQ ID NO: 3276223 - protein, 18 aa, Plasmodium falciparum
TLMRKESILQFFENITHY

SEQ ID NO: 3276224 - protein, 18 aa, Plasmodium falciparum
TLMWFSFLNIIIIVIAAI

SEQ ID NO: 3276225 - protein, 20 aa, Plasmodium falciparum
TLNDLLKCKEHFNQNLIKCK

SEQ ID NO: 3276226 - protein, 18 aa, Plasmodium falciparum
TLNGINLLTAEYIESISI

SEQ ID NO: 3276227 - protein, 24 aa, Plasmodium falciparum
TLNMKLLSLFLFSNKYFKYEEFYH

SEQ ID NO: 3276228 - protein, 18 aa, Plasmodium falciparum
TLNVYSLILPSSFIFTLI

SEQ ID NO: 3276229 - protein, 24 aa, Plasmodium falciparum
TLNYFIKRVWFNKVGPSREENYST

SEQ ID NO: 3276230 - protein, 20 aa, Plasmodium falciparum
TLPCNFYFYHFEASRGDLYK

SEQ ID NO: 3276231 - protein, 24 aa, Plasmodium falciparum
TLPFNFFFSYFFFKQIKFNLLMII

SEQ ID NO: 3276232 - protein, 24 aa, Plasmodium falciparum
TLQLTYFFFFLLWKDTYELYNNII

SEQ ID NO: 3276233 - protein, 24 aa, Plasmodium falciparum
TLQYRLPPVFWTRCKILKENKILQ

SEQ ID NO: 3276234 - protein, 18 aa, Plasmodium falciparum
TLRLWKLNFVKREKENKD

SEQ ID NO: 3276235 - protein, 30 aa, Plasmodium falciparum
TLRRKKAFPVFTKILLVSFLVWVLKCSNNC

SEQ ID NO: 3276236 - protein, 25 aa, Plasmodium falciparum
TLSFLKIILFNSIYLSIAIICRFLY

SEQ ID NO: 3276237 - protein, 24 aa, Plasmodium falciparum
TLSKEEFFFFVYIFPQHVKYSSKV

SEQ ID NO: 3276238 - protein, 17 aa, Plasmodium falciparum
TLSMKMTSFCFFIKDNI

SEQ ID NO: 3276239 - protein, 17 aa, Plasmodium falciparum
TLTNFALLQNRKLNLPK

SEQ ID NO: 3276240 - protein, 23 aa, Plasmodium falciparum
TLTNYIVPIVESFHDNDNLTILV

SEQ ID NO: 3276241 - protein, 25 aa, Plasmodium falciparum
TLTYCLCKFPIILIDQAQPNNINIE

SEQ ID NO: 3276242 - protein, 18 aa, Plasmodium falciparum
TLWELEYQKKLFLNILNI

SEQ ID NO: 3276243 - protein, 26 aa, Plasmodium falciparum
TLYEFTCPLCRSIANSFVVYIPKRYI

SEQ ID NO: 3276244 - protein, 30 aa, Plasmodium falciparum
TLYFLFFQFFYKYLVFHCEDIFKNFKSHIS

SEQ ID NO: 3276245 - protein, 21 aa, Plasmodium falciparum
TLYNCYGVIKIYYSKKYLFYF

SEQ ID NO: 3276246 - protein, 21 aa, Plasmodium falciparum
TLYNIDLFKIIVLKYNGNLYN

SEQ ID NO: 3276247 - protein, 19 aa, Plasmodium falciparum
TLYVMRTWGIHIKVNHKGI

SEQ ID NO: 3276248 - protein, 26 aa, Plasmodium falciparum
TMASFSRISLILSLASVIFSRLSNFF

SEQ ID NO: 3276249 - protein, 34 aa, Plasmodium falciparum
TMEDIRIVFDYLNIRDKNCINILFDVLGRNITLH

SEQ ID NO: 3276250 - protein, 26 aa, Plasmodium falciparum
TMFISYWTSPYVFRGIFYLIKAVFLP

SEQ ID NO: 3276251 - protein, 17 aa, Plasmodium falciparum
TMFSILIIFIVFIQCIY

SEQ ID NO: 3276252 - protein, 23 aa, Plasmodium falciparum
TMGSRKTYCYVIFVDNVDDEKNV

SEQ ID NO: 3276253 - protein, 17 aa, Plasmodium falciparum
TMIFMKMIYNYDVDHNK

SEQ ID NO: 3276254 - protein, 26 aa, Plasmodium falciparum
TMKELLKRWLEYFFEDYNRIQKKLKP

SEQ ID NO: 3276255 - protein, 17 aa, Plasmodium falciparum
TMKHILIAHILKIDVSN

SEQ ID NO: 3276256 - protein, 21 aa, Plasmodium falciparum
TMKKLSPYLWLLNKKCNDIEI

SEQ ID NO: 3276257 - protein, 18 aa, Plasmodium falciparum
TMLARSFADIGDIIRGKD

SEQ ID NO: 3276258 - protein, 17 aa, Plasmodium falciparum
TMLARSFADIGDIVRGK

SEQ ID NO: 3276259 - protein, 18 aa, Plasmodium falciparum
TMLARSFADIGDIVRGKD

SEQ ID NO: 3276260 - protein, 22 aa, Plasmodium falciparum
TMMRELEGLISKYVNRSNDNNY

SEQ ID NO: 3276261 - protein, 19 aa, Plasmodium falciparum
TMPGFDFIHDDVLQINYKE

SEQ ID NO: 3276262 - protein, 28 aa, Plasmodium falciparum
TMPICFPQCLATLIACPGFWIDDIEGPC

SEQ ID NO: 3276263 - protein, 44 aa, Plasmodium falciparum
TMRRKARHGDYKTKEDFGIELKRMFDNCRLYNAPTTIYFKYANE

SEQ ID NO: 3276264 - protein, 23 aa, Plasmodium falciparum
TMRRLGLLRAMFTLIKLIVSILF

SEQ ID NO: 3276265 - protein, 31 aa, Plasmodium falciparum
TNAIIDFGEKIVWVSFEFKNLHMLKKIKNNF

SEQ ID NO: 3276266 - protein, 20 aa, Plasmodium falciparum
TNCNFDHFFDNCLEIIQRYL

SEQ ID NO: 3276267 - protein, 46 aa, Plasmodium falciparum
TNCNGYMKCIPFYNNVSERWKRYNFIQLYIIRSALNIHVMSKYNML

SEQ ID NO: 3276268 - protein, 18 aa, Plasmodium falciparum
TNDLLKFVELPEMNQQND

SEQ ID NO: 3276269 - protein, 24 aa, Plasmodium falciparum
TNDTIEFFFYLVILHHNTGMLFQT

SEQ ID NO: 3276270 - protein, 20 aa, Plasmodium falciparum
TNDVPLFYCTTNDIINEGNK

SEQ ID NO: 3276271 - protein, 18 aa, Plasmodium falciparum
TNDYKNVCYMNNIHKEHI

SEQ ID NO: 3276272 - protein, 21 aa, Plasmodium falciparum
TNEIIELGKVLIFVFNFTIFY

SEQ ID NO: 3276273 - protein, 23 aa, Plasmodium falciparum
TNEKRWLYFDIEYDIINNYENKE

SEQ ID NO: 3276274 - protein, 18 aa, Plasmodium falciparum
TNEKYAYLYKNIAKYIQD

SEQ ID NO: 3276275 - protein, 20 aa, Plasmodium falciparum
TNELDLLVQYSCNLNISNPQ

SEQ ID NO: 3276276 - protein, 25 aa, Plasmodium falciparum
TNELVYKIVRLIIGITSNLTVSILT

SEQ ID NO: 3276277 - protein, 25 aa, Plasmodium falciparum
TNFISENKLFLFFSEIQNDIKNIIE

SEQ ID NO: 3276278 - protein, 33 aa, Plasmodium falciparum
TNFPVCIYKKICKRRSKELPTALNIYDSLDMLL

SEQ ID NO: 3276279 - protein, 19 aa, Plasmodium falciparum
TNFRLRKPTFFVILEQNVE

SEQ ID NO: 3276280 - protein, 33 aa, Plasmodium falciparum
TNFRSHYDPSCRNVFDYSMSIKEDFRVNCKNSI

SEQ ID NO: 3276281 - protein, 17 aa, Plasmodium falciparum
TNGELYIAIFSKKKKIM

SEQ ID NO: 3276282 - protein, 19 aa, Plasmodium falciparum
TNHILSIRYNDMSILENYH

SEQ ID NO: 3276283 - protein, 25 aa, Plasmodium falciparum
TNHKLSCFIGDSIIDLDAMLSTDIP

SEQ ID NO: 3276284 - protein, 19 aa, Plasmodium falciparum
TNICIRHIYDFNKLLLQKS

SEQ ID NO: 3276285 - protein, 25 aa, Plasmodium falciparum
TNICLNRLVKNKVIIKVPERKNKNF

SEQ ID NO: 3276286 - protein, 18 aa, Plasmodium falciparum
TNIFKYNKEFSIFLLTLI

SEQ ID NO: 3276287 - protein, 17 aa, Plasmodium falciparum
TNIIPLWKNEAEKSGRE

SEQ ID NO: 3276288 - protein, 23 aa, Plasmodium falciparum
TNIKFKVDISVFSLFLKNYFNNY

SEQ ID NO: 3276289 - protein, 26 aa, Plasmodium falciparum
TNIKKYESPFCVYPFINIKNKENIHI

SEQ ID NO: 3276290 - protein, 17 aa, Plasmodium falciparum
TNINLPFLIMGHTNTAK

SEQ ID NO: 3276291 - protein, 23 aa, Plasmodium falciparum
TNIVLKWAVAQSVTILAGLISYP

SEQ ID NO: 3276292 - protein, 26 aa, Plasmodium falciparum
TNIYGLRNSVKWSFYEIIETFNKLQH

SEQ ID NO: 3276293 - protein, 26 aa, Plasmodium falciparum
TNIYKFKWRPYDFLKLIYETIHNYNH

SEQ ID NO: 3276294 - protein, 18 aa, Plasmodium falciparum
TNKCRYIMGIGYIVDIIF

SEQ ID NO: 3276295 - protein, 21 aa, Plasmodium falciparum
TNKKRNIKYASLFNNNYHTTN

SEQ ID NO: 3276296 - protein, 36 aa, Plasmodium falciparum
TNKLFKKKFRYLSLKLKNILMSHCAGGLKTNHNKKI

SEQ ID NO: 3276297 - protein, 25 aa, Plasmodium falciparum
TNKRKKIFFFLFIKQECINNFLKIK

SEQ ID NO: 3276298 - protein, 26 aa, Plasmodium falciparum
TNKWILSCLIAWAIIDIIRYLFYSLN

SEQ ID NO: 3276299 - protein, 26 aa, Plasmodium falciparum
TNKYISLNNICMFDKMKYLIISKGIN

SEQ ID NO: 3276300 - protein, 28 aa, Plasmodium falciparum
TNKYKIKCIQIIDICFNQDFNIIDIREK

SEQ ID NO: 3276301 - protein, 24 aa, Plasmodium falciparum
TNLECSSDDFLECHNINKEKEHGM

SEQ ID NO: 3276302 - protein, 26 aa, Plasmodium falciparum
TNLFFIVKLFFDYVVEKVEYLLYNKE

SEQ ID NO: 3276303 - protein, 25 aa, Plasmodium falciparum
TNLLYRGINCMGFTTIINYDMPFDT

SEQ ID NO: 3276304 - protein, 24 aa, Plasmodium falciparum
TNLNFKLTYYLSIINMNTQYKDNI

SEQ ID NO: 3276305 - protein, 23 aa, Plasmodium falciparum
TNLNKIKRKMCTNKLEQQKQKQE

SEQ ID NO: 3276306 - protein, 17 aa, Plasmodium falciparum
TNLRKKKNSLFYNLKKY

SEQ ID NO: 3276307 - protein, 17 aa, Plasmodium falciparum
TNMCGVHDFNIKKMMIK

SEQ ID NO: 3276308 - protein, 28 aa, Plasmodium falciparum
TNMLKCKKPYLLHSFSIYSLFPGKVFFY

SEQ ID NO: 3276309 - protein, 23 aa, Plasmodium falciparum
TNMNEFEGFLGRNSMASNVVTSE

SEQ ID NO: 3276310 - protein, 23 aa, Plasmodium falciparum
TNMQILFIILNIYFTYIMDIFIK

SEQ ID NO: 3276311 - protein, 22 aa, Plasmodium falciparum
TNMSNNILCFSLISNLLKKNQN

SEQ ID NO: 3276312 - protein, 18 aa, Plasmodium falciparum
TNNDLSLVNNTICESIKK

SEQ ID NO: 3276313 - protein, 26 aa, Plasmodium falciparum
TNNKESDDLFCFNKRMSNLTNLINKD

SEQ ID NO: 3276314 - protein, 19 aa, Plasmodium falciparum
TNNLCKKVYIGINNIQILD

SEQ ID NO: 3276315 - protein, 26 aa, Plasmodium falciparum
TNNNCLLWCLIYLKGYLKKITKNLHH

SEQ ID NO: 3276316 - protein, 18 aa, Plasmodium falciparum
TNNNWKSMEYFHADISQI

SEQ ID NO: 3276317 - protein, 42 aa, Plasmodium falciparum
TNNYISVKIIKYILRFPHKFGLCLYGYILGFIYEHIYEDPTI

SEQ ID NO: 3276318 - protein, 19 aa, Plasmodium falciparum
TNPFFPLLLIKLYTTDKFI

SEQ ID NO: 3276319 - protein, 34 aa, Plasmodium falciparum
TNPKLKDFVLRPTYFRYLEEWGQNFCKERKKRLD

SEQ ID NO: 3276320 - protein, 17 aa, Plasmodium falciparum
TNPMYKYYHHCSILRKE

SEQ ID NO: 3276321 - protein, 24 aa, Plasmodium falciparum
TNPPEIISNIIYIQNFRHPSRFIS

SEQ ID NO: 3276322 - protein, 23 aa, Plasmodium falciparum
TNRKFTKLLIWILYDKDNKIKIC

SEQ ID NO: 3276323 - protein, 19 aa, Plasmodium falciparum
TNRKIEMLVNYIFSKKKIK

SEQ ID NO: 3276324 - protein, 22 aa, Plasmodium falciparum
TNRLKINIKKIFDQINQKYDDL

SEQ ID NO: 3276325 - protein, 39 aa, Plasmodium falciparum
TNRLKKEKDICCIAPSRIPICGKIRVFFFDKTGTLTDHK

SEQ ID NO: 3276326 - protein, 28 aa, Plasmodium falciparum
TNSLPSRYPCVFCMKKGIKYDNKYINII

SEQ ID NO: 3276327 - protein, 18 aa, Plasmodium falciparum
TNSLSLNERSSCIIHAYS

SEQ ID NO: 3276328 - protein, 30 aa, Plasmodium falciparum
TNSSKCGYEYFLKCNPINYNVVSSYEKNKK

SEQ ID NO: 3276329 - protein, 21 aa, Plasmodium falciparum
TNSYGLILIEGKLIFVKFLYI

SEQ ID NO: 3276330 - protein, 23 aa, Plasmodium falciparum
TNTCGACAPYRRLHLCHHNLESI

SEQ ID NO: 3276331 - protein, 23 aa, Plasmodium falciparum
TNVELKYIINLLMLIVNLKCDIH

SEQ ID NO: 3276332 - protein, 19 aa, Plasmodium falciparum
TNVGFKIPFHILINRYNIN

SEQ ID NO: 3276333 - protein, 17 aa, Plasmodium falciparum
TNVGNILDFLSEHYTWY

SEQ ID NO: 3276334 - protein, 31 aa, Plasmodium falciparum
TNVKIYYHILKKIPLSYIIAQLHIKKGQATN

SEQ ID NO: 3276335 - protein, 17 aa, Plasmodium falciparum
TNWCRVMKNEEDKYYLL

SEQ ID NO: 3276336 - protein, 30 aa, Plasmodium falciparum
TNYILKKWKKKSFISFYFKQPVILSEIKEQ

SEQ ID NO: 3276337 - protein, 25 aa, Plasmodium falciparum
TNYLFWLNGCSIFISKINNFKSPKY

SEQ ID NO: 3276338 - protein, 22 aa, Plasmodium falciparum
TNYPRNISFFFGKRKNNKIINL

SEQ ID NO: 3276339 - protein, 26 aa, Plasmodium falciparum
TNYYEYFKNIFFEYLLKIKTTTEKIK

SEQ ID NO: 3276340 - protein, 27 aa, Plasmodium falciparum
TNYYKWKEKLIFHFLKNAFVHIKDKKK

SEQ ID NO: 3276341 - protein, 23 aa, Plasmodium falciparum
TPASLWGDFAQYIWNGMICALTY

SEQ ID NO: 3276342 - protein, 27 aa, Plasmodium falciparum
TPDSGREWNDFMYSIGFNDIYKPFWNS

SEQ ID NO: 3276343 - protein, 23 aa, Plasmodium falciparum
TPEIHVIRPSDLMDKGENKSAGH

SEQ ID NO: 3276344 - protein, 21 aa, Plasmodium falciparum
TPFFITFLFNYFFIINTIIKF

SEQ ID NO: 3276345 - protein, 18 aa, Plasmodium falciparum
TPFYEAFVAFAQKEGIAA

SEQ ID NO: 3276346 - protein, 34 aa, Plasmodium falciparum
TPHIPNFLPNSIKKCLQKCFSFQPEDRPTAYEMY

SEQ ID NO: 3276347 - protein, 20 aa, Plasmodium falciparum
TPIECWRIRKKLREKNITDP

SEQ ID NO: 3276348 - protein, 19 aa, Plasmodium falciparum
TPIEILNIYYFKKKLYRYL

SEQ ID NO: 3276349 - protein, 17 aa, Plasmodium falciparum
TPIFLRILTLIFLINLF

SEQ ID NO: 3276350 - protein, 17 aa, Plasmodium falciparum
TPIKRITLDNVDNIEAQ

SEQ ID NO: 3276351 - protein, 17 aa, Plasmodium falciparum
TPILIKIIFCMLKSNIK

SEQ ID NO: 3276352 - protein, 33 aa, Plasmodium falciparum
TPKKKIKNIWPFKEGKGDLTFLGFQQSIKVGEY

SEQ ID NO: 3276353 - protein, 18 aa, Plasmodium falciparum
TPLCCKMVNEKYNYYNIS

SEQ ID NO: 3276354 - protein, 21 aa, Plasmodium falciparum
TPLDVCNTVKTALEGDLGEAC

SEQ ID NO: 3276355 - protein, 20 aa, Plasmodium falciparum
TPLFIKEIVNIFTILVKKLQ

SEQ ID NO: 3276356 - protein, 17 aa, Plasmodium falciparum
TPLMYFLIVSITAFVIY

SEQ ID NO: 3276357 - protein, 26 aa, Plasmodium falciparum
TPLSYMSVELYLFFEDVMKYVSKKEF

SEQ ID NO: 3276358 - protein, 18 aa, Plasmodium falciparum
TPLTLINFVFVPRIYQAT

SEQ ID NO: 3276359 - protein, 18 aa, Plasmodium falciparum
TPLTWYTLLYFIKNIDFL

SEQ ID NO: 3276360 - protein, 26 aa, Plasmodium falciparum
TPNIKNFIELFLLSREDILNWCSKNN

SEQ ID NO: 3276361 - protein, 23 aa, Plasmodium falciparum
TPNLRKGSLGFDSFKKLELGTLN

SEQ ID NO: 3276362 - protein, 26 aa, Plasmodium falciparum
TPPQFLRWIKEWGTNVCIQKEEHKEY

SEQ ID NO: 3276363 - protein, 25 aa, Plasmodium falciparum
TPQFLRWFIEWSDEFCRERKEKLDK

SEQ ID NO: 3276364 - protein, 23 aa, Plasmodium falciparum
TPQIDVCAIVKTALTTPGNLTQA

SEQ ID NO: 3276365 - protein, 21 aa, Plasmodium falciparum
TPSLIKHFISISLIIISFQIM

SEQ ID NO: 3276366 - protein, 35 aa, Plasmodium falciparum
TPVPEFSIVLLLQMELCKGYTLRKWLDRSTRSDKP

SEQ ID NO: 3276367 - protein, 22 aa, Plasmodium falciparum
TPYEFITFFLKFVQKIKKKKKI

SEQ ID NO: 3276368 - protein, 27 aa, Plasmodium falciparum
TQASCIKSYCYKNPLNLKTLEVLLKKN

SEQ ID NO: 3276369 - protein, 31 aa, Plasmodium falciparum
TQFVLRPPYFRYLEEWGETFCRQRTRMLAKI

SEQ ID NO: 3276370 - protein, 20 aa, Plasmodium falciparum
TQHICKQCLNTFYDEKEISL

SEQ ID NO: 3276371 - protein, 18 aa, Plasmodium falciparum
TQHNIDCVFRYFSSSLHD

SEQ ID NO: 3276372 - protein, 20 aa, Plasmodium falciparum
TQIFSIFFSFLIKKNEGSKM

SEQ ID NO: 3276373 - protein, 17 aa, Plasmodium falciparum
TQILRTTIYLILKGDIR

SEQ ID NO: 3276374 - protein, 21 aa, Plasmodium falciparum
TQKCNVHFWISLFYLGIYNNF

SEQ ID NO: 3276375 - protein, 23 aa, Plasmodium falciparum
TQKECLHSLSYLKDRINNNNNNN

SEQ ID NO: 3276376 - protein, 21 aa, Plasmodium falciparum
TQKFFCLAKKLGIYDDLEYKI

SEQ ID NO: 3276377 - protein, 34 aa, Plasmodium falciparum
TQKGILHYISFKFLCLCLYMIGFYYVFLNNSSEN

SEQ ID NO: 3276378 - protein, 24 aa, Plasmodium falciparum
TQKILLTFIFKYFVNTFGCITIKY

SEQ ID NO: 3276379 - protein, 24 aa, Plasmodium falciparum
TQKNRKSFLFFFFLYNKYFFGKQE

SEQ ID NO: 3276380 - protein, 29 aa, Plasmodium falciparum
TQLLKYKLNKFLLFFIRFLLVLEPLLPIY

SEQ ID NO: 3276381 - protein, 22 aa, Plasmodium falciparum
TQLNFLLFRIFYNEKNLSYFFK

SEQ ID NO: 3276382 - protein, 17 aa, Plasmodium falciparum
TQLQILKERCMVYQYNG

SEQ ID NO: 3276383 - protein, 17 aa, Plasmodium falciparum
TQLRDIITIKMCIDLNI

SEQ ID NO: 3276384 - protein, 18 aa, Plasmodium falciparum
TQNEIFHIYEIIHGNYSD

SEQ ID NO: 3276385 - protein, 28 aa, Plasmodium falciparum
TQRRMHLSICVFPNFHFYDNKLKTANVT

SEQ ID NO: 3276386 - protein, 18 aa, Plasmodium falciparum
TQTFHLKNLIKINECYYD

SEQ ID NO: 3276387 - protein, 24 aa, Plasmodium falciparum
TQTKKKKVCIFNMGSMLFNVINAI

SEQ ID NO: 3276388 - protein, 25 aa, Plasmodium falciparum
TQVFREARPGGGFKAYEEKYESKHY

SEQ ID NO: 3276389 - protein, 17 aa, Plasmodium falciparum
TQVIEMFSSYLITKPIR

SEQ ID NO: 3276390 - protein, 17 aa, Plasmodium falciparum
TQVPQFLYEYGFTSNDY

SEQ ID NO: 3276391 - protein, 24 aa, Plasmodium falciparum
TQWIKEWHGEFLLERDNRSKLPKS

SEQ ID NO: 3276392 - protein, 20 aa, Plasmodium falciparum
TQYRICAMAYLGMYCASLFP

SEQ ID NO: 3276393 - protein, 20 aa, Plasmodium falciparum
TRENLSLSLLSFFLEDYKSS

SEQ ID NO: 3276394 - protein, 25 aa, Plasmodium falciparum
TREQIKCAISYDVLNISNIINSLEK

SEQ ID NO: 3276395 - protein, 21 aa, Plasmodium falciparum
TRGKKKFLWKSLIDEEEEEEE

SEQ ID NO: 3276396 - protein, 18 aa, Plasmodium falciparum
TRGRFGVTVAPAECVLSN

SEQ ID NO: 3276397 - protein, 49 aa, Plasmodium falciparum
TRIDYFKIHMLLKLICTFTPCYNSRIVKISCFFMIFIIMNKKINRYKQD

SEQ ID NO: 3276398 - protein, 23 aa, Plasmodium falciparum
TRISNNFFYYNFNNFLYLYKYNY

SEQ ID NO: 3276399 - protein, 26 aa, Plasmodium falciparum
TRIYHVVFILKLFFHNLLFISCTNNS

SEQ ID NO: 3276400 - protein, 22 aa, Plasmodium falciparum
TRKELIEIVKLLMSIYAELKLY

SEQ ID NO: 3276401 - protein, 25 aa, Plasmodium falciparum
TRKRMLGKIKHECRGDKVCSGYGEN

SEQ ID NO: 3276402 - protein, 24 aa, Plasmodium falciparum
TRKRWWGKYRKVIWKGMLCGIQNK

SEQ ID NO: 3276403 - protein, 17 aa, Plasmodium falciparum
TRLKAYSKYINEHFNDN

SEQ ID NO: 3276404 - protein, 25 aa, Plasmodium falciparum
TRLKLNFITCNKFHAYVLCNLMTNI

SEQ ID NO: 3276405 - protein, 17 aa, Plasmodium falciparum
TRLVTNIIEHFGKKNTT

SEQ ID NO: 3276406 - protein, 25 aa, Plasmodium falciparum
TRNNCSYVSYPLCINECKGRMDNSV

SEQ ID NO: 3276407 - protein, 19 aa, Plasmodium falciparum
TRNVNYLKLMYIISNVILP

SEQ ID NO: 3276408 - protein, 20 aa, Plasmodium falciparum
TRRFSIHNKDIFKYDYPEYL

SEQ ID NO: 3276409 - protein, 23 aa, Plasmodium falciparum
TRRLGKIKGECKVDDSGSGRGGV

SEQ ID NO: 3276410 - protein, 19 aa, Plasmodium falciparum
TRRLLCECELYAPANYDSV

SEQ ID NO: 3276411 - protein, 24 aa, Plasmodium falciparum
TRRNGLRYVLKRRTILSVFAVICM

SEQ ID NO: 3276412 - protein, 26 aa, Plasmodium falciparum
TRRNSYVFKCPIYKNIHKSGYTLTNN

SEQ ID NO: 3276413 - protein, 18 aa, Plasmodium falciparum
TRRWKRFLHMKGSNNRNI

SEQ ID NO: 3276414 - protein, 24 aa, Plasmodium falciparum
TRTLPRNKRPAIVVDDIIIHPIQI

SEQ ID NO: 3276415 - protein, 37 aa, Plasmodium falciparum
TRVDEETKFDICADFFLSINIDLLWEEFNKTMQVINN

SEQ ID NO: 3276416 - protein, 23 aa, Plasmodium falciparum
TRYKKQFLDEWYDMLKYMDKILN

SEQ ID NO: 3276417 - protein, 22 aa, Plasmodium falciparum
TSACIYFDWSAIRKLLLHVGKY

SEQ ID NO: 3276418 - protein, 20 aa, Plasmodium falciparum
TSALEFFNIHGLAREEVINN

SEQ ID NO: 3276419 - protein, 23 aa, Plasmodium falciparum
TSCSVWCRMYEKWIDNQKKEFLK

SEQ ID NO: 3276420 - protein, 22 aa, Plasmodium falciparum
TSDFYFMCHFFISIFQMFSLFY

SEQ ID NO: 3276421 - protein, 24 aa, Plasmodium falciparum
TSDKEIMLHGGMMGGVNYSDMEHD

SEQ ID NO: 3276422 - protein, 21 aa, Plasmodium falciparum
TSDYLVNCTFIEIKYSAKELI

SEQ ID NO: 3276423 - protein, 17 aa, Plasmodium falciparum
TSEEFLKSLQLITHEDI

SEQ ID NO: 3276424 - protein, 24 aa, Plasmodium falciparum
TSEELFLEKLNKIWKKYDKENNKY

SEQ ID NO: 3276425 - protein, 18 aa, Plasmodium falciparum
TSEKLKNFVENEEEEENN

SEQ ID NO: 3276426 - protein, 24 aa, Plasmodium falciparum
TSEKWIFHHSIIYFHMFHFLFQYT

SEQ ID NO: 3276427 - protein, 27 aa, Plasmodium falciparum
TSELILKTLCTFDQIIIYMQHQMQITN

SEQ ID NO: 3276428 - protein, 17 aa, Plasmodium falciparum
TSENYFLNRNFLSSQKP

SEQ ID NO: 3276429 - protein, 33 aa, Plasmodium falciparum
TSEQVYCRCLQFLKLIHALAINYFASLEKINEQ

SEQ ID NO: 3276430 - protein, 20 aa, Plasmodium falciparum
TSEVVVIFPSYFFIKHFKIL

SEQ ID NO: 3276431 - protein, 30 aa, Plasmodium falciparum
TSFDICKQVLKPFLFLYVDIFDSFIQALKK

SEQ ID NO: 3276432 - protein, 19 aa, Plasmodium falciparum
TSFENCFHSKLGNKINTTS

SEQ ID NO: 3276433 - protein, 20 aa, Plasmodium falciparum
TSFHYNNFVLPYPYESNTQH

SEQ ID NO: 3276434 - protein, 24 aa, Plasmodium falciparum
TSFMDKLKCYFFHKNKSNDNEKNK

SEQ ID NO: 3276435 - protein, 24 aa, Plasmodium falciparum
TSFNEIFKNYAFNFSFYNPYKDPK

SEQ ID NO: 3276436 - protein, 17 aa, Plasmodium falciparum
TSFNFSSNIYLYLQSFH

SEQ ID NO: 3276437 - protein, 23 aa, Plasmodium falciparum
TSFPYHFSSLYAGSVFSYLLAEV

SEQ ID NO: 3276438 - protein, 18 aa, Plasmodium falciparum
TSGIFKGIRKEQWKCDNV

SEQ ID NO: 3276439 - protein, 21 aa, Plasmodium falciparum
TSHKFLKIFLFLLISLFLMNI

SEQ ID NO: 3276440 - protein, 23 aa, Plasmodium falciparum
TSHLSFYLILLIILYSKEEKFKN

SEQ ID NO: 3276441 - protein, 18 aa, Plasmodium falciparum
TSHNTHWVGIQVVRRPIW

SEQ ID NO: 3276442 - protein, 23 aa, Plasmodium falciparum
TSIGGPLCSYVSYHLSNFNKKSN

SEQ ID NO: 3276443 - protein, 17 aa, Plasmodium falciparum
TSIGYIFHYTGLYEFTI

SEQ ID NO: 3276444 - protein, 25 aa, Plasmodium falciparum
TSILHWRKPELGLRRNIDIAMMLCS

SEQ ID NO: 3276445 - protein, 17 aa, Plasmodium falciparum
TSISGRKCLHWNSLNME

SEQ ID NO: 3276446 - protein, 26 aa, Plasmodium falciparum
TSISLSLKCVHDFLYGANIMFACIFL

SEQ ID NO: 3276447 - protein, 26 aa, Plasmodium falciparum
TSIYRRFLNLHFYKNCNKERKNSESG

SEQ ID NO: 3276448 - protein, 28 aa, Plasmodium falciparum
TSIYYKINILNILIICIKQTYNNNKSIE

SEQ ID NO: 3276449 - protein, 24 aa, Plasmodium falciparum
TSKKLKIKYLKIILKEIENTCHFI

SEQ ID NO: 3276450 - protein, 18 aa, Plasmodium falciparum
TSKLFKGIRKQNWTCKFN

SEQ ID NO: 3276451 - protein, 18 aa, Plasmodium falciparum
TSLFYIYMILLRNIEERY

SEQ ID NO: 3276452 - protein, 19 aa, Plasmodium falciparum
TSLHFCIKDSHLSCFFFQK

SEQ ID NO: 3276453 - protein, 24 aa, Plasmodium falciparum
TSLHTWQMWGCLITVGTLPFIKNV

SEQ ID NO: 3276454 - protein, 31 aa, Plasmodium falciparum
TSLIICAYLFLKSKFSYYSFEQLYINSYAQI

SEQ ID NO: 3276455 - protein, 23 aa, Plasmodium falciparum
TSLKSCPLYTIYGSVKDAICSFA

SEQ ID NO: 3276456 - protein, 23 aa, Plasmodium falciparum
TSLLNFFFLFFINHISFLIKHKK

SEQ ID NO: 3276457 - protein, 35 aa, Plasmodium falciparum
TSLLNLFLMQFLKLFPIPWLKKKKCHFKYIKQINT

SEQ ID NO: 3276458 - protein, 20 aa, Plasmodium falciparum
TSLMKENHLSGIINNTIDME

SEQ ID NO: 3276459 - protein, 26 aa, Plasmodium falciparum
TSLVMICLNKAFYLSYLCMYQKLIEK

SEQ ID NO: 3276460 - protein, 20 aa, Plasmodium falciparum
TSLVNTKWIYGLVINTGNRT

SEQ ID NO: 3276461 - protein, 20 aa, Plasmodium falciparum
TSLWFFRIITYLILCTEFYY

SEQ ID NO: 3276462 - protein, 18 aa, Plasmodium falciparum
TSLWKSNMLFISGNIFIR

SEQ ID NO: 3276463 - protein, 21 aa, Plasmodium falciparum
TSMVFFCIIFTILILTIYNLM

SEQ ID NO: 3276464 - protein, 24 aa, Plasmodium falciparum
TSNCPKKKFEIVDLDTKFTEFNSN

SEQ ID NO: 3276465 - protein, 29 aa, Plasmodium falciparum
TSNFPLVFMCVYKPPYVHVLAKRNYANKN

SEQ ID NO: 3276466 - protein, 24 aa, Plasmodium falciparum
TSNKIKYIFKYRNNINDAITLSEI

SEQ ID NO: 3276467 - protein, 21 aa, Plasmodium falciparum
TSNLMFYNSVIVRLKKKTTKI

SEQ ID NO: 3276468 - protein, 25 aa, Plasmodium falciparum
TSNPSNCFSLGIKIEELFLNMPKEG

SEQ ID NO: 3276469 - protein, 30 aa, Plasmodium falciparum
TSNSLFHKMMCAFKKKLFKNEQVIEKDIRN

SEQ ID NO: 3276470 - protein, 23 aa, Plasmodium falciparum
TSPIRRYIDIVIHRILQSLIDQD

SEQ ID NO: 3276471 - protein, 25 aa, Plasmodium falciparum
TSPIRRYPDILVHRVIKKIISDEQK

SEQ ID NO: 3276472 - protein, 25 aa, Plasmodium falciparum
TSRFLSEPLLEFDTVFDVFKDTFLK

SEQ ID NO: 3276473 - protein, 36 aa, Plasmodium falciparum
TSRVPLGGFKNLMGMRGAQKMIIYKAYGEDRLPTAH

SEQ ID NO: 3276474 - protein, 21 aa, Plasmodium falciparum
TSSCYRCLKSFNNHSQNNDCD

SEQ ID NO: 3276475 - protein, 17 aa, Plasmodium falciparum
TSSFFLSNQFLYDDDEI

SEQ ID NO: 3276476 - protein, 21 aa, Plasmodium falciparum
TSSHIRRGCLNIDKQHMNELN

SEQ ID NO: 3276477 - protein, 19 aa, Plasmodium falciparum
TSSICNIDFNIDHINIKEL

SEQ ID NO: 3276478 - protein, 26 aa, Plasmodium falciparum
TSSKCTKFPFNIHDFKKYSINIYFLV

SEQ ID NO: 3276479 - protein, 19 aa, Plasmodium falciparum
TSSNLCFKGSEGYLCNNCS

SEQ ID NO: 3276480 - protein, 23 aa, Plasmodium falciparum
TSSRPKFCPEIPQPEPEPEPFPE

SEQ ID NO: 3276481 - protein, 19 aa, Plasmodium falciparum
TSSYCLKSVKSLLFRIYLN

SEQ ID NO: 3276482 - protein, 22 aa, Plasmodium falciparum
TSSYELLHCDTHDSNYNRITSY

SEQ ID NO: 3276483 - protein, 18 aa, Plasmodium falciparum
TSTFAQRFILGEKKFEKF

SEQ ID NO: 3276484 - protein, 20 aa, Plasmodium falciparum
TSTPFIFYRLLKPCASVGFL

SEQ ID NO: 3276485 - protein, 21 aa, Plasmodium falciparum
TSVFCGFLYDHIGPKFTAIIG

SEQ ID NO: 3276486 - protein, 17 aa, Plasmodium falciparum
TSVFFKNKHKFIKLRNC

SEQ ID NO: 3276487 - protein, 22 aa, Plasmodium falciparum
TSVFYKDYLKRNNINNQLILYN

SEQ ID NO: 3276488 - protein, 36 aa, Plasmodium falciparum
TSVIPKISFYFYLAHELMHAYIWLTKMEKSHNYKHI

SEQ ID NO: 3276489 - protein, 27 aa, Plasmodium falciparum
TSVISGITICKIVAHFTLLILKNPDSS

SEQ ID NO: 3276490 - protein, 19 aa, Plasmodium falciparum
TSWYLLGICRNNILKNSMV

SEQ ID NO: 3276491 - protein, 18 aa, Plasmodium falciparum
TTCLTCTGSEFNKEEKDE

SEQ ID NO: 3276492 - protein, 29 aa, Plasmodium falciparum
TTCSFPTKYKCTFSTLFMYTSYEKYNKPS

SEQ ID NO: 3276493 - protein, 22 aa, Plasmodium falciparum
TTETYLFFHISFDIIKYNNQYL

SEQ ID NO: 3276494 - protein, 25 aa, Plasmodium falciparum
TTFPWPIKFVFKSSLLKVPIGGQAL

SEQ ID NO: 3276495 - protein, 26 aa, Plasmodium falciparum
TTGSIFYGCILLIYRDIKFRELNKNN

SEQ ID NO: 3276496 - protein, 21 aa, Plasmodium falciparum
TTHNKCLRTEHNYDKKYRDVI

SEQ ID NO: 3276497 - protein, 25 aa, Plasmodium falciparum
TTHYRNIHESEIFDYQWSIPTEPKG

SEQ ID NO: 3276498 - protein, 17 aa, Plasmodium falciparum
TTIAAWVRKSKLHPRGP

SEQ ID NO: 3276499 - protein, 26 aa, Plasmodium falciparum
TTIDALAKMIICMMKLIDIQQISPFV

SEQ ID NO: 3276500 - protein, 35 aa, Plasmodium falciparum
TTIPVDLSLFFIFRKEYLKSVLITISQNFPVDSLL

SEQ ID NO: 3276501 - protein, 18 aa, Plasmodium falciparum
TTIYLILKGDIRVFQIFY

SEQ ID NO: 3276502 - protein, 27 aa, Plasmodium falciparum
TTKCKIEIANFISFYFFFLHIKDILNK

SEQ ID NO: 3276503 - protein, 20 aa, Plasmodium falciparum
TTLFMRIIILPLTISSERDR

SEQ ID NO: 3276504 - protein, 22 aa, Plasmodium falciparum
TTLKTAMGYITKFKDFIKNKSE

SEQ ID NO: 3276505 - protein, 18 aa, Plasmodium falciparum
TTLLLLCRSTEWVSTNHI

SEQ ID NO: 3276506 - protein, 24 aa, Plasmodium falciparum
TTMMAVMCACIFIGPVHICALKNF

SEQ ID NO: 3276507 - protein, 21 aa, Plasmodium falciparum
TTNNILICISFNSVDYPLEIN

SEQ ID NO: 3276508 - protein, 19 aa, Plasmodium falciparum
TTNSFPLFDSYCLNYEGAK

SEQ ID NO: 3276509 - protein, 18 aa, Plasmodium falciparum
TTNVIGLFVKKISSVKTH

SEQ ID NO: 3276510 - protein, 17 aa, Plasmodium falciparum
TTPKDWWETYGKDIWEG

SEQ ID NO: 3276511 - protein, 26 aa, Plasmodium falciparum
TTPNSIIFKLNFEDFQSTLNIFECLC

SEQ ID NO: 3276512 - protein, 19 aa, Plasmodium falciparum
TTPYRLGIYAFNIRPNDLY

SEQ ID NO: 3276513 - protein, 39 aa, Plasmodium falciparum
TTRKCTFYIFKLCFSCYMLKYGYCIIDLSKACLTNYVLL

SEQ ID NO: 3276514 - protein, 30 aa, Plasmodium falciparum
TTSKTFVHLFCVIFFISNVFCYNIYNMNYW

SEQ ID NO: 3276515 - protein, 18 aa, Plasmodium falciparum
TTSPKRSSSGIIKNDMEL

SEQ ID NO: 3276516 - protein, 25 aa, Plasmodium falciparum
TTTYRLTQLYFYITVTIQMIQIFKS

SEQ ID NO: 3276517 - protein, 25 aa, Plasmodium falciparum
TVDLYRTISMLGYALLPLVILSLIS

SEQ ID NO: 3276518 - protein, 23 aa, Plasmodium falciparum
TVGQRPVILIGYSVGARVIFYCL

SEQ ID NO: 3276519 - protein, 25 aa, Plasmodium falciparum
TVGVNEYFRGLSLASYLIEYTIYFF

SEQ ID NO: 3276520 - protein, 18 aa, Plasmodium falciparum
TVINEFNVLLELQLCILD

SEQ ID NO: 3276521 - protein, 24 aa, Plasmodium falciparum
TVISILPRREMQFLELLVSKLLIK

SEQ ID NO: 3276522 - protein, 21 aa, Plasmodium falciparum
TVKWFPWLVALLIIFWFIINV

SEQ ID NO: 3276523 - protein, 23 aa, Plasmodium falciparum
TVLLHKCTYIFHKLLKNSDKLLY

SEQ ID NO: 3276524 - protein, 21 aa, Plasmodium falciparum
TVLLIPWYVAFNLISTYCKES

SEQ ID NO: 3276525 - protein, 27 aa, Plasmodium falciparum
TVLWISCAFIFLIIKIYKNWKGYRNYD

SEQ ID NO: 3276526 - protein, 24 aa, Plasmodium falciparum
TVLYDIFPNITFPNYIFVNTKDIV

SEQ ID NO: 3276527 - protein, 19 aa, Plasmodium falciparum
TVNAYRINRYFMYRNTLVA

SEQ ID NO: 3276528 - protein, 34 aa, Plasmodium falciparum
TVNGSFIFVSPLFRVPRNFTLFKKVMLNLLKRGV

SEQ ID NO: 3276529 - protein, 20 aa, Plasmodium falciparum
TVNYICYFDKAVIINSIVSL

SEQ ID NO: 3276530 - protein, 22 aa, Plasmodium falciparum
TVPEIAYTLVINNFLNDLLKLI

SEQ ID NO: 3276531 - protein, 21 aa, Plasmodium falciparum
TVRARGKLRYGNRCTDCLFAC

SEQ ID NO: 3276532 - protein, 25 aa, Plasmodium falciparum
TVRIIRDHMRYSFYVENICSKKMRH

SEQ ID NO: 3276533 - protein, 17 aa, Plasmodium falciparum
TVRRICLELQRKNKKFF

SEQ ID NO: 3276534 - protein, 21 aa, Plasmodium falciparum
TVSCSLLFMIKNVCFIIIHGA

SEQ ID NO: 3276535 - protein, 25 aa, Plasmodium falciparum
TVSSICFVSSLAFLKGFSNLYHHLM

SEQ ID NO: 3276536 - protein, 19 aa, Plasmodium falciparum
TVVPLKYALHKIFISEKKT

SEQ ID NO: 3276537 - protein, 19 aa, Plasmodium falciparum
TVYETIEFTAKLKLDIRDK

SEQ ID NO: 3276538 - protein, 34 aa, Plasmodium falciparum
TVYYTPDDCVFCTQLNCTIKKRWDKKKKKKLKSA

SEQ ID NO: 3276539 - protein, 20 aa, Plasmodium falciparum
TVYYYKWIKSKIVIDIRNSF

SEQ ID NO: 3276540 - protein, 22 aa, Plasmodium falciparum
TWIPGHSFRLKMIFSNIKHYFK

SEQ ID NO: 3276541 - protein, 22 aa, Plasmodium falciparum
TWKHILGMAMLIIPTFYFKNLI

SEQ ID NO: 3276542 - protein, 19 aa, Plasmodium falciparum
TWNNIPFEIYINDKLDITL

SEQ ID NO: 3276543 - protein, 26 aa, Plasmodium falciparum
TYAAMKCYRYLSDHFTRIELLVDLCT

SEQ ID NO: 3276544 - protein, 22 aa, Plasmodium falciparum
TYCKIMLMIIMLISLRTRCDTN

SEQ ID NO: 3276545 - protein, 41 aa, Plasmodium falciparum
TYDVISLYCVYIMNLYYAYIMYKRNIVTLYVYIQRIQTFLW

SEQ ID NO: 3276546 - protein, 17 aa, Plasmodium falciparum
TYEEFIYHLDLYKKHIF

SEQ ID NO: 3276547 - protein, 17 aa, Plasmodium falciparum
TYEELLLNFMLISLCYY

SEQ ID NO: 3276548 - protein, 27 aa, Plasmodium falciparum
TYEKRIYYIFFYRLYKNFGSVLNSSNK

SEQ ID NO: 3276549 - protein, 17 aa, Plasmodium falciparum
TYESFKTYCNFETGDKY

SEQ ID NO: 3276550 - protein, 18 aa, Plasmodium falciparum
TYEYLFYLLKNYKLPYYS

SEQ ID NO: 3276551 - protein, 35 aa, Plasmodium falciparum
TYFLFKMKSFLIIFMLRFFLSLVIILIFIYPVFRT

SEQ ID NO: 3276552 - protein, 19 aa, Plasmodium falciparum
TYFMVPFFLFENIDFSHNE

SEQ ID NO: 3276553 - protein, 22 aa, Plasmodium falciparum
TYFRYLEEWGETFCRQRTRMLA

SEQ ID NO: 3276554 - protein, 23 aa, Plasmodium falciparum
TYGIPIRIGFLLGSAAFLFFYLK

SEQ ID NO: 3276555 - protein, 17 aa, Plasmodium falciparum
TYHRIINRWKDGKKNTG

SEQ ID NO: 3276556 - protein, 17 aa, Plasmodium falciparum
TYIAIVECFLLGSIFDT

SEQ ID NO: 3276557 - protein, 18 aa, Plasmodium falciparum
TYIKKRDLQKFKNKIKKI

SEQ ID NO: 3276558 - protein, 22 aa, Plasmodium falciparum
TYINCIKKYLLIYENKIRNIIN

SEQ ID NO: 3276559 - protein, 27 aa, Plasmodium falciparum
TYINSFKMKFSIIIGFIHMTFGVLMKG

SEQ ID NO: 3276560 - protein, 19 aa, Plasmodium falciparum
TYITHLFNLFIWKIKMEKN

SEQ ID NO: 3276561 - protein, 24 aa, Plasmodium falciparum
TYITIGYLFKLFLHHKNMYKKFTH

SEQ ID NO: 3276562 - protein, 24 aa, Plasmodium falciparum
TYIYKNVYLYFYFIFEKYQKKNKK

SEQ ID NO: 3276563 - protein, 21 aa, Plasmodium falciparum
TYIYLCHRINSSISNMINFQH

SEQ ID NO: 3276564 - protein, 22 aa, Plasmodium falciparum
TYKCKNEILNIAGKRKKKKKKK

SEQ ID NO: 3276565 - protein, 17 aa, Plasmodium falciparum
TYKHVREPFGVARNPGM

SEQ ID NO: 3276566 - protein, 21 aa, Plasmodium falciparum
TYKKWQCSFFSTSEEKKYKIE

SEQ ID NO: 3276567 - protein, 24 aa, Plasmodium falciparum
TYKLYKSKMHIIPYSLLVGDYILT

SEQ ID NO: 3276568 - protein, 26 aa, Plasmodium falciparum
TYKRGRKIFNDFLCSNILKYNLKITF

SEQ ID NO: 3276569 - protein, 23 aa, Plasmodium falciparum
TYKRKCLYLGMNKLNNICKESLK

SEQ ID NO: 3276570 - protein, 18 aa, Plasmodium falciparum
TYKVIKYNIYFLNEIYIV

SEQ ID NO: 3276571 - protein, 39 aa, Plasmodium falciparum
TYKYELKGNILAKFKSPHGIIYRGHIKNIFRNKNNILSY

SEQ ID NO: 3276572 - protein, 24 aa, Plasmodium falciparum
TYLALCVIPAFFIANFLDDKTNTH

SEQ ID NO: 3276573 - protein, 27 aa, Plasmodium falciparum
TYLESAPLITKLVCLIINTKIEKSELV

SEQ ID NO: 3276574 - protein, 24 aa, Plasmodium falciparum
TYLHKHLIDHLLFNVTHKESKKND

SEQ ID NO: 3276575 - protein, 18 aa, Plasmodium falciparum
TYLILPIFIDIIKILDVY

SEQ ID NO: 3276576 - protein, 24 aa, Plasmodium falciparum
TYLIRSSIILLIFSNLFFCKFINF

SEQ ID NO: 3276577 - protein, 19 aa, Plasmodium falciparum
TYLKHYIYHYYLFNYDFTF

SEQ ID NO: 3276578 - protein, 19 aa, Plasmodium falciparum
TYLLFLKKNFYQIDHFYDA

SEQ ID NO: 3276579 - protein, 17 aa, Plasmodium falciparum
TYLNVTLNINYVFLQII

SEQ ID NO: 3276580 - protein, 19 aa, Plasmodium falciparum
TYLQITVKSINTFLDFFIS

SEQ ID NO: 3276581 - protein, 21 aa, Plasmodium falciparum
TYLQRKWKSLTHISDKDKSSN

SEQ ID NO: 3276582 - protein, 19 aa, Plasmodium falciparum
TYLSLLLFIVHIFYYIINH

SEQ ID NO: 3276583 - protein, 19 aa, Plasmodium falciparum
TYLYYKYLNIFYVSNTYSV

SEQ ID NO: 3276584 - protein, 22 aa, Plasmodium falciparum
TYMRYEKMIHFVTFHDYLQLFV

SEQ ID NO: 3276585 - protein, 26 aa, Plasmodium falciparum
TYNCFRKQRFTSMHYIAGGGIIALLL

SEQ ID NO: 3276586 - protein, 35 aa, Plasmodium falciparum
TYNDFFYFWIRRFLNDSMYWRGKIGGCLKNKSEKC

SEQ ID NO: 3276587 - protein, 27 aa, Plasmodium falciparum
TYNDFFYYWVAHMLKDSIHWRTKKLDK

SEQ ID NO: 3276588 - protein, 18 aa, Plasmodium falciparum
TYNFNIQNVQSFSSTKTN

SEQ ID NO: 3276589 - protein, 34 aa, Plasmodium falciparum
TYNIHATQSLVLYQRLFIPEIYNALNTSNIMINI

SEQ ID NO: 3276590 - protein, 24 aa, Plasmodium falciparum
TYNMFKENVDIFINKIKRESLLKI

SEQ ID NO: 3276591 - protein, 19 aa, Plasmodium falciparum
TYNRLGIALYKLINLLPNE

SEQ ID NO: 3276592 - protein, 25 aa, Plasmodium falciparum
TYNSICKFYLLYIPTIFNMYKYSSL

SEQ ID NO: 3276593 - protein, 24 aa, Plasmodium falciparum
TYNYYFPFICKNKYGGISSNDGED

SEQ ID NO: 3276594 - protein, 19 aa, Plasmodium falciparum
TYPDFFNYLYLESDPYHLI

SEQ ID NO: 3276595 - protein, 25 aa, Plasmodium falciparum
TYPFKELYSKLLLNKYHFLIIDNQV

SEQ ID NO: 3276596 - protein, 23 aa, Plasmodium falciparum
TYPLKYYLENSFVYEKDKEKKNT

SEQ ID NO: 3276597 - protein, 26 aa, Plasmodium falciparum
TYRDREFLSDFSLNFLYEVVKSKNSF

SEQ ID NO: 3276598 - protein, 26 aa, Plasmodium falciparum
TYRLLLKNLGAWIGIITIGRNKPLMS

SEQ ID NO: 3276599 - protein, 17 aa, Plasmodium falciparum
TYSIPHLIVTEFINNVM

SEQ ID NO: 3276600 - protein, 25 aa, Plasmodium falciparum
TYSISCTFFASACIINRLSYPIKLK

SEQ ID NO: 3276601 - protein, 19 aa, Plasmodium falciparum
TYSNINYYYSKYIKNIFHF

SEQ ID NO: 3276602 - protein, 20 aa, Plasmodium falciparum
TYSNVCRFMTNIFFNNNGLH

SEQ ID NO: 3276603 - protein, 25 aa, Plasmodium falciparum
TYSSLRKRIKLMSEMFKKYEQKYFI

SEQ ID NO: 3276604 - protein, 24 aa, Plasmodium falciparum
TYTLIGMGFLEFLGIICVLMSAVL

SEQ ID NO: 3276605 - protein, 30 aa, Plasmodium falciparum
TYVHLVHFFLLKVAETFSFYEGDMKEKFLD

SEQ ID NO: 3276606 - protein, 18 aa, Plasmodium falciparum
TYVYLKNIIKRIFKNDYY

SEQ ID NO: 3276607 - protein, 17 aa, Plasmodium falciparum
TYYAQVYLSLTFNLGYF

SEQ ID NO: 3276608 - protein, 33 aa, Plasmodium falciparum
TYYCLKNRLKKFCFTLFFSVTLKNLIKCYICKI

SEQ ID NO: 3276609 - protein, 24 aa, Plasmodium falciparum
TYYEDIHVLLFYKLSREMLCNQYI

SEQ ID NO: 3276610 - protein, 17 aa, Plasmodium falciparum
TYYFFHSLNTYYEKKFK

SEQ ID NO: 3276611 - protein, 17 aa, Plasmodium falciparum
TYYIQFIYLITLQYNVL

SEQ ID NO: 3276612 - protein, 18 aa, Plasmodium falciparum
TYYIQFIYLITLQYNVLN

SEQ ID NO: 3276613 - protein, 21 aa, Plasmodium falciparum
TYYLLRLYKNYLLYIHQNYLG

SEQ ID NO: 3276614 - protein, 26 aa, Plasmodium falciparum
TYYLSLRIRASYGWVHGTETKICNSE

SEQ ID NO: 3276615 - protein, 20 aa, Plasmodium falciparum
TYYMALSWGAYIFITNSISL

SEQ ID NO: 3276616 - protein, 20 aa, Plasmodium falciparum
TYYSCIKKLYSQFNKSKFLH

SEQ ID NO: 3276617 - protein, 27 aa, Plasmodium falciparum
TYYTLKITDFYSGWLLIPKYYYENKGL

SEQ ID NO: 3276618 - protein, 17 aa, Plasmodium falciparum
TYYYGCLDMEKKEDDKF

SEQ ID NO: 3276619 - protein, 17 aa, Plasmodium falciparum
VAAFASYVVGFFTFSLF

SEQ ID NO: 3276620 - protein, 17 aa, Plasmodium falciparum
VAALKAATEYALTEGAA

SEQ ID NO: 3276621 - protein, 18 aa, Plasmodium falciparum
VADSLFLTVKKTNICLNR

SEQ ID NO: 3276622 - protein, 24 aa, Plasmodium falciparum
VADTLKLFKPYLIKLKNHLLKEDN

SEQ ID NO: 3276623 - protein, 18 aa, Plasmodium falciparum
VAETMPICFPQCLATLIA

SEQ ID NO: 3276624 - protein, 19 aa, Plasmodium falciparum
VAFFQLVMFTFFSRVQNKF

SEQ ID NO: 3276625 - protein, 18 aa, Plasmodium falciparum
VAFIFFWFFGVDYWIFPN

SEQ ID NO: 3276626 - protein, 26 aa, Plasmodium falciparum
VAIFHIFTSTWLFEKEIYYVSIVNVF

SEQ ID NO: 3276627 - protein, 20 aa, Plasmodium falciparum
VAIFSLCLHFIFQPFDKRNY

SEQ ID NO: 3276628 - protein, 40 aa, Plasmodium falciparum
VAIIPSGASFCAIPFALMAGILFFQVYRLTKKHYYNRKKT

SEQ ID NO: 3276629 - protein, 19 aa, Plasmodium falciparum
VAINIWKPAALDAAIAKAI

SEQ ID NO: 3276630 - protein, 20 aa, Plasmodium falciparum
VAINIWKPAALDAAIAKAIT

SEQ ID NO: 3276631 - protein, 19 aa, Plasmodium falciparum
VAINIWKPAALDAAITAAL

SEQ ID NO: 3276632 - protein, 20 aa, Plasmodium falciparum
VAINIWKPAALKAAIAKAIT

SEQ ID NO: 3276633 - protein, 33 aa, Plasmodium falciparum
VAKICSKNKIPILWIRIDNDFVLLGRIRRSQSI

SEQ ID NO: 3276634 - protein, 25 aa, Plasmodium falciparum
VAKIPFPLTYKFKSTLQMGMDIELL

SEQ ID NO: 3276635 - protein, 18 aa, Plasmodium falciparum
VALAVFGVLFVFILFNKE

SEQ ID NO: 3276636 - protein, 24 aa, Plasmodium falciparum
VALGENRSSLILLIVIFILTVHTY

SEQ ID NO: 3276637 - protein, 26 aa, Plasmodium falciparum
VALIMLYIWFYRRRKSSWKYAYKNHL

SEQ ID NO: 3276638 - protein, 23 aa, Plasmodium falciparum
VALSGCIPFICFGFVDNSFMIIS

SEQ ID NO: 3276639 - protein, 17 aa, Plasmodium falciparum
VAPGWGLLSGFGYVTWS

SEQ ID NO: 3276640 - protein, 24 aa, Plasmodium falciparum
VASFLRLFINITIGVLKYSKYASY

SEQ ID NO: 3276641 - protein, 23 aa, Plasmodium falciparum
VATGYLHKIPPCQIKDKEEKENI

SEQ ID NO: 3276642 - protein, 19 aa, Plasmodium falciparum
VAVGAWKPTALKAAIVAAQ

SEQ ID NO: 3276643 - protein, 26 aa, Plasmodium falciparum
VAVGYVLGMSLCFFISRYLIHNYIYK

SEQ ID NO: 3276644 - protein, 23 aa, Plasmodium falciparum
VAVHAWKPLALKATIEKALELNA

SEQ ID NO: 3276645 - protein, 18 aa, Plasmodium falciparum
VAVITVFFIAIVIQRTTF

SEQ ID NO: 3276646 - protein, 17 aa, Plasmodium falciparum
VAYEPLVYLLLNSLGFL

SEQ ID NO: 3276647 - protein, 27 aa, Plasmodium falciparum
VAYYILQFLDYIDCCIYIDNGKHMCML

SEQ ID NO: 3276648 - protein, 23 aa, Plasmodium falciparum
VAYYKNKPSIFTWGGNSCNQLGL

SEQ ID NO: 3276649 - protein, 22 aa, Plasmodium falciparum
VCAYSNGSIFMWGEQKLGQTST

SEQ ID NO: 3276650 - protein, 25 aa, Plasmodium falciparum
VCDSIIGGVTFEFVEKEILNIFYLA

SEQ ID NO: 3276651 - protein, 21 aa, Plasmodium falciparum
VCETLFKYMHYIRRSKNEEMK

SEQ ID NO: 3276652 - protein, 21 aa, Plasmodium falciparum
VCFLCGQIILALAFFSLAILK

SEQ ID NO: 3276653 - protein, 18 aa, Plasmodium falciparum
VCFTSYKKSELVHCKYCN

SEQ ID NO: 3276654 - protein, 29 aa, Plasmodium falciparum
VCFVKECLCEMRGSSVMYLFDYLFSDIKK

SEQ ID NO: 3276655 - protein, 17 aa, Plasmodium falciparum
VCGLSFSGFIVFIIYML

SEQ ID NO: 3276656 - protein, 17 aa, Plasmodium falciparum
VCINTLFLLLNNITQNN

SEQ ID NO: 3276657 - protein, 24 aa, Plasmodium falciparum
VCIPPRRRKLYVGELTKWAESKQV

SEQ ID NO: 3276658 - protein, 24 aa, Plasmodium falciparum
VCIPPRRRRLYVKNLQDLTGEESL

SEQ ID NO: 3276659 - protein, 23 aa, Plasmodium falciparum
VCISLPVFLNYSMDVIYNTALLS

SEQ ID NO: 3276660 - protein, 19 aa, Plasmodium falciparum
VCKACPHKKVIEKKMEQKI

SEQ ID NO: 3276661 - protein, 17 aa, Plasmodium falciparum
VCKAEVSKENVIPLYGR

SEQ ID NO: 3276662 - protein, 30 aa, Plasmodium falciparum
VCKYNSSIIYNICVVTRNLLLLLPLGIYIF

SEQ ID NO: 3276663 - protein, 21 aa, Plasmodium falciparum
VCLLTLCKFAIISQTFCQKIM

SEQ ID NO: 3276664 - protein, 17 aa, Plasmodium falciparum
VCLVIFCIGFLIGNHIS

SEQ ID NO: 3276665 - protein, 22 aa, Plasmodium falciparum
VCMPPRRQKLCLYYIAHESETK

SEQ ID NO: 3276666 - protein, 18 aa, Plasmodium falciparum
VCNKSCTDYDKWIINKRK

SEQ ID NO: 3276667 - protein, 17 aa, Plasmodium falciparum
VCPKINNDNVLKCEFEE

SEQ ID NO: 3276668 - protein, 27 aa, Plasmodium falciparum
VCPSIYRQALQLCVYEFSLQSSFLYSD

SEQ ID NO: 3276669 - protein, 19 aa, Plasmodium falciparum
VCSELIQLFYYILKKNSTY

SEQ ID NO: 3276670 - protein, 18 aa, Plasmodium falciparum
VCTFPYFLTDEMVNICHW

SEQ ID NO: 3276671 - protein, 25 aa, Plasmodium falciparum
VCTNTLECLIKFLRIIYICDLSKYY

SEQ ID NO: 3276672 - protein, 21 aa, Plasmodium falciparum
VCVPPRRRKLYIHDLQSLGVE

SEQ ID NO: 3276673 - protein, 21 aa, Plasmodium falciparum
VCVPPRRRKLYIHDLQSLIGK

SEQ ID NO: 3276674 - protein, 25 aa, Plasmodium falciparum
VCVPPRRRKLYVGELTKWAEEARKS

SEQ ID NO: 3276675 - protein, 30 aa, Plasmodium falciparum
VCVPPRRRKLYVGGLTKWAEIQLKSQAGGD

SEQ ID NO: 3276676 - protein, 21 aa, Plasmodium falciparum
VCVPPRRRRLYIHKVDDNVKD

SEQ ID NO: 3276677 - protein, 24 aa, Plasmodium falciparum
VCVPSRRRKLYIQKLHDWAEKQVG

SEQ ID NO: 3276678 - protein, 21 aa, Plasmodium falciparum
VCVRSTIFFHLYIFIFNNCKK

SEQ ID NO: 3276679 - protein, 19 aa, Plasmodium falciparum
VCYFLGKKNIYFWLVQICF

SEQ ID NO: 3276680 - protein, 21 aa, Plasmodium falciparum
VDAKRDIPFCNSVWNQIQAVS

SEQ ID NO: 3276681 - protein, 22 aa, Plasmodium falciparum
VDCTLFHFFYRNNIILLLYLFI

SEQ ID NO: 3276682 - protein, 25 aa, Plasmodium falciparum
VDDIWLCLTCSNVGCGRYHKRHAQM

SEQ ID NO: 3276683 - protein, 18 aa, Plasmodium falciparum
VDDLKGSILDMLKGDMEL

SEQ ID NO: 3276684 - protein, 22 aa, Plasmodium falciparum
VDEISCLKNKINISITVEQENE

SEQ ID NO: 3276685 - protein, 19 aa, Plasmodium falciparum
VDEIWEFTITFAKENKISE

SEQ ID NO: 3276686 - protein, 18 aa, Plasmodium falciparum
VDELYNIYDQLFKNISQN

SEQ ID NO: 3276687 - protein, 18 aa, Plasmodium falciparum
VDESNLLDILFLFNEEIV

SEQ ID NO: 3276688 - protein, 20 aa, Plasmodium falciparum
VDFCGFFGSILFILCMVSLI

SEQ ID NO: 3276689 - protein, 19 aa, Plasmodium falciparum
VDFLLYFLFNVRLENEKKE

SEQ ID NO: 3276690 - protein, 18 aa, Plasmodium falciparum
VDFLNCSKQVYYYHQVID

SEQ ID NO: 3276691 - protein, 19 aa, Plasmodium falciparum
VDFMMFWINHMLKDSIDWR

SEQ ID NO: 3276692 - protein, 18 aa, Plasmodium falciparum
VDFPGHPKLSYSLNKYFN

SEQ ID NO: 3276693 - protein, 17 aa, Plasmodium falciparum
VDGFIYIFGEFIKGSNG

SEQ ID NO: 3276694 - protein, 21 aa, Plasmodium falciparum
VDGNISLLFAHKLFNNIYDNF

SEQ ID NO: 3276695 - protein, 21 aa, Plasmodium falciparum
VDICLCLYIICSLYDNKNAGV

SEQ ID NO: 3276696 - protein, 19 aa, Plasmodium falciparum
VDIFLPYLVTNLFKSLRFY

SEQ ID NO: 3276697 - protein, 23 aa, Plasmodium falciparum
VDIKCFKTWFNNINYNNSFNHIL

SEQ ID NO: 3276698 - protein, 27 aa, Plasmodium falciparum
VDILNKGLHAMKAYASGKMYNIVTPKD

SEQ ID NO: 3276699 - protein, 19 aa, Plasmodium falciparum
VDILYIYTQCLYKLKSYEK

SEQ ID NO: 3276700 - protein, 24 aa, Plasmodium falciparum
VDIVKKYCRGERDGEKYCSLNGCD

SEQ ID NO: 3276701 - protein, 22 aa, Plasmodium falciparum
VDKDIKDGCHFYDMTNSNMNDT

SEQ ID NO: 3276702 - protein, 23 aa, Plasmodium falciparum
VDKMIKKEICYKEIKYINTPHNH

SEQ ID NO: 3276703 - protein, 20 aa, Plasmodium falciparum
VDKYMLGILFIAIWNNGYLW

SEQ ID NO: 3276704 - protein, 18 aa, Plasmodium falciparum
VDKYMLGIMLIWIWDYKY

SEQ ID NO: 3276705 - protein, 17 aa, Plasmodium falciparum
VDLFSVINIPKSDYDIP

SEQ ID NO: 3276706 - protein, 29 aa, Plasmodium falciparum
VDLGNRIFFFIIFFSFHSFQFLYQFFMNM

SEQ ID NO: 3276707 - protein, 21 aa, Plasmodium falciparum
VDLKKRKSIYEEKKRDYISCS

SEQ ID NO: 3276708 - protein, 23 aa, Plasmodium falciparum
VDLKRALRFAYLDKDHSVYIRIP

SEQ ID NO: 3276709 - protein, 29 aa, Plasmodium falciparum
VDLRKAFIKCAAIETFFAWHEFKKEKERE

SEQ ID NO: 3276710 - protein, 18 aa, Plasmodium falciparum
VDLVKAFVESAAVETFFL

SEQ ID NO: 3276711 - protein, 19 aa, Plasmodium falciparum
VDLYKVKGITFINTDQNGN

SEQ ID NO: 3276712 - protein, 22 aa, Plasmodium falciparum
VDMILCCYCIKEEKMKKLKLPW

SEQ ID NO: 3276713 - protein, 18 aa, Plasmodium falciparum
VDMKILIPYANIYQYKKM

SEQ ID NO: 3276714 - protein, 44 aa, Plasmodium falciparum
VDMSFGYHRAEIIGALFSIFFIWSLSAYILYTAIFRLFDVPKVN

SEQ ID NO: 3276715 - protein, 22 aa, Plasmodium falciparum
VDNKCVWYSKPLFESGTLGTKG

SEQ ID NO: 3276716 - protein, 18 aa, Plasmodium falciparum
VDNTILIEYILKNINKKW

SEQ ID NO: 3276717 - protein, 17 aa, Plasmodium falciparum
VDPELVYLFWSSIQIIY

SEQ ID NO: 3276718 - protein, 23 aa, Plasmodium falciparum
VDSCACRLKIFLTLSKQIKIILQ

SEQ ID NO: 3276719 - protein, 24 aa, Plasmodium falciparum
VDSKPICTWVRANFFAAKDSPGNF

SEQ ID NO: 3276720 - protein, 25 aa, Plasmodium falciparum
VDSYIPIFLSKTVSFVMERKKFTFL

SEQ ID NO: 3276721 - protein, 18 aa, Plasmodium falciparum
VDVCQAAKFEGQSITQDY

SEQ ID NO: 3276722 - protein, 28 aa, Plasmodium falciparum
VDVLIIFLSFCFFLFIFVELIRKICEHF

SEQ ID NO: 3276723 - protein, 19 aa, Plasmodium falciparum
VDVLKIKLYDTLNFLLNFL

SEQ ID NO: 3276724 - protein, 23 aa, Plasmodium falciparum
VDVYEDLPLEYSRIYDYESSENL

SEQ ID NO: 3276725 - protein, 18 aa, Plasmodium falciparum
VDVYFCFESFVEKFLKEF

SEQ ID NO: 3276726 - protein, 24 aa, Plasmodium falciparum
VEAKPGDILYLLGVKRKNKKYLYV

SEQ ID NO: 3276727 - protein, 18 aa, Plasmodium falciparum
VEDAYYFRQTCGGEKTAS

SEQ ID NO: 3276728 - protein, 25 aa, Plasmodium falciparum
VEEKRLFNCFRWNKSNNVYNKINKS

SEQ ID NO: 3276729 - protein, 18 aa, Plasmodium falciparum
VEELKKFIHFSIYMIDAC

SEQ ID NO: 3276730 - protein, 17 aa, Plasmodium falciparum
VEFCNDVYEAKEQTIEV

SEQ ID NO: 3276731 - protein, 17 aa, Plasmodium falciparum
VEFCNDVYEAKEQTVEQ

SEQ ID NO: 3276732 - protein, 17 aa, Plasmodium falciparum
VEFFYECLEDVDEFAQK

SEQ ID NO: 3276733 - protein, 17 aa, Plasmodium falciparum
VEGAGGLCILKKKKEKS

SEQ ID NO: 3276734 - protein, 19 aa, Plasmodium falciparum
VEIFIHIICSLLIIIFNSI

SEQ ID NO: 3276735 - protein, 25 aa, Plasmodium falciparum
VEIGCLRCGCALGGVAASVGLFGGL

SEQ ID NO: 3276736 - protein, 29 aa, Plasmodium falciparum
VEIKKDINMPISFYISRRNVESFNDLYVI

SEQ ID NO: 3276737 - protein, 20 aa, Plasmodium falciparum
VEINYIYKYISSIENKTIQF

SEQ ID NO: 3276738 - protein, 29 aa, Plasmodium falciparum
VEIPTFFRWLHEWGSDFCRQRKRMLKNVK

SEQ ID NO: 3276739 - protein, 22 aa, Plasmodium falciparum
VEIYCARLFQYSIYQLHEEKYF

SEQ ID NO: 3276740 - protein, 18 aa, Plasmodium falciparum
VEIYIRIINILKLKRVGK

SEQ ID NO: 3276741 - protein, 25 aa, Plasmodium falciparum
VEKCCLICGCGLGGGVTPFIGLFGG

SEQ ID NO: 3276742 - protein, 25 aa, Plasmodium falciparum
VEKCCLICGCGLGGVAAGIGIIGGI

SEQ ID NO: 3276743 - protein, 24 aa, Plasmodium falciparum
VEKCCLICGCGLGGVAASVGIFGG

SEQ ID NO: 3276744 - protein, 25 aa, Plasmodium falciparum
VEKCCLICGCGLGGVAASVGIFGTI

SEQ ID NO: 3276745 - protein, 25 aa, Plasmodium falciparum
VEKCCLICGCGLGGVAASVGIFGTV

SEQ ID NO: 3276746 - protein, 24 aa, Plasmodium falciparum
VEKCCLICGCGLGGVAASVGLIGG

SEQ ID NO: 3276747 - protein, 26 aa, Plasmodium falciparum
VEKDLYFCGFLTFICPIKVTTPNYIL

SEQ ID NO: 3276748 - protein, 19 aa, Plasmodium falciparum
VEKEIKPKEVKGVKGKLKK

SEQ ID NO: 3276749 - protein, 24 aa, Plasmodium falciparum
VEKGCLECGGILGAAMPELGSIGG

SEQ ID NO: 3276750 - protein, 25 aa, Plasmodium falciparum
VEKGCLKCGCGLGGVAASIGIFGTI

SEQ ID NO: 3276751 - protein, 24 aa, Plasmodium falciparum
VEKGCLKCGYGLGGVAAGVGIFGA

SEQ ID NO: 3276752 - protein, 23 aa, Plasmodium falciparum
VEKGCLKCGYGLGTVAPTVGLIG

SEQ ID NO: 3276753 - protein, 24 aa, Plasmodium falciparum
VEKGCLRCGCILGAAMPELGSVGG

SEQ ID NO: 3276754 - protein, 24 aa, Plasmodium falciparum
VEKGCLRCGFGLGGVAAGVGIFGS

SEQ ID NO: 3276755 - protein, 24 aa, Plasmodium falciparum
VEKGCLRCGSILGAAMPEVASIGA

SEQ ID NO: 3276756 - protein, 24 aa, Plasmodium falciparum
VEKGCLRCGSILGSAMPELGLIGG

SEQ ID NO: 3276757 - protein, 25 aa, Plasmodium falciparum
VEKGLPCLPNVQNVACRIVDIDMIE

SEQ ID NO: 3276758 - protein, 32 aa, Plasmodium falciparum
VEKKRFLFLFKMNKWLLYFFLYLMNIYFSKDN

SEQ ID NO: 3276759 - protein, 19 aa, Plasmodium falciparum
VEKNNCAHVLYSMNNIDIK

SEQ ID NO: 3276760 - protein, 18 aa, Plasmodium falciparum
VEKPRNIIIIAVFINSST

SEQ ID NO: 3276761 - protein, 24 aa, Plasmodium falciparum
VEKTCLKCGGILGVGVAPSLGLLG

SEQ ID NO: 3276762 - protein, 25 aa, Plasmodium falciparum
VEKTCLKCGGLLGGGITPTVGFFST

SEQ ID NO: 3276763 - protein, 25 aa, Plasmodium falciparum
VEKTCLKCGYGLGGDFAPAWDLFSG

SEQ ID NO: 3276764 - protein, 25 aa, Plasmodium falciparum
VEKVCLKCGCGLGGVGASIGIFGAI

SEQ ID NO: 3276765 - protein, 24 aa, Plasmodium falciparum
VEKVCLRCGFGLGGVAAGVGIFGA

SEQ ID NO: 3276766 - protein, 21 aa, Plasmodium falciparum
VEKYMNYKFVYIIHHYISSIN

SEQ ID NO: 3276767 - protein, 19 aa, Plasmodium falciparum
VELALLLRDRLETYLEGDE

SEQ ID NO: 3276768 - protein, 23 aa, Plasmodium falciparum
VELDELRVDMKLKEENIEELERI

SEQ ID NO: 3276769 - protein, 33 aa, Plasmodium falciparum
VELDFKFIECSLCFELIKFICIQECNHTYCFLC

SEQ ID NO: 3276770 - protein, 19 aa, Plasmodium falciparum
VELHFDYVLFQLCYDESKC

SEQ ID NO: 3276771 - protein, 17 aa, Plasmodium falciparum
VELISSKYFMPKFLSNI

SEQ ID NO: 3276772 - protein, 23 aa, Plasmodium falciparum
VELNEEWDIRASLIEEMKDYIER

SEQ ID NO: 3276773 - protein, 20 aa, Plasmodium falciparum
VELRKLLDRFIFQYNSIDEC

SEQ ID NO: 3276774 - protein, 22 aa, Plasmodium falciparum
VELSCLIPFRLKVKNIIMVGDP

SEQ ID NO: 3276775 - protein, 19 aa, Plasmodium falciparum
VELSLPNKSFFALWSSLYE

SEQ ID NO: 3276776 - protein, 24 aa, Plasmodium falciparum
VELVNFCDLNFLLKSMCQDKFIKF

SEQ ID NO: 3276777 - protein, 17 aa, Plasmodium falciparum
VEMCRKDTLDYVKEDIN

SEQ ID NO: 3276778 - protein, 21 aa, Plasmodium falciparum
VENCGLGMAKLCDDCDGAWKT

SEQ ID NO: 3276779 - protein, 35 aa, Plasmodium falciparum
VENILIIRKFFRVFLNFAQKKFLSLSLKRHLNRNM

SEQ ID NO: 3276780 - protein, 26 aa, Plasmodium falciparum
VENQFYKYIISIRDWLFEIIKSKSYS

SEQ ID NO: 3276781 - protein, 21 aa, Plasmodium falciparum
VEQLKKLNYDFGKSVFNAVEF

SEQ ID NO: 3276782 - protein, 19 aa, Plasmodium falciparum
VEREWKRRETFNSVEGTPT

SEQ ID NO: 3276783 - protein, 25 aa, Plasmodium falciparum
VERGCLRCGYGLGSVAPMIGLTGSV

SEQ ID NO: 3276784 - protein, 27 aa, Plasmodium falciparum
VERPPFFRWLHEWGSDFCGKRARMLKN

SEQ ID NO: 3276785 - protein, 30 aa, Plasmodium falciparum
VESIKKCKKLNCGIRIGGELELCGVNCKSS

SEQ ID NO: 3276786 - protein, 33 aa, Plasmodium falciparum
VESKDIFEIICGFRHFIGCPVFSEQIIKGPQSK

SEQ ID NO: 3276787 - protein, 17 aa, Plasmodium falciparum
VESLIEILKYSSDSMDY

SEQ ID NO: 3276788 - protein, 25 aa, Plasmodium falciparum
VESMKIFLCIAMRATVVLFCKLQNE

SEQ ID NO: 3276789 - protein, 21 aa, Plasmodium falciparum
VESYLCIPLCIGYNDIVSNKG

SEQ ID NO: 3276790 - protein, 39 aa, Plasmodium falciparum
VETLNKEFSCFYLFIYFRCCFENINFYLIEKFIENYYIN

SEQ ID NO: 3276791 - protein, 24 aa, Plasmodium falciparum
VEVRKRYIYDFLKVEYISKAYQEK

SEQ ID NO: 3276792 - protein, 22 aa, Plasmodium falciparum
VEYENYIAFVFLQPEDYYYSSS

SEQ ID NO: 3276793 - protein, 18 aa, Plasmodium falciparum
VEYLKCIASTGVEEKNHL

SEQ ID NO: 3276794 - protein, 21 aa, Plasmodium falciparum
VEYWNEFLLYIFDIHNKVNQK

SEQ ID NO: 3276795 - protein, 21 aa, Plasmodium falciparum
VFCFLCCLLDLLIYTFISYFG

SEQ ID NO: 3276796 - protein, 19 aa, Plasmodium falciparum
VFDEFTWKWFFPLNVECAQ

SEQ ID NO: 3276797 - protein, 18 aa, Plasmodium falciparum
VFDSFLFLIENVNKKKKK

SEQ ID NO: 3276798 - protein, 18 aa, Plasmodium falciparum
VFDTHLYLLLSVAYYDLG

SEQ ID NO: 3276799 - protein, 19 aa, Plasmodium falciparum
VFFELYFILNFNVTSCFQL

SEQ ID NO: 3276800 - protein, 18 aa, Plasmodium falciparum
VFFFEYVKCQGKFVNTKK

SEQ ID NO: 3276801 - protein, 20 aa, Plasmodium falciparum
VFFFILKYIIYYNVMVTKTG

SEQ ID NO: 3276802 - protein, 21 aa, Plasmodium falciparum
VFFKNGCVVIWNMNKKNMKNF

SEQ ID NO: 3276803 - protein, 23 aa, Plasmodium falciparum
VFFLNILYDLSFIFNSNKNIQNI

SEQ ID NO: 3276804 - protein, 17 aa, Plasmodium falciparum
VFFMYNFLNTVDIKFLN

SEQ ID NO: 3276805 - protein, 18 aa, Plasmodium falciparum
VFFNCIIKGLKDEDVKRK

SEQ ID NO: 3276806 - protein, 27 aa, Plasmodium falciparum
VFFNLVILFVFLNFERVELKLNNIIYD

SEQ ID NO: 3276807 - protein, 19 aa, Plasmodium falciparum
VFFPLLIVLTANAIKDAFE

SEQ ID NO: 3276808 - protein, 27 aa, Plasmodium falciparum
VFFSFPYEILCRIIIIQLKFFSNKILN

SEQ ID NO: 3276809 - protein, 19 aa, Plasmodium falciparum
VFFYFKKEEISGVLSNKLR

SEQ ID NO: 3276810 - protein, 22 aa, Plasmodium falciparum
VFFYHFRLLYTYQKEEIFLNFD

SEQ ID NO: 3276811 - protein, 17 aa, Plasmodium falciparum
VFGDATILFPLMVLNSF

SEQ ID NO: 3276812 - protein, 18 aa, Plasmodium falciparum
VFHFNSFNILYTTYPTDN

SEQ ID NO: 3276813 - protein, 26 aa, Plasmodium falciparum
VFHHVIWMGDFNFRVHGIHIEKVIHY

SEQ ID NO: 3276814 - protein, 22 aa, Plasmodium falciparum
VFIGNISIVWSICIKYIGTSIL

SEQ ID NO: 3276815 - protein, 17 aa, Plasmodium falciparum
VFIIFFFLFLKRRVICS

SEQ ID NO: 3276816 - protein, 26 aa, Plasmodium falciparum
VFIIMFCILGIIWSMEREHLKELFCG

SEQ ID NO: 3276817 - protein, 19 aa, Plasmodium falciparum
VFIKKCFFIISKILGTNIN

SEQ ID NO: 3276818 - protein, 19 aa, Plasmodium falciparum
VFIKYLLTCIYTFNEDIVL

SEQ ID NO: 3276819 - protein, 20 aa, Plasmodium falciparum
VFKINCNIYYIALYLLCILK

SEQ ID NO: 3276820 - protein, 19 aa, Plasmodium falciparum
VFKLDIWSLGILLFIMTQG

SEQ ID NO: 3276821 - protein, 18 aa, Plasmodium falciparum
VFKNLGIQYNIEFLNKRK

SEQ ID NO: 3276822 - protein, 19 aa, Plasmodium falciparum
VFLELGELHILQTHYYFYY

SEQ ID NO: 3276823 - protein, 20 aa, Plasmodium falciparum
VFLIIYKWVTPVGYGGFQKQ

SEQ ID NO: 3276824 - protein, 25 aa, Plasmodium falciparum
VFLNIIKILTIRYILHEHLQNCIIT

SEQ ID NO: 3276825 - protein, 21 aa, Plasmodium falciparum
VFLNYLNKIILHFYEKKREHI

SEQ ID NO: 3276826 - protein, 22 aa, Plasmodium falciparum
VFLSIVIFFCVFFERFKNEIEN

SEQ ID NO: 3276827 - protein, 28 aa, Plasmodium falciparum
VFMKHIYEHLHFMMARQAFSINLYYEAL

SEQ ID NO: 3276828 - protein, 25 aa, Plasmodium falciparum
VFNYICYRIPILLLHMKQFSINIFR

SEQ ID NO: 3276829 - protein, 32 aa, Plasmodium falciparum
VFPNCYCDLYCLKWENHLLKTLGSLIETMLSQ

SEQ ID NO: 3276830 - protein, 18 aa, Plasmodium falciparum
VFPNFNINNIKNFTLLDF

SEQ ID NO: 3276831 - protein, 25 aa, Plasmodium falciparum
VFQIIPIIIEFILYLYILTYKIHYT

SEQ ID NO: 3276832 - protein, 25 aa, Plasmodium falciparum
VFQNDNYVALSFFDGMWNEFINPND

SEQ ID NO: 3276833 - protein, 20 aa, Plasmodium falciparum
VFRKIFYIYQCITHVNNNIC

SEQ ID NO: 3276834 - protein, 17 aa, Plasmodium falciparum
VFSETLALYGLIIGIYI

SEQ ID NO: 3276835 - protein, 22 aa, Plasmodium falciparum
VFSRKICVLFIMTVIIFPSDES

SEQ ID NO: 3276836 - protein, 25 aa, Plasmodium falciparum
VFTPEIRFLLLHSYNKYSKYIAQNG

SEQ ID NO: 3276837 - protein, 31 aa, Plasmodium falciparum
VFTYPNLKTIRRFLKKKIKSLKIQSDEKNVP

SEQ ID NO: 3276838 - protein, 21 aa, Plasmodium falciparum
VFVEFYFETIIELYKKISKNY

SEQ ID NO: 3276839 - protein, 21 aa, Plasmodium falciparum
VFVFLCCFLMSFNIFEPRIEI

SEQ ID NO: 3276840 - protein, 23 aa, Plasmodium falciparum
VFVLHLFYIIGIIILFLDHVQSS

SEQ ID NO: 3276841 - protein, 27 aa, Plasmodium falciparum
VFVNCVTFILLHFIMILSFSLFMDMYI

SEQ ID NO: 3276842 - protein, 19 aa, Plasmodium falciparum
VFVPRIYQATVVFFADFFW

SEQ ID NO: 3276843 - protein, 24 aa, Plasmodium falciparum
VFYLCISIWCLFVNICKNSDTKNN

SEQ ID NO: 3276844 - protein, 18 aa, Plasmodium falciparum
VFYMLSLLSLTDKRYKEY

SEQ ID NO: 3276845 - protein, 18 aa, Plasmodium falciparum
VGACAPFRRLHLCVRNLE

SEQ ID NO: 3276846 - protein, 17 aa, Plasmodium falciparum
VGEYLRKYYYTFNKLNK

SEQ ID NO: 3276847 - protein, 17 aa, Plasmodium falciparum
VGFARLCTEEYKKKKRY

SEQ ID NO: 3276848 - protein, 20 aa, Plasmodium falciparum
VGFSCPYNFLTTPSDCFESI

SEQ ID NO: 3276849 - protein, 24 aa, Plasmodium falciparum
VGFWKKNKKWGYGKMTWIQKKKSQ

SEQ ID NO: 3276850 - protein, 18 aa, Plasmodium falciparum
VGHYCDRLNYNIMNVKID

SEQ ID NO: 3276851 - protein, 23 aa, Plasmodium falciparum
VGILGILFYYTFMYRQEQSPLSS

SEQ ID NO: 3276852 - protein, 26 aa, Plasmodium falciparum
VGIYLYKRIYTIYIKLLTVFESLIYL

SEQ ID NO: 3276853 - protein, 39 aa, Plasmodium falciparum
VGKGKKIYMKIRMHRFSICSNFRINLKKYKHAYKELNNT

SEQ ID NO: 3276854 - protein, 17 aa, Plasmodium falciparum
VGKKYFFISLLFNIDYY

SEQ ID NO: 3276855 - protein, 24 aa, Plasmodium falciparum
VGKLKDFGNLLLGKVGLSLDNFEV

SEQ ID NO: 3276856 - protein, 26 aa, Plasmodium falciparum
VGKLSDRINFIFLKIEKINCLAIFEE

SEQ ID NO: 3276857 - protein, 32 aa, Plasmodium falciparum
VGKYRMGNQCTKCFFACYPYENWIEKQKEQFD

SEQ ID NO: 3276858 - protein, 19 aa, Plasmodium falciparum
VGLECAKNLILSGPQSVCI

SEQ ID NO: 3276859 - protein, 25 aa, Plasmodium falciparum
VGLFGGIAVNVWKTGALKIAIDKAI

SEQ ID NO: 3276860 - protein, 18 aa, Plasmodium falciparum
VGLFGGLGIYGWKTAALA

SEQ ID NO: 3276861 - protein, 18 aa, Plasmodium falciparum
VGLFGGLGIYGWKTSATA

SEQ ID NO: 3276862 - protein, 18 aa, Plasmodium falciparum
VGLFGGLGTYGWKIAAIT

SEQ ID NO: 3276863 - protein, 19 aa, Plasmodium falciparum
VGLFGGLGTYGWKIAATAT

SEQ ID NO: 3276864 - protein, 18 aa, Plasmodium falciparum
VGLFGGLGTYGWKSAAIA

SEQ ID NO: 3276865 - protein, 25 aa, Plasmodium falciparum
VGLIHIKDLINIWFGINKIIFDNRN

SEQ ID NO: 3276866 - protein, 17 aa, Plasmodium falciparum
VGLLCPKLLESIGDTIH

SEQ ID NO: 3276867 - protein, 17 aa, Plasmodium falciparum
VGLLGGFGIYVSKSAAL

SEQ ID NO: 3276868 - protein, 18 aa, Plasmodium falciparum
VGLLTGYGCSTLYKYIIS

SEQ ID NO: 3276869 - protein, 17 aa, Plasmodium falciparum
VGLMNLGNTCYLNSLLQ

SEQ ID NO: 3276870 - protein, 23 aa, Plasmodium falciparum
VGNDKYLFCFLLRKKYNMNCLVS

SEQ ID NO: 3276871 - protein, 29 aa, Plasmodium falciparum
VGQFYPKHFQKAAIFIGMVNVFLECKRLY

SEQ ID NO: 3276872 - protein, 20 aa, Plasmodium falciparum
VGTKCCIKGLTLEDVNDICD

SEQ ID NO: 3276873 - protein, 17 aa, Plasmodium falciparum
VGTTCLRNIPRLKTACD

SEQ ID NO: 3276874 - protein, 17 aa, Plasmodium falciparum
VGYYCVWSVTPALHTPL

SEQ ID NO: 3276875 - protein, 19 aa, Plasmodium falciparum
VHAFSCLLYGLAAYLLEVY

SEQ ID NO: 3276876 - protein, 24 aa, Plasmodium falciparum
VHDDLLCVKTLYLFIKTNKVPISL

SEQ ID NO: 3276877 - protein, 20 aa, Plasmodium falciparum
VHDLHVWSLSIGKPALACHI

SEQ ID NO: 3276878 - protein, 17 aa, Plasmodium falciparum
VHEAAEIKKLFQSVAQA

SEQ ID NO: 3276879 - protein, 23 aa, Plasmodium falciparum
VHFFIICTINFDKLYISYSYNIV

SEQ ID NO: 3276880 - protein, 18 aa, Plasmodium falciparum
VHFFLIFFIITVFTSLFY

SEQ ID NO: 3276881 - protein, 17 aa, Plasmodium falciparum
VHFIHKFDIYNLCQAVH

SEQ ID NO: 3276882 - protein, 17 aa, Plasmodium falciparum
VHFSYHVIGHMIKIIDI

SEQ ID NO: 3276883 - protein, 25 aa, Plasmodium falciparum
VHGNNKWNILFSFSDCCIRSFIHDK

SEQ ID NO: 3276884 - protein, 23 aa, Plasmodium falciparum
VHHDISLFFFIFFYIILFFSNDY

SEQ ID NO: 3276885 - protein, 22 aa, Plasmodium falciparum
VHHIIKTMIFLFVLIFYNVHVD

SEQ ID NO: 3276886 - protein, 23 aa, Plasmodium falciparum
VHIIKNKRKAFIYKENNDDKKKN

SEQ ID NO: 3276887 - protein, 24 aa, Plasmodium falciparum
VHIMTDIDYVFGIDYNSVINYDSI

SEQ ID NO: 3276888 - protein, 17 aa, Plasmodium falciparum
VHINYMLHFLCMKNIYG

SEQ ID NO: 3276889 - protein, 18 aa, Plasmodium falciparum
VHKFSWQIINLIIDSIWK

SEQ ID NO: 3276890 - protein, 21 aa, Plasmodium falciparum
VHKILLKKKEEILEWEDKKES

SEQ ID NO: 3276891 - protein, 25 aa, Plasmodium falciparum
VHKSFPLFFHYAKKYLHIYVQNGSN

SEQ ID NO: 3276892 - protein, 19 aa, Plasmodium falciparum
VHLFKEKKLYVAYVGDSRA

SEQ ID NO: 3276893 - protein, 17 aa, Plasmodium falciparum
VHLKESIINDGIDIRGI

SEQ ID NO: 3276894 - protein, 17 aa, Plasmodium falciparum
VHLLLFSIICLFEGGEI

SEQ ID NO: 3276895 - protein, 40 aa, Plasmodium falciparum
VHLLSIYEYLLWVCFYIVKDVYRLCCCLKKEKEKRKILEY

SEQ ID NO: 3276896 - protein, 18 aa, Plasmodium falciparum
VHNIPEYYLSGFSKETKY

SEQ ID NO: 3276897 - protein, 22 aa, Plasmodium falciparum
VHNKMFYCYIVEIIILVVITVY

SEQ ID NO: 3276898 - protein, 21 aa, Plasmodium falciparum
VHPSSLFPILYTGYYINSPKY

SEQ ID NO: 3276899 - protein, 28 aa, Plasmodium falciparum
VHRCKNEGKCILLIKSYFNDYLCALVNS

SEQ ID NO: 3276900 - protein, 18 aa, Plasmodium falciparum
VHSIMYFYFGFIYIFPRI

SEQ ID NO: 3276901 - protein, 24 aa, Plasmodium falciparum
VHSVYIPLYFFKLSINNMSLLLNI

SEQ ID NO: 3276902 - protein, 24 aa, Plasmodium falciparum
VHTHLKPDFFIQSIVLNLYKKTDS

SEQ ID NO: 3276903 - protein, 18 aa, Plasmodium falciparum
VHYDCLDNLISFIFTKLY

SEQ ID NO: 3276904 - protein, 19 aa, Plasmodium falciparum
VIAIFAYFAIILFPIKFHH

SEQ ID NO: 3276905 - protein, 24 aa, Plasmodium falciparum
VIAKGEVVYKCSYKDVKTQTELAN

SEQ ID NO: 3276906 - protein, 19 aa, Plasmodium falciparum
VIAMLLLHLIFYKVSIYYL

SEQ ID NO: 3276907 - protein, 19 aa, Plasmodium falciparum
VICCSATSAIYPYLTYTKH

SEQ ID NO: 3276908 - protein, 22 aa, Plasmodium falciparum
VICTALARSFADIGDIIRGKDL

SEQ ID NO: 3276909 - protein, 20 aa, Plasmodium falciparum
VIDDLNFLRYNILTVAGGAE

SEQ ID NO: 3276910 - protein, 39 aa, Plasmodium falciparum
VIDILREGRACLVTSINCYKYMLLYGFMISFIKILLFMN

SEQ ID NO: 3276911 - protein, 27 aa, Plasmodium falciparum
VIEGLLIMAFMCSKLNFVNISTYIYKN

SEQ ID NO: 3276912 - protein, 26 aa, Plasmodium falciparum
VIENFKEWAEKNIIQKCLDDYFKDAS

SEQ ID NO: 3276913 - protein, 24 aa, Plasmodium falciparum
VIENPKFANALGVSLSELNEALYP

SEQ ID NO: 3276914 - protein, 21 aa, Plasmodium falciparum
VIETFNIFLSLIINNLNKVKY

SEQ ID NO: 3276915 - protein, 18 aa, Plasmodium falciparum
VIFEKILFISMNFLICYS

SEQ ID NO: 3276916 - protein, 24 aa, Plasmodium falciparum
VIFFNVLTGLAFIYLLKNYNENTK

SEQ ID NO: 3276917 - protein, 17 aa, Plasmodium falciparum
VIFKIFKKKQHIMDKHF

SEQ ID NO: 3276918 - protein, 19 aa, Plasmodium falciparum
VIFLYGKLHSLQGLNTPFS

SEQ ID NO: 3276919 - protein, 17 aa, Plasmodium falciparum
VIFNFIIKIIDKIIPKY

SEQ ID NO: 3276920 - protein, 17 aa, Plasmodium falciparum
VIFNNYFLNLLHMKLYL

SEQ ID NO: 3276921 - protein, 20 aa, Plasmodium falciparum
VIFYCGMCMFGSNFLIKNKS

SEQ ID NO: 3276922 - protein, 27 aa, Plasmodium falciparum
VIFYSHKICGHFSMFKHNIIRLYSNIE

SEQ ID NO: 3276923 - protein, 18 aa, Plasmodium falciparum
VIGSECTKCSVWCRLYEK

SEQ ID NO: 3276924 - protein, 18 aa, Plasmodium falciparum
VIHAEEIYLFEWYCLGIN

SEQ ID NO: 3276925 - protein, 17 aa, Plasmodium falciparum
VIIDFEIYIIIFILLVY

SEQ ID NO: 3276926 - protein, 17 aa, Plasmodium falciparum
VIIFFVLSKYIRSYKKR

SEQ ID NO: 3276927 - protein, 18 aa, Plasmodium falciparum
VIIILSIIFLLYLHTYKK

SEQ ID NO: 3276928 - protein, 23 aa, Plasmodium falciparum
VIILDEIIKFYAKRKLKEEQRTK

SEQ ID NO: 3276929 - protein, 21 aa, Plasmodium falciparum
VIINMELLNSYLFYKDANNNY

SEQ ID NO: 3276930 - protein, 21 aa, Plasmodium falciparum
VIIRYLLWNLYKNHINKIDMK

SEQ ID NO: 3276931 - protein, 17 aa, Plasmodium falciparum
VIITLTIYNFLMFIQQK

SEQ ID NO: 3276932 - protein, 18 aa, Plasmodium falciparum
VIKELSIFFFFFCILIII

SEQ ID NO: 3276933 - protein, 27 aa, Plasmodium falciparum
VIKFLNLIKRKLIYKILFPDIQIDTKS

SEQ ID NO: 3276934 - protein, 20 aa, Plasmodium falciparum
VIKGNLFLFHQHLNKQLENK

SEQ ID NO: 3276935 - protein, 19 aa, Plasmodium falciparum
VIKIFRLLLYCNIYVESVD

SEQ ID NO: 3276936 - protein, 26 aa, Plasmodium falciparum
VIKILKDKWGTGRIVDTIANSLNKSY

SEQ ID NO: 3276937 - protein, 26 aa, Plasmodium falciparum
VIKKKILTFYLDLFFDDNEQIRERAS

SEQ ID NO: 3276938 - protein, 35 aa, Plasmodium falciparum
VIKKKKRRTLIYTFFTNFFLLYYILYHADQCFDNK

SEQ ID NO: 3276939 - protein, 29 aa, Plasmodium falciparum
VIKKSPCLHDPFHLLGLIYEREYKNLKKA

SEQ ID NO: 3276940 - protein, 19 aa, Plasmodium falciparum
VIKLCKLNLKKTVKLLLII

SEQ ID NO: 3276941 - protein, 33 aa, Plasmodium falciparum
VIKQDFYPSEWVFPNVHFQLTVHNFKNRKNSIS

SEQ ID NO: 3276942 - protein, 25 aa, Plasmodium falciparum
VIKYIREYFYIFVFFQKIIHNKENC

SEQ ID NO: 3276943 - protein, 26 aa, Plasmodium falciparum
VILDGVPLLNFFSHNILKKKNEEELK

SEQ ID NO: 3276944 - protein, 22 aa, Plasmodium falciparum
VILDPIITFNVIFGDDTMFKFI

SEQ ID NO: 3276945 - protein, 20 aa, Plasmodium falciparum
VILFKATLPPIGSYTETNVI

SEQ ID NO: 3276946 - protein, 18 aa, Plasmodium falciparum
VILKVVDKKGLYLFNTIS

SEQ ID NO: 3276947 - protein, 17 aa, Plasmodium falciparum
VILNIPIFFFILYIKFV

SEQ ID NO: 3276948 - protein, 37 aa, Plasmodium falciparum
VILNKNDICYICRKTIFYKKCYVFSCNHYFHSECALN

SEQ ID NO: 3276949 - protein, 25 aa, Plasmodium falciparum
VILNLKGLYSFWCFIKDMKFYSSFF

SEQ ID NO: 3276950 - protein, 17 aa, Plasmodium falciparum
VILVDRFSVCKYPIHLL

SEQ ID NO: 3276951 - protein, 25 aa, Plasmodium falciparum
VIMTNEFCGIFTPHYIKLTKYTDTF

SEQ ID NO: 3276952 - protein, 25 aa, Plasmodium falciparum
VINEKRVPIHLVHGAPGSGKSELIS

SEQ ID NO: 3276953 - protein, 25 aa, Plasmodium falciparum
VINIFKKKCFIIYIVDVLDLYVYSN

SEQ ID NO: 3276954 - protein, 18 aa, Plasmodium falciparum
VINLEYWKPEKLKEEDGN

SEQ ID NO: 3276955 - protein, 27 aa, Plasmodium falciparum
VIPLGRLRLLYDFKDVEHMVCGEREIN

SEQ ID NO: 3276956 - protein, 32 aa, Plasmodium falciparum
VIQIIRVIYLFSLKYFPTLFLKTINYLNYIKV

SEQ ID NO: 3276957 - protein, 26 aa, Plasmodium falciparum
VIQKVQCQKCLFISKKKEIIHDLSFP

SEQ ID NO: 3276958 - protein, 31 aa, Plasmodium falciparum
VIQLLTCNKYFLKRRGFFFLNSISDNDDIIF

SEQ ID NO: 3276959 - protein, 19 aa, Plasmodium falciparum
VIQSLDMLFLIVRDYELNT

SEQ ID NO: 3276960 - protein, 25 aa, Plasmodium falciparum
VIRDFPFDINNLWKDKKKWNIYDQY

SEQ ID NO: 3276961 - protein, 25 aa, Plasmodium falciparum
VIRNDKFSYFTLYKNNLFPNSNNYF

SEQ ID NO: 3276962 - protein, 21 aa, Plasmodium falciparum
VISEMFLIVYEKIYKKYIKKK

SEQ ID NO: 3276963 - protein, 24 aa, Plasmodium falciparum
VISLKLCLLFTCIHLKNIYPFVFS

SEQ ID NO: 3276964 - protein, 25 aa, Plasmodium falciparum
VIVKRIKLYYPLRNKNVFTNISKII

SEQ ID NO: 3276965 - protein, 22 aa, Plasmodium falciparum
VIVLICIYCYINSTLGFYNDEE

SEQ ID NO: 3276966 - protein, 23 aa, Plasmodium falciparum
VIYFPKHLHNITHILHFCDEPYI

SEQ ID NO: 3276967 - protein, 24 aa, Plasmodium falciparum
VIYKHYIFKGYIFLLYLKLKKIKW

SEQ ID NO: 3276968 - protein, 19 aa, Plasmodium falciparum
VIYLKPLAGVYRSLKKQIE

SEQ ID NO: 3276969 - protein, 21 aa, Plasmodium falciparum
VIYNVFGWFSAPLLSGIIMDI

SEQ ID NO: 3276970 - protein, 26 aa, Plasmodium falciparum
VIYSFYLFQNYHFFISKNNFCDLDKT

SEQ ID NO: 3276971 - protein, 20 aa, Plasmodium falciparum
VIYTYKFISNSGITTTIPKD

SEQ ID NO: 3276972 - protein, 27 aa, Plasmodium falciparum
VKASFPYFLKLFFLEVLRKKNEKAYNL

SEQ ID NO: 3276973 - protein, 18 aa, Plasmodium falciparum
VKCCIIICGNEFFKKNIF

SEQ ID NO: 3276974 - protein, 24 aa, Plasmodium falciparum
VKCHKNFRLFCCQNPYKEGGGRKG

SEQ ID NO: 3276975 - protein, 33 aa, Plasmodium falciparum
VKCKCKEGYKLEGIECVELLSLASSSLNLIFNS

SEQ ID NO: 3276976 - protein, 21 aa, Plasmodium falciparum
VKCLCMPGYYWDLKEFKCIKC

SEQ ID NO: 3276977 - protein, 18 aa, Plasmodium falciparum
VKCLISFVSNFWINNMNI

SEQ ID NO: 3276978 - protein, 26 aa, Plasmodium falciparum
VKCLSDKSVTCFILYKYQKMLWFQIL

SEQ ID NO: 3276979 - protein, 26 aa, Plasmodium falciparum
VKCQCSHLYFGDGVFCVKNSQTKQTL

SEQ ID NO: 3276980 - protein, 23 aa, Plasmodium falciparum
VKCVDVCSIFSIHYNGFTNDSSY

SEQ ID NO: 3276981 - protein, 19 aa, Plasmodium falciparum
VKCYVEISPNMNFNEFFIS

SEQ ID NO: 3276982 - protein, 20 aa, Plasmodium falciparum
VKDDLPIIVLTNEHGTHINN

SEQ ID NO: 3276983 - protein, 25 aa, Plasmodium falciparum
VKDELRKRGYPTFGSIDEIKTRLCD

SEQ ID NO: 3276984 - protein, 17 aa, Plasmodium falciparum
VKDGGKIHFEKVNSTSG

SEQ ID NO: 3276985 - protein, 27 aa, Plasmodium falciparum
VKDILKFISKDIWYILFNKNSDKIQTQ

SEQ ID NO: 3276986 - protein, 18 aa, Plasmodium falciparum
VKEENLMKILCYIIEESD

SEQ ID NO: 3276987 - protein, 23 aa, Plasmodium falciparum
VKEFKMPYFKNWKVNLTSNTYTP

SEQ ID NO: 3276988 - protein, 21 aa, Plasmodium falciparum
VKEFRSINNYRFFYKMKYLLN

SEQ ID NO: 3276989 - protein, 25 aa, Plasmodium falciparum
VKEHIICGDILILIGHKNIEKFHKG

SEQ ID NO: 3276990 - protein, 17 aa, Plasmodium falciparum
VKEKCQSFFFKDNIINL

SEQ ID NO: 3276991 - protein, 25 aa, Plasmodium falciparum
VKELNKRLICVFVYSFDNDLKKNIK

SEQ ID NO: 3276992 - protein, 21 aa, Plasmodium falciparum
VKEQYKKTCLGEEELIVDGNT

SEQ ID NO: 3276993 - protein, 22 aa, Plasmodium falciparum
VKESKLIFVTGFLLTTLSAIVD

SEQ ID NO: 3276994 - protein, 28 aa, Plasmodium falciparum
VKESNIFKWNKLKIYKGAYTKLSEKEKQ

SEQ ID NO: 3276995 - protein, 18 aa, Plasmodium falciparum
VKEYYWEIHFDGLYIDHQ

SEQ ID NO: 3276996 - protein, 18 aa, Plasmodium falciparum
VKFFHSYSHFVDLYSKYK

SEQ ID NO: 3276997 - protein, 23 aa, Plasmodium falciparum
VKFLSFRIILQMVVNSRSIKMRR

SEQ ID NO: 3276998 - protein, 23 aa, Plasmodium falciparum
VKFRGTGGLSFGVFLTSGVNFEL

SEQ ID NO: 3276999 - protein, 33 aa, Plasmodium falciparum
VKGCYKSFYKFCFFPIRYIPYIQRYTEKIKSWI

SEQ ID NO: 3277000 - protein, 22 aa, Plasmodium falciparum
VKGDYKGFISIASLLIYINTKY

SEQ ID NO: 3277001 - protein, 22 aa, Plasmodium falciparum
VKGKNYGWRCVAPSHTTSETTG

SEQ ID NO: 3277002 - protein, 22 aa, Plasmodium falciparum
VKGPYITSSWIDYLEDCGNKSQ

SEQ ID NO: 3277003 - protein, 19 aa, Plasmodium falciparum
VKHNCGILYSKLLKDEKKK

SEQ ID NO: 3277004 - protein, 27 aa, Plasmodium falciparum
VKHYNIDNIFIQWIYTIFLTCLPFNIY

SEQ ID NO: 3277005 - protein, 24 aa, Plasmodium falciparum
VKIHIIKCILNIIVFLDNENIKAC

SEQ ID NO: 3277006 - protein, 22 aa, Plasmodium falciparum
VKIIKKKICVLYSNIDNNISKK

SEQ ID NO: 3277007 - protein, 28 aa, Plasmodium falciparum
VKIIPELSIKMYSYEFMKLNVYKYYYNN

SEQ ID NO: 3277008 - protein, 25 aa, Plasmodium falciparum
VKIKDELYINIDLIYKNKNNKSFLS

SEQ ID NO: 3277009 - protein, 23 aa, Plasmodium falciparum
VKIKDPFIWKNIIEIQLKIMEES

SEQ ID NO: 3277010 - protein, 20 aa, Plasmodium falciparum
VKIKLLIYKNEIIKQIYKFK

SEQ ID NO: 3277011 - protein, 20 aa, Plasmodium falciparum
VKILGYIFKNFLLKNKELKR

SEQ ID NO: 3277012 - protein, 17 aa, Plasmodium falciparum
VKILLLAAFISFVLTLL

SEQ ID NO: 3277013 - protein, 24 aa, Plasmodium falciparum
VKIPFLFEYFTLFVITINLSEKLH

SEQ ID NO: 3277014 - protein, 27 aa, Plasmodium falciparum
VKIPTFFRWLHEWGSDFCGTRKRMLDK

SEQ ID NO: 3277015 - protein, 28 aa, Plasmodium falciparum
VKIRCIYSLCFIHNKYIYTQKIIQNLFL

SEQ ID NO: 3277016 - protein, 21 aa, Plasmodium falciparum
VKIYQSFYIHGFRKIQKKFNK

SEQ ID NO: 3277017 - protein, 21 aa, Plasmodium falciparum
VKKDELRNILKMEPNTNNKHN

SEQ ID NO: 3277018 - protein, 17 aa, Plasmodium falciparum
VKKECVHNNIFFSDTDL

SEQ ID NO: 3277019 - protein, 23 aa, Plasmodium falciparum
VKKHKRKGICPLFLEDILKTRIM

SEQ ID NO: 3277020 - protein, 25 aa, Plasmodium falciparum
VKKILQFCILLTFHIYKQMYLNNYM

SEQ ID NO: 3277021 - protein, 21 aa, Plasmodium falciparum
VKKKYLQKMCNLKKRRDDKNV

SEQ ID NO: 3277022 - protein, 17 aa, Plasmodium falciparum
VKKLMGLSKICGNKSGK

SEQ ID NO: 3277023 - protein, 26 aa, Plasmodium falciparum
VKKSIRHLLPFYAIFRFMSDVKIFII

SEQ ID NO: 3277024 - protein, 18 aa, Plasmodium falciparum
VKKSYKIIFKELLINITI

SEQ ID NO: 3277025 - protein, 20 aa, Plasmodium falciparum
VKKVIKKKVEKGIKENHTES

SEQ ID NO: 3277026 - protein, 20 aa, Plasmodium falciparum
VKKYKRKVCETLFCKYINVL

SEQ ID NO: 3277027 - protein, 23 aa, Plasmodium falciparum
VKKYKVFAAPFISAVAAFASYVV

SEQ ID NO: 3277028 - protein, 32 aa, Plasmodium falciparum
VKLDPIIGHVCKRKPIPYIKMVRNIRKKLEQL

SEQ ID NO: 3277029 - protein, 17 aa, Plasmodium falciparum
VKLEYLDKILIDTISYN

SEQ ID NO: 3277030 - protein, 27 aa, Plasmodium falciparum
VKLFFALSVWCFIKLLIYVTHTIICFA

SEQ ID NO: 3277031 - protein, 20 aa, Plasmodium falciparum
VKLFYKKDVDNDICHMPYNV

SEQ ID NO: 3277032 - protein, 17 aa, Plasmodium falciparum
VKLKEFFKKKIIKKKKN

SEQ ID NO: 3277033 - protein, 23 aa, Plasmodium falciparum
VKLKLIEGCLSFPGIEGKVERPS

SEQ ID NO: 3277034 - protein, 25 aa, Plasmodium falciparum
VKLKSILAVFIKWLVISPDSFMQNE

SEQ ID NO: 3277035 - protein, 26 aa, Plasmodium falciparum
VKLLNLLPLQVFFKCRDKIQTIKSFQ

SEQ ID NO: 3277036 - protein, 18 aa, Plasmodium falciparum
VKLLVIICSILLALIKTQ

SEQ ID NO: 3277037 - protein, 23 aa, Plasmodium falciparum
VKLMFKLEKIFIKFIDKKLQENE

SEQ ID NO: 3277038 - protein, 20 aa, Plasmodium falciparum
VKLPSTIYHFYHLMTDETYE

SEQ ID NO: 3277039 - protein, 25 aa, Plasmodium falciparum
VKLTFPVQWNLPSIYLTNDEIVEDE

SEQ ID NO: 3277040 - protein, 19 aa, Plasmodium falciparum
VKMGILLIRPYIPLENISK

SEQ ID NO: 3277041 - protein, 17 aa, Plasmodium falciparum
VKMKPKIPFIIDIYSTF

SEQ ID NO: 3277042 - protein, 18 aa, Plasmodium falciparum
VKMLTIEIIYCIILHISE

SEQ ID NO: 3277043 - protein, 28 aa, Plasmodium falciparum
VKMNVMIKKKCMLYLTFNRKENDNIINN

SEQ ID NO: 3277044 - protein, 25 aa, Plasmodium falciparum
VKNCKLKYFEMVLIILKELQMDIHY

SEQ ID NO: 3277045 - protein, 27 aa, Plasmodium falciparum
VKNDMSVCIIHFLNLILFILIYLNDLA

SEQ ID NO: 3277046 - protein, 17 aa, Plasmodium falciparum
VKNGGGLCILPNPKKNQ

SEQ ID NO: 3277047 - protein, 33 aa, Plasmodium falciparum
VKNIMIFFICCIFYLNELYIKYNNSLVTNIKPI

SEQ ID NO: 3277048 - protein, 18 aa, Plasmodium falciparum
VKNIRKIQSFCVLYMDIK

SEQ ID NO: 3277049 - protein, 25 aa, Plasmodium falciparum
VKNISICKKCMFSYFEFKNVTKVIY

SEQ ID NO: 3277050 - protein, 26 aa, Plasmodium falciparum
VKNKEFTTDCDFLYNLMIQMDKNVEK

SEQ ID NO: 3277051 - protein, 24 aa, Plasmodium falciparum
VKNLFCCNNNFNSIISMDTIKIPK

SEQ ID NO: 3277052 - protein, 19 aa, Plasmodium falciparum
VKNLFMKMCHMVHYGNNGV

SEQ ID NO: 3277053 - protein, 42 aa, Plasmodium falciparum
VKNNKCFFYKPERLCSMSPYIIDKCYFVYIKNKIPYNAFIAY

SEQ ID NO: 3277054 - protein, 33 aa, Plasmodium falciparum
VKNSHSLSCHEFLRMLFNYKYFIDDNLNYKYIE

SEQ ID NO: 3277055 - protein, 20 aa, Plasmodium falciparum
VKNVSILYIHFLKLAYRNTV

SEQ ID NO: 3277056 - protein, 41 aa, Plasmodium falciparum
VKNYLCAKLVHEICKSGLYMKTFIFKSIINFYEFDYYNYLL

SEQ ID NO: 3277057 - protein, 23 aa, Plasmodium falciparum
VKNYSILCMLNYVFFQLNTNLDN

SEQ ID NO: 3277058 - protein, 26 aa, Plasmodium falciparum
VKPILKECYYLICFLTSQNEVMKKYM

SEQ ID NO: 3277059 - protein, 17 aa, Plasmodium falciparum
VKQNIYHHMLLKKNYFL

SEQ ID NO: 3277060 - protein, 17 aa, Plasmodium falciparum
VKQRKLKELAEQQLNKE

SEQ ID NO: 3277061 - protein, 24 aa, Plasmodium falciparum
VKRMKCGITCRSFIFMSLSLCVIS

SEQ ID NO: 3277062 - protein, 21 aa, Plasmodium falciparum
VKRNTSPFCMNLMFYNFHEDF

SEQ ID NO: 3277063 - protein, 23 aa, Plasmodium falciparum
VKRRKVIIRYNFLINDLCLLYFF

SEQ ID NO: 3277064 - protein, 17 aa, Plasmodium falciparum
VKRTYKLLRKSLPFESD

SEQ ID NO: 3277065 - protein, 25 aa, Plasmodium falciparum
VKSFILPYYHSFRFFSQEVTRYETT

SEQ ID NO: 3277066 - protein, 24 aa, Plasmodium falciparum
VKSRSVCGSDFYLAPEIIKNKEYG

SEQ ID NO: 3277067 - protein, 35 aa, Plasmodium falciparum
VKTDCDWKKYYLSNVISFLNCKYVDLNNYLLSMKY

SEQ ID NO: 3277068 - protein, 20 aa, Plasmodium falciparum
VKTGGGLCILEKTNGKEKVN

SEQ ID NO: 3277069 - protein, 17 aa, Plasmodium falciparum
VKTKEINKHVSVVYEDN

SEQ ID NO: 3277070 - protein, 21 aa, Plasmodium falciparum
VKTYIIFEVEVLFKNLSLNIQ

SEQ ID NO: 3277071 - protein, 24 aa, Plasmodium falciparum
VKVFYRINKFILFINKSYHMNEDE

SEQ ID NO: 3277072 - protein, 20 aa, Plasmodium falciparum
VKVSKCLHLLYSIISNNNEG

SEQ ID NO: 3277073 - protein, 19 aa, Plasmodium falciparum
VKVYKLKRKIEDIIQEVQD

SEQ ID NO: 3277074 - protein, 19 aa, Plasmodium falciparum
VKWELLALLTVVNMLLLLL

SEQ ID NO: 3277075 - protein, 24 aa, Plasmodium falciparum
VKYHSDFYFSICNFDDNTIIDDDI

SEQ ID NO: 3277076 - protein, 18 aa, Plasmodium falciparum
VKYIKAHDNFYFIGTMNP

SEQ ID NO: 3277077 - protein, 26 aa, Plasmodium falciparum
VKYKYNINSAMSYRYLMNISSNLRLY

SEQ ID NO: 3277078 - protein, 26 aa, Plasmodium falciparum
VKYNKYRLYLLLNIVTHERMLQALRS

SEQ ID NO: 3277079 - protein, 26 aa, Plasmodium falciparum
VKYSDWKFKSIPTVGFSKDGDRLQEM

SEQ ID NO: 3277080 - protein, 31 aa, Plasmodium falciparum
VKYVGGHTPIWSIDTAFLGYFFATAEDDGNL

SEQ ID NO: 3277081 - protein, 25 aa, Plasmodium falciparum
VKYVKYKKCKAIEELLKNMVSDKKM

SEQ ID NO: 3277082 - protein, 17 aa, Plasmodium falciparum
VKYVLRCTTAAPGFFNF

SEQ ID NO: 3277083 - protein, 23 aa, Plasmodium falciparum
VLANFLLSLVLLELSCYSESFLF

SEQ ID NO: 3277084 - protein, 23 aa, Plasmodium falciparum
VLASCSFPYLLQPFKLLEKKYNK

SEQ ID NO: 3277085 - protein, 21 aa, Plasmodium falciparum
VLCAVCSYMALISFMNFFIRS

SEQ ID NO: 3277086 - protein, 20 aa, Plasmodium falciparum
VLCMIEIFFKNVLIEEFIVS

SEQ ID NO: 3277087 - protein, 18 aa, Plasmodium falciparum
VLCNAWFLSKTIPFFSVF

SEQ ID NO: 3277088 - protein, 18 aa, Plasmodium falciparum
VLCRKYNKIVSFFHVNYK

SEQ ID NO: 3277089 - protein, 18 aa, Plasmodium falciparum
VLDGCISFFWSINNYHLP

SEQ ID NO: 3277090 - protein, 23 aa, Plasmodium falciparum
VLDIFKNCFLLSLNNYLREQKIK

SEQ ID NO: 3277091 - protein, 17 aa, Plasmodium falciparum
VLDLGYINCRILPIMDG

SEQ ID NO: 3277092 - protein, 28 aa, Plasmodium falciparum
VLFEDTCFLCFLYKPFINTLHKLFKENN

SEQ ID NO: 3277093 - protein, 22 aa, Plasmodium falciparum
VLFFFIFHVLIYKSFQLVKKKE

SEQ ID NO: 3277094 - protein, 17 aa, Plasmodium falciparum
VLFKLKEYYIIINNLLL

SEQ ID NO: 3277095 - protein, 21 aa, Plasmodium falciparum
VLFKPELGYVQGMSYIALVFL

SEQ ID NO: 3277096 - protein, 17 aa, Plasmodium falciparum
VLFLILFIFFHVAGNFV

SEQ ID NO: 3277097 - protein, 25 aa, Plasmodium falciparum
VLFLKRIRNNFDIKRNIYINETIND

SEQ ID NO: 3277098 - protein, 18 aa, Plasmodium falciparum
VLFLQLFSSFNIKFSTDI

SEQ ID NO: 3277099 - protein, 23 aa, Plasmodium falciparum
VLFMYGLHPNFAVSFLSLQLLSI

SEQ ID NO: 3277100 - protein, 26 aa, Plasmodium falciparum
VLFQKVMNIFCRIIVYESRKNKSNFN

SEQ ID NO: 3277101 - protein, 19 aa, Plasmodium falciparum
VLFRKSIIHSLFFYNKLIY

SEQ ID NO: 3277102 - protein, 47 aa, Plasmodium falciparum
VLGIKTVLCILLYMYNNILLFVVFLILCVVSFYGLIVNTIKSLVLYI

SEQ ID NO: 3277103 - protein, 30 aa, Plasmodium falciparum
VLGLWKGNFVNTIRGGIVYSAKFGTNDIIK

SEQ ID NO: 3277104 - protein, 18 aa, Plasmodium falciparum
VLGNFASFYFYKYLCNIF

SEQ ID NO: 3277105 - protein, 19 aa, Plasmodium falciparum
VLGNMPFKYKEFATVNKSD

SEQ ID NO: 3277106 - protein, 22 aa, Plasmodium falciparum
VLHIPKKLSANIIINMNEKIHH

SEQ ID NO: 3277107 - protein, 18 aa, Plasmodium falciparum
VLICCMFPVWPLRLKLAL

SEQ ID NO: 3277108 - protein, 28 aa, Plasmodium falciparum
VLICKALRSYINIFILYKKHFFIYNEIF

SEQ ID NO: 3277109 - protein, 26 aa, Plasmodium falciparum
VLIKIFYKYFNYFIKQNWKTIFYYIP

SEQ ID NO: 3277110 - protein, 19 aa, Plasmodium falciparum
VLIKMLHLDLLKILYNLQY

SEQ ID NO: 3277111 - protein, 21 aa, Plasmodium falciparum
VLILCVYYNYIILKYYFYSLF

SEQ ID NO: 3277112 - protein, 17 aa, Plasmodium falciparum
VLILKKFFYLIQTKLPI

SEQ ID NO: 3277113 - protein, 17 aa, Plasmodium falciparum
VLIPCTYVYLKNIIKRI

SEQ ID NO: 3277114 - protein, 18 aa, Plasmodium falciparum
VLITYSFTVSYIFFMSFK

SEQ ID NO: 3277115 - protein, 21 aa, Plasmodium falciparum
VLKERIILYSLMINSLRYSDN

SEQ ID NO: 3277116 - protein, 23 aa, Plasmodium falciparum
VLKKKSRGINEWVGVVEKENIVH

SEQ ID NO: 3277117 - protein, 22 aa, Plasmodium falciparum
VLKNLGSWLGFITLGRNRPLKS

SEQ ID NO: 3277118 - protein, 25 aa, Plasmodium falciparum
VLKPLQWICIGVIFSTLIVQSYLKK

SEQ ID NO: 3277119 - protein, 19 aa, Plasmodium falciparum
VLKSVFPISSYILSLILIN

SEQ ID NO: 3277120 - protein, 22 aa, Plasmodium falciparum
VLLDPHLTDFAFSFNDIHNEHM

SEQ ID NO: 3277121 - protein, 21 aa, Plasmodium falciparum
VLLFIEFKKEANIKFTSFLKH

SEQ ID NO: 3277122 - protein, 25 aa, Plasmodium falciparum
VLLGGWLMCLGILLSYFTVFNFYLF

SEQ ID NO: 3277123 - protein, 17 aa, Plasmodium falciparum
VLLIILYIWLYRRRKNS

SEQ ID NO: 3277124 - protein, 19 aa, Plasmodium falciparum
VLLIKQYLVIILWFNDIKP

SEQ ID NO: 3277125 - protein, 24 aa, Plasmodium falciparum
VLLKCITVTLFLFIIFVDTFKGKR

SEQ ID NO: 3277126 - protein, 24 aa, Plasmodium falciparum
VLLKELLQKLLINIIGKHSCINDN

SEQ ID NO: 3277127 - protein, 23 aa, Plasmodium falciparum
VLLKEPFKYFLSHQDFLDIKAPK

SEQ ID NO: 3277128 - protein, 17 aa, Plasmodium falciparum
VLLKPCDTLLKDEDAWS

SEQ ID NO: 3277129 - protein, 24 aa, Plasmodium falciparum
VLLLLNIYLIFSIKGILIYMNIYY

SEQ ID NO: 3277130 - protein, 29 aa, Plasmodium falciparum
VLLPQPPIYPPFEIWFFMSKKCASQLHKL

SEQ ID NO: 3277131 - protein, 17 aa, Plasmodium falciparum
VLLRYIKIHFLRYIICM

SEQ ID NO: 3277132 - protein, 17 aa, Plasmodium falciparum
VLLRYLKKFHIYQKFKI

SEQ ID NO: 3277133 - protein, 17 aa, Plasmodium falciparum
VLLSKLLLIHFILMILL

SEQ ID NO: 3277134 - protein, 22 aa, Plasmodium falciparum
VLLYCLCSCLCYTDMLDRDIMN

SEQ ID NO: 3277135 - protein, 30 aa, Plasmodium falciparum
VLMHLCALIKFRFAGLCSAFLYMCVTSVYT

SEQ ID NO: 3277136 - protein, 26 aa, Plasmodium falciparum
VLNCYELQILPCLQKKDTLYALYWDN

SEQ ID NO: 3277137 - protein, 18 aa, Plasmodium falciparum
VLNELNYDNAGTNLYNEL

SEQ ID NO: 3277138 - protein, 27 aa, Plasmodium falciparum
VLNFCVCFFFFFVIDLCINKNIFITNY

SEQ ID NO: 3277139 - protein, 18 aa, Plasmodium falciparum
VLNHFYLTMDFTKFQWYI

SEQ ID NO: 3277140 - protein, 26 aa, Plasmodium falciparum
VLNIIRTSFHWAITSFVLFFLFEHFS

SEQ ID NO: 3277141 - protein, 25 aa, Plasmodium falciparum
VLNILSCKLMKIKIKKDFAPKLEEK

SEQ ID NO: 3277142 - protein, 24 aa, Plasmodium falciparum
VLNKCAHVLNLLSADEHRGKKEEK

SEQ ID NO: 3277143 - protein, 22 aa, Plasmodium falciparum
VLNLYSCLCVKLFSENNILVIM

SEQ ID NO: 3277144 - protein, 19 aa, Plasmodium falciparum
VLNSLSIKGYRVLCLAVNI

SEQ ID NO: 3277145 - protein, 28 aa, Plasmodium falciparum
VLNYCNFDIPLILALLYIIQLHKFPDIK

SEQ ID NO: 3277146 - protein, 22 aa, Plasmodium falciparum
VLPSIFLFPLCNEFIAHEHTTD

SEQ ID NO: 3277147 - protein, 25 aa, Plasmodium falciparum
VLPVYRLLYVLNFFFLFIFGAFLFM

SEQ ID NO: 3277148 - protein, 23 aa, Plasmodium falciparum
VLQFRIFLYHHLDKYHKVYKNLL

SEQ ID NO: 3277149 - protein, 23 aa, Plasmodium falciparum
VLRKGEITYRCSYEDVKTQSELS

SEQ ID NO: 3277150 - protein, 25 aa, Plasmodium falciparum
VLRNKRLGRNVLIYDGSEYLIYVPE

SEQ ID NO: 3277151 - protein, 24 aa, Plasmodium falciparum
VLRPRIKRSRSIYEREETNQENSP

SEQ ID NO: 3277152 - protein, 17 aa, Plasmodium falciparum
VLSKLNAVYKVNSVHKM

SEQ ID NO: 3277153 - protein, 24 aa, Plasmodium falciparum
VLSLICIIGLISLFVYLYRIDTKL

SEQ ID NO: 3277154 - protein, 24 aa, Plasmodium falciparum
VLSNLMIYMFARFYPEIKVQFKKF

SEQ ID NO: 3277155 - protein, 24 aa, Plasmodium falciparum
VLSNSELYEFYGYHINSLKKSILY

SEQ ID NO: 3277156 - protein, 30 aa, Plasmodium falciparum
VLSSCWFLDRILIHLFLYYYSSCMIDKNSK

SEQ ID NO: 3277157 - protein, 25 aa, Plasmodium falciparum
VLTKRCYISYYLLNEINEIKNKSHM

SEQ ID NO: 3277158 - protein, 24 aa, Plasmodium falciparum
VLTPRKLLGESWGFICPVHTPDGT

SEQ ID NO: 3277159 - protein, 20 aa, Plasmodium falciparum
VLVECAKKLIGDLSSNGRGG

SEQ ID NO: 3277160 - protein, 27 aa, Plasmodium falciparum
VLVHEYLRIIGLQTFFILIIASSLILM

SEQ ID NO: 3277161 - protein, 18 aa, Plasmodium falciparum
VLVKINFLLIKGYNIIAI

SEQ ID NO: 3277162 - protein, 19 aa, Plasmodium falciparum
VLVNHNVYFKALISDMFFG

SEQ ID NO: 3277163 - protein, 29 aa, Plasmodium falciparum
VLVSFPVLLFCLSFIILSYRSFNTEYFDK

SEQ ID NO: 3277164 - protein, 29 aa, Plasmodium falciparum
VLVYDENFLRVLFFNILVVLNYLNRELQI

SEQ ID NO: 3277165 - protein, 20 aa, Plasmodium falciparum
VLWMRRKGYTLWYLNLDQTS

SEQ ID NO: 3277166 - protein, 18 aa, Plasmodium falciparum
VLYHIIKKLYKSLIKKKD

SEQ ID NO: 3277167 - protein, 17 aa, Plasmodium falciparum
VLYILQLNDCLFKKGIL

SEQ ID NO: 3277168 - protein, 20 aa, Plasmodium falciparum
VLYLGNRINKLLLRNVYFFM

SEQ ID NO: 3277169 - protein, 25 aa, Plasmodium falciparum
VLYNIKRLLGIILSKVKLFEEISKW

SEQ ID NO: 3277170 - protein, 18 aa, Plasmodium falciparum
VLYSCFFLIIYIILFSIY

SEQ ID NO: 3277171 - protein, 21 aa, Plasmodium falciparum
VLYSKPVEHFNIFEFNVSPVL

SEQ ID NO: 3277172 - protein, 23 aa, Plasmodium falciparum
VMDKEKKRFLGLKNVLRKYQEEF

SEQ ID NO: 3277173 - protein, 28 aa, Plasmodium falciparum
VMEKLYGKELFNFLVYKKQVKENICKYI

SEQ ID NO: 3277174 - protein, 26 aa, Plasmodium falciparum
VMFYLKRIYFPYIMYEHDDNSIICNE

SEQ ID NO: 3277175 - protein, 17 aa, Plasmodium falciparum
VMKCTKRDEQLFIIRIN

SEQ ID NO: 3277176 - protein, 18 aa, Plasmodium falciparum
VMLFNIYISYKFSDIIFL

SEQ ID NO: 3277177 - protein, 27 aa, Plasmodium falciparum
VMLTRRGRKMLDFLIMLNKFYDNINVR

SEQ ID NO: 3277178 - protein, 18 aa, Plasmodium falciparum
VMNIFELPESSKLYSDEE

SEQ ID NO: 3277179 - protein, 18 aa, Plasmodium falciparum
VMSFHYPSSFVFPIMNYY

SEQ ID NO: 3277180 - protein, 19 aa, Plasmodium falciparum
VMSFSKFLPEHKIARKKKK

SEQ ID NO: 3277181 - protein, 24 aa, Plasmodium falciparum
VMYRIICNHNLLILNNTSFLKPTK

SEQ ID NO: 3277182 - protein, 28 aa, Plasmodium falciparum
VNCLTKWLYKSQVCPICRTNIVNCINSK

SEQ ID NO: 3277183 - protein, 17 aa, Plasmodium falciparum
VNCNACFQNIFTNLFNE

SEQ ID NO: 3277184 - protein, 18 aa, Plasmodium falciparum
VNDLLYFDYVNHFKSFRN

SEQ ID NO: 3277185 - protein, 26 aa, Plasmodium falciparum
VNDLRHRPNLLLYKGKMVDNMNGNKN

SEQ ID NO: 3277186 - protein, 22 aa, Plasmodium falciparum
VNEEYKALTLINILSVENNNVY

SEQ ID NO: 3277187 - protein, 27 aa, Plasmodium falciparum
VNEFLKCVRLLIFKKRVFESKLESAEK

SEQ ID NO: 3277188 - protein, 25 aa, Plasmodium falciparum
VNEILKHWIEYGVLKDKYNETFIAS

SEQ ID NO: 3277189 - protein, 26 aa, Plasmodium falciparum
VNEILWKMFLMPIVDKYLKEEELNGI

SEQ ID NO: 3277190 - protein, 18 aa, Plasmodium falciparum
VNEQDSYMLYTFNIHTLS

SEQ ID NO: 3277191 - protein, 17 aa, Plasmodium falciparum
VNFGAPLSYIQIVIKKK

SEQ ID NO: 3277192 - protein, 19 aa, Plasmodium falciparum
VNFHYCFYVGVQKALYSFY

SEQ ID NO: 3277193 - protein, 18 aa, Plasmodium falciparum
VNFIHPTIYYMLASLEKF

SEQ ID NO: 3277194 - protein, 18 aa, Plasmodium falciparum
VNFILSIYIDIFVNNLIK

SEQ ID NO: 3277195 - protein, 17 aa, Plasmodium falciparum
VNFIYAFSNLRAINYKI

SEQ ID NO: 3277196 - protein, 22 aa, Plasmodium falciparum
VNFIYKCINYFDELKKKLFDKY

SEQ ID NO: 3277197 - protein, 17 aa, Plasmodium falciparum
VNFLKNFGYKSLYDILK

SEQ ID NO: 3277198 - protein, 28 aa, Plasmodium falciparum
VNGCIYMCMLCMCGCMFGNMYKKPKSTV

SEQ ID NO: 3277199 - protein, 22 aa, Plasmodium falciparum
VNGKKLKSTFNPFKRRRNKLKE

SEQ ID NO: 3277200 - protein, 25 aa, Plasmodium falciparum
VNGNYNVKCKYHYNNSRKILCSNNM

SEQ ID NO: 3277201 - protein, 21 aa, Plasmodium falciparum
VNGSLCLKKTISNWSIQIFNV

SEQ ID NO: 3277202 - protein, 18 aa, Plasmodium falciparum
VNIFFCFISTVLNIFCIY

SEQ ID NO: 3277203 - protein, 27 aa, Plasmodium falciparum
VNIIHLYILFCLLFILYEFLKRATKFT

SEQ ID NO: 3277204 - protein, 27 aa, Plasmodium falciparum
VNIKDCLKSPFFCDICECILNICRNNK

SEQ ID NO: 3277205 - protein, 23 aa, Plasmodium falciparum
VNIKLAYRTVRAVYSHVKSFFNI

SEQ ID NO: 3277206 - protein, 28 aa, Plasmodium falciparum
VNILILFLICYSISFIIYMFSYIPFVFF

SEQ ID NO: 3277207 - protein, 17 aa, Plasmodium falciparum
VNILKIKNLEHIKYNYI

SEQ ID NO: 3277208 - protein, 17 aa, Plasmodium falciparum
VNIVCVYPLNFSSTYFI

SEQ ID NO: 3277209 - protein, 21 aa, Plasmodium falciparum
VNKCTIIQIFIFDTSITNSFE

SEQ ID NO: 3277210 - protein, 25 aa, Plasmodium falciparum
VNKCTLPNFIPIYFLNSDGDSDDNG

SEQ ID NO: 3277211 - protein, 27 aa, Plasmodium falciparum
VNKEIIKLNSLYSFLDNLHKCVGSLLI

SEQ ID NO: 3277212 - protein, 26 aa, Plasmodium falciparum
VNKIYSFGIYIDYIFEIHNFMHEEMK

SEQ ID NO: 3277213 - protein, 24 aa, Plasmodium falciparum
VNKLCYDWLDYILLSDNLLEDLSK

SEQ ID NO: 3277214 - protein, 17 aa, Plasmodium falciparum
VNKNCLLINTGCGNSNI

SEQ ID NO: 3277215 - protein, 22 aa, Plasmodium falciparum
VNKTCLYFNFNENIYYMLQNND

SEQ ID NO: 3277216 - protein, 23 aa, Plasmodium falciparum
VNKYHFFCKFCFNKKPNQSKENI

SEQ ID NO: 3277217 - protein, 25 aa, Plasmodium falciparum
VNKYKHHFSNVILKLIHYSFYNLTY

SEQ ID NO: 3277218 - protein, 25 aa, Plasmodium falciparum
VNKYRYAYFKALEVINHYEELVKRN

SEQ ID NO: 3277219 - protein, 24 aa, Plasmodium falciparum
VNLENFKLYIDDIVSYKQKNVYHI

SEQ ID NO: 3277220 - protein, 22 aa, Plasmodium falciparum
VNLFRNLLLFVHFNKNIMYDNV

SEQ ID NO: 3277221 - protein, 17 aa, Plasmodium falciparum
VNLFYIFLKENNKKYET

SEQ ID NO: 3277222 - protein, 20 aa, Plasmodium falciparum
VNLICLDFSLAIKVIHVLSQ

SEQ ID NO: 3277223 - protein, 24 aa, Plasmodium falciparum
VNLIDTCMLTFQIHHNVQGIIKHS

SEQ ID NO: 3277224 - protein, 27 aa, Plasmodium falciparum
VNLKYLSKYGFLYLIFLFFKIDKHTVQ

SEQ ID NO: 3277225 - protein, 25 aa, Plasmodium falciparum
VNLNAICLFFLSLGGYYIYTPYSDN

SEQ ID NO: 3277226 - protein, 26 aa, Plasmodium falciparum
VNLRLFRTVFLSWILTVVFSATVTAG

SEQ ID NO: 3277227 - protein, 21 aa, Plasmodium falciparum
VNMFKLFRLQSYCIVILAGIL

SEQ ID NO: 3277228 - protein, 20 aa, Plasmodium falciparum
VNMYDLYNDIIFLDREKKTH

SEQ ID NO: 3277229 - protein, 25 aa, Plasmodium falciparum
VNNFDYKLYGAIIHGGISASSGHYY

SEQ ID NO: 3277230 - protein, 18 aa, Plasmodium falciparum
VNNFLCFMFYKHLSNKLN

SEQ ID NO: 3277231 - protein, 20 aa, Plasmodium falciparum
VNNIKECIIYLISSILMYAQ

SEQ ID NO: 3277232 - protein, 17 aa, Plasmodium falciparum
VNNKFHVHKNISHNKDD

SEQ ID NO: 3277233 - protein, 23 aa, Plasmodium falciparum
VNNMEFQHLPKLINNMEPYNKNN

SEQ ID NO: 3277234 - protein, 31 aa, Plasmodium falciparum
VNNNICNIFLYFFVMIFFHLYIQNSDDKRKE

SEQ ID NO: 3277235 - protein, 24 aa, Plasmodium falciparum
VNNRKLRKGCTVHEIGFMDDDNRN

SEQ ID NO: 3277236 - protein, 19 aa, Plasmodium falciparum
VNNSSCYYIKYGEKDFNVN

SEQ ID NO: 3277237 - protein, 20 aa, Plasmodium falciparum
VNNSSFLWGVWTIENNANEK

SEQ ID NO: 3277238 - protein, 20 aa, Plasmodium falciparum
VNNTKWCWHKLEGKNFRVFV

SEQ ID NO: 3277239 - protein, 27 aa, Plasmodium falciparum
VNQQHKVKCINFFRKLSKNGFLNMDEE

SEQ ID NO: 3277240 - protein, 23 aa, Plasmodium falciparum
VNRERIINLLFFLYKKYIDKKDL

SEQ ID NO: 3277241 - protein, 17 aa, Plasmodium falciparum
VNRNVCNALYIWKVCAD

SEQ ID NO: 3277242 - protein, 28 aa, Plasmodium falciparum
VNRNYPFFVDLIFWGRANENISVLDTKE

SEQ ID NO: 3277243 - protein, 18 aa, Plasmodium falciparum
VNRSIKLFEKFEREHKKD

SEQ ID NO: 3277244 - protein, 24 aa, Plasmodium falciparum
VNRTYEFLFSFFLLLDNIQINISN

SEQ ID NO: 3277245 - protein, 18 aa, Plasmodium falciparum
VNRVSWKDQNGVVEHNNC

SEQ ID NO: 3277246 - protein, 24 aa, Plasmodium falciparum
VNRYKILIETSGKYIGMCSDNELF

SEQ ID NO: 3277247 - protein, 18 aa, Plasmodium falciparum
VNSIKFPLYIKFEEELFK

SEQ ID NO: 3277248 - protein, 20 aa, Plasmodium falciparum
VNSQMCLRIEKIRNDRRESN

SEQ ID NO: 3277249 - protein, 17 aa, Plasmodium falciparum
VNTCLNLLYIIDLYMEF

SEQ ID NO: 3277250 - protein, 17 aa, Plasmodium falciparum
VNTWNVHKSIIYEIKKT

SEQ ID NO: 3277251 - protein, 23 aa, Plasmodium falciparum
VNVKFLKGCSEFIRNYYIRTNEN

SEQ ID NO: 3277252 - protein, 21 aa, Plasmodium falciparum
VNVLGAIDFIGNPLIIYKHWK

SEQ ID NO: 3277253 - protein, 37 aa, Plasmodium falciparum
VNVYDFCFLENIILNFSLSFYRQWIRFIKIKNEDFFK

SEQ ID NO: 3277254 - protein, 17 aa, Plasmodium falciparum
VNYCLVVLIKLNLLNKK

SEQ ID NO: 3277255 - protein, 17 aa, Plasmodium falciparum
VNYDIQYSYIFKDLNSQ

SEQ ID NO: 3277256 - protein, 17 aa, Plasmodium falciparum
VNYECVEYISSLQIDFR

SEQ ID NO: 3277257 - protein, 22 aa, Plasmodium falciparum
VNYELRCYIYACRNVISHFNDS

SEQ ID NO: 3277258 - protein, 17 aa, Plasmodium falciparum
VNYFIKYKNDDKLINDL

SEQ ID NO: 3277259 - protein, 19 aa, Plasmodium falciparum
VNYLIKIVKSCYDFRFTYN

SEQ ID NO: 3277260 - protein, 21 aa, Plasmodium falciparum
VNYLKYIFKNNIDEEINKLDS

SEQ ID NO: 3277261 - protein, 17 aa, Plasmodium falciparum
VNYNGVCNHIIFTYKYN

SEQ ID NO: 3277262 - protein, 17 aa, Plasmodium falciparum
VNYNIYNSLSFGYVKKI

SEQ ID NO: 3277263 - protein, 25 aa, Plasmodium falciparum
VNYYKIKSLILYGGTDIFESIKTLF

SEQ ID NO: 3277264 - protein, 19 aa, Plasmodium falciparum
VPCSEFLKDISGYIINILH

SEQ ID NO: 3277265 - protein, 23 aa, Plasmodium falciparum
VPDFMKKTFYLAAAGEGKKLREK

SEQ ID NO: 3277266 - protein, 17 aa, Plasmodium falciparum
VPEILYFSKFFMNACFI

SEQ ID NO: 3277267 - protein, 21 aa, Plasmodium falciparum
VPFNILYKLLNKYALNNNNLY

SEQ ID NO: 3277268 - protein, 26 aa, Plasmodium falciparum
VPHISSFFCTFLIHPSYFMPNDLDEN

SEQ ID NO: 3277269 - protein, 19 aa, Plasmodium falciparum
VPHYSALRYNKVEKNVTDE

SEQ ID NO: 3277270 - protein, 25 aa, Plasmodium falciparum
VPIFKEYPTLWLLLNNIEYEQIYYL

SEQ ID NO: 3277271 - protein, 27 aa, Plasmodium falciparum
VPILLEYWLFINILKFLKTAFFFHKFV

SEQ ID NO: 3277272 - protein, 23 aa, Plasmodium falciparum
VPIPGIFNLFSHYKKYSCLDFLK

SEQ ID NO: 3277273 - protein, 17 aa, Plasmodium falciparum
VPIPSYFYKKSFYKCFS

SEQ ID NO: 3277274 - protein, 24 aa, Plasmodium falciparum
VPIYSFKKKVVFKLSRGQNREFSI

SEQ ID NO: 3277275 - protein, 19 aa, Plasmodium falciparum
VPLALALLFTSFPKPNIVD

SEQ ID NO: 3277276 - protein, 23 aa, Plasmodium falciparum
VPLFMKDIFTFFTLSLNKNIIVY

SEQ ID NO: 3277277 - protein, 17 aa, Plasmodium falciparum
VPLKKRFYMESRKSINE

SEQ ID NO: 3277278 - protein, 22 aa, Plasmodium falciparum
VPLNYMYFCISKNTDIYDYIKN

SEQ ID NO: 3277279 - protein, 36 aa, Plasmodium falciparum
VPLSVISCIYIYYKMRVRVCFFFKNTYSNVCRFMTN

SEQ ID NO: 3277280 - protein, 19 aa, Plasmodium falciparum
VPMKILFNNTFELFCLFVF

SEQ ID NO: 3277281 - protein, 18 aa, Plasmodium falciparum
VPNIKYPNFFINKNNIPY

SEQ ID NO: 3277282 - protein, 23 aa, Plasmodium falciparum
VPNKRLRIKPVYKEVKVPQIEYI

SEQ ID NO: 3277283 - protein, 18 aa, Plasmodium falciparum
VPNTLPIEYFDYETLKEN

SEQ ID NO: 3277284 - protein, 18 aa, Plasmodium falciparum
VPPMDWEKLIIFGNFSDG

SEQ ID NO: 3277285 - protein, 17 aa, Plasmodium falciparum
VPPQRVYHSADMCKEGP

SEQ ID NO: 3277286 - protein, 21 aa, Plasmodium falciparum
VPQFLRWFEEWAEDFCRKKKK

SEQ ID NO: 3277287 - protein, 19 aa, Plasmodium falciparum
VPQFLRWFTEWAEEFCRIR

SEQ ID NO: 3277288 - protein, 24 aa, Plasmodium falciparum
VPQFLRWLTEWIEDFYREKQNLID

SEQ ID NO: 3277289 - protein, 21 aa, Plasmodium falciparum
VPQYIRWFEEWAEDFCRKKKK

SEQ ID NO: 3277290 - protein, 20 aa, Plasmodium falciparum
VPQYLRWFEEWAEDFCRKKK

SEQ ID NO: 3277291 - protein, 21 aa, Plasmodium falciparum
VPQYLRWFEEWAEDFCRKKKH

SEQ ID NO: 3277292 - protein, 22 aa, Plasmodium falciparum
VPQYLRWFEEWAEDFCRKKKHK

SEQ ID NO: 3277293 - protein, 21 aa, Plasmodium falciparum
VPQYLRWFEEWAEDFCRKKNK

SEQ ID NO: 3277294 - protein, 21 aa, Plasmodium falciparum
VPQYLRWFEEWAEDFCRKRKH

SEQ ID NO: 3277295 - protein, 22 aa, Plasmodium falciparum
VPQYLRWFEEWAEDFCRKRKKQ

SEQ ID NO: 3277296 - protein, 21 aa, Plasmodium falciparum
VPQYLRWFEEWAEDFCRKRKY

SEQ ID NO: 3277297 - protein, 22 aa, Plasmodium falciparum
VPQYLRWFEEWAEDFCRKRKYK

SEQ ID NO: 3277298 - protein, 25 aa, Plasmodium falciparum
VPQYLRWFEEWAEDFCRLRKHKLQN

SEQ ID NO: 3277299 - protein, 25 aa, Plasmodium falciparum
VPQYLRWFEEWAEEFCRLRKHKLQN

SEQ ID NO: 3277300 - protein, 23 aa, Plasmodium falciparum
VPQYLRWFEEWGEDFCRKKKKKV

SEQ ID NO: 3277301 - protein, 21 aa, Plasmodium falciparum
VPQYLRWFEEWTEEFCRKKKK

SEQ ID NO: 3277302 - protein, 20 aa, Plasmodium falciparum
VPRAPKYKTLIEVVLEPSGK

SEQ ID NO: 3277303 - protein, 17 aa, Plasmodium falciparum
VPRNHIFHINKCDLNYY

SEQ ID NO: 3277304 - protein, 17 aa, Plasmodium falciparum
VPSLFAYFLKRHKDNEN

SEQ ID NO: 3277305 - protein, 24 aa, Plasmodium falciparum
VPSNLKFKYMYGKRDTTNFNNKEN

SEQ ID NO: 3277306 - protein, 21 aa, Plasmodium falciparum
VPTCVKSSFCNYCCVSDDKIY

SEQ ID NO: 3277307 - protein, 17 aa, Plasmodium falciparum
VPTFLTALGGIILLVTL

SEQ ID NO: 3277308 - protein, 25 aa, Plasmodium falciparum
VPTYIKRKCMAKVNFHMTNDYLDLE

SEQ ID NO: 3277309 - protein, 27 aa, Plasmodium falciparum
VPVVFWIILLLFGWNEILFFIRMFFKL

SEQ ID NO: 3277310 - protein, 22 aa, Plasmodium falciparum
VPYLHDFPFPYFVVVDDLNNIP

SEQ ID NO: 3277311 - protein, 22 aa, Plasmodium falciparum
VPYLLFENFLTYSLNKIDNEKD

SEQ ID NO: 3277312 - protein, 24 aa, Plasmodium falciparum
VPYMSYLCKQEILKYNVLDIPLKI

SEQ ID NO: 3277313 - protein, 26 aa, Plasmodium falciparum
VQDLGYRLYELIFIKLISLSKNKLKL

SEQ ID NO: 3277314 - protein, 27 aa, Plasmodium falciparum
VQEFSRFQIMIVRCLSFLLKKKNINKL

SEQ ID NO: 3277315 - protein, 25 aa, Plasmodium falciparum
VQERMLSNFIKFWIIKSKQFEYFQQ

SEQ ID NO: 3277316 - protein, 22 aa, Plasmodium falciparum
VQEVKDAGGLCILKNDKNKKEE

SEQ ID NO: 3277317 - protein, 19 aa, Plasmodium falciparum
VQFHFPIYYTKFLYNYKST

SEQ ID NO: 3277318 - protein, 24 aa, Plasmodium falciparum
VQFISVHIYFLYSIKLPKKTFKQK

SEQ ID NO: 3277319 - protein, 17 aa, Plasmodium falciparum
VQHKIGILLFVGDEYGC

SEQ ID NO: 3277320 - protein, 17 aa, Plasmodium falciparum
VQIFKNIFLVFQKTLKY

SEQ ID NO: 3277321 - protein, 25 aa, Plasmodium falciparum
VQILKVCFYISFILFTLYVLPKKLV

SEQ ID NO: 3277322 - protein, 17 aa, Plasmodium falciparum
VQILYARYYFLKEKYIK

SEQ ID NO: 3277323 - protein, 23 aa, Plasmodium falciparum
VQKKESRRFYSINLKEKNFRWSM

SEQ ID NO: 3277324 - protein, 21 aa, Plasmodium falciparum
VQLFYILTIIILKYVFKSVNK

SEQ ID NO: 3277325 - protein, 20 aa, Plasmodium falciparum
VQLLLKLGADLTIKNKKGIS

SEQ ID NO: 3277326 - protein, 17 aa, Plasmodium falciparum
VQMMDLLINKMDLALNP

SEQ ID NO: 3277327 - protein, 34 aa, Plasmodium falciparum
VQMNFIFCRICCIFLFFQNMCFHKYDLINKECKV

SEQ ID NO: 3277328 - protein, 22 aa, Plasmodium falciparum
VQNGFKRLINFNLQLYNELNNK

SEQ ID NO: 3277329 - protein, 18 aa, Plasmodium falciparum
VQNGLKYLFFYMKNSHKF

SEQ ID NO: 3277330 - protein, 17 aa, Plasmodium falciparum
VQNVKCDKTKIAIISFN

SEQ ID NO: 3277331 - protein, 24 aa, Plasmodium falciparum
VQNYLYLLIFQRLHLLNYRNNDTL

SEQ ID NO: 3277332 - protein, 25 aa, Plasmodium falciparum
VQPKHLNLLKMLKKYMYEIIEESCF

SEQ ID NO: 3277333 - protein, 21 aa, Plasmodium falciparum
VQRMSFPFFLFLLVNVLINDL

SEQ ID NO: 3277334 - protein, 28 aa, Plasmodium falciparum
VQSANILWRNDIIGVISFELKLIKNKRN

SEQ ID NO: 3277335 - protein, 26 aa, Plasmodium falciparum
VQSYKIKINFLVLMFLLLYSSKQIDD

SEQ ID NO: 3277336 - protein, 24 aa, Plasmodium falciparum
VQTKLPFHYVWAIIYLFIIFTSSV

SEQ ID NO: 3277337 - protein, 18 aa, Plasmodium falciparum
VQTYICKDKEKISSNYEE

SEQ ID NO: 3277338 - protein, 20 aa, Plasmodium falciparum
VQVIPKHMIHEFKELVNKKH

SEQ ID NO: 3277339 - protein, 22 aa, Plasmodium falciparum
VQYKKKYLKILMNPKHLTTLTQ

SEQ ID NO: 3277340 - protein, 25 aa, Plasmodium falciparum
VRALIKRWLEYFLEDYNKIKKKLKS

SEQ ID NO: 3277341 - protein, 17 aa, Plasmodium falciparum
VRCILPINYEQPITTKE

SEQ ID NO: 3277342 - protein, 18 aa, Plasmodium falciparum
VREALVFNVPFFSKFPQF

SEQ ID NO: 3277343 - protein, 20 aa, Plasmodium falciparum
VREILKTKVSILKNNKYYER

SEQ ID NO: 3277344 - protein, 22 aa, Plasmodium falciparum
VREYWWALNRDQVWKAITCDAD

SEQ ID NO: 3277345 - protein, 18 aa, Plasmodium falciparum
VRFYLNEKLQHMKFEDLY

SEQ ID NO: 3277346 - protein, 29 aa, Plasmodium falciparum
VRGIIPPSLSDKIILLIFFTVVNIIHLYI

SEQ ID NO: 3277347 - protein, 27 aa, Plasmodium falciparum
VRHPLCPSKIRSCCITPMTVTSLFGLI

SEQ ID NO: 3277348 - protein, 17 aa, Plasmodium falciparum
VRIALKVFSIVLNIFNL

SEQ ID NO: 3277349 - protein, 17 aa, Plasmodium falciparum
VRIFIKLFSKNDYSIFF

SEQ ID NO: 3277350 - protein, 26 aa, Plasmodium falciparum
VRIINKCGIPLEFCFFDGSRNPILLT

SEQ ID NO: 3277351 - protein, 18 aa, Plasmodium falciparum
VRILSETEPPMSLEEIMR

SEQ ID NO: 3277352 - protein, 17 aa, Plasmodium falciparum
VRIRYGFLHNGYVPNKW

SEQ ID NO: 3277353 - protein, 23 aa, Plasmodium falciparum
VRKECRGEYPGEKYCGGDGHDCT

SEQ ID NO: 3277354 - protein, 22 aa, Plasmodium falciparum
VRKKWYDSMDCISINNKDENNN

SEQ ID NO: 3277355 - protein, 17 aa, Plasmodium falciparum
VRKTKEWQQVKAHYEKE

SEQ ID NO: 3277356 - protein, 17 aa, Plasmodium falciparum
VRLLFLSIISFIFELGF

SEQ ID NO: 3277357 - protein, 18 aa, Plasmodium falciparum
VRLLIWGFFIPFLYFLYK

SEQ ID NO: 3277358 - protein, 19 aa, Plasmodium falciparum
VRLSFGKCLLTICELNIKE

SEQ ID NO: 3277359 - protein, 22 aa, Plasmodium falciparum
VRNGYIPFCMCNNTEGLFLKRD

SEQ ID NO: 3277360 - protein, 27 aa, Plasmodium falciparum
VRNKYRKLHFGWKLFVNISPPAALAII

SEQ ID NO: 3277361 - protein, 37 aa, Plasmodium falciparum
VRNKYRKLHFGWKLFVNISPPAALAIIGTAVAIIPSG

SEQ ID NO: 3277362 - protein, 19 aa, Plasmodium falciparum
VRNSLNFQNIMSIDNKEEY

SEQ ID NO: 3277363 - protein, 17 aa, Plasmodium falciparum
VRNYSYKIIKDSYTNHV

SEQ ID NO: 3277364 - protein, 24 aa, Plasmodium falciparum
VRRIRRINEQILLILCNEKMIHNI

SEQ ID NO: 3277365 - protein, 20 aa, Plasmodium falciparum
VRRLMPCVSLNKINSVYLLK

SEQ ID NO: 3277366 - protein, 26 aa, Plasmodium falciparum
VRRPIWKFSSGIFQMMGFKKKSYNIM

SEQ ID NO: 3277367 - protein, 17 aa, Plasmodium falciparum
VRSNNKFDLLKNDDEKH

SEQ ID NO: 3277368 - protein, 17 aa, Plasmodium falciparum
VRSPFLVSLFKGDNFKS

SEQ ID NO: 3277369 - protein, 19 aa, Plasmodium falciparum
VRSQWTFILILLYFIILAA

SEQ ID NO: 3277370 - protein, 18 aa, Plasmodium falciparum
VRTFAGAISIEYQTDSCL

SEQ ID NO: 3277371 - protein, 18 aa, Plasmodium falciparum
VRTGGGLCILEKKKEEGE

SEQ ID NO: 3277372 - protein, 27 aa, Plasmodium falciparum
VRYYTWWCEEPQFLPMHLMPKEIQNLV

SEQ ID NO: 3277373 - protein, 17 aa, Plasmodium falciparum
VSAGLFFNKHIMIIESN

SEQ ID NO: 3277374 - protein, 33 aa, Plasmodium falciparum
VSAQEYFCDYFLCYIKYLLILKKKNMIYFKVSK

SEQ ID NO: 3277375 - protein, 19 aa, Plasmodium falciparum
VSCNKSPKKILICLYCGST

SEQ ID NO: 3277376 - protein, 17 aa, Plasmodium falciparum
VSCSTPFNARGLLKSAI

SEQ ID NO: 3277377 - protein, 21 aa, Plasmodium falciparum
VSCVVIKVILTEEVKEIMQRK

SEQ ID NO: 3277378 - protein, 19 aa, Plasmodium falciparum
VSDVHAFIQKDMKYLDDLI

SEQ ID NO: 3277379 - protein, 21 aa, Plasmodium falciparum
VSEYTLFKSMYIIRKYCHINE

SEQ ID NO: 3277380 - protein, 17 aa, Plasmodium falciparum
VSFFWAPFIYFQFSMLF

SEQ ID NO: 3277381 - protein, 17 aa, Plasmodium falciparum
VSFLKRRVEKKRNKKQM

SEQ ID NO: 3277382 - protein, 20 aa, Plasmodium falciparum
VSFLKTCAFYLKNYIKLYLL

SEQ ID NO: 3277383 - protein, 29 aa, Plasmodium falciparum
VSFLNMFPYILATHLKCFLYNLKNNSCFV

SEQ ID NO: 3277384 - protein, 25 aa, Plasmodium falciparum
VSFNCIYDKIKLMYQFKPQPYITHI

SEQ ID NO: 3277385 - protein, 17 aa, Plasmodium falciparum
VSGFLATLVHDLIITPI

SEQ ID NO: 3277386 - protein, 17 aa, Plasmodium falciparum
VSGSRYVPNKSVINIDK

SEQ ID NO: 3277387 - protein, 17 aa, Plasmodium falciparum
VSGSTFIELYIGSGASK

SEQ ID NO: 3277388 - protein, 23 aa, Plasmodium falciparum
VSIINIYINYIFKKKKNSHLNIS

SEQ ID NO: 3277389 - protein, 19 aa, Plasmodium falciparum
VSIIPRNNGALGYSQHLSE

SEQ ID NO: 3277390 - protein, 17 aa, Plasmodium falciparum
VSILLFLSSHPMLWECI

SEQ ID NO: 3277391 - protein, 22 aa, Plasmodium falciparum
VSKPALKAIIKFLNPIKDKLDP

SEQ ID NO: 3277392 - protein, 17 aa, Plasmodium falciparum
VSKRWQFFIPHINKEGL

SEQ ID NO: 3277393 - protein, 22 aa, Plasmodium falciparum
VSLCIIYFIFFFIKILKYINKI

SEQ ID NO: 3277394 - protein, 17 aa, Plasmodium falciparum
VSLEICSKQKAYFDGNT

SEQ ID NO: 3277395 - protein, 24 aa, Plasmodium falciparum
VSLINAVVLYIGMSLPSSILIFHN

SEQ ID NO: 3277396 - protein, 23 aa, Plasmodium falciparum
VSLKFPYKGSSPQPLNSINNNNN

SEQ ID NO: 3277397 - protein, 20 aa, Plasmodium falciparum
VSLKLFHFIIKRSSQIFSDA

SEQ ID NO: 3277398 - protein, 18 aa, Plasmodium falciparum
VSLSSAFSLGAKLYLYKK

SEQ ID NO: 3277399 - protein, 23 aa, Plasmodium falciparum
VSLYYRCMEVLLNFLFNTDKRLC

SEQ ID NO: 3277400 - protein, 20 aa, Plasmodium falciparum
VSMVCDLKGSFSADIKKNNF

SEQ ID NO: 3277401 - protein, 22 aa, Plasmodium falciparum
VSNIFKLSFVILKNILNIYHTY

SEQ ID NO: 3277402 - protein, 23 aa, Plasmodium falciparum
VSNIFKRRGFKYIGSAMHLVCLV

SEQ ID NO: 3277403 - protein, 18 aa, Plasmodium falciparum
VSNRKVRRFFENKMNIKE

SEQ ID NO: 3277404 - protein, 18 aa, Plasmodium falciparum
VSRKRFDSNASFKLSDEY

SEQ ID NO: 3277405 - protein, 18 aa, Plasmodium falciparum
VSSATWLIYLYELKRASF

SEQ ID NO: 3277406 - protein, 19 aa, Plasmodium falciparum
VSSCLRGGPVPGVPPVRPT

SEQ ID NO: 3277407 - protein, 21 aa, Plasmodium falciparum
VSSDFFKMFQYLYEPREKNIF

SEQ ID NO: 3277408 - protein, 19 aa, Plasmodium falciparum
VSSEKLAFFPKEYTKKLKL

SEQ ID NO: 3277409 - protein, 34 aa, Plasmodium falciparum
VSSKLKDIGKCIGMKLIERMLIYKNEFYDVKDIL

SEQ ID NO: 3277410 - protein, 17 aa, Plasmodium falciparum
VSTDGSYHWKRKIVDHI

SEQ ID NO: 3277411 - protein, 18 aa, Plasmodium falciparum
VSTLKLLHILIEKFDKDI

SEQ ID NO: 3277412 - protein, 17 aa, Plasmodium falciparum
VSVPRLSVNEFENNDDV

SEQ ID NO: 3277413 - protein, 22 aa, Plasmodium falciparum
VSWLCASLISPFIGIISDYIYK

SEQ ID NO: 3277414 - protein, 37 aa, Plasmodium falciparum
VSYFYFLDLLYKVGTFDFIFNMFNYVMSVYISLLSLY

SEQ ID NO: 3277415 - protein, 21 aa, Plasmodium falciparum
VTANRFLWRKSLLDVQEECNV

SEQ ID NO: 3277416 - protein, 27 aa, Plasmodium falciparum
VTCSLCACLSSIVGTCFGGFLMDFYNL

SEQ ID NO: 3277417 - protein, 43 aa, Plasmodium falciparum
VTDKTWFFLLYFYKLLFEKLYEYFKLYFIYPMKNEEENKNITS

SEQ ID NO: 3277418 - protein, 17 aa, Plasmodium falciparum
VTDLLSWNYMLENMILS

SEQ ID NO: 3277419 - protein, 25 aa, Plasmodium falciparum
VTDLRYITTFYVIKYFPGFSSDNDI

SEQ ID NO: 3277420 - protein, 21 aa, Plasmodium falciparum
VTEVFRYIFDKLGGSEKEFLR

SEQ ID NO: 3277421 - protein, 21 aa, Plasmodium falciparum
VTEYPFFKGIVKKLTLDKSRF

SEQ ID NO: 3277422 - protein, 18 aa, Plasmodium falciparum
VTFENVYNLKSCLLNIYS

SEQ ID NO: 3277423 - protein, 36 aa, Plasmodium falciparum
VTFIFIVDFIFKWIYMFISHNLRLCAAYHLELKSMY

SEQ ID NO: 3277424 - protein, 28 aa, Plasmodium falciparum
VTINIFAPIKIKYAYYNMMTYNNFEQYY

SEQ ID NO: 3277425 - protein, 41 aa, Plasmodium falciparum
VTIYICAMLLGMLCIHICLNLYISYKLLMQVQVSKSLKSIE

SEQ ID NO: 3277426 - protein, 24 aa, Plasmodium falciparum
VTKAGKFLTMFIIITCISFVAAQF

SEQ ID NO: 3277427 - protein, 22 aa, Plasmodium falciparum
VTKAKTKFWGFDNNKSLETNKN

SEQ ID NO: 3277428 - protein, 23 aa, Plasmodium falciparum
VTKDRKRGLGLRRTGTEDTSQEG

SEQ ID NO: 3277429 - protein, 17 aa, Plasmodium falciparum
VTKGRLYRGTVFDEDDN

SEQ ID NO: 3277430 - protein, 19 aa, Plasmodium falciparum
VTKNLAHFFGFSRVLDTPI

SEQ ID NO: 3277431 - protein, 30 aa, Plasmodium falciparum
VTKNSCIYFFKFIIFYILEILKNSYFKIHL

SEQ ID NO: 3277432 - protein, 19 aa, Plasmodium falciparum
VTKNSFLKAYIDWNNVPYN

SEQ ID NO: 3277433 - protein, 23 aa, Plasmodium falciparum
VTLKNLIKCYICKIKREELNKSN

SEQ ID NO: 3277434 - protein, 32 aa, Plasmodium falciparum
VTLNLIPYYCRYICIINKYAKDMYPIIIDELK

SEQ ID NO: 3277435 - protein, 18 aa, Plasmodium falciparum
VTLYALKYDHVNNFGYHN

SEQ ID NO: 3277436 - protein, 19 aa, Plasmodium falciparum
VTNEWINKLVIKYKNDYID

SEQ ID NO: 3277437 - protein, 21 aa, Plasmodium falciparum
VTNFLCMYDYSDLLNILNHYI

SEQ ID NO: 3277438 - protein, 24 aa, Plasmodium falciparum
VTNNKIRLFVLFLELVLCTILHTT

SEQ ID NO: 3277439 - protein, 19 aa, Plasmodium falciparum
VTPGRRYGHVMVYSKPNLI

SEQ ID NO: 3277440 - protein, 20 aa, Plasmodium falciparum
VTRKRFVGLNSYEDNTFITV

SEQ ID NO: 3277441 - protein, 22 aa, Plasmodium falciparum
VTSCKGWSAPHKTLLYLNRNNY

SEQ ID NO: 3277442 - protein, 24 aa, Plasmodium falciparum
VTSPTCIKSLFLKLISTIQELNSI

SEQ ID NO: 3277443 - protein, 23 aa, Plasmodium falciparum
VTSSLLAFTGIAIIMMGKLSLHG

SEQ ID NO: 3277444 - protein, 27 aa, Plasmodium falciparum
VTTPQTWWELHGPHIWNGMICALTYKE

SEQ ID NO: 3277445 - protein, 21 aa, Plasmodium falciparum
VTTREIICKDFCLETNEYLIR

SEQ ID NO: 3277446 - protein, 17 aa, Plasmodium falciparum
VTVLFGWILNKPMTLAF

SEQ ID NO: 3277447 - protein, 26 aa, Plasmodium falciparum
VTVPIGVLKDSVRFFNSKKNKRKKGT

SEQ ID NO: 3277448 - protein, 28 aa, Plasmodium falciparum
VTYFFLSFFFSKYFISFLLLFLSLILFI

SEQ ID NO: 3277449 - protein, 27 aa, Plasmodium falciparum
VTYIKGYEFIYINLLLLLEYCIELLLC

SEQ ID NO: 3277450 - protein, 17 aa, Plasmodium falciparum
VTYKWLYNIISYEIFIR

SEQ ID NO: 3277451 - protein, 18 aa, Plasmodium falciparum
VVELRGTFNDELINLPIL

SEQ ID NO: 3277452 - protein, 27 aa, Plasmodium falciparum
VVFIAKGGVFLNIFPYYSGNNINNIHS

SEQ ID NO: 3277453 - protein, 19 aa, Plasmodium falciparum
VVFTFFFWLLKYGKTRSYP

SEQ ID NO: 3277454 - protein, 25 aa, Plasmodium falciparum
VVGFRTNMCPPFRHDVFAANVQYEL

SEQ ID NO: 3277455 - protein, 19 aa, Plasmodium falciparum
VVICMVFIRRVKGEKVTYG

SEQ ID NO: 3277456 - protein, 17 aa, Plasmodium falciparum
VVIKKFFIMINLACHTR

SEQ ID NO: 3277457 - protein, 24 aa, Plasmodium falciparum
VVIPYKYKNSFFYNFITLNENYKN

SEQ ID NO: 3277458 - protein, 25 aa, Plasmodium falciparum
VVIRNRIKYLYPFLHDYFLNLDYFK

SEQ ID NO: 3277459 - protein, 20 aa, Plasmodium falciparum
VVIYCLYSQKILVSHAHYFV

SEQ ID NO: 3277460 - protein, 19 aa, Plasmodium falciparum
VVIYSVLLFIEFKKEANIK

SEQ ID NO: 3277461 - protein, 21 aa, Plasmodium falciparum
VVKEIIHKHVIKLCKLNLKKT

SEQ ID NO: 3277462 - protein, 17 aa, Plasmodium falciparum
VVKKGIFYLGNKVPKVV

SEQ ID NO: 3277463 - protein, 27 aa, Plasmodium falciparum
VVKYIDWNCMKPLHIQPFFNYFEQYRI

SEQ ID NO: 3277464 - protein, 25 aa, Plasmodium falciparum
VVLIPCSPFILLGGIGRCTFHSKES

SEQ ID NO: 3277465 - protein, 25 aa, Plasmodium falciparum
VVLIPSIYNRRGVLYNKNPINSDNF

SEQ ID NO: 3277466 - protein, 22 aa, Plasmodium falciparum
VVLKRQPFFVFLGYGACEYNLD

SEQ ID NO: 3277467 - protein, 38 aa, Plasmodium falciparum
VVLSPFSLIFVHLFFCIFFISLSYKYGKFVPPYYKKKN

SEQ ID NO: 3277468 - protein, 25 aa, Plasmodium falciparum
VVLWIELIATFFFWFIISNTKFFLD

SEQ ID NO: 3277469 - protein, 19 aa, Plasmodium falciparum
VVMRLCFLSLTLIFMFFLN

SEQ ID NO: 3277470 - protein, 17 aa, Plasmodium falciparum
VVNFLCWAAEPAHDERK

SEQ ID NO: 3277471 - protein, 17 aa, Plasmodium falciparum
VVNFYFLLNRLINRTHN

SEQ ID NO: 3277472 - protein, 27 aa, Plasmodium falciparum
VVPILSFEILDVFAFDNVRKRMSLIVK

SEQ ID NO: 3277473 - protein, 18 aa, Plasmodium falciparum
VVSSTFFLYFSILVIVSL

SEQ ID NO: 3277474 - protein, 25 aa, Plasmodium falciparum
VVTEVTICCPICLKNNKKIFYCSQE

SEQ ID NO: 3277475 - protein, 18 aa, Plasmodium falciparum
VVVSRTRFFKSISNYGEF

SEQ ID NO: 3277476 - protein, 27 aa, Plasmodium falciparum
VVWKHKRIKIFSNINICLLKLKVNQGI

SEQ ID NO: 3277477 - protein, 24 aa, Plasmodium falciparum
VVYGCFFFNIILLMGISTKRYLAN

SEQ ID NO: 3277478 - protein, 27 aa, Plasmodium falciparum
VVYLPICLKCFYTLFFDYVAYYIYIRY

SEQ ID NO: 3277479 - protein, 22 aa, Plasmodium falciparum
VWAGPSVGWTAEFALSAISDNP

SEQ ID NO: 3277480 - protein, 18 aa, Plasmodium falciparum
VWEKIRMVVTNRVINVYS

SEQ ID NO: 3277481 - protein, 18 aa, Plasmodium falciparum
VWESMRCGIDEVDQRRKT

SEQ ID NO: 3277482 - protein, 18 aa, Plasmodium falciparum
VWNKCCAIITEELLKLDS

SEQ ID NO: 3277483 - protein, 25 aa, Plasmodium falciparum
VWVFIGIGCGYIYGTLEYKKKIRDK

SEQ ID NO: 3277484 - protein, 19 aa, Plasmodium falciparum
VYAGSKCVEGVVIIYVKDI

SEQ ID NO: 3277485 - protein, 26 aa, Plasmodium falciparum
VYCFIACLLLCNINQVFTLHVLNYNN

SEQ ID NO: 3277486 - protein, 20 aa, Plasmodium falciparum
VYDFFFNRFFQICSNVFFLL

SEQ ID NO: 3277487 - protein, 21 aa, Plasmodium falciparum
VYDINNFYLLSSFEYNNKEII

SEQ ID NO: 3277488 - protein, 23 aa, Plasmodium falciparum
VYDRPCTFIICSLICCLLLTCGF

SEQ ID NO: 3277489 - protein, 21 aa, Plasmodium falciparum
VYEDLNILSIINFLNISTNIN

SEQ ID NO: 3277490 - protein, 23 aa, Plasmodium falciparum
VYEESCESFLPKVQYKNSHNNNN

SEQ ID NO: 3277491 - protein, 27 aa, Plasmodium falciparum
VYEIYRKTHLLPFIKKDYNSISLFLSL

SEQ ID NO: 3277492 - protein, 23 aa, Plasmodium falciparum
VYEKKLFVCDLCANNYNYENVNC

SEQ ID NO: 3277493 - protein, 22 aa, Plasmodium falciparum
VYFFNYSFHFIKHFDKDLFLSY

SEQ ID NO: 3277494 - protein, 22 aa, Plasmodium falciparum
VYFLYKIIYHFDKFQNIENNKK

SEQ ID NO: 3277495 - protein, 18 aa, Plasmodium falciparum
VYFSANFFLSLLTIIYEN

SEQ ID NO: 3277496 - protein, 19 aa, Plasmodium falciparum
VYFSLCVSFEIKLIDSFSF

SEQ ID NO: 3277497 - protein, 28 aa, Plasmodium falciparum
VYFSSPYLNLFLSFSIKLIYKYKNVVQC

SEQ ID NO: 3277498 - protein, 32 aa, Plasmodium falciparum
VYIKTLYSCFILRFLELWKRWYKIKYNEEVIN

SEQ ID NO: 3277499 - protein, 17 aa, Plasmodium falciparum
VYILSTIFYFLLYHERF

SEQ ID NO: 3277500 - protein, 17 aa, Plasmodium falciparum
VYINAILYFEFIYNKQN

SEQ ID NO: 3277501 - protein, 23 aa, Plasmodium falciparum
VYIYRRILKSVDMFSSIFENYNN

SEQ ID NO: 3277502 - protein, 19 aa, Plasmodium falciparum
VYIYYALVCALFYFCIGGS

SEQ ID NO: 3277503 - protein, 23 aa, Plasmodium falciparum
VYKEVMKYYLFIFSYFNKHFFDI

SEQ ID NO: 3277504 - protein, 21 aa, Plasmodium falciparum
VYKKKINNIFFLSSSKRNENS

SEQ ID NO: 3277505 - protein, 18 aa, Plasmodium falciparum
VYKSFSFNNIQFNKGTIF

SEQ ID NO: 3277506 - protein, 17 aa, Plasmodium falciparum
VYLENGTDLFGNNAIYH

SEQ ID NO: 3277507 - protein, 17 aa, Plasmodium falciparum
VYLFHMFSLSLRMQKNI

SEQ ID NO: 3277508 - protein, 20 aa, Plasmodium falciparum
VYLFVKKIPIEVWIRQYNLM

SEQ ID NO: 3277509 - protein, 20 aa, Plasmodium falciparum
VYLKFPCYIYNLITLLVNYI

SEQ ID NO: 3277510 - protein, 23 aa, Plasmodium falciparum
VYLLKKFLKVIIRILRLDIQKED

SEQ ID NO: 3277511 - protein, 24 aa, Plasmodium falciparum
VYLLYKMKIIISIYINPNQYIMLN

SEQ ID NO: 3277512 - protein, 19 aa, Plasmodium falciparum
VYLYYKCYNKLYNLKIDNN

SEQ ID NO: 3277513 - protein, 24 aa, Plasmodium falciparum
VYMPPRRQKLCVINLEHFKENTSD

SEQ ID NO: 3277514 - protein, 27 aa, Plasmodium falciparum
VYNAGGVVCCVLFFASITFFSMDRSNK

SEQ ID NO: 3277515 - protein, 27 aa, Plasmodium falciparum
VYNENYKLIGMLLKILMKHKIYVETII

SEQ ID NO: 3277516 - protein, 19 aa, Plasmodium falciparum
VYNFFKTFFVTLISISSIN

SEQ ID NO: 3277517 - protein, 25 aa, Plasmodium falciparum
VYNFSLKIKPFFRSLNFMTVDTRKV

SEQ ID NO: 3277518 - protein, 20 aa, Plasmodium falciparum
VYNIRECNFTLLKKIQLSKN

SEQ ID NO: 3277519 - protein, 21 aa, Plasmodium falciparum
VYNKKVCVHYISPINVKSSND

SEQ ID NO: 3277520 - protein, 17 aa, Plasmodium falciparum
VYNKLVYYIKDMLLELD

SEQ ID NO: 3277521 - protein, 26 aa, Plasmodium falciparum
VYNLCLKGDSVIIFLSGMQDITDMYH

SEQ ID NO: 3277522 - protein, 20 aa, Plasmodium falciparum
VYNLKSCLLNIYSNVCDDQE

SEQ ID NO: 3277523 - protein, 44 aa, Plasmodium falciparum
VYNNVCINILCGHIFHSNCLKKCCFTSCPICRYKQYNYQIANCD

SEQ ID NO: 3277524 - protein, 24 aa, Plasmodium falciparum
VYPSSKACKYEFNFPTRKESTFDY

SEQ ID NO: 3277525 - protein, 20 aa, Plasmodium falciparum
VYPVRSFLETWIPKIPVANA

SEQ ID NO: 3277526 - protein, 18 aa, Plasmodium falciparum
VYRIFKAYNKILLYEYNY

SEQ ID NO: 3277527 - protein, 24 aa, Plasmodium falciparum
VYSEKVMITYSFIKKYLFKNMYEK

SEQ ID NO: 3277528 - protein, 24 aa, Plasmodium falciparum
VYSKYGRNVFFFIYEKLSAHKKEC

SEQ ID NO: 3277529 - protein, 24 aa, Plasmodium falciparum
VYTFGRKSFESVNMYVDDNEEDEG

SEQ ID NO: 3277530 - protein, 35 aa, Plasmodium falciparum
VYTFNEYYYCISFIKCLDSLLSYCTFEITDPNIKT

SEQ ID NO: 3277531 - protein, 25 aa, Plasmodium falciparum
VYTLNLIIFFKLLKTNIFHSQNNQL

SEQ ID NO: 3277532 - protein, 28 aa, Plasmodium falciparum
VYTLQLFMNILWCASADLHAKKNNPSIV

SEQ ID NO: 3277533 - protein, 40 aa, Plasmodium falciparum
VYTLQSFIFYNFFFKKINKYMCTYPFFNYKYTHFKNYINQ

SEQ ID NO: 3277534 - protein, 25 aa, Plasmodium falciparum
VYYLSNLYHAFIFSKNIKYYQHNFN

SEQ ID NO: 3277535 - protein, 26 aa, Plasmodium falciparum
VYYQFFEFLLKYYITFLCTNNLTFLL

SEQ ID NO: 3277536 - protein, 17 aa, Plasmodium falciparum
WALYLIWAFIFDDILIL

SEQ ID NO: 3277537 - protein, 23 aa, Plasmodium falciparum
WANISVLCSIVIDIFKQEDMVLK

SEQ ID NO: 3277538 - protein, 26 aa, Plasmodium falciparum
WAVWSICKLLYFNISFDNYYIKLKKR

SEQ ID NO: 3277539 - protein, 21 aa, Plasmodium falciparum
WAYKLKYFVKNIIRRISLILA

SEQ ID NO: 3277540 - protein, 25 aa, Plasmodium falciparum
WCNNDLMCLPAILTKPYECYEDSSL

SEQ ID NO: 3277541 - protein, 19 aa, Plasmodium falciparum
WCVFFWFVSFFYFPVFYFF

SEQ ID NO: 3277542 - protein, 18 aa, Plasmodium falciparum
WDIFYSIYNRLIIESSSD

SEQ ID NO: 3277543 - protein, 23 aa, Plasmodium falciparum
WDKSDICNLHYLPKMKSIILNLY

SEQ ID NO: 3277544 - protein, 18 aa, Plasmodium falciparum
WDNYKCLLNFITTICTDL

SEQ ID NO: 3277545 - protein, 20 aa, Plasmodium falciparum
WDRIVLKFCRTVAIEEAEYT

SEQ ID NO: 3277546 - protein, 17 aa, Plasmodium falciparum
WDYKYLWNKADSLEDND

SEQ ID NO: 3277547 - protein, 20 aa, Plasmodium falciparum
WEDLEKVLLQSGRHKKFYDK

SEQ ID NO: 3277548 - protein, 24 aa, Plasmodium falciparum
WEECRGDFLQICLEEFLKTKDGIN

SEQ ID NO: 3277549 - protein, 18 aa, Plasmodium falciparum
WEESHIWDRIILSEIEWN

SEQ ID NO: 3277550 - protein, 25 aa, Plasmodium falciparum
WEKHYIINCLLILYIEEGNNEKIKN

SEQ ID NO: 3277551 - protein, 20 aa, Plasmodium falciparum
WEKNCFEFYTDVAYELVKYS

SEQ ID NO: 3277552 - protein, 20 aa, Plasmodium falciparum
WENEEWFKLLMSKYEKDRDD

SEQ ID NO: 3277553 - protein, 20 aa, Plasmodium falciparum
WENEEWFKLLMSTYEKDRDD

SEQ ID NO: 3277554 - protein, 39 aa, Plasmodium falciparum
WENGRRLSKNFNVKRFGNDGALRMAITMKLKKSNPKEQM

SEQ ID NO: 3277555 - protein, 20 aa, Plasmodium falciparum
WENIWKRKRNSLIKETRNLN

SEQ ID NO: 3277556 - protein, 18 aa, Plasmodium falciparum
WEQLWGCTGDNLKDVKDQ

SEQ ID NO: 3277557 - protein, 23 aa, Plasmodium falciparum
WESMLCGYKHAYGNISENDRKML

SEQ ID NO: 3277558 - protein, 18 aa, Plasmodium falciparum
WFDNYNILCAFLSPEKEV

SEQ ID NO: 3277559 - protein, 26 aa, Plasmodium falciparum
WFIISCTVIPFLLIILFILLYKRWFP

SEQ ID NO: 3277560 - protein, 18 aa, Plasmodium falciparum
WFKRHTYILDKWKEEEWF

SEQ ID NO: 3277561 - protein, 24 aa, Plasmodium falciparum
WFLIFSIILFYMLKNSSLVTFLFR

SEQ ID NO: 3277562 - protein, 33 aa, Plasmodium falciparum
WFLSKTIPFFSVFYMLGSYFYKDIQKYINKDIN

SEQ ID NO: 3277563 - protein, 21 aa, Plasmodium falciparum
WFLYFPYPKCELFQNKKHIRF

SEQ ID NO: 3277564 - protein, 20 aa, Plasmodium falciparum
WFPYLYHIFNYILNMNSTHF

SEQ ID NO: 3277565 - protein, 19 aa, Plasmodium falciparum
WFTEWAEEFCRIRKIKLGK

SEQ ID NO: 3277566 - protein, 17 aa, Plasmodium falciparum
WFTREKCWFLKLFSFDL

SEQ ID NO: 3277567 - protein, 18 aa, Plasmodium falciparum
WFTREKCWFLKLFSFDLR

SEQ ID NO: 3277568 - protein, 19 aa, Plasmodium falciparum
WFVFEVKSFLVYVSGLIKW

SEQ ID NO: 3277569 - protein, 17 aa, Plasmodium falciparum
WGDFHVLYFQNEENNIK

SEQ ID NO: 3277570 - protein, 23 aa, Plasmodium falciparum
WGGNSCNQLGLGINNRFVNNPTV

SEQ ID NO: 3277571 - protein, 25 aa, Plasmodium falciparum
WGHIPRLEWKFFFFPDHLKKEDYKK

SEQ ID NO: 3277572 - protein, 20 aa, Plasmodium falciparum
WGILGSIGFYGFVNSIAIDV

SEQ ID NO: 3277573 - protein, 19 aa, Plasmodium falciparum
WGIQELKVFHSLYRLIEVS

SEQ ID NO: 3277574 - protein, 18 aa, Plasmodium falciparum
WGKDVFAGFVTKKLKTLL

SEQ ID NO: 3277575 - protein, 24 aa, Plasmodium falciparum
WGNGKKQIRCCFIKNLYNNNRGIF

SEQ ID NO: 3277576 - protein, 17 aa, Plasmodium falciparum
WGTYFMVPFFLFENIDF

SEQ ID NO: 3277577 - protein, 22 aa, Plasmodium falciparum
WHPFFVFFCGVSGLYVKELQVG

SEQ ID NO: 3277578 - protein, 17 aa, Plasmodium falciparum
WHRYKKEWELRQKEAEQ

SEQ ID NO: 3277579 - protein, 19 aa, Plasmodium falciparum
WHYIGTFLLGLKMNISLVV

SEQ ID NO: 3277580 - protein, 25 aa, Plasmodium falciparum
WICEDFEYSRGIFLYATNFPRNTEI

SEQ ID NO: 3277581 - protein, 18 aa, Plasmodium falciparum
WIDDFSSMFFSRHHTTEN

SEQ ID NO: 3277582 - protein, 17 aa, Plasmodium falciparum
WIDEDVFFYQGNNKSQK

SEQ ID NO: 3277583 - protein, 17 aa, Plasmodium falciparum
WIEQLIETIEFILGLIS

SEQ ID NO: 3277584 - protein, 30 aa, Plasmodium falciparum
WIESVLRLIALQICLGVKPLNDSRYVVPFL

SEQ ID NO: 3277585 - protein, 25 aa, Plasmodium falciparum
WIFEAIFYSMIIYFFAYAALKENSH

SEQ ID NO: 3277586 - protein, 18 aa, Plasmodium falciparum
WIHNLYLFEESINKKKKN

SEQ ID NO: 3277587 - protein, 17 aa, Plasmodium falciparum
WIIYLIISLITSYNKKD

SEQ ID NO: 3277588 - protein, 18 aa, Plasmodium falciparum
WIKILKKKLKIYDIQWHE

SEQ ID NO: 3277589 - protein, 18 aa, Plasmodium falciparum
WILIFFKNKNQFFLSQKK

SEQ ID NO: 3277590 - protein, 24 aa, Plasmodium falciparum
WILLISELMGLYFVTNSLLLTSYL

SEQ ID NO: 3277591 - protein, 26 aa, Plasmodium falciparum
WILNNHIFEYFDFVIIYEKELLPQQY

SEQ ID NO: 3277592 - protein, 19 aa, Plasmodium falciparum
WINKLVIKYKNDYIDLKKD

SEQ ID NO: 3277593 - protein, 17 aa, Plasmodium falciparum
WIPKQIKKLNIKKNNLK

SEQ ID NO: 3277594 - protein, 19 aa, Plasmodium falciparum
WIPTESWLVSWMNKLPLHF

SEQ ID NO: 3277595 - protein, 18 aa, Plasmodium falciparum
WIYKLDFEQKCFFIKIYS

SEQ ID NO: 3277596 - protein, 22 aa, Plasmodium falciparum
WIYRYINNCNIFFKNNNNKKGQ

SEQ ID NO: 3277597 - protein, 30 aa, Plasmodium falciparum
WIYTIFLTCLPFNIYIRLFDIYTFNEKIIY

SEQ ID NO: 3277598 - protein, 21 aa, Plasmodium falciparum
WKAITCNAWGNTYFRTTCSDG

SEQ ID NO: 3277599 - protein, 19 aa, Plasmodium falciparum
WKAITCRAPNGANYFRKGL

SEQ ID NO: 3277600 - protein, 17 aa, Plasmodium falciparum
WKALIYKSLNTFIDDVA

SEQ ID NO: 3277601 - protein, 17 aa, Plasmodium falciparum
WKCAIILSKVSEKPENV

SEQ ID NO: 3277602 - protein, 26 aa, Plasmodium falciparum
WKCGNVCGLDICSLKKINNNGQESDE

SEQ ID NO: 3277603 - protein, 23 aa, Plasmodium falciparum
WKCRNVCGYIVCGLKGDNGQKVN

SEQ ID NO: 3277604 - protein, 22 aa, Plasmodium falciparum
WKCRNVCGYIVCKLEEVNGEKD

SEQ ID NO: 3277605 - protein, 21 aa, Plasmodium falciparum
WKCRNVCGYVVCKSEKGNGET

SEQ ID NO: 3277606 - protein, 18 aa, Plasmodium falciparum
WKDKYFINKKDIFYWFHM

SEQ ID NO: 3277607 - protein, 22 aa, Plasmodium falciparum
WKHFHYKVKYVFLVINNFALYH

SEQ ID NO: 3277608 - protein, 17 aa, Plasmodium falciparum
WKHMKKCLVTKVIRSQA

SEQ ID NO: 3277609 - protein, 17 aa, Plasmodium falciparum
WKHWVEMKENMNIYNKW

SEQ ID NO: 3277610 - protein, 36 aa, Plasmodium falciparum
WKIFLYNTRFNQLLFKFLHLCMNYFLHVAYVYDING

SEQ ID NO: 3277611 - protein, 18 aa, Plasmodium falciparum
WKIKNLFTPQPFRQLSDF

SEQ ID NO: 3277612 - protein, 19 aa, Plasmodium falciparum
WKIKYPINIFQNLKRLKDF

SEQ ID NO: 3277613 - protein, 20 aa, Plasmodium falciparum
WKILSLFVILILLYFLLKIE

SEQ ID NO: 3277614 - protein, 25 aa, Plasmodium falciparum
WKIQKRFQILYVFFFLLITGALFYY

SEQ ID NO: 3277615 - protein, 17 aa, Plasmodium falciparum
WKIRFNATCIFQLIYPV

SEQ ID NO: 3277616 - protein, 17 aa, Plasmodium falciparum
WKKGYETFIHDLKKSLD

SEQ ID NO: 3277617 - protein, 17 aa, Plasmodium falciparum
WKKHINCCKYHFYFFSS

SEQ ID NO: 3277618 - protein, 19 aa, Plasmodium falciparum
WKKILLSIFDEKNFYVHNL

SEQ ID NO: 3277619 - protein, 19 aa, Plasmodium falciparum
WKKKDMVSILLSELQHNMN

SEQ ID NO: 3277620 - protein, 22 aa, Plasmodium falciparum
WKKKKLMWNKWIEKNRYIMNNW

SEQ ID NO: 3277621 - protein, 21 aa, Plasmodium falciparum
WKKKLEKCLKNGTKTRCKNNK

SEQ ID NO: 3277622 - protein, 23 aa, Plasmodium falciparum
WKKPKLRPTKLIRVIDIPQNDYG

SEQ ID NO: 3277623 - protein, 20 aa, Plasmodium falciparum
WKKREWNFEGDEMWINQYSA

SEQ ID NO: 3277624 - protein, 24 aa, Plasmodium falciparum
WKLFCGLPTIRFRKDISVENLTYL

SEQ ID NO: 3277625 - protein, 21 aa, Plasmodium falciparum
WKLGIRCLNKYLDLSKRFEIK

SEQ ID NO: 3277626 - protein, 19 aa, Plasmodium falciparum
WKLLNIYIIDHLKFLNISM

SEQ ID NO: 3277627 - protein, 20 aa, Plasmodium falciparum
WKLQGHQDLKNALTDVETKY

SEQ ID NO: 3277628 - protein, 20 aa, Plasmodium falciparum
WKLSKRFSLLNYLWFITGTV

SEQ ID NO: 3277629 - protein, 20 aa, Plasmodium falciparum
WKLTDQFVRAISLLPSHFNS

SEQ ID NO: 3277630 - protein, 20 aa, Plasmodium falciparum
WKNEEWFKKLKYNWNDEVNR

SEQ ID NO: 3277631 - protein, 19 aa, Plasmodium falciparum
WKNKIFNMSCKKKTYKSIA

SEQ ID NO: 3277632 - protein, 28 aa, Plasmodium falciparum
WKNKPNIKSICGRRLHRSLYEFQISNNS

SEQ ID NO: 3277633 - protein, 28 aa, Plasmodium falciparum
WKNMYKICFFYVYPYRFTFNKYKKFFNK

SEQ ID NO: 3277634 - protein, 20 aa, Plasmodium falciparum
WKNPWYIFYIFVSIFLSFFT

SEQ ID NO: 3277635 - protein, 25 aa, Plasmodium falciparum
WKNRFLYKCMNLFRNDKKSVLSNKL

SEQ ID NO: 3277636 - protein, 25 aa, Plasmodium falciparum
WKPQWVPMQIQYALLYSYVGKSGTI

SEQ ID NO: 3277637 - protein, 21 aa, Plasmodium falciparum
WKRADPPNDRTFNNFLKYNLN

SEQ ID NO: 3277638 - protein, 20 aa, Plasmodium falciparum
WKSFHLSIFLLRCINSIFIL

SEQ ID NO: 3277639 - protein, 24 aa, Plasmodium falciparum
WKTIFRLYYYLLLLKKIEKKKKKC

SEQ ID NO: 3277640 - protein, 17 aa, Plasmodium falciparum
WKTLTNFALLQNRKLNL

SEQ ID NO: 3277641 - protein, 25 aa, Plasmodium falciparum
WKTMIQPYAHLGCRKPDENEPQINR

SEQ ID NO: 3277642 - protein, 17 aa, Plasmodium falciparum
WKVMSASAFPWTVGVAF

SEQ ID NO: 3277643 - protein, 19 aa, Plasmodium falciparum
WKWVSEMLDDSIKWRAELD

SEQ ID NO: 3277644 - protein, 24 aa, Plasmodium falciparum
WKYEPSMCKTYLSFDNRFNISEQR

SEQ ID NO: 3277645 - protein, 17 aa, Plasmodium falciparum
WKYFFESPFTLYKKLTP

SEQ ID NO: 3277646 - protein, 19 aa, Plasmodium falciparum
WKYSDLFSEYKNEINKNNM

SEQ ID NO: 3277647 - protein, 18 aa, Plasmodium falciparum
WLDHNPWKNWKVQRIKMF

SEQ ID NO: 3277648 - protein, 27 aa, Plasmodium falciparum
WLDYSCIEVPISLKEDFDVFKMKFSFY

SEQ ID NO: 3277649 - protein, 32 aa, Plasmodium falciparum
WLEDSEGYLKSWLIKQWIQWKNMKILECLMNE

SEQ ID NO: 3277650 - protein, 17 aa, Plasmodium falciparum
WLEEWADEFCRKRTHKL

SEQ ID NO: 3277651 - protein, 17 aa, Plasmodium falciparum
WLERELTNSNARAHIII

SEQ ID NO: 3277652 - protein, 20 aa, Plasmodium falciparum
WLHFNECLFISSQLQCLFDD

SEQ ID NO: 3277653 - protein, 23 aa, Plasmodium falciparum
WLIHWSLIIIFHFFMYVIYVKNT

SEQ ID NO: 3277654 - protein, 24 aa, Plasmodium falciparum
WLLEVNSNPSLRIDYIDPNYANFE

SEQ ID NO: 3277655 - protein, 18 aa, Plasmodium falciparum
WLNLYGFHKKEFDLEKIT

SEQ ID NO: 3277656 - protein, 18 aa, Plasmodium falciparum
WLPALGYLLPYEKIKFLR

SEQ ID NO: 3277657 - protein, 20 aa, Plasmodium falciparum
WLRLLSDVCFQNQHDYNSHN

SEQ ID NO: 3277658 - protein, 19 aa, Plasmodium falciparum
WLTLFFHSLIQYFVYLNNS

SEQ ID NO: 3277659 - protein, 17 aa, Plasmodium falciparum
WLVFLFFFLELAKCGIP

SEQ ID NO: 3277660 - protein, 17 aa, Plasmodium falciparum
WLVHNILEVVHFLEDVN

SEQ ID NO: 3277661 - protein, 18 aa, Plasmodium falciparum
WLYLNCAYYFFYKLYFLL

SEQ ID NO: 3277662 - protein, 34 aa, Plasmodium falciparum
WLYNIISYEIFIRCVKKFIYRCTREISIFYKKKV

SEQ ID NO: 3277663 - protein, 20 aa, Plasmodium falciparum
WMLLFCISTILSIIYYLEIK

SEQ ID NO: 3277664 - protein, 25 aa, Plasmodium falciparum
WMSKEWRHMMKKNKIPVEYRPLYSN

SEQ ID NO: 3277665 - protein, 18 aa, Plasmodium falciparum
WMSSFFFKENNNREIYKE

SEQ ID NO: 3277666 - protein, 17 aa, Plasmodium falciparum
WMTEWGEDFCKKRKEQV

SEQ ID NO: 3277667 - protein, 18 aa, Plasmodium falciparum
WMTEWSEYFCKELNRKLE

SEQ ID NO: 3277668 - protein, 20 aa, Plasmodium falciparum
WNAIEILKSLPGVNEKNMHY

SEQ ID NO: 3277669 - protein, 20 aa, Plasmodium falciparum
WNANRQKVWEVITCGARSND

SEQ ID NO: 3277670 - protein, 17 aa, Plasmodium falciparum
WNCKEDVGCVPPRRQNL

SEQ ID NO: 3277671 - protein, 17 aa, Plasmodium falciparum
WNDKCDICDQKFYFFSL

SEQ ID NO: 3277672 - protein, 21 aa, Plasmodium falciparum
WNEDIKCQSLLPVSYASHQMY

SEQ ID NO: 3277673 - protein, 17 aa, Plasmodium falciparum
WNEEKYLLLKQYIYKYI

SEQ ID NO: 3277674 - protein, 19 aa, Plasmodium falciparum
WNENFLMEKKRLFLNIKDK

SEQ ID NO: 3277675 - protein, 32 aa, Plasmodium falciparum
WNENGPYIWKGMLCSLEKAWGKDTIKNKSNYN

SEQ ID NO: 3277676 - protein, 17 aa, Plasmodium falciparum
WNFKKNVLFSSMIFSIN

SEQ ID NO: 3277677 - protein, 18 aa, Plasmodium falciparum
WNHDIICSKKYKYNPFKQ

SEQ ID NO: 3277678 - protein, 17 aa, Plasmodium falciparum
WNIGTATIMLLGDTCTR

SEQ ID NO: 3277679 - protein, 21 aa, Plasmodium falciparum
WNKLYFLCFTNFCFNINRKDY

SEQ ID NO: 3277680 - protein, 24 aa, Plasmodium falciparum
WNLLKSTIGFLILVAAGSVYMEGV

SEQ ID NO: 3277681 - protein, 17 aa, Plasmodium falciparum
WNLPIYYFVCRHINKPL

SEQ ID NO: 3277682 - protein, 20 aa, Plasmodium falciparum
WNQFNKWSLDFLIKNRLIFN

SEQ ID NO: 3277683 - protein, 17 aa, Plasmodium falciparum
WNSLENFKGKKLLTEGI

SEQ ID NO: 3277684 - protein, 20 aa, Plasmodium falciparum
WNTNKKYIWLAMKHGAGMNS

SEQ ID NO: 3277685 - protein, 18 aa, Plasmodium falciparum
WPSVAIEENFSGSFKCLF

SEQ ID NO: 3277686 - protein, 17 aa, Plasmodium falciparum
WPTVFGIMGLVFLMIAG

SEQ ID NO: 3277687 - protein, 34 aa, Plasmodium falciparum
WQAIIDLSSQCLVLPKMFWLSLMEYLPVNKDDDR

SEQ ID NO: 3277688 - protein, 18 aa, Plasmodium falciparum
WQELSIQEEIEWLDWVKE

SEQ ID NO: 3277689 - protein, 17 aa, Plasmodium falciparum
WQFSQSIMIKENLNKEK

SEQ ID NO: 3277690 - protein, 20 aa, Plasmodium falciparum
WQVDLDLHFGNLTVEKATAI

SEQ ID NO: 3277691 - protein, 21 aa, Plasmodium falciparum
WRAITCYIPYYVNYFKKTSDD

SEQ ID NO: 3277692 - protein, 29 aa, Plasmodium falciparum
WRCKNKCKNNCKCFEKWVKKKQVEWNTMK

SEQ ID NO: 3277693 - protein, 19 aa, Plasmodium falciparum
WRKLFELMTNSSYLVTNST

SEQ ID NO: 3277694 - protein, 19 aa, Plasmodium falciparum
WRLKEPMSKYDASFRHVNR

SEQ ID NO: 3277695 - protein, 39 aa, Plasmodium falciparum
WRNCEKNGKGKLLFKYFNIWYLYEGNFCNDEIVDKGIIS

SEQ ID NO: 3277696 - protein, 24 aa, Plasmodium falciparum
WRNNGARYWFEWDKNMQNAKLAIV

SEQ ID NO: 3277697 - protein, 30 aa, Plasmodium falciparum
WRNRIFKEYIEWKEWIYYKGQSANVSDVSY

SEQ ID NO: 3277698 - protein, 17 aa, Plasmodium falciparum
WRNWLRNQKSVMGKYKD

SEQ ID NO: 3277699 - protein, 22 aa, Plasmodium falciparum
WRRFSEIPFKCNAFSDFKNTFP

SEQ ID NO: 3277700 - protein, 25 aa, Plasmodium falciparum
WRTKKIKGCLSNGAKIRCNKKNKCN

SEQ ID NO: 3277701 - protein, 30 aa, Plasmodium falciparum
WSAEEELLLLDGISKFGFGNWEQVADLVNS

SEQ ID NO: 3277702 - protein, 21 aa, Plasmodium falciparum
WSCGYFCNLDICSLKTSHGEN

SEQ ID NO: 3277703 - protein, 17 aa, Plasmodium falciparum
WSGSLSYFCSFMKKEYE

SEQ ID NO: 3277704 - protein, 19 aa, Plasmodium falciparum
WSITIWASLYVQLIVLALT

SEQ ID NO: 3277705 - protein, 17 aa, Plasmodium falciparum
WSKELDRCIKKDDKSKC

SEQ ID NO: 3277706 - protein, 26 aa, Plasmodium falciparum
WSLAKCSYFNFKIYKKILYFLQKYIS

SEQ ID NO: 3277707 - protein, 17 aa, Plasmodium falciparum
WSNHFPNTFNISLDLKE

SEQ ID NO: 3277708 - protein, 27 aa, Plasmodium falciparum
WSNIFWSCANIGLGLYKDMYKDHKGLQ

SEQ ID NO: 3277709 - protein, 19 aa, Plasmodium falciparum
WSRLEFVYGNHVIVLIICQ

SEQ ID NO: 3277710 - protein, 21 aa, Plasmodium falciparum
WSRREAWSHVSIYFFTVKGYQ

SEQ ID NO: 3277711 - protein, 25 aa, Plasmodium falciparum
WSSGIDRFSAFIFASFIGAVKQTYH

SEQ ID NO: 3277712 - protein, 19 aa, Plasmodium falciparum
WSVSTLYLLEIILGDECIV

SEQ ID NO: 3277713 - protein, 20 aa, Plasmodium falciparum
WTANRATIWEAMTCSEDLKN

SEQ ID NO: 3277714 - protein, 20 aa, Plasmodium falciparum
WTANRATVWEAITCSDRLGG

SEQ ID NO: 3277715 - protein, 23 aa, Plasmodium falciparum
WTANRATVWKAITCHAGESDKYF

SEQ ID NO: 3277716 - protein, 21 aa, Plasmodium falciparum
WTCGNVCGYVVCKPKEGNRET

SEQ ID NO: 3277717 - protein, 18 aa, Plasmodium falciparum
WTDYKKKKKFFTYLKNIR

SEQ ID NO: 3277718 - protein, 21 aa, Plasmodium falciparum
WTEDFCRKRTYKLKKAKQECR

SEQ ID NO: 3277719 - protein, 22 aa, Plasmodium falciparum
WTKCYKTSFPFIEDLILLIYEN

SEQ ID NO: 3277720 - protein, 26 aa, Plasmodium falciparum
WTTFFWPKELKIILRQLLDLECRKNL

SEQ ID NO: 3277721 - protein, 31 aa, Plasmodium falciparum
WTTLLYSNKNLKCNFYYNNNNLSTYVIKHNR

SEQ ID NO: 3277722 - protein, 18 aa, Plasmodium falciparum
WVAKHPYRIREKKIDEWF

SEQ ID NO: 3277723 - protein, 23 aa, Plasmodium falciparum
WVIQMIICLISAYYNAIIVSSSR

SEQ ID NO: 3277724 - protein, 17 aa, Plasmodium falciparum
WVKRWDQIYKRYSKYIE

SEQ ID NO: 3277725 - protein, 28 aa, Plasmodium falciparum
WVLGLLLCHKDIWIVHSYHIKNDRTRKN

SEQ ID NO: 3277726 - protein, 21 aa, Plasmodium falciparum
WVLKICRKYKHTIKKIILITN

SEQ ID NO: 3277727 - protein, 18 aa, Plasmodium falciparum
WVLVYKHSLIDRVHGTGK

SEQ ID NO: 3277728 - protein, 17 aa, Plasmodium falciparum
WVRNEYKYLSSIKNQNI

SEQ ID NO: 3277729 - protein, 17 aa, Plasmodium falciparum
WVTLPSISKFRHTSWVY

SEQ ID NO: 3277730 - protein, 29 aa, Plasmodium falciparum
WVYCELESKELLALCLKKVNKLKKLKILD

SEQ ID NO: 3277731 - protein, 18 aa, Plasmodium falciparum
WWETYGKDIWEGMVCALT

SEQ ID NO: 3277732 - protein, 30 aa, Plasmodium falciparum
WYDNIVWILARYTYYFLLSYKFNGLSQKIV

SEQ ID NO: 3277733 - protein, 18 aa, Plasmodium falciparum
WYFTCKQSAHIADIKKMI

SEQ ID NO: 3277734 - protein, 19 aa, Plasmodium falciparum
WYIFIFNIINKIYFENIRY

SEQ ID NO: 3277735 - protein, 17 aa, Plasmodium falciparum
WYIKYGKDVFFSMLEND

SEQ ID NO: 3277736 - protein, 24 aa, Plasmodium falciparum
WYLYDAFWPLSAFKDFQTANEKCI

SEQ ID NO: 3277737 - protein, 17 aa, Plasmodium falciparum
WYNIFLNKTIQYIYKEK

SEQ ID NO: 3277738 - protein, 17 aa, Plasmodium falciparum
WYPQRINHYYINGVVFP

SEQ ID NO: 3277739 - protein, 17 aa, Plasmodium falciparum
WYSIASKIHIDYFNNSE

SEQ ID NO: 3277740 - protein, 19 aa, Plasmodium falciparum
WYSRIWYLFYSLKGTLNFN

SEQ ID NO: 3277741 - protein, 18 aa, Plasmodium falciparum
WYWEIIVFSRKICVLFIM

SEQ ID NO: 3277742 - protein, 18 aa, Plasmodium falciparum
YACAKKTLKDIIEAEPDM

SEQ ID NO: 3277743 - protein, 31 aa, Plasmodium falciparum
YACLPFEFINKYEFLQCLNINGLSTQNFQHL

SEQ ID NO: 3277744 - protein, 18 aa, Plasmodium falciparum
YACSFGFLIMGFIGYIIK

SEQ ID NO: 3277745 - protein, 24 aa, Plasmodium falciparum
YADEICLTLLLLLVVVKSEYLRSC

SEQ ID NO: 3277746 - protein, 21 aa, Plasmodium falciparum
YADLYSLKRKCYDDDDEKYRR

SEQ ID NO: 3277747 - protein, 18 aa, Plasmodium falciparum
YADRFFKELSSFYEIVIW

SEQ ID NO: 3277748 - protein, 28 aa, Plasmodium falciparum
YAFLNILKIKGCIKILTIIIKYYLIKYD

SEQ ID NO: 3277749 - protein, 24 aa, Plasmodium falciparum
YAFRVPEYVIYLGCTSPKKLLDRM

SEQ ID NO: 3277750 - protein, 21 aa, Plasmodium falciparum
YAGLVTSTFLPYGIVAIVLIL

SEQ ID NO: 3277751 - protein, 25 aa, Plasmodium falciparum
YAHFLKSLFYRITYIEIKTKDGRII

SEQ ID NO: 3277752 - protein, 25 aa, Plasmodium falciparum
YAHFREHPETFALKHVKFCNKLITL

SEQ ID NO: 3277753 - protein, 23 aa, Plasmodium falciparum
YAHILREKFIFIIIPMLNIDGVI

SEQ ID NO: 3277754 - protein, 22 aa, Plasmodium falciparum
YAHITFTIVFFVWKLLYTDIVL

SEQ ID NO: 3277755 - protein, 31 aa, Plasmodium falciparum
YAIKFLNVVLFKYRFSKFLLNVYTNKYDDMH

SEQ ID NO: 3277756 - protein, 19 aa, Plasmodium falciparum
YAINELLAIRSDECKELSN

SEQ ID NO: 3277757 - protein, 23 aa, Plasmodium falciparum
YAKCFVNAFLNYGIIEYDAEQIK

SEQ ID NO: 3277758 - protein, 27 aa, Plasmodium falciparum
YAKLFPHQICVFAGTFDFLHLNNLNFK

SEQ ID NO: 3277759 - protein, 17 aa, Plasmodium falciparum
YALFSKYTYITSMHDMH

SEQ ID NO: 3277760 - protein, 19 aa, Plasmodium falciparum
YALIKGCNIQMEHKEEKMN

SEQ ID NO: 3277761 - protein, 17 aa, Plasmodium falciparum
YALKIFEKLLLKDISTI

SEQ ID NO: 3277762 - protein, 24 aa, Plasmodium falciparum
YALLKLIKKRGFNYICIDADTYVK

SEQ ID NO: 3277763 - protein, 19 aa, Plasmodium falciparum
YALLPLVILSLISIIINLR

SEQ ID NO: 3277764 - protein, 30 aa, Plasmodium falciparum
YALNYRVHYLWKYFSLHSIADYLYVINERN

SEQ ID NO: 3277765 - protein, 17 aa, Plasmodium falciparum
YANDIFLVVKFSYPSIW

SEQ ID NO: 3277766 - protein, 20 aa, Plasmodium falciparum
YANKYNYCHQKKTTHDTTSS

SEQ ID NO: 3277767 - protein, 19 aa, Plasmodium falciparum
YANRQQVWYAITCGAEGYQ

SEQ ID NO: 3277768 - protein, 27 aa, Plasmodium falciparum
YAPQCVYCKFIWDKLRYIQRSIQNENR

SEQ ID NO: 3277769 - protein, 29 aa, Plasmodium falciparum
YASCKRLLNFIKLFFFIDIGISDVLIKYF

SEQ ID NO: 3277770 - protein, 17 aa, Plasmodium falciparum
YASDLLQNFIQSILELC

SEQ ID NO: 3277771 - protein, 18 aa, Plasmodium falciparum
YAVACISNDLNFFRIEEY

SEQ ID NO: 3277772 - protein, 25 aa, Plasmodium falciparum
YAVRNTRYLLKHSYYDSNILNNILN

SEQ ID NO: 3277773 - protein, 21 aa, Plasmodium falciparum
YAYNYLFKFIISLGNINYFYI

SEQ ID NO: 3277774 - protein, 23 aa, Plasmodium falciparum
YAYSRTTLIYFYKMFTVNEYVYI

SEQ ID NO: 3277775 - protein, 25 aa, Plasmodium falciparum
YCCELKLRYTQNITVKNLFCCNNNF

SEQ ID NO: 3277776 - protein, 21 aa, Plasmodium falciparum
YCDDEKCYLINKENKNILLKK

SEQ ID NO: 3277777 - protein, 17 aa, Plasmodium falciparum
YCDICMNSFNLLDKSYK

SEQ ID NO: 3277778 - protein, 18 aa, Plasmodium falciparum
YCEMYIINIFINYLYHNF

SEQ ID NO: 3277779 - protein, 23 aa, Plasmodium falciparum
YCERFIKELLKKNIIKIILSSVD

SEQ ID NO: 3277780 - protein, 19 aa, Plasmodium falciparum
YCETCPWCATKKKGIDGNW

SEQ ID NO: 3277781 - protein, 20 aa, Plasmodium falciparum
YCETCPWCATKKKGIDGNWE

SEQ ID NO: 3277782 - protein, 17 aa, Plasmodium falciparum
YCFNHRFVIHNNDTLNI

SEQ ID NO: 3277783 - protein, 23 aa, Plasmodium falciparum
YCGECILFKNLVPEFYHLRDMLF

SEQ ID NO: 3277784 - protein, 23 aa, Plasmodium falciparum
YCGIKDKRAITVQKFCIHKTNKY

SEQ ID NO: 3277785 - protein, 18 aa, Plasmodium falciparum
YCGLLNSHFDIMCFQVCD

SEQ ID NO: 3277786 - protein, 32 aa, Plasmodium falciparum
YCHEMKAEFYLYISFLLLIVFSKIQRKIKTNI

SEQ ID NO: 3277787 - protein, 18 aa, Plasmodium falciparum
YCHSIVSILLFLSSHPML

SEQ ID NO: 3277788 - protein, 27 aa, Plasmodium falciparum
YCIKWYVKCCFLRCVYILGSLFSSSLF

SEQ ID NO: 3277789 - protein, 18 aa, Plasmodium falciparum
YCINFNFFYKYMSSPSLL

SEQ ID NO: 3277790 - protein, 18 aa, Plasmodium falciparum
YCINKIYRDIFISLIVLK

SEQ ID NO: 3277791 - protein, 21 aa, Plasmodium falciparum
YCKKHFRHIHKKSQMINLLKY

SEQ ID NO: 3277792 - protein, 20 aa, Plasmodium falciparum
YCKKYFYRGEKIYEENLRSW

SEQ ID NO: 3277793 - protein, 27 aa, Plasmodium falciparum
YCKNYILLNILFNWFPYLYHIFNYILN

SEQ ID NO: 3277794 - protein, 19 aa, Plasmodium falciparum
YCKPCPDCGVKRKDNQWKD

SEQ ID NO: 3277795 - protein, 17 aa, Plasmodium falciparum
YCKYFASYIYYKMKRAF

SEQ ID NO: 3277796 - protein, 26 aa, Plasmodium falciparum
YCKYFLNCSFFFNYLFIHLYLKNKLL

SEQ ID NO: 3277797 - protein, 21 aa, Plasmodium falciparum
YCLRLKSKELVKEANEEIGKI

SEQ ID NO: 3277798 - protein, 29 aa, Plasmodium falciparum
YCLYIMLLSYLFIGYRILRISENSPCSNV

SEQ ID NO: 3277799 - protein, 26 aa, Plasmodium falciparum
YCMSCIPSNCRRRITRKRFFNSNATL

SEQ ID NO: 3277800 - protein, 17 aa, Plasmodium falciparum
YCNEANEIFYLSRERNN

SEQ ID NO: 3277801 - protein, 22 aa, Plasmodium falciparum
YCNIKLVLRNKIIRNINVKAKG

SEQ ID NO: 3277802 - protein, 23 aa, Plasmodium falciparum
YCNNTKFSNIILHGILLTHKRVL
